United States Patent 11,640,849 (METHODS FOR HISTOLOGICAL DIAGNOSIS AND TREATMENT OF DISEASES) - sequence listing, part 69

SEQ ID NO: 2631773 - protein, 41 aa, Entamoeba histolytica
KITRDLSREKKAEERSKRNLNKDRKKAREKSKQLRKEKDAI

SEQ ID NO: 2631774 - protein, 6 aa, Entamoeba histolytica
KITSGK

SEQ ID NO: 2631775 - protein, 9 aa, Entamoeba histolytica
KITSQEREK

SEQ ID NO: 2631776 - protein, 8 aa, Entamoeba histolytica
KITSQNDI

SEQ ID NO: 2631777 - protein, 5 aa, Entamoeba histolytica
KITSS

SEQ ID NO: 2631778 - protein, 23 aa, Entamoeba histolytica
KITSSSLKEKPQEKITPKEDVYS

SEQ ID NO: 2631779 - protein, 6 aa, Entamoeba histolytica
KITSTW

SEQ ID NO: 2631780 - protein, 9 aa, Entamoeba histolytica
KITTANIGD

SEQ ID NO: 2631781 - protein, 10 aa, Entamoeba histolytica
KITTDYEYKD

SEQ ID NO: 2631782 - protein, 11 aa, Entamoeba histolytica
KITTETVTQKD

SEQ ID NO: 2631783 - protein, 6 aa, Entamoeba histolytica
KITTSA

SEQ ID NO: 2631784 - protein, 6 aa, Entamoeba histolytica
KIVRGS

SEQ ID NO: 2631785 - protein, 27 aa, Entamoeba histolytica
KIYDTQTHSYKNTLKTEENEKKPFPSL

SEQ ID NO: 2631786 - protein, 8 aa, Entamoeba histolytica
KIYNDGKI

SEQ ID NO: 2631787 - protein, 12 aa, Entamoeba histolytica
KKAALRSAKRQV

SEQ ID NO: 2631788 - protein, 8 aa, Entamoeba histolytica
KKACESKI

SEQ ID NO: 2631789 - protein, 16 aa, Entamoeba histolytica
KKADEATKRDKELETA

SEQ ID NO: 2631790 - protein, 6 aa, Entamoeba histolytica
KKAEDE

SEQ ID NO: 2631791 - protein, 8 aa, Entamoeba histolytica
KKAEEELG

SEQ ID NO: 2631792 - protein, 7 aa, Entamoeba histolytica
KKAEKKY

SEQ ID NO: 2631793 - protein, 7 aa, Entamoeba histolytica
KKAESNP

SEQ ID NO: 2631794 - protein, 10 aa, Entamoeba histolytica
KKAESRKSYK

SEQ ID NO: 2631795 - protein, 9 aa, Entamoeba histolytica
KKAFQRRSE

SEQ ID NO: 2631796 - protein, 16 aa, Entamoeba histolytica
KKAGEGVVNGKEPSEY

SEQ ID NO: 2631797 - protein, 8 aa, Entamoeba histolytica
KKAGGKEV

SEQ ID NO: 2631798 - protein, 8 aa, Entamoeba histolytica
KKAGKNGS

SEQ ID NO: 2631799 - protein, 11 aa, Entamoeba histolytica
KKAGKPLSSDD

SEQ ID NO: 2631800 - protein, 4 aa, Entamoeba histolytica
KKAI

SEQ ID NO: 2631801 - protein, 9 aa, Entamoeba histolytica
KKAISSARS

SEQ ID NO: 2631802 - protein, 11 aa, Entamoeba histolytica
KKAKDDSESIQ

SEQ ID NO: 2631803 - protein, 37 aa, Entamoeba histolytica
KKAKEELSKLEEEKIAAEKEKEEANEKVQKLEEEMRE

SEQ ID NO: 2631804 - protein, 23 aa, Entamoeba histolytica
KKAKELSSTKEKTPKQQQAEAYN

SEQ ID NO: 2631805 - protein, 17 aa, Entamoeba histolytica
KKAKEYQEKEIKRREEA

SEQ ID NO: 2631806 - protein, 13 aa, Entamoeba histolytica
KKAKGESKKKEEK

SEQ ID NO: 2631807 - protein, 21 aa, Entamoeba histolytica
KKAKKEYKKQKLQRLYHLLHL

SEQ ID NO: 2631808 - protein, 7 aa, Entamoeba histolytica
KKAKLTE

SEQ ID NO: 2631809 - protein, 22 aa, Entamoeba histolytica
KKAKLTKSRIDSTKKETDELKK

SEQ ID NO: 2631810 - protein, 8 aa, Entamoeba histolytica
KKAKPDGI

SEQ ID NO: 2631811 - protein, 24 aa, Entamoeba histolytica
KKAKQKEVDNTPIKQEKQEIQEID

SEQ ID NO: 2631812 - protein, 4 aa, Entamoeba histolytica
KKAL

SEQ ID NO: 2631813 - protein, 20 aa, Entamoeba histolytica
KKALDENDRITRKFTSKDNN

SEQ ID NO: 2631814 - protein, 7 aa, Entamoeba histolytica
KKALDKE

SEQ ID NO: 2631815 - protein, 13 aa, Entamoeba histolytica
KKANEEAESFKEN

SEQ ID NO: 2631816 - protein, 6 aa, Entamoeba histolytica
KKANEM

SEQ ID NO: 2631817 - protein, 15 aa, Entamoeba histolytica
KKANFEKVKEQAHRA

SEQ ID NO: 2631818 - protein, 10 aa, Entamoeba histolytica
KKANKSTQDK

SEQ ID NO: 2631819 - protein, 10 aa, Entamoeba histolytica
KKARKENGPH

SEQ ID NO: 2631820 - protein, 5 aa, Entamoeba histolytica
KKASD

SEQ ID NO: 2631821 - protein, 21 aa, Entamoeba histolytica
KKASETTYRPSKKEINSNETL

SEQ ID NO: 2631822 - protein, 6 aa, Entamoeba histolytica
KKASHA

SEQ ID NO: 2631823 - protein, 9 aa, Entamoeba histolytica
KKASIKTSI

SEQ ID NO: 2631824 - protein, 20 aa, Entamoeba histolytica
KKASKEVGKTLNSEDTEKLE

SEQ ID NO: 2631825 - protein, 12 aa, Entamoeba histolytica
KKATEDMKPNKP

SEQ ID NO: 2631826 - protein, 40 aa, Entamoeba histolytica
KKATEKKSVEKKPKKVTEKKVKSRDDEGRKNTLSKKSGLQ

SEQ ID NO: 2631827 - protein, 7 aa, Entamoeba histolytica
KKATIGV

SEQ ID NO: 2631828 - protein, 7 aa, Entamoeba histolytica
KKATPGI

SEQ ID NO: 2631829 - protein, 7 aa, Entamoeba histolytica
KKATSNR

SEQ ID NO: 2631830 - protein, 7 aa, Entamoeba histolytica
KKATTKE

SEQ ID NO: 2631831 - protein, 12 aa, Entamoeba histolytica
KKATTYGCFGRS

SEQ ID NO: 2631832 - protein, 19 aa, Entamoeba histolytica
KKAYEEAKTEREKLRNENN

SEQ ID NO: 2631833 - protein, 8 aa, Entamoeba histolytica
KKAYGPYV

SEQ ID NO: 2631834 - protein, 7 aa, Entamoeba histolytica
KKCEHNG

SEQ ID NO: 2631835 - protein, 10 aa, Entamoeba histolytica
KKCGENLKSG

SEQ ID NO: 2631836 - protein, 6 aa, Entamoeba histolytica
KKCKNS

SEQ ID NO: 2631837 - protein, 12 aa, Entamoeba histolytica
KKCPKDKNEEVR

SEQ ID NO: 2631838 - protein, 5 aa, Entamoeba histolytica
KKCPP

SEQ ID NO: 2631839 - protein, 13 aa, Entamoeba histolytica
KKCSRDSDKIEES

SEQ ID NO: 2631840 - protein, 6 aa, Entamoeba histolytica
KKCVSN

SEQ ID NO: 2631841 - protein, 6 aa, Entamoeba histolytica
KKDACS

SEQ ID NO: 2631842 - protein, 17 aa, Entamoeba histolytica
KKDDENGIKKHKKKCIF

SEQ ID NO: 2631843 - protein, 6 aa, Entamoeba histolytica
KKDDGR

SEQ ID NO: 2631844 - protein, 7 aa, Entamoeba histolytica
KKDDKIN

SEQ ID NO: 2631845 - protein, 8 aa, Entamoeba histolytica
KKDDNQKE

SEQ ID NO: 2631846 - protein, 7 aa, Entamoeba histolytica
KKDDNVA

SEQ ID NO: 2631847 - protein, 12 aa, Entamoeba histolytica
KKDDQKKPPKKD

SEQ ID NO: 2631848 - protein, 8 aa, Entamoeba histolytica
KKDEDKIQ

SEQ ID NO: 2631849 - protein, 17 aa, Entamoeba histolytica
KKDEENGIKKHKKKCIF

SEQ ID NO: 2631850 - protein, 17 aa, Entamoeba histolytica
KKDEKGVKEVVKKTKKK

SEQ ID NO: 2631851 - protein, 25 aa, Entamoeba histolytica
KKDEKQQKKLDITGKPIKERKGIET

SEQ ID NO: 2631852 - protein, 7 aa, Entamoeba histolytica
KKDENLN

SEQ ID NO: 2631853 - protein, 9 aa, Entamoeba histolytica
KKDENSGID

SEQ ID NO: 2631854 - protein, 15 aa, Entamoeba histolytica
KKDEPEEKKTISKAM

SEQ ID NO: 2631855 - protein, 13 aa, Entamoeba histolytica
KKDFRSEKKLEKH

SEQ ID NO: 2631856 - protein, 8 aa, Entamoeba histolytica
KKDFSCSD

SEQ ID NO: 2631857 - protein, 5 aa, Entamoeba histolytica
KKDGA

SEQ ID NO: 2631858 - protein, 24 aa, Entamoeba histolytica
KKDGEEEENNDMSEEPKELNEEEL

SEQ ID NO: 2631859 - protein, 8 aa, Entamoeba histolytica
KKDGGSVE

SEQ ID NO: 2631860 - protein, 8 aa, Entamoeba histolytica
KKDGIKPT

SEQ ID NO: 2631861 - protein, 5 aa, Entamoeba histolytica
KKDGK

SEQ ID NO: 2631862 - protein, 9 aa, Entamoeba histolytica
KKDGTPDKV

SEQ ID NO: 2631863 - protein, 4 aa, Entamoeba histolytica
KKDH

SEQ ID NO: 2631864 - protein, 6 aa, Entamoeba histolytica
KKDIAE

SEQ ID NO: 2631865 - protein, 7 aa, Entamoeba histolytica
KKDIEEH

SEQ ID NO: 2631866 - protein, 25 aa, Entamoeba histolytica
KKDIENIKEEKEELIKKNNEKEEEI

SEQ ID NO: 2631867 - protein, 14 aa, Entamoeba histolytica
KKDIKEKRDNLEND

SEQ ID NO: 2631868 - protein, 14 aa, Entamoeba histolytica
KKDIKSYSAPKRTI

SEQ ID NO: 2631869 - protein, 6 aa, Entamoeba histolytica
KKDKDQ

SEQ ID NO: 2631870 - protein, 40 aa, Entamoeba histolytica
KKDKDRNNRKSMIEKSSSYSQKIEDSQPTEKVNKKDTTLN

SEQ ID NO: 2631871 - protein, 101 aa, Entamoeba histolytica
KKDKKGESKKQRKKKEEEEKKKRKEEEERKRKEEEERIKKEEEEKARKEEEERIKREEEERKRQEEEERIKREEEEKARKEEEEEKARKEEEERKRKEEEI

SEQ ID NO: 2631872 - protein, 9 aa, Entamoeba histolytica
KKDKNKEDD

SEQ ID NO: 2631873 - protein, 13 aa, Entamoeba histolytica
KKDKPYMAPNGHG

SEQ ID NO: 2631874 - protein, 13 aa, Entamoeba histolytica
KKDKQQQSKLIGT

SEQ ID NO: 2631875 - protein, 14 aa, Entamoeba histolytica
KKDKRKTKSPSLQQ

SEQ ID NO: 2631876 - protein, 10 aa, Entamoeba histolytica
KKDKTMKPRK

SEQ ID NO: 2631877 - protein, 21 aa, Entamoeba histolytica
KKDLRKKKNRQETIEEEEGYD

SEQ ID NO: 2631878 - protein, 22 aa, Entamoeba histolytica
KKDLRKKKNRQETIEEEEGYDV

SEQ ID NO: 2631879 - protein, 17 aa, Entamoeba histolytica
KKDLSSQREVAYESAEN

SEQ ID NO: 2631880 - protein, 9 aa, Entamoeba histolytica
KKDLTSEIT

SEQ ID NO: 2631881 - protein, 5 aa, Entamoeba histolytica
KKDNE

SEQ ID NO: 2631882 - protein, 12 aa, Entamoeba histolytica
KKDNEYLYSICS

SEQ ID NO: 2631883 - protein, 7 aa, Entamoeba histolytica
KKDNEYT

SEQ ID NO: 2631884 - protein, 6 aa, Entamoeba histolytica
KKDNIK

SEQ ID NO: 2631885 - protein, 9 aa, Entamoeba histolytica
KKDNKKDLL

SEQ ID NO: 2631886 - protein, 9 aa, Entamoeba histolytica
KKDNTKDKL

SEQ ID NO: 2631887 - protein, 8 aa, Entamoeba histolytica
KKDPETSL

SEQ ID NO: 2631888 - protein, 8 aa, Entamoeba histolytica
KKDPQTNQ

SEQ ID NO: 2631889 - protein, 49 aa, Entamoeba histolytica
KKDQESNSSSHPSDDSSSQEKKKHHKHHEKKNKEHKETKPKVNDEDQPK

SEQ ID NO: 2631890 - protein, 8 aa, Entamoeba histolytica
KKDQKPWK

SEQ ID NO: 2631891 - protein, 6 aa, Entamoeba histolytica
KKDRKD

SEQ ID NO: 2631892 - protein, 13 aa, Entamoeba histolytica
KKDRQEEDTARSL

SEQ ID NO: 2631893 - protein, 10 aa, Entamoeba histolytica
KKDRSKEGFD

SEQ ID NO: 2631894 - protein, 4 aa, Entamoeba histolytica
KKDS

SEQ ID NO: 2631895 - protein, 6 aa, Entamoeba histolytica
KKDSFD

SEQ ID NO: 2631896 - protein, 8 aa, Entamoeba histolytica
KKDSMNGE

SEQ ID NO: 2631897 - protein, 10 aa, Entamoeba histolytica
KKDSNESQQH

SEQ ID NO: 2631898 - protein, 8 aa, Entamoeba histolytica
KKDSQEVK

SEQ ID NO: 2631899 - protein, 29 aa, Entamoeba histolytica
KKDSSSPRHYSSMNSSGPIGTRASPATLE

SEQ ID NO: 2631900 - protein, 7 aa, Entamoeba histolytica
KKDSTEL

SEQ ID NO: 2631901 - protein, 6 aa, Entamoeba histolytica
KKDSVS

SEQ ID NO: 2631902 - protein, 9 aa, Entamoeba histolytica
KKDSYGKQI

SEQ ID NO: 2631903 - protein, 21 aa, Entamoeba histolytica
KKDTEPKEVPNKSEDSQGELT

SEQ ID NO: 2631904 - protein, 7 aa, Entamoeba histolytica
KKDTINE

SEQ ID NO: 2631905 - protein, 7 aa, Entamoeba histolytica
KKDTTEI

SEQ ID NO: 2631906 - protein, 4 aa, Entamoeba histolytica
KKDV

SEQ ID NO: 2631907 - protein, 9 aa, Entamoeba histolytica
KKDVNESLK

SEQ ID NO: 2631908 - protein, 9 aa, Entamoeba histolytica
KKDVNSKGC

SEQ ID NO: 2631909 - protein, 6 aa, Entamoeba histolytica
KKDVQP

SEQ ID NO: 2631910 - protein, 4 aa, Entamoeba histolytica
KKDY

SEQ ID NO: 2631911 - protein, 8 aa, Entamoeba histolytica
KKDYEKIE

SEQ ID NO: 2631912 - protein, 13 aa, Entamoeba histolytica
KKDYEKMEKTTTV

SEQ ID NO: 2631913 - protein, 24 aa, Entamoeba histolytica
KKDYEKMEKTTTVFSNPSDLDGYA

SEQ ID NO: 2631914 - protein, 7 aa, Entamoeba histolytica
KKDYPNL

SEQ ID NO: 2631915 - protein, 11 aa, Entamoeba histolytica
KKEAEAKMQQE

SEQ ID NO: 2631916 - protein, 11 aa, Entamoeba histolytica
KKEAEDTVDKL

SEQ ID NO: 2631917 - protein, 5 aa, Entamoeba histolytica
KKEAH

SEQ ID NO: 2631918 - protein, 11 aa, Entamoeba histolytica
KKEANKKPSKQ

SEQ ID NO: 2631919 - protein, 10 aa, Entamoeba histolytica
KKEAQNGERI

SEQ ID NO: 2631920 - protein, 8 aa, Entamoeba histolytica
KKECPEGY

SEQ ID NO: 2631921 - protein, 8 aa, Entamoeba histolytica
KKEDDRKN

SEQ ID NO: 2631922 - protein, 16 aa, Entamoeba histolytica
KKEDISVPKASIKYSS

SEQ ID NO: 2631923 - protein, 6 aa, Entamoeba histolytica
KKEDIT

SEQ ID NO: 2631924 - protein, 15 aa, Entamoeba histolytica
KKEDITPSNQQSSIP

SEQ ID NO: 2631925 - protein, 15 aa, Entamoeba histolytica
KKEDSLKKEKLNTQI

SEQ ID NO: 2631926 - protein, 11 aa, Entamoeba histolytica
KKEDTSKSNKI

SEQ ID NO: 2631927 - protein, 13 aa, Entamoeba histolytica
KKEDYIESDTGGP

SEQ ID NO: 2631928 - protein, 4 aa, Entamoeba histolytica
KKEE

SEQ ID NO: 2631929 - protein, 8 aa, Entamoeba histolytica
KKEEANRL

SEQ ID NO: 2631930 - protein, 34 aa, Entamoeba histolytica; identical to SEQ ID NO: 2436592

SEQ ID NO: 2631931 - protein, 13 aa, Entamoeba histolytica
KKEEDGKTIGDID

SEQ ID NO: 2631932 - protein, 14 aa, Entamoeba histolytica
KKEEDKEKQERDEI

SEQ ID NO: 2631933 - protein, 7 aa, Entamoeba histolytica
KKEEDSI

SEQ ID NO: 2631934 - protein, 9 aa, Entamoeba histolytica
KKEEEEKRV

SEQ ID NO: 2631935 - protein, 43 aa, Entamoeba histolytica
KKEEEERKNKAEEERKQKEEEERIKREEDYKKQQEEIARQVNE

SEQ ID NO: 2631936 - protein, 8 aa, Entamoeba histolytica
KKEEEKNP

SEQ ID NO: 2631937 - protein, 6 aa, Entamoeba histolytica
KKEEEL

SEQ ID NO: 2631938 - protein, 8 aa, Entamoeba histolytica
KKEEELKQ

SEQ ID NO: 2631939 - protein, 8 aa, Entamoeba histolytica
KKEEELNN

SEQ ID NO: 2631940 - protein, 27 aa, Entamoeba histolytica
KKEEENKRKQEELNEIQTKEQTRSVNE

SEQ ID NO: 2631941 - protein, 19 aa, Entamoeba histolytica
KKEEENNLLEEEKKKVNTF

SEQ ID NO: 2631942 - protein, 11 aa, Entamoeba histolytica
KKEEEPEEGNL

SEQ ID NO: 2631943 - protein, 12 aa, Entamoeba histolytica
KKEEEQQEEENI

SEQ ID NO: 2631944 - protein, 31 aa, Entamoeba histolytica
KKEEETAAYVPPSLRGKPSCVEDDNDPIPGQ

SEQ ID NO: 2631945 - protein, 22 aa, Entamoeba histolytica
KKEEEVKGLNQEIDKINKENEI

SEQ ID NO: 2631946 - protein, 11 aa, Entamoeba histolytica
KKEEEVSQKEK

SEQ ID NO: 2631947 - protein, 8 aa, Entamoeba histolytica
KKEEGDKW

SEQ ID NO: 2631948 - protein, 7 aa, Entamoeba histolytica
KKEEGNV

SEQ ID NO: 2631949 - protein, 13 aa, Entamoeba histolytica
KKEEISKEEELNK

SEQ ID NO: 2631950 - protein, 23 aa, Entamoeba histolytica
KKEEKEINKPKELTTTKKGSYQT

SEQ ID NO: 2631951 - protein, 65 aa, Entamoeba histolytica
KKEEKERKIAEEKRKKEEEEKKKKAEEEAKKKAEEEKKKTEEKPKEESKKMEEEKTGASEPPPVP

SEQ ID NO: 2631952 - protein, 18 aa, Entamoeba histolytica
KKEEKKEEKKEEKKKMNK

SEQ ID NO: 2631953 - protein, 10 aa, Entamoeba histolytica
KKEEKTQDEG

SEQ ID NO: 2631954 - protein, 6 aa, Entamoeba histolytica
KKEEMT

SEQ ID NO: 2631955 - protein, 14 aa, Entamoeba histolytica
KKEENEEEEKKEED

SEQ ID NO: 2631956 - protein, 32 aa, Entamoeba histolytica
KKEENKPISSKKQQEPITNEKKEDSDDENWDF

SEQ ID NO: 2631957 - protein, 17 aa, Entamoeba histolytica
KKEEPKPIIKEEEPKCD

SEQ ID NO: 2631958 - protein, 15 aa, Entamoeba histolytica
KKEEQIESTQQTDFN

SEQ ID NO: 2631959 - protein, 22 aa, Entamoeba histolytica
KKEEQRLKGKVTEGKSQITQNE

SEQ ID NO: 2631960 - protein, 6 aa, Entamoeba histolytica
KKEESF

SEQ ID NO: 2631961 - protein, 8 aa, Entamoeba histolytica
KKEETKEE

SEQ ID NO: 2631962 - protein, 15 aa, Entamoeba histolytica
KKEETKPNSNSQISR

SEQ ID NO: 2631963 - protein, 10 aa, Entamoeba histolytica
KKEETRPNTR

SEQ ID NO: 2631964 - protein, 20 aa, Entamoeba histolytica
KKEETTLTIPNQQQKKDEET

SEQ ID NO: 2631965 - protein, 38 aa, Entamoeba histolytica
KKEEVKKNTSTKKQNNKSVNPKKERNSQPKNNKNKTLG

SEQ ID NO: 2631966 - protein, 8 aa, Entamoeba histolytica
KKEEYPGR

SEQ ID NO: 2631967 - protein, 8 aa, Entamoeba histolytica
KKEEYSKI

SEQ ID NO: 2631968 - protein, 4 aa, Entamoeba histolytica
KKEF

SEQ ID NO: 2631969 - protein, 6 aa, Entamoeba histolytica
KKEFDY

SEQ ID NO: 2631970 - protein, 10 aa, Entamoeba histolytica
KKEFKTEEES

SEQ ID NO: 2631971 - protein, 6 aa, Entamoeba histolytica
KKEFPE

SEQ ID NO: 2631972 - protein, 23 aa, Entamoeba histolytica
KKEGDTTQTNEVEEQPIIINEKA

SEQ ID NO: 2631973 - protein, 8 aa, Entamoeba histolytica
KKEGESEV

SEQ ID NO: 2631974 - protein, 8 aa, Entamoeba histolytica
KKEGESTM

SEQ ID NO: 2631975 - protein, 12 aa, Entamoeba histolytica
KKEGGKSDSETV

SEQ ID NO: 2631976 - protein, 5 aa, Entamoeba histolytica
KKEGH

SEQ ID NO: 2631977 - protein, 41 aa, Entamoeba histolytica
KKEGISIKKKKEKKLVTPKKRGRKPKPKYSLSNEKKDRVKQ

SEQ ID NO: 2631978 - protein, 7 aa, Entamoeba histolytica
KKEGKKT

SEQ ID NO: 2631979 - protein, 5 aa, Entamoeba histolytica
KKEGN

SEQ ID NO: 2631980 - protein, 6 aa, Entamoeba histolytica
KKEGPE

SEQ ID NO: 2631981 - protein, 12 aa, Entamoeba histolytica
KKEGQETPKIET

SEQ ID NO: 2631982 - protein, 6 aa, Entamoeba histolytica
KKEGTL

SEQ ID NO: 2631983 - protein, 7 aa, Entamoeba histolytica
KKEHKEE

SEQ ID NO: 2631984 - protein, 9 aa, Entamoeba histolytica
KKEHNTSSE

SEQ ID NO: 2631985 - protein, 4 aa, Entamoeba histolytica
KKEI

SEQ ID NO: 2631986 - protein, 20 aa, Entamoeba histolytica
KKEIDNSEKKYSKKTSHHSI

SEQ ID NO: 2631987 - protein, 5 aa, Entamoeba histolytica
KKEIE

SEQ ID NO: 2631988 - protein, 6 aa, Entamoeba histolytica
KKEIEE

SEQ ID NO: 2631989 - protein, 12 aa, Entamoeba histolytica
KKEIEKKNKKQA

SEQ ID NO: 2631990 - protein, 19 aa, Entamoeba histolytica
KKEIESLKEGAKKESERKK

SEQ ID NO: 2631991 - protein, 8 aa, Entamoeba histolytica
KKEIETQP

SEQ ID NO: 2631992 - protein, 6 aa, Entamoeba histolytica
KKEIGV

SEQ ID NO: 2631993 - protein, 6 aa, Entamoeba histolytica
KKEIIE

SEQ ID NO: 2631994 - protein, 7 aa, Entamoeba histolytica
KKEIKDT

SEQ ID NO: 2631995 - protein, 8 aa, Entamoeba histolytica
KKEIKEKR

SEQ ID NO: 2631996 - protein, 20 aa, Entamoeba histolytica
KKEIKTTEKEEETSKYKAEI

SEQ ID NO: 2631997 - protein, 14 aa, Entamoeba histolytica
KKEINEKKEEREKL

SEQ ID NO: 2631998 - protein, 7 aa, Entamoeba histolytica
KKEIPKF

SEQ ID NO: 2631999 - protein, 7 aa, Entamoeba histolytica
KKEIPYG

SEQ ID NO: 2632000 - protein, 18 aa, Entamoeba histolytica
KKEISKNEFQKLILHICS

SEQ ID NO: 2632001 - protein, 8 aa, Entamoeba histolytica
KKEISQQR

SEQ ID NO: 2632002 - protein, 4 aa, Entamoeba histolytica
KKEK

SEQ ID NO: 2632003 - protein, 10 aa, Entamoeba histolytica
KKEKDEEITK

SEQ ID NO: 2632004 - protein, 8 aa, Entamoeba histolytica
KKEKDEKI

SEQ ID NO: 2632005 - protein, 13 aa, Entamoeba histolytica
KKEKDETTPEFKE

SEQ ID NO: 2632006 - protein, 16 aa, Entamoeba histolytica
KKEKDKQNCIDDEQQV

SEQ ID NO: 2632007 - protein, 17 aa, Entamoeba histolytica
KKEKEAEMNRKKGRMTG

SEQ ID NO: 2632008 - protein, 14 aa, Entamoeba histolytica
KKEKEKKELQKEVE

SEQ ID NO: 2632009 - protein, 11 aa, Entamoeba histolytica
KKEKEMEEEYN

SEQ ID NO: 2632010 - protein, 9 aa, Entamoeba histolytica
KKEKENELT

SEQ ID NO: 2632011 - protein, 17 aa, Entamoeba histolytica
KKEKEYNERSKKIQENI

SEQ ID NO: 2632012 - protein, 12 aa, Entamoeba histolytica
KKEKIKRKSCLI

SEQ ID NO: 2632013 - protein, 23 aa, Entamoeba histolytica
KKEKKEEKKRKKEVGGDLTSEIS

SEQ ID NO: 2632014 - protein, 8 aa, Entamoeba histolytica
KKEKKISK

SEQ ID NO: 2632015 - protein, 16 aa, Entamoeba histolytica
KKEKKVKEEKEEVIPT

SEQ ID NO: 2632016 - protein, 6 aa, Entamoeba histolytica
KKEKNN

SEQ ID NO: 2632017 - protein, 12 aa, Entamoeba histolytica
KKEKQKKADEIH

SEQ ID NO: 2632018 - protein, 25 aa, Entamoeba histolytica
KKEKQSKDLNEKGETSIQSINPPLQ

SEQ ID NO: 2632019 - protein, 15 aa, Entamoeba histolytica
KKEKRIRREKKQEEV

SEQ ID NO: 2632020 - protein, 17 aa, Entamoeba histolytica
KKEKSVNITEQSSEIEK

SEQ ID NO: 2632021 - protein, 6 aa, Entamoeba histolytica
KKEKYA

SEQ ID NO: 2632022 - protein, 18 aa, Entamoeba histolytica
KKELEDNKQYTQKEIDNQ

SEQ ID NO: 2632023 - protein, 6 aa, Entamoeba histolytica
KKELEE

SEQ ID NO: 2632024 - protein, 9 aa, Entamoeba histolytica
KKELEEKQT

SEQ ID NO: 2632025 - protein, 6 aa, Entamoeba histolytica
KKELER

SEQ ID NO: 2632026 - protein, 7 aa, Entamoeba histolytica
KKELKDI

SEQ ID NO: 2632027 - protein, 6 aa, Entamoeba histolytica
KKELKE

SEQ ID NO: 2632028 - protein, 16 aa, Entamoeba histolytica
KKELKNSNKDKKDKKI

SEQ ID NO: 2632029 - protein, 19 aa, Entamoeba histolytica
KKELNEKNEELKKIEEEYG

SEQ ID NO: 2632030 - protein, 6 aa, Entamoeba histolytica
KKELTP

SEQ ID NO: 2632031 - protein, 5 aa, Entamoeba histolytica
KKEMK

SEQ ID NO: 2632032 - protein, 5 aa, Entamoeba histolytica
KKEMQ

SEQ ID NO: 2632033 - protein, 7 aa, Entamoeba histolytica
KKENDED

SEQ ID NO: 2632034 - protein, 10 aa, Entamoeba histolytica
KKENEAKRKR

SEQ ID NO: 2632035 - protein, 31 aa, Entamoeba histolytica
KKENEELKKENNKITEELSQVKSSTIGEKEE

SEQ ID NO: 2632036 - protein, 19 aa, Entamoeba histolytica
KKENEELKTENENNKKEIK

SEQ ID NO: 2632037 - protein, 8 aa, Entamoeba histolytica
KKENEIEE

SEQ ID NO: 2632038 - protein, 13 aa, Entamoeba histolytica
KKENEKIQSEKEE

SEQ ID NO: 2632039 - protein, 22 aa, Entamoeba histolytica
KKENETKPKRTQPTPLVIVRRK

SEQ ID NO: 2632040 - protein, 14 aa, Entamoeba histolytica
KKENKEENKTTSTH

SEQ ID NO: 2632041 - protein, 7 aa, Entamoeba histolytica
KKENKEL

SEQ ID NO: 2632042 - protein, 17 aa, Entamoeba histolytica
KKENKERKSKKKTTRKN

SEQ ID NO: 2632043 - protein, 7 aa, Entamoeba histolytica
KKENKLY

SEQ ID NO: 2632044 - protein, 7 aa, Entamoeba histolytica
KKENKYI

SEQ ID NO: 2632045 - protein, 18 aa, Entamoeba histolytica
KKENKYIKPTLEQEADAF

SEQ ID NO: 2632046 - protein, 10 aa, Entamoeba histolytica
KKENPKINQP

SEQ ID NO: 2632047 - protein, 5 aa, Entamoeba histolytica
KKENS

SEQ ID NO: 2632048 - protein, 58 aa, Entamoeba histolytica
KKENTNPPKIETNSKENTNSNEEQKDVKKENTNPPKTETNSKENKEIIQSSNTNKQIN

SEQ ID NO: 2632049 - protein, 6 aa, Entamoeba histolytica
KKENTQ

SEQ ID NO: 2632050 - protein, 7 aa, Entamoeba histolytica
KKENYYN

SEQ ID NO: 2632051 - protein, 8 aa, Entamoeba histolytica
KKEPFKVT

SEQ ID NO: 2632052 - protein, 10 aa, Entamoeba histolytica
KKEPRKTTDI

SEQ ID NO: 2632053 - protein, 9 aa, Entamoeba histolytica
KKEPSTKRS

SEQ ID NO: 2632054 - protein, 18 aa, Entamoeba histolytica
KKEQEEADKIKAEEEKMK

SEQ ID NO: 2632055 - protein, 14 aa, Entamoeba histolytica
KKEQEENTSSNAVV

SEQ ID NO: 2632056 - protein, 6 aa, Entamoeba histolytica
KKEQEI

SEQ ID NO: 2632057 - protein, 8 aa, Entamoeba histolytica
KKEQGKTY

SEQ ID NO: 2632058 - protein, 13 aa, Entamoeba histolytica
KKEQHPPKETRKF

SEQ ID NO: 2632059 - protein, 15 aa, Entamoeba histolytica
KKEQKEREEEIEKKE

SEQ ID NO: 2632060 - protein, 5 aa, Entamoeba histolytica
KKEQL

SEQ ID NO: 2632061 - protein, 14 aa, Entamoeba histolytica
KKEQLTQQKPIQKP

SEQ ID NO: 2632062 - protein, 11 aa, Entamoeba histolytica
KKEQTGNSELN

SEQ ID NO: 2632063 - protein, 13 aa, Entamoeba histolytica
KKEQTNKKLFENE

SEQ ID NO: 2632064 - protein, 7 aa, Entamoeba histolytica
KKEQTVY

SEQ ID NO: 2632065 - protein, 10 aa, Entamoeba histolytica
KKERDDKNYE

SEQ ID NO: 2632066 - protein, 28 aa, Entamoeba histolytica
KKEREANGEEDVEDEEKNPRKRVPPKAL

SEQ ID NO: 2632067 - protein, 7 aa, Entamoeba histolytica
KKEREEM

SEQ ID NO: 2632068 - protein, 12 aa, Entamoeba histolytica
KKEREINHQREN

SEQ ID NO: 2632069 - protein, 6 aa, Entamoeba histolytica
KKERIK

SEQ ID NO: 2632070 - protein, 12 aa, Entamoeba histolytica
KKERINNKEYPT

SEQ ID NO: 2632071 - protein, 20 aa, Entamoeba histolytica
KKERKGLIQSSGIKESSSFN

SEQ ID NO: 2632072 - protein, 18 aa, Entamoeba histolytica
KKERKKRKGDHKSDRREE

SEQ ID NO: 2632073 - protein, 15 aa, Entamoeba histolytica
KKERKREVKDNKNMG

SEQ ID NO: 2632074 - protein, 20 aa, Entamoeba histolytica
KKERQNEKSSHDSDRKVLEE

SEQ ID NO: 2632075 - protein, 5 aa, Entamoeba histolytica
KKERW

SEQ ID NO: 2632076 - protein, 12 aa, Entamoeba histolytica
KKESALGGPQSR

SEQ ID NO: 2632077 - protein, 7 aa, Entamoeba histolytica
KKESGHL

SEQ ID NO: 2632078 - protein, 9 aa, Entamoeba histolytica
KKESGLEGK

SEQ ID NO: 2632079 - protein, 5 aa, Entamoeba histolytica
KKESP

SEQ ID NO: 2632080 - protein, 6 aa, Entamoeba histolytica
KKESPD

SEQ ID NO: 2632081 - protein, 7 aa, Entamoeba histolytica
KKESPDV

SEQ ID NO: 2632082 - protein, 17 aa, Entamoeba histolytica
KKESREDDSSSKYKYGK

SEQ ID NO: 2632083 - protein, 7 aa, Entamoeba histolytica
KKESTEV

SEQ ID NO: 2632084 - protein, 6 aa, Entamoeba histolytica
KKESTL

SEQ ID NO: 2632085 - protein, 8 aa, Entamoeba histolytica
KKESTPLS

SEQ ID NO: 2632086 - protein, 18 aa, Entamoeba histolytica
KKETESYLANSKKVRNSK

SEQ ID NO: 2632087 - protein, 5 aa, Entamoeba histolytica
KKETF

SEQ ID NO: 2632088 - protein, 6 aa, Entamoeba histolytica
KKETFS

SEQ ID NO: 2632089 - protein, 11 aa, Entamoeba histolytica
KKETGDKNKVY

SEQ ID NO: 2632090 - protein, 9 aa, Entamoeba histolytica
KKETKGEMS

SEQ ID NO: 2632091 - protein, 25 aa, Entamoeba histolytica
KKEVAEAKAEKAKEMKKKVNKKGYS

SEQ ID NO: 2632092 - protein, 9 aa, Entamoeba histolytica
KKEVDNKNI

SEQ ID NO: 2632093 - protein, 8 aa, Entamoeba histolytica
KKEVERGR

SEQ ID NO: 2632094 - protein, 12 aa, Entamoeba histolytica
KKEVNNKLTKQN

SEQ ID NO: 2632095 - protein, 5 aa, Entamoeba histolytica
KKEVR

SEQ ID NO: 2632096 - protein, 5 aa, Entamoeba histolytica
KKEVS

SEQ ID NO: 2632097 - protein, 15 aa, Entamoeba histolytica
KKEVSDEEAQNYSKR

SEQ ID NO: 2632098 - protein, 6 aa, Entamoeba histolytica
KKEVTN

SEQ ID NO: 2632099 - protein, 8 aa, Entamoeba histolytica
KKEVTTKQ

SEQ ID NO: 2632100 - protein, 7 aa, Entamoeba histolytica
KKEYDEV

SEQ ID NO: 2632101 - protein, 7 aa, Entamoeba histolytica
KKEYEEK

SEQ ID NO: 2632102 - protein, 17 aa, Entamoeba histolytica
KKEYESNPSAWDTCIIS

SEQ ID NO: 2632103 - protein, 13 aa, Entamoeba histolytica
KKEYKATEVKEPV

SEQ ID NO: 2632104 - protein, 14 aa, Entamoeba histolytica
KKEYNRKKEITEIN

SEQ ID NO: 2632105 - protein, 8 aa, Entamoeba histolytica
KKEYQSRK

SEQ ID NO: 2632106 - protein, 6 aa, Entamoeba histolytica
KKFAEK

SEQ ID NO: 2632107 - protein, 9 aa, Entamoeba histolytica
KKFCTPDDI

SEQ ID NO: 2632108 - protein, 4 aa, Entamoeba histolytica
KKFD

SEQ ID NO: 2632109 - protein, 6 aa, Entamoeba histolytica
KKFDGS

SEQ ID NO: 2632110 - protein, 7 aa, Entamoeba histolytica
KKFDNEE

SEQ ID NO: 2632111 - protein, 6 aa, Entamoeba histolytica
KKFEEG

SEQ ID NO: 2632112 - protein, 12 aa, Entamoeba histolytica
KKFERPKLQKYE

SEQ ID NO: 2632113 - protein, 41 aa, Entamoeba histolytica
KKFETPTGRSLKGNEEESPLKKKNQPESDISYSEDPYIEVD

SEQ ID NO: 2632114 - protein, 7 aa, Entamoeba histolytica
KKFGNER

SEQ ID NO: 2632115 - protein, 4 aa, Entamoeba histolytica
KKFI

SEQ ID NO: 2632116 - protein, 14 aa, Entamoeba histolytica
KKFNSKKETVEGET

SEQ ID NO: 2632117 - protein, 10 aa, Entamoeba histolytica
KKFQPSKDVQ

SEQ ID NO: 2632118 - protein, 9 aa, Entamoeba histolytica
KKFSTKDNV

SEQ ID NO: 2632119 - protein, 8 aa, Entamoeba histolytica
KKFTPEEI

SEQ ID NO: 2632120 - protein, 10 aa, Entamoeba histolytica
KKGAIKPAVG

SEQ ID NO: 2632121 - protein, 16 aa, Entamoeba histolytica
KKGANEATKALNRGKA

SEQ ID NO: 2632122 - protein, 15 aa, Entamoeba histolytica
KKGANETTKALNRGK

SEQ ID NO: 2632123 - protein, 6 aa, Entamoeba histolytica
KKGANQ

SEQ ID NO: 2632124 - protein, 9 aa, Entamoeba histolytica
KKGAYKSDH

SEQ ID NO: 2632125 - protein, 13 aa, Entamoeba histolytica
KKGCYKSQSLKGT

SEQ ID NO: 2632126 - protein, 9 aa, Entamoeba histolytica
KKGDASDKK

SEQ ID NO: 2632127 - protein, 10 aa, Entamoeba histolytica
KKGDDNGSVF

SEQ ID NO: 2632128 - protein, 13 aa, Entamoeba histolytica
KKGDLRKEYPGNI

SEQ ID NO: 2632129 - protein, 5 aa, Entamoeba histolytica
KKGDN

SEQ ID NO: 2632130 - protein, 7 aa, Entamoeba histolytica
KKGDPFW

SEQ ID NO: 2632131 - protein, 6 aa, Entamoeba histolytica
KKGDRV

SEQ ID NO: 2632132 - protein, 8 aa, Entamoeba histolytica
KKGDSCGI

SEQ ID NO: 2632133 - protein, 10 aa, Entamoeba histolytica
KKGEAKPIPQ

SEQ ID NO: 2632134 - protein, 9 aa, Entamoeba histolytica
KKGEDSERL

SEQ ID NO: 2632135 - protein, 7 aa, Entamoeba histolytica
KKGEEIN

SEQ ID NO: 2632136 - protein, 24 aa, Entamoeba histolytica
KKGEEKSKKSKEKTPSKKNDDSFE

SEQ ID NO: 2632137 - protein, 18 aa, Entamoeba histolytica
KKGEGIHQGDPNKKEELK

SEQ ID NO: 2632138 - protein, 18 aa, Entamoeba histolytica
KKGEGMFRGNPNDKTKLN

SEQ ID NO: 2632139 - protein, 7 aa, Entamoeba histolytica
KKGEKRC

SEQ ID NO: 2632140 - protein, 7 aa, Entamoeba histolytica
KKGEKYY

SEQ ID NO: 2632141 - protein, 12 aa, Entamoeba histolytica
KKGENDIYLDMS

SEQ ID NO: 2632142 - protein, 9 aa, Entamoeba histolytica
KKGEREKRK

SEQ ID NO: 2632143 - protein, 6 aa, Entamoeba histolytica
KKGESI

SEQ ID NO: 2632144 - protein, 6 aa, Entamoeba histolytica
KKGFPE

SEQ ID NO: 2632145 - protein, 8 aa, Entamoeba histolytica
KKGGAIAV

SEQ ID NO: 2632146 - protein, 6 aa, Entamoeba histolytica
KKGGDA

SEQ ID NO: 2632147 - protein, 7 aa, Entamoeba histolytica
KKGGELN

SEQ ID NO: 2632148 - protein, 10 aa, Entamoeba histolytica
KKGGIGTPEY

SEQ ID NO: 2632149 - protein, 8 aa, Entamoeba histolytica
KKGGNVTQ

SEQ ID NO: 2632150 - protein, 4 aa, Entamoeba histolytica
KKGI

SEQ ID NO: 2632151 - protein, 6 aa, Entamoeba histolytica
KKGIEK

SEQ ID NO: 2632152 - protein, 6 aa, Entamoeba histolytica
KKGIKE

SEQ ID NO: 2632153 - protein, 12 aa, Entamoeba histolytica
KKGISEKTARRR

SEQ ID NO: 2632154 - protein, 8 aa, Entamoeba histolytica
KKGKCEEW

SEQ ID NO: 2632155 - protein, 10 aa, Entamoeba histolytica
KKGKDLNTKQ

SEQ ID NO: 2632156 - protein, 7 aa, Entamoeba histolytica
KKGKESI

SEQ ID NO: 2632157 - protein, 7 aa, Entamoeba histolytica
KKGKFNN

SEQ ID NO: 2632158 - protein, 18 aa, Entamoeba histolytica
KKGKGMFKGTPDTKEELK

SEQ ID NO: 2632159 - protein, 11 aa, Entamoeba histolytica
KKGKIGVTQPR

SEQ ID NO: 2632160 - protein, 8 aa, Entamoeba histolytica
KKGKITDF

SEQ ID NO: 2632161 - protein, 6 aa, Entamoeba histolytica
KKGKIY

SEQ ID NO: 2632162 - protein, 8 aa, Entamoeba histolytica
KKGKKEGM

SEQ ID NO: 2632163 - protein, 13 aa, Entamoeba histolytica
KKGKSTKKTSRKV

SEQ ID NO: 2632164 - protein, 8 aa, Entamoeba histolytica
KKGKTTSQ

SEQ ID NO: 2632165 - protein, 18 aa, Entamoeba histolytica
KKGKTTSQLRNADAKTND

SEQ ID NO: 2632166 - protein, 9 aa, Entamoeba histolytica
KKGKTWDDF

SEQ ID NO: 2632167 - protein, 15 aa, Entamoeba histolytica
KKGKVTPIRDQGNCG

SEQ ID NO: 2632168 - protein, 8 aa, Entamoeba histolytica
KKGLTKGS

SEQ ID NO: 2632169 - protein, 7 aa, Entamoeba histolytica
KKGMKKG

SEQ ID NO: 2632170 - protein, 24 aa, Entamoeba histolytica
KKGMNAEKKQYKQMKEEAERYQEL

SEQ ID NO: 2632171 - protein, 7 aa, Entamoeba histolytica
KKGMTAD

SEQ ID NO: 2632172 - protein, 9 aa, Entamoeba histolytica
KKGNDDKNT

SEQ ID NO: 2632173 - protein, 7 aa, Entamoeba histolytica
KKGNDKL

SEQ ID NO: 2632174 - protein, 7 aa, Entamoeba histolytica
KKGNDVN

SEQ ID NO: 2632175 - protein, 7 aa, Entamoeba histolytica
KKGNLTP

SEQ ID NO: 2632176 - protein, 8 aa, Entamoeba histolytica
KKGNNEKK

SEQ ID NO: 2632177 - protein, 12 aa, Entamoeba histolytica
KKGNPYIAEVLG

SEQ ID NO: 2632178 - protein, 5 aa, Entamoeba histolytica
KKGNQ

SEQ ID NO: 2632179 - protein, 6 aa, Entamoeba histolytica
KKGNVC

SEQ ID NO: 2632180 - protein, 10 aa, Entamoeba histolytica
KKGNVSNSID

SEQ ID NO: 2632181 - protein, 5 aa, Entamoeba histolytica
KKGNY

SEQ ID NO: 2632182 - protein, 12 aa, Entamoeba histolytica
KKGPKTKENIKT

SEQ ID NO: 2632183 - protein, 6 aa, Entamoeba histolytica
KKGPTC

SEQ ID NO: 2632184 - protein, 7 aa, Entamoeba histolytica
KKGQPDL

SEQ ID NO: 2632185 - protein, 7 aa, Entamoeba histolytica
KKGRRTR

SEQ ID NO: 2632186 - protein, 7 aa, Entamoeba histolytica
KKGRSFT

SEQ ID NO: 2632187 - protein, 7 aa, Entamoeba histolytica
KKGRVEK

SEQ ID NO: 2632188 - protein, 8 aa, Entamoeba histolytica
KKGSDGVY

SEQ ID NO: 2632189 - protein, 8 aa, Entamoeba histolytica
KKGSLGDL

SEQ ID NO: 2632190 - protein, 7 aa, Entamoeba histolytica
KKGSLKG

SEQ ID NO: 2632191 - protein, 9 aa, Entamoeba histolytica
KKGSNINKT

SEQ ID NO: 2632192 - protein, 15 aa, Entamoeba histolytica
KKGSRSSSRKREDII

SEQ ID NO: 2632193 - protein, 7 aa, Entamoeba histolytica
KKGSRTD

SEQ ID NO: 2632194 - protein, 9 aa, Entamoeba histolytica
KKGSSRNGF

SEQ ID NO: 2632195 - protein, 11 aa, Entamoeba histolytica
KKGSTILTKKQ

SEQ ID NO: 2632196 - protein, 8 aa, Entamoeba histolytica
KKGSWDEA

SEQ ID NO: 2632197 - protein, 6 aa, Entamoeba histolytica
KKGTEV

SEQ ID NO: 2632198 - protein, 7 aa, Entamoeba histolytica
KKGTFGY

SEQ ID NO: 2632199 - protein, 7 aa, Entamoeba histolytica
KKGTKEF

SEQ ID NO: 2632200 - protein, 5 aa, Entamoeba histolytica
KKGTL

SEQ ID NO: 2632201 - protein, 7 aa, Entamoeba histolytica
KKGTNLS

SEQ ID NO: 2632202 - protein, 8 aa, Entamoeba histolytica
KKGTPVTQ

SEQ ID NO: 2632203 - protein, 8 aa, Entamoeba histolytica
KKGVDAAM

SEQ ID NO: 2632204 - protein, 13 aa, Entamoeba histolytica
KKGVDRKNRSASV

SEQ ID NO: 2632205 - protein, 6 aa, Entamoeba histolytica
KKGVEL

SEQ ID NO: 2632206 - protein, 15 aa, Entamoeba histolytica
KKGVVEKESTSDRST

SEQ ID NO: 2632207 - protein, 8 aa, Entamoeba histolytica
KKGWNEDD

SEQ ID NO: 2632208 - protein, 6 aa, Entamoeba histolytica
KKGYIP

SEQ ID NO: 2632209 - protein, 6 aa, Entamoeba histolytica
KKGYKY

SEQ ID NO: 2632210 - protein, 19 aa, Entamoeba histolytica
KKHFERSDYNCSNKKTTLP

SEQ ID NO: 2632211 - protein, 7 aa, Entamoeba histolytica
KKHHINE

SEQ ID NO: 2632212 - protein, 8 aa, Entamoeba histolytica
KKHKERME

SEQ ID NO: 2632213 - protein, 6 aa, Entamoeba histolytica
KKHLTQ

SEQ ID NO: 2632214 - protein, 6 aa, Entamoeba histolytica
KKHNQA

SEQ ID NO: 2632215 - protein, 13 aa, Entamoeba histolytica
KKHNSTTKQQEMI

SEQ ID NO: 2632216 - protein, 6 aa, Entamoeba histolytica
KKHNTK

SEQ ID NO: 2632217 - protein, 5 aa, Entamoeba histolytica
KKHPD

SEQ ID NO: 2632218 - protein, 6 aa, Entamoeba histolytica
KKHPNE

SEQ ID NO: 2632219 - protein, 7 aa, Entamoeba histolytica
KKHQKYS

SEQ ID NO: 2632220 - protein, 10 aa, Entamoeba histolytica
KKHSAHSITS

SEQ ID NO: 2632221 - protein, 9 aa, Entamoeba histolytica
KKIAESDGI

SEQ ID NO: 2632222 - protein, 9 aa, Entamoeba histolytica
KKIAESKLD

SEQ ID NO: 2632223 - protein, 13 aa, Entamoeba histolytica
KKIANKEVKQNSI

SEQ ID NO: 2632224 - protein, 7 aa, Entamoeba histolytica
KKIANSK

SEQ ID NO: 2632225 - protein, 11 aa, Entamoeba histolytica
KKIAQREQQQS

SEQ ID NO: 2632226 - protein, 4 aa, Entamoeba histolytica
KKID

SEQ ID NO: 2632227 - protein, 6 aa, Entamoeba histolytica
KKIDSK

SEQ ID NO: 2632228 - protein, 10 aa, Entamoeba histolytica
KKIDTKSPEL

SEQ ID NO: 2632229 - protein, 19 aa, Entamoeba histolytica
KKIDTTKKNKKLLSKNPNI

SEQ ID NO: 2632230 - protein, 4 aa, Entamoeba histolytica
KKIE

SEQ ID NO: 2632231 - protein, 10 aa, Entamoeba histolytica
KKIEDEERKL

SEQ ID NO: 2632232 - protein, 20 aa, Entamoeba histolytica
KKIEEDNSLQKKITSSREQK

SEQ ID NO: 2632233 - protein, 9 aa, Entamoeba histolytica
KKIEEEKSK

SEQ ID NO: 2632234 - protein, 10 aa, Entamoeba histolytica
KKIEEKKLKS

SEQ ID NO: 2632235 - protein, 8 aa, Entamoeba histolytica
KKIEEKQE

SEQ ID NO: 2632236 - protein, 23 aa, Entamoeba histolytica
KKIEENNERNKHNGRNVTNRRMD

SEQ ID NO: 2632237 - protein, 32 aa, Entamoeba histolytica
KKIEEPKKGESQEEMNQANNKEKSRISLEPNI

SEQ ID NO: 2632238 - protein, 7 aa, Entamoeba histolytica
KKIEEQY

SEQ ID NO: 2632239 - protein, 7 aa, Entamoeba histolytica
KKIEINK

SEQ ID NO: 2632240 - protein, 13 aa, Entamoeba histolytica
KKIEKGKKEKQQF

SEQ ID NO: 2632241 - protein, 7 aa, Entamoeba histolytica
KKIEKKD

SEQ ID NO: 2632242 - protein, 5 aa, Entamoeba histolytica
KKIEN

SEQ ID NO: 2632243 - protein, 9 aa, Entamoeba histolytica
KKIEQDNCQ

SEQ ID NO: 2632244 - protein, 17 aa, Entamoeba histolytica
KKIEQSQVSNTTSPQQL

SEQ ID NO: 2632245 - protein, 16 aa, Entamoeba histolytica
KKIERRDPRFTEEGGK

SEQ ID NO: 2632246 - protein, 7 aa, Entamoeba histolytica
KKIETPN

SEQ ID NO: 2632247 - protein, 6 aa, Entamoeba histolytica
KKIGEK

SEQ ID NO: 2632248 - protein, 11 aa, Entamoeba histolytica
KKIGKSTIETE

SEQ ID NO: 2632249 - protein, 7 aa, Entamoeba histolytica
KKIGNDG

SEQ ID NO: 2632250 - protein, 12 aa, Entamoeba histolytica
KKIGNSKQIEYN

SEQ ID NO: 2632251 - protein, 4 aa, Entamoeba histolytica
KKII

SEQ ID NO: 2632252 - protein, 20 aa, Entamoeba histolytica
KKIKDEKEKIESKQRRYDQL

SEQ ID NO: 2632253 - protein, 12 aa, Entamoeba histolytica
KKIKENESQVQP

SEQ ID NO: 2632254 - protein, 17 aa, Entamoeba histolytica
KKIKGTKKKKRASDDHA

SEQ ID NO: 2632255 - protein, 8 aa, Entamoeba histolytica
KKIKKKDI

SEQ ID NO: 2632256 - protein, 10 aa, Entamoeba histolytica
KKIKTSLKQN

SEQ ID NO: 2632257 - protein, 7 aa, Entamoeba histolytica
KKILNER

SEQ ID NO: 2632258 - protein, 8 aa, Entamoeba histolytica
KKINENTF

SEQ ID NO: 2632259 - protein, 6 aa, Entamoeba histolytica
KKINES

SEQ ID NO: 2632260 - protein, 17 aa, Entamoeba histolytica
KKINETNDSKSIPKYNK

SEQ ID NO: 2632261 - protein, 6 aa, Entamoeba histolytica
KKINGK

SEQ ID NO: 2632262 - protein, 6 aa, Entamoeba histolytica
KKINKN

SEQ ID NO: 2632263 - protein, 8 aa, Entamoeba histolytica
KKINNDDC

SEQ ID NO: 2632264 - protein, 17 aa, Entamoeba histolytica
KKINNTSYISNNPHNSI

SEQ ID NO: 2632265 - protein, 5 aa, Entamoeba histolytica
KKINS

SEQ ID NO: 2632266 - protein, 16 aa, Entamoeba histolytica
KKINSNYTSIDYTQSA

SEQ ID NO: 2632267 - protein, 7 aa, Entamoeba histolytica
KKIPEEF

SEQ ID NO: 2632268 - protein, 7 aa, Entamoeba histolytica
KKIPPET

SEQ ID NO: 2632269 - protein, 19 aa, Entamoeba histolytica
KKIPSGEYKSYEKHGSPRL

SEQ ID NO: 2632270 - protein, 7 aa, Entamoeba histolytica
KKIPSIQ

SEQ ID NO: 2632271 - protein, 16 aa, Entamoeba histolytica
KKIQEENEKNEKIKRR

SEQ ID NO: 2632272 - protein, 33 aa, Entamoeba histolytica
KKIQEERTLEEQQEGIEKEKEKKEKIQNEREKK

SEQ ID NO: 2632273 - protein, 7 aa, Entamoeba histolytica
KKIQGTN

SEQ ID NO: 2632274 - protein, 9 aa, Entamoeba histolytica
KKIQKKNKK

SEQ ID NO: 2632275 - protein, 7 aa, Entamoeba histolytica
KKIQNQM

SEQ ID NO: 2632276 - protein, 11 aa, Entamoeba histolytica
KKIRRSRRSLR

SEQ ID NO: 2632277 - protein, 20 aa, Entamoeba histolytica
KKISASPQKVYDSTDTITQQ

SEQ ID NO: 2632278 - protein, 7 aa, Entamoeba histolytica
KKISELT

SEQ ID NO: 2632279 - protein, 5 aa, Entamoeba histolytica
KKISL

SEQ ID NO: 2632280 - protein, 42 aa, Entamoeba histolytica
KKISPAELARKKALEKLKKDKEEEERLQKEEEEREKAEAEAL

SEQ ID NO: 2632281 - protein, 15 aa, Entamoeba histolytica
KKITKSSTKSIENSH

SEQ ID NO: 2632282 - protein, 10 aa, Entamoeba histolytica
KKKAKPPHID

SEQ ID NO: 2632283 - protein, 13 aa, Entamoeba histolytica
KKKAQSDKELNSL

SEQ ID NO: 2632284 - protein, 17 aa, Entamoeba histolytica
KKKATTDKKILSQSDHP

SEQ ID NO: 2632285 - protein, 6 aa, Entamoeba histolytica
KKKAYP

SEQ ID NO: 2632286 - protein, 10 aa, Entamoeba histolytica
KKKCKASNFS

SEQ ID NO: 2632287 - protein, 4 aa, Entamoeba histolytica
KKKD

SEQ ID NO: 2632288 - protein, 7 aa, Entamoeba histolytica
KKKDDGK

SEQ ID NO: 2632289 - protein, 7 aa, Entamoeba histolytica
KKKDGSL

SEQ ID NO: 2632290 - protein, 8 aa, Entamoeba histolytica
KKKDKNDV

SEQ ID NO: 2632291 - protein, 14 aa, Entamoeba histolytica
KKKDPNNPNQPEEV

SEQ ID NO: 2632292 - protein, 9 aa, Entamoeba histolytica
KKKDQEKLT

SEQ ID NO: 2632293 - protein, 21 aa, Entamoeba histolytica
KKKDSLSTGRTDEQEKRQVKT

SEQ ID NO: 2632294 - protein, 33 aa, Entamoeba histolytica
KKKDVSPTKLGDDGIISSSRTTISRKIRRGSEF

SEQ ID NO: 2632295 - protein, 10 aa, Entamoeba histolytica
KKKEDKKGKV

SEQ ID NO: 2632296 - protein, 16 aa, Entamoeba histolytica
KKKEDSTSSSEDSIVQ

SEQ ID NO: 2632297 - protein, 8 aa, Entamoeba histolytica
KKKEEEQM

SEQ ID NO: 2632298 - protein, 13 aa, Entamoeba histolytica
KKKEEESKPKKED

SEQ ID NO: 2632299 - protein, 8 aa, Entamoeba histolytica
KKKEEKVE

SEQ ID NO: 2632300 - protein, 11 aa, Entamoeba histolytica
KKKEELKGGIE

SEQ ID NO: 2632301 - protein, 8 aa, Entamoeba histolytica
KKKEETTV

SEQ ID NO: 2632302 - protein, 29 aa, Entamoeba histolytica
KKKEKEKEKNELEKKKEEELKKTVETKEF

SEQ ID NO: 2632303 - protein, 25 aa, Entamoeba histolytica
KKKEKKSGDESGCDSSVLDSSETVY

SEQ ID NO: 2632304 - protein, 5 aa, Entamoeba histolytica
KKKEL

SEQ ID NO: 2632305 - protein, 11 aa, Entamoeba histolytica
KKKELNGMSSK

SEQ ID NO: 2632306 - protein, 23 aa, Entamoeba histolytica
KKKELNRKKHAKKERKTKKEENE

SEQ ID NO: 2632307 - protein, 25 aa, Entamoeba histolytica
KKKELNRKKHAKKERKTKKEKEENE

SEQ ID NO: 2632308 - protein, 9 aa, Entamoeba histolytica
KKKENYEKG

SEQ ID NO: 2632309 - protein, 7 aa, Entamoeba histolytica
KKKEQNV

SEQ ID NO: 2632310 - protein, 9 aa, Entamoeba histolytica
KKKETNECK

SEQ ID NO: 2632311 - protein, 8 aa, Entamoeba histolytica
KKKGFNSS

SEQ ID NO: 2632312 - protein, 10 aa, Entamoeba histolytica
KKKGIENEKM

SEQ ID NO: 2632313 - protein, 10 aa, Entamoeba histolytica
KKKGIKKNEY

SEQ ID NO: 2632314 - protein, 7 aa, Entamoeba histolytica
KKKGIKP

SEQ ID NO: 2632315 - protein, 9 aa, Entamoeba histolytica
KKKGKKAMN

SEQ ID NO: 2632316 - protein, 6 aa, Entamoeba histolytica
KKKGKS

SEQ ID NO: 2632317 - protein, 8 aa, Entamoeba histolytica
KKKGSEEV

SEQ ID NO: 2632318 - protein, 7 aa, Entamoeba histolytica
KKKGYTR

SEQ ID NO: 2632319 - protein, 18 aa, Entamoeba histolytica
KKKHGFSPRSSTSTVVDT

SEQ ID NO: 2632320 - protein, 7 aa, Entamoeba histolytica
KKKHITD

SEQ ID NO: 2632321 - protein, 9 aa, Entamoeba histolytica
KKKHTGGKI

SEQ ID NO: 2632322 - protein, 4 aa, Entamoeba histolytica
KKKI

SEQ ID NO: 2632323 - protein, 15 aa, Entamoeba histolytica
KKKIEEKEHELSTIS

SEQ ID NO: 2632324 - protein, 19 aa, Entamoeba histolytica
KKKIEELKKSSESSDWDEM

SEQ ID NO: 2632325 - protein, 10 aa, Entamoeba histolytica
KKKIEEPTEI

SEQ ID NO: 2632326 - protein, 19 aa, Entamoeba histolytica
KKKIGKINKIGSENEKTFK

SEQ ID NO: 2632327 - protein, 20 aa, Entamoeba histolytica
KKKIKEEEKARKKAIKEKQK

SEQ ID NO: 2632328 - protein, 17 aa, Entamoeba histolytica
KKKIQEIGARKDVDLEE

SEQ ID NO: 2632329 - protein, 8 aa, Entamoeba histolytica
KKKITKEL

SEQ ID NO: 2632330 - protein, 10 aa, Entamoeba histolytica
KKKKDNKSHG

SEQ ID NO: 2632331 - protein, 27 aa, Entamoeba histolytica
KKKKEDKEKDKTDKKERKERELERSSI

SEQ ID NO: 2632332 - protein, 20 aa, Entamoeba histolytica
KKKKEEKEKQLQAEQQAAYE

SEQ ID NO: 2632333 - protein, 96 aa, Entamoeba histolytica
KKKKEEKKEEKKEEKKGLFSSHKDKKDELSSSTKQKIEQKEEVPPPVPSKKYNSKSPVPPATSPSLPAKPLRSSSGAKTTEKPKENLSDSSHSNTL

SEQ ID NO: 2632334 - protein, 8 aa, Entamoeba histolytica
KKKKEKKS

SEQ ID NO: 2632335 - protein, 13 aa, Entamoeba histolytica
KKKKELRKDEDFQ

SEQ ID NO: 2632336 - protein, 5 aa, Entamoeba histolytica
KKKKF

SEQ ID NO: 2632337 - protein, 8 aa, Entamoeba histolytica
KKKKGTFK

SEQ ID NO: 2632338 - protein, 9 aa, Entamoeba histolytica
KKKKGYYAT

SEQ ID NO: 2632339 - protein, 8 aa, Entamoeba histolytica
KKKKIQKC

SEQ ID NO: 2632340 - protein, 8 aa, Entamoeba histolytica
KKKKISSA

SEQ ID NO: 2632341 - protein, 8 aa, Entamoeba histolytica
KKKKITKT

SEQ ID NO: 2632342 - protein, 10 aa, Entamoeba histolytica
KKKKKESQEF

SEQ ID NO: 2632343 - protein, 8 aa, Entamoeba histolytica
KKKKMGWN

SEQ ID NO: 2632344 - protein, 8 aa, Entamoeba histolytica
KKKKQVKI

SEQ ID NO: 2632345 - protein, 8 aa, Entamoeba histolytica
KKKKSEAR

SEQ ID NO: 2632346 - protein, 7 aa, Entamoeba histolytica
KKKKSQI

SEQ ID NO: 2632347 - protein, 6 aa, Entamoeba histolytica
KKKKTI

SEQ ID NO: 2632348 - protein, 7 aa, Entamoeba histolytica
KKKKTLS

SEQ ID NO: 2632349 - protein, 7 aa, Entamoeba histolytica
KKKLDQC

SEQ ID NO: 2632350 - protein, 10 aa, Entamoeba histolytica
KKKLEQDAKE

SEQ ID NO: 2632351 - protein, 10 aa, Entamoeba histolytica
KKKLGDKVEK

SEQ ID NO: 2632352 - protein, 14 aa, Entamoeba histolytica
KKKMEEKEKVKQQF

SEQ ID NO: 2632353 - protein, 7 aa, Entamoeba histolytica
KKKMSKE

SEQ ID NO: 2632354 - protein, 7 aa, Entamoeba histolytica
KKKNDKV

SEQ ID NO: 2632355 - protein, 9 aa, Entamoeba histolytica
KKKNENQFN

SEQ ID NO: 2632356 - protein, 11 aa, Entamoeba histolytica
KKKNGNRQDKL

SEQ ID NO: 2632357 - protein, 9 aa, Entamoeba histolytica
KKKNKEEEI

SEQ ID NO: 2632358 - protein, 15 aa, Entamoeba histolytica
KKKNLHKRLPPNFKE

SEQ ID NO: 2632359 - protein, 9 aa, Entamoeba histolytica
KKKPEKNFM

SEQ ID NO: 2632360 - protein, 7 aa, Entamoeba histolytica
KKKPITT

SEQ ID NO: 2632361 - protein, 8 aa, Entamoeba histolytica
KKKPKFKE

SEQ ID NO: 2632362 - protein, 6 aa, Entamoeba histolytica
KKKPNF

SEQ ID NO: 2632363 - protein, 16 aa, Entamoeba histolytica
KKKPRKLRDESERVKW

SEQ ID NO: 2632364 - protein, 4 aa, Entamoeba histolytica
KKKQ

SEQ ID NO: 2632365 - protein, 42 aa, Entamoeba histolytica
KKKQEEEEKKKEEAKKMEEEKPKEEEVKKEENTPMEEEKPKE

SEQ ID NO: 2632366 - protein, 8 aa, Entamoeba histolytica
KKKQEGKE

SEQ ID NO: 2632367 - protein, 162 aa, Entamoeba histolytica
KKKQEKKEISNEEKKKPVTKAEKEEKKESKKESKKEEKKEEKKEKKEKKEKKEEDGKDSSKEEKKEKKKHHEKKEKKEEETKSNKEDKKEEKKDKKEEKKDKKDKKKEKKEHKKHDKKEEEGIKEDKKPETKAEKEKKKEKKHKKEAKKEEKKTESTKRAPK

SEQ ID NO: 2632368 - protein, 21 aa, Entamoeba histolytica
KKKQEKQEEKEERIEKQEQPL

SEQ ID NO: 2632369 - protein, 10 aa, Entamoeba histolytica
KKKQENERKI

SEQ ID NO: 2632370 - protein, 16 aa, Entamoeba histolytica
KKKQERDGLDEEDERE

SEQ ID NO: 2632371 - protein, 8 aa, Entamoeba histolytica
KKKQEVQM

SEQ ID NO: 2632372 - protein, 4 aa, Entamoeba histolytica
KKKR

SEQ ID NO: 2632373 - protein, 20 aa, Entamoeba histolytica
KKKREEEEEKARKKEEMRKI

SEQ ID NO: 2632374 - protein, 8 aa, Entamoeba histolytica
KKKRISPE

SEQ ID NO: 2632375 - protein, 14 aa, Entamoeba histolytica
KKKRKADTSRRKED

SEQ ID NO: 2632376 - protein, 8 aa, Entamoeba histolytica
KKKRSEQI

SEQ ID NO: 2632377 - protein, 9 aa, Entamoeba histolytica
KKKSEKGTL

SEQ ID NO: 2632378 - protein, 5 aa, Entamoeba histolytica
KKKSF

SEQ ID NO: 2632379 - protein, 25 aa, Entamoeba histolytica
KKKSKTESQIAQETRSSLLSFLKQV

SEQ ID NO: 2632380 - protein, 7 aa, Entamoeba histolytica
KKKSMEL

SEQ ID NO: 2632381 - protein, 8 aa, Entamoeba histolytica
KKKSSINK

SEQ ID NO: 2632382 - protein, 9 aa, Entamoeba histolytica
KKKSSRTAE

SEQ ID NO: 2632383 - protein, 4 aa, Entamoeba histolytica
KKKT

SEQ ID NO: 2632384 - protein, 10 aa, Entamoeba histolytica
KKKTGINKEG

SEQ ID NO: 2632385 - protein, 11 aa, Entamoeba histolytica
KKKTKEVPEVE

SEQ ID NO: 2632386 - protein, 11 aa, Entamoeba histolytica
KKKTKKNETIA

SEQ ID NO: 2632387 - protein, 10 aa, Entamoeba histolytica
KKKTKKPEGM

SEQ ID NO: 2632388 - protein, 13 aa, Entamoeba histolytica
KKKTKNEKIPKNL

SEQ ID NO: 2632389 - protein, 9 aa, Entamoeba histolytica
KKKTKTIQT

SEQ ID NO: 2632390 - protein, 10 aa, Entamoeba histolytica
KKKTPEGDID

SEQ ID NO: 2632391 - protein, 9 aa, Entamoeba histolytica
KKKTPTQYD

SEQ ID NO: 2632392 - protein, 8 aa, Entamoeba histolytica
KKKTREKV

SEQ ID NO: 2632393 - protein, 16 aa, Entamoeba histolytica
KKKTTEMEEKITKNDQ

SEQ ID NO: 2632394 - protein, 9 aa, Entamoeba histolytica
KKKTTKTKI

SEQ ID NO: 2632395 - protein, 4 aa, Entamoeba histolytica
KKKV

SEQ ID NO: 2632396 - protein, 13 aa, Entamoeba histolytica
KKKVENKVEEEKI

SEQ ID NO: 2632397 - protein, 6 aa, Entamoeba histolytica
KKKVGE

SEQ ID NO: 2632398 - protein, 7 aa, Entamoeba histolytica
KKKVGRA

SEQ ID NO: 2632399 - protein, 7 aa, Entamoeba histolytica
KKKYEEL

SEQ ID NO: 2632400 - protein, 7 aa, Entamoeba histolytica
KKKYPDF

SEQ ID NO: 2632401 - protein, 8 aa, Entamoeba histolytica
KKKYSERI

SEQ ID NO: 2632402 - protein, 12 aa, Entamoeba histolytica
KKLAKDVENYEN

SEQ ID NO: 2632403 - protein, 7 aa, Entamoeba histolytica
KKLDQGS

SEQ ID NO: 2632404 - protein, 17 aa, Entamoeba histolytica
KKLEETEKNAAAGSEEL

SEQ ID NO: 2632405 - protein, 5 aa, Entamoeba histolytica
KKLEG

SEQ ID NO: 2632406 - protein, 35 aa, Entamoeba histolytica; identical to SEQ ID NO: 2437085

SEQ ID NO: 2632407 - protein, 14 aa, Entamoeba histolytica
KKLESESYEDSIEE

SEQ ID NO: 2632408 - protein, 7 aa, Entamoeba histolytica
KKLESSS

SEQ ID NO: 2632409 - protein, 7 aa, Entamoeba histolytica
KKLETQQ

SEQ ID NO: 2632410 - protein, 10 aa, Entamoeba histolytica
KKLGEQEDPS

SEQ ID NO: 2632411 - protein, 8 aa, Entamoeba histolytica
KKLGGGSF

SEQ ID NO: 2632412 - protein, 9 aa, Entamoeba histolytica
KKLGKEKAI

SEQ ID NO: 2632413 - protein, 10 aa, Entamoeba histolytica
KKLGNSSIQN

SEQ ID NO: 2632414 - protein, 6 aa, Entamoeba histolytica
KKLGNV

SEQ ID NO: 2632415 - protein, 5 aa, Entamoeba histolytica
KKLGV

SEQ ID NO: 2632416 - protein, 9 aa, Entamoeba histolytica
KKLIGEAEN

SEQ ID NO: 2632417 - protein, 5 aa, Entamoeba histolytica
KKLKE

SEQ ID NO: 2632418 - protein, 18 aa, Entamoeba histolytica
KKLKEEPNNNKPLPPPPV

SEQ ID NO: 2632419 - protein, 20 aa, Entamoeba histolytica
KKLKEETKPSRSGKKIKKSL

SEQ ID NO: 2632420 - protein, 6 aa, Entamoeba histolytica
KKLKEK

SEQ ID NO: 2632421 - protein, 21 aa, Entamoeba histolytica
KKLKFDKKDKKTKSKMEREEK

SEQ ID NO: 2632422 - protein, 15 aa, Entamoeba histolytica
KKLKGDAKRRNRRYG

SEQ ID NO: 2632423 - protein, 8 aa, Entamoeba histolytica
KKLKGGEG

SEQ ID NO: 2632424 - protein, 6 aa, Entamoeba histolytica
KKLNDP

SEQ ID NO: 2632425 - protein, 17 aa, Entamoeba histolytica
KKLNESKPKKGCENKKK

SEQ ID NO: 2632426 - protein, 11 aa, Entamoeba histolytica
KKLNVDRSKGY

SEQ ID NO: 2632427 - protein, 18 aa, Entamoeba histolytica
KKLPKSGKNNTLTGSASL

SEQ ID NO: 2632428 - protein, 9 aa, Entamoeba histolytica
KKLPPSINT

SEQ ID NO: 2632429 - protein, 8 aa, Entamoeba histolytica
KKLPQNEI

SEQ ID NO: 2632430 - protein, 8 aa, Entamoeba histolytica
KKLPQPIQ

SEQ ID NO: 2632431 - protein, 11 aa, Entamoeba histolytica
KKLPTENSGHS

SEQ ID NO: 2632432 - protein, 6 aa, Entamoeba histolytica
KKLQSQ

SEQ ID NO: 2632433 - protein, 11 aa, Entamoeba histolytica
KKLRDEKETAI

SEQ ID NO: 2632434 - protein, 9 aa, Entamoeba histolytica
KKLRPSLQG

SEQ ID NO: 2632435 - protein, 7 aa, Entamoeba histolytica
KKLSLEE

SEQ ID NO: 2632436 - protein, 13 aa, Entamoeba histolytica
KKLSLTSKNIRST

SEQ ID NO: 2632437 - protein, 8 aa, Entamoeba histolytica
KKLSPRSS

SEQ ID NO: 2632438 - protein, 13 aa, Entamoeba histolytica
KKLSQQTNQSLSN

SEQ ID NO: 2632439 - protein, 7 aa, Entamoeba histolytica
KKLSSAV

SEQ ID NO: 2632440 - protein, 8 aa, Entamoeba histolytica
KKLSSEEI

SEQ ID NO: 2632441 - protein, 17 aa, Entamoeba histolytica
KKLSVQQKNTISTNTPI

SEQ ID NO: 2632442 - protein, 14 aa, Entamoeba histolytica
KKLTEESDTIPDPL

SEQ ID NO: 2632443 - protein, 9 aa, Entamoeba histolytica
KKLTNESKE

SEQ ID NO: 2632444 - protein, 8 aa, Entamoeba histolytica
KKLTNNQH

SEQ ID NO: 2632445 - protein, 16 aa, Entamoeba histolytica
KKLTSKTSSLSANQNK

SEQ ID NO: 2632446 - protein, 7 aa, Entamoeba histolytica
KKMDGDT

SEQ ID NO: 2632447 - protein, 7 aa, Entamoeba histolytica
KKMEDSR

SEQ ID NO: 2632448 - protein, 7 aa, Entamoeba histolytica
KKMEEES

SEQ ID NO: 2632449 - protein, 6 aa, Entamoeba histolytica
KKMERS

SEQ ID NO: 2632450 - protein, 13 aa, Entamoeba histolytica
KKMKQPTESPKTL

SEQ ID NO: 2632451 - protein, 6 aa, Entamoeba histolytica
KKMNEE

SEQ ID NO: 2632452 - protein, 7 aa, Entamoeba histolytica
KKMQTKK

SEQ ID NO: 2632453 - protein, 13 aa, Entamoeba histolytica
KKMSKKQKELYKD

SEQ ID NO: 2632454 - protein, 15 aa, Entamoeba histolytica
KKMSPSKLATKISSE

SEQ ID NO: 2632455 - protein, 4 aa, Entamoeba histolytica
KKMT

SEQ ID NO: 2632456 - protein, 6 aa, Entamoeba histolytica
KKNAKP

SEQ ID NO: 2632457 - protein, 5 aa, Entamoeba histolytica
KKNDK

SEQ ID NO: 2632458 - protein, 6 aa, Entamoeba histolytica
KKNDKS

SEQ ID NO: 2632459 - protein, 7 aa, Entamoeba histolytica
KKNDPEF

SEQ ID NO: 2632460 - protein, 9 aa, Entamoeba histolytica
KKNDRPSSV

SEQ ID NO: 2632461 - protein, 8 aa, Entamoeba histolytica
KKNDSNCI

SEQ ID NO: 2632462 - protein, 7 aa, Entamoeba histolytica
KKNEEAV

SEQ ID NO: 2632463 - protein, 9 aa, Entamoeba histolytica
KKNEEIDDL

SEQ ID NO: 2632464 - protein, 6 aa, Entamoeba histolytica
KKNEEM

SEQ ID NO: 2632465 - protein, 7 aa, Entamoeba histolytica
KKNEETI

SEQ ID NO: 2632466 - protein, 13 aa, Entamoeba histolytica
KKNEIEKEKEILD

SEQ ID NO: 2632467 - protein, 19 aa, Entamoeba histolytica
KKNEKEQNVKENILSKILY

SEQ ID NO: 2632468 - protein, 7 aa, Entamoeba histolytica
KKNEKTI

SEQ ID NO: 2632469 - protein, 5 aa, Entamoeba histolytica
KKNEL

SEQ ID NO: 2632470 - protein, 7 aa, Entamoeba histolytica
KKNEMQG

SEQ ID NO: 2632471 - protein, 10 aa, Entamoeba histolytica
KKNEMRPRSV

SEQ ID NO: 2632472 - protein, 5 aa, Entamoeba histolytica
KKNER

SEQ ID NO: 2632473 - protein, 8 aa, Entamoeba histolytica
KKNESDNF

SEQ ID NO: 2632474 - protein, 12 aa, Entamoeba histolytica
KKNETHNKMSQD

SEQ ID NO: 2632475 - protein, 7 aa, Entamoeba histolytica
KKNETVI

SEQ ID NO: 2632476 - protein, 6 aa, Entamoeba histolytica
KKNEYS

SEQ ID NO: 2632477 - protein, 4 aa, Entamoeba histolytica
KKNG

SEQ ID NO: 2632478 - protein, 11 aa, Entamoeba histolytica
KKNGADIGKPL

SEQ ID NO: 2632479 - protein, 9 aa, Entamoeba histolytica
KKNGKVEEN

SEQ ID NO: 2632480 - protein, 8 aa, Entamoeba histolytica
KKNGYRES

SEQ ID NO: 2632481 - protein, 4 aa, Entamoeba histolytica
KKNI

SEQ ID NO: 2632482 - protein, 20 aa, Entamoeba histolytica
KKNIEKKKKTKKNITKPIET

SEQ ID NO: 2632483 - protein, 9 aa, Entamoeba histolytica
KKNKAISEE

SEQ ID NO: 2632484 - protein, 10 aa, Entamoeba histolytica
KKNKETTHSQ

SEQ ID NO: 2632485 - protein, 8 aa, Entamoeba histolytica
KKNKLGEY

SEQ ID NO: 2632486 - protein, 6 aa, Entamoeba histolytica
KKNKQE

SEQ ID NO: 2632487 - protein, 29 aa, Entamoeba histolytica
KKNKRKLMRSESERNMLSPSELKTDGKKL

SEQ ID NO: 2632488 - protein, 22 aa, Entamoeba histolytica
KKNKTLNSNEHKPIKPPKATLM

SEQ ID NO: 2632489 - protein, 9 aa, Entamoeba histolytica
KKNNDEEKD

SEQ ID NO: 2632490 - protein, 30 aa, Entamoeba histolytica
KKNNEEMNKSQEEEVQKQEEEIQKQEEEKM

SEQ ID NO: 2632491 - protein, 8 aa, Entamoeba histolytica
KKNNEYGK

SEQ ID NO: 2632492 - protein, 14 aa, Entamoeba histolytica
KKNNISASSLTQNE

SEQ ID NO: 2632493 - protein, 8 aa, Entamoeba histolytica
KKNNIYKG

SEQ ID NO: 2632494 - protein, 7 aa, Entamoeba histolytica
KKNNPDF

SEQ ID NO: 2632495 - protein, 9 aa, Entamoeba histolytica
KKNNQASGI

SEQ ID NO: 2632496 - protein, 9 aa, Entamoeba histolytica
KKNNQNNSF

SEQ ID NO: 2632497 - protein, 8 aa, Entamoeba histolytica
KKNNTKSL

SEQ ID NO: 2632498 - protein, 10 aa, Entamoeba histolytica
KKNNTNDITQ

SEQ ID NO: 2632499 - protein, 5 aa, Entamoeba histolytica
KKNNV

SEQ ID NO: 2632500 - protein, 10 aa, Entamoeba histolytica
KKNPEDIRQE

SEQ ID NO: 2632501 - protein, 6 aa, Entamoeba histolytica
KKNPLQ

SEQ ID NO: 2632502 - protein, 9 aa, Entamoeba histolytica
KKNPQSPLY

SEQ ID NO: 2632503 - protein, 7 aa, Entamoeba histolytica
KKNQDTC

SEQ ID NO: 2632504 - protein, 5 aa, Entamoeba histolytica
KKNQE

SEQ ID NO: 2632505 - protein, 14 aa, Entamoeba histolytica
KKNQEEYFYKKLID

SEQ ID NO: 2632506 - protein, 9 aa, Entamoeba histolytica
KKNRDPLER

SEQ ID NO: 2632507 - protein, 9 aa, Entamoeba histolytica
KKNREEEEV

SEQ ID NO: 2632508 - protein, 6 aa, Entamoeba histolytica
KKNRFQ

SEQ ID NO: 2632509 - protein, 9 aa, Entamoeba histolytica
KKNRGKEPF

SEQ ID NO: 2632510 - protein, 8 aa, Entamoeba histolytica
KKNRTTES

SEQ ID NO: 2632511 - protein, 7 aa, Entamoeba histolytica
KKNRYSD

SEQ ID NO: 2632512 - protein, 29 aa, Entamoeba histolytica
KKNSDEKKKRIEKAEQQKAKKKGEEKKKV

SEQ ID NO: 2632513 - protein, 5 aa, Entamoeba histolytica
KKNSE

SEQ ID NO: 2632514 - protein, 15 aa, Entamoeba histolytica
KKNSHDIDITSEGIS

SEQ ID NO: 2632515 - protein, 8 aa, Entamoeba histolytica
KKNSSELA

SEQ ID NO: 2632516 - protein, 11 aa, Entamoeba histolytica
KKNSSNSQKIE

SEQ ID NO: 2632517 - protein, 6 aa, Entamoeba histolytica
KKNSTI

SEQ ID NO: 2632518 - protein, 8 aa, Entamoeba histolytica
KKNSTKLD

SEQ ID NO: 2632519 - protein, 9 aa, Entamoeba histolytica
KKNTDQKAV

SEQ ID NO: 2632520 - protein, 11 aa, Entamoeba histolytica
KKNTERMKEKN

SEQ ID NO: 2632521 - protein, 6 aa, Entamoeba histolytica
KKNTGN

SEQ ID NO: 2632522 - protein, 7 aa, Entamoeba histolytica
KKNTPRV

SEQ ID NO: 2632523 - protein, 7 aa, Entamoeba histolytica
KKNTQIN

SEQ ID NO: 2632524 - protein, 29 aa, Entamoeba histolytica
KKNTTTHIGNNDENKSIGGNNKNKKEYTR

SEQ ID NO: 2632525 - protein, 7 aa, Entamoeba histolytica
KKNTTTL

SEQ ID NO: 2632526 - protein, 6 aa, Entamoeba histolytica
KKNWKK

SEQ ID NO: 2632527 - protein, 6 aa, Entamoeba histolytica
KKNYEV

SEQ ID NO: 2632528 - protein, 7 aa, Entamoeba histolytica
KKNYIEG

SEQ ID NO: 2632529 - protein, 5 aa, Entamoeba histolytica
KKPAY

SEQ ID NO: 2632530 - protein, 9 aa, Entamoeba histolytica
KKPDNDSIS

SEQ ID NO: 2632531 - protein, 8 aa, Entamoeba histolytica
KKPEEVYN

SEQ ID NO: 2632532 - protein, 8 aa, Entamoeba histolytica
KKPENDCL

SEQ ID NO: 2632533 - protein, 10 aa, Entamoeba histolytica
KKPENKQVGL

SEQ ID NO: 2632534 - protein, 6 aa, Entamoeba histolytica
KKPEQQ

SEQ ID NO: 2632535 - protein, 9 aa, Entamoeba histolytica
KKPERRSQK

SEQ ID NO: 2632536 - protein, 10 aa, Entamoeba histolytica
KKPERRSQKT

SEQ ID NO: 2632537 - protein, 6 aa, Entamoeba histolytica
KKPFED

SEQ ID NO: 2632538 - protein, 43 aa, Entamoeba histolytica
KKPFSSSNSPSSSSSTIQTIQTQTSSEIGQESLNEKDDQDDIR

SEQ ID NO: 2632539 - protein, 4 aa, Entamoeba histolytica
KKPG

SEQ ID NO: 2632540 - protein, 8 aa, Entamoeba histolytica
KKPGCKGK

SEQ ID NO: 2632541 - protein, 7 aa, Entamoeba histolytica
KKPGCSG

SEQ ID NO: 2632542 - protein, 9 aa, Entamoeba histolytica
KKPGDDPYL

SEQ ID NO: 2632543 - protein, 6 aa, Entamoeba histolytica
KKPGRG

SEQ ID NO: 2632544 - protein, 7 aa, Entamoeba histolytica
KKPHDED

SEQ ID NO: 2632545 - protein, 10 aa, Entamoeba histolytica
KKPHKKSKIN

SEQ ID NO: 2632546 - protein, 4 aa, Entamoeba histolytica
KKPI

SEQ ID NO: 2632547 - protein, 11 aa, Entamoeba histolytica
KKPIDPKLTSK

SEQ ID NO: 2632548 - protein, 5 aa, Entamoeba histolytica
KKPIE

SEQ ID NO: 2632549 - protein, 7 aa, Entamoeba histolytica
KKPIEEI

SEQ ID NO: 2632550 - protein, 40 aa, Entamoeba histolytica
KKPIEKKSVEKKPKKVTEKKVKSRDDEGRKNTLSKKSGLQ

SEQ ID NO: 2632551 - protein, 6 aa, Entamoeba histolytica
KKPIGG

SEQ ID NO: 2632552 - protein, 5 aa, Entamoeba histolytica
KKPIP

SEQ ID NO: 2632553 - protein, 7 aa, Entamoeba histolytica
KKPISQE

SEQ ID NO: 2632554 - protein, 5 aa, Entamoeba histolytica
KKPIT

SEQ ID NO: 2632555 - protein, 6 aa, Entamoeba histolytica
KKPITF

SEQ ID NO: 2632556 - protein, 12 aa, Entamoeba histolytica
KKPITTSDLNQH

SEQ ID NO: 2632557 - protein, 8 aa, Entamoeba histolytica
KKPKDEQF

SEQ ID NO: 2632558 - protein, 12 aa, Entamoeba histolytica
KKPKKGNEDIDT

SEQ ID NO: 2632559 - protein, 9 aa, Entamoeba histolytica
KKPKNILEP

SEQ ID NO: 2632560 - protein, 9 aa, Entamoeba histolytica
KKPKRNTEI

SEQ ID NO: 2632561 - protein, 8 aa, Entamoeba histolytica
KKPKTITE

SEQ ID NO: 2632562 - protein, 14 aa, Entamoeba histolytica
KKPKTTKKAKKPLS

SEQ ID NO: 2632563 - protein, 8 aa, Entamoeba histolytica
KKPLGTNP

SEQ ID NO: 2632564 - protein, 7 aa, Entamoeba histolytica
KKPLKGW

SEQ ID NO: 2632565 - protein, 6 aa, Entamoeba histolytica
KKPLKQ

SEQ ID NO: 2632566 - protein, 4 aa, Entamoeba histolytica
KKPN

SEQ ID NO: 2632567 - protein, 23 aa, Entamoeba histolytica
KKPNERKKHLSKVTQQQTPQKEL

SEQ ID NO: 2632568 - protein, 8 aa, Entamoeba histolytica
KKPNETNC

SEQ ID NO: 2632569 - protein, 7 aa, Entamoeba histolytica
KKPNGND

SEQ ID NO: 2632570 - protein, 16 aa, Entamoeba histolytica
KKPNKEFQEEWEQEKY

SEQ ID NO: 2632571 - protein, 8 aa, Entamoeba histolytica
KKPNPKTW

SEQ ID NO: 2632572 - protein, 7 aa, Entamoeba histolytica
KKPNPSL

SEQ ID NO: 2632573 - protein, 6 aa, Entamoeba histolytica
KKPPTF

SEQ ID NO: 2632574 - protein, 6 aa, Entamoeba histolytica
KKPQIG

SEQ ID NO: 2632575 - protein, 5 aa, Entamoeba histolytica
KKPQV

SEQ ID NO: 2632576 - protein, 9 aa, Entamoeba histolytica
KKPRKTEKR

SEQ ID NO: 2632577 - protein, 7 aa, Entamoeba histolytica
KKPSDEI

SEQ ID NO: 2632578 - protein, 15 aa, Entamoeba histolytica
KKPSTPTKKRLTETT

SEQ ID NO: 2632579 - protein, 12 aa, Entamoeba histolytica
KKPSYYNTYPTN

SEQ ID NO: 2632580 - protein, 4 aa, Entamoeba histolytica
KKPT

SEQ ID NO: 2632581 - protein, 5 aa, Entamoeba histolytica
KKPTI

SEQ ID NO: 2632582 - protein, 6 aa, Entamoeba histolytica
KKPTQK

SEQ ID NO: 2632583 - protein, 7 aa, Entamoeba histolytica
KKPTSVC

SEQ ID NO: 2632584 - protein, 29 aa, Entamoeba histolytica
KKPVEEQQTISPHVASPRESNQSKRSGGW

SEQ ID NO: 2632585 - protein, 28 aa, Entamoeba histolytica
KKPVKKSVKTGHSKGGLQLGKKKQAETI

SEQ ID NO: 2632586 - protein, 19 aa, Entamoeba histolytica
KKPVNRQKGLADAQTDFTY

SEQ ID NO: 2632587 - protein, 7 aa, Entamoeba histolytica
KKPVTKS

SEQ ID NO: 2632588 - protein, 7 aa, Entamoeba histolytica
KKPYGEM

SEQ ID NO: 2632589 - protein, 9 aa, Entamoeba histolytica
KKPYGGMNK

SEQ ID NO: 2632590 - protein, 14 aa, Entamoeba histolytica
KKPYKHDAKEAKEL

SEQ ID NO: 2632591 - protein, 19 aa, Entamoeba histolytica
KKQAKEQKHTENEQEEVAP

SEQ ID NO: 2632592 - protein, 7 aa, Entamoeba histolytica
KKQAPKK

SEQ ID NO: 2632593 - protein, 7 aa, Entamoeba histolytica
KKQDDST

SEQ ID NO: 2632594 - protein, 6 aa, Entamoeba histolytica
KKQDMQ

SEQ ID NO: 2632595 - protein, 17 aa, Entamoeba histolytica
KKQDSKDQDYWIMRKKL

SEQ ID NO: 2632596 - protein, 9 aa, Entamoeba histolytica
KKQDYPKVK

SEQ ID NO: 2632597 - protein, 6 aa, Entamoeba histolytica
KKQDYQ

SEQ ID NO: 2632598 - protein, 15 aa, Entamoeba histolytica
KKQEAVRKHREETVD

SEQ ID NO: 2632599 - protein, 11 aa, Entamoeba histolytica
KKQEDCKTTLE

SEQ ID NO: 2632600 - protein, 11 aa, Entamoeba histolytica
KKQEEDIAKVD

SEQ ID NO: 2632601 - protein, 7 aa, Entamoeba histolytica
KKQEETK

SEQ ID NO: 2632602 - protein, 16 aa, Entamoeba histolytica
KKQEINGKVSVFYGEE

SEQ ID NO: 2632603 - protein, 7 aa, Entamoeba histolytica
KKQEINN

SEQ ID NO: 2632604 - protein, 13 aa, Entamoeba histolytica
KKQEQKEETPVTK

SEQ ID NO: 2632605 - protein, 7 aa, Entamoeba histolytica
KKQESVA

SEQ ID NO: 2632606 - protein, 8 aa, Entamoeba histolytica
KKQETAKD

SEQ ID NO: 2632607 - protein, 5 aa, Entamoeba histolytica
KKQEV

SEQ ID NO: 2632608 - protein, 9 aa, Entamoeba histolytica
KKQEYHGEP

SEQ ID NO: 2632609 - protein, 8 aa, Entamoeba histolytica
KKQFNKKG

SEQ ID NO: 2632610 - protein, 6 aa, Entamoeba histolytica
KKQFQG

SEQ ID NO: 2632611 - protein, 8 aa, Entamoeba histolytica
KKQGGAPC

SEQ ID NO: 2632612 - protein, 9 aa, Entamoeba histolytica
KKQGGSVKN

SEQ ID NO: 2632613 - protein, 18 aa, Entamoeba histolytica
KKQGIGESEKIEMREKEI

SEQ ID NO: 2632614 - protein, 8 aa, Entamoeba histolytica
KKQGKNLK

SEQ ID NO: 2632615 - protein, 6 aa, Entamoeba histolytica
KKQGVL

SEQ ID NO: 2632616 - protein, 12 aa, Entamoeba histolytica
KKQHEQHRDITE

SEQ ID NO: 2632617 - protein, 9 aa, Entamoeba histolytica
KKQIAGGAY

SEQ ID NO: 2632618 - protein, 12 aa, Entamoeba histolytica
KKQIEDKTDSFK

SEQ ID NO: 2632619 - protein, 11 aa, Entamoeba histolytica
KKQIEGTDQEI

SEQ ID NO: 2632620 - protein, 8 aa, Entamoeba histolytica
KKQINSSQ

SEQ ID NO: 2632621 - protein, 13 aa, Entamoeba histolytica
KKQKKSAEKTYQI

SEQ ID NO: 2632622 - protein, 18 aa, Entamoeba histolytica
KKQKQNKKKVKPQPRRQT

SEQ ID NO: 2632623 - protein, 4 aa, Entamoeba histolytica
KKQL

SEQ ID NO: 2632624 - protein, 13 aa, Entamoeba histolytica
KKQLEKEEKEKLK

SEQ ID NO: 2632625 - protein, 8 aa, Entamoeba histolytica
KKQLYSKN

SEQ ID NO: 2632626 - protein, 26 aa, Entamoeba histolytica
KKQMKKEEDRITGGKKRVPRKQFSGK

SEQ ID NO: 2632627 - protein, 17 aa, Entamoeba histolytica
KKQNEETKKITPTKELN

SEQ ID NO: 2632628 - protein, 16 aa, Entamoeba histolytica
KKQNELRKKKKMRENP

SEQ ID NO: 2632629 - protein, 10 aa, Entamoeba histolytica
KKQNENQRKY

SEQ ID NO: 2632630 - protein, 8 aa, Entamoeba histolytica
KKQNIDQG

SEQ ID NO: 2632631 - protein, 5 aa, Entamoeba histolytica
KKQNK

SEQ ID NO: 2632632 - protein, 11 aa, Entamoeba histolytica
KKQNKQTEMEV

SEQ ID NO: 2632633 - protein, 13 aa, Entamoeba histolytica
KKQNTTPPNKSLN

SEQ ID NO: 2632634 - protein, 6 aa, Entamoeba histolytica
KKQNWK

SEQ ID NO: 2632635 - protein, 5 aa, Entamoeba histolytica
KKQPE

SEQ ID NO: 2632636 - protein, 6 aa, Entamoeba histolytica
KKQPEL

SEQ ID NO: 2632637 - protein, 7 aa, Entamoeba histolytica
KKQPNRC

SEQ ID NO: 2632638 - protein, 8 aa, Entamoeba histolytica
KKQPSPYI

SEQ ID NO: 2632639 - protein, 7 aa, Entamoeba histolytica
KKQPTAA

SEQ ID NO: 2632640 - protein, 7 aa, Entamoeba histolytica
KKQPTNV

SEQ ID NO: 2632641 - protein, 35 aa, Entamoeba histolytica
KKQQEKKTKKPKRTISSSEKSKKTLSKQKRVSDSE

SEQ ID NO: 2632642 - protein, 9 aa, Entamoeba histolytica
KKQQELKRR

SEQ ID NO: 2632643 - protein, 17 aa, Entamoeba histolytica
KKQQIEEKRKKKEQEQL

SEQ ID NO: 2632644 - protein, 18 aa, Entamoeba histolytica
KKQQKAKEEFERYNEGKK

SEQ ID NO: 2632645 - protein, 8 aa, Entamoeba histolytica
KKQQTAKE

SEQ ID NO: 2632646 - protein, 8 aa, Entamoeba histolytica
KKQQTAQD

SEQ ID NO: 2632647 - protein, 10 aa, Entamoeba histolytica
KKQRKQYTIT

SEQ ID NO: 2632648 - protein, 7 aa, Entamoeba histolytica
KKQRSPI

SEQ ID NO: 2632649 - protein, 8 aa, Entamoeba histolytica
KKQSALTG

SEQ ID NO: 2632650 - protein, 7 aa, Entamoeba histolytica
KKQSEKM

SEQ ID NO: 2632651 - protein, 6 aa, Entamoeba histolytica
KKQSEL

SEQ ID NO: 2632652 - protein, 5 aa, Entamoeba histolytica
KKQSI

SEQ ID NO: 2632653 - protein, 15 aa, Entamoeba histolytica
KKQSKKCTITSPTPL

SEQ ID NO: 2632654 - protein, 23 aa, Entamoeba histolytica
KKQSKRSEVHEPTEEQSKFSDSV

SEQ ID NO: 2632655 - protein, 7 aa, Entamoeba histolytica
KKQSNGC

SEQ ID NO: 2632656 - protein, 8 aa, Entamoeba histolytica
KKQSPKLL

SEQ ID NO: 2632657 - protein, 9 aa, Entamoeba histolytica
KKQSQETNK

SEQ ID NO: 2632658 - protein, 15 aa, Entamoeba histolytica
KKQSQRKASGEEDVA

SEQ ID NO: 2632659 - protein, 46 aa, Entamoeba histolytica
KKQSVQEKGQEQNENNEEQNENNEEQNEKEKSKEEKPKKEFSSEEK

SEQ ID NO: 2632660 - protein, 9 aa, Entamoeba histolytica
KKQTDLDSL

SEQ ID NO: 2632661 - protein, 9 aa, Entamoeba histolytica
KKQTGCDTE

SEQ ID NO: 2632662 - protein, 75 aa, Entamoeba histolytica
KKQTHKTSMVDNNKKTGSLKKEKPITYEDETITQEDETITQEDKTITQEDETTRYEDGQQKEHTNTQINDGNETI

SEQ ID NO: 2632663 - protein, 6 aa, Entamoeba histolytica
KKQTPG

SEQ ID NO: 2632664 - protein, 15 aa, Entamoeba histolytica
KKQTSEEEIQKIEEQ

SEQ ID NO: 2632665 - protein, 7 aa, Entamoeba histolytica
KKQVENE

SEQ ID NO: 2632666 - protein, 20 aa, Entamoeba histolytica
KKQVNQSHQENTEEFPNETQ

SEQ ID NO: 2632667 - protein, 4 aa, Entamoeba histolytica
KKQY

SEQ ID NO: 2632668 - protein, 5 aa, Entamoeba histolytica
KKQYQ

SEQ ID NO: 2632669 - protein, 20 aa, Entamoeba histolytica
KKQYTKTTEEKEEENNAADK

SEQ ID NO: 2632670 - protein, 9 aa, Entamoeba histolytica
KKRARDAKL

SEQ ID NO: 2632671 - protein, 5 aa, Entamoeba histolytica
KKRAV

SEQ ID NO: 2632672 - protein, 15 aa, Entamoeba histolytica
KKRDPEKDKKRRAGY

SEQ ID NO: 2632673 - protein, 11 aa, Entamoeba histolytica
KKRDYTKGRVT

SEQ ID NO: 2632674 - protein, 27 aa, Entamoeba histolytica
KKREENKPKKSEKDIKKKKQLSKLLSK

SEQ ID NO: 2632675 - protein, 13 aa, Entamoeba histolytica
KKREERAKRDADF

SEQ ID NO: 2632676 - protein, 8 aa, Entamoeba histolytica
KKRENGEF

SEQ ID NO: 2632677 - protein, 9 aa, Entamoeba histolytica
KKREQEKNQ

SEQ ID NO: 2632678 - protein, 7 aa, Entamoeba histolytica
KKRERNR

SEQ ID NO: 2632679 - protein, 35 aa, Entamoeba histolytica
KKRESDTKPPKISKTYQQNEIEKKVNKEDKDVKQL

SEQ ID NO: 2632680 - protein, 6 aa, Entamoeba histolytica
KKRETL

SEQ ID NO: 2632681 - protein, 14 aa, Entamoeba histolytica
KKRFDTNDSEIAKT

SEQ ID NO: 2632682 - protein, 47 aa, Entamoeba histolytica
KKRFPTKAKREKCLSEEKKKTDEIEKKKNDESKPKKNEEENDNPIEI

SEQ ID NO: 2632683 - protein, 6 aa, Entamoeba histolytica
KKRFSL

SEQ ID NO: 2632684 - protein, 8 aa, Entamoeba histolytica
KKRGAEEV

SEQ ID NO: 2632685 - protein, 14 aa, Entamoeba histolytica
KKRGMTQKEKATYK

SEQ ID NO: 2632686 - protein, 13 aa, Entamoeba histolytica
KKRGMTQKEKITY

SEQ ID NO: 2632687 - protein, 8 aa, Entamoeba histolytica
KKRGRTVE

SEQ ID NO: 2632688 - protein, 6 aa, Entamoeba histolytica
KKRGST

SEQ ID NO: 2632689 - protein, 6 aa, Entamoeba histolytica
KKRHQL

SEQ ID NO: 2632690 - protein, 7 aa, Entamoeba histolytica
KKRIDKN

SEQ ID NO: 2632691 - protein, 5 aa, Entamoeba histolytica
KKRIQ

SEQ ID NO: 2632692 - protein, 56 aa, Entamoeba histolytica
KKRKEKHHKHSHNITEKKEQKKEEKEVNEKKEENPKEINEKKEESPKENNKKIETI

SEQ ID NO: 2632693 - protein, 20 aa, Entamoeba histolytica
KKRKGINNKRIKEEKEEEEW

SEQ ID NO: 2632694 - protein, 17 aa, Entamoeba histolytica
KKRKGSVSTGSPYSLEN

SEQ ID NO: 2632695 - protein, 14 aa, Entamoeba histolytica
KKRKKKETKKTKTI

SEQ ID NO: 2632696 - protein, 6 aa, Entamoeba histolytica
KKRKNG

SEQ ID NO: 2632697 - protein, 7 aa, Entamoeba histolytica
KKRKNLL

SEQ ID NO: 2632698 - protein, 16 aa, Entamoeba histolytica
KKRKRIGKLSTGRVES

SEQ ID NO: 2632699 - protein, 9 aa, Entamoeba histolytica
KKRKRMETL

SEQ ID NO: 2632700 - protein, 11 aa, Entamoeba histolytica
KKRKSNDIKLG

SEQ ID NO: 2632701 - protein, 24 aa, Entamoeba histolytica
KKRLDGSPNIDKKNSPMQTPRKVA

SEQ ID NO: 2632702 - protein, 7 aa, Entamoeba histolytica
KKRLSAQ

SEQ ID NO: 2632703 - protein, 13 aa, Entamoeba histolytica
KKRNEENRRRREM

SEQ ID NO: 2632704 - protein, 6 aa, Entamoeba histolytica
KKRNEL

SEQ ID NO: 2632705 - protein, 9 aa, Entamoeba histolytica
KKRNERRNK

SEQ ID NO: 2632706 - protein, 8 aa, Entamoeba histolytica
KKRNNTIT

SEQ ID NO: 2632707 - protein, 10 aa, Entamoeba histolytica
KKRNSQENIK

SEQ ID NO: 2632708 - protein, 22 aa, Entamoeba histolytica
KKRNTSTSVATSNVSTKESINP

SEQ ID NO: 2632709 - protein, 6 aa, Entamoeba histolytica
KKRPEN

SEQ ID NO: 2632710 - protein, 5 aa, Entamoeba histolytica
KKRPN

SEQ ID NO: 2632711 - protein, 16 aa, Entamoeba histolytica
KKRPSISIEKKERGGI

SEQ ID NO: 2632712 - protein, 37 aa, Entamoeba histolytica
KKRPSKKHRTKGTKTVAQAERDAVGSTKQTTEKATAR

SEQ ID NO: 2632713 - protein, 8 aa, Entamoeba histolytica
KKRQDDAL

SEQ ID NO: 2632714 - protein, 7 aa, Entamoeba histolytica
KKRQENY

SEQ ID NO: 2632715 - protein, 14 aa, Entamoeba histolytica
KKRQSDADRINAEY

SEQ ID NO: 2632716 - protein, 13 aa, Entamoeba histolytica
KKRRFTEEETQNL

SEQ ID NO: 2632717 - protein, 23 aa, Entamoeba histolytica
KKRRKTKKSITRKRKLNYISFIF

SEQ ID NO: 2632718 - protein, 16 aa, Entamoeba histolytica
KKRRNSVSSCSSITSS

SEQ ID NO: 2632719 - protein, 9 aa, Entamoeba histolytica
KKRRPSASI

SEQ ID NO: 2632720 - protein, 8 aa, Entamoeba histolytica
KKRRQRGV

SEQ ID NO: 2632721 - protein, 5 aa, Entamoeba histolytica
KKRRS

SEQ ID NO: 2632722 - protein, 9 aa, Entamoeba histolytica
KKRSEIPTK

SEQ ID NO: 2632723 - protein, 7 aa, Entamoeba histolytica
KKRSHNK

SEQ ID NO: 2632724 - protein, 10 aa, Entamoeba histolytica
KKRSKPKNKL

SEQ ID NO: 2632725 - protein, 10 aa, Entamoeba histolytica
KKRSNSSHAM

SEQ ID NO: 2632726 - protein, 6 aa, Entamoeba histolytica
KKRSSL

SEQ ID NO: 2632727 - protein, 13 aa, Entamoeba histolytica
KKRSTKPTKYTTK

SEQ ID NO: 2632728 - protein, 11 aa, Entamoeba histolytica
KKRSVTQGNKK

SEQ ID NO: 2632729 - protein, 10 aa, Entamoeba histolytica
KKRTENLSEN

SEQ ID NO: 2632730 - protein, 8 aa, Entamoeba histolytica
KKRTESLG

SEQ ID NO: 2632731 - protein, 8 aa, Entamoeba histolytica
KKRTSDLA

SEQ ID NO: 2632732 - protein, 8 aa, Entamoeba histolytica
KKRTTERW

SEQ ID NO: 2632733 - protein, 15 aa, Entamoeba histolytica
KKRTVACKKRGQTAW

SEQ ID NO: 2632734 - protein, 4 aa, Entamoeba histolytica
KKRV

SEQ ID NO: 2632735 - protein, 32 aa, Entamoeba histolytica
KKRVNTGDSYIDERKRELKDDYQQKREQPPVK

SEQ ID NO: 2632736 - protein, 30 aa, Entamoeba histolytica
KKRVNTGDSYIDERKRELKDDYQQKRKNKF

SEQ ID NO: 2632737 - protein, 7 aa, Entamoeba histolytica
KKRVQPE

SEQ ID NO: 2632738 - protein, 6 aa, Entamoeba histolytica
KKSAGN

SEQ ID NO: 2632739 - protein, 22 aa, Entamoeba histolytica
KKSANNQKKKKTPITNPNQMGF

SEQ ID NO: 2632740 - protein, 25 aa, Entamoeba histolytica
KKSDASQWENLTKTQQNHHQQSATN

SEQ ID NO: 2632741 - protein, 7 aa, Entamoeba histolytica
KKSDIDK

SEQ ID NO: 2632742 - protein, 8 aa, Entamoeba histolytica
KKSDVDET

SEQ ID NO: 2632743 - protein, 24 aa, Entamoeba histolytica
KKSEANSCNEKKAKKSQSNIKENL

SEQ ID NO: 2632744 - protein, 8 aa, Entamoeba histolytica
KKSEDSDI

SEQ ID NO: 2632745 - protein, 6 aa, Entamoeba histolytica
KKSEEI

SEQ ID NO: 2632746 - protein, 8 aa, Entamoeba histolytica
KKSEKSVK

SEQ ID NO: 2632747 - protein, 8 aa, Entamoeba histolytica
KKSENNGL

SEQ ID NO: 2632748 - protein, 17 aa, Entamoeba histolytica
KKSESIKEKSSIQNPRN

SEQ ID NO: 2632749 - protein, 22 aa, Entamoeba histolytica
KKSETNSQINSTTSSKKSKVSL

SEQ ID NO: 2632750 - protein, 6 aa, Entamoeba histolytica
KKSFDL

SEQ ID NO: 2632751 - protein, 6 aa, Entamoeba histolytica
KKSFIS

SEQ ID NO: 2632752 - protein, 6 aa, Entamoeba histolytica
KKSFKD

SEQ ID NO: 2632753 - protein, 14 aa, Entamoeba histolytica
KKSGEKTPRTRRRT

SEQ ID NO: 2632754 - protein, 8 aa, Entamoeba histolytica
KKSGEQFA

SEQ ID NO: 2632755 - protein, 7 aa, Entamoeba histolytica
KKSGITE

SEQ ID NO: 2632756 - protein, 9 aa, Entamoeba histolytica
KKSGKEIDG

SEQ ID NO: 2632757 - protein, 6 aa, Entamoeba histolytica
KKSGLK

SEQ ID NO: 2632758 - protein, 6 aa, Entamoeba histolytica
KKSGSL

SEQ ID NO: 2632759 - protein, 23 aa, Entamoeba histolytica
KKSGVAPPNGRKSFHQGTSAKHA

SEQ ID NO: 2632760 - protein, 6 aa, Entamoeba histolytica
KKSHEI

SEQ ID NO: 2632761 - protein, 16 aa, Entamoeba histolytica
KKSITSENDQTESEED

SEQ ID NO: 2632762 - protein, 8 aa, Entamoeba histolytica
KKSKEEME

SEQ ID NO: 2632763 - protein, 7 aa, Entamoeba histolytica
KKSKEWK

SEQ ID NO: 2632764 - protein, 12 aa, Entamoeba histolytica
KKSKIIPTNPIP

SEQ ID NO: 2632765 - protein, 8 aa, Entamoeba histolytica
KKSKKCPT

SEQ ID NO: 2632766 - protein, 40 aa, Entamoeba histolytica
KKSKSAKFEEEGLEKEDKKEKKEKKEKKRKEEKENERKRH

SEQ ID NO: 2632767 - protein, 12 aa, Entamoeba histolytica
KKSKTSSKINGD

SEQ ID NO: 2632768 - protein, 8 aa, Entamoeba histolytica
KKSKTVYN

SEQ ID NO: 2632769 - protein, 5 aa, Entamoeba histolytica
KKSKV

SEQ ID NO: 2632770 - protein, 5 aa, Entamoeba histolytica
KKSLD

SEQ ID NO: 2632771 - protein, 9 aa, Entamoeba histolytica
KKSLEDTYK

SEQ ID NO: 2632772 - protein, 6 aa, Entamoeba histolytica
KKSLEV

SEQ ID NO: 2632773 - protein, 6 aa, Entamoeba histolytica
KKSLNQ

SEQ ID NO: 2632774 - protein, 13 aa, Entamoeba histolytica
KKSLRTNRRLDRP

SEQ ID NO: 2632775 - protein, 5 aa, Entamoeba histolytica
KKSLS

SEQ ID NO: 2632776 - protein, 6 aa, Entamoeba histolytica
KKSLTY

SEQ ID NO: 2632777 - protein, 6 aa, Entamoeba histolytica
KKSLVN

SEQ ID NO: 2632778 - protein, 12 aa, Entamoeba histolytica
KKSLYDSSLSNH

SEQ ID NO: 2632779 - protein, 25 aa, Entamoeba histolytica
KKSMEEEEKAKATKGKEEEKEKEQQ

SEQ ID NO: 2632780 - protein, 5 aa, Entamoeba histolytica
KKSMG

SEQ ID NO: 2632781 - protein, 9 aa, Entamoeba histolytica
KKSNESASV

SEQ ID NO: 2632782 - protein, 14 aa, Entamoeba histolytica
KKSNISFARPPKNN

SEQ ID NO: 2632783 - protein, 20 aa, Entamoeba histolytica
KKSNNDKEKALSELKGNPLE

SEQ ID NO: 2632784 - protein, 9 aa, Entamoeba histolytica
KKSNPTNTS

SEQ ID NO: 2632785 - protein, 12 aa, Entamoeba histolytica
KKSNRMEKGKAM

SEQ ID NO: 2632786 - protein, 25 aa, Entamoeba histolytica
KKSNSFRPPVPTHPLPPTPTPKVPF

SEQ ID NO: 2632787 - protein, 20 aa, Entamoeba histolytica
KKSNSSNNSGEEDKQDEEVS

SEQ ID NO: 2632788 - protein, 8 aa, Entamoeba histolytica
KKSNTIVR

SEQ ID NO: 2632789 - protein, 12 aa, Entamoeba histolytica
KKSNTMTQEETK

SEQ ID NO: 2632790 - protein, 5 aa, Entamoeba histolytica
KKSNV

SEQ ID NO: 2632791 - protein, 19 aa, Entamoeba histolytica
KKSPIIRKKTTKKMVRIAE

SEQ ID NO: 2632792 - protein, 6 aa, Entamoeba histolytica
KKSPIK

SEQ ID NO: 2632793 - protein, 12 aa, Entamoeba histolytica
KKSPMGWVKVDI

SEQ ID NO: 2632794 - protein, 6 aa, Entamoeba histolytica
KKSQEC

SEQ ID NO: 2632795 - protein, 12 aa, Entamoeba histolytica
KKSQKDNREQSD

SEQ ID NO: 2632796 - protein, 5 aa, Entamoeba histolytica
KKSQN

SEQ ID NO: 2632797 - protein, 7 aa, Entamoeba histolytica
KKSQTSK

SEQ ID NO: 2632798 - protein, 8 aa, Entamoeba histolytica
KKSRRMSA

SEQ ID NO: 2632799 - protein, 9 aa, Entamoeba histolytica
KKSRRTPEL

SEQ ID NO: 2632800 - protein, 7 aa, Entamoeba histolytica
KKSSDVQ

SEQ ID NO: 2632801 - protein, 8 aa, Entamoeba histolytica
KKSSDVQQ

SEQ ID NO: 2632802 - protein, 14 aa, Entamoeba histolytica
KKSSDWKKGVNPDE

SEQ ID NO: 2632803 - protein, 10 aa, Entamoeba histolytica
KKSSEDPAKV

SEQ ID NO: 2632804 - protein, 7 aa, Entamoeba histolytica
KKSSFES

SEQ ID NO: 2632805 - protein, 9 aa, Entamoeba histolytica
KKSSGKKGT

SEQ ID NO: 2632806 - protein, 5 aa, Entamoeba histolytica
KKSSI

SEQ ID NO: 2632807 - protein, 14 aa, Entamoeba histolytica
KKSSLSIKTQNGNN

SEQ ID NO: 2632808 - protein, 8 aa, Entamoeba histolytica
KKSSNEDK

SEQ ID NO: 2632809 - protein, 14 aa, Entamoeba histolytica
KKSSSFKKHGRTPR

SEQ ID NO: 2632810 - protein, 21 aa, Entamoeba histolytica
KKSSTSQSKTFQKADQKQRQL

SEQ ID NO: 2632811 - protein, 13 aa, Entamoeba histolytica
KKSSVNEELTENE

SEQ ID NO: 2632812 - protein, 10 aa, Entamoeba histolytica
KKSTEEVEDE

SEQ ID NO: 2632813 - protein, 7 aa, Entamoeba histolytica
KKSTGDV

SEQ ID NO: 2632814 - protein, 9 aa, Entamoeba histolytica
KKSTKTSPL

SEQ ID NO: 2632815 - protein, 8 aa, Entamoeba histolytica
KKSTNEIK

SEQ ID NO: 2632816 - protein, 8 aa, Entamoeba histolytica
KKSTNNLE

SEQ ID NO: 2632817 - protein, 7 aa, Entamoeba histolytica
KKSTPFE

SEQ ID NO: 2632818 - protein, 9 aa, Entamoeba histolytica
KKSTRGYGY

SEQ ID NO: 2632819 - protein, 6 aa, Entamoeba histolytica
KKSVEP

SEQ ID NO: 2632820 - protein, 18 aa, Entamoeba histolytica
KKSVIGQKNAPKSQTPIV

SEQ ID NO: 2632821 - protein, 8 aa, Entamoeba histolytica
KKSVITVP

SEQ ID NO: 2632822 - protein, 8 aa, Entamoeba histolytica
KKSVQRET

SEQ ID NO: 2632823 - protein, 20 aa, Entamoeba histolytica
KKSVTTPSDGVPIKKSFSFS

SEQ ID NO: 2632824 - protein, 8 aa, Entamoeba histolytica
KKTAKERE

SEQ ID NO: 2632825 - protein, 8 aa, Entamoeba histolytica
KKTDNNMA

SEQ ID NO: 2632826 - protein, 6 aa, Entamoeba histolytica
KKTDRS

SEQ ID NO: 2632827 - protein, 7 aa, Entamoeba histolytica
KKTDTNV

SEQ ID NO: 2632828 - protein, 7 aa, Entamoeba histolytica
KKTDTST

SEQ ID NO: 2632829 - protein, 8 aa, Entamoeba histolytica
KKTEETQI

SEQ ID NO: 2632830 - protein, 12 aa, Entamoeba histolytica
KKTEKEQTYQEA

SEQ ID NO: 2632831 - protein, 10 aa, Entamoeba histolytica
KKTEKEVPID

SEQ ID NO: 2632832 - protein, 37 aa, Entamoeba histolytica
KKTEKKREGEERIGGKKDKEIINKKKKTEENKRIDEE

SEQ ID NO: 2632833 - protein, 8 aa, Entamoeba histolytica
KKTEKNEK

SEQ ID NO: 2632834 - protein, 7 aa, Entamoeba histolytica
KKTEKQI

SEQ ID NO: 2632835 - protein, 6 aa, Entamoeba histolytica
KKTERF

SEQ ID NO: 2632836 - protein, 8 aa, Entamoeba histolytica
KKTEYNEQ

SEQ ID NO: 2632837 - protein, 32 aa, Entamoeba histolytica
KKTFSDAKDAIKVKDTYKKNLDKITNGAKTLS

SEQ ID NO: 2632838 - protein, 7 aa, Entamoeba histolytica
KKTGAAL

SEQ ID NO: 2632839 - protein, 11 aa, Entamoeba histolytica
KKTGEKSRTFT

SEQ ID NO: 2632840 - protein, 20 aa, Entamoeba histolytica
KKTGESDAQFAKRVSKQKKL

SEQ ID NO: 2632841 - protein, 11 aa, Entamoeba histolytica
KKTGKEGKINE

SEQ ID NO: 2632842 - protein, 7 aa, Entamoeba histolytica
KKTGNSL

SEQ ID NO: 2632843 - protein, 7 aa, Entamoeba histolytica
KKTGVYG

SEQ ID NO: 2632844 - protein, 10 aa, Entamoeba histolytica
KKTHNPEEKP

SEQ ID NO: 2632845 - protein, 16 aa, Entamoeba histolytica
KKTHQISEHNGRTESS

SEQ ID NO: 2632846 - protein, 9 aa, Entamoeba histolytica
KKTHSNFSD

SEQ ID NO: 2632847 - protein, 11 aa, Entamoeba histolytica
KKTIDNEYETM

SEQ ID NO: 2632848 - protein, 8 aa, Entamoeba histolytica
KKTIERKG

SEQ ID NO: 2632849 - protein, 12 aa, Entamoeba histolytica
KKTIGAPDASVP

SEQ ID NO: 2632850 - protein, 9 aa, Entamoeba histolytica
KKTINQQKY

SEQ ID NO: 2632851 - protein, 20 aa, Entamoeba histolytica
KKTIPKPLHKTNSINTSTSL

SEQ ID NO: 2632852 - protein, 9 aa, Entamoeba histolytica
KKTKEERAV

SEQ ID NO: 2632853 - protein, 8 aa, Entamoeba histolytica
KKTKEGEC

SEQ ID NO: 2632854 - protein, 8 aa, Entamoeba histolytica
KKTKEQRL

SEQ ID NO: 2632855 - protein, 23 aa, Entamoeba histolytica
KKTKKDLKKLKDREPSLNEHDSL

SEQ ID NO: 2632856 - protein, 8 aa, Entamoeba histolytica
KKTKNNPV

SEQ ID NO: 2632857 - protein, 9 aa, Entamoeba histolytica
KKTKPKNLS

SEQ ID NO: 2632858 - protein, 12 aa, Entamoeba histolytica
KKTKQPSISLPR

SEQ ID NO: 2632859 - protein, 15 aa, Entamoeba histolytica
KKTKQVKKLKSEKAV

SEQ ID NO: 2632860 - protein, 7 aa, Entamoeba histolytica
KKTKRAV

SEQ ID NO: 2632861 - protein, 9 aa, Entamoeba histolytica
KKTKSTKVT

SEQ ID NO: 2632862 - protein, 14 aa, Entamoeba histolytica
KKTKTIDSTKNKQF

SEQ ID NO: 2632863 - protein, 7 aa, Entamoeba histolytica
KKTLRQV

SEQ ID NO: 2632864 - protein, 8 aa, Entamoeba histolytica
KKTLSKDD

SEQ ID NO: 2632865 - protein, 16 aa, Entamoeba histolytica
KKTLSNTHSNENEPTF

SEQ ID NO: 2632866 - protein, 8 aa, Entamoeba histolytica
KKTLTTPI

SEQ ID NO: 2632867 - protein, 5 aa, Entamoeba histolytica
KKTNL

SEQ ID NO: 2632868 - protein, 46 aa, Entamoeba histolytica
KKTNRKRLPPKTKPLPQPNQTHQPKSLPQPPSPTPLKQESQKIKGV

SEQ ID NO: 2632869 - protein, 20 aa, Entamoeba histolytica
KKTNSGTKEEIRNATNKMRD

SEQ ID NO: 2632870 - protein, 10 aa, Entamoeba histolytica
KKTNYPIPTP

SEQ ID NO: 2632871 - protein, 11 aa, Entamoeba histolytica
KKTPEEITVEE

SEQ ID NO: 2632872 - protein, 5 aa, Entamoeba histolytica
KKTQF

SEQ ID NO: 2632873 - protein, 8 aa, Entamoeba histolytica
KKTQNEKK

SEQ ID NO: 2632874 - protein, 6 aa, Entamoeba histolytica
KKTQTH

SEQ ID NO: 2632875 - protein, 9 aa, Entamoeba histolytica
KKTQVELEG

SEQ ID NO: 2632876 - protein, 16 aa, Entamoeba histolytica
KKTRAELPVSAQKTLD

SEQ ID NO: 2632877 - protein, 8 aa, Entamoeba histolytica
KKTREEVQ

SEQ ID NO: 2632878 - protein, 12 aa, Entamoeba histolytica
KKTRKEKKPRKD

SEQ ID NO: 2632879 - protein, 7 aa, Entamoeba histolytica
KKTRRIT

SEQ ID NO: 2632880 - protein, 8 aa, Entamoeba histolytica
KKTRTERV

SEQ ID NO: 2632881 - protein, 6 aa, Entamoeba histolytica
KKTSEY

SEQ ID NO: 2632882 - protein, 11 aa, Entamoeba histolytica
KKTSGERNKMK

SEQ ID NO: 2632883 - protein, 21 aa, Entamoeba histolytica
KKTSKRSERSSRSKMSKTPDL

SEQ ID NO: 2632884 - protein, 6 aa, Entamoeba histolytica
KKTSPI

SEQ ID NO: 2632885 - protein, 8 aa, Entamoeba histolytica
KKTSPYDT

SEQ ID NO: 2632886 - protein, 10 aa, Entamoeba histolytica
KKTSQDNEMI

SEQ ID NO: 2632887 - protein, 18 aa, Entamoeba histolytica
KKTSTQLRDKINNTRSSY

SEQ ID NO: 2632888 - protein, 7 aa, Entamoeba histolytica
KKTSYEE

SEQ ID NO: 2632889 - protein, 6 aa, Entamoeba histolytica
KKTTEH

SEQ ID NO: 2632890 - protein, 8 aa, Entamoeba histolytica
KKTTFEKN

SEQ ID NO: 2632891 - protein, 7 aa, Entamoeba histolytica
KKTTGDI

SEQ ID NO: 2632892 - protein, 7 aa, Entamoeba histolytica
KKTTGDV

SEQ ID NO: 2632893 - protein, 5 aa, Entamoeba histolytica
KKTTK

SEQ ID NO: 2632894 - protein, 6 aa, Entamoeba histolytica
KKTTLE

SEQ ID NO: 2632895 - protein, 8 aa, Entamoeba histolytica
KKTTLGRC

SEQ ID NO: 2632896 - protein, 12 aa, Entamoeba histolytica
KKTTQPQTISSN

SEQ ID NO: 2632897 - protein, 26 aa, Entamoeba histolytica
KKTTSINDKENITTTKKTNKKKVVKK

SEQ ID NO: 2632898 - protein, 5 aa, Entamoeba histolytica
KKTTT

SEQ ID NO: 2632899 - protein, 6 aa, Entamoeba histolytica
KKTTTV

SEQ ID NO: 2632900 - protein, 8 aa, Entamoeba histolytica
KKTYENTV

SEQ ID NO: 2632901 - protein, 6 aa, Entamoeba histolytica
KKTYQL

SEQ ID NO: 2632902 - protein, 7 aa, Entamoeba histolytica
KKVAKPF

SEQ ID NO: 2632903 - protein, 7 aa, Entamoeba histolytica
KKVARGE

SEQ ID NO: 2632904 - protein, 14 aa, Entamoeba histolytica
KKVCESKTNEGNRI

SEQ ID NO: 2632905 - protein, 9 aa, Entamoeba histolytica
KKVDGQNKG

SEQ ID NO: 2632906 - protein, 8 aa, Entamoeba histolytica
KKVEEKPA

SEQ ID NO: 2632907 - protein, 14 aa, Entamoeba histolytica
KKVEEKRIKRESGK

SEQ ID NO: 2632908 - protein, 15 aa, Entamoeba histolytica
KKVENEKIEKEKKEL

SEQ ID NO: 2632909 - protein, 21 aa, Entamoeba histolytica
KKVENKQTTKKTNEPKSLSET

SEQ ID NO: 2632910 - protein, 10 aa, Entamoeba histolytica
KKVENLPSNG

SEQ ID NO: 2632911 - protein, 11 aa, Entamoeba histolytica
KKVEQEAGRRK

SEQ ID NO: 2632912 - protein, 9 aa, Entamoeba histolytica
KKVEQEKRK

SEQ ID NO: 2632913 - protein, 8 aa, Entamoeba histolytica
KKVERSTH

SEQ ID NO: 2632914 - protein, 6 aa, Entamoeba histolytica
KKVETI

SEQ ID NO: 2632915 - protein, 11 aa, Entamoeba histolytica
KKVGKHQPGKS

SEQ ID NO: 2632916 - protein, 8 aa, Entamoeba histolytica
KKVGQGTF

SEQ ID NO: 2632917 - protein, 21 aa, Entamoeba histolytica
KKVGQSGKTDYKPRSRTSKAV

SEQ ID NO: 2632918 - protein, 9 aa, Entamoeba histolytica
KKVKEEEGC

SEQ ID NO: 2632919 - protein, 30 aa, Entamoeba histolytica
KKVKEENEKKDEIRKLKGERESLKPLEGRI

SEQ ID NO: 2632920 - protein, 17 aa, Entamoeba histolytica
KKVKEKKKAINKTVNDL

SEQ ID NO: 2632921 - protein, 7 aa, Entamoeba histolytica
KKVKGFN

SEQ ID NO: 2632922 - protein, 41 aa, Entamoeba histolytica; identical to SEQ ID NO: 2437661

SEQ ID NO: 2632923 - protein, 12 aa, Entamoeba histolytica
KKVKKSRKETME

SEQ ID NO: 2632924 - protein, 134 aa, Entamoeba histolytica
KKVKKVKKVKKATNEDSTQSNVKKVKKVKKVKKVKKVKKAVEQPKPEETPKEEIKEETKPVETTSTEKIVEEAAPKQQATESREERERKLKEQQEALQKKKEERERLRAERAAELERKKKELEELKAKRAAAAN

SEQ ID NO: 2632925 - protein, 20 aa, Entamoeba histolytica
KKVKRQRKGNEYKPMKNNSE

SEQ ID NO: 2632926 - protein, 14 aa, Entamoeba histolytica
KKVKTPEVAKKEYK

SEQ ID NO: 2632927 - protein, 6 aa, Entamoeba histolytica
KKVNVN

SEQ ID NO: 2632928 - protein, 4 aa, Entamoeba histolytica
KKVP

SEQ ID NO: 2632929 - protein, 6 aa, Entamoeba histolytica
KKVPDY

SEQ ID NO: 2632930 - protein, 6 aa, Entamoeba histolytica
KKVPEQ

SEQ ID NO: 2632931 - protein, 8 aa, Entamoeba histolytica
KKVRRQLQ

SEQ ID NO: 2632932 - protein, 26 aa, Entamoeba histolytica
KKVSELKKENKDSQTIQEKKTKEGIA

SEQ ID NO: 2632933 - protein, 5 aa, Entamoeba histolytica
KKVSI

SEQ ID NO: 2632934 - protein, 9 aa, Entamoeba histolytica
KKVSSKGYQ

SEQ ID NO: 2632935 - protein, 9 aa, Entamoeba histolytica
KKVSTQNVL

SEQ ID NO: 2632936 - protein, 6 aa, Entamoeba histolytica
KKVTAK

SEQ ID NO: 2632937 - protein, 9 aa, Entamoeba histolytica
KKVTNPGIQ

SEQ ID NO: 2632938 - protein, 16 aa, Entamoeba histolytica
KKVTPLLPSSYQNKEK

SEQ ID NO: 2632939 - protein, 7 aa, Entamoeba histolytica
KKVTPNE

SEQ ID NO: 2632940 - protein, 40 aa, Entamoeba histolytica
KKVTQGEKKAEKKRKAEQKKMEKEEKKRKREEEKKSKKDV

SEQ ID NO: 2632941 - protein, 9 aa, Entamoeba histolytica
KKVTTQEQR

SEQ ID NO: 2632942 - protein, 6 aa, Entamoeba histolytica
KKVYGD

SEQ ID NO: 2632943 - protein, 4 aa, Entamoeba histolytica
KKWD

SEQ ID NO: 2632944 - protein, 4 aa, Entamoeba histolytica
KKWE

SEQ ID NO: 2632945 - protein, 8 aa, Entamoeba histolytica
KKWEKNRK

SEQ ID NO: 2632946 - protein, 7 aa, Entamoeba histolytica
KKWESGE

SEQ ID NO: 2632947 - protein, 11 aa, Entamoeba histolytica
KKWKLNEKEIK

SEQ ID NO: 2632948 - protein, 9 aa, Entamoeba histolytica
KKWNEEEKI

SEQ ID NO: 2632949 - protein, 6 aa, Entamoeba histolytica
KKWRKG

SEQ ID NO: 2632950 - protein, 5 aa, Entamoeba histolytica
KKWSQ

SEQ ID NO: 2632951 - protein, 8 aa, Entamoeba histolytica
KKWSTDMT

SEQ ID NO: 2632952 - protein, 21 aa, Entamoeba histolytica
KKWTDSLEVESSQRKDSNIQT

SEQ ID NO: 2632953 - protein, 17 aa, Entamoeba histolytica
KKWTQTSNGGADRGSPY

SEQ ID NO: 2632954 - protein, 4 aa, Entamoeba histolytica
KKYA

SEQ ID NO: 2632955 - protein, 8 aa, Entamoeba histolytica
KKYATKQQ

SEQ ID NO: 2632956 - protein, 4 aa, Entamoeba histolytica
KKYD

SEQ ID NO: 2632957 - protein, 9 aa, Entamoeba histolytica
KKYDDVEKD

SEQ ID NO: 2632958 - protein, 5 aa, Entamoeba histolytica
KKYDG

SEQ ID NO: 2632959 - protein, 7 aa, Entamoeba histolytica
KKYDQKI

SEQ ID NO: 2632960 - protein, 17 aa, Entamoeba histolytica
KKYDSVCESTTAKEIEE

SEQ ID NO: 2632961 - protein, 10 aa, Entamoeba histolytica
KKYDSYSGKN

SEQ ID NO: 2632962 - protein, 10 aa, Entamoeba histolytica
KKYEEGYNQS

SEQ ID NO: 2632963 - protein, 6 aa, Entamoeba histolytica
KKYEEK

SEQ ID NO: 2632964 - protein, 7 aa, Entamoeba histolytica
KKYEHQG

SEQ ID NO: 2632965 - protein, 7 aa, Entamoeba histolytica
KKYEKYN

SEQ ID NO: 2632966 - protein, 15 aa, Entamoeba histolytica
KKYETNNDKESRRGI

SEQ ID NO: 2632967 - protein, 18 aa, Entamoeba histolytica
KKYETTGQSEYDKVDTNK

SEQ ID NO: 2632968 - protein, 7 aa, Entamoeba histolytica
KKYGDKS

SEQ ID NO: 2632969 - protein, 9 aa, Entamoeba histolytica
KKYGESYPS

SEQ ID NO: 2632970 - protein, 11 aa, Entamoeba histolytica
KKYGNKGKIPP

SEQ ID NO: 2632971 - protein, 8 aa, Entamoeba histolytica
KKYGPTKV

SEQ ID NO: 2632972 - protein, 7 aa, Entamoeba histolytica
KKYGQDD

SEQ ID NO: 2632973 - protein, 5 aa, Entamoeba histolytica
KKYHN

SEQ ID NO: 2632974 - protein, 4 aa, Entamoeba histolytica
KKYK

SEQ ID NO: 2632975 - protein, 7 aa, Entamoeba histolytica
KKYKDSL

SEQ ID NO: 2632976 - protein, 15 aa, Entamoeba histolytica
KKYKEEELKKSKEIT

SEQ ID NO: 2632977 - protein, 8 aa, Entamoeba histolytica
KKYKQNAE

SEQ ID NO: 2632978 - protein, 8 aa, Entamoeba histolytica
KKYKSKTK

SEQ ID NO: 2632979 - protein, 5 aa, Entamoeba histolytica
KKYND

SEQ ID NO: 2632980 - protein, 9 aa, Entamoeba histolytica
KKYNEEKTP

SEQ ID NO: 2632981 - protein, 9 aa, Entamoeba histolytica
KKYNEGEEK

SEQ ID NO: 2632982 - protein, 7 aa, Entamoeba histolytica
KKYNSDE

SEQ ID NO: 2632983 - protein, 8 aa, Entamoeba histolytica
KKYNSYYG

SEQ ID NO: 2632984 - protein, 16 aa, Entamoeba histolytica
KKYPIDNYESRVGGGI

SEQ ID NO: 2632985 - protein, 8 aa, Entamoeba histolytica
KKYPPGNV

SEQ ID NO: 2632986 - protein, 6 aa, Entamoeba histolytica
KKYPSI

SEQ ID NO: 2632987 - protein, 12 aa, Entamoeba histolytica
KKYQEDKQENKH

SEQ ID NO: 2632988 - protein, 29 aa, Entamoeba histolytica
KKYQSEIQEQQQKQKQMEEEINNKTQKWK

SEQ ID NO: 2632989 - protein, 7 aa, Entamoeba histolytica
KKYQTEI

SEQ ID NO: 2632990 - protein, 7 aa, Entamoeba histolytica
KKYQTTH

SEQ ID NO: 2632991 - protein, 8 aa, Entamoeba histolytica
KKYRDNKT

SEQ ID NO: 2632992 - protein, 17 aa, Entamoeba histolytica
KKYRTMTTVGNKPSFNE

SEQ ID NO: 2632993 - protein, 7 aa, Entamoeba histolytica
KKYTTVR

SEQ ID NO: 2632994 - protein, 20 aa, Entamoeba histolytica
KLAEEIKKERLNQTSNHSEC

SEQ ID NO: 2632995 - protein, 26 aa, Entamoeba histolytica
KLAEEIKKREAAENALASATAKIGEL

SEQ ID NO: 2632996 - protein, 7 aa, Entamoeba histolytica
KLAEHNG

SEQ ID NO: 2632997 - protein, 4 aa, Entamoeba histolytica
KLAK

SEQ ID NO: 2632998 - protein, 12 aa, Entamoeba histolytica
KLAKEPNERLAK

SEQ ID NO: 2632999 - protein, 10 aa, Entamoeba histolytica
KLAKKAAKKM

SEQ ID NO: 2633000 - protein, 8 aa, Entamoeba histolytica
KLANPGLQ

SEQ ID NO: 2633001 - protein, 5 aa, Entamoeba histolytica
KLAPR

SEQ ID NO: 2633002 - protein, 13 aa, Entamoeba histolytica
KLATPTKPYAPNQ

SEQ ID NO: 2633003 - protein, 9 aa, Entamoeba histolytica
KLATTTRLS

SEQ ID NO: 2633004 - protein, 14 aa, Entamoeba histolytica
KLDDANKAGTKEGN

SEQ ID NO: 2633005 - protein, 8 aa, Entamoeba histolytica
KLDDGLNE

SEQ ID NO: 2633006 - protein, 42 aa, Entamoeba histolytica
KLDDNEPKNISDELDKEQVKSINTDPEQVTISNSQDTDNDFK

SEQ ID NO: 2633007 - protein, 4 aa, Entamoeba histolytica
KLDE

SEQ ID NO: 2633008 - protein, 11 aa, Entamoeba histolytica
KLDEEEGGSEM

SEQ ID NO: 2633009 - protein, 8 aa, Entamoeba histolytica
KLDEFATG

SEQ ID NO: 2633010 - protein, 16 aa, Entamoeba histolytica
KLDESTDSNDTSSQHN

SEQ ID NO: 2633011 - protein, 10 aa, Entamoeba histolytica
KLDESTKQKY

SEQ ID NO: 2633012 - protein, 15 aa, Entamoeba histolytica
KLDETEGGHQHEKIE

SEQ ID NO: 2633013 - protein, 10 aa, Entamoeba histolytica
KLDGAKDEMG

SEQ ID NO: 2633014 - protein, 5 aa, Entamoeba histolytica
KLDGC

SEQ ID NO: 2633015 - protein, 6 aa, Entamoeba histolytica
KLDHST

SEQ ID NO: 2633016 - protein, 7 aa, Entamoeba histolytica
KLDKGSI

SEQ ID NO: 2633017 - protein, 6 aa, Entamoeba histolytica
KLDKRY

SEQ ID NO: 2633018 - protein, 6 aa, Entamoeba histolytica
KLDKSR

SEQ ID NO: 2633019 - protein, 8 aa, Entamoeba histolytica
KLDPHKKE

SEQ ID NO: 2633020 - protein, 5 aa, Entamoeba histolytica
KLDSF

SEQ ID NO: 2633021 - protein, 10 aa, Entamoeba histolytica
KLDSKGGNVR

SEQ ID NO: 2633022 - protein, 5 aa, Entamoeba histolytica
KLEAD

SEQ ID NO: 2633023 - protein, 8 aa, Entamoeba histolytica
KLEADYRA

SEQ ID NO: 2633024 - protein, 5 aa, Entamoeba histolytica
KLEAE

SEQ ID NO: 2633025 - protein, 13 aa, Entamoeba histolytica
KLEDDVGKEIKER

SEQ ID NO: 2633026 - protein, 21 aa, Entamoeba histolytica
KLEDNNEEILEEEEDELEEEE

SEQ ID NO: 2633027 - protein, 23 aa, Entamoeba histolytica
KLEEEKKDEWKGNNEGEERENEQ

SEQ ID NO: 2633028 - protein, 33 aa, Entamoeba histolytica
KLEEERKAKEEEERKAKELEEERKAKELEEEEK

SEQ ID NO: 2633029 - protein, 42 aa, Entamoeba histolytica
KLEEERKKREQERIKREQERIKREQERIKREQERKKKEEELE

SEQ ID NO: 2633030 - protein, 11 aa, Entamoeba histolytica
KLEEESKKEEV

SEQ ID NO: 2633031 - protein, 11 aa, Entamoeba histolytica
KLEEKDKTNTF

SEQ ID NO: 2633032 - protein, 5 aa, Entamoeba histolytica
KLEEL

SEQ ID NO: 2633033 - protein, 12 aa, Entamoeba histolytica
KLEEMPKPKESM

SEQ ID NO: 2633034 - protein, 6 aa, Entamoeba histolytica
KLEENT

SEQ ID NO: 2633035 - protein, 6 aa, Entamoeba histolytica
KLEESN

SEQ ID NO: 2633036 - protein, 20 aa, Entamoeba histolytica
KLEESNNTPDQPNDKTPNNE

SEQ ID NO: 2633037 - protein, 5 aa, Entamoeba histolytica
KLEEY

SEQ ID NO: 2633038 - protein, 7 aa, Entamoeba histolytica
KLEGEKK

SEQ ID NO: 2633039 - protein, 29 aa, Entamoeba histolytica
KLEGNSKQLSGKANVNIKESKKTKSKCFL

SEQ ID NO: 2633040 - protein, 6 aa, Entamoeba histolytica
KLEGRK

SEQ ID NO: 2633041 - protein, 6 aa, Entamoeba histolytica
KLEGRN

SEQ ID NO: 2633042 - protein, 8 aa, Entamoeba histolytica
KLEGTKDS

SEQ ID NO: 2633043 - protein, 5 aa, Entamoeba histolytica
KLEIG

SEQ ID NO: 2633044 - protein, 9 aa, Entamoeba histolytica
KLEKAKSQI

SEQ ID NO: 2633045 - protein, 31 aa, Entamoeba histolytica
KLEKENISKEEENNSLKKQIEEEQSVQQQTL

SEQ ID NO: 2633046 - protein, 12 aa, Entamoeba histolytica
KLENDRKHLTTE

SEQ ID NO: 2633047 - protein, 32 aa, Entamoeba histolytica; identical to SEQ ID NO: 2437786

SEQ ID NO: 2633048 - protein, 5 aa, Entamoeba histolytica
KLENR

SEQ ID NO: 2633049 - protein, 9 aa, Entamoeba histolytica
KLENTTASV

SEQ ID NO: 2633050 - protein, 8 aa, Entamoeba histolytica
KLENVQDE

SEQ ID NO: 2633051 - protein, 7 aa, Entamoeba histolytica
KLEPPKP

SEQ ID NO: 2633052 - protein, 24 aa, Entamoeba histolytica
KLEQAEKDRQNAKKEPQLAQQDTP

SEQ ID NO: 2633053 - protein, 15 aa, Entamoeba histolytica
KLEQEIEKQINEITK

SEQ ID NO: 2633054 - protein, 5 aa, Entamoeba histolytica
KLEQL

SEQ ID NO: 2633055 - protein, 7 aa, Entamoeba histolytica
KLEQSDY

SEQ ID NO: 2633056 - protein, 29 aa, Entamoeba histolytica
KLEQSERKKRINDEVGKRFKAKKAQGDVM

SEQ ID NO: 2633057 - protein, 14 aa, Entamoeba histolytica
KLERNKKNITYQSN

SEQ ID NO: 2633058 - protein, 15 aa, Entamoeba histolytica
KLESDAAKGGVRGMA

SEQ ID NO: 2633059 - protein, 20 aa, Entamoeba histolytica
KLESEETKKTENKERRKSLS

SEQ ID NO: 2633060 - protein, 9 aa, Entamoeba histolytica
KLESEGKEV

SEQ ID NO: 2633061 - protein, 10 aa, Entamoeba histolytica
KLESQTKQEI

SEQ ID NO: 2633062 - protein, 6 aa, Entamoeba histolytica
KLETDY

SEQ ID NO: 2633063 - protein, 6 aa, Entamoeba histolytica
KLETEA

SEQ ID NO: 2633064 - protein, 8 aa, Entamoeba histolytica
KLETQSID

SEQ ID NO: 2633065 - protein, 6 aa, Entamoeba histolytica
KLEYPD

SEQ ID NO: 2633066 - protein, 4 aa, Entamoeba histolytica
KLFG

SEQ ID NO: 2633067 - protein, 5 aa, Entamoeba histolytica
KLGDA

SEQ ID NO: 2633068 - protein, 7 aa, Entamoeba histolytica
KLGDDEK

SEQ ID NO: 2633069 - protein, 20 aa, Entamoeba histolytica
KLGEALQQKEECKMNQQPVN

SEQ ID NO: 2633070 - protein, 8 aa, Entamoeba histolytica
KLGEGKNQ

SEQ ID NO: 2633071 - protein, 9 aa, Entamoeba histolytica
KLGEGSEGC

SEQ ID NO: 2633072 - protein, 10 aa, Entamoeba histolytica
KLGEPGYTQR

SEQ ID NO: 2633073 - protein, 95 aa, Entamoeba histolytica
KLGETEKSLAAQVAATKKASDERDTLSQNLENEKLTTKNLTKTKADLEKKISGLKQDYEDLEDDKNKIEGDLRNAQRKIKELDDEITKGADVSQY

SEQ ID NO: 2633074 - protein, 18 aa, Entamoeba histolytica
KLGGQLKEKTEPTNISDE

SEQ ID NO: 2633075 - protein, 4 aa, Entamoeba histolytica
KLGK

SEQ ID NO: 2633076 - protein, 19 aa, Entamoeba histolytica
KLGPRHVQTTGGGTTSAGL

SEQ ID NO: 2633077 - protein, 6 aa, Entamoeba histolytica
KLGQKT

SEQ ID NO: 2633078 - protein, 4 aa, Entamoeba histolytica
KLGR

SEQ ID NO: 2633079 - protein, 18 aa, Entamoeba histolytica
KLGRERINTQMNKRANTI

SEQ ID NO: 2633080 - protein, 5 aa, Entamoeba histolytica
KLGRF

SEQ ID NO: 2633081 - protein, 11 aa, Entamoeba histolytica
KLGRKTFNENT

SEQ ID NO: 2633082 - protein, 17 aa, Entamoeba histolytica
KLGRSRDKAKPQKNASE

SEQ ID NO: 2633083 - protein, 6 aa, Entamoeba histolytica
KLGSGN

SEQ ID NO: 2633084 - protein, 15 aa, Entamoeba histolytica
KLGSNCTGTSEKFES

SEQ ID NO: 2633085 - protein, 11 aa, Entamoeba histolytica
KLGSSQPLLPV

SEQ ID NO: 2633086 - protein, 11 aa, Entamoeba histolytica
KLGYEAKDNAS

SEQ ID NO: 2633087 - protein, 5 aa, Entamoeba histolytica
KLHEP

SEQ ID NO: 2633088 - protein, 29 aa, Entamoeba histolytica
KLIESTSSCNNRERKHVSKNKFKDVILKN

SEQ ID NO: 2633089 - protein, 4 aa, Entamoeba histolytica
KLIT

SEQ ID NO: 2633090 - protein, 8 aa, Entamoeba histolytica
KLKASQPN

SEQ ID NO: 2633091 - protein, 7 aa, Entamoeba histolytica
KLKDTNL

SEQ ID NO: 2633092 - protein, 4 aa, Entamoeba histolytica
KLKE

SEQ ID NO: 2633093 - protein, 10 aa, Entamoeba histolytica
KLKEDNGKPI

SEQ ID NO: 2633094 - protein, 19 aa, Entamoeba histolytica
KLKEDPIKKCGEKDIEQLL

SEQ ID NO: 2633095 - protein, 13 aa, Entamoeba histolytica
KLKEDSKTIQQTM

SEQ ID NO: 2633096 - protein, 6 aa, Entamoeba histolytica
KLKEEE

SEQ ID NO: 2633097 - protein, 9 aa, Entamoeba histolytica
KLKENQTKL

SEQ ID NO: 2633098 - protein, 5 aa, Entamoeba histolytica
KLKEQ

SEQ ID NO: 2633099 - protein, 8 aa, Entamoeba histolytica
KLKESYTQ

SEQ ID NO: 2633100 - protein, 9 aa, Entamoeba histolytica
KLKGNEKQF

SEQ ID NO: 2633101 - protein, 9 aa, Entamoeba histolytica
KLKGNEREV

SEQ ID NO: 2633102 - protein, 18 aa, Entamoeba histolytica
KLKKEGNARIKKYIKYIS

SEQ ID NO: 2633103 - protein, 18 aa, Entamoeba histolytica
KLKKEGNTKIKKYIKYLS

SEQ ID NO: 2633104 - protein, 40 aa, Entamoeba histolytica
KLKKELDEAKKEVENSKKVNEQLSSELNELKNKQEGVSKE

SEQ ID NO: 2633105 - protein, 14 aa, Entamoeba histolytica
KLKKNKSIPEYCLK

SEQ ID NO: 2633106 - protein, 9 aa, Entamoeba histolytica
KLKNELRES

SEQ ID NO: 2633107 - protein, 19 aa, Entamoeba histolytica
KLKNPMKTQVQSKNQETQV

SEQ ID NO: 2633108 - protein, 10 aa, Entamoeba histolytica
KLKPLKEEYE

SEQ ID NO: 2633109 - protein, 9 aa, Entamoeba histolytica
KLKPSHSQI

SEQ ID NO: 2633110 - protein, 15 aa, Entamoeba histolytica
KLKQNLDKKTKKVIQ

SEQ ID NO: 2633111 - protein, 9 aa, Entamoeba histolytica
KLKQPKNKL

SEQ ID NO: 2633112 - protein, 9 aa, Entamoeba histolytica
KLKSEGNNI

SEQ ID NO: 2633113 - protein, 12 aa, Entamoeba histolytica
KLKSENEELSNN

SEQ ID NO: 2633114 - protein, 28 aa, Entamoeba histolytica
KLKSENKLEIRRKNGIKTNEENDFKPRD

SEQ ID NO: 2633115 - protein, 9 aa, Entamoeba histolytica
KLKSNTTLN

SEQ ID NO: 2633116 - protein, 8 aa, Entamoeba histolytica
KLKTEIEK

SEQ ID NO: 2633117 - protein, 10 aa, Entamoeba histolytica
KLKTEPSDQT

SEQ ID NO: 2633118 - protein, 13 aa, Entamoeba histolytica
KLKTKQSDEPSVS

SEQ ID NO: 2633119 - protein, 15 aa, Entamoeba histolytica
KLKTLKRDKKAEDEY

SEQ ID NO: 2633120 - protein, 9 aa, Entamoeba histolytica
KLKTPEGSK

SEQ ID NO: 2633121 - protein, 11 aa, Entamoeba histolytica
KLKTTNDRIND

SEQ ID NO: 2633122 - protein, 14 aa, Entamoeba histolytica
KLLDQESNVRSREA

SEQ ID NO: 2633123 - protein, 14 aa, Entamoeba histolytica
KLLPEEESNVQSSI

SEQ ID NO: 2633124 - protein, 6 aa, Entamoeba histolytica
KLNASA

SEQ ID NO: 2633125 - protein, 17 aa, Entamoeba histolytica
KLNDSRNKILQTNNQQP

SEQ ID NO: 2633126 - protein, 9 aa, Entamoeba histolytica
KLNDSSVLE

SEQ ID NO: 2633127 - protein, 5 aa, Entamoeba histolytica
KLNED

SEQ ID NO: 2633128 - protein, 5 aa, Entamoeba histolytica
KLNEE

SEQ ID NO: 2633129 - protein, 6 aa, Entamoeba histolytica
KLNEHA

SEQ ID NO: 2633130 - protein, 36 aa, Entamoeba histolytica
KLNEKEKLEKKPKKEKPKDLENRKKDGIVSKKLHFK

SEQ ID NO: 2633131 - protein, 17 aa, Entamoeba histolytica
KLNGTNNCTKEEQQSSI

SEQ ID NO: 2633132 - protein, 6 aa, Entamoeba histolytica
KLNGTY

SEQ ID NO: 2633133 - protein, 21 aa, Entamoeba histolytica
KLNKEARKYCRKGDKENAKRQ

SEQ ID NO: 2633134 - protein, 41 aa, Entamoeba histolytica
KLNKEKEEMNEKYNKKEIENEDDKEKLKNEIQKREEIENNK

SEQ ID NO: 2633135 - protein, 11 aa, Entamoeba histolytica
KLNKGKESIRP

SEQ ID NO: 2633136 - protein, 7 aa, Entamoeba histolytica
KLNKKEM

SEQ ID NO: 2633137 - protein, 11 aa, Entamoeba histolytica
KLNKKGAEIKP

SEQ ID NO: 2633138 - protein, 10 aa, Entamoeba histolytica
KLNKTNFEER

SEQ ID NO: 2633139 - protein, 5 aa, Entamoeba histolytica
KLNNT

SEQ ID NO: 2633140 - protein, 4 aa, Entamoeba histolytica
KLNP

SEQ ID NO: 2633141 - protein, 11 aa, Entamoeba histolytica
KLNPKEIPSGT

SEQ ID NO: 2633142 - protein, 17 aa, Entamoeba histolytica
KLNPSSVDNDAEQATIQ

SEQ ID NO: 2633143 - protein, 6 aa, Entamoeba histolytica
KLNPYG

SEQ ID NO: 2633144 - protein, 6 aa, Entamoeba histolytica
KLNQGN

SEQ ID NO: 2633145 - protein, 12 aa, Entamoeba histolytica
KLNQKTINQSTI

SEQ ID NO: 2633146 - protein, 5 aa, Entamoeba histolytica
KLNSG

SEQ ID NO: 2633147 - protein, 13 aa, Entamoeba histolytica
KLNSKTQKVVLIP

SEQ ID NO: 2633148 - protein, 5 aa, Entamoeba histolytica
KLNSR

SEQ ID NO: 2633149 - protein, 5 aa, Entamoeba histolytica
KLNTN

SEQ ID NO: 2633150 - protein, 15 aa, Entamoeba histolytica
KLNTSVSAENIVDGN

SEQ ID NO: 2633151 - protein, 19 aa, Entamoeba histolytica
KLPADDVSDELNGTLEDDP

SEQ ID NO: 2633152 - protein, 5 aa, Entamoeba histolytica
KLPAG

SEQ ID NO: 2633153 - protein, 10 aa, Entamoeba histolytica
KLPAKTSSLK

SEQ ID NO: 2633154 - protein, 22 aa, Entamoeba histolytica
KLPANEIQNNTNEQKINQNGMK

SEQ ID NO: 2633155 - protein, 13 aa, Entamoeba histolytica
KLPDGNTTGEGNG

SEQ ID NO: 2633156 - protein, 5 aa, Entamoeba histolytica
KLPDT

SEQ ID NO: 2633157 - protein, 20 aa, Entamoeba histolytica
KLPEVEQKEKLEKKKAMDIS

SEQ ID NO: 2633158 - protein, 12 aa, Entamoeba histolytica
KLPGEDELNATE

SEQ ID NO: 2633159 - protein, 24 aa, Entamoeba histolytica
KLPGNSASYHPAPEYKNENNTNYD

SEQ ID NO: 2633160 - protein, 8 aa, Entamoeba histolytica
KLPHTNND

SEQ ID NO: 2633161 - protein, 4 aa, Entamoeba histolytica
KLPK

SEQ ID NO: 2633162 - protein, 13 aa, Entamoeba histolytica
KLPKKGKEQENEW

SEQ ID NO: 2633163 - protein, 13 aa, Entamoeba histolytica
KLPKNELNGVEDV

SEQ ID NO: 2633164 - protein, 6 aa, Entamoeba histolytica
KLPNEY

SEQ ID NO: 2633165 - protein, 11 aa, Entamoeba histolytica
KLPNGNNISES

SEQ ID NO: 2633166 - protein, 5 aa, Entamoeba histolytica
KLPPH

SEQ ID NO: 2633167 - protein, 5 aa, Entamoeba histolytica
KLPPK

SEQ ID NO: 2633168 - protein, 13 aa, Entamoeba histolytica
KLPPKRKSGFVKE

SEQ ID NO: 2633169 - protein, 5 aa, Entamoeba histolytica
KLPPS

SEQ ID NO: 2633170 - protein, 7 aa, Entamoeba histolytica
KLPPSQE

SEQ ID NO: 2633171 - protein, 6 aa, Entamoeba histolytica
KLPPYL

SEQ ID NO: 2633172 - protein, 8 aa, Entamoeba histolytica
KLPQQQPS

SEQ ID NO: 2633173 - protein, 7 aa, Entamoeba histolytica
KLPRMSN

SEQ ID NO: 2633174 - protein, 12 aa, Entamoeba histolytica
KLPRNEKGLIDP

SEQ ID NO: 2633175 - protein, 9 aa, Entamoeba histolytica
KLPSGGDME

SEQ ID NO: 2633176 - protein, 7 aa, Entamoeba histolytica
KLPSPDR

SEQ ID NO: 2633177 - protein, 14 aa, Entamoeba histolytica
KLPSSPNNQSYKQH

SEQ ID NO: 2633178 - protein, 5 aa, Entamoeba histolytica
KLPST

SEQ ID NO: 2633179 - protein, 6 aa, Entamoeba histolytica
KLPYSA

SEQ ID NO: 2633180 - protein, 12 aa, Entamoeba histolytica
KLQDEQKDALTK

SEQ ID NO: 2633181 - protein, 8 aa, Entamoeba histolytica
KLQDGVNP

SEQ ID NO: 2633182 - protein, 6 aa, Entamoeba histolytica
KLQDNN

SEQ ID NO: 2633183 - protein, 6 aa, Entamoeba histolytica
KLQDNR

SEQ ID NO: 2633184 - protein, 18 aa, Entamoeba histolytica
KLQENTRGALLADIQAKA

SEQ ID NO: 2633185 - protein, 7 aa, Entamoeba histolytica
KLQETAE

SEQ ID NO: 2633186 - protein, 11 aa, Entamoeba histolytica
KLQKDDNAQLK

SEQ ID NO: 2633187 - protein, 14 aa, Entamoeba histolytica
KLQKSCKERSKETE

SEQ ID NO: 2633188 - protein, 37 aa, Entamoeba histolytica
KLQNKINELKEKDKIQEDENNKLQSEITNYSKTITSL

SEQ ID NO: 2633189 - protein, 13 aa, Entamoeba histolytica
KLQNPPTAEDCKT

SEQ ID NO: 2633190 - protein, 15 aa, Entamoeba histolytica
KLQPEKKHRTSNPQL

SEQ ID NO: 2633191 - protein, 5 aa, Entamoeba histolytica
KLQPT

SEQ ID NO: 2633192 - protein, 15 aa, Entamoeba histolytica
KLQQTIEQLENSSNE

SEQ ID NO: 2633193 - protein, 11 aa, Entamoeba histolytica
KLQRDGTEKLK

SEQ ID NO: 2633194 - protein, 4 aa, Entamoeba histolytica
KLQS

SEQ ID NO: 2633195 - protein, 16 aa, Entamoeba histolytica
KLQSAISSRNIDETKS

SEQ ID NO: 2633196 - protein, 10 aa, Entamoeba histolytica
KLQSASVPNF

SEQ ID NO: 2633197 - protein, 19 aa, Entamoeba histolytica
KLQSDEEIDELKDSNIEYT

SEQ ID NO: 2633198 - protein, 16 aa, Entamoeba histolytica
KLQTEREKKIEEEEKI

SEQ ID NO: 2633199 - protein, 5 aa, Entamoeba histolytica
KLQTP

SEQ ID NO: 2633200 - protein, 4 aa, Entamoeba histolytica
KLRE

SEQ ID NO: 2633201 - protein, 12 aa, Entamoeba histolytica
KLREEGKIIPDG

SEQ ID NO: 2633202 - protein, 31 aa, Entamoeba histolytica
KLRENKVNRTPDDKSEKNETKPPKGPSQKSA

SEQ ID NO: 2633203 - protein, 5 aa, Entamoeba histolytica
KLRGD

SEQ ID NO: 2633204 - protein, 6 aa, Entamoeba histolytica
KLRGRA

SEQ ID NO: 2633205 - protein, 6 aa, Entamoeba histolytica
KLRHMS

SEQ ID NO: 2633206 - protein, 13 aa, Entamoeba histolytica
KLRKQRKGKGPKL

SEQ ID NO: 2633207 - protein, 7 aa, Entamoeba histolytica
KLRKSNE

SEQ ID NO: 2633208 - protein, 13 aa, Entamoeba histolytica
KLRNEKNLQAQQQ

SEQ ID NO: 2633209 - protein, 21 aa, Entamoeba histolytica
KLRNPEKLAEEARQRDEEQRL

SEQ ID NO: 2633210 - protein, 10 aa, Entamoeba histolytica
KLRRKTKEDY

SEQ ID NO: 2633211 - protein, 6 aa, Entamoeba histolytica
KLSDAQ

SEQ ID NO: 2633212 - protein, 7 aa, Entamoeba histolytica
KLSDDLD

SEQ ID NO: 2633213 - protein, 6 aa, Entamoeba histolytica
KLSDDN

SEQ ID NO: 2633214 - protein, 11 aa, Entamoeba histolytica
KLSDEELKEES

SEQ ID NO: 2633215 - protein, 14 aa, Entamoeba histolytica
KLSDEINNGLNEAT

SEQ ID NO: 2633216 - protein, 9 aa, Entamoeba histolytica
KLSDKTELT

SEQ ID NO: 2633217 - protein, 7 aa, Entamoeba histolytica
KLSDQPV

SEQ ID NO: 2633218 - protein, 5 aa, Entamoeba histolytica
KLSDY

SEQ ID NO: 2633219 - protein, 7 aa, Entamoeba histolytica
KLSEADK

SEQ ID NO: 2633220 - protein, 7 aa, Entamoeba histolytica
KLSEALE

SEQ ID NO: 2633221 - protein, 33 aa, Entamoeba histolytica; identical to SEQ ID NO: 2437976

SEQ ID NO: 2633222 - protein, 6 aa, Entamoeba histolytica
KLSEDD

SEQ ID NO: 2633223 - protein, 9 aa, Entamoeba histolytica
KLSEEDQKL

SEQ ID NO: 2633224 - protein, 19 aa, Entamoeba histolytica
KLSGGVKKTKIDDEEKEKL

SEQ ID NO: 2633225 - protein, 5 aa, Entamoeba histolytica
KLSGK

SEQ ID NO: 2633226 - protein, 25 aa, Entamoeba histolytica
KLSKKGGTVAQPTNVNEKTPSQPTI

SEQ ID NO: 2633227 - protein, 13 aa, Entamoeba histolytica
KLSKKKKKQSCII

SEQ ID NO: 2633228 - protein, 13 aa, Entamoeba histolytica
KLSKSEQDIKDCT

SEQ ID NO: 2633229 - protein, 41 aa, Entamoeba histolytica
KLSNDQKNVRGTSNSENQSLKRRYKEDQNEDKQHQKETTLK

SEQ ID NO: 2633230 - protein, 6 aa, Entamoeba histolytica
KLSNKT

SEQ ID NO: 2633231 - protein, 24 aa, Entamoeba histolytica
KLSNLKSKQVIDQKPIEQISQSDV

SEQ ID NO: 2633232 - protein, 5 aa, Entamoeba histolytica
KLSNS

SEQ ID NO: 2633233 - protein, 7 aa, Entamoeba histolytica
KLSNSSS

SEQ ID NO: 2633234 - protein, 10 aa, Entamoeba histolytica
KLSPGSNGLS

SEQ ID NO: 2633235 - protein, 8 aa, Entamoeba histolytica
KLSPKTWG

SEQ ID NO: 2633236 - protein, 6 aa, Entamoeba histolytica
KLSPYR

SEQ ID NO: 2633237 - protein, 18 aa, Entamoeba histolytica
KLSQEKDHKRNETTELTD

SEQ ID NO: 2633238 - protein, 9 aa, Entamoeba histolytica
KLSQKYGGY

SEQ ID NO: 2633239 - protein, 8 aa, Entamoeba histolytica
KLSRSIGE

SEQ ID NO: 2633240 - protein, 8 aa, Entamoeba histolytica
KLSSDQIT

SEQ ID NO: 2633241 - protein, 12 aa, Entamoeba histolytica
KLSSINGNSFDY

SEQ ID NO: 2633242 - protein, 7 aa, Entamoeba histolytica
KLSSPSF

SEQ ID NO: 2633243 - protein, 15 aa, Entamoeba histolytica
KLSSSLQRYQQEDAT

SEQ ID NO: 2633244 - protein, 8 aa, Entamoeba histolytica
KLSSTFGD

SEQ ID NO: 2633245 - protein, 11 aa, Entamoeba histolytica
KLSTGNSTLED

SEQ ID NO: 2633246 - protein, 38 aa, Entamoeba histolytica
KLSVPSQLTSLSSNTSISIETTGVSSRENIKEQQPSDI

SEQ ID NO: 2633247 - protein, 6 aa, Entamoeba histolytica
KLSVSE

SEQ ID NO: 2633248 - protein, 5 aa, Entamoeba histolytica
KLTAS

SEQ ID NO: 2633249 - protein, 10 aa, Entamoeba histolytica
KLTDKQKEEW

SEQ ID NO: 2633250 - protein, 6 aa, Entamoeba histolytica
KLTDPN

SEQ ID NO: 2633251 - protein, 9 aa, Entamoeba histolytica
KLTDSANKA

SEQ ID NO: 2633252 - protein, 7 aa, Entamoeba histolytica
KLTDSQQ

SEQ ID NO: 2633253 - protein, 6 aa, Entamoeba histolytica
KLTEEQ

SEQ ID NO: 2633254 - protein, 9 aa, Entamoeba histolytica
KLTEEQQKR

SEQ ID NO: 2633255 - protein, 12 aa, Entamoeba histolytica
KLTEQEKTKLAQ

SEQ ID NO: 2633256 - protein, 7 aa, Entamoeba histolytica
KLTEQEV

SEQ ID NO: 2633257 - protein, 5 aa, Entamoeba histolytica
KLTGE

SEQ ID NO: 2633258 - protein, 6 aa, Entamoeba histolytica
KLTGQV

SEQ ID NO: 2633259 - protein, 7 aa, Entamoeba histolytica
KLTGTEA

SEQ ID NO: 2633260 - protein, 24 aa, Entamoeba histolytica
KLTHDQNTSSLEEVSSIKKNGGVV

SEQ ID NO: 2633261 - protein, 7 aa, Entamoeba histolytica
KLTKEAQ

SEQ ID NO: 2633262 - protein, 10 aa, Entamoeba histolytica
KLTKESKQQF

SEQ ID NO: 2633263 - protein, 9 aa, Entamoeba histolytica
KLTKQSSKM

SEQ ID NO: 2633264 - protein, 15 aa, Entamoeba histolytica
KLTNAQRSGLNQIPN

SEQ ID NO: 2633265 - protein, 13 aa, Entamoeba histolytica
KLTNNEKERPNDI

SEQ ID NO: 2633266 - protein, 12 aa, Entamoeba histolytica
KLTPDQQKEIPN

SEQ ID NO: 2633267 - protein, 10 aa, Entamoeba histolytica
KLTPEKVNQQ

SEQ ID NO: 2633268 - protein, 5 aa, Entamoeba histolytica
KLTPI

SEQ ID NO: 2633269 - protein, 16 aa, Entamoeba histolytica
KLTPPQCQPTPPPSIT

SEQ ID NO: 2633270 - protein, 7 aa, Entamoeba histolytica
KLTPPYV

SEQ ID NO: 2633271 - protein, 7 aa, Entamoeba histolytica
KLTPTQE

SEQ ID NO: 2633272 - protein, 17 aa, Entamoeba histolytica
KLTQDPPPGITAGPISE

SEQ ID NO: 2633273 - protein, 6 aa, Entamoeba histolytica
KLTQEA

SEQ ID NO: 2633274 - protein, 5 aa, Entamoeba histolytica
KLTQK

SEQ ID NO: 2633275 - protein, 6 aa, Entamoeba histolytica
KLTQLP

SEQ ID NO: 2633276 - protein, 6 aa, Entamoeba histolytica
KLTQPE

SEQ ID NO: 2633277 - protein, 9 aa, Entamoeba histolytica
KLTQPTKAG

SEQ ID NO: 2633278 - protein, 17 aa, Entamoeba histolytica
KLTQQHKKRDEKLEAQS

SEQ ID NO: 2633279 - protein, 12 aa, Entamoeba histolytica
KLTSFPEKGISY

SEQ ID NO: 2633280 - protein, 5 aa, Entamoeba histolytica
KLTSK

SEQ ID NO: 2633281 - protein, 9 aa, Entamoeba histolytica
KLTSSAEEV

SEQ ID NO: 2633282 - protein, 6 aa, Entamoeba histolytica
KLVPDG

SEQ ID NO: 2633283 - protein, 6 aa, Entamoeba histolytica
KLYSKE

SEQ ID NO: 2633284 - protein, 11 aa, Entamoeba histolytica
KLYTPKKNQMK

SEQ ID NO: 2633285 - protein, 8 aa, Entamoeba histolytica
KMAKSTGN

SEQ ID NO: 2633286 - protein, 5 aa, Entamoeba histolytica
KMAPN

SEQ ID NO: 2633287 - protein, 4 aa, Entamoeba histolytica
KMAR

SEQ ID NO: 2633288 - protein, 12 aa, Entamoeba histolytica
KMATSSTNFGEE

SEQ ID NO: 2633289 - protein, 10 aa, Entamoeba histolytica
KMDDQDRTSI

SEQ ID NO: 2633290 - protein, 8 aa, Entamoeba histolytica
KMDETDRT

SEQ ID NO: 2633291 - protein, 7 aa, Entamoeba histolytica
KMDGERK

SEQ ID NO: 2633292 - protein, 8 aa, Entamoeba histolytica
KMDKGELR

SEQ ID NO: 2633293 - protein, 11 aa, Entamoeba histolytica
KMDKNYSNSVV

SEQ ID NO: 2633294 - protein, 13 aa, Entamoeba histolytica
KMEAEDNDDDELA

SEQ ID NO: 2633295 - protein, 13 aa, Entamoeba histolytica
KMEDCPTSYETPF

SEQ ID NO: 2633296 - protein, 9 aa, Entamoeba histolytica
KMEDGFGEL

SEQ ID NO: 2633297 - protein, 17 aa, Entamoeba histolytica
KMEDPATSAEQKATYDA

SEQ ID NO: 2633298 - protein, 8 aa, Entamoeba histolytica
KMEEEEED

SEQ ID NO: 2633299 - protein, 14 aa, Entamoeba histolytica
KMEEEGNNKNDDEI

SEQ ID NO: 2633300 - protein, 20 aa, Entamoeba histolytica
KMEEEKDKKQTSKVREEKEI

SEQ ID NO: 2633301 - protein, 9 aa, Entamoeba histolytica
KMEEEKKPI

SEQ ID NO: 2633302 - protein, 8 aa, Entamoeba histolytica
KMEEEPKE

SEQ ID NO: 2633303 - protein, 14 aa, Entamoeba histolytica
KMEEESNKEQERVE

SEQ ID NO: 2633304 - protein, 8 aa, Entamoeba histolytica
KMEEMKQG

SEQ ID NO: 2633305 - protein, 9 aa, Entamoeba histolytica
KMEETGDSL

SEQ ID NO: 2633306 - protein, 6 aa, Entamoeba histolytica
KMEGNE

SEQ ID NO: 2633307 - protein, 15 aa, Entamoeba histolytica
KMEKENEQNQANTNE

SEQ ID NO: 2633308 - protein, 54 aa, Entamoeba histolytica
KMEKKAEKEIVKEKKPKKKQRLNDENNDEEKEVKDDKKVSSLEENKISKQTKNY

SEQ ID NO: 2633309 - protein, 10 aa, Entamoeba histolytica
KMGKKGEQWE

SEQ ID NO: 2633310 - protein, 4 aa, Entamoeba histolytica
KMGM

SEQ ID NO: 2633311 - protein, 12 aa, Entamoeba histolytica
KMGNDIKEGKKT

SEQ ID NO: 2633312 - protein, 12 aa, Entamoeba histolytica
KMGSDIKEGKKT

SEQ ID NO: 2633313 - protein, 8 aa, Entamoeba histolytica
KMHEKNMN

SEQ ID NO: 2633314 - protein, 15 aa, Entamoeba histolytica
KMIQTTQQESQVQPP

SEQ ID NO: 2633315 - protein, 6 aa, Entamoeba histolytica
KMKDNE

SEQ ID NO: 2633316 - protein, 7 aa, Entamoeba histolytica
KMKESSQ

SEQ ID NO: 2633317 - protein, 26 aa, Entamoeba histolytica
KMKKPKKLMESKPKKRLSKKRKGGNK

SEQ ID NO: 2633318 - protein, 29 aa, Entamoeba histolytica
KMKPKSSEECNYYENKNSPSSPNSGNNGC

SEQ ID NO: 2633319 - protein, 4 aa, Entamoeba histolytica
KMKS

SEQ ID NO: 2633320 - protein, 10 aa, Entamoeba histolytica
KMMKNGKGKV

SEQ ID NO: 2633321 - protein, 11 aa, Entamoeba histolytica
KMNEKNNKGIT

SEQ ID NO: 2633322 - protein, 9 aa, Entamoeba histolytica
KMNEKQTTF

SEQ ID NO: 2633323 - protein, 9 aa, Entamoeba histolytica
KMNESESNA

SEQ ID NO: 2633324 - protein, 6 aa, Entamoeba histolytica
KMNETS

SEQ ID NO: 2633325 - protein, 9 aa, Entamoeba histolytica
KMNKERVDR

SEQ ID NO: 2633326 - protein, 23 aa, Entamoeba histolytica
KMNNDDKGYDNDNNGYGKQLSEP

SEQ ID NO: 2633327 - protein, 9 aa, Entamoeba histolytica
KMNNERKRY

SEQ ID NO: 2633328 - protein, 6 aa, Entamoeba histolytica
KMNNQH

SEQ ID NO: 2633329 - protein, 5 aa, Entamoeba histolytica
KMNPD

SEQ ID NO: 2633330 - protein, 4 aa, Entamoeba histolytica
KMNQ

SEQ ID NO: 2633331 - protein, 18 aa, Entamoeba histolytica
KMNQEEKKAKGDSVSKER

SEQ ID NO: 2633332 - protein, 9 aa, Entamoeba histolytica
KMNTSNPLD

SEQ ID NO: 2633333 - protein, 6 aa, Entamoeba histolytica
KMNTTE

SEQ ID NO: 2633334 - protein, 12 aa, Entamoeba histolytica
KMPDKQNTWINE

SEQ ID NO: 2633335 - protein, 6 aa, Entamoeba histolytica
KMPHDP

SEQ ID NO: 2633336 - protein, 5 aa, Entamoeba histolytica
KMPNN

SEQ ID NO: 2633337 - protein, 6 aa, Entamoeba histolytica
KMPNRF

SEQ ID NO: 2633338 - protein, 6 aa, Entamoeba histolytica
KMPNVP

SEQ ID NO: 2633339 - protein, 7 aa, Entamoeba histolytica
KMPTSVS

SEQ ID NO: 2633340 - protein, 24 aa, Entamoeba histolytica
KMQEEKEAIGNDVKNKEKTIKEKE

SEQ ID NO: 2633341 - protein, 6 aa, Entamoeba histolytica
KMQEEY

SEQ ID NO: 2633342 - protein, 13 aa, Entamoeba histolytica
KMRDYSKKRISEG

SEQ ID NO: 2633343 - protein, 13 aa, Entamoeba histolytica
KMREEEKQEMETL

SEQ ID NO: 2633344 - protein, 9 aa, Entamoeba histolytica
KMSGSENIG

SEQ ID NO: 2633345 - protein, 10 aa, Entamoeba histolytica
KMSQEKESRE

SEQ ID NO: 2633346 - protein, 10 aa, Entamoeba histolytica
KMSSDSQKQI

SEQ ID NO: 2633347 - protein, 5 aa, Entamoeba histolytica
KMSSE

SEQ ID NO: 2633348 - protein, 5 aa, Entamoeba histolytica
KMSSF

SEQ ID NO: 2633349 - protein, 7 aa, Entamoeba histolytica
KMTEDLA

SEQ ID NO: 2633350 - protein, 16 aa, Entamoeba histolytica
KMTEEEKTIFLGILKS

SEQ ID NO: 2633351 - protein, 13 aa, Entamoeba histolytica
KMTEENKKQIEEV

SEQ ID NO: 2633352 - protein, 11 aa, Entamoeba histolytica
KMTEKMKDKTK

SEQ ID NO: 2633353 - protein, 9 aa, Entamoeba histolytica
KMTTPEYRA

SEQ ID NO: 2633354 - protein, 21 aa, Entamoeba histolytica
KMTTPTDQTDKESSENQTYEE

SEQ ID NO: 2633355 - protein, 10 aa, Entamoeba histolytica
KMYRPSPSPH

SEQ ID NO: 2633356 - protein, 4 aa, Entamoeba histolytica
KNAD

SEQ ID NO: 2633357 - protein, 7 aa, Entamoeba histolytica
KNADAKA

SEQ ID NO: 2633358 - protein, 17 aa, Entamoeba histolytica
KNADIKSSQAVNRVPTK

SEQ ID NO: 2633359 - protein, 9 aa, Entamoeba histolytica
KNADPSKLD

SEQ ID NO: 2633360 - protein, 13 aa, Entamoeba histolytica
KNAEHKRRSRENQ

SEQ ID NO: 2633361 - protein, 7 aa, Entamoeba histolytica
KNAEING

SEQ ID NO: 2633362 - protein, 9 aa, Entamoeba histolytica
KNAGLEKDI

SEQ ID NO: 2633363 - protein, 13 aa, Entamoeba histolytica
KNAGVKKAGALYG

SEQ ID NO: 2633364 - protein, 6 aa, Entamoeba histolytica
KNAIGS

SEQ ID NO: 2633365 - protein, 19 aa, Entamoeba histolytica
KNAKEVSDSSYEKEKLEGR

SEQ ID NO: 2633366 - protein, 10 aa, Entamoeba histolytica
KNAKPVSSIP

SEQ ID NO: 2633367 - protein, 11 aa, Entamoeba histolytica
KNAKSISSDQL

SEQ ID NO: 2633368 - protein, 4 aa, Entamoeba histolytica
KNAL

SEQ ID NO: 2633369 - protein, 5 aa, Entamoeba histolytica
KNALP

SEQ ID NO: 2633370 - protein, 7 aa, Entamoeba histolytica
KNANTNK

SEQ ID NO: 2633371 - protein, 9 aa, Entamoeba histolytica
KNAQPSIQS

SEQ ID NO: 2633372 - protein, 8 aa, Entamoeba histolytica
KNASGTRP

SEQ ID NO: 2633373 - protein, 6 aa, Entamoeba histolytica
KNATID

SEQ ID NO: 2633374 - protein, 39 aa, Entamoeba histolytica; identical to SEQ ID NO: 2438129

SEQ ID NO: 2633375 - protein, 9 aa, Entamoeba histolytica
KNATTKEQK

SEQ ID NO: 2633376 - protein, 7 aa, Entamoeba histolytica
KNAYGFK

SEQ ID NO: 2633377 - protein, 5 aa, Entamoeba histolytica
KNCEK

SEQ ID NO: 2633378 - protein, 8 aa, Entamoeba histolytica
KNCKLSKE

SEQ ID NO: 2633379 - protein, 20 aa, Entamoeba histolytica
KNCNTNGNETIKRFGDSTQG

SEQ ID NO: 2633380 - protein, 7 aa, Entamoeba histolytica
KNCPKPI

SEQ ID NO: 2633381 - protein, 8 aa, Entamoeba histolytica
KNCREVTQ

SEQ ID NO: 2633382 - protein, 12 aa, Entamoeba histolytica
KNCSDAELKKAY

SEQ ID NO: 2633383 - protein, 15 aa, Entamoeba histolytica
KNDCEPANRAVSSDQ

SEQ ID NO: 2633384 - protein, 19 aa, Entamoeba histolytica
KNDDESDNTLTNEEKKQHD

SEQ ID NO: 2633385 - protein, 12 aa, Entamoeba histolytica
KNDDSDYPYPFL

SEQ ID NO: 2633386 - protein, 20 aa, Entamoeba histolytica
KNDEDKKKSIEEKKNLNQEI

SEQ ID NO: 2633387 - protein, 8 aa, Entamoeba histolytica
KNDEEGHE

SEQ ID NO: 2633388 - protein, 10 aa, Entamoeba histolytica
KNDESRTLPL

SEQ ID NO: 2633389 - protein, 8 aa, Entamoeba histolytica
KNDFDNTE

SEQ ID NO: 2633390 - protein, 7 aa, Entamoeba histolytica
KNDFEPK

SEQ ID NO: 2633391 - protein, 5 aa, Entamoeba histolytica
KNDFR

SEQ ID NO: 2633392 - protein, 11 aa, Entamoeba histolytica
KNDFSPTTQSQ

SEQ ID NO: 2633393 - protein, 6 aa, Entamoeba histolytica
KNDGDG

SEQ ID NO: 2633394 - protein, 7 aa, Entamoeba histolytica
KNDGKCT

SEQ ID NO: 2633395 - protein, 12 aa, Entamoeba histolytica
KNDGKVNLENYS

SEQ ID NO: 2633396 - protein, 7 aa, Entamoeba histolytica
KNDGLDG

SEQ ID NO: 2633397 - protein, 8 aa, Entamoeba histolytica
KNDGLKTE

SEQ ID NO: 2633398 - protein, 7 aa, Entamoeba histolytica
KNDGSEY

SEQ ID NO: 2633399 - protein, 4 aa, Entamoeba histolytica
KNDI

SEQ ID NO: 2633400 - protein, 9 aa, Entamoeba histolytica
KNDIDSYKK

SEQ ID NO: 2633401 - protein, 5 aa, Entamoeba histolytica
KNDIT

SEQ ID NO: 2633402 - protein, 7 aa, Entamoeba histolytica
KNDITKE

SEQ ID NO: 2633403 - protein, 31 aa, Entamoeba histolytica
KNDKKSKEDEKKKLEKERKKKRSEAKKAKEE

SEQ ID NO: 2633404 - protein, 15 aa, Entamoeba histolytica
KNDKVKTNKKYVTAY

SEQ ID NO: 2633405 - protein, 5 aa, Entamoeba histolytica
KNDLP

SEQ ID NO: 2633406 - protein, 8 aa, Entamoeba histolytica
KNDMKSYG

SEQ ID NO: 2633407 - protein, 9 aa, Entamoeba histolytica
KNDMKSYGY

SEQ ID NO: 2633408 - protein, 43 aa, Entamoeba histolytica
KNDMNESNEEIEESTEESGNQTKEDTCKEETTTTLDDTSDSEQ

SEQ ID NO: 2633409 - protein, 6 aa, Entamoeba histolytica
KNDMSS

SEQ ID NO: 2633410 - protein, 5 aa, Entamoeba histolytica
KNDNQ

SEQ ID NO: 2633411 - protein, 5 aa, Entamoeba histolytica
KNDPN

SEQ ID NO: 2633412 - protein, 5 aa, Entamoeba histolytica
KNDQE

SEQ ID NO: 2633413 - protein, 16 aa, Entamoeba histolytica
KNDQQYNGTKMTNSAW

SEQ ID NO: 2633414 - protein, 6 aa, Entamoeba histolytica
KNDRRS

SEQ ID NO: 2633415 - protein, 4 aa, Entamoeba histolytica
KNDS

SEQ ID NO: 2633416 - protein, 10 aa, Entamoeba histolytica
KNDSEETKRN

SEQ ID NO: 2633417 - protein, 9 aa, Entamoeba histolytica
KNDSEKKIP

SEQ ID NO: 2633418 - protein, 5 aa, Entamoeba histolytica
KNDSS

SEQ ID NO: 2633419 - protein, 8 aa, Entamoeba histolytica
KNDTEAKG

SEQ ID NO: 2633420 - protein, 9 aa, Entamoeba histolytica
KNDTNQKKI

SEQ ID NO: 2633421 - protein, 6 aa, Entamoeba histolytica
KNDTVT

SEQ ID NO: 2633422 - protein, 10 aa, Entamoeba histolytica
KNDVKTAMTN

SEQ ID NO: 2633423 - protein, 6 aa, Entamoeba histolytica
KNDVLG

SEQ ID NO: 2633424 - protein, 10 aa, Entamoeba histolytica
KNDWNEAPTG

SEQ ID NO: 2633425 - protein, 5 aa, Entamoeba histolytica
KNDYE

SEQ ID NO: 2633426 - protein, 6 aa, Entamoeba histolytica
KNEAEE

SEQ ID NO: 2633427 - protein, 12 aa, Entamoeba histolytica
KNEANAEDEQKP

SEQ ID NO: 2633428 - protein, 9 aa, Entamoeba histolytica
KNEASKFKP

SEQ ID NO: 2633429 - protein, 7 aa, Entamoeba histolytica
KNEDEYE

SEQ ID NO: 2633430 - protein, 7 aa, Entamoeba histolytica
KNEDKDA

SEQ ID NO: 2633431 - protein, 47 aa, Entamoeba histolytica
KNEEDDYKKIKEKGMSEEEYEAEKKEIKEIEEKKKNIIRQRTEGRMN

SEQ ID NO: 2633432 - protein, 14 aa, Entamoeba histolytica
KNEEDITKAKKEIK

SEQ ID NO: 2633433 - protein, 9 aa, Entamoeba histolytica
KNEEEEVED

SEQ ID NO: 2633434 - protein, 7 aa, Entamoeba histolytica
KNEEEFT

SEQ ID NO: 2633435 - protein, 16 aa, Entamoeba histolytica
KNEEEIEQKIKKEEEV

SEQ ID NO: 2633436 - protein, 11 aa, Entamoeba histolytica
KNEEEIKSYRT

SEQ ID NO: 2633437 - protein, 22 aa, Entamoeba histolytica
KNEEEQGTTNDNEDVIDDILQW

SEQ ID NO: 2633438 - protein, 7 aa, Entamoeba histolytica
KNEEEVR

SEQ ID NO: 2633439 - protein, 16 aa, Entamoeba histolytica
KNEEFESIRNKNKELR

SEQ ID NO: 2633440 - protein, 23 aa, Entamoeba histolytica
KNEEIKKEEEENAWEDEDDQNKV

SEQ ID NO: 2633441 - protein, 7 aa, Entamoeba histolytica
KNEEKAE

SEQ ID NO: 2633442 - protein, 9 aa, Entamoeba histolytica
KNEEKKQKL

SEQ ID NO: 2633443 - protein, 19 aa, Entamoeba histolytica
KNEEKRQKLISSSDSKKKC

SEQ ID NO: 2633444 - protein, 17 aa, Entamoeba histolytica
KNEELQNQLKQSEEEIK

SEQ ID NO: 2633445 - protein, 14 aa, Entamoeba histolytica
KNEELVDGGPQDKY

SEQ ID NO: 2633446 - protein, 38 aa, Entamoeba histolytica
KNEEQERKRKEVEELKKRNEELEKENTKVKESIGSNDL

SEQ ID NO: 2633447 - protein, 9 aa, Entamoeba histolytica
KNEEQPLGI

SEQ ID NO: 2633448 - protein, 5 aa, Entamoeba histolytica
KNEET

SEQ ID NO: 2633449 - protein, 22 aa, Entamoeba histolytica
KNEETSQQPDQPTQNETFTRTS

SEQ ID NO: 2633450 - protein, 6 aa, Entamoeba histolytica
KNEEVK

SEQ ID NO: 2633451 - protein, 6 aa, Entamoeba histolytica
KNEFTN

SEQ ID NO: 2633452 - protein, 7 aa, Entamoeba histolytica
KNEGATE

SEQ ID NO: 2633453 - protein, 10 aa, Entamoeba histolytica
KNEGDDSDFE

SEQ ID NO: 2633454 - protein, 8 aa, Entamoeba histolytica
KNEGNTEL

SEQ ID NO: 2633455 - protein, 6 aa, Entamoeba histolytica
KNEIER

SEQ ID NO: 2633456 - protein, 8 aa, Entamoeba histolytica
KNEIKQED

SEQ ID NO: 2633457 - protein, 11 aa, Entamoeba histolytica
KNEIKREQGTR

SEQ ID NO: 2633458 - protein, 5 aa, Entamoeba histolytica
KNEIQ

SEQ ID NO: 2633459 - protein, 6 aa, Entamoeba histolytica
KNEIQS

SEQ ID NO: 2633460 - protein, 13 aa, Entamoeba histolytica
KNEIQTMTSAASA

SEQ ID NO: 2633461 - protein, 6 aa, Entamoeba histolytica
KNEKDK

SEQ ID NO: 2633462 - protein, 11 aa, Entamoeba histolytica
KNEKDQNQHSE

SEQ ID NO: 2633463 - protein, 5 aa, Entamoeba histolytica
KNEKE

SEQ ID NO: 2633464 - protein, 7 aa, Entamoeba histolytica
KNEKFSS

SEQ ID NO: 2633465 - protein, 7 aa, Entamoeba histolytica
KNEKGEN

SEQ ID NO: 2633466 - protein, 7 aa, Entamoeba histolytica
KNEKISG

SEQ ID NO: 2633467 - protein, 7 aa, Entamoeba histolytica
KNEKISK

SEQ ID NO: 2633468 - protein, 7 aa, Entamoeba histolytica
KNEKMRH

SEQ ID NO: 2633469 - protein, 5 aa, Entamoeba histolytica
KNEKP

SEQ ID NO: 2633470 - protein, 6 aa, Entamoeba histolytica
KNEKTY

SEQ ID NO: 2633471 - protein, 8 aa, Entamoeba histolytica
KNEKYSDE

SEQ ID NO: 2633472 - protein, 6 aa, Entamoeba histolytica
KNELEK

SEQ ID NO: 2633473 - protein, 5 aa, Entamoeba histolytica
KNELG

SEQ ID NO: 2633474 - protein, 6 aa, Entamoeba histolytica
KNELGD

SEQ ID NO: 2633475 - protein, 18 aa, Entamoeba histolytica
KNELHEDSDSEKKEKKDE

SEQ ID NO: 2633476 - protein, 13 aa, Entamoeba histolytica
KNEMNSLKKKNAF

SEQ ID NO: 2633477 - protein, 8 aa, Entamoeba histolytica
KNENEALK

SEQ ID NO: 2633478 - protein, 8 aa, Entamoeba histolytica
KNENEEVP

SEQ ID NO: 2633479 - protein, 7 aa, Entamoeba histolytica
KNENEIG

SEQ ID NO: 2633480 - protein, 16 aa, Entamoeba histolytica
KNENESLEEETPTSSI

SEQ ID NO: 2633481 - protein, 8 aa, Entamoeba histolytica
KNENFKRE

SEQ ID NO: 2633482 - protein, 7 aa, Entamoeba histolytica
KNENGIK

SEQ ID NO: 2633483 - protein, 10 aa, Entamoeba histolytica
KNENKEPIRS

SEQ ID NO: 2633484 - protein, 10 aa, Entamoeba histolytica
KNENMKNEDW

SEQ ID NO: 2633485 - protein, 5 aa, Entamoeba histolytica
KNENP

SEQ ID NO: 2633486 - protein, 8 aa, Entamoeba histolytica
KNEPLNSF

SEQ ID NO: 2633487 - protein, 16 aa, Entamoeba histolytica
KNEPYNNSEYSMEPQR

SEQ ID NO: 2633488 - protein, 7 aa, Entamoeba histolytica
KNEQIRE

SEQ ID NO: 2633489 - protein, 14 aa, Entamoeba histolytica
KNEQLAANFLLDGF

SEQ ID NO: 2633490 - protein, 6 aa, Entamoeba histolytica
KNEQRY

SEQ ID NO: 2633491 - protein, 22 aa, Entamoeba histolytica
KNEQTGLPSNIPTGSSSKKIPT

SEQ ID NO: 2633492 - protein, 7 aa, Entamoeba histolytica
KNERPAF

SEQ ID NO: 2633493 - protein, 12 aa, Entamoeba histolytica
KNERTITHNTNN

SEQ ID NO: 2633494 - protein, 14 aa, Entamoeba histolytica
KNESETQEKSQSMN

SEQ ID NO: 2633495 - protein, 18 aa, Entamoeba histolytica
KNESIKEESKEEVGGKKM

SEQ ID NO: 2633496 - protein, 6 aa, Entamoeba histolytica
KNESIN

SEQ ID NO: 2633497 - protein, 5 aa, Entamoeba histolytica
KNESL

SEQ ID NO: 2633498 - protein, 8 aa, Entamoeba histolytica
KNESLGKK

SEQ ID NO: 2633499 - protein, 10 aa, Entamoeba histolytica
KNESSKRMKD

SEQ ID NO: 2633500 - protein, 6 aa, Entamoeba histolytica
KNESVT

SEQ ID NO: 2633501 - protein, 4 aa, Entamoeba histolytica
KNET

SEQ ID NO: 2633502 - protein, 5 aa, Entamoeba histolytica
KNETM

SEQ ID NO: 2633503 - protein, 9 aa, Entamoeba histolytica
KNETNEAAK

SEQ ID NO: 2633504 - protein, 7 aa, Entamoeba histolytica
KNETNER

SEQ ID NO: 2633505 - protein, 7 aa, Entamoeba histolytica
KNETSIG

SEQ ID NO: 2633506 - protein, 6 aa, Entamoeba histolytica
KNETSR

SEQ ID NO: 2633507 - protein, 5 aa, Entamoeba histolytica
KNEVD

SEQ ID NO: 2633508 - protein, 12 aa, Entamoeba histolytica
KNEVLKKENEKL

SEQ ID NO: 2633509 - protein, 7 aa, Entamoeba histolytica
KNEVQPN

SEQ ID NO: 2633510 - protein, 7 aa, Entamoeba histolytica
KNEVSEE

SEQ ID NO: 2633511 - protein, 12 aa, Entamoeba histolytica
KNEYKNDSPQPV

SEQ ID NO: 2633512 - protein, 27 aa, Entamoeba histolytica
KNFAAKKGVDGQMKQGVGESKPKGYGI

SEQ ID NO: 2633513 - protein, 26 aa, Entamoeba histolytica
KNFSGKRLSPRESSKKEVKPKSPFKK

SEQ ID NO: 2633514 - protein, 16 aa, Entamoeba histolytica
KNFSKGKKTKLDPRFK

SEQ ID NO: 2633515 - protein, 6 aa, Entamoeba histolytica
KNFYEQ

SEQ ID NO: 2633516 - protein, 5 aa, Entamoeba histolytica
KNGAC

SEQ ID NO: 2633517 - protein, 9 aa, Entamoeba histolytica
KNGASNKVS

SEQ ID NO: 2633518 - protein, 6 aa, Entamoeba histolytica
KNGDEC

SEQ ID NO: 2633519 - protein, 7 aa, Entamoeba histolytica
KNGDPVA

SEQ ID NO: 2633520 - protein, 20 aa, Entamoeba histolytica
KNGEIKRLKTGQSFEENEED

SEQ ID NO: 2633521 - protein, 9 aa, Entamoeba histolytica
KNGEKEELD

SEQ ID NO: 2633522 - protein, 6 aa, Entamoeba histolytica
KNGEKF

SEQ ID NO: 2633523 - protein, 10 aa, Entamoeba histolytica
KNGEMNVNGE

SEQ ID NO: 2633524 - protein, 5 aa, Entamoeba histolytica
KNGEP

SEQ ID NO: 2633525 - protein, 6 aa, Entamoeba histolytica
KNGETH

SEQ ID NO: 2633526 - protein, 6 aa, Entamoeba histolytica
KNGFDR

SEQ ID NO: 2633527 - protein, 4 aa, Entamoeba histolytica
KNGG

SEQ ID NO: 2633528 - protein, 6 aa, Entamoeba histolytica
KNGGGL

SEQ ID NO: 2633529 - protein, 10 aa, Entamoeba histolytica
KNGGGSGNYS

SEQ ID NO: 2633530 - protein, 7 aa, Entamoeba histolytica
KNGGTVN

SEQ ID NO: 2633531 - protein, 5 aa, Entamoeba histolytica
KNGHA

SEQ ID NO: 2633532 - protein, 11 aa, Entamoeba histolytica
KNGIPTMPESD

SEQ ID NO: 2633533 - protein, 7 aa, Entamoeba histolytica
KNGIPTN

SEQ ID NO: 2633534 - protein, 10 aa, Entamoeba histolytica
KNGKGKRRLI

SEQ ID NO: 2633535 - protein, 9 aa, Entamoeba histolytica
KNGKISPEQ

SEQ ID NO: 2633536 - protein, 12 aa, Entamoeba histolytica
KNGKKEIQQRTR

SEQ ID NO: 2633537 - protein, 7 aa, Entamoeba histolytica
KNGKSWK

SEQ ID NO: 2633538 - protein, 8 aa, Entamoeba histolytica
KNGKTKEI

SEQ ID NO: 2633539 - protein, 6 aa, Entamoeba histolytica
KNGLKP

SEQ ID NO: 2633540 - protein, 9 aa, Entamoeba histolytica
KNGLTSDQL

SEQ ID NO: 2633541 - protein, 4 aa, Entamoeba histolytica
KNGN

SEQ ID NO: 2633542 - protein, 5 aa, Entamoeba histolytica
KNGNL

SEQ ID NO: 2633543 - protein, 5 aa, Entamoeba histolytica
KNGNN

SEQ ID NO: 2633544 - protein, 9 aa, Entamoeba histolytica
KNGNRMTKS

SEQ ID NO: 2633545 - protein, 6 aa, Entamoeba histolytica
KNGNSI

SEQ ID NO: 2633546 - protein, 5 aa, Entamoeba histolytica
KNGNV

SEQ ID NO: 2633547 - protein, 12 aa, Entamoeba histolytica
KNGQTYRLNGSE

SEQ ID NO: 2633548 - protein, 10 aa, Entamoeba histolytica
KNGRNAGRGY

SEQ ID NO: 2633549 - protein, 4 aa, Entamoeba histolytica
KNGS

SEQ ID NO: 2633550 - protein, 8 aa, Entamoeba histolytica
KNGSEEAV

SEQ ID NO: 2633551 - protein, 7 aa, Entamoeba histolytica
KNGSQQL

SEQ ID NO: 2633552 - protein, 11 aa, Entamoeba histolytica
KNGSSAKFKEI

SEQ ID NO: 2633553 - protein, 7 aa, Entamoeba histolytica
KNGSTLD

SEQ ID NO: 2633554 - protein, 5 aa, Entamoeba histolytica
KNGSV

SEQ ID NO: 2633555 - protein, 8 aa, Entamoeba histolytica
KNGTEYGK

SEQ ID NO: 2633556 - protein, 4 aa, Entamoeba histolytica
KNGV

SEQ ID NO: 2633557 - protein, 5 aa, Entamoeba histolytica
KNGVG

SEQ ID NO: 2633558 - protein, 6 aa, Entamoeba histolytica
KNGVYE

SEQ ID NO: 2633559 - protein, 6 aa, Entamoeba histolytica
KNGYDV

SEQ ID NO: 2633560 - protein, 7 aa, Entamoeba histolytica
KNGYKIE

SEQ ID NO: 2633561 - protein, 8 aa, Entamoeba histolytica
KNHENDGS

SEQ ID NO: 2633562 - protein, 7 aa, Entamoeba histolytica
KNHKYEI

SEQ ID NO: 2633563 - protein, 4 aa, Entamoeba histolytica
KNHL

SEQ ID NO: 2633564 - protein, 10 aa, Entamoeba histolytica
KNHNGQCYDS

SEQ ID NO: 2633565 - protein, 10 aa, Entamoeba histolytica
KNHPAQNPRL

SEQ ID NO: 2633566 - protein, 12 aa, Entamoeba histolytica
KNHQQTTGEINT

SEQ ID NO: 2633567 - protein, 7 aa, Entamoeba histolytica
KNIAPNK

SEQ ID NO: 2633568 - protein, 6 aa, Entamoeba histolytica
KNIAST

SEQ ID NO: 2633569 - protein, 5 aa, Entamoeba histolytica
KNIDE

SEQ ID NO: 2633570 - protein, 6 aa, Entamoeba histolytica
KNIDEK

SEQ ID NO: 2633571 - protein, 5 aa, Entamoeba histolytica
KNIDN

SEQ ID NO: 2633572 - protein, 22 aa, Entamoeba histolytica
KNIGSSNIRKIEDNEVNNSHNG

SEQ ID NO: 2633573 - protein, 24 aa, Entamoeba histolytica
KNIKDKKAKKDKKDPNRPKRPPTP

SEQ ID NO: 2633574 - protein, 6 aa, Entamoeba histolytica
KNIKEI

SEQ ID NO: 2633575 - protein, 15 aa, Entamoeba histolytica
KNIKNEKEKIKETAH

SEQ ID NO: 2633576 - protein, 5 aa, Entamoeba histolytica
KNIKS

SEQ ID NO: 2633577 - protein, 6 aa, Entamoeba histolytica
KNINEN

SEQ ID NO: 2633578 - protein, 10 aa, Entamoeba histolytica
KNINEVGKDG

SEQ ID NO: 2633579 - protein, 11 aa, Entamoeba histolytica
KNINKEKGENK

SEQ ID NO: 2633580 - protein, 7 aa, Entamoeba histolytica
KNINSLQ

SEQ ID NO: 2633581 - protein, 6 aa, Entamoeba histolytica
KNIPIE

SEQ ID NO: 2633582 - protein, 19 aa, Entamoeba histolytica
KNIPSGVGTTSTQTLTEKE

SEQ ID NO: 2633583 - protein, 6 aa, Entamoeba histolytica
KNIQSE

SEQ ID NO: 2633584 - protein, 7 aa, Entamoeba histolytica
KNIRDDE

SEQ ID NO: 2633585 - protein, 7 aa, Entamoeba histolytica
KNISPKQ

SEQ ID NO: 2633586 - protein, 16 aa, Entamoeba histolytica
KNISQTLNENERTIEE

SEQ ID NO: 2633587 - protein, 5 aa, Entamoeba histolytica
KNITG

SEQ ID NO: 2633588 - protein, 6 aa, Entamoeba histolytica
KNIYGD

SEQ ID NO: 2633589 - protein, 4 aa, Entamoeba histolytica
KNKA

SEQ ID NO: 2633590 - protein, 7 aa, Entamoeba histolytica
KNKAITI

SEQ ID NO: 2633591 - protein, 4 aa, Entamoeba histolytica
KNKC

SEQ ID NO: 2633592 - protein, 8 aa, Entamoeba histolytica
KNKDDNTP

SEQ ID NO: 2633593 - protein, 7 aa, Entamoeba histolytica
KNKDELN

SEQ ID NO: 2633594 - protein, 8 aa, Entamoeba histolytica
KNKDGQDY

SEQ ID NO: 2633595 - protein, 5 aa, Entamoeba histolytica
KNKDM

SEQ ID NO: 2633596 - protein, 8 aa, Entamoeba histolytica
KNKDNTIS

SEQ ID NO: 2633597 - protein, 9 aa, Entamoeba histolytica
KNKDPKPGI

SEQ ID NO: 2633598 - protein, 10 aa, Entamoeba histolytica
KNKDPQETEL

SEQ ID NO: 2633599 - protein, 7 aa, Entamoeba histolytica
KNKDQRN

SEQ ID NO: 2633600 - protein, 6 aa, Entamoeba histolytica
KNKDQT

SEQ ID NO: 2633601 - protein, 8 aa, Entamoeba histolytica
KNKDSSVS

SEQ ID NO: 2633602 - protein, 5 aa, Entamoeba histolytica
KNKDV

SEQ ID NO: 2633603 - protein, 5 aa, Entamoeba histolytica
KNKDY

SEQ ID NO: 2633604 - protein, 7 aa, Entamoeba histolytica
KNKEADQ

SEQ ID NO: 2633605 - protein, 55 aa, Entamoeba histolytica
KNKEEQQEEENKDSANTKENKEEKTEKKEEKTEKKEEEKKKVNVEEKGDDEERNR

SEQ ID NO: 2633606 - protein, 8 aa, Entamoeba histolytica
KNKEISEE

SEQ ID NO: 2633607 - protein, 5 aa, Entamoeba histolytica
KNKEL

SEQ ID NO: 2633608 - protein, 8 aa, Entamoeba histolytica
KNKEQKYV

SEQ ID NO: 2633609 - protein, 8 aa, Entamoeba histolytica
KNKEREET

SEQ ID NO: 2633610 - protein, 20 aa, Entamoeba histolytica
KNKETEDKDAESSLEEGEMN

SEQ ID NO: 2633611 - protein, 7 aa, Entamoeba histolytica
KNKETLE

SEQ ID NO: 2633612 - protein, 5 aa, Entamoeba histolytica
KNKFE

SEQ ID NO: 2633613 - protein, 18 aa, Entamoeba histolytica
KNKFGGNTPLCPFDCDCC

SEQ ID NO: 2633614 - protein, 10 aa, Entamoeba histolytica
KNKGAESEGI

SEQ ID NO: 2633615 - protein, 16 aa, Entamoeba histolytica
KNKGELSKINTNSDEY

SEQ ID NO: 2633616 - protein, 8 aa, Entamoeba histolytica
KNKGIAAE

SEQ ID NO: 2633617 - protein, 10 aa, Entamoeba histolytica
KNKGSSCNGF

SEQ ID NO: 2633618 - protein, 10 aa, Entamoeba histolytica
KNKGSSKTNF

SEQ ID NO: 2633619 - protein, 8 aa, Entamoeba histolytica
KNKGVSMP

SEQ ID NO: 2633620 - protein, 6 aa, Entamoeba histolytica
KNKIES

SEQ ID NO: 2633621 - protein, 8 aa, Entamoeba histolytica
KNKINKVT

SEQ ID NO: 2633622 - protein, 15 aa, Entamoeba histolytica
KNKIQGKYEADSNNH

SEQ ID NO: 2633623 - protein, 5 aa, Entamoeba histolytica
KNKKA

SEQ ID NO: 2633624 - protein, 8 aa, Entamoeba histolytica
KNKKAKEI

SEQ ID NO: 2633625 - protein, 21 aa, Entamoeba histolytica
KNKKEDETNNRITAYSNGVNL

SEQ ID NO: 2633626 - protein, 11 aa, Entamoeba histolytica
KNKKFEKKQAK

SEQ ID NO: 2633627 - protein, 19 aa, Entamoeba histolytica
KNKKGERYGDASERLLARG

SEQ ID NO: 2633628 - protein, 20 aa, Entamoeba histolytica
KNKKGSKPARNGTGKSKVMK

SEQ ID NO: 2633629 - protein, 13 aa, Entamoeba histolytica
KNKKISDDKVTPI

SEQ ID NO: 2633630 - protein, 5 aa, Entamoeba histolytica
KNKKM

SEQ ID NO: 2633631 - protein, 10 aa, Entamoeba histolytica
KNKKPNQTRN

SEQ ID NO: 2633632 - protein, 16 aa, Entamoeba histolytica
KNKKRQSTTQKINTPL

SEQ ID NO: 2633633 - protein, 14 aa, Entamoeba histolytica
KNKKTGEIVNEQPE

SEQ ID NO: 2633634 - protein, 8 aa, Entamoeba histolytica
KNKLPPCI

SEQ ID NO: 2633635 - protein, 15 aa, Entamoeba histolytica
KNKLTEEKESIKQEL

SEQ ID NO: 2633636 - protein, 6 aa, Entamoeba histolytica
KNKMEN

SEQ ID NO: 2633637 - protein, 4 aa, Entamoeba histolytica
KNKN

SEQ ID NO: 2633638 - protein, 5 aa, Entamoeba histolytica
KNKNA

SEQ ID NO: 2633639 - protein, 7 aa, Entamoeba histolytica
KNKNEPI

SEQ ID NO: 2633640 - protein, 8 aa, Entamoeba histolytica
KNKNGVNV

SEQ ID NO: 2633641 - protein, 7 aa, Entamoeba histolytica
KNKNIAP

SEQ ID NO: 2633642 - protein, 41 aa, Entamoeba histolytica
KNKNISTRSSSSYKDTEHKQQEVKQSSSSINQNSVKEEPKK

SEQ ID NO: 2633643 - protein, 18 aa, Entamoeba histolytica
KNKNRKENEMNARQASEN

SEQ ID NO: 2633644 - protein, 5 aa, Entamoeba histolytica
KNKNV

SEQ ID NO: 2633645 - protein, 8 aa, Entamoeba histolytica
KNKNVKGY

SEQ ID NO: 2633646 - protein, 4 aa, Entamoeba histolytica
KNKP

SEQ ID NO: 2633647 - protein, 27 aa, Entamoeba histolytica
KNKPFKRRTGSKRQQKIKGKKKTEAVS

SEQ ID NO: 2633648 - protein, 13 aa, Entamoeba histolytica
KNKPKGKDEKKSC

SEQ ID NO: 2633649 - protein, 8 aa, Entamoeba histolytica
KNKPNDGV

SEQ ID NO: 2633650 - protein, 10 aa, Entamoeba histolytica
KNKPSKYGSV

SEQ ID NO: 2633651 - protein, 4 aa, Entamoeba histolytica
KNKR

SEQ ID NO: 2633652 - protein, 6 aa, Entamoeba histolytica
KNKREY

SEQ ID NO: 2633653 - protein, 9 aa, Entamoeba histolytica
KNKRKEEQV

SEQ ID NO: 2633654 - protein, 7 aa, Entamoeba histolytica
KNKRNLD

SEQ ID NO: 2633655 - protein, 4 aa, Entamoeba histolytica
KNKS

SEQ ID NO: 2633656 - protein, 7 aa, Entamoeba histolytica
KNKSGVN

SEQ ID NO: 2633657 - protein, 33 aa, Entamoeba histolytica
KNKSKEKGKIGKEENQNYEEGRKIEENNQNEKM

SEQ ID NO: 2633658 - protein, 20 aa, Entamoeba histolytica
KNKSTTYKQAFEKNSALTKY

SEQ ID NO: 2633659 - protein, 4 aa, Entamoeba histolytica
KNKT

SEQ ID NO: 2633660 - protein, 5 aa, Entamoeba histolytica
KNKTI

SEQ ID NO: 2633661 - protein, 7 aa, Entamoeba histolytica
KNKTLQK

SEQ ID NO: 2633662 - protein, 11 aa, Entamoeba histolytica
KNKTSEGIQED

SEQ ID NO: 2633663 - protein, 9 aa, Entamoeba histolytica
KNKTSLTES

SEQ ID NO: 2633664 - protein, 5 aa, Entamoeba histolytica
KNKVD

SEQ ID NO: 2633665 - protein, 4 aa, Entamoeba histolytica
KNKY

SEQ ID NO: 2633666 - protein, 7 aa, Entamoeba histolytica
KNKYEKL

SEQ ID NO: 2633667 - protein, 9 aa, Entamoeba histolytica
KNLADSTKK

SEQ ID NO: 2633668 - protein, 10 aa, Entamoeba histolytica
KNLEAKEKTL

SEQ ID NO: 2633669 - protein, 9 aa, Entamoeba histolytica
KNLEEKDLK

SEQ ID NO: 2633670 - protein, 5 aa, Entamoeba histolytica
KNLGE

SEQ ID NO: 2633671 - protein, 6 aa, Entamoeba histolytica
KNLGES

SEQ ID NO: 2633672 - protein, 4 aa, Entamoeba histolytica
KNLK

SEQ ID NO: 2633673 - protein, 11 aa, Entamoeba histolytica
KNLKEGENYTI

SEQ ID NO: 2633674 - protein, 15 aa, Entamoeba histolytica
KNLKGHKKHSKGKTR

SEQ ID NO: 2633675 - protein, 5 aa, Entamoeba histolytica
KNLKN

SEQ ID NO: 2633676 - protein, 20 aa, Entamoeba histolytica
KNLKNDKSTLKENEITEGSK

SEQ ID NO: 2633677 - protein, 13 aa, Entamoeba histolytica
KNLNDENKNEQNI

SEQ ID NO: 2633678 - protein, 6 aa, Entamoeba histolytica
KNLNKI

SEQ ID NO: 2633679 - protein, 8 aa, Entamoeba histolytica
KNLNQQTE

SEQ ID NO: 2633680 - protein, 13 aa, Entamoeba histolytica
KNLPSGQEAENIK

SEQ ID NO: 2633681 - protein, 6 aa, Entamoeba histolytica
KNLPSV

SEQ ID NO: 2633682 - protein, 5 aa, Entamoeba histolytica
KNLQN

SEQ ID NO: 2633683 - protein, 5 aa, Entamoeba histolytica
KNLRE

SEQ ID NO: 2633684 - protein, 9 aa, Entamoeba histolytica
KNLRERSSD

SEQ ID NO: 2633685 - protein, 8 aa, Entamoeba histolytica
KNLSDKNV

SEQ ID NO: 2633686 - protein, 9 aa, Entamoeba histolytica
KNLSEEKRD

SEQ ID NO: 2633687 - protein, 7 aa, Entamoeba histolytica
KNLSGSF

SEQ ID NO: 2633688 - protein, 9 aa, Entamoeba histolytica
KNLSIKGTD

SEQ ID NO: 2633689 - protein, 28 aa, Entamoeba histolytica
KNLSNTAKSITTTEDKQSKEEKKEEDHI

SEQ ID NO: 2633690 - protein, 21 aa, Entamoeba histolytica
KNLSTKNTETKTNPTEEENEL

SEQ ID NO: 2633691 - protein, 6 aa, Entamoeba histolytica
KNLTEE

SEQ ID NO: 2633692 - protein, 7 aa, Entamoeba histolytica
KNLTGEK

SEQ ID NO: 2633693 - protein, 16 aa, Entamoeba histolytica
KNLTSLQPKYPMSQQP

SEQ ID NO: 2633694 - protein, 9 aa, Entamoeba histolytica
KNLTTSISY

SEQ ID NO: 2633695 - protein, 13 aa, Entamoeba histolytica
KNMGNWEEQYTQD

SEQ ID NO: 2633696 - protein, 5 aa, Entamoeba histolytica
KNMKI

SEQ ID NO: 2633697 - protein, 6 aa, Entamoeba histolytica
KNMPID

SEQ ID NO: 2633698 - protein, 5 aa, Entamoeba histolytica
KNMPM

SEQ ID NO: 2633699 - protein, 6 aa, Entamoeba histolytica
KNMPVE

SEQ ID NO: 2633700 - protein, 7 aa, Entamoeba histolytica
KNMSNPK

SEQ ID NO: 2633701 - protein, 11 aa, Entamoeba histolytica
KNNDALKELNN

SEQ ID NO: 2633702 - protein, 8 aa, Entamoeba histolytica
KNNDEDSI

SEQ ID NO: 2633703 - protein, 9 aa, Entamoeba histolytica
KNNDETLDK

SEQ ID NO: 2633704 - protein, 16 aa, Entamoeba histolytica
KNNEFTQRLNEKKEIS

SEQ ID NO: 2633705 - protein, 8 aa, Entamoeba histolytica
KNNEKAQD

SEQ ID NO: 2633706 - protein, 7 aa, Entamoeba histolytica
KNNETRC

SEQ ID NO: 2633707 - protein, 6 aa, Entamoeba histolytica
KNNETT

SEQ ID NO: 2633708 - protein, 7 aa, Entamoeba histolytica
KNNFTED

SEQ ID NO: 2633709 - protein, 5 aa, Entamoeba histolytica
KNNGG

SEQ ID NO: 2633710 - protein, 6 aa, Entamoeba histolytica
KNNGIG

SEQ ID NO: 2633711 - protein, 9 aa, Entamoeba histolytica
KNNGKVQGI

SEQ ID NO: 2633712 - protein, 8 aa, Entamoeba histolytica
KNNGSLSI

SEQ ID NO: 2633713 - protein, 6 aa, Entamoeba histolytica
KNNKAI

SEQ ID NO: 2633714 - protein, 6 aa, Entamoeba histolytica
KNNKIN

SEQ ID NO: 2633715 - protein, 9 aa, Entamoeba histolytica
KNNKITEKE

SEQ ID NO: 2633716 - protein, 5 aa, Entamoeba histolytica
KNNKL

SEQ ID NO: 2633717 - protein, 14 aa, Entamoeba histolytica
KNNKLAKKAKKTLK

SEQ ID NO: 2633718 - protein, 8 aa, Entamoeba histolytica
KNNKRESS

SEQ ID NO: 2633719 - protein, 7 aa, Entamoeba histolytica
KNNLKNK

SEQ ID NO: 2633720 - protein, 8 aa, Entamoeba histolytica
KNNLNPKQ

SEQ ID NO: 2633721 - protein, 7 aa, Entamoeba histolytica
KNNLPGI

SEQ ID NO: 2633722 - protein, 14 aa, Entamoeba histolytica
KNNMSDKEEPEIES

SEQ ID NO: 2633723 - protein, 7 aa, Entamoeba histolytica
KNNNKGW

SEQ ID NO: 2633724 - protein, 5 aa, Entamoeba histolytica
KNNNL

SEQ ID NO: 2633725 - protein, 6 aa, Entamoeba histolytica
KNNNNK

SEQ ID NO: 2633726 - protein, 12 aa, Entamoeba histolytica
KNNNNKKQEGSL

SEQ ID NO: 2633727 - protein, 8 aa, Entamoeba histolytica
KNNNSSEV

SEQ ID NO: 2633728 - protein, 10 aa, Entamoeba histolytica
KNNNSWGENI

SEQ ID NO: 2633729 - protein, 7 aa, Entamoeba histolytica
KNNPLDE

SEQ ID NO: 2633730 - protein, 8 aa, Entamoeba histolytica
KNNPRSIQ

SEQ ID NO: 2633731 - protein, 5 aa, Entamoeba histolytica
KNNPS

SEQ ID NO: 2633732 - protein, 8 aa, Entamoeba histolytica
KNNQLSKT

SEQ ID NO: 2633733 - protein, 7 aa, Entamoeba histolytica
KNNSAMD

SEQ ID NO: 2633734 - protein, 8 aa, Entamoeba histolytica
KNNSKSTF

SEQ ID NO: 2633735 - protein, 8 aa, Entamoeba histolytica
KNNSQKIN

SEQ ID NO: 2633736 - protein, 7 aa, Entamoeba histolytica
KNNTEDI

SEQ ID NO: 2633737 - protein, 7 aa, Entamoeba histolytica
KNNTLET

SEQ ID NO: 2633738 - protein, 7 aa, Entamoeba histolytica
KNNTNGV

SEQ ID NO: 2633739 - protein, 7 aa, Entamoeba histolytica
KNNVNDT

SEQ ID NO: 2633740 - protein, 7 aa, Entamoeba histolytica
KNNYSPC

SEQ ID NO: 2633741 - protein, 9 aa, Entamoeba histolytica
KNPDAPLPS

SEQ ID NO: 2633742 - protein, 8 aa, Entamoeba histolytica
KNPDCDQQ

SEQ ID NO: 2633743 - protein, 10 aa, Entamoeba histolytica
KNPDGKYYTS

SEQ ID NO: 2633744 - protein, 6 aa, Entamoeba histolytica
KNPEEC

SEQ ID NO: 2633745 - protein, 15 aa, Entamoeba histolytica
KNPENMKKPTQLDPK

SEQ ID NO: 2633746 - protein, 5 aa, Entamoeba histolytica
KNPGD

SEQ ID NO: 2633747 - protein, 11 aa, Entamoeba histolytica
KNPGSSASIQG

SEQ ID NO: 2633748 - protein, 4 aa, Entamoeba histolytica
KNPI

SEQ ID NO: 2633749 - protein, 6 aa, Entamoeba histolytica
KNPIPQ

SEQ ID NO: 2633750 - protein, 8 aa, Entamoeba histolytica
KNPISSTK

SEQ ID NO: 2633751 - protein, 12 aa, Entamoeba histolytica
KNPKDKQAQEDL

SEQ ID NO: 2633752 - protein, 10 aa, Entamoeba histolytica
KNPKIEPNSG

SEQ ID NO: 2633753 - protein, 6 aa, Entamoeba histolytica
KNPKVS

SEQ ID NO: 2633754 - protein, 16 aa, Entamoeba histolytica
KNPLKSTKKFIKNINP

SEQ ID NO: 2633755 - protein, 11 aa, Entamoeba histolytica
KNPLSSIGELP

SEQ ID NO: 2633756 - protein, 11 aa, Entamoeba histolytica
KNPLTQTPSTL

SEQ ID NO: 2633757 - protein, 14 aa, Entamoeba histolytica
KNPMKVSSSEIDEV

SEQ ID NO: 2633758 - protein, 6 aa, Entamoeba histolytica
KNPNAI

SEQ ID NO: 2633759 - protein, 6 aa, Entamoeba histolytica
KNPNAT

SEQ ID NO: 2633760 - protein, 7 aa, Entamoeba histolytica
KNPNDNN

SEQ ID NO: 2633761 - protein, 6 aa, Entamoeba histolytica
KNPNKE

SEQ ID NO: 2633762 - protein, 8 aa, Entamoeba histolytica
KNPNKRPN

SEQ ID NO: 2633763 - protein, 65 aa, Entamoeba histolytica
KNPPAPVKRGGAKGGAKGGANNRGSRGGNRGGSRGGFNNRGARGGNKGSFGGNRGGFGGNKGPRN

SEQ ID NO: 2633764 - protein, 6 aa, Entamoeba histolytica
KNPPQK

SEQ ID NO: 2633765 - protein, 7 aa, Entamoeba histolytica
KNPQCIS

SEQ ID NO: 2633766 - protein, 8 aa, Entamoeba histolytica
KNPQQSIE

SEQ ID NO: 2633767 - protein, 13 aa, Entamoeba histolytica
KNPQSFDKESKQV

SEQ ID NO: 2633768 - protein, 6 aa, Entamoeba histolytica
KNPQTL

SEQ ID NO: 2633769 - protein, 6 aa, Entamoeba histolytica
KNPQVE

SEQ ID NO: 2633770 - protein, 7 aa, Entamoeba histolytica
KNPRNSL

SEQ ID NO: 2633771 - protein, 8 aa, Entamoeba histolytica
KNPSKSLL

SEQ ID NO: 2633772 - protein, 23 aa, Entamoeba histolytica
KNPSVKVKNPSPPNSSGKKTKKY

SEQ ID NO: 2633773 - protein, 5 aa, Entamoeba histolytica
KNPSY

SEQ ID NO: 2633774 - protein, 6 aa, Entamoeba histolytica
KNPTDQ

SEQ ID NO: 2633775 - protein, 7 aa, Entamoeba histolytica
KNPTEQI

SEQ ID NO: 2633776 - protein, 6 aa, Entamoeba histolytica
KNPTIT

SEQ ID NO: 2633777 - protein, 5 aa, Entamoeba histolytica
KNPTL

SEQ ID NO: 2633778 - protein, 7 aa, Entamoeba histolytica
KNPVEGI

SEQ ID NO: 2633779 - protein, 7 aa, Entamoeba histolytica
KNQAQEL

SEQ ID NO: 2633780 - protein, 9 aa, Entamoeba histolytica
KNQEEEIRG

SEQ ID NO: 2633781 - protein, 4 aa, Entamoeba histolytica
KNQF

SEQ ID NO: 2633782 - protein, 7 aa, Entamoeba histolytica
KNQFDDK

SEQ ID NO: 2633783 - protein, 9 aa, Entamoeba histolytica
KNQFDSSEL

SEQ ID NO: 2633784 - protein, 6 aa, Entamoeba histolytica
KNQFKK

SEQ ID NO: 2633785 - protein, 8 aa, Entamoeba histolytica
KNQFRSAD

SEQ ID NO: 2633786 - protein, 10 aa, Entamoeba histolytica
KNQGEEEDED

SEQ ID NO: 2633787 - protein, 17 aa, Entamoeba histolytica
KNQGNQLPTIPQNNKPI

SEQ ID NO: 2633788 - protein, 4 aa, Entamoeba histolytica
KNQI

SEQ ID NO: 2633789 - protein, 9 aa, Entamoeba histolytica
KNQIGASNQ

SEQ ID NO: 2633790 - protein, 11 aa, Entamoeba histolytica
KNQIPKKTITY

SEQ ID NO: 2633791 - protein, 7 aa, Entamoeba histolytica
KNQISES

SEQ ID NO: 2633792 - protein, 4 aa, Entamoeba histolytica
KNQK

SEQ ID NO: 2633793 - protein, 8 aa, Entamoeba histolytica
KNQKGSIR

SEQ ID NO: 2633794 - protein, 10 aa, Entamoeba histolytica
KNQKTKTNEL

SEQ ID NO: 2633795 - protein, 9 aa, Entamoeba histolytica
KNQKTTQMI

SEQ ID NO: 2633796 - protein, 8 aa, Entamoeba histolytica
KNQKVRED

SEQ ID NO: 2633797 - protein, 5 aa, Entamoeba histolytica
KNQLK

SEQ ID NO: 2633798 - protein, 14 aa, Entamoeba histolytica
KNQMKETPRVTPDN

SEQ ID NO: 2633799 - protein, 7 aa, Entamoeba histolytica
KNQNDQI

SEQ ID NO: 2633800 - protein, 13 aa, Entamoeba histolytica
KNQNNGKDENYKR

SEQ ID NO: 2633801 - protein, 4 aa, Entamoeba histolytica
KNQP

SEQ ID NO: 2633802 - protein, 6 aa, Entamoeba histolytica
KNQPAK

SEQ ID NO: 2633803 - protein, 5 aa, Entamoeba histolytica
KNQPF

SEQ ID NO: 2633804 - protein, 14 aa, Entamoeba histolytica
KNQPQKSSHKMCTL

SEQ ID NO: 2633805 - protein, 5 aa, Entamoeba histolytica
KNQQP

SEQ ID NO: 2633806 - protein, 7 aa, Entamoeba histolytica
KNQQSQI

SEQ ID NO: 2633807 - protein, 13 aa, Entamoeba histolytica
KNQRKINGTVENQ

SEQ ID NO: 2633808 - protein, 4 aa, Entamoeba histolytica
KNQS

SEQ ID NO: 2633809 - protein, 11 aa, Entamoeba histolytica
KNQSKKHKTKA

SEQ ID NO: 2633810 - protein, 7 aa, Entamoeba histolytica
KNQSKRV

SEQ ID NO: 2633811 - protein, 7 aa, Entamoeba histolytica
KNQSVSP

SEQ ID NO: 2633812 - protein, 7 aa, Entamoeba histolytica
KNQTDVS

SEQ ID NO: 2633813 - protein, 26 aa, Entamoeba histolytica
KNQTENLPIKQTNSLVSSNTASMPDI

SEQ ID NO: 2633814 - protein, 7 aa, Entamoeba histolytica
KNQTNLN

SEQ ID NO: 2633815 - protein, 10 aa, Entamoeba histolytica
KNQTPQKHER

SEQ ID NO: 2633816 - protein, 6 aa, Entamoeba histolytica
KNQVTE

SEQ ID NO: 2633817 - protein, 5 aa, Entamoeba histolytica
KNQYD

SEQ ID NO: 2633818 - protein, 11 aa, Entamoeba histolytica
KNRDNSKRKHH

SEQ ID NO: 2633819 - protein, 25 aa, Entamoeba histolytica
KNRDNSKRKHHLEDTNEYQEKRDFE

SEQ ID NO: 2633820 - protein, 27 aa, Entamoeba histolytica
KNRDNSKRKHHLEDTNEYQEKRDYERG

SEQ ID NO: 2633821 - protein, 8 aa, Entamoeba histolytica
KNRETNKM

SEQ ID NO: 2633822 - protein, 6 aa, Entamoeba histolytica
KNRGDM

SEQ ID NO: 2633823 - protein, 6 aa, Entamoeba histolytica
KNRIRK

SEQ ID NO: 2633824 - protein, 6 aa, Entamoeba histolytica
KNRKLV

SEQ ID NO: 2633825 - protein, 14 aa, Entamoeba histolytica
KNRMRGYGEKVRKQ

SEQ ID NO: 2633826 - protein, 14 aa, Entamoeba histolytica
KNRNNNENQSNEIT

SEQ ID NO: 2633827 - protein, 9 aa, Entamoeba histolytica
KNRPKPGLA

SEQ ID NO: 2633828 - protein, 6 aa, Entamoeba histolytica
KNRPRA

SEQ ID NO: 2633829 - protein, 66 aa, Entamoeba histolytica
KNRRELEKEINEKIQGVESVEEKVNNEKIKNEEKQKEIEEEKKKEEKELEDMSKEVNEIKNELENR

SEQ ID NO: 2633830 - protein, 14 aa, Entamoeba histolytica
KNRRGQVQADGKAK

SEQ ID NO: 2633831 - protein, 6 aa, Entamoeba histolytica
KNRRRI

SEQ ID NO: 2633832 - protein, 5 aa, Entamoeba histolytica
KNRST

SEQ ID NO: 2633833 - protein, 5 aa, Entamoeba histolytica
KNRTS

SEQ ID NO: 2633834 - protein, 7 aa, Entamoeba histolytica
KNRVSNQ

SEQ ID NO: 2633835 - protein, 6 aa, Entamoeba histolytica
KNRYTM

SEQ ID NO: 2633836 - protein, 4 aa, Entamoeba histolytica
KNSA

SEQ ID NO: 2633837 - protein, 5 aa, Entamoeba histolytica
KNSDI

SEQ ID NO: 2633838 - protein, 8 aa, Entamoeba histolytica
KNSEEELI

SEQ ID NO: 2633839 - protein, 8 aa, Entamoeba histolytica
KNSEEELL

SEQ ID NO: 2633840 - protein, 6 aa, Entamoeba histolytica
KNSENF

SEQ ID NO: 2633841 - protein, 8 aa, Entamoeba histolytica
KNSFIQGK

SEQ ID NO: 2633842 - protein, 7 aa, Entamoeba histolytica
KNSFPKK

SEQ ID NO: 2633843 - protein, 8 aa, Entamoeba histolytica
KNSFRQGI

SEQ ID NO: 2633844 - protein, 6 aa, Entamoeba histolytica
KNSFSL

SEQ ID NO: 2633845 - protein, 7 aa, Entamoeba histolytica
KNSGSID

SEQ ID NO: 2633846 - protein, 11 aa, Entamoeba histolytica
KNSGVNKMTAD

SEQ ID NO: 2633847 - protein, 9 aa, Entamoeba histolytica
KNSIKQNAE

SEQ ID NO: 2633848 - protein, 6 aa, Entamoeba histolytica
KNSKAI

SEQ ID NO: 2633849 - protein, 9 aa, Entamoeba histolytica
KNSKGKEIS

SEQ ID NO: 2633850 - protein, 7 aa, Entamoeba histolytica
KNSKKAM

SEQ ID NO: 2633851 - protein, 17 aa, Entamoeba histolytica
KNSKKCGDVTTDEGEAD

SEQ ID NO: 2633852 - protein, 6 aa, Entamoeba histolytica
KNSKKI

SEQ ID NO: 2633853 - protein, 11 aa, Entamoeba histolytica
KNSLDPQPSSL

SEQ ID NO: 2633854 - protein, 14 aa, Entamoeba histolytica
KNSLPKDEASVEYY

SEQ ID NO: 2633855 - protein, 5 aa, Entamoeba histolytica
KNSME

SEQ ID NO: 2633856 - protein, 8 aa, Entamoeba histolytica
KNSNAVEK

SEQ ID NO: 2633857 - protein, 6 aa, Entamoeba histolytica
KNSNEI

SEQ ID NO: 2633858 - protein, 6 aa, Entamoeba histolytica
KNSNEN

SEQ ID NO: 2633859 - protein, 8 aa, Entamoeba histolytica
KNSNEPQT

SEQ ID NO: 2633860 - protein, 7 aa, Entamoeba histolytica
KNSNGLT

SEQ ID NO: 2633861 - protein, 5 aa, Entamoeba histolytica
KNSNS

SEQ ID NO: 2633862 - protein, 6 aa, Entamoeba histolytica
KNSNSY

SEQ ID NO: 2633863 - protein, 10 aa, Entamoeba histolytica
KNSPFDLSSD

SEQ ID NO: 2633864 - protein, 11 aa, Entamoeba histolytica
KNSPKKQKTFN

SEQ ID NO: 2633865 - protein, 12 aa, Entamoeba histolytica
KNSPPLSPDTDK

SEQ ID NO: 2633866 - protein, 8 aa, Entamoeba histolytica
KNSQEKEQ

SEQ ID NO: 2633867 - protein, 12 aa, Entamoeba histolytica
KNSQLSSFPGQT

SEQ ID NO: 2633868 - protein, 7 aa, Entamoeba histolytica
KNSQNCV

SEQ ID NO: 2633869 - protein, 14 aa, Entamoeba histolytica
KNSQRKKPKLPALE

SEQ ID NO: 2633870 - protein, 8 aa, Entamoeba histolytica
KNSQSKRC

SEQ ID NO: 2633871 - protein, 6 aa, Entamoeba histolytica
KNSQSY

SEQ ID NO: 2633872 - protein, 7 aa, Entamoeba histolytica
KNSQTSM

SEQ ID NO: 2633873 - protein, 4 aa, Entamoeba histolytica
KNSR

SEQ ID NO: 2633874 - protein, 10 aa, Entamoeba histolytica
KNSRSSISVE

SEQ ID NO: 2633875 - protein, 6 aa, Entamoeba histolytica
KNSSNR

SEQ ID NO: 2633876 - protein, 50 aa, Entamoeba histolytica
KNSSNSISTIEEKEEIQDNQKEIQEEKEEKTEDIEKSTKETGKTNLNSKV

SEQ ID NO: 2633877 - protein, 7 aa, Entamoeba histolytica
KNSSSSL

SEQ ID NO: 2633878 - protein, 18 aa, Entamoeba histolytica
KNSSTSVFQRNTESKSSF

SEQ ID NO: 2633879 - protein, 7 aa, Entamoeba histolytica
KNSTKDI

SEQ ID NO: 2633880 - protein, 12 aa, Entamoeba histolytica
KNSTPEAAIEAT

SEQ ID NO: 2633881 - protein, 9 aa, Entamoeba histolytica
KNSTSAQGY

SEQ ID NO: 2633882 - protein, 14 aa, Entamoeba histolytica
KNSTTKKSEAEIKA

SEQ ID NO: 2633883 - protein, 15 aa, Entamoeba histolytica
KNSTTKKSKEDIRAE

SEQ ID NO: 2633884 - protein, 15 aa, Entamoeba histolytica
KNSTTKKSKEEIKAE

SEQ ID NO: 2633885 - protein, 32 aa, Entamoeba histolytica
KNSTTKKSKEEIKAEFEAKRKELKEGGKSTMD

SEQ ID NO: 2633886 - protein, 24 aa, Entamoeba histolytica
KNSTTKNPIIAEEKEEYQAKRKLD

SEQ ID NO: 2633887 - protein, 6 aa, Entamoeba histolytica
KNSTYK

SEQ ID NO: 2633888 - protein, 9 aa, Entamoeba histolytica
KNSVGKKKQ

SEQ ID NO: 2633889 - protein, 6 aa, Entamoeba histolytica
KNSYDN

SEQ ID NO: 2633890 - protein, 7 aa, Entamoeba histolytica
KNTAIDN

SEQ ID NO: 2633891 - protein, 8 aa, Entamoeba histolytica
KNTAKQGV

SEQ ID NO: 2633892 - protein, 10 aa, Entamoeba histolytica
KNTDEELQNC

SEQ ID NO: 2633893 - protein, 4 aa, Entamoeba histolytica
KNTE

SEQ ID NO: 2633894 - protein, 6 aa, Entamoeba histolytica
KNTEEI

SEQ ID NO: 2633895 - protein, 8 aa, Entamoeba histolytica
KNTEITGK

SEQ ID NO: 2633896 - protein, 6 aa, Entamoeba histolytica
KNTEKD

SEQ ID NO: 2633897 - protein, 10 aa, Entamoeba histolytica
KNTEKDHPDA

SEQ ID NO: 2633898 - protein, 5 aa, Entamoeba histolytica
KNTEQ

SEQ ID NO: 2633899 - protein, 6 aa, Entamoeba histolytica
KNTETY

SEQ ID NO: 2633900 - protein, 6 aa, Entamoeba histolytica
KNTFDK

SEQ ID NO: 2633901 - protein, 6 aa, Entamoeba histolytica
KNTGDL

SEQ ID NO: 2633902 - protein, 6 aa, Entamoeba histolytica
KNTILE

SEQ ID NO: 2633903 - protein, 36 aa, Entamoeba histolytica
KNTISSQQKPLTKSDSIDSNISEYTISENSLNPPFP

SEQ ID NO: 2633904 - protein, 21 aa, Entamoeba histolytica
KNTKDKKAKKDPNRPKRPPTP

SEQ ID NO: 2633905 - protein, 46 aa, Entamoeba histolytica
KNTKEEQKQQKQHHKKEVKGSLAQRKQIKTQKEVETSSKASTKPKK

SEQ ID NO: 2633906 - protein, 6 aa, Entamoeba histolytica
KNTKME

SEQ ID NO: 2633907 - protein, 6 aa, Entamoeba histolytica
KNTKNL

SEQ ID NO: 2633908 - protein, 9 aa, Entamoeba histolytica
KNTKQKTRL

SEQ ID NO: 2633909 - protein, 11 aa, Entamoeba histolytica
KNTKSDHPDYA

SEQ ID NO: 2633910 - protein, 7 aa, Entamoeba histolytica
KNTLKNV

SEQ ID NO: 2633911 - protein, 11 aa, Entamoeba histolytica
KNTNFNKTGLA

SEQ ID NO: 2633912 - protein, 21 aa, Entamoeba histolytica
KNTNNNQENISDEDEETEMNG

SEQ ID NO: 2633913 - protein, 5 aa, Entamoeba histolytica
KNTNS

SEQ ID NO: 2633914 - protein, 8 aa, Entamoeba histolytica
KNTNSLNE

SEQ ID NO: 2633915 - protein, 4 aa, Entamoeba histolytica
KNTP

SEQ ID NO: 2633916 - protein, 16 aa, Entamoeba histolytica
KNTPDGTLGKSALATA

SEQ ID NO: 2633917 - protein, 6 aa, Entamoeba histolytica
KNTPKR

SEQ ID NO: 2633918 - protein, 6 aa, Entamoeba histolytica
KNTPLK

SEQ ID NO: 2633919 - protein, 8 aa, Entamoeba histolytica
KNTPTLDN

SEQ ID NO: 2633920 - protein, 5 aa, Entamoeba histolytica
KNTQE

SEQ ID NO: 2633921 - protein, 8 aa, Entamoeba histolytica
KNTQNKKL

SEQ ID NO: 2633922 - protein, 9 aa, Entamoeba histolytica
KNTQPLQKK

SEQ ID NO: 2633923 - protein, 5 aa, Entamoeba histolytica
KNTQV

SEQ ID NO: 2633924 - protein, 8 aa, Entamoeba histolytica
KNTRGNGF

SEQ ID NO: 2633925 - protein, 8 aa, Entamoeba histolytica
KNTRKCPK

SEQ ID NO: 2633926 - protein, 11 aa, Entamoeba histolytica
KNTRKPVDSVE

SEQ ID NO: 2633927 - protein, 8 aa, Entamoeba histolytica
KNTSNCTQ

SEQ ID NO: 2633928 - protein, 11 aa, Entamoeba histolytica
KNTSNTSISFP

SEQ ID NO: 2633929 - protein, 15 aa, Entamoeba histolytica
KNTSSQQDNLDTKTQ

SEQ ID NO: 2633930 - protein, 17 aa, Entamoeba histolytica
KNTSTLDEARTYCKYYL

SEQ ID NO: 2633931 - protein, 6 aa, Entamoeba histolytica
KNTTKM

SEQ ID NO: 2633932 - protein, 15 aa, Entamoeba histolytica
KNTTNEAKHNIEGDV

SEQ ID NO: 2633933 - protein, 4 aa, Entamoeba histolytica
KNTV

SEQ ID NO: 2633934 - protein, 5 aa, Entamoeba histolytica
KNTVP

SEQ ID NO: 2633935 - protein, 21 aa, Entamoeba histolytica
KNVAPYNPIGRAEEEIEEGFS

SEQ ID NO: 2633936 - protein, 9 aa, Entamoeba histolytica
KNVDQQKQD

SEQ ID NO: 2633937 - protein, 6 aa, Entamoeba histolytica
KNVKAE

SEQ ID NO: 2633938 - protein, 9 aa, Entamoeba histolytica
KNVKDEQEV

SEQ ID NO: 2633939 - protein, 12 aa, Entamoeba histolytica
KNVKSKKAQGRL

SEQ ID NO: 2633940 - protein, 18 aa, Entamoeba histolytica
KNVNTKSINITSSNQKNY

SEQ ID NO: 2633941 - protein, 6 aa, Entamoeba histolytica
KNVPGT

SEQ ID NO: 2633942 - protein, 7 aa, Entamoeba histolytica
KNVPQGN

SEQ ID NO: 2633943 - protein, 14 aa, Entamoeba histolytica
KNVPYRKTHESESR

SEQ ID NO: 2633944 - protein, 8 aa, Entamoeba histolytica
KNVRNKAR

SEQ ID NO: 2633945 - protein, 6 aa, Entamoeba histolytica
KNVRPG

SEQ ID NO: 2633946 - protein, 7 aa, Entamoeba histolytica
KNVSPIT

SEQ ID NO: 2633947 - protein, 7 aa, Entamoeba histolytica
KNVTQTR

SEQ ID NO: 2633948 - protein, 6 aa, Entamoeba histolytica
KNVTYN

SEQ ID NO: 2633949 - protein, 4 aa, Entamoeba histolytica
KNWE

SEQ ID NO: 2633950 - protein, 16 aa, Entamoeba histolytica
KNWQPKPRKVKPVKPS

SEQ ID NO: 2633951 - protein, 4 aa, Entamoeba histolytica
KNWR

SEQ ID NO: 2633952 - protein, 4 aa, Entamoeba histolytica
KNWT

SEQ ID NO: 2633953 - protein, 6 aa, Entamoeba histolytica
KNWTKD

SEQ ID NO: 2633954 - protein, 5 aa, Entamoeba histolytica
KNYAP

SEQ ID NO: 2633955 - protein, 10 aa, Entamoeba histolytica
KNYEGRFETP

SEQ ID NO: 2633956 - protein, 11 aa, Entamoeba histolytica
KNYETSQGGID

SEQ ID NO: 2633957 - protein, 4 aa, Entamoeba histolytica
KNYH

SEQ ID NO: 2633958 - protein, 12 aa, Entamoeba histolytica
KNYHKQDGSKGS

SEQ ID NO: 2633959 - protein, 4 aa, Entamoeba histolytica
KNYI

SEQ ID NO: 2633960 - protein, 6 aa, Entamoeba histolytica
KNYIGG

SEQ ID NO: 2633961 - protein, 19 aa, Entamoeba histolytica
KNYKESNEYKRKRRALRQE

SEQ ID NO: 2633962 - protein, 8 aa, Entamoeba histolytica
KNYNEALE

SEQ ID NO: 2633963 - protein, 8 aa, Entamoeba histolytica
KNYPGSEI

SEQ ID NO: 2633964 - protein, 9 aa, Entamoeba histolytica
KNYSDQGLI

SEQ ID NO: 2633965 - protein, 7 aa, Entamoeba histolytica
KNYSLSK

SEQ ID NO: 2633966 - protein, 6 aa, Entamoeba histolytica
KNYTSE

SEQ ID NO: 2633967 - protein, 7 aa, Entamoeba histolytica
KPADEDA

SEQ ID NO: 2633968 - protein, 5 aa, Entamoeba histolytica
KPADL

SEQ ID NO: 2633969 - protein, 8 aa, Entamoeba histolytica
KPADPRLP

SEQ ID NO: 2633970 - protein, 9 aa, Entamoeba histolytica
KPADPRLPK

SEQ ID NO: 2633971 - protein, 8 aa, Entamoeba histolytica
KPAFSRYG

SEQ ID NO: 2633972 - protein, 166 aa, Entamoeba histolytica
KPAGVTPVNPTPEPETPTDGSTDGNSPSTPSTDGNTPSGDSTPSTDGNTPSGDSTPSTDGNTPSTPSTDGNTPSGDSTPSTDITPSTPSSGSNTPSTPSSGSNTPSSSSNTPSSSSNTPSSSSNTPSSSSNTPSTPSSGSNNGSSNGSNNTSKPRKTKEEKRLSKR

SEQ ID NO: 2633973 - protein, 9 aa, Entamoeba histolytica
KPAHTNDSF

SEQ ID NO: 2633974 - protein, 7 aa, Entamoeba histolytica
KPAISEE

SEQ ID NO: 2633975 - protein, 4 aa, Entamoeba histolytica
KPAL

SEQ ID NO: 2633976 - protein, 8 aa, Entamoeba histolytica
KPANPSSH

SEQ ID NO: 2633977 - protein, 5 aa, Entamoeba histolytica
KPAQL

SEQ ID NO: 2633978 - protein, 22 aa, Entamoeba histolytica
KPARPIRPSQSMVSDTDSSESI

SEQ ID NO: 2633979 - protein, 22 aa, Entamoeba histolytica
KPARPIRSSQSMVSDTDSSESI

SEQ ID NO: 2633980 - protein, 6 aa, Entamoeba histolytica
KPASIK

SEQ ID NO: 2633981 - protein, 8 aa, Entamoeba histolytica
KPASKVAA

SEQ ID NO: 2633982 - protein, 5 aa, Entamoeba histolytica
KPATM

SEQ ID NO: 2633983 - protein, 5 aa, Entamoeba histolytica
KPCET

SEQ ID NO: 2633984 - protein, 4 aa, Entamoeba histolytica
KPCN

SEQ ID NO: 2633985 - protein, 7 aa, Entamoeba histolytica
KPCNEKT

SEQ ID NO: 2633986 - protein, 4 aa, Entamoeba histolytica
KPCP

SEQ ID NO: 2633987 - protein, 6 aa, Entamoeba histolytica
KPCSSH

SEQ ID NO: 2633988 - protein, 7 aa, Entamoeba histolytica
KPCTSQQ

SEQ ID NO: 2633989 - protein, 6 aa, Entamoeba histolytica
KPDASR

SEQ ID NO: 2633990 - protein, 4 aa, Entamoeba histolytica
KPDD

SEQ ID NO: 2633991 - protein, 7 aa, Entamoeba histolytica
KPDEFNE

SEQ ID NO: 2633992 - protein, 4 aa, Entamoeba histolytica
KPDI

SEQ ID NO: 2633993 - protein, 12 aa, Entamoeba histolytica
KPDKYIGVRFHL

SEQ ID NO: 2633994 - protein, 4 aa, Entamoeba histolytica
KPDN

SEQ ID NO: 2633995 - protein, 8 aa, Entamoeba histolytica
KPDNANRY

SEQ ID NO: 2633996 - protein, 6 aa, Entamoeba histolytica
KPDNIP

SEQ ID NO: 2633997 - protein, 7 aa, Entamoeba histolytica
KPDNLNN

SEQ ID NO: 2633998 - protein, 13 aa, Entamoeba histolytica
KPDNTSAASCYEK

SEQ ID NO: 2633999 - protein, 7 aa, Entamoeba histolytica
KPDPALS

SEQ ID NO: 2634000 - protein, 6 aa, Entamoeba histolytica
KPDRNS

SEQ ID NO: 2634001 - protein, 8 aa, Entamoeba histolytica
KPDSEASN

SEQ ID NO: 2634002 - protein, 7 aa, Entamoeba histolytica
KPDTKSV

SEQ ID NO: 2634003 - protein, 8 aa, Entamoeba histolytica
KPDVEEIK

SEQ ID NO: 2634004 - protein, 8 aa, Entamoeba histolytica
KPDVTKQR

SEQ ID NO: 2634005 - protein, 7 aa, Entamoeba histolytica
KPDYDYN

SEQ ID NO: 2634006 - protein, 10 aa, Entamoeba histolytica
KPEEDQWETA

SEQ ID NO: 2634007 - protein, 8 aa, Entamoeba histolytica
KPEEETKL

SEQ ID NO: 2634008 - protein, 12 aa, Entamoeba histolytica
KPEEFTSDRGNR

SEQ ID NO: 2634009 - protein, 6 aa, Entamoeba histolytica
KPEEPK

SEQ ID NO: 2634010 - protein, 7 aa, Entamoeba histolytica
KPEGPIA

SEQ ID NO: 2634011 - protein, 8 aa, Entamoeba histolytica
KPEGSKKL

SEQ ID NO: 2634012 - protein, 5 aa, Entamoeba histolytica
KPEIT

SEQ ID NO: 2634013 - protein, 7 aa, Entamoeba histolytica
KPEKAES

SEQ ID NO: 2634014 - protein, 7 aa, Entamoeba histolytica
KPENGKA

SEQ ID NO: 2634015 - protein, 6 aa, Entamoeba histolytica
KPENLR

SEQ ID NO: 2634016 - protein, 7 aa, Entamoeba histolytica
KPEPKKL

SEQ ID NO: 2634017 - protein, 6 aa, Entamoeba histolytica
KPEQIQ

SEQ ID NO: 2634018 - protein, 6 aa, Entamoeba histolytica
KPEQPF

SEQ ID NO: 2634019 - protein, 8 aa, Entamoeba histolytica
KPEQQSKT

SEQ ID NO: 2634020 - protein, 10 aa, Entamoeba histolytica
KPESSRSSSY

SEQ ID NO: 2634021 - protein, 5 aa, Entamoeba histolytica
KPESV

SEQ ID NO: 2634022 - protein, 9 aa, Entamoeba histolytica
KPETSANGA

SEQ ID NO: 2634023 - protein, 8 aa, Entamoeba histolytica
KPETSVNG

SEQ ID NO: 2634024 - protein, 8 aa, Entamoeba histolytica
KPETTEAI

SEQ ID NO: 2634025 - protein, 10 aa, Entamoeba histolytica
KPEVNEKQHS

SEQ ID NO: 2634026 - protein, 12 aa, Entamoeba histolytica
KPEVQQEPQPGC

SEQ ID NO: 2634027 - protein, 6 aa, Entamoeba histolytica
KPEYRE

SEQ ID NO: 2634028 - protein, 6 aa, Entamoeba histolytica
KPFADE

SEQ ID NO: 2634029 - protein, 5 aa, Entamoeba histolytica
KPFAN

SEQ ID NO: 2634030 - protein, 6 aa, Entamoeba histolytica
KPFDPF

SEQ ID NO: 2634031 - protein, 4 aa, Entamoeba histolytica
KPFE

SEQ ID NO: 2634032 - protein, 14 aa, Entamoeba histolytica
KPFEISSESTEYKE

SEQ ID NO: 2634033 - protein, 6 aa, Entamoeba histolytica
KPFEPM

SEQ ID NO: 2634034 - protein, 5 aa, Entamoeba histolytica
KPFEQ

SEQ ID NO: 2634035 - protein, 9 aa, Entamoeba histolytica
KPFKQENGS

SEQ ID NO: 2634036 - protein, 6 aa, Entamoeba histolytica
KPFKTS

SEQ ID NO: 2634037 - protein, 5 aa, Entamoeba histolytica
KPFNG

SEQ ID NO: 2634038 - protein, 6 aa, Entamoeba histolytica
KPFPNG

SEQ ID NO: 2634039 - protein, 8 aa, Entamoeba histolytica
KPFPPYDP

SEQ ID NO: 2634040 - protein, 6 aa, Entamoeba histolytica
KPFPTD

SEQ ID NO: 2634041 - protein, 7 aa, Entamoeba histolytica
KPFPTPS

SEQ ID NO: 2634042 - protein, 4 aa, Entamoeba histolytica
KPFQ

SEQ ID NO: 2634043 - protein, 12 aa, Entamoeba histolytica
KPFSEEDDMDYG

SEQ ID NO: 2634044 - protein, 6 aa, Entamoeba histolytica
KPFTFN

SEQ ID NO: 2634045 - protein, 4 aa, Entamoeba histolytica
KPGD

SEQ ID NO: 2634046 - protein, 6 aa, Entamoeba histolytica
KPGDPL

SEQ ID NO: 2634047 - protein, 48 aa, Entamoeba histolytica
KPGDQQNESDEYTDDSSGFQDDDGDYDGGDYDGGDYDEDEDGVVDSSK

SEQ ID NO: 2634048 - protein, 5 aa, Entamoeba histolytica
KPGDV

SEQ ID NO: 2634049 - protein, 10 aa, Entamoeba histolytica
KPGDVDTGIG

SEQ ID NO: 2634050 - protein, 14 aa, Entamoeba histolytica
KPGHIGRDCSQPDD

SEQ ID NO: 2634051 - protein, 41 aa, Entamoeba histolytica; identical to SEQ ID NO: 2438821

SEQ ID NO: 2634052 - protein, 8 aa, Entamoeba histolytica
KPGKDESF

SEQ ID NO: 2634053 - protein, 9 aa, Entamoeba histolytica
KPGKFGDIT

SEQ ID NO: 2634054 - protein, 10 aa, Entamoeba histolytica
KPGKNWGPAC

SEQ ID NO: 2634055 - protein, 6 aa, Entamoeba histolytica
KPGNIL

SEQ ID NO: 2634056 - protein, 6 aa, Entamoeba histolytica
KPGNYK

SEQ ID NO: 2634057 - protein, 8 aa, Entamoeba histolytica
KPGQDENA

SEQ ID NO: 2634058 - protein, 16 aa, Entamoeba histolytica
KPGQKTEDEMYSNTEC

SEQ ID NO: 2634059 - protein, 6 aa, Entamoeba histolytica
KPGQTI

SEQ ID NO: 2634060 - protein, 7 aa, Entamoeba histolytica
KPGSDIG

SEQ ID NO: 2634061 - protein, 10 aa, Entamoeba histolytica
KPGTGNGKEL

SEQ ID NO: 2634062 - protein, 13 aa, Entamoeba histolytica
KPGTSVAHHKQSN

SEQ ID NO: 2634063 - protein, 8 aa, Entamoeba histolytica
KPHDDYSG

SEQ ID NO: 2634064 - protein, 6 aa, Entamoeba histolytica
KPHGGK

SEQ ID NO: 2634065 - protein, 4 aa, Entamoeba histolytica
KPHM

SEQ ID NO: 2634066 - protein, 12 aa, Entamoeba histolytica
KPHNQPLNSQTA

SEQ ID NO: 2634067 - protein, 5 aa, Entamoeba histolytica
KPHPP

SEQ ID NO: 2634068 - protein, 5 aa, Entamoeba histolytica
KPIAD

SEQ ID NO: 2634069 - protein, 6 aa, Entamoeba histolytica
KPIAES

SEQ ID NO: 2634070 - protein, 7 aa, Entamoeba histolytica
KPIAGRS

SEQ ID NO: 2634071 - protein, 6 aa, Entamoeba histolytica
KPIAPG

SEQ ID NO: 2634072 - protein, 6 aa, Entamoeba histolytica
KPIAQK

SEQ ID NO: 2634073 - protein, 6 aa, Entamoeba histolytica
KPIDAS

SEQ ID NO: 2634074 - protein, 8 aa, Entamoeba histolytica
KPIEGGFD

SEQ ID NO: 2634075 - protein, 13 aa, Entamoeba histolytica
KPIEKELNQTTPH

SEQ ID NO: 2634076 - protein, 7 aa, Entamoeba histolytica
KPIEKSQ

SEQ ID NO: 2634077 - protein, 5 aa, Entamoeba histolytica
KPIEN

SEQ ID NO: 2634078 - protein, 6 aa, Entamoeba histolytica
KPIEQA

SEQ ID NO: 2634079 - protein, 22 aa, Entamoeba histolytica
KPIEQKTKKRTLKPISSDDEES

SEQ ID NO: 2634080 - protein, 11 aa, Entamoeba histolytica
KPIEQPRKKGT

SEQ ID NO: 2634081 - protein, 8 aa, Entamoeba histolytica
KPIETKPS

SEQ ID NO: 2634082 - protein, 5 aa, Entamoeba histolytica
KPIGQ

SEQ ID NO: 2634083 - protein, 5 aa, Entamoeba histolytica
KPIGS

SEQ ID NO: 2634084 - protein, 5 aa, Entamoeba histolytica
KPIHE

SEQ ID NO: 2634085 - protein, 24 aa, Entamoeba histolytica
KPIHETTHDEISNEEEEDKTQQLK

SEQ ID NO: 2634086 - protein, 10 aa, Entamoeba histolytica
KPIKKDTTND

SEQ ID NO: 2634087 - protein, 37 aa, Entamoeba histolytica
KPIKRQSEEPDQKELPLKKRSSDNSDTVTDDTITTEY

SEQ ID NO: 2634088 - protein, 5 aa, Entamoeba histolytica
KPIKS

SEQ ID NO: 2634089 - protein, 6 aa, Entamoeba histolytica
KPIKTN

SEQ ID NO: 2634090 - protein, 6 aa, Entamoeba histolytica
KPIKVG

SEQ ID NO: 2634091 - protein, 16 aa, Entamoeba histolytica
KPINKDTIQPSTPKLF

SEQ ID NO: 2634092 - protein, 10 aa, Entamoeba histolytica
KPINNYSPPL

SEQ ID NO: 2634093 - protein, 11 aa, Entamoeba histolytica
KPIPHPPSTGH

SEQ ID NO: 2634094 - protein, 5 aa, Entamoeba histolytica
KPIPK

SEQ ID NO: 2634095 - protein, 22 aa, Entamoeba histolytica
KPIPNEKKPLVNPEVPTKKEND

SEQ ID NO: 2634096 - protein, 8 aa, Entamoeba histolytica
KPIPPCPS

SEQ ID NO: 2634097 - protein, 8 aa, Entamoeba histolytica
KPIPQHPK

SEQ ID NO: 2634098 - protein, 6 aa, Entamoeba histolytica
KPIPTP

SEQ ID NO: 2634099 - protein, 6 aa, Entamoeba histolytica
KPIPYP

SEQ ID NO: 2634100 - protein, 5 aa, Entamoeba histolytica
KPIQE

SEQ ID NO: 2634101 - protein, 7 aa, Entamoeba histolytica
KPIQKTD

SEQ ID NO: 2634102 - protein, 5 aa, Entamoeba histolytica
KPIQT

SEQ ID NO: 2634103 - protein, 11 aa, Entamoeba histolytica
KPIRKGRDREK

SEQ ID NO: 2634104 - protein, 5 aa, Entamoeba histolytica
KPISK

SEQ ID NO: 2634105 - protein, 5 aa, Entamoeba histolytica
KPISY

SEQ ID NO: 2634106 - protein, 5 aa, Entamoeba histolytica
KPITT

SEQ ID NO: 2634107 - protein, 12 aa, Entamoeba histolytica
KPIYNGAKSLET

SEQ ID NO: 2634108 - protein, 13 aa, Entamoeba histolytica
KPIYSNSETVDDK

SEQ ID NO: 2634109 - protein, 6 aa, Entamoeba histolytica
KPKCLP

SEQ ID NO: 2634110 - protein, 19 aa, Entamoeba histolytica
KPKDFQKQEQNDNESSPIY

SEQ ID NO: 2634111 - protein, 16 aa, Entamoeba histolytica
KPKDKSSSIQSIGRGG

SEQ ID NO: 2634112 - protein, 7 aa, Entamoeba histolytica
KPKEDID

SEQ ID NO: 2634113 - protein, 8 aa, Entamoeba histolytica
KPKEDNKN

SEQ ID NO: 2634114 - protein, 15 aa, Entamoeba histolytica
KPKEEKEKNERKKRK

SEQ ID NO: 2634115 - protein, 13 aa, Entamoeba histolytica
KPKEKSITISQST

SEQ ID NO: 2634116 - protein, 81 aa, Entamoeba histolytica
KPKEQKKEEEELNKKEDKKEQKTSTEKEEAKEEIDKKEEEEKKTVSLEAERKEKEEELEKEKQPTEIESQMKKSTEERKVK

SEQ ID NO: 2634117 - protein, 6 aa, Entamoeba histolytica
KPKEVD

SEQ ID NO: 2634118 - protein, 23 aa, Entamoeba histolytica
KPKEVQPENQKGFGVPTTDPVSC

SEQ ID NO: 2634119 - protein, 5 aa, Entamoeba histolytica
KPKGY

SEQ ID NO: 2634120 - protein, 4 aa, Entamoeba histolytica
KPKH

SEQ ID NO: 2634121 - protein, 11 aa, Entamoeba histolytica
KPKHKKKNGMF

SEQ ID NO: 2634122 - protein, 10 aa, Entamoeba histolytica
KPKHPDQCKT

SEQ ID NO: 2634123 - protein, 4 aa, Entamoeba histolytica
KPKI

SEQ ID NO: 2634124 - protein, 13 aa, Entamoeba histolytica
KPKKEDVKNCQDE

SEQ ID NO: 2634125 - protein, 10 aa, Entamoeba histolytica
KPKKEISSSI

SEQ ID NO: 2634126 - protein, 8 aa, Entamoeba histolytica
KPKKFEKS

SEQ ID NO: 2634127 - protein, 6 aa, Entamoeba histolytica
KPKKKW

SEQ ID NO: 2634128 - protein, 23 aa, Entamoeba histolytica
KPKKQYQIKPIEESKKKFSHCLI

SEQ ID NO: 2634129 - protein, 7 aa, Entamoeba histolytica
KPKKRST

SEQ ID NO: 2634130 - protein, 9 aa, Entamoeba histolytica
KPKKSITDI

SEQ ID NO: 2634131 - protein, 6 aa, Entamoeba histolytica
KPKLNK

SEQ ID NO: 2634132 - protein, 5 aa, Entamoeba histolytica
KPKLQ

SEQ ID NO: 2634133 - protein, 6 aa, Entamoeba histolytica
KPKNSF

SEQ ID NO: 2634134 - protein, 14 aa, Entamoeba histolytica
KPKQANKKEMVKDK

SEQ ID NO: 2634135 - protein, 22 aa, Entamoeba histolytica
KPKQKQGKTFNIGSYANKLLDQ

SEQ ID NO: 2634136 - protein, 7 aa, Entamoeba histolytica
KPKQLSY

SEQ ID NO: 2634137 - protein, 6 aa, Entamoeba histolytica
KPKRSF

SEQ ID NO: 2634138 - protein, 6 aa, Entamoeba histolytica
KPKSEK

SEQ ID NO: 2634139 - protein, 8 aa, Entamoeba histolytica
KPKSEKLS

SEQ ID NO: 2634140 - protein, 10 aa, Entamoeba histolytica
KPKSKSTTTL

SEQ ID NO: 2634141 - protein, 7 aa, Entamoeba histolytica
KPKSPET

SEQ ID NO: 2634142 - protein, 6 aa, Entamoeba histolytica
KPKTEE

SEQ ID NO: 2634143 - protein, 31 aa, Entamoeba histolytica
KPKTEIKDSTEVSDETNVQVSDEDKEFREAS

SEQ ID NO: 2634144 - protein, 8 aa, Entamoeba histolytica
KPKTTTQL

SEQ ID NO: 2634145 - protein, 6 aa, Entamoeba histolytica
KPKYRS

SEQ ID NO: 2634146 - protein, 5 aa, Entamoeba histolytica
KPLDG

SEQ ID NO: 2634147 - protein, 5 aa, Entamoeba histolytica
KPLDQ

SEQ ID NO: 2634148 - protein, 5 aa, Entamoeba histolytica
KPLDV

SEQ ID NO: 2634149 - protein, 6 aa, Entamoeba histolytica
KPLENL

SEQ ID NO: 2634150 - protein, 8 aa, Entamoeba histolytica
KPLETTSD

SEQ ID NO: 2634151 - protein, 7 aa, Entamoeba histolytica
KPLGHGT

SEQ ID NO: 2634152 - protein, 26 aa, Entamoeba histolytica
KPLGQDSVDGNVSDSMQIEENSLKSP

SEQ ID NO: 2634153 - protein, 5 aa, Entamoeba histolytica
KPLGT

SEQ ID NO: 2634154 - protein, 12 aa, Entamoeba histolytica
KPLHGTNVPHDP

SEQ ID NO: 2634155 - protein, 4 aa, Entamoeba histolytica
KPLK

SEQ ID NO: 2634156 - protein, 5 aa, Entamoeba histolytica
KPLKI

SEQ ID NO: 2634157 - protein, 8 aa, Entamoeba histolytica
KPLNNGSF

SEQ ID NO: 2634158 - protein, 6 aa, Entamoeba histolytica
KPLNPA

SEQ ID NO: 2634159 - protein, 24 aa, Entamoeba histolytica
KPLNSQDKLKTAREKIKEKMSDSQ

SEQ ID NO: 2634160 - protein, 26 aa, Entamoeba histolytica
KPLNSQDSLKTVREKLKGKMSDSQQF

SEQ ID NO: 2634161 - protein, 5 aa, Entamoeba histolytica
KPLPG

SEQ ID NO: 2634162 - protein, 8 aa, Entamoeba histolytica
KPLPKAST

SEQ ID NO: 2634163 - protein, 8 aa, Entamoeba histolytica
KPLPPPCY

SEQ ID NO: 2634164 - protein, 9 aa, Entamoeba histolytica
KPLPQDEHS

SEQ ID NO: 2634165 - protein, 8 aa, Entamoeba histolytica
KPLPQNRV

SEQ ID NO: 2634166 - protein, 19 aa, Entamoeba histolytica
KPLPRSDNGETLDKESSKE

SEQ ID NO: 2634167 - protein, 7 aa, Entamoeba histolytica
KPLPSRE

SEQ ID NO: 2634168 - protein, 32 aa, Entamoeba histolytica
KPLPVPPKPSGLSKTDPRKKPLPPSPGNKKNI

SEQ ID NO: 2634169 - protein, 7 aa, Entamoeba histolytica
KPLRSNK

SEQ ID NO: 2634170 - protein, 4 aa, Entamoeba histolytica
KPLS

SEQ ID NO: 2634171 - protein, 7 aa, Entamoeba histolytica
KPLSPND

SEQ ID NO: 2634172 - protein, 6 aa, Entamoeba histolytica
KPLSSI

SEQ ID NO: 2634173 - protein, 6 aa, Entamoeba histolytica
KPLSSS

SEQ ID NO: 2634174 - protein, 8 aa, Entamoeba histolytica
KPLTEQQA

SEQ ID NO: 2634175 - protein, 4 aa, Entamoeba histolytica
KPLY

SEQ ID NO: 2634176 - protein, 6 aa, Entamoeba histolytica
KPLYEK

SEQ ID NO: 2634177 - protein, 6 aa, Entamoeba histolytica
KPMESQ

SEQ ID NO: 2634178 - protein, 10 aa, Entamoeba histolytica
KPMKKGKKCK

SEQ ID NO: 2634179 - protein, 13 aa, Entamoeba histolytica
KPNAKTSEIQGVE

SEQ ID NO: 2634180 - protein, 5 aa, Entamoeba histolytica
KPNAR

SEQ ID NO: 2634181 - protein, 11 aa, Entamoeba histolytica
KPNDYNYGDPC

SEQ ID NO: 2634182 - protein, 6 aa, Entamoeba histolytica
KPNEAH

SEQ ID NO: 2634183 - protein, 5 aa, Entamoeba histolytica
KPNEE

SEQ ID NO: 2634184 - protein, 8 aa, Entamoeba histolytica
KPNEEISE

SEQ ID NO: 2634185 - protein, 10 aa, Entamoeba histolytica
KPNEIENDKS

SEQ ID NO: 2634186 - protein, 10 aa, Entamoeba histolytica
KPNELNQNNE

SEQ ID NO: 2634187 - protein, 7 aa, Entamoeba histolytica
KPNENPV

SEQ ID NO: 2634188 - protein, 27 aa, Entamoeba histolytica
KPNENSSEDETKLKDTSEQIQSNNISD

SEQ ID NO: 2634189 - protein, 6 aa, Entamoeba histolytica
KPNESE

SEQ ID NO: 2634190 - protein, 6 aa, Entamoeba histolytica
KPNEVS

SEQ ID NO: 2634191 - protein, 9 aa, Entamoeba histolytica
KPNGESNEA

SEQ ID NO: 2634192 - protein, 16 aa, Entamoeba histolytica
KPNGGSIPVTKENKKE

SEQ ID NO: 2634193 - protein, 11 aa, Entamoeba histolytica
KPNGIQPHPNS

SEQ ID NO: 2634194 - protein, 7 aa, Entamoeba histolytica
KPNGNEI

SEQ ID NO: 2634195 - protein, 9 aa, Entamoeba histolytica
KPNGNRKRI

SEQ ID NO: 2634196 - protein, 11 aa, Entamoeba histolytica
KPNKQRKTSYF

SEQ ID NO: 2634197 - protein, 22 aa, Entamoeba histolytica
KPNKQVAQEIANGTVDPDTHKP

SEQ ID NO: 2634198 - protein, 5 aa, Entamoeba histolytica
KPNKY

SEQ ID NO: 2634199 - protein, 6 aa, Entamoeba histolytica
KPNLKK

SEQ ID NO: 2634200 - protein, 13 aa, Entamoeba histolytica
KPNNICKGEGLEK

SEQ ID NO: 2634201 - protein, 6 aa, Entamoeba histolytica
KPNNKR

SEQ ID NO: 2634202 - protein, 6 aa, Entamoeba histolytica
KPNNMP

SEQ ID NO: 2634203 - protein, 9 aa, Entamoeba histolytica
KPNNNVPNE

SEQ ID NO: 2634204 - protein, 6 aa, Entamoeba histolytica
KPNNQR

SEQ ID NO: 2634205 - protein, 27 aa, Entamoeba histolytica
KPNNSQDQLNTSEESNKNKSDENNNID

SEQ ID NO: 2634206 - protein, 5 aa, Entamoeba histolytica
KPNNW

SEQ ID NO: 2634207 - protein, 6 aa, Entamoeba histolytica
KPNPDV

SEQ ID NO: 2634208 - protein, 4 aa, Entamoeba histolytica
KPNQ

SEQ ID NO: 2634209 - protein, 8 aa, Entamoeba histolytica
KPNQTTED

SEQ ID NO: 2634210 - protein, 5 aa, Entamoeba histolytica
KPNRI

SEQ ID NO: 2634211 - protein, 6 aa, Entamoeba histolytica
KPNRNG

SEQ ID NO: 2634212 - protein, 8 aa, Entamoeba histolytica
KPNRYSSL

SEQ ID NO: 2634213 - protein, 6 aa, Entamoeba histolytica
KPNSKE

SEQ ID NO: 2634214 - protein, 14 aa, Entamoeba histolytica
KPNTINKTQNERKM

SEQ ID NO: 2634215 - protein, 6 aa, Entamoeba histolytica
KPNTLT

SEQ ID NO: 2634216 - protein, 64 aa, Entamoeba histolytica
KPNVEEHKKETNPEGKITKDKKDTQINKIKEKDETEAKPKKEKKHKKNKKHEEIEEEDGDDPMI

SEQ ID NO: 2634217 - protein, 4 aa, Entamoeba histolytica
KPNW

SEQ ID NO: 2634218 - protein, 7 aa, Entamoeba histolytica
KPNYNTY

SEQ ID NO: 2634219 - protein, 82 aa, Entamoeba histolytica
KPPALPPRRSASTTQALPTVPTRTYPTNNNNKQLEQQTKRTSGHTNSSPNLTSTRITEKTESINKRPLPPVPNKRTNFKINS

SEQ ID NO: 2634220 - protein, 6 aa, Entamoeba histolytica
KPPECK

SEQ ID NO: 2634221 - protein, 5 aa, Entamoeba histolytica
KPPEL

SEQ ID NO: 2634222 - protein, 6 aa, Entamoeba histolytica
KPPEYE

SEQ ID NO: 2634223 - protein, 15 aa, Entamoeba histolytica
KPPGNELKRERSGAK

SEQ ID NO: 2634224 - protein, 5 aa, Entamoeba histolytica
KPPIS

SEQ ID NO: 2634225 - protein, 16 aa, Entamoeba histolytica
KPPKYQYQTNLPSGEY

SEQ ID NO: 2634226 - protein, 7 aa, Entamoeba histolytica
KPPMEND

SEQ ID NO: 2634227 - protein, 9 aa, Entamoeba histolytica
KPPNQKEQI

SEQ ID NO: 2634228 - protein, 10 aa, Entamoeba histolytica
KPPPGITDEE

SEQ ID NO: 2634229 - protein, 12 aa, Entamoeba histolytica
KPPPKSSPSDII

SEQ ID NO: 2634230 - protein, 16 aa, Entamoeba histolytica
KPPPRSFKAKPTSPSR

SEQ ID NO: 2634231 - protein, 8 aa, Entamoeba histolytica
KPPPSLIT

SEQ ID NO: 2634232 - protein, 7 aa, Entamoeba histolytica
KPPQPSL

SEQ ID NO: 2634233 - protein, 8 aa, Entamoeba histolytica
KPPRSNKI

SEQ ID NO: 2634234 - protein, 6 aa, Entamoeba histolytica
KPPSID

SEQ ID NO: 2634235 - protein, 8 aa, Entamoeba histolytica
KPPSSRKI

SEQ ID NO: 2634236 - protein, 8 aa, Entamoeba histolytica
KPPTEEEC

SEQ ID NO: 2634237 - protein, 8 aa, Entamoeba histolytica
KPPTNQLT

SEQ ID NO: 2634238 - protein, 7 aa, Entamoeba histolytica
KPQDDEY

SEQ ID NO: 2634239 - protein, 13 aa, Entamoeba histolytica
KPQDKIPTDSTLK

SEQ ID NO: 2634240 - protein, 6 aa, Entamoeba histolytica
KPQEIR

SEQ ID NO: 2634241 - protein, 6 aa, Entamoeba histolytica
KPQELE

SEQ ID NO: 2634242 - protein, 20 aa, Entamoeba histolytica
KPQKPVVSNEVPKSDGPEFS

SEQ ID NO: 2634243 - protein, 5 aa, Entamoeba histolytica
KPQNI

SEQ ID NO: 2634244 - protein, 11 aa, Entamoeba histolytica
KPQPTKREKQL

SEQ ID NO: 2634245 - protein, 8 aa, Entamoeba histolytica
KPQPTQVP

SEQ ID NO: 2634246 - protein, 8 aa, Entamoeba histolytica
KPQRLQEQ

SEQ ID NO: 2634247 - protein, 7 aa, Entamoeba histolytica
KPQRSIK

SEQ ID NO: 2634248 - protein, 7 aa, Entamoeba histolytica
KPQSRRI

SEQ ID NO: 2634249 - protein, 34 aa, Entamoeba histolytica
KPQTRSNAKVQKQSSKVKLSKTPELINEPEEQIK

SEQ ID NO: 2634250 - protein, 19 aa, Entamoeba histolytica
KPQVTEENNQEKKPKLPKE

SEQ ID NO: 2634251 - protein, 9 aa, Entamoeba histolytica
KPRDFQETS

SEQ ID NO: 2634252 - protein, 7 aa, Entamoeba histolytica
KPRDIND

SEQ ID NO: 2634253 - protein, 7 aa, Entamoeba histolytica
KPRGRKE

SEQ ID NO: 2634254 - protein, 8 aa, Entamoeba histolytica
KPRIGGDG

SEQ ID NO: 2634255 - protein, 12 aa, Entamoeba histolytica
KPRKKGFGSRDG

SEQ ID NO: 2634256 - protein, 7 aa, Entamoeba histolytica
KPRKPTE

SEQ ID NO: 2634257 - protein, 8 aa, Entamoeba histolytica
KPRNQGLS

SEQ ID NO: 2634258 - protein, 7 aa, Entamoeba histolytica
KPRPFGV

SEQ ID NO: 2634259 - protein, 16 aa, Entamoeba histolytica
KPRPTAEKITSTTPLV

SEQ ID NO: 2634260 - protein, 5 aa, Entamoeba histolytica
KPRQC

SEQ ID NO: 2634261 - protein, 5 aa, Entamoeba histolytica
KPRTF

SEQ ID NO: 2634262 - protein, 8 aa, Entamoeba histolytica
KPRTFDSI

SEQ ID NO: 2634263 - protein, 17 aa, Entamoeba histolytica
KPSDWKNSLETCKKTLE

SEQ ID NO: 2634264 - protein, 10 aa, Entamoeba histolytica
KPSEKIEDQH

SEQ ID NO: 2634265 - protein, 7 aa, Entamoeba histolytica
KPSERWS

SEQ ID NO: 2634266 - protein, 11 aa, Entamoeba histolytica
KPSESSTILNE

SEQ ID NO: 2634267 - protein, 16 aa, Entamoeba histolytica
KPSGIPTHSGGRYTEN

SEQ ID NO: 2634268 - protein, 4 aa, Entamoeba histolytica
KPSH

SEQ ID NO: 2634269 - protein, 8 aa, Entamoeba histolytica
KPSHGPHG

SEQ ID NO: 2634270 - protein, 15 aa, Entamoeba histolytica
KPSIQTLSPDEEQEE

SEQ ID NO: 2634271 - protein, 9 aa, Entamoeba histolytica
KPSISPFPP

SEQ ID NO: 2634272 - protein, 5 aa, Entamoeba histolytica
KPSKK

SEQ ID NO: 2634273 - protein, 9 aa, Entamoeba histolytica
KPSKKTTTT

SEQ ID NO: 2634274 - protein, 7 aa, Entamoeba histolytica
KPSKQSI

SEQ ID NO: 2634275 - protein, 4 aa, Entamoeba histolytica
KPSL

SEQ ID NO: 2634276 - protein, 5 aa, Entamoeba histolytica
KPSLE

SEQ ID NO: 2634277 - protein, 6 aa, Entamoeba histolytica
KPSMDK

SEQ ID NO: 2634278 - protein, 5 aa, Entamoeba histolytica
KPSNA

SEQ ID NO: 2634279 - protein, 5 aa, Entamoeba histolytica
KPSNL

SEQ ID NO: 2634280 - protein, 7 aa, Entamoeba histolytica
KPSNNQI

SEQ ID NO: 2634281 - protein, 14 aa, Entamoeba histolytica
KPSNTNQTNTPTPH

SEQ ID NO: 2634282 - protein, 6 aa, Entamoeba histolytica
KPSPVD

SEQ ID NO: 2634283 - protein, 5 aa, Entamoeba histolytica
KPSQI

SEQ ID NO: 2634284 - protein, 14 aa, Entamoeba histolytica
KPSRDKSYSLGTTT

SEQ ID NO: 2634285 - protein, 7 aa, Entamoeba histolytica
KPSREKI

SEQ ID NO: 2634286 - protein, 10 aa, Entamoeba histolytica
KPSSAARLDP

SEQ ID NO: 2634287 - protein, 7 aa, Entamoeba histolytica
KPSSALS

SEQ ID NO: 2634288 - protein, 7 aa, Entamoeba histolytica
KPSSDES

SEQ ID NO: 2634289 - protein, 15 aa, Entamoeba histolytica
KPSSEATRTKTTQQT

SEQ ID NO: 2634290 - protein, 7 aa, Entamoeba histolytica
KPSSEKL

SEQ ID NO: 2634291 - protein, 6 aa, Entamoeba histolytica
KPSSFE

SEQ ID NO: 2634292 - protein, 6 aa, Entamoeba histolytica
KPSSIP

SEQ ID NO: 2634293 - protein, 9 aa, Entamoeba histolytica
KPSSNQSNC

SEQ ID NO: 2634294 - protein, 8 aa, Entamoeba histolytica
KPSSSRYF

SEQ ID NO: 2634295 - protein, 6 aa, Entamoeba histolytica
KPSTEI

SEQ ID NO: 2634296 - protein, 15 aa, Entamoeba histolytica
KPSTVLPESPSDDQF

SEQ ID NO: 2634297 - protein, 22 aa, Entamoeba histolytica
KPSVMQKRKETPSNHSQEQRYD

SEQ ID NO: 2634298 - protein, 6 aa, Entamoeba histolytica
KPSYNN

SEQ ID NO: 2634299 - protein, 6 aa, Entamoeba histolytica
KPSYRT

SEQ ID NO: 2634300 - protein, 6 aa, Entamoeba histolytica
KPSYYK

SEQ ID NO: 2634301 - protein, 10 aa, Entamoeba histolytica
KPTAINVPGY

SEQ ID NO: 2634302 - protein, 12 aa, Entamoeba histolytica
KPTASDEEIKKA

SEQ ID NO: 2634303 - protein, 9 aa, Entamoeba histolytica
KPTASDSSS

SEQ ID NO: 2634304 - protein, 7 aa, Entamoeba histolytica
KPTATPN

SEQ ID NO: 2634305 - protein, 12 aa, Entamoeba histolytica
KPTDCRRRLFQD

SEQ ID NO: 2634306 - protein, 7 aa, Entamoeba histolytica
KPTEENL

SEQ ID NO: 2634307 - protein, 5 aa, Entamoeba histolytica
KPTEK

SEQ ID NO: 2634308 - protein, 7 aa, Entamoeba histolytica
KPTGDFP

SEQ ID NO: 2634309 - protein, 8 aa, Entamoeba histolytica
KPTGEKSL

SEQ ID NO: 2634310 - protein, 17 aa, Entamoeba histolytica
KPTGSSQKISQPQQQVE

SEQ ID NO: 2634311 - protein, 11 aa, Entamoeba histolytica
KPTILTTPREV

SEQ ID NO: 2634312 - protein, 6 aa, Entamoeba histolytica
KPTIVS

SEQ ID NO: 2634313 - protein, 15 aa, Entamoeba histolytica
KPTIVTDENGKKKLG

SEQ ID NO: 2634314 - protein, 5 aa, Entamoeba histolytica
KPTLE

SEQ ID NO: 2634315 - protein, 6 aa, Entamoeba histolytica
KPTLTS

SEQ ID NO: 2634316 - protein, 4 aa, Entamoeba histolytica
KPTN

SEQ ID NO: 2634317 - protein, 7 aa, Entamoeba histolytica
KPTPEQL

SEQ ID NO: 2634318 - protein, 5 aa, Entamoeba histolytica
KPTPL

SEQ ID NO: 2634319 - protein, 7 aa, Entamoeba histolytica
KPTPLSN

SEQ ID NO: 2634320 - protein, 36 aa, Entamoeba histolytica
KPTPSFKKSATQSSTIEEKQKEGMKQETNQQTEEVD

SEQ ID NO: 2634321 - protein, 14 aa, Entamoeba histolytica
KPTPTISDDQLNRI

SEQ ID NO: 2634322 - protein, 16 aa, Entamoeba histolytica
KPTQKKEENDSKNILP

SEQ ID NO: 2634323 - protein, 8 aa, Entamoeba histolytica
KPTRIQEN

SEQ ID NO: 2634324 - protein, 5 aa, Entamoeba histolytica
KPTSF

SEQ ID NO: 2634325 - protein, 9 aa, Entamoeba histolytica
KPTSKKGYC

SEQ ID NO: 2634326 - protein, 5 aa, Entamoeba histolytica
KPTSL

SEQ ID NO: 2634327 - protein, 7 aa, Entamoeba histolytica
KPTSLNK

SEQ ID NO: 2634328 - protein, 7 aa, Entamoeba histolytica
KPTSLNR

SEQ ID NO: 2634329 - protein, 8 aa, Entamoeba histolytica
KPTTKREE

SEQ ID NO: 2634330 - protein, 5 aa, Entamoeba histolytica
KPTWN

SEQ ID NO: 2634331 - protein, 13 aa, Entamoeba histolytica
KPVAESLNERPHS

SEQ ID NO: 2634332 - protein, 8 aa, Entamoeba histolytica
KPVATPQQ

SEQ ID NO: 2634333 - protein, 12 aa, Entamoeba histolytica
KPVDDQKTSTEK

SEQ ID NO: 2634334 - protein, 19 aa, Entamoeba histolytica
KPVEAKKQLEDTLKGNGSV

SEQ ID NO: 2634335 - protein, 5 aa, Entamoeba histolytica
KPVET

SEQ ID NO: 2634336 - protein, 4 aa, Entamoeba histolytica
KPVF

SEQ ID NO: 2634337 - protein, 7 aa, Entamoeba histolytica
KPVISSN

SEQ ID NO: 2634338 - protein, 14 aa, Entamoeba histolytica
KPVKAENSHKKKLT

SEQ ID NO: 2634339 - protein, 11 aa, Entamoeba histolytica
KPVKKASVTQQ

SEQ ID NO: 2634340 - protein, 4 aa, Entamoeba histolytica
KPVN

SEQ ID NO: 2634341 - protein, 6 aa, Entamoeba histolytica
KPVNCT

SEQ ID NO: 2634342 - protein, 7 aa, Entamoeba histolytica
KPVPATS

SEQ ID NO: 2634343 - protein, 28 aa, Entamoeba histolytica
KPVPKASVTTQAKSQENTQQKKKSKCLL

SEQ ID NO: 2634344 - protein, 28 aa, Entamoeba histolytica
KPVPKASVTTQAKSQESTQQKKKSKCLL

SEQ ID NO: 2634345 - protein, 15 aa, Entamoeba histolytica
KPVPNSGNVFSSKKK

SEQ ID NO: 2634346 - protein, 8 aa, Entamoeba histolytica
KPVPQQPA

SEQ ID NO: 2634347 - protein, 7 aa, Entamoeba histolytica
KPVPTGK

SEQ ID NO: 2634348 - protein, 7 aa, Entamoeba histolytica
KPVSRTD

SEQ ID NO: 2634349 - protein, 15 aa, Entamoeba histolytica
KPVTKEIKTAQKAEV

SEQ ID NO: 2634350 - protein, 4 aa, Entamoeba histolytica
KPWN

SEQ ID NO: 2634351 - protein, 6 aa, Entamoeba histolytica
KPYDWE

SEQ ID NO: 2634352 - protein, 7 aa, Entamoeba histolytica
KPYEPSF

SEQ ID NO: 2634353 - protein, 6 aa, Entamoeba histolytica
KPYEVQ

SEQ ID NO: 2634354 - protein, 9 aa, Entamoeba histolytica
KPYGLKSDT

SEQ ID NO: 2634355 - protein, 4 aa, Entamoeba histolytica
KPYH

SEQ ID NO: 2634356 - protein, 6 aa, Entamoeba histolytica
KPYHHK

SEQ ID NO: 2634357 - protein, 11 aa, Entamoeba histolytica
KPYIPKRNKKV

SEQ ID NO: 2634358 - protein, 7 aa, Entamoeba histolytica
KPYNKGD

SEQ ID NO: 2634359 - protein, 5 aa, Entamoeba histolytica
KPYYA

SEQ ID NO: 2634360 - protein, 19 aa, Entamoeba histolytica
KQAAMDDETKEELKQAEEE

SEQ ID NO: 2634361 - protein, 16 aa, Entamoeba histolytica
KQAEAKKLENQFGDIK

SEQ ID NO: 2634362 - protein, 51 aa, Entamoeba histolytica
KQAEEKRKKEEQQKTLETIKGNTSTGSYTAASDNIPPNTQETTSNQQYTSQ

SEQ ID NO: 2634363 - protein, 6 aa, Entamoeba histolytica
KQAFNG

SEQ ID NO: 2634364 - protein, 5 aa, Entamoeba histolytica
KQAFP

SEQ ID NO: 2634365 - protein, 6 aa, Entamoeba histolytica
KQAGVE

SEQ ID NO: 2634366 - protein, 7 aa, Entamoeba histolytica
KQAGVEN

SEQ ID NO: 2634367 - protein, 5 aa, Entamoeba histolytica
KQAIA

SEQ ID NO: 2634368 - protein, 28 aa, Entamoeba histolytica
KQAKDPTFADPSVGKRSNEEQQENGIGG

SEQ ID NO: 2634369 - protein, 11 aa, Entamoeba histolytica
KQAKKEESKFT

SEQ ID NO: 2634370 - protein, 7 aa, Entamoeba histolytica
KQALQDN

SEQ ID NO: 2634371 - protein, 5 aa, Entamoeba histolytica
KQANE

SEQ ID NO: 2634372 - protein, 8 aa, Entamoeba histolytica
KQANQEGI

SEQ ID NO: 2634373 - protein, 11 aa, Entamoeba histolytica
KQAPGTFKEDK

SEQ ID NO: 2634374 - protein, 13 aa, Entamoeba histolytica
KQAPTPSKSPSSS

SEQ ID NO: 2634375 - protein, 10 aa, Entamoeba histolytica
KQAQEESAGI

SEQ ID NO: 2634376 - protein, 8 aa, Entamoeba histolytica
KQAQGDFN

SEQ ID NO: 2634377 - protein, 8 aa, Entamoeba histolytica
KQARLEKP

SEQ ID NO: 2634378 - protein, 6 aa, Entamoeba histolytica
KQARTI

SEQ ID NO: 2634379 - protein, 5 aa, Entamoeba histolytica
KQARV

SEQ ID NO: 2634380 - protein, 4 aa, Entamoeba histolytica
KQAS

SEQ ID NO: 2634381 - protein, 11 aa, Entamoeba histolytica
KQASTDPASRG

SEQ ID NO: 2634382 - protein, 6 aa, Entamoeba histolytica
KQATLV

SEQ ID NO: 2634383 - protein, 6 aa, Entamoeba histolytica
KQCEGS

SEQ ID NO: 2634384 - protein, 4 aa, Entamoeba histolytica
KQCF

SEQ ID NO: 2634385 - protein, 10 aa, Entamoeba histolytica
KQCSRTNTPM

SEQ ID NO: 2634386 - protein, 6 aa, Entamoeba histolytica
KQDAEF

SEQ ID NO: 2634387 - protein, 7 aa, Entamoeba histolytica
KQDDEMK

SEQ ID NO: 2634388 - protein, 11 aa, Entamoeba histolytica
KQDDSEENKYP

SEQ ID NO: 2634389 - protein, 5 aa, Entamoeba histolytica
KQDDW

SEQ ID NO: 2634390 - protein, 38 aa, Entamoeba histolytica
KQDEFEKTLKEATDRYTEQGKKKKKEKKKKKIEEERKK

SEQ ID NO: 2634391 - protein, 6 aa, Entamoeba histolytica
KQDGKT

SEQ ID NO: 2634392 - protein, 6 aa, Entamoeba histolytica
KQDGNV

SEQ ID NO: 2634393 - protein, 12 aa, Entamoeba histolytica
KQDITDKDVEEY

SEQ ID NO: 2634394 - protein, 9 aa, Entamoeba histolytica
KQDKPVPKL

SEQ ID NO: 2634395 - protein, 7 aa, Entamoeba histolytica
KQDNESD

SEQ ID NO: 2634396 - protein, 6 aa, Entamoeba histolytica
KQDQNV

SEQ ID NO: 2634397 - protein, 16 aa, Entamoeba histolytica
KQDRLEEEATKSLRIA

SEQ ID NO: 2634398 - protein, 7 aa, Entamoeba histolytica
KQDSNDK

SEQ ID NO: 2634399 - protein, 8 aa, Entamoeba histolytica
KQDTFSSL

SEQ ID NO: 2634400 - protein, 8 aa, Entamoeba histolytica
KQDTKNYT

SEQ ID NO: 2634401 - protein, 7 aa, Entamoeba histolytica
KQDTPIN

SEQ ID NO: 2634402 - protein, 14 aa, Entamoeba histolytica
KQDVQDRSDNPHWN

SEQ ID NO: 2634403 - protein, 7 aa, Entamoeba histolytica
KQDYREK

SEQ ID NO: 2634404 - protein, 6 aa, Entamoeba histolytica
KQEAVE

SEQ ID NO: 2634405 - protein, 4 aa, Entamoeba histolytica
KQED

SEQ ID NO: 2634406 - protein, 6 aa, Entamoeba histolytica
KQEDGK

SEQ ID NO: 2634407 - protein, 6 aa, Entamoeba histolytica
KQEDVE

SEQ ID NO: 2634408 - protein, 14 aa, Entamoeba histolytica
KQEEDNKKPHIPSS

SEQ ID NO: 2634409 - protein, 8 aa, Entamoeba histolytica
KQEEEMKT

SEQ ID NO: 2634410 - protein, 7 aa, Entamoeba histolytica
KQEEHYE

SEQ ID NO: 2634411 - protein, 6 aa, Entamoeba histolytica
KQEEPA

SEQ ID NO: 2634412 - protein, 11 aa, Entamoeba histolytica
KQEETKTNEIK

SEQ ID NO: 2634413 - protein, 12 aa, Entamoeba histolytica
KQEETNSKTMKN

SEQ ID NO: 2634414 - protein, 7 aa, Entamoeba histolytica
KQEEWEN

SEQ ID NO: 2634415 - protein, 4 aa, Entamoeba histolytica
KQEF

SEQ ID NO: 2634416 - protein, 6 aa, Entamoeba histolytica
KQEGIE

SEQ ID NO: 2634417 - protein, 8 aa, Entamoeba histolytica
KQEIDNSA

SEQ ID NO: 2634418 - protein, 5 aa, Entamoeba histolytica
KQEIR

SEQ ID NO: 2634419 - protein, 17 aa, Entamoeba histolytica
KQEITPENNIVNQSTEI

SEQ ID NO: 2634420 - protein, 9 aa, Entamoeba histolytica
KQEKEKYET

SEQ ID NO: 2634421 - protein, 5 aa, Entamoeba histolytica
KQEKI

SEQ ID NO: 2634422 - protein, 9 aa, Entamoeba histolytica
KQEKKTQTH

SEQ ID NO: 2634423 - protein, 8 aa, Entamoeba histolytica
KQEKVGDN

SEQ ID NO: 2634424 - protein, 10 aa, Entamoeba histolytica
KQELSDEKYN

SEQ ID NO: 2634425 - protein, 6 aa, Entamoeba histolytica
KQELTQ

SEQ ID NO: 2634426 - protein, 4 aa, Entamoeba histolytica
KQEN

SEQ ID NO: 2634427 - protein, 21 aa, Entamoeba histolytica
KQENKALKSGKKFDKKQKITK

SEQ ID NO: 2634428 - protein, 10 aa, Entamoeba histolytica
KQENKPLTPN

SEQ ID NO: 2634429 - protein, 10 aa, Entamoeba histolytica
KQENKVNSSI

SEQ ID NO: 2634430 - protein, 6 aa, Entamoeba histolytica
KQENNL

SEQ ID NO: 2634431 - protein, 7 aa, Entamoeba histolytica
KQENNNI

SEQ ID NO: 2634432 - protein, 7 aa, Entamoeba histolytica
KQENTFD

SEQ ID NO: 2634433 - protein, 36 aa, Entamoeba histolytica
KQEPKEDGLDEIKEQNEESQNEEKTVTEETELDKIE

SEQ ID NO: 2634434 - protein, 8 aa, Entamoeba histolytica
KQEPKPKL

SEQ ID NO: 2634435 - protein, 5 aa, Entamoeba histolytica
KQEQL

SEQ ID NO: 2634436 - protein, 87 aa, Entamoeba histolytica; identical to SEQ ID NO: 2439159

SEQ ID NO: 2634437 - protein, 4 aa, Entamoeba histolytica
KQER

SEQ ID NO: 2634438 - protein, 8 aa, Entamoeba histolytica
KQESPQNK

SEQ ID NO: 2634439 - protein, 10 aa, Entamoeba histolytica
KQESSGSYST

SEQ ID NO: 2634440 - protein, 6 aa, Entamoeba histolytica
KQETAA

SEQ ID NO: 2634441 - protein, 6 aa, Entamoeba histolytica
KQETIE

SEQ ID NO: 2634442 - protein, 9 aa, Entamoeba histolytica
KQETKDSFN

SEQ ID NO: 2634443 - protein, 6 aa, Entamoeba histolytica
KQETNG

SEQ ID NO: 2634444 - protein, 11 aa, Entamoeba histolytica
KQETTSKNPEE

SEQ ID NO: 2634445 - protein, 6 aa, Entamoeba histolytica
KQEVKD

SEQ ID NO: 2634446 - protein, 4 aa, Entamoeba histolytica
KQEY

SEQ ID NO: 2634447 - protein, 9 aa, Entamoeba histolytica
KQEYEAEVE

SEQ ID NO: 2634448 - protein, 7 aa, Entamoeba histolytica
KQFEEEE

SEQ ID NO: 2634449 - protein, 10 aa, Entamoeba histolytica
KQFEQAQDNI

SEQ ID NO: 2634450 - protein, 6 aa, Entamoeba histolytica
KQFNEN

SEQ ID NO: 2634451 - protein, 5 aa, Entamoeba histolytica
KQFQD

SEQ ID NO: 2634452 - protein, 8 aa, Entamoeba histolytica
KQFSDEQI

SEQ ID NO: 2634453 - protein, 6 aa, Entamoeba histolytica
KQGADL

SEQ ID NO: 2634454 - protein, 20 aa, Entamoeba histolytica
KQGEDEDNKKKEDNKTEEIN

SEQ ID NO: 2634455 - protein, 6 aa, Entamoeba histolytica
KQGEPL

SEQ ID NO: 2634456 - protein, 8 aa, Entamoeba histolytica
KQGEPNCD

SEQ ID NO: 2634457 - protein, 9 aa, Entamoeba histolytica
KQGEPNCDK

SEQ ID NO: 2634458 - protein, 4 aa, Entamoeba histolytica
KQGF

SEQ ID NO: 2634459 - protein, 8 aa, Entamoeba histolytica
KQGFDPDL

SEQ ID NO: 2634460 - protein, 6 aa, Entamoeba histolytica
KQGFSR

SEQ ID NO: 2634461 - protein, 6 aa, Entamoeba histolytica
KQGGIN

SEQ ID NO: 2634462 - protein, 9 aa, Entamoeba histolytica
KQGGSHKSW

SEQ ID NO: 2634463 - protein, 5 aa, Entamoeba histolytica
KQGGV

SEQ ID NO: 2634464 - protein, 4 aa, Entamoeba histolytica
KQGI

SEQ ID NO: 2634465 - protein, 9 aa, Entamoeba histolytica
KQGKDLVKK

SEQ ID NO: 2634466 - protein, 11 aa, Entamoeba histolytica
KQGKLKATEIE

SEQ ID NO: 2634467 - protein, 7 aa, Entamoeba histolytica
KQGMYEE

SEQ ID NO: 2634468 - protein, 4 aa, Entamoeba histolytica
KQGN

SEQ ID NO: 2634469 - protein, 5 aa, Entamoeba histolytica
KQGNE

SEQ ID NO: 2634470 - protein, 12 aa, Entamoeba histolytica
KQGNLSQSIRDN

SEQ ID NO: 2634471 - protein, 11 aa, Entamoeba histolytica
KQGNSLKETCE

SEQ ID NO: 2634472 - protein, 6 aa, Entamoeba histolytica
KQGNTS

SEQ ID NO: 2634473 - protein, 5 aa, Entamoeba histolytica
KQGQE

SEQ ID NO: 2634474 - protein, 6 aa, Entamoeba histolytica
KQGRSD

SEQ ID NO: 2634475 - protein, 25 aa, Entamoeba histolytica
KQGSAPKGKVSKREKYRGNSSFNKH

SEQ ID NO: 2634476 - protein, 10 aa, Entamoeba histolytica
KQGVGNTQKG

SEQ ID NO: 2634477 - protein, 13 aa, Entamoeba histolytica
KQGVQDEDKDGNT

SEQ ID NO: 2634478 - protein, 9 aa, Entamoeba histolytica
KQHENENQD

SEQ ID NO: 2634479 - protein, 9 aa, Entamoeba histolytica
KQHGFDPRE

SEQ ID NO: 2634480 - protein, 14 aa, Entamoeba histolytica
KQHKGVSQQKAESL

SEQ ID NO: 2634481 - protein, 8 aa, Entamoeba histolytica
KQHKPDVS

SEQ ID NO: 2634482 - protein, 13 aa, Entamoeba histolytica
KQHKSQKKEEKKL

SEQ ID NO: 2634483 - protein, 10 aa, Entamoeba histolytica
KQHNEEKPYI

SEQ ID NO: 2634484 - protein, 7 aa, Entamoeba histolytica
KQHNENL

SEQ ID NO: 2634485 - protein, 44 aa, Entamoeba histolytica
KQHPIEKKEPKPTKTNRGKKIRRKISEEEEYEEKRTKKRKHTKA

SEQ ID NO: 2634486 - protein, 6 aa, Entamoeba histolytica
KQHSQV

SEQ ID NO: 2634487 - protein, 5 aa, Entamoeba histolytica
KQHYN

SEQ ID NO: 2634488 - protein, 12 aa, Entamoeba histolytica
KQIAQELEQKKE

SEQ ID NO: 2634489 - protein, 6 aa, Entamoeba histolytica
KQIDDG

SEQ ID NO: 2634490 - protein, 9 aa, Entamoeba histolytica
KQIEDSKLN

SEQ ID NO: 2634491 - protein, 16 aa, Entamoeba histolytica
KQIEERDKGMKEKNDK

SEQ ID NO: 2634492 - protein, 43 aa, Entamoeba histolytica
KQIEKKKNDDDLEIESDSDDWSKKSLINKDNPKRNEKREDDDI

SEQ ID NO: 2634493 - protein, 9 aa, Entamoeba histolytica
KQIEKNKDK

SEQ ID NO: 2634494 - protein, 5 aa, Entamoeba histolytica
KQIGD

SEQ ID NO: 2634495 - protein, 7 aa, Entamoeba histolytica
KQIGEKN

SEQ ID NO: 2634496 - protein, 12 aa, Entamoeba histolytica
KQIKKKQNESNS

SEQ ID NO: 2634497 - protein, 15 aa, Entamoeba histolytica
KQIKKTTGNTKKQLQ

SEQ ID NO: 2634498 - protein, 6 aa, Entamoeba histolytica
KQIKRD

SEQ ID NO: 2634499 - protein, 8 aa, Entamoeba histolytica
KQIKRKKK

SEQ ID NO: 2634500 - protein, 12 aa, Entamoeba histolytica
KQINDTGATPYV

SEQ ID NO: 2634501 - protein, 10 aa, Entamoeba histolytica
KQINKEQPKM

SEQ ID NO: 2634502 - protein, 10 aa, Entamoeba histolytica
KQIPKEKKDG

SEQ ID NO: 2634503 - protein, 7 aa, Entamoeba histolytica
KQIPPTG

SEQ ID NO: 2634504 - protein, 8 aa, Entamoeba histolytica
KQIPQKSE

SEQ ID NO: 2634505 - protein, 5 aa, Entamoeba histolytica
KQIPS

SEQ ID NO: 2634506 - protein, 10 aa, Entamoeba histolytica
KQIPSKRSPH

SEQ ID NO: 2634507 - protein, 8 aa, Entamoeba histolytica
KQIQQGGI

SEQ ID NO: 2634508 - protein, 6 aa, Entamoeba histolytica
KQIRQQ

SEQ ID NO: 2634509 - protein, 11 aa, Entamoeba histolytica
KQIRYNDETVR

SEQ ID NO: 2634510 - protein, 6 aa, Entamoeba histolytica
KQISEL

SEQ ID NO: 2634511 - protein, 6 aa, Entamoeba histolytica
KQISNS

SEQ ID NO: 2634512 - protein, 23 aa, Entamoeba histolytica
KQISPEKKDRKKYEKRNVISSTN

SEQ ID NO: 2634513 - protein, 8 aa, Entamoeba histolytica
KQISSKGY

SEQ ID NO: 2634514 - protein, 5 aa, Entamoeba histolytica
KQKAK

SEQ ID NO: 2634515 - protein, 8 aa, Entamoeba histolytica
KQKAPNID

SEQ ID NO: 2634516 - protein, 7 aa, Entamoeba histolytica
KQKAQKS

SEQ ID NO: 2634517 - protein, 13 aa, Entamoeba histolytica
KQKASKEDQDLVF

SEQ ID NO: 2634518 - protein, 4 aa, Entamoeba histolytica
KQKD

SEQ ID NO: 2634519 - protein, 7 aa, Entamoeba histolytica
KQKDAIK

SEQ ID NO: 2634520 - protein, 4 aa, Entamoeba histolytica
KQKE

SEQ ID NO: 2634521 - protein, 9 aa, Entamoeba histolytica
KQKEDETKN

SEQ ID NO: 2634522 - protein, 36 aa, Entamoeba histolytica
KQKEDQNKSQTTKETEKYQTTNQEKISQKSCDHQNI

SEQ ID NO: 2634523 - protein, 8 aa, Entamoeba histolytica
KQKEEALK

SEQ ID NO: 2634524 - protein, 9 aa, Entamoeba histolytica
KQKEEYESQ

SEQ ID NO: 2634525 - protein, 5 aa, Entamoeba histolytica
KQKEI

SEQ ID NO: 2634526 - protein, 5 aa, Entamoeba histolytica
KQKEK

SEQ ID NO: 2634527 - protein, 8 aa, Entamoeba histolytica
KQKELEKQ

SEQ ID NO: 2634528 - protein, 11 aa, Entamoeba histolytica
KQKENVLNGTT

SEQ ID NO: 2634529 - protein, 8 aa, Entamoeba histolytica
KQKEQETF

SEQ ID NO: 2634530 - protein, 17 aa, Entamoeba histolytica
KQKEQIKSQNSQELQKN

SEQ ID NO: 2634531 - protein, 38 aa, Entamoeba histolytica
KQKEQQIGRGKKKEGIDSYQRKGESNVSDTTKDVRKTP

SEQ ID NO: 2634532 - protein, 6 aa, Entamoeba histolytica
KQKESF

SEQ ID NO: 2634533 - protein, 30 aa, Entamoeba histolytica
KQKEVYEIEGEKEEKEEVTTNDKKSTESDL

SEQ ID NO: 2634534 - protein, 6 aa, Entamoeba histolytica
KQKGDG

SEQ ID NO: 2634535 - protein, 8 aa, Entamoeba histolytica
KQKGENDL

SEQ ID NO: 2634536 - protein, 5 aa, Entamoeba histolytica
KQKGL

SEQ ID NO: 2634537 - protein, 10 aa, Entamoeba histolytica
KQKGNDNDNF

SEQ ID NO: 2634538 - protein, 8 aa, Entamoeba histolytica
KQKGSVVD

SEQ ID NO: 2634539 - protein, 10 aa, Entamoeba histolytica
KQKIGERPDP

SEQ ID NO: 2634540 - protein, 29 aa, Entamoeba histolytica
KQKIIPNNSFNSLSSKESEQNTKSQKQQL

SEQ ID NO: 2634541 - protein, 8 aa, Entamoeba histolytica
KQKKAGYV

SEQ ID NO: 2634542 - protein, 20 aa, Entamoeba histolytica
KQKKDKYNINEESEEEEEFT

SEQ ID NO: 2634543 - protein, 16 aa, Entamoeba histolytica
KQKKEEEERKKKLEAE

SEQ ID NO: 2634544 - protein, 12 aa, Entamoeba histolytica
KQKKEHAYDEEQ

SEQ ID NO: 2634545 - protein, 6 aa, Entamoeba histolytica
KQKKEY

SEQ ID NO: 2634546 - protein, 10 aa, Entamoeba histolytica
KQKKKRISPE

SEQ ID NO: 2634547 - protein, 10 aa, Entamoeba histolytica
KQKKQQIKDS

SEQ ID NO: 2634548 - protein, 41 aa, Entamoeba histolytica
KQKKQQLSERRERKRGVAEKETEKNVQTEEELVSKTKTKLK

SEQ ID NO: 2634549 - protein, 7 aa, Entamoeba histolytica
KQKLTKV

SEQ ID NO: 2634550 - protein, 20 aa, Entamoeba histolytica
KQKNDPDEDKSVDDDTNYFS

SEQ ID NO: 2634551 - protein, 60 aa, Entamoeba histolytica
KQKNEEIDNIKKEKEVLSKENKQLKEQISSAEENSNSIIENEKKEKEDLKHQNEELKQQI

SEQ ID NO: 2634552 - protein, 9 aa, Entamoeba histolytica
KQKNELKSF

SEQ ID NO: 2634553 - protein, 7 aa, Entamoeba histolytica
KQKNPSL

SEQ ID NO: 2634554 - protein, 9 aa, Entamoeba histolytica
KQKPEPINV

SEQ ID NO: 2634555 - protein, 17 aa, Entamoeba histolytica
KQKPIPGKVNKEEVEST

SEQ ID NO: 2634556 - protein, 10 aa, Entamoeba histolytica
KQKPVSSLTE

SEQ ID NO: 2634557 - protein, 19 aa, Entamoeba histolytica
KQKQGIQKIEEEKKTQHTM

SEQ ID NO: 2634558 - protein, 13 aa, Entamoeba histolytica
KQKQSNEDDLSSL

SEQ ID NO: 2634559 - protein, 4 aa, Entamoeba histolytica
KQKR

SEQ ID NO: 2634560 - protein, 13 aa, Entamoeba histolytica
KQKRDTSKREYTS

SEQ ID NO: 2634561 - protein, 9 aa, Entamoeba histolytica
KQKREEESL

SEQ ID NO: 2634562 - protein, 6 aa, Entamoeba histolytica
KQKRID

SEQ ID NO: 2634563 - protein, 61 aa, Entamoeba histolytica
KQKRMESYSPRSSSSENDDCQLKRKRGRSRSKSKEKQSRDSRENSSLGTVGDSPHASPLQN

SEQ ID NO: 2634564 - protein, 7 aa, Entamoeba histolytica
KQKRTSY

SEQ ID NO: 2634565 - protein, 9 aa, Entamoeba histolytica
KQKSKEKKY

SEQ ID NO: 2634566 - protein, 26 aa, Entamoeba histolytica
KQKSLTEKSLKDEKTIDELRKENQRL

SEQ ID NO: 2634567 - protein, 121 aa, Entamoeba histolytica
KQKSNIEKESNTEKDQQNEEQQNNETNQEEVEEEEVEEEVKEEDNQGDKETKESETNSQRKCRESNFESQEGVSHGDPNIRGDSETKTGTTVPDRCDSQEDKGSIEKVKQNEEQENTEISK

SEQ ID NO: 2634568 - protein, 15 aa, Entamoeba histolytica
KQKSPGKTNPSTTFT

SEQ ID NO: 2634569 - protein, 198 aa, Entamoeba histolytica
KQKSPSETKQKTESTTGEGTDGTSNTDGQNPKASTSTTEGGDKNEATHGNNEQETGTSGAGGEEGQKQDEQHDKGTNDSTNEQGKEQNNKGATTDGNGEPATNNNNKGEEGKKEEKVKPKNETTPDEKDTKTNNDKDEKNNSETGTSDNTKNNSNEKQQTTSNDKQNNTTNTNSENKMNEKSNNNHDEQNEQHNIDNA

SEQ ID NO: 2634570 - protein, 10 aa, Entamoeba histolytica
KQKSSVTRQK

SEQ ID NO: 2634571 - protein, 20 aa, Entamoeba histolytica
KQKSVNSGNQKLDGTSVNNI

SEQ ID NO: 2634572 - protein, 8 aa, Entamoeba histolytica
KQKTESIY

SEQ ID NO: 2634573 - protein, 13 aa, Entamoeba histolytica
KQKTTDKMKEKAD

SEQ ID NO: 2634574 - protein, 11 aa, Entamoeba histolytica
KQKVEDKPSDL

SEQ ID NO: 2634575 - protein, 6 aa, Entamoeba histolytica
KQKYKK

SEQ ID NO: 2634576 - protein, 6 aa, Entamoeba histolytica
KQLADK

SEQ ID NO: 2634577 - protein, 4 aa, Entamoeba histolytica
KQLD

SEQ ID NO: 2634578 - protein, 7 aa, Entamoeba histolytica
KQLEDQN

SEQ ID NO: 2634579 - protein, 9 aa, Entamoeba histolytica
KQLEEENQN

SEQ ID NO: 2634580 - protein, 31 aa, Entamoeba histolytica
KQLEEERKKKEEERKKREEEERKKEEEEERL

SEQ ID NO: 2634581 - protein, 18 aa, Entamoeba histolytica
KQLEEQTKSQPKEKEHAK

SEQ ID NO: 2634582 - protein, 8 aa, Entamoeba histolytica
KQLENENE

SEQ ID NO: 2634583 - protein, 8 aa, Entamoeba histolytica
KQLGEGVQ

SEQ ID NO: 2634584 - protein, 9 aa, Entamoeba histolytica
KQLKEDNTI

SEQ ID NO: 2634585 - protein, 6 aa, Entamoeba histolytica
KQLKEE

SEQ ID NO: 2634586 - protein, 8 aa, Entamoeba histolytica
KQLKQANE

SEQ ID NO: 2634587 - protein, 9 aa, Entamoeba histolytica
KQLKYNEEE

SEQ ID NO: 2634588 - protein, 25 aa, Entamoeba histolytica
KQLNEKQKKEDKEKKEKTKVKHPEV

SEQ ID NO: 2634589 - protein, 27 aa, Entamoeba histolytica
KQLNEKVSATDYTPKLPPKMNQTSSKI

SEQ ID NO: 2634590 - protein, 9 aa, Entamoeba histolytica
KQLNKQEKM

SEQ ID NO: 2634591 - protein, 9 aa, Entamoeba histolytica
KQLNSESIT

SEQ ID NO: 2634592 - protein, 7 aa, Entamoeba histolytica
KQLPDDS

SEQ ID NO: 2634593 - protein, 8 aa, Entamoeba histolytica
KQLPSNPM

SEQ ID NO: 2634594 - protein, 6 aa, Entamoeba histolytica
KQLPSY

SEQ ID NO: 2634595 - protein, 17 aa, Entamoeba histolytica
KQLPTDITTEEQEESYA

SEQ ID NO: 2634596 - protein, 34 aa, Entamoeba histolytica
KQLPTQPLQNSMSTQPLQNSMSTQPLQKQVTRQQ

SEQ ID NO: 2634597 - protein, 6 aa, Entamoeba histolytica
KQLQNS

SEQ ID NO: 2634598 - protein, 24 aa, Entamoeba histolytica
KQLRKQNNELEDHADDAENADDDY

SEQ ID NO: 2634599 - protein, 18 aa, Entamoeba histolytica
KQLSKESFEEKEQKSKIK

SEQ ID NO: 2634600 - protein, 11 aa, Entamoeba histolytica
KQLSKSTEAYQ

SEQ ID NO: 2634601 - protein, 11 aa, Entamoeba histolytica
KQLSQQHTTSI

SEQ ID NO: 2634602 - protein, 14 aa, Entamoeba histolytica
KQLSSEDDQTSTFC

SEQ ID NO: 2634603 - protein, 6 aa, Entamoeba histolytica
KQLSYD

SEQ ID NO: 2634604 - protein, 22 aa, Entamoeba histolytica
KQLTDKRKDKLARITGRRNSLE

SEQ ID NO: 2634605 - protein, 15 aa, Entamoeba histolytica
KQLTEEMKEKMEEEE

SEQ ID NO: 2634606 - protein, 12 aa, Entamoeba histolytica
KQLTESNFEKGD

SEQ ID NO: 2634607 - protein, 8 aa, Entamoeba histolytica
KQLTNKIE

SEQ ID NO: 2634608 - protein, 6 aa, Entamoeba histolytica
KQLTTI

SEQ ID NO: 2634609 - protein, 5 aa, Entamoeba histolytica
KQMDK

SEQ ID NO: 2634610 - protein, 9 aa, Entamoeba histolytica
KQMEEDIEK

SEQ ID NO: 2634611 - protein, 4 aa, Entamoeba histolytica
KQMK

SEQ ID NO: 2634612 - protein, 9 aa, Entamoeba histolytica
KQMNETARS

SEQ ID NO: 2634613 - protein, 10 aa, Entamoeba histolytica
KQMQEQNKMN

SEQ ID NO: 2634614 - protein, 8 aa, Entamoeba histolytica
KQMTGYGS

SEQ ID NO: 2634615 - protein, 10 aa, Entamoeba histolytica
KQMTIQPDSV

SEQ ID NO: 2634616 - protein, 8 aa, Entamoeba histolytica
KQMTTQSP

SEQ ID NO: 2634617 - protein, 25 aa, Entamoeba histolytica
KQNDDTQNELSLPSIKSNVNLSNNL

SEQ ID NO: 2634618 - protein, 10 aa, Entamoeba histolytica
KQNDENGDGV

SEQ ID NO: 2634619 - protein, 13 aa, Entamoeba histolytica
KQNDNKLSKLLKE

SEQ ID NO: 2634620 - protein, 11 aa, Entamoeba histolytica
KQNDSEPTEED

SEQ ID NO: 2634621 - protein, 18 aa, Entamoeba histolytica
KQNEERKRVCEESSEDLL

SEQ ID NO: 2634622 - protein, 6 aa, Entamoeba histolytica
KQNEIS

SEQ ID NO: 2634623 - protein, 21 aa, Entamoeba histolytica
KQNEKRHNKQQEEKPKQEEQH

SEQ ID NO: 2634624 - protein, 6 aa, Entamoeba histolytica
KQNELP

SEQ ID NO: 2634625 - protein, 56 aa, Entamoeba histolytica
KQNEQQTQKVDENKNTNDETVNTSDENEHSMEQVDSNESGSEEQSQMENDDIKPIP

SEQ ID NO: 2634626 - protein, 4 aa, Entamoeba histolytica
KQNG

SEQ ID NO: 2634627 - protein, 6 aa, Entamoeba histolytica
KQNGNE

SEQ ID NO: 2634628 - protein, 7 aa, Entamoeba histolytica
KQNGTYE

SEQ ID NO: 2634629 - protein, 7 aa, Entamoeba histolytica
KQNGTYT

SEQ ID NO: 2634630 - protein, 5 aa, Entamoeba histolytica
KQNIH

SEQ ID NO: 2634631 - protein, 8 aa, Entamoeba histolytica
KQNINAKT

SEQ ID NO: 2634632 - protein, 6 aa, Entamoeba histolytica
KQNISQ

SEQ ID NO: 2634633 - protein, 24 aa, Entamoeba histolytica
KQNKAGSKKAASKGKKVGSKKTGK

SEQ ID NO: 2634634 - protein, 24 aa, Entamoeba histolytica
KQNKAGSKKAASKGKKVSSKKTGK

SEQ ID NO: 2634635 - protein, 10 aa, Entamoeba histolytica
KQNKESKEKI

SEQ ID NO: 2634636 - protein, 5 aa, Entamoeba histolytica
KQNKF

SEQ ID NO: 2634637 - protein, 7 aa, Entamoeba histolytica
KQNKGNI

SEQ ID NO: 2634638 - protein, 13 aa, Entamoeba histolytica
KQNKMINNGNYQE

SEQ ID NO: 2634639 - protein, 8 aa, Entamoeba histolytica
KQNKQATT

SEQ ID NO: 2634640 - protein, 10 aa, Entamoeba histolytica
KQNKSKERRC

SEQ ID NO: 2634641 - protein, 8 aa, Entamoeba histolytica
KQNKSLKT

SEQ ID NO: 2634642 - protein, 33 aa, Entamoeba histolytica
KQNKSNGIKKKPKRSINGNEVEEKKATRRKKNV

SEQ ID NO: 2634643 - protein, 4 aa, Entamoeba histolytica
KQNN

SEQ ID NO: 2634644 - protein, 17 aa, Entamoeba histolytica
KQNNCSVPMSNEIFMEL

SEQ ID NO: 2634645 - protein, 9 aa, Entamoeba histolytica
KQNNEDEGC

SEQ ID NO: 2634646 - protein, 9 aa, Entamoeba histolytica
KQNNKINEL

SEQ ID NO: 2634647 - protein, 44 aa, Entamoeba histolytica
KQNNSNSSSRSISPNSSEFPHDKSPSIKRRNSLSAFSPAAPSEF

SEQ ID NO: 2634648 - protein, 8 aa, Entamoeba histolytica
KQNPESAK

SEQ ID NO: 2634649 - protein, 7 aa, Entamoeba histolytica
KQNPQSF

SEQ ID NO: 2634650 - protein, 9 aa, Entamoeba histolytica
KQNPSRQSQ

SEQ ID NO: 2634651 - protein, 8 aa, Entamoeba histolytica
KQNPVQTK

SEQ ID NO: 2634652 - protein, 13 aa, Entamoeba histolytica
KQNQKEQSHAQSM

SEQ ID NO: 2634653 - protein, 6 aa, Entamoeba histolytica
KQNQMK

SEQ ID NO: 2634654 - protein, 6 aa, Entamoeba histolytica
KQNQTI

SEQ ID NO: 2634655 - protein, 6 aa, Entamoeba histolytica
KQNQTL

SEQ ID NO: 2634656 - protein, 6 aa, Entamoeba histolytica
KQNSHD

SEQ ID NO: 2634657 - protein, 9 aa, Entamoeba histolytica
KQNSNPKQF

SEQ ID NO: 2634658 - protein, 4 aa, Entamoeba histolytica
KQNT

SEQ ID NO: 2634659 - protein, 28 aa, Entamoeba histolytica
KQNTEPKQNIPENKTQNSPSHETKLPEN

SEQ ID NO: 2634660 - protein, 6 aa, Entamoeba histolytica
KQNTSN

SEQ ID NO: 2634661 - protein, 52 aa, Entamoeba histolytica
KQNTTTSINTTTTTNNNNNNNCNNNSHDTSSIQSIKQSKPRKVSDEINKKYS

SEQ ID NO: 2634662 - protein, 12 aa, Entamoeba histolytica
KQNYDDDYDDVG

SEQ ID NO: 2634663 - protein, 42 aa, Entamoeba histolytica
KQNYDDSIEEDENSSNVTFSSEEQNEQKVKEIKKPLKTNHKR

SEQ ID NO: 2634664 - protein, 7 aa, Entamoeba histolytica
KQNYDKI

SEQ ID NO: 2634665 - protein, 11 aa, Entamoeba histolytica
KQNYKEAIEQY

SEQ ID NO: 2634666 - protein, 10 aa, Entamoeba histolytica
KQPAKKSVVT

SEQ ID NO: 2634667 - protein, 13 aa, Entamoeba histolytica
KQPATQQQPTSNS

SEQ ID NO: 2634668 - protein, 6 aa, Entamoeba histolytica
KQPDDI

SEQ ID NO: 2634669 - protein, 5 aa, Entamoeba histolytica
KQPDN

SEQ ID NO: 2634670 - protein, 6 aa, Entamoeba histolytica
KQPEMT

SEQ ID NO: 2634671 - protein, 7 aa, Entamoeba histolytica
KQPEQYL

SEQ ID NO: 2634672 - protein, 6 aa, Entamoeba histolytica
KQPERE

SEQ ID NO: 2634673 - protein, 12 aa, Entamoeba histolytica
KQPEVTANSFTE

SEQ ID NO: 2634674 - protein, 6 aa, Entamoeba histolytica
KQPGSL

SEQ ID NO: 2634675 - protein, 5 aa, Entamoeba histolytica
KQPHS

SEQ ID NO: 2634676 - protein, 7 aa, Entamoeba histolytica
KQPHTQK

SEQ ID NO: 2634677 - protein, 6 aa, Entamoeba histolytica
KQPIVD

SEQ ID NO: 2634678 - protein, 7 aa, Entamoeba histolytica
KQPKDKI

SEQ ID NO: 2634679 - protein, 16 aa, Entamoeba histolytica
KQPKTKGKKLITNHSS

SEQ ID NO: 2634680 - protein, 14 aa, Entamoeba histolytica
KQPLDEKETITQSP

SEQ ID NO: 2634681 - protein, 6 aa, Entamoeba histolytica
KQPLSF

SEQ ID NO: 2634682 - protein, 9 aa, Entamoeba histolytica
KQPNHPDKS

SEQ ID NO: 2634683 - protein, 9 aa, Entamoeba histolytica
KQPNLSPEE

SEQ ID NO: 2634684 - protein, 5 aa, Entamoeba histolytica
KQPNY

SEQ ID NO: 2634685 - protein, 19 aa, Entamoeba histolytica
KQPPLSEPTEETEVSPIDK

SEQ ID NO: 2634686 - protein, 9 aa, Entamoeba histolytica
KQPPRGFTE

SEQ ID NO: 2634687 - protein, 9 aa, Entamoeba histolytica
KQPQEAINS

SEQ ID NO: 2634688 - protein, 8 aa, Entamoeba histolytica
KQPSEPIN

SEQ ID NO: 2634689 - protein, 6 aa, Entamoeba histolytica
KQPSKS

SEQ ID NO: 2634690 - protein, 7 aa, Entamoeba histolytica
KQPSPSE

SEQ ID NO: 2634691 - protein, 8 aa, Entamoeba histolytica
KQPSQASI

SEQ ID NO: 2634692 - protein, 7 aa, Entamoeba histolytica
KQPTIEL

SEQ ID NO: 2634693 - protein, 7 aa, Entamoeba histolytica
KQPTMAP

SEQ ID NO: 2634694 - protein, 6 aa, Entamoeba histolytica
KQPTSS

SEQ ID NO: 2634695 - protein, 15 aa, Entamoeba histolytica
KQPTTSRSPIASRSN

SEQ ID NO: 2634696 - protein, 6 aa, Entamoeba histolytica
KQPTVE

SEQ ID NO: 2634697 - protein, 6 aa, Entamoeba histolytica
KQPYNR

SEQ ID NO: 2634698 - protein, 10 aa, Entamoeba histolytica
KQQAEKKITE

SEQ ID NO: 2634699 - protein, 10 aa, Entamoeba histolytica
KQQDSVKQLS

SEQ ID NO: 2634700 - protein, 12 aa, Entamoeba histolytica
KQQEDNKIPKDF

SEQ ID NO: 2634701 - protein, 5 aa, Entamoeba histolytica
KQQEF

SEQ ID NO: 2634702 - protein, 17 aa, Entamoeba histolytica
KQQEQDDSELQNQIKEG

SEQ ID NO: 2634703 - protein, 7 aa, Entamoeba histolytica
KQQESRV

SEQ ID NO: 2634704 - protein, 15 aa, Entamoeba histolytica
KQQETNKKLKQKKEP

SEQ ID NO: 2634705 - protein, 7 aa, Entamoeba histolytica
KQQFENE

SEQ ID NO: 2634706 - protein, 12 aa, Entamoeba histolytica
KQQGVDEYENNE

SEQ ID NO: 2634707 - protein, 9 aa, Entamoeba histolytica
KQQHENYKA

SEQ ID NO: 2634708 - protein, 5 aa, Entamoeba histolytica
KQQIE

SEQ ID NO: 2634709 - protein, 8 aa, Entamoeba histolytica
KQQIETET

SEQ ID NO: 2634710 - protein, 5 aa, Entamoeba histolytica
KQQIG

SEQ ID NO: 2634711 - protein, 15 aa, Entamoeba histolytica
KQQIGTDEFQNGKDN

SEQ ID NO: 2634712 - protein, 13 aa, Entamoeba histolytica
KQQINQQQNQLNS

SEQ ID NO: 2634713 - protein, 24 aa, Entamoeba histolytica
KQQKEEEDLETKKNSWKAFASKMK

SEQ ID NO: 2634714 - protein, 7 aa, Entamoeba histolytica
KQQKEQL

SEQ ID NO: 2634715 - protein, 7 aa, Entamoeba histolytica
KQQKMTK

SEQ ID NO: 2634716 - protein, 13 aa, Entamoeba histolytica
KQQKQEKEEKKQK

SEQ ID NO: 2634717 - protein, 7 aa, Entamoeba histolytica
KQQKRDD

SEQ ID NO: 2634718 - protein, 13 aa, Entamoeba histolytica
KQQKRSEEAETCN

SEQ ID NO: 2634719 - protein, 24 aa, Entamoeba histolytica
KQQLSQVKTTNEEEQKKKQEEINN

SEQ ID NO: 2634720 - protein, 8 aa, Entamoeba histolytica
KQQNEDQR

SEQ ID NO: 2634721 - protein, 8 aa, Entamoeba histolytica
KQQNGNGV

SEQ ID NO: 2634722 - protein, 20 aa, Entamoeba histolytica
KQQNQVSKSKDEDINKKQQM

SEQ ID NO: 2634723 - protein, 4 aa, Entamoeba histolytica
KQQP

SEQ ID NO: 2634724 - protein, 16 aa, Entamoeba histolytica
KQQPKRKGLRKDENGI

SEQ ID NO: 2634725 - protein, 17 aa, Entamoeba histolytica
KQQPKTKTKKVKKEKLE

SEQ ID NO: 2634726 - protein, 9 aa, Entamoeba histolytica
KQQPSLPNT

SEQ ID NO: 2634727 - protein, 7 aa, Entamoeba histolytica
KQQPVDD

SEQ ID NO: 2634728 - protein, 24 aa, Entamoeba histolytica
KQQQDIEESHINTQPKKSRLAFWK

SEQ ID NO: 2634729 - protein, 33 aa, Entamoeba histolytica
KQQQETQPRPLSGGPGGQLKPTKEKGGLIFLKK

SEQ ID NO: 2634730 - protein, 8 aa, Entamoeba histolytica
KQQQIEYK

SEQ ID NO: 2634731 - protein, 7 aa, Entamoeba histolytica
KQQQKDK

SEQ ID NO: 2634732 - protein, 23 aa, Entamoeba histolytica
KQQQLEKDEAEKARWKEQEQKHR

SEQ ID NO: 2634733 - protein, 11 aa, Entamoeba histolytica
KQQQNDEEIKL

SEQ ID NO: 2634734 - protein, 15 aa, Entamoeba histolytica
KQQQPIESRAPPIIN

SEQ ID NO: 2634735 - protein, 8 aa, Entamoeba histolytica
KQQREEEM

SEQ ID NO: 2634736 - protein, 6 aa, Entamoeba histolytica
KQQREN

SEQ ID NO: 2634737 - protein, 21 aa, Entamoeba histolytica
KQQRLEKQIQSEKTGNGLGDN

SEQ ID NO: 2634738 - protein, 13 aa, Entamoeba histolytica
KQQRYQNNVQQQN

SEQ ID NO: 2634739 - protein, 6 aa, Entamoeba histolytica
KQQSAS

SEQ ID NO: 2634740 - protein, 13 aa, Entamoeba histolytica
KQQSVVQNQTPNF

SEQ ID NO: 2634741 - protein, 7 aa, Entamoeba histolytica
KQQTNDK

SEQ ID NO: 2634742 - protein, 7 aa, Entamoeba histolytica
KQQTNSL

SEQ ID NO: 2634743 - protein, 8 aa, Entamoeba histolytica
KQQVEKAN

SEQ ID NO: 2634744 - protein, 5 aa, Entamoeba histolytica
KQRDE

SEQ ID NO: 2634745 - protein, 5 aa, Entamoeba histolytica
KQREL

SEQ ID NO: 2634746 - protein, 6 aa, Entamoeba histolytica
KQRETV

SEQ ID NO: 2634747 - protein, 8 aa, Entamoeba histolytica
KQRFNEPD

SEQ ID NO: 2634748 - protein, 23 aa, Entamoeba histolytica
KQRFSSNPDIRKANLKGNYQSMD

SEQ ID NO: 2634749 - protein, 8 aa, Entamoeba histolytica
KQRGITEE

SEQ ID NO: 2634750 - protein, 5 aa, Entamoeba histolytica
KQRGM

SEQ ID NO: 2634751 - protein, 15 aa, Entamoeba histolytica
KQRGSRNDSTGVSDT

SEQ ID NO: 2634752 - protein, 12 aa, Entamoeba histolytica
KQRIQYDQEKFT

SEQ ID NO: 2634753 - protein, 34 aa, Entamoeba histolytica
KQRKAAAEKQKEEEKARKKEEKGGKKKIRRTEEG

SEQ ID NO: 2634754 - protein, 7 aa, Entamoeba histolytica
KQRKKDG

SEQ ID NO: 2634755 - protein, 7 aa, Entamoeba histolytica
KQRNDIN

SEQ ID NO: 2634756 - protein, 11 aa, Entamoeba histolytica
KQRNEFNEKLK

SEQ ID NO: 2634757 - protein, 5 aa, Entamoeba histolytica
KQRPG

SEQ ID NO: 2634758 - protein, 12 aa, Entamoeba histolytica
KQRPKANEKNTQ

SEQ ID NO: 2634759 - protein, 5 aa, Entamoeba histolytica
KQRQE

SEQ ID NO: 2634760 - protein, 6 aa, Entamoeba histolytica
KQRQKI

SEQ ID NO: 2634761 - protein, 21 aa, Entamoeba histolytica
KQRQRLEKQIQNKKTGNGFGD

SEQ ID NO: 2634762 - protein, 17 aa, Entamoeba histolytica
KQRRIESTRDSNRFKTL

SEQ ID NO: 2634763 - protein, 5 aa, Entamoeba histolytica
KQRRN

SEQ ID NO: 2634764 - protein, 8 aa, Entamoeba histolytica
KQRSREVT

SEQ ID NO: 2634765 - protein, 10 aa, Entamoeba histolytica
KQRTKKSLSE

SEQ ID NO: 2634766 - protein, 9 aa, Entamoeba histolytica
KQRTQNETN

SEQ ID NO: 2634767 - protein, 13 aa, Entamoeba histolytica
KQRTRTNTSGDIG

SEQ ID NO: 2634768 - protein, 9 aa, Entamoeba histolytica
KQRVGKSPY

SEQ ID NO: 2634769 - protein, 5 aa, Entamoeba histolytica
KQRYD

SEQ ID NO: 2634770 - protein, 55 aa, Entamoeba histolytica
KQSAMASSITPTTSTPSKQTTASSQISSGLARSARDARSQNCSSRGDFSGGSVDI

SEQ ID NO: 2634771 - protein, 12 aa, Entamoeba histolytica
KQSAPINNDYSS

SEQ ID NO: 2634772 - protein, 6 aa, Entamoeba histolytica
KQSDIK

SEQ ID NO: 2634773 - protein, 8 aa, Entamoeba histolytica
KQSEEGKQ

SEQ ID NO: 2634774 - protein, 6 aa, Entamoeba histolytica
KQSEEI

SEQ ID NO: 2634775 - protein, 5 aa, Entamoeba histolytica
KQSEL

SEQ ID NO: 2634776 - protein, 9 aa, Entamoeba histolytica
KQSFNSEGS

SEQ ID NO: 2634777 - protein, 12 aa, Entamoeba histolytica
KQSGKTREPKVH

SEQ ID NO: 2634778 - protein, 25 aa, Entamoeba histolytica
KQSHAEPTISPVSQKSSQQSKPSDI

SEQ ID NO: 2634779 - protein, 7 aa, Entamoeba histolytica
KQSIKPN

SEQ ID NO: 2634780 - protein, 10 aa, Entamoeba histolytica
KQSIPQQPKQ

SEQ ID NO: 2634781 - protein, 36 aa, Entamoeba histolytica
KQSKELKKNNNKKIDIKRPEIKKNEPIKSNGITTNP

SEQ ID NO: 2634782 - protein, 7 aa, Entamoeba histolytica
KQSKNEH

SEQ ID NO: 2634783 - protein, 14 aa, Entamoeba histolytica
KQSKPTITKGHGKL

SEQ ID NO: 2634784 - protein, 6 aa, Entamoeba histolytica
KQSKTF

SEQ ID NO: 2634785 - protein, 6 aa, Entamoeba histolytica
KQSKVY

SEQ ID NO: 2634786 - protein, 18 aa, Entamoeba histolytica
KQSLAESYGTIEGVEEKN

SEQ ID NO: 2634787 - protein, 6 aa, Entamoeba histolytica
KQSLTN

SEQ ID NO: 2634788 - protein, 5 aa, Entamoeba histolytica
KQSNH

SEQ ID NO: 2634789 - protein, 6 aa, Entamoeba histolytica
KQSNTL

SEQ ID NO: 2634790 - protein, 8 aa, Entamoeba histolytica
KQSNTLRL

SEQ ID NO: 2634791 - protein, 6 aa, Entamoeba histolytica
KQSNTS

SEQ ID NO: 2634792 - protein, 5 aa, Entamoeba histolytica
KQSPI

SEQ ID NO: 2634793 - protein, 6 aa, Entamoeba histolytica
KQSPKV

SEQ ID NO: 2634794 - protein, 5 aa, Entamoeba histolytica
KQSPL

SEQ ID NO: 2634795 - protein, 7 aa, Entamoeba histolytica
KQSQSKL

SEQ ID NO: 2634796 - protein, 6 aa, Entamoeba histolytica
KQSRGL

SEQ ID NO: 2634797 - protein, 7 aa, Entamoeba histolytica
KQSRKLE

SEQ ID NO: 2634798 - protein, 16 aa, Entamoeba histolytica
KQSSFTTINEQAKDEW

SEQ ID NO: 2634799 - protein, 9 aa, Entamoeba histolytica
KQSSITSED

SEQ ID NO: 2634800 - protein, 11 aa, Entamoeba histolytica
KQSSMTKEQEI

SEQ ID NO: 2634801 - protein, 7 aa, Entamoeba histolytica
KQSSNQA

SEQ ID NO: 2634802 - protein, 11 aa, Entamoeba histolytica
KQSSSESQHRS

SEQ ID NO: 2634803 - protein, 6 aa, Entamoeba histolytica
KQSSYI

SEQ ID NO: 2634804 - protein, 7 aa, Entamoeba histolytica
KQSTCPE

SEQ ID NO: 2634805 - protein, 14 aa, Entamoeba histolytica
KQSTKTKPTSIASA

SEQ ID NO: 2634806 - protein, 8 aa, Entamoeba histolytica
KQSTKYSS

SEQ ID NO: 2634807 - protein, 7 aa, Entamoeba histolytica
KQSTPLS

SEQ ID NO: 2634808 - protein, 10 aa, Entamoeba histolytica
KQSTQKESKL

SEQ ID NO: 2634809 - protein, 9 aa, Entamoeba histolytica
KQSVSTTRD

SEQ ID NO: 2634810 - protein, 11 aa, Entamoeba histolytica
KQSYPNNGEFD

SEQ ID NO: 2634811 - protein, 4 aa, Entamoeba histolytica
KQTD

SEQ ID NO: 2634812 - protein, 8 aa, Entamoeba histolytica
KQTDDETL

SEQ ID NO: 2634813 - protein, 8 aa, Entamoeba histolytica
KQTDRKEI

SEQ ID NO: 2634814 - protein, 4 aa, Entamoeba histolytica
KQTE

SEQ ID NO: 2634815 - protein, 36 aa, Entamoeba histolytica
KQTEATKAAEIAKADEEAAIARQKEAQAAEEEVTKA

SEQ ID NO: 2634816 - protein, 7 aa, Entamoeba histolytica
KQTETLK

SEQ ID NO: 2634817 - protein, 9 aa, Entamoeba histolytica
KQTFTGNDH

SEQ ID NO: 2634818 - protein, 16 aa, Entamoeba histolytica
KQTGINGSVILNINNQ

SEQ ID NO: 2634819 - protein, 5 aa, Entamoeba histolytica
KQTGL

SEQ ID NO: 2634820 - protein, 5 aa, Entamoeba histolytica
KQTGV

SEQ ID NO: 2634821 - protein, 7 aa, Entamoeba histolytica
KQTINTK

SEQ ID NO: 2634822 - protein, 18 aa, Entamoeba histolytica
KQTKDSVAPLGEKKTFKS

SEQ ID NO: 2634823 - protein, 15 aa, Entamoeba histolytica
KQTKEKSKANEMDDS

SEQ ID NO: 2634824 - protein, 12 aa, Entamoeba histolytica
KQTKGEKELKTK

SEQ ID NO: 2634825 - protein, 10 aa, Entamoeba histolytica
KQTKKTKCTE

SEQ ID NO: 2634826 - protein, 10 aa, Entamoeba histolytica
KQTKNFSGAE

SEQ ID NO: 2634827 - protein, 12 aa, Entamoeba histolytica
KQTKSRKTYTRG

SEQ ID NO: 2634828 - protein, 10 aa, Entamoeba histolytica
KQTKSSKKTV

SEQ ID NO: 2634829 - protein, 13 aa, Entamoeba histolytica
KQTKTNEIEQTIE

SEQ ID NO: 2634830 - protein, 8 aa, Entamoeba histolytica
KQTKTSFT

SEQ ID NO: 2634831 - protein, 6 aa, Entamoeba histolytica
KQTNES

SEQ ID NO: 2634832 - protein, 10 aa, Entamoeba histolytica
KQTNKQTKFP

SEQ ID NO: 2634833 - protein, 5 aa, Entamoeba histolytica
KQTPE

SEQ ID NO: 2634834 - protein, 15 aa, Entamoeba histolytica
KQTPIPKPAAPPPPS

SEQ ID NO: 2634835 - protein, 6 aa, Entamoeba histolytica
KQTPQY

SEQ ID NO: 2634836 - protein, 16 aa, Entamoeba histolytica
KQTPREISIDSRRTEL

SEQ ID NO: 2634837 - protein, 7 aa, Entamoeba histolytica
KQTPYTL

SEQ ID NO: 2634838 - protein, 5 aa, Entamoeba histolytica
KQTQE

SEQ ID NO: 2634839 - protein, 7 aa, Entamoeba histolytica
KQTQEAK

SEQ ID NO: 2634840 - protein, 17 aa, Entamoeba histolytica
KQTQKELKDAKDKIEGL

SEQ ID NO: 2634841 - protein, 15 aa, Entamoeba histolytica
KQTQLYDNKESVSNR

SEQ ID NO: 2634842 - protein, 7 aa, Entamoeba histolytica
KQTRKSS

SEQ ID NO: 2634843 - protein, 5 aa, Entamoeba histolytica
KQTRR

SEQ ID NO: 2634844 - protein, 4 aa, Entamoeba histolytica
KQTS

SEQ ID NO: 2634845 - protein, 9 aa, Entamoeba histolytica
KQTSAYVDK

SEQ ID NO: 2634846 - protein, 9 aa, Entamoeba histolytica
KQTSSKPDI

SEQ ID NO: 2634847 - protein, 6 aa, Entamoeba histolytica
KQTTGI

SEQ ID NO: 2634848 - protein, 6 aa, Entamoeba histolytica
KQTTHQ

SEQ ID NO: 2634849 - protein, 8 aa, Entamoeba histolytica
KQTTHYSK

SEQ ID NO: 2634850 - protein, 5 aa, Entamoeba histolytica
KQTTI

SEQ ID NO: 2634851 - protein, 19 aa, Entamoeba histolytica
KQTTPNIHKTESPQKRLSE

SEQ ID NO: 2634852 - protein, 13 aa, Entamoeba histolytica
KQTTQNAQRMFSI

SEQ ID NO: 2634853 - protein, 11 aa, Entamoeba histolytica
KQTTSQNPEED

SEQ ID NO: 2634854 - protein, 11 aa, Entamoeba histolytica
KQTVSTTKNEI

SEQ ID NO: 2634855 - protein, 6 aa, Entamoeba histolytica
KQTYDD

SEQ ID NO: 2634856 - protein, 6 aa, Entamoeba histolytica
KQTYEK

SEQ ID NO: 2634857 - protein, 7 aa, Entamoeba histolytica
KQVAEAK

SEQ ID NO: 2634858 - protein, 6 aa, Entamoeba histolytica
KQVDEF

SEQ ID NO: 2634859 - protein, 7 aa, Entamoeba histolytica
KQVGTSK

SEQ ID NO: 2634860 - protein, 7 aa, Entamoeba histolytica
KQVIEGK

SEQ ID NO: 2634861 - protein, 12 aa, Entamoeba histolytica
KQVLSEDEKESF

SEQ ID NO: 2634862 - protein, 6 aa, Entamoeba histolytica
KQVNRD

SEQ ID NO: 2634863 - protein, 9 aa, Entamoeba histolytica
KQVNSAPWP

SEQ ID NO: 2634864 - protein, 12 aa, Entamoeba histolytica
KQVQNNDTELNQ

SEQ ID NO: 2634865 - protein, 32 aa, Entamoeba histolytica
KQVSEGKSKDEKLNNEDKEEDTELKPENDDEL

SEQ ID NO: 2634866 - protein, 25 aa, Entamoeba histolytica
KQVTGDDANDLEKLQEDYDQLQEDY

SEQ ID NO: 2634867 - protein, 4 aa, Entamoeba histolytica
KQWN

SEQ ID NO: 2634868 - protein, 4 aa, Entamoeba histolytica
KQYA

SEQ ID NO: 2634869 - protein, 7 aa, Entamoeba histolytica
KQYDNIS

SEQ ID NO: 2634870 - protein, 36 aa, Entamoeba histolytica
KQYGNDRRTTKPPRSPIDDRRTSQRDYSKRIPARDR

SEQ ID NO: 2634871 - protein, 8 aa, Entamoeba histolytica
KQYKESER

SEQ ID NO: 2634872 - protein, 6 aa, Entamoeba histolytica
KQYLEK

SEQ ID NO: 2634873 - protein, 5 aa, Entamoeba histolytica
KQYNG

SEQ ID NO: 2634874 - protein, 15 aa, Entamoeba histolytica
KQYNPSSDKETTDVE

SEQ ID NO: 2634875 - protein, 4 aa, Entamoeba histolytica
KQYS

SEQ ID NO: 2634876 - protein, 13 aa, Entamoeba histolytica
KQYTPSEGTNEKE

SEQ ID NO: 2634877 - protein, 14 aa, Entamoeba histolytica
KQYYTTKNSQTSAS

SEQ ID NO: 2634878 - protein, 12 aa, Entamoeba histolytica
KRAAASKNITQL

SEQ ID NO: 2634879 - protein, 11 aa, Entamoeba histolytica
KRADELGVDEE

SEQ ID NO: 2634880 - protein, 31 aa, Entamoeba histolytica
KRAEEAKKSAEAAAARQKEAQAAEDEVTKAL

SEQ ID NO: 2634881 - protein, 15 aa, Entamoeba histolytica
KRAEERKGRRENPYT

SEQ ID NO: 2634882 - protein, 13 aa, Entamoeba histolytica
KRAEIDKKTAIAR

SEQ ID NO: 2634883 - protein, 5 aa, Entamoeba histolytica
KRAFN

SEQ ID NO: 2634884 - protein, 7 aa, Entamoeba histolytica
KRAIKNE

SEQ ID NO: 2634885 - protein, 5 aa, Entamoeba histolytica
KRAIQ

SEQ ID NO: 2634886 - protein, 9 aa, Entamoeba histolytica
KRAKEVKED

SEQ ID NO: 2634887 - protein, 7 aa, Entamoeba histolytica
KRAKNIN

SEQ ID NO: 2634888 - protein, 56 aa, Entamoeba histolytica; identical to SEQ ID NO: 2567341

SEQ ID NO: 2634889 - protein, 13 aa, Entamoeba histolytica
KRAPQLRRGVKNE

SEQ ID NO: 2634890 - protein, 6 aa, Entamoeba histolytica
KRAQQI

SEQ ID NO: 2634891 - protein, 7 aa, Entamoeba histolytica
KRARAAT

SEQ ID NO: 2634892 - protein, 5 aa, Entamoeba histolytica
KRASQ

SEQ ID NO: 2634893 - protein, 10 aa, Entamoeba histolytica
KRCRENDGIE

SEQ ID NO: 2634894 - protein, 53 aa, Entamoeba histolytica
KRDDEDLSVSSNSNQVSSVGSSTLNGREKDGNSMSISSNVTPTPLVSNPPPVL

SEQ ID NO: 2634895 - protein, 10 aa, Entamoeba histolytica
KRDDSSSGSF

SEQ ID NO: 2634896 - protein, 10 aa, Entamoeba histolytica
KRDETMKPRK

SEQ ID NO: 2634897 - protein, 18 aa, Entamoeba histolytica
KRDGEERNKILQSIIEHQ

SEQ ID NO: 2634898 - protein, 5 aa, Entamoeba histolytica
KRDGL

SEQ ID NO: 2634899 - protein, 23 aa, Entamoeba histolytica
KRDGPLRESSTRELKVNTSRRNT

SEQ ID NO: 2634900 - protein, 10 aa, Entamoeba histolytica
KRDGSNYNSK

SEQ ID NO: 2634901 - protein, 7 aa, Entamoeba histolytica
KRDGVNE

SEQ ID NO: 2634902 - protein, 7 aa, Entamoeba histolytica
KRDINTL

SEQ ID NO: 2634903 - protein, 7 aa, Entamoeba histolytica
KRDKDSW

SEQ ID NO: 2634904 - protein, 8 aa, Entamoeba histolytica
KRDKERKW

SEQ ID NO: 2634905 - protein, 10 aa, Entamoeba histolytica
KRDKKALKKW

SEQ ID NO: 2634906 - protein, 6 aa, Entamoeba histolytica
KRDKYI

SEQ ID NO: 2634907 - protein, 9 aa, Entamoeba histolytica
KRDLGDKKK

SEQ ID NO: 2634908 - protein, 8 aa, Entamoeba histolytica
KRDLKSRI

SEQ ID NO: 2634909 - protein, 4 aa, Entamoeba histolytica
KRDN

SEQ ID NO: 2634910 - protein, 6 aa, Entamoeba histolytica
KRDNEI

SEQ ID NO: 2634911 - protein, 11 aa, Entamoeba histolytica
KRDNEKKPKIC

SEQ ID NO: 2634912 - protein, 9 aa, Entamoeba histolytica
KRDPAYTGA

SEQ ID NO: 2634913 - protein, 26 aa, Entamoeba histolytica
KRDPPFDSPRDSPRRRSFSRERGRLD

SEQ ID NO: 2634914 - protein, 9 aa, Entamoeba histolytica
KRDPQEGYR

SEQ ID NO: 2634915 - protein, 6 aa, Entamoeba histolytica
KRDQNG

SEQ ID NO: 2634916 - protein, 4 aa, Entamoeba histolytica
KRDS

SEQ ID NO: 2634917 - protein, 9 aa, Entamoeba histolytica
KRDSDGKLK

SEQ ID NO: 2634918 - protein, 8 aa, Entamoeba histolytica
KRDSDTNW

SEQ ID NO: 2634919 - protein, 8 aa, Entamoeba histolytica
KRDSMQDT

SEQ ID NO: 2634920 - protein, 8 aa, Entamoeba histolytica
KRDSSSFK

SEQ ID NO: 2634921 - protein, 19 aa, Entamoeba histolytica
KRDTGPFRGDETISSPNTL

SEQ ID NO: 2634922 - protein, 6 aa, Entamoeba histolytica
KRDTLK

SEQ ID NO: 2634923 - protein, 4 aa, Entamoeba histolytica
KRDV

SEQ ID NO: 2634924 - protein, 7 aa, Entamoeba histolytica
KREDAYK

SEQ ID NO: 2634925 - protein, 12 aa, Entamoeba histolytica
KREDELKIPDEV

SEQ ID NO: 2634926 - protein, 4 aa, Entamoeba histolytica
KREE

SEQ ID NO: 2634927 - protein, 5 aa, Entamoeba histolytica
KREED

SEQ ID NO: 2634928 - protein, 9 aa, Entamoeba histolytica
KREEEDGSL

SEQ ID NO: 2634929 - protein, 6 aa, Entamoeba histolytica
KREEEE

SEQ ID NO: 2634930 - protein, 10 aa, Entamoeba histolytica
KREEERKSER

SEQ ID NO: 2634931 - protein, 14 aa, Entamoeba histolytica
KREEFKKEIGKNEK

SEQ ID NO: 2634932 - protein, 18 aa, Entamoeba histolytica
KREEIAATLKDGEKINAK

SEQ ID NO: 2634933 - protein, 128 aa, Entamoeba histolytica
KREEIQRKQDEIRKMREETEKQHKKGEERLKQEEERFKKEEEERKKKEEERLRQEEEENKRIKEERQRKEEELRKKKAEEERKRKLEEEARKRKEEEEQRKEEEEKRKVEEELKKKEEEERKRKEAIE

SEQ ID NO: 2634934 - protein, 12 aa, Entamoeba histolytica
KREEKSEIQTIS

SEQ ID NO: 2634935 - protein, 5 aa, Entamoeba histolytica
KREEV

SEQ ID NO: 2634936 - protein, 8 aa, Entamoeba histolytica
KREEYKEF

SEQ ID NO: 2634937 - protein, 8 aa, Entamoeba histolytica
KREFEEDN

SEQ ID NO: 2634938 - protein, 7 aa, Entamoeba histolytica
KREFESK

SEQ ID NO: 2634939 - protein, 6 aa, Entamoeba histolytica
KREGEL

SEQ ID NO: 2634940 - protein, 7 aa, Entamoeba histolytica
KREGKQS

SEQ ID NO: 2634941 - protein, 13 aa, Entamoeba histolytica
KREIETTNAETQV

SEQ ID NO: 2634942 - protein, 6 aa, Entamoeba histolytica
KREISD

SEQ ID NO: 2634943 - protein, 8 aa, Entamoeba histolytica
KRELERED

SEQ ID NO: 2634944 - protein, 11 aa, Entamoeba histolytica
KRELKEETGYV

SEQ ID NO: 2634945 - protein, 48 aa, Entamoeba histolytica
KRELTKKKQELESKLGQNKTIKKEENEPTKGVPISEQTKESISPEEEK

SEQ ID NO: 2634946 - protein, 25 aa, Entamoeba histolytica
KREMMTEKKSGDINKSNLEKKSIAE

SEQ ID NO: 2634947 - protein, 6 aa, Entamoeba histolytica
KRENKK

SEQ ID NO: 2634948 - protein, 6 aa, Entamoeba histolytica
KRENKT

SEQ ID NO: 2634949 - protein, 5 aa, Entamoeba histolytica
KRENL

SEQ ID NO: 2634950 - protein, 6 aa, Entamoeba histolytica
KRENNE

SEQ ID NO: 2634951 - protein, 7 aa, Entamoeba histolytica
KRENPDV

SEQ ID NO: 2634952 - protein, 20 aa, Entamoeba histolytica
KREPIDPDTEIIPPNKKQLQ

SEQ ID NO: 2634953 - protein, 6 aa, Entamoeba histolytica
KREQGT

SEQ ID NO: 2634954 - protein, 7 aa, Entamoeba histolytica
KREQIKA

SEQ ID NO: 2634955 - protein, 21 aa, Entamoeba histolytica
KREQNQKKRLRKKRSLKKKRE

SEQ ID NO: 2634956 - protein, 7 aa, Entamoeba histolytica
KREQPNS

SEQ ID NO: 2634957 - protein, 4 aa, Entamoeba histolytica
KRER

SEQ ID NO: 2634958 - protein, 10 aa, Entamoeba histolytica
KRERGEALSR

SEQ ID NO: 2634959 - protein, 9 aa, Entamoeba histolytica
KRERNKMSK

SEQ ID NO: 2634960 - protein, 12 aa, Entamoeba histolytica
KRESRDEEATLA

SEQ ID NO: 2634961 - protein, 9 aa, Entamoeba histolytica
KRESRENSG

SEQ ID NO: 2634962 - protein, 12 aa, Entamoeba histolytica
KRETEKDSTIKT

SEQ ID NO: 2634963 - protein, 12 aa, Entamoeba histolytica
KREYEEGKKRIE

SEQ ID NO: 2634964 - protein, 18 aa, Entamoeba histolytica
KREYSQPITNSSSKLKQT

SEQ ID NO: 2634965 - protein, 5 aa, Entamoeba histolytica
KRFEK

SEQ ID NO: 2634966 - protein, 6 aa, Entamoeba histolytica
KRFNRG

SEQ ID NO: 2634967 - protein, 4 aa, Entamoeba histolytica
KRFP

SEQ ID NO: 2634968 - protein, 5 aa, Entamoeba histolytica
KRFSQ

SEQ ID NO: 2634969 - protein, 4 aa, Entamoeba histolytica
KRFV

SEQ ID NO: 2634970 - protein, 11 aa, Entamoeba histolytica
KRGCDPQEGSI

SEQ ID NO: 2634971 - protein, 6 aa, Entamoeba histolytica
KRGCDR

SEQ ID NO: 2634972 - protein, 7 aa, Entamoeba histolytica
KRGDCGG

SEQ ID NO: 2634973 - protein, 19 aa, Entamoeba histolytica
KRGDDITTKKKRGPPAKHS

SEQ ID NO: 2634974 - protein, 5 aa, Entamoeba histolytica
KRGDE

SEQ ID NO: 2634975 - protein, 7 aa, Entamoeba histolytica
KRGDETA

SEQ ID NO: 2634976 - protein, 5 aa, Entamoeba histolytica
KRGDR

SEQ ID NO: 2634977 - protein, 9 aa, Entamoeba histolytica
KRGGAATPE

SEQ ID NO: 2634978 - protein, 5 aa, Entamoeba histolytica
KRGIY

SEQ ID NO: 2634979 - protein, 11 aa, Entamoeba histolytica
KRGKKLEYNSP

SEQ ID NO: 2634980 - protein, 6 aa, Entamoeba histolytica
KRGKQE

SEQ ID NO: 2634981 - protein, 10 aa, Entamoeba histolytica
KRGNLTAKEI

SEQ ID NO: 2634982 - protein, 6 aa, Entamoeba histolytica
KRGNRM

SEQ ID NO: 2634983 - protein, 5 aa, Entamoeba histolytica
KRGPN

SEQ ID NO: 2634984 - protein, 11 aa, Entamoeba histolytica
KRGRKKSENTF

SEQ ID NO: 2634985 - protein, 6 aa, Entamoeba histolytica
KRGSET

SEQ ID NO: 2634986 - protein, 5 aa, Entamoeba histolytica
KRGSV

SEQ ID NO: 2634987 - protein, 9 aa, Entamoeba histolytica
KRGTEEDRK

SEQ ID NO: 2634988 - protein, 4 aa, Entamoeba histolytica
KRGV

SEQ ID NO: 2634989 - protein, 17 aa, Entamoeba histolytica
KRGVAKKLSSKEERTVM

SEQ ID NO: 2634990 - protein, 8 aa, Entamoeba histolytica
KRGVKEED

SEQ ID NO: 2634991 - protein, 13 aa, Entamoeba histolytica
KRHFNEETQTPKV

SEQ ID NO: 2634992 - protein, 4 aa, Entamoeba histolytica
KRHG

SEQ ID NO: 2634993 - protein, 4 aa, Entamoeba histolytica
KRHI

SEQ ID NO: 2634994 - protein, 4 aa, Entamoeba histolytica
KRHK

SEQ ID NO: 2634995 - protein, 9 aa, Entamoeba histolytica
KRHRNANKM

SEQ ID NO: 2634996 - protein, 8 aa, Entamoeba histolytica
KRHRNSVN

SEQ ID NO: 2634997 - protein, 11 aa, Entamoeba histolytica
KRHSKSYEAIQ

SEQ ID NO: 2634998 - protein, 13 aa, Entamoeba histolytica
KRIAQNKKHYEQL

SEQ ID NO: 2634999 - protein, 4 aa, Entamoeba histolytica
KRIC

SEQ ID NO: 2635000 - protein, 7 aa, Entamoeba histolytica
KRIDGEV

SEQ ID NO: 2635001 - protein, 20 aa, Entamoeba histolytica
KRIENKKENIALENNKTKAL

SEQ ID NO: 2635002 - protein, 11 aa, Entamoeba histolytica
KRIESLSDPFK

SEQ ID NO: 2635003 - protein, 13 aa, Entamoeba histolytica
KRIETKPLSSGII

SEQ ID NO: 2635004 - protein, 26 aa, Entamoeba histolytica
KRIETRSKNHSHQSSRSQSRKQSISS

SEQ ID NO: 2635005 - protein, 5 aa, Entamoeba histolytica
KRIEY

SEQ ID NO: 2635006 - protein, 6 aa, Entamoeba histolytica
KRIGGK

SEQ ID NO: 2635007 - protein, 7 aa, Entamoeba histolytica
KRIGKEK

SEQ ID NO: 2635008 - protein, 11 aa, Entamoeba histolytica
KRIKTSQEHNF

SEQ ID NO: 2635009 - protein, 12 aa, Entamoeba histolytica
KRINAGKPRQTI

SEQ ID NO: 2635010 - protein, 31 aa, Entamoeba histolytica
KRINDKTKKATRVSEDKIRSVPRRGRIGFSL

SEQ ID NO: 2635011 - protein, 19 aa, Entamoeba histolytica
KRINSQQAVAPVPKPSEEN

SEQ ID NO: 2635012 - protein, 4 aa, Entamoeba histolytica
KRIP

SEQ ID NO: 2635013 - protein, 8 aa, Entamoeba histolytica
KRIPERYS

SEQ ID NO: 2635014 - protein, 5 aa, Entamoeba histolytica
KRIPY

SEQ ID NO: 2635015 - protein, 8 aa, Entamoeba histolytica
KRIRENGG

SEQ ID NO: 2635016 - protein, 12 aa, Entamoeba histolytica
KRIRSANDEVNS

SEQ ID NO: 2635017 - protein, 9 aa, Entamoeba histolytica
KRIRSTDSL

SEQ ID NO: 2635018 - protein, 7 aa, Entamoeba histolytica
KRISAAD

SEQ ID NO: 2635019 - protein, 7 aa, Entamoeba histolytica
KRISELK

SEQ ID NO: 2635020 - protein, 8 aa, Entamoeba histolytica
KRISKEEE

SEQ ID NO: 2635021 - protein, 6 aa, Entamoeba histolytica
KRITEK

SEQ ID NO: 2635022 - protein, 12 aa, Entamoeba histolytica
KRITTKSTGCSP

SEQ ID NO: 2635023 - protein, 14 aa, Entamoeba histolytica
KRKAINDRFNEQNH

SEQ ID NO: 2635024 - protein, 5 aa, Entamoeba histolytica
KRKAT

SEQ ID NO: 2635025 - protein, 15 aa, Entamoeba histolytica
KRKATIKKQQTKKTI

SEQ ID NO: 2635026 - protein, 5 aa, Entamoeba histolytica
KRKCK

SEQ ID NO: 2635027 - protein, 8 aa, Entamoeba histolytica
KRKDDKNY

SEQ ID NO: 2635028 - protein, 25 aa, Entamoeba histolytica
KRKDKNSEKKPKKKQKTTIKSSLES

SEQ ID NO: 2635029 - protein, 8 aa, Entamoeba histolytica
KRKDNGER

SEQ ID NO: 2635030 - protein, 4 aa, Entamoeba histolytica
KRKE

SEQ ID NO: 2635031 - protein, 10 aa, Entamoeba histolytica
KRKEAIEENR

SEQ ID NO: 2635032 - protein, 8 aa, Entamoeba histolytica
KRKEECNE

SEQ ID NO: 2635033 - protein, 17 aa, Entamoeba histolytica
KRKEEELSTTEVERNVP

SEQ ID NO: 2635034 - protein, 9 aa, Entamoeba histolytica
KRKEEETNM

SEQ ID NO: 2635035 - protein, 24 aa, Entamoeba histolytica
KRKEEKPFEDSFSKQTNEEKKELE

SEQ ID NO: 2635036 - protein, 8 aa, Entamoeba histolytica
KRKEEREE

SEQ ID NO: 2635037 - protein, 8 aa, Entamoeba histolytica
KRKEETIN

SEQ ID NO: 2635038 - protein, 13 aa, Entamoeba histolytica
KRKEETKPIPPSF

SEQ ID NO: 2635039 - protein, 12 aa, Entamoeba histolytica
KRKEGDQPEIER

SEQ ID NO: 2635040 - protein, 5 aa, Entamoeba histolytica
KRKEI

SEQ ID NO: 2635041 - protein, 13 aa, Entamoeba histolytica
KRKEKEKKWDEEW

SEQ ID NO: 2635042 - protein, 5 aa, Entamoeba histolytica
KRKEL

SEQ ID NO: 2635043 - protein, 7 aa, Entamoeba histolytica
KRKELYK

SEQ ID NO: 2635044 - protein, 8 aa, Entamoeba histolytica
KRKEPFDP

SEQ ID NO: 2635045 - protein, 5 aa, Entamoeba histolytica
KRKEQ

SEQ ID NO: 2635046 - protein, 7 aa, Entamoeba histolytica
KRKEQLY

SEQ ID NO: 2635047 - protein, 30 aa, Entamoeba histolytica
KRKEVETDWNDDDFEGEEREDELTEEGEIE

SEQ ID NO: 2635048 - protein, 5 aa, Entamoeba histolytica
KRKEY

SEQ ID NO: 2635049 - protein, 6 aa, Entamoeba histolytica
KRKGFD

SEQ ID NO: 2635050 - protein, 10 aa, Entamoeba histolytica
KRKGGETGGI

SEQ ID NO: 2635051 - protein, 9 aa, Entamoeba histolytica
KRKGSSSKQ

SEQ ID NO: 2635052 - protein, 11 aa, Entamoeba histolytica
KRKGTINATEL

SEQ ID NO: 2635053 - protein, 11 aa, Entamoeba histolytica
KRKHKKNEGMT

SEQ ID NO: 2635054 - protein, 9 aa, Entamoeba histolytica
KRKIDKRNQ

SEQ ID NO: 2635055 - protein, 14 aa, Entamoeba histolytica
KRKIPLPGDIIYCD

SEQ ID NO: 2635056 - protein, 10 aa, Entamoeba histolytica
KRKKDEIYNP

SEQ ID NO: 2635057 - protein, 9 aa, Entamoeba histolytica
KRKKEEETM

SEQ ID NO: 2635058 - protein, 9 aa, Entamoeba histolytica
KRKKEIEEE

SEQ ID NO: 2635059 - protein, 6 aa, Entamoeba histolytica
KRKKEL

SEQ ID NO: 2635060 - protein, 8 aa, Entamoeba histolytica
KRKKEQWT

SEQ ID NO: 2635061 - protein, 26 aa, Entamoeba histolytica
KRKKKETEENIKKGVEQEVEETEESL

SEQ ID NO: 2635062 - protein, 28 aa, Entamoeba histolytica
KRKKKVTKLPLKKKKTDTLSKSEISPIS

SEQ ID NO: 2635063 - protein, 15 aa, Entamoeba histolytica
KRKKLEDKRGEITKS

SEQ ID NO: 2635064 - protein, 7 aa, Entamoeba histolytica
KRKKNKK

SEQ ID NO: 2635065 - protein, 10 aa, Entamoeba histolytica
KRKKNKKGIL

SEQ ID NO: 2635066 - protein, 9 aa, Entamoeba histolytica
KRKKRKSRE

SEQ ID NO: 2635067 - protein, 16 aa, Entamoeba histolytica
KRKKTETIKESLSPTW

SEQ ID NO: 2635068 - protein, 4 aa, Entamoeba histolytica
KRKL

SEQ ID NO: 2635069 - protein, 18 aa, Entamoeba histolytica
KRKLKQSDFVKGGDKAKN

SEQ ID NO: 2635070 - protein, 9 aa, Entamoeba histolytica
KRKLPDADV

SEQ ID NO: 2635071 - protein, 10 aa, Entamoeba histolytica
KRKLPDADVK

SEQ ID NO: 2635072 - protein, 4 aa, Entamoeba histolytica
KRKN

SEQ ID NO: 2635073 - protein, 6 aa, Entamoeba histolytica
KRKNEF

SEQ ID NO: 2635074 - protein, 15 aa, Entamoeba histolytica
KRKNQRESSDSSSSS

SEQ ID NO: 2635075 - protein, 11 aa, Entamoeba histolytica
KRKPGVDQRAS

SEQ ID NO: 2635076 - protein, 58 aa, Entamoeba histolytica
KRKPKETEDEDGFQSVSKGKVATKYSSRNESPYQKKQQVKGSYHPTPKSFKQSPDSIK

SEQ ID NO: 2635077 - protein, 9 aa, Entamoeba histolytica
KRKPNEPIL

SEQ ID NO: 2635078 - protein, 5 aa, Entamoeba histolytica
KRKPS

SEQ ID NO: 2635079 - protein, 13 aa, Entamoeba histolytica
KRKPTLLPNSTNT

SEQ ID NO: 2635080 - protein, 5 aa, Entamoeba histolytica
KRKPW

SEQ ID NO: 2635081 - protein, 4 aa, Entamoeba histolytica
KRKQ

SEQ ID NO: 2635082 - protein, 11 aa, Entamoeba histolytica
KRKQAQSHEEE

SEQ ID NO: 2635083 - protein, 13 aa, Entamoeba histolytica
KRKQEKKEVENKR

SEQ ID NO: 2635084 - protein, 6 aa, Entamoeba histolytica
KRKQQR

SEQ ID NO: 2635085 - protein, 6 aa, Entamoeba histolytica
KRKQSN

SEQ ID NO: 2635086 - protein, 23 aa, Entamoeba histolytica
KRKREEAKQLKEAGIEVSEPTMD

SEQ ID NO: 2635087 - protein, 6 aa, Entamoeba histolytica
KRKSLE

SEQ ID NO: 2635088 - protein, 10 aa, Entamoeba histolytica
KRKSLGDDEL

SEQ ID NO: 2635089 - protein, 6 aa, Entamoeba histolytica
KRKSLL

SEQ ID NO: 2635090 - protein, 7 aa, Entamoeba histolytica
KRKSNLY

SEQ ID NO: 2635091 - protein, 38 aa, Entamoeba histolytica
KRKSTGSTIQKEEENEKKQRRNSEGNKYLKEERKENNI

SEQ ID NO: 2635092 - protein, 10 aa, Entamoeba histolytica
KRKTIKGFSK

SEQ ID NO: 2635093 - protein, 7 aa, Entamoeba histolytica
KRKTLAS

SEQ ID NO: 2635094 - protein, 8 aa, Entamoeba histolytica
KRKTNEKL

SEQ ID NO: 2635095 - protein, 6 aa, Entamoeba histolytica
KRKVGD

SEQ ID NO: 2635096 - protein, 6 aa, Entamoeba histolytica
KRKVGT

SEQ ID NO: 2635097 - protein, 23 aa, Entamoeba histolytica
KRKVTTYTKPKKDALQSRSSRSA

SEQ ID NO: 2635098 - protein, 4 aa, Entamoeba histolytica
KRKY

SEQ ID NO: 2635099 - protein, 10 aa, Entamoeba histolytica
KRKYQKKNEE

SEQ ID NO: 2635100 - protein, 13 aa, Entamoeba histolytica
KRLATEKNRIESS

SEQ ID NO: 2635101 - protein, 7 aa, Entamoeba histolytica
KRLDEAT

SEQ ID NO: 2635102 - protein, 4 aa, Entamoeba histolytica
KRLE

SEQ ID NO: 2635103 - protein, 5 aa, Entamoeba histolytica
KRLEQ

SEQ ID NO: 2635104 - protein, 14 aa, Entamoeba histolytica
KRLERKEPKVIENT

SEQ ID NO: 2635105 - protein, 47 aa, Entamoeba histolytica
KRLETENERLKQEQEQLKEVKDKKKKDNKKEKKKSVKIKESPIISTT

SEQ ID NO: 2635106 - protein, 26 aa, Entamoeba histolytica
KRLGEEGSFYKENNKLQKKIVDDNKS

SEQ ID NO: 2635107 - protein, 20 aa, Entamoeba histolytica
KRLGEEGSFYKENNKLQKRI

SEQ ID NO: 2635108 - protein, 13 aa, Entamoeba histolytica
KRLKRNSAGNIGS

SEQ ID NO: 2635109 - protein, 11 aa, Entamoeba histolytica
KRLKSQTTTPL

SEQ ID NO: 2635110 - protein, 8 aa, Entamoeba histolytica
KRLPAPSC

SEQ ID NO: 2635111 - protein, 5 aa, Entamoeba histolytica
KRLQS

SEQ ID NO: 2635112 - protein, 9 aa, Entamoeba histolytica
KRLRKSEVR

SEQ ID NO: 2635113 - protein, 5 aa, Entamoeba histolytica
KRLRP

SEQ ID NO: 2635114 - protein, 21 aa, Entamoeba histolytica
KRMDGKKCQKGYDSHFSPKGN

SEQ ID NO: 2635115 - protein, 16 aa, Entamoeba histolytica
KRMEEKTELEKKNEEL

SEQ ID NO: 2635116 - protein, 6 aa, Entamoeba histolytica
KRMENG

SEQ ID NO: 2635117 - protein, 4 aa, Entamoeba histolytica
KRMK

SEQ ID NO: 2635118 - protein, 8 aa, Entamoeba histolytica
KRMKDASS

SEQ ID NO: 2635119 - protein, 14 aa, Entamoeba histolytica
KRMKQEIESGLSHE

SEQ ID NO: 2635120 - protein, 5 aa, Entamoeba histolytica
KRMPS

SEQ ID NO: 2635121 - protein, 9 aa, Entamoeba histolytica
KRMSRNEET

SEQ ID NO: 2635122 - protein, 24 aa, Entamoeba histolytica
KRMTSAKRKRVEKAKKKINLKQRR

SEQ ID NO: 2635123 - protein, 4 aa, Entamoeba histolytica
KRNA

SEQ ID NO: 2635124 - protein, 5 aa, Entamoeba histolytica
KRNAL

SEQ ID NO: 2635125 - protein, 12 aa, Entamoeba histolytica
KRNANPEKFTSR

SEQ ID NO: 2635126 - protein, 9 aa, Entamoeba histolytica
KRNATKQNI

SEQ ID NO: 2635127 - protein, 6 aa, Entamoeba histolytica
KRNDVR

SEQ ID NO: 2635128 - protein, 6 aa, Entamoeba histolytica
KRNDYT

SEQ ID NO: 2635129 - protein, 8 aa, Entamoeba histolytica
KRNEDWNE

SEQ ID NO: 2635130 - protein, 6 aa, Entamoeba histolytica
KRNEEV

SEQ ID NO: 2635131 - protein, 7 aa, Entamoeba histolytica
KRNEEVA

SEQ ID NO: 2635132 - protein, 6 aa, Entamoeba histolytica
KRNEFN

SEQ ID NO: 2635133 - protein, 5 aa, Entamoeba histolytica
KRNEG

SEQ ID NO: 2635134 - protein, 7 aa, Entamoeba histolytica
KRNEGSE

SEQ ID NO: 2635135 - protein, 7 aa, Entamoeba histolytica
KRNEKVM

SEQ ID NO: 2635136 - protein, 7 aa, Entamoeba histolytica
KRNELIR

SEQ ID NO: 2635137 - protein, 11 aa, Entamoeba histolytica
KRNERKLEERI

SEQ ID NO: 2635138 - protein, 16 aa, Entamoeba histolytica
KRNERLKHQIIKIKKL

SEQ ID NO: 2635139 - protein, 9 aa, Entamoeba histolytica
KRNESDEKY

SEQ ID NO: 2635140 - protein, 7 aa, Entamoeba histolytica
KRNESVP

SEQ ID NO: 2635141 - protein, 7 aa, Entamoeba histolytica
KRNEYDS

SEQ ID NO: 2635142 - protein, 4 aa, Entamoeba histolytica
KRNG

SEQ ID NO: 2635143 - protein, 6 aa, Entamoeba histolytica
KRNGRT

SEQ ID NO: 2635144 - protein, 11 aa, Entamoeba histolytica
KRNHGSYDGRQ

SEQ ID NO: 2635145 - protein, 15 aa, Entamoeba histolytica
KRNIAQGIEPPQYPA

SEQ ID NO: 2635146 - protein, 5 aa, Entamoeba histolytica
KRNKC

SEQ ID NO: 2635147 - protein, 6 aa, Entamoeba histolytica
KRNKDA

SEQ ID NO: 2635148 - protein, 6 aa, Entamoeba histolytica
KRNKEV

SEQ ID NO: 2635149 - protein, 8 aa, Entamoeba histolytica
KRNKGINT

SEQ ID NO: 2635150 - protein, 23 aa, Entamoeba histolytica
KRNKKTVKQEEKDKQKKDEGKKY

SEQ ID NO: 2635151 - protein, 12 aa, Entamoeba histolytica
KRNKSEYSPGFN

SEQ ID NO: 2635152 - protein, 8 aa, Entamoeba histolytica
KRNKSTEL

SEQ ID NO: 2635153 - protein, 10 aa, Entamoeba histolytica
KRNKVTRKSI

SEQ ID NO: 2635154 - protein, 6 aa, Entamoeba histolytica
KRNLDT

SEQ ID NO: 2635155 - protein, 31 aa, Entamoeba histolytica
KRNLQRNKKGISRIEAAEKVKCELSSSEESV

SEQ ID NO: 2635156 - protein, 4 aa, Entamoeba histolytica
KRNN

SEQ ID NO: 2635157 - protein, 7 aa, Entamoeba histolytica
KRNNDSL

SEQ ID NO: 2635158 - protein, 10 aa, Entamoeba histolytica
KRNNENSNAI

SEQ ID NO: 2635159 - protein, 11 aa, Entamoeba histolytica
KRNNSITKATS

SEQ ID NO: 2635160 - protein, 8 aa, Entamoeba histolytica
KRNPDTVN

SEQ ID NO: 2635161 - protein, 6 aa, Entamoeba histolytica
KRNPEN

SEQ ID NO: 2635162 - protein, 5 aa, Entamoeba histolytica
KRNPF

SEQ ID NO: 2635163 - protein, 7 aa, Entamoeba histolytica
KRNPRKF

SEQ ID NO: 2635164 - protein, 7 aa, Entamoeba histolytica
KRNQISS

SEQ ID NO: 2635165 - protein, 14 aa, Entamoeba histolytica
KRNQQNIKTEEDYI

SEQ ID NO: 2635166 - protein, 13 aa, Entamoeba histolytica
KRNYEEAKKEFKE

SEQ ID NO: 2635167 - protein, 6 aa, Entamoeba histolytica
KRPAEN

SEQ ID NO: 2635168 - protein, 8 aa, Entamoeba histolytica
KRPALQSG

SEQ ID NO: 2635169 - protein, 6 aa, Entamoeba histolytica
KRPDEE

SEQ ID NO: 2635170 - protein, 7 aa, Entamoeba histolytica
KRPDMDQ

SEQ ID NO: 2635171 - protein, 8 aa, Entamoeba histolytica
KRPDTIST

SEQ ID NO: 2635172 - protein, 7 aa, Entamoeba histolytica
KRPEEIA

SEQ ID NO: 2635173 - protein, 5 aa, Entamoeba histolytica
KRPEI

SEQ ID NO: 2635174 - protein, 14 aa, Entamoeba histolytica
KRPETSHIASSETV

SEQ ID NO: 2635175 - protein, 8 aa, Entamoeba histolytica
KRPHHESL

SEQ ID NO: 2635176 - protein, 17 aa, Entamoeba histolytica
KRPHQPPTNDLLPPTHQ

SEQ ID NO: 2635177 - protein, 6 aa, Entamoeba histolytica
KRPIDE

SEQ ID NO: 2635178 - protein, 6 aa, Entamoeba histolytica
KRPISD

SEQ ID NO: 2635179 - protein, 8 aa, Entamoeba histolytica
KRPKSIDF

SEQ ID NO: 2635180 - protein, 5 aa, Entamoeba histolytica
KRPLQ

SEQ ID NO: 2635181 - protein, 6 aa, Entamoeba histolytica
KRPQLK

SEQ ID NO: 2635182 - protein, 25 aa, Entamoeba histolytica
KRPQMKTPTGNITSTQSNNSTPIHE

SEQ ID NO: 2635183 - protein, 7 aa, Entamoeba histolytica
KRPRAST

SEQ ID NO: 2635184 - protein, 16 aa, Entamoeba histolytica
KRPSASYLLKHITEFF

SEQ ID NO: 2635185 - protein, 27 aa, Entamoeba histolytica
KRPSEITPNSRAKTLKPKTSETPDPVL

SEQ ID NO: 2635186 - protein, 10 aa, Entamoeba histolytica
KRPSEMKNKD

SEQ ID NO: 2635187 - protein, 13 aa, Entamoeba histolytica
KRPSGPRKGQSIQ

SEQ ID NO: 2635188 - protein, 6 aa, Entamoeba histolytica
KRPSIS

SEQ ID NO: 2635189 - protein, 7 aa, Entamoeba histolytica
KRPTIGT

SEQ ID NO: 2635190 - protein, 4 aa, Entamoeba histolytica
KRQE

SEQ ID NO: 2635191 - protein, 6 aa, Entamoeba histolytica
KRQEAA

SEQ ID NO: 2635192 - protein, 43 aa, Entamoeba histolytica
KRQEKKIKEKEKIKEKEMKRINDENNKFETTSKQKRKNRNERR

SEQ ID NO: 2635193 - protein, 6 aa, Entamoeba histolytica
KRQELS

SEQ ID NO: 2635194 - protein, 12 aa, Entamoeba histolytica
KRQKDGKNISPD

SEQ ID NO: 2635195 - protein, 6 aa, Entamoeba histolytica
KRQKEI

SEQ ID NO: 2635196 - protein, 7 aa, Entamoeba histolytica
KRQLKED

SEQ ID NO: 2635197 - protein, 5 aa, Entamoeba histolytica
KRQMK

SEQ ID NO: 2635198 - protein, 4 aa, Entamoeba histolytica
KRQN

SEQ ID NO: 2635199 - protein, 4 aa, Entamoeba histolytica
KRQP

SEQ ID NO: 2635200 - protein, 18 aa, Entamoeba histolytica
KRQPTVKSTNNPNEKKNN

SEQ ID NO: 2635201 - protein, 4 aa, Entamoeba histolytica
KRQQ

SEQ ID NO: 2635202 - protein, 6 aa, Entamoeba histolytica
KRQQLE

SEQ ID NO: 2635203 - protein, 7 aa, Entamoeba histolytica
KRQQLNQ

SEQ ID NO: 2635204 - protein, 7 aa, Entamoeba histolytica
KRQQSKV

SEQ ID NO: 2635205 - protein, 4 aa, Entamoeba histolytica
KRQR

SEQ ID NO: 2635206 - protein, 12 aa, Entamoeba histolytica
KRQSRDEEASFS

SEQ ID NO: 2635207 - protein, 6 aa, Entamoeba histolytica
KRQTIP

SEQ ID NO: 2635208 - protein, 5 aa, Entamoeba histolytica
KRREC

SEQ ID NO: 2635209 - protein, 10 aa, Entamoeba histolytica
KRREIKRNRE

SEQ ID NO: 2635210 - protein, 4 aa, Entamoeba histolytica
KRRF

SEQ ID NO: 2635211 - protein, 6 aa, Entamoeba histolytica
KRRGST

SEQ ID NO: 2635212 - protein, 16 aa, Entamoeba histolytica
KRRGTMRENRTIPRRT

SEQ ID NO: 2635213 - protein, 9 aa, Entamoeba histolytica
KRRKENEAA

SEQ ID NO: 2635214 - protein, 5 aa, Entamoeba histolytica
KRRKQ

SEQ ID NO: 2635215 - protein, 12 aa, Entamoeba histolytica
KRRNETNNITKK

SEQ ID NO: 2635216 - protein, 13 aa, Entamoeba histolytica
KRRQQAEDTPEQI

SEQ ID NO: 2635217 - protein, 8 aa, Entamoeba histolytica
KRRREIDS

SEQ ID NO: 2635218 - protein, 8 aa, Entamoeba histolytica
KRRRQPTV

SEQ ID NO: 2635219 - protein, 9 aa, Entamoeba histolytica
KRRSARVPN

SEQ ID NO: 2635220 - protein, 6 aa, Entamoeba histolytica
KRRSEE

SEQ ID NO: 2635221 - protein, 4 aa, Entamoeba histolytica
KRRY

SEQ ID NO: 2635222 - protein, 6 aa, Entamoeba histolytica
KRSADN

SEQ ID NO: 2635223 - protein, 7 aa, Entamoeba histolytica
KRSCSPV

SEQ ID NO: 2635224 - protein, 10 aa, Entamoeba histolytica
KRSDFGDTTT

SEQ ID NO: 2635225 - protein, 9 aa, Entamoeba histolytica
KRSEAGETV

SEQ ID NO: 2635226 - protein, 7 aa, Entamoeba histolytica
KRSELEN

SEQ ID NO: 2635227 - protein, 6 aa, Entamoeba histolytica
KRSETV

SEQ ID NO: 2635228 - protein, 17 aa, Entamoeba histolytica
KRSFTQTEFNHDYNELK

SEQ ID NO: 2635229 - protein, 10 aa, Entamoeba histolytica
KRSGEEKGEV

SEQ ID NO: 2635230 - protein, 7 aa, Entamoeba histolytica
KRSGQLS

SEQ ID NO: 2635231 - protein, 9 aa, Entamoeba histolytica
KRSHPRNSS

SEQ ID NO: 2635232 - protein, 13 aa, Entamoeba histolytica
KRSHSKSGKIDID

SEQ ID NO: 2635233 - protein, 6 aa, Entamoeba histolytica
KRSIGP

SEQ ID NO: 2635234 - protein, 7 aa, Entamoeba histolytica
KRSKKTM

SEQ ID NO: 2635235 - protein, 5 aa, Entamoeba histolytica
KRSKS

SEQ ID NO: 2635236 - protein, 8 aa, Entamoeba histolytica
KRSNSTTS

SEQ ID NO: 2635237 - protein, 7 aa, Entamoeba histolytica
KRSPIEK

SEQ ID NO: 2635238 - protein, 11 aa, Entamoeba histolytica
KRSPSGTTPMP

SEQ ID NO: 2635239 - protein, 9 aa, Entamoeba histolytica
KRSQPRNVA

SEQ ID NO: 2635240 - protein, 11 aa, Entamoeba histolytica
KRSRDDQKEAI

SEQ ID NO: 2635241 - protein, 8 aa, Entamoeba histolytica
KRSREAQL

SEQ ID NO: 2635242 - protein, 5 aa, Entamoeba histolytica
KRSSK

SEQ ID NO: 2635243 - protein, 15 aa, Entamoeba histolytica
KRSTFEEGVANGTAE

SEQ ID NO: 2635244 - protein, 5 aa, Entamoeba histolytica
KRSTI

SEQ ID NO: 2635245 - protein, 14 aa, Entamoeba histolytica
KRSTKKTKLETETA

SEQ ID NO: 2635246 - protein, 12 aa, Entamoeba histolytica
KRSTKSSKKTLQ

SEQ ID NO: 2635247 - protein, 13 aa, Entamoeba histolytica
KRSVRYPDGNYEQ

SEQ ID NO: 2635248 - protein, 6 aa, Entamoeba histolytica
KRSYRE

SEQ ID NO: 2635249 - protein, 7 aa, Entamoeba histolytica
KRTATNN

SEQ ID NO: 2635250 - protein, 12 aa, Entamoeba histolytica
KRTDSPKKRSHT

SEQ ID NO: 2635251 - protein, 10 aa, Entamoeba histolytica
KRTEDKKGIR

SEQ ID NO: 2635252 - protein, 29 aa, Entamoeba histolytica
KRTGNKERKHPLNKTKENKKKNESKPKKS

SEQ ID NO: 2635253 - protein, 11 aa, Entamoeba histolytica
KRTIDSYGITE

SEQ ID NO: 2635254 - protein, 6 aa, Entamoeba histolytica
KRTIDT

SEQ ID NO: 2635255 - protein, 7 aa, Entamoeba histolytica
KRTKELD

SEQ ID NO: 2635256 - protein, 12 aa, Entamoeba histolytica
KRTKGQSQNSPF

SEQ ID NO: 2635257 - protein, 7 aa, Entamoeba histolytica
KRTKNSY

SEQ ID NO: 2635258 - protein, 11 aa, Entamoeba histolytica
KRTKREQRDSL

SEQ ID NO: 2635259 - protein, 7 aa, Entamoeba histolytica
KRTLADN

SEQ ID NO: 2635260 - protein, 6 aa, Entamoeba histolytica
KRTLNS

SEQ ID NO: 2635261 - protein, 5 aa, Entamoeba histolytica
KRTLQ

SEQ ID NO: 2635262 - protein, 8 aa, Entamoeba histolytica
KRTNCYSD

SEQ ID NO: 2635263 - protein, 6 aa, Entamoeba histolytica
KRTNEL

SEQ ID NO: 2635264 - protein, 12 aa, Entamoeba histolytica
KRTNGKTTHSRI

SEQ ID NO: 2635265 - protein, 8 aa, Entamoeba histolytica
KRTNNDDD

SEQ ID NO: 2635266 - protein, 8 aa, Entamoeba histolytica
KRTNTPPL

SEQ ID NO: 2635267 - protein, 30 aa, Entamoeba histolytica
KRTPKPSDTSLSYEEKNNLTQPSSDDSWKT

SEQ ID NO: 2635268 - protein, 8 aa, Entamoeba histolytica
KRTPLNDE

SEQ ID NO: 2635269 - protein, 7 aa, Entamoeba histolytica
KRTPSVE

SEQ ID NO: 2635270 - protein, 7 aa, Entamoeba histolytica
KRTQGKT

SEQ ID NO: 2635271 - protein, 13 aa, Entamoeba histolytica
KRTRSSQSVVRFI

SEQ ID NO: 2635272 - protein, 4 aa, Entamoeba histolytica
KRTS

SEQ ID NO: 2635273 - protein, 7 aa, Entamoeba histolytica
KRTSTRI

SEQ ID NO: 2635274 - protein, 5 aa, Entamoeba histolytica
KRTSV

SEQ ID NO: 2635275 - protein, 14 aa, Entamoeba histolytica
KRTTHSKDKSQENI

SEQ ID NO: 2635276 - protein, 14 aa, Entamoeba histolytica
KRTTIAQKEELERK

SEQ ID NO: 2635277 - protein, 6 aa, Entamoeba histolytica
KRTTVN

SEQ ID NO: 2635278 - protein, 23 aa, Entamoeba histolytica
KRTVNDSTNQRRRRNTIGSRNGL

SEQ ID NO: 2635279 - protein, 14 aa, Entamoeba histolytica
KRVEEDEGENDERL

SEQ ID NO: 2635280 - protein, 5 aa, Entamoeba histolytica
KRVEI

SEQ ID NO: 2635281 - protein, 47 aa, Entamoeba histolytica
KRVEKDYNNQEKKEEKLTQKQNQQQKKEKNERRRKTKMNKQEKQEEV

SEQ ID NO: 2635282 - protein, 36 aa, Entamoeba histolytica
KRVESKKPKVIKESKAKKPQIKLPKERKKREGSEIA

SEQ ID NO: 2635283 - protein, 5 aa, Entamoeba histolytica
KRVLE

SEQ ID NO: 2635284 - protein, 6 aa, Entamoeba histolytica
KRVNEE

SEQ ID NO: 2635285 - protein, 5 aa, Entamoeba histolytica
KRVNK

SEQ ID NO: 2635286 - protein, 9 aa, Entamoeba histolytica
KRVNQRQAI

SEQ ID NO: 2635287 - protein, 5 aa, Entamoeba histolytica
KRVPK

SEQ ID NO: 2635288 - protein, 26 aa, Entamoeba histolytica
KRVPKNAQNQKQSCITEDPTEDRGIK

SEQ ID NO: 2635289 - protein, 8 aa, Entamoeba histolytica
KRVQVDEK

SEQ ID NO: 2635290 - protein, 7 aa, Entamoeba histolytica
KRVSSRD

SEQ ID NO: 2635291 - protein, 9 aa, Entamoeba histolytica
KRVSTQEQI

SEQ ID NO: 2635292 - protein, 4 aa, Entamoeba histolytica
KRWD

SEQ ID NO: 2635293 - protein, 5 aa, Entamoeba histolytica
KRWSA

SEQ ID NO: 2635294 - protein, 17 aa, Entamoeba histolytica
KRYEDQDEEDRKKMEER

SEQ ID NO: 2635295 - protein, 30 aa, Entamoeba histolytica
KRYEELNDNYKKIKKENETLKKRGSGLSGL

SEQ ID NO: 2635296 - protein, 12 aa, Entamoeba histolytica
KRYEEVPSEQVS

SEQ ID NO: 2635297 - protein, 7 aa, Entamoeba histolytica
KRYGGMD

SEQ ID NO: 2635298 - protein, 5 aa, Entamoeba histolytica
KRYGW

SEQ ID NO: 2635299 - protein, 10 aa, Entamoeba histolytica
KRYKEAKEQY

SEQ ID NO: 2635300 - protein, 4 aa, Entamoeba histolytica
KRYN

SEQ ID NO: 2635301 - protein, 5 aa, Entamoeba histolytica
KRYNQ

SEQ ID NO: 2635302 - protein, 5 aa, Entamoeba histolytica
KRYPK

SEQ ID NO: 2635303 - protein, 12 aa, Entamoeba histolytica
KRYPVPSPFEKV

SEQ ID NO: 2635304 - protein, 4 aa, Entamoeba histolytica
KRYQ

SEQ ID NO: 2635305 - protein, 8 aa, Entamoeba histolytica
KRYRYDGQ

SEQ ID NO: 2635306 - protein, 4 aa, Entamoeba histolytica
KRYS

SEQ ID NO: 2635307 - protein, 6 aa, Entamoeba histolytica
KRYSSG

SEQ ID NO: 2635308 - protein, 5 aa, Entamoeba histolytica
KRYTN

SEQ ID NO: 2635309 - protein, 9 aa, Entamoeba histolytica
KSAADIPSK

SEQ ID NO: 2635310 - protein, 12 aa, Entamoeba histolytica
KSAALKNATNTL

SEQ ID NO: 2635311 - protein, 9 aa, Entamoeba histolytica
KSADNDIES

SEQ ID NO: 2635312 - protein, 10 aa, Entamoeba histolytica
KSADSQPIFE

SEQ ID NO: 2635313 - protein, 22 aa, Entamoeba histolytica
KSAEDQKAAVEKLNGTTQKERA

SEQ ID NO: 2635314 - protein, 7 aa, Entamoeba histolytica
KSAGCNT

SEQ ID NO: 2635315 - protein, 14 aa, Entamoeba histolytica
KSAIGTEKLTSKRL

SEQ ID NO: 2635316 - protein, 6 aa, Entamoeba histolytica
KSAINP

SEQ ID NO: 2635317 - protein, 11 aa, Entamoeba histolytica
KSAKENVESVE

SEQ ID NO: 2635318 - protein, 29 aa, Entamoeba histolytica
KSALDNGTYSPLLSPTRRSQGANSLGVPH

SEQ ID NO: 2635319 - protein, 6 aa, Entamoeba histolytica
KSANAE

SEQ ID NO: 2635320 - protein, 11 aa, Entamoeba histolytica
KSAPLDTDKPQ

SEQ ID NO: 2635321 - protein, 13 aa, Entamoeba histolytica
KSAQQAIENGCND

SEQ ID NO: 2635322 - protein, 6 aa, Entamoeba histolytica
KSARQA

SEQ ID NO: 2635323 - protein, 15 aa, Entamoeba histolytica
KSAVNDTKDSEQALG

SEQ ID NO: 2635324 - protein, 28 aa, Entamoeba histolytica
KSCCKGKSKPTTPEKQPHPPAEPFDDEH

SEQ ID NO: 2635325 - protein, 20 aa, Entamoeba histolytica
KSCDGVSPVTGKKCPPDPYD

SEQ ID NO: 2635326 - protein, 5 aa, Entamoeba histolytica
KSCEI

SEQ ID NO: 2635327 - protein, 7 aa, Entamoeba histolytica
KSCRVDQ

SEQ ID NO: 2635328 - protein, 23 aa, Entamoeba histolytica
KSDAKAIKKYTQQFTGKDSSAAV

SEQ ID NO: 2635329 - protein, 11 aa, Entamoeba histolytica
KSDCSDEERQV

SEQ ID NO: 2635330 - protein, 13 aa, Entamoeba histolytica
KSDDVEKKETLNV

SEQ ID NO: 2635331 - protein, 6 aa, Entamoeba histolytica
KSDEET

SEQ ID NO: 2635332 - protein, 4 aa, Entamoeba histolytica
KSDG

SEQ ID NO: 2635333 - protein, 11 aa, Entamoeba histolytica
KSDGKENINNI

SEQ ID NO: 2635334 - protein, 7 aa, Entamoeba histolytica
KSDGSYE

SEQ ID NO: 2635335 - protein, 10 aa, Entamoeba histolytica
KSDHSSDSRI

SEQ ID NO: 2635336 - protein, 19 aa, Entamoeba histolytica
KSDIEQQRDITTDVGASLA

SEQ ID NO: 2635337 - protein, 8 aa, Entamoeba histolytica
KSDIFTPN

SEQ ID NO: 2635338 - protein, 13 aa, Entamoeba histolytica
KSDINSDVTIENG

SEQ ID NO: 2635339 - protein, 14 aa, Entamoeba histolytica
KSDIPPEVETSTTL

SEQ ID NO: 2635340 - protein, 7 aa, Entamoeba histolytica
KSDISQD

SEQ ID NO: 2635341 - protein, 19 aa, Entamoeba histolytica
KSDKEKEKDEKIKRKGGLG

SEQ ID NO: 2635342 - protein, 9 aa, Entamoeba histolytica
KSDKPIDNS

SEQ ID NO: 2635343 - protein, 9 aa, Entamoeba histolytica
KSDLDSNRV

SEQ ID NO: 2635344 - protein, 22 aa, Entamoeba histolytica
KSDLEASRQVSTDEGKEFASKK

SEQ ID NO: 2635345 - protein, 7 aa, Entamoeba histolytica
KSDLEQN

SEQ ID NO: 2635346 - protein, 8 aa, Entamoeba histolytica
KSDLESER

SEQ ID NO: 2635347 - protein, 17 aa, Entamoeba histolytica
KSDLGDSKTPKEEADEF

SEQ ID NO: 2635348 - protein, 14 aa, Entamoeba histolytica
KSDLKSSRQVNSAS

SEQ ID NO: 2635349 - protein, 7 aa, Entamoeba histolytica
KSDLLSK

SEQ ID NO: 2635350 - protein, 22 aa, Entamoeba histolytica
KSDLNDIKTSKEDADEFVNDKS

SEQ ID NO: 2635351 - protein, 10 aa, Entamoeba histolytica
KSDLPPTVSE

SEQ ID NO: 2635352 - protein, 12 aa, Entamoeba histolytica
KSDLRDNSINHS

SEQ ID NO: 2635353 - protein, 6 aa, Entamoeba histolytica
KSDLSY

SEQ ID NO: 2635354 - protein, 9 aa, Entamoeba histolytica
KSDLVSQDD

SEQ ID NO: 2635355 - protein, 12 aa, Entamoeba histolytica
KSDMTGKESNPF

SEQ ID NO: 2635356 - protein, 8 aa, Entamoeba histolytica
KSDNEYNE

SEQ ID NO: 2635357 - protein, 8 aa, Entamoeba histolytica
KSDNLKNP

SEQ ID NO: 2635358 - protein, 9 aa, Entamoeba histolytica
KSDNMKMAG

SEQ ID NO: 2635359 - protein, 9 aa, Entamoeba histolytica
KSDNNTEIQ

SEQ ID NO: 2635360 - protein, 7 aa, Entamoeba histolytica
KSDPADV

SEQ ID NO: 2635361 - protein, 7 aa, Entamoeba histolytica
KSDPQQG

SEQ ID NO: 2635362 - protein, 8 aa, Entamoeba histolytica
KSDQIKKM

SEQ ID NO: 2635363 - protein, 15 aa, Entamoeba histolytica
KSDRYSKSSFSSLSR

SEQ ID NO: 2635364 - protein, 4 aa, Entamoeba histolytica
KSDS

SEQ ID NO: 2635365 - protein, 8 aa, Entamoeba histolytica
KSDSLSTV

SEQ ID NO: 2635366 - protein, 7 aa, Entamoeba histolytica
KSDSRMK

SEQ ID NO: 2635367 - protein, 9 aa, Entamoeba histolytica
KSDSSDISH

SEQ ID NO: 2635368 - protein, 9 aa, Entamoeba histolytica
KSDTASVSI

SEQ ID NO: 2635369 - protein, 5 aa, Entamoeba histolytica
KSDTF

SEQ ID NO: 2635370 - protein, 4 aa, Entamoeba histolytica
KSDV

SEQ ID NO: 2635371 - protein, 12 aa, Entamoeba histolytica
KSDVFSKSTPLN

SEQ ID NO: 2635372 - protein, 10 aa, Entamoeba histolytica
KSDVRNNPNA

SEQ ID NO: 2635373 - protein, 7 aa, Entamoeba histolytica
KSDYNGN

SEQ ID NO: 2635374 - protein, 26 aa, Entamoeba histolytica
KSEEDPKKLDTRHKQVSYGKVTEGYA

SEQ ID NO: 2635375 - protein, 9 aa, Entamoeba histolytica
KSEEDTMKE

SEQ ID NO: 2635376 - protein, 28 aa, Entamoeba histolytica
KSEEEIDNRTNGMIEEKKQSEENPSQEI

SEQ ID NO: 2635377 - protein, 7 aa, Entamoeba histolytica
KSEEELL

SEQ ID NO: 2635378 - protein, 8 aa, Entamoeba histolytica
KSEEETIN

SEQ ID NO: 2635379 - protein, 10 aa, Entamoeba histolytica
KSEENNLKKN

SEQ ID NO: 2635380 - protein, 8 aa, Entamoeba histolytica
KSEERSIN

SEQ ID NO: 2635381 - protein, 6 aa, Entamoeba histolytica
KSEFEY

SEQ ID NO: 2635382 - protein, 22 aa, Entamoeba histolytica
KSEFNKNSKRVQSALEKKSDEV

SEQ ID NO: 2635383 - protein, 4 aa, Entamoeba histolytica
KSEI

SEQ ID NO: 2635384 - protein, 8 aa, Entamoeba histolytica
KSEIEENK

SEQ ID NO: 2635385 - protein, 21 aa, Entamoeba histolytica
KSEINHSDSKTEQLNQSFTSV

SEQ ID NO: 2635386 - protein, 8 aa, Entamoeba histolytica
KSEKDLQI

SEQ ID NO: 2635387 - protein, 7 aa, Entamoeba histolytica
KSEKEGI

SEQ ID NO: 2635388 - protein, 96 aa, Entamoeba histolytica
KSEKEGKKNATTNEIPKNKKEVKVETKEKQKGVKEEKKVVEEKKEVKEEEKKKEIKEENNKESSSSSSSESSSDSSSSESSDSESSSNSSSSSSES

SEQ ID NO: 2635389 - protein, 5 aa, Entamoeba histolytica
KSEKI

SEQ ID NO: 2635390 - protein, 9 aa, Entamoeba histolytica
KSEKNNERD

SEQ ID NO: 2635391 - protein, 12 aa, Entamoeba histolytica
KSEKNQSIIPSE

SEQ ID NO: 2635392 - protein, 8 aa, Entamoeba histolytica
KSEKSKMT

SEQ ID NO: 2635393 - protein, 7 aa, Entamoeba histolytica
KSEKVAK

SEQ ID NO: 2635394 - protein, 5 aa, Entamoeba histolytica
KSEMK

SEQ ID NO: 2635395 - protein, 7 aa, Entamoeba histolytica
KSENSQI

SEQ ID NO: 2635396 - protein, 7 aa, Entamoeba histolytica
KSEPNEL

SEQ ID NO: 2635397 - protein, 30 aa, Entamoeba histolytica
KSEPSIGRSLPPIPQKRSGINIQHTPYPQI

SEQ ID NO: 2635398 - protein, 8 aa, Entamoeba histolytica
KSEPSISK

SEQ ID NO: 2635399 - protein, 6 aa, Entamoeba histolytica
KSEQGC

SEQ ID NO: 2635400 - protein, 17 aa, Entamoeba histolytica
KSEQKRKLREKEQEDLA

SEQ ID NO: 2635401 - protein, 9 aa, Entamoeba histolytica
KSEQMNNKE

SEQ ID NO: 2635402 - protein, 7 aa, Entamoeba histolytica
KSEQNSF

SEQ ID NO: 2635403 - protein, 5 aa, Entamoeba histolytica
KSEQP

SEQ ID NO: 2635404 - protein, 11 aa, Entamoeba histolytica
KSEQPKRRMTS

SEQ ID NO: 2635405 - protein, 7 aa, Entamoeba histolytica
KSEQYKK

SEQ ID NO: 2635406 - protein, 19 aa, Entamoeba histolytica
KSERIRESIKNKEKRIEEN

SEQ ID NO: 2635407 - protein, 7 aa, Entamoeba histolytica
KSESNEK

SEQ ID NO: 2635408 - protein, 12 aa, Entamoeba histolytica
KSESQTQNELNE

SEQ ID NO: 2635409 - protein, 10 aa, Entamoeba histolytica
KSESSKEKKW

SEQ ID NO: 2635410 - protein, 14 aa, Entamoeba histolytica
KSETAGRYVTYRAV

SEQ ID NO: 2635411 - protein, 9 aa, Entamoeba histolytica
KSETDNYSS

SEQ ID NO: 2635412 - protein, 5 aa, Entamoeba histolytica
KSETE

SEQ ID NO: 2635413 - protein, 10 aa, Entamoeba histolytica
KSETEIEKSL

SEQ ID NO: 2635414 - protein, 9 aa, Entamoeba histolytica
KSETPMKKG

SEQ ID NO: 2635415 - protein, 22 aa, Entamoeba histolytica
KSETYSKQRSTSSSSKVREVED

SEQ ID NO: 2635416 - protein, 13 aa, Entamoeba histolytica
KSEVDEAKSNSSG

SEQ ID NO: 2635417 - protein, 14 aa, Entamoeba histolytica
KSEVSDSAKEQYED

SEQ ID NO: 2635418 - protein, 7 aa, Entamoeba histolytica
KSEYTEQ

SEQ ID NO: 2635419 - protein, 11 aa, Entamoeba histolytica
KSFDTSMGNST

SEQ ID NO: 2635420 - protein, 4 aa, Entamoeba histolytica
KSFE

SEQ ID NO: 2635421 - protein, 20 aa, Entamoeba histolytica
KSFEDNTIKHDEKDDIDQQL

SEQ ID NO: 2635422 - protein, 6 aa, Entamoeba histolytica
KSFEDT

SEQ ID NO: 2635423 - protein, 7 aa, Entamoeba histolytica
KSFEESL

SEQ ID NO: 2635424 - protein, 10 aa, Entamoeba histolytica
KSFEGSENEM

SEQ ID NO: 2635425 - protein, 6 aa, Entamoeba histolytica
KSFENE

SEQ ID NO: 2635426 - protein, 6 aa, Entamoeba histolytica
KSFGPD

SEQ ID NO: 2635427 - protein, 6 aa, Entamoeba histolytica
KSFGSD

SEQ ID NO: 2635428 - protein, 8 aa, Entamoeba histolytica
KSFKGKEG

SEQ ID NO: 2635429 - protein, 6 aa, Entamoeba histolytica
KSFKPK

SEQ ID NO: 2635430 - protein, 14 aa, Entamoeba histolytica
KSFKPSYIVAIQWS

SEQ ID NO: 2635431 - protein, 10 aa, Entamoeba histolytica
KSFNENIEKE

SEQ ID NO: 2635432 - protein, 6 aa, Entamoeba histolytica
KSFNLS

SEQ ID NO: 2635433 - protein, 7 aa, Entamoeba histolytica
KSFPEET

SEQ ID NO: 2635434 - protein, 8 aa, Entamoeba histolytica
KSFPKNIE

SEQ ID NO: 2635435 - protein, 13 aa, Entamoeba histolytica
KSFQTTEDSTTIS

SEQ ID NO: 2635436 - protein, 13 aa, Entamoeba histolytica
KSFRTSKSEDYVR

SEQ ID NO: 2635437 - protein, 4 aa, Entamoeba histolytica
KSFT

SEQ ID NO: 2635438 - protein, 7 aa, Entamoeba histolytica
KSGDDIV

SEQ ID NO: 2635439 - protein, 9 aa, Entamoeba histolytica
KSGDENATK

SEQ ID NO: 2635440 - protein, 10 aa, Entamoeba histolytica
KSGESATNCN

SEQ ID NO: 2635441 - protein, 4 aa, Entamoeba histolytica
KSGF

SEQ ID NO: 2635442 - protein, 5 aa, Entamoeba histolytica
KSGFE

SEQ ID NO: 2635443 - protein, 5 aa, Entamoeba histolytica
KSGGA

SEQ ID NO: 2635444 - protein, 7 aa, Entamoeba histolytica
KSGGHFG

SEQ ID NO: 2635445 - protein, 8 aa, Entamoeba histolytica
KSGGYYSN

SEQ ID NO: 2635446 - protein, 4 aa, Entamoeba histolytica
KSGI

SEQ ID NO: 2635447 - protein, 5 aa, Entamoeba histolytica
KSGKK

SEQ ID NO: 2635448 - protein, 6 aa, Entamoeba histolytica
KSGKRG

SEQ ID NO: 2635449 - protein, 9 aa, Entamoeba histolytica
KSGKRQNKA

SEQ ID NO: 2635450 - protein, 8 aa, Entamoeba histolytica
KSGKSEAV

SEQ ID NO: 2635451 - protein, 4 aa, Entamoeba histolytica
KSGL

SEQ ID NO: 2635452 - protein, 11 aa, Entamoeba histolytica
KSGLEYKVDKE

SEQ ID NO: 2635453 - protein, 13 aa, Entamoeba histolytica
KSGLLGENPLGIP

SEQ ID NO: 2635454 - protein, 5 aa, Entamoeba histolytica
KSGLR

SEQ ID NO: 2635455 - protein, 6 aa, Entamoeba histolytica
KSGNEE

SEQ ID NO: 2635456 - protein, 4 aa, Entamoeba histolytica
KSGQ

SEQ ID NO: 2635457 - protein, 9 aa, Entamoeba histolytica
KSGQPIQSL

SEQ ID NO: 2635458 - protein, 9 aa, Entamoeba histolytica
KSGQSDLQE

SEQ ID NO: 2635459 - protein, 9 aa, Entamoeba histolytica
KSGRYSSSG

SEQ ID NO: 2635460 - protein, 16 aa, Entamoeba histolytica
KSGTKIQKRRTLGRNT

SEQ ID NO: 2635461 - protein, 12 aa, Entamoeba histolytica
KSGTKKKSYCGA

SEQ ID NO: 2635462 - protein, 8 aa, Entamoeba histolytica
KSGTPEEF

SEQ ID NO: 2635463 - protein, 6 aa, Entamoeba histolytica
KSGVHA

SEQ ID NO: 2635464 - protein, 8 aa, Entamoeba histolytica
KSGYYKGN

SEQ ID NO: 2635465 - protein, 7 aa, Entamoeba histolytica
KSHAATL

SEQ ID NO: 2635466 - protein, 5 aa, Entamoeba histolytica
KSHDL

SEQ ID NO: 2635467 - protein, 6 aa, Entamoeba histolytica
KSHEEG

SEQ ID NO: 2635468 - protein, 8 aa, Entamoeba histolytica
KSHEGRER

SEQ ID NO: 2635469 - protein, 7 aa, Entamoeba histolytica
KSHEKGK

SEQ ID NO: 2635470 - protein, 4 aa, Entamoeba histolytica
KSHH

SEQ ID NO: 2635471 - protein, 7 aa, Entamoeba histolytica
KSHNKAV

SEQ ID NO: 2635472 - protein, 5 aa, Entamoeba histolytica
KSHPE

SEQ ID NO: 2635473 - protein, 4 aa, Entamoeba histolytica
KSHQ

SEQ ID NO: 2635474 - protein, 6 aa, Entamoeba histolytica
KSHQTL

SEQ ID NO: 2635475 - protein, 7 aa, Entamoeba histolytica
KSHSGEV

SEQ ID NO: 2635476 - protein, 7 aa, Entamoeba histolytica
KSHSTSK

SEQ ID NO: 2635477 - protein, 6 aa, Entamoeba histolytica
KSIATD

SEQ ID NO: 2635478 - protein, 7 aa, Entamoeba histolytica
KSIATTL

SEQ ID NO: 2635479 - protein, 7 aa, Entamoeba histolytica
KSIDDAK

SEQ ID NO: 2635480 - protein, 5 aa, Entamoeba histolytica
KSIDE

SEQ ID NO: 2635481 - protein, 8 aa, Entamoeba histolytica
KSIDEFPD

SEQ ID NO: 2635482 - protein, 7 aa, Entamoeba histolytica
KSIDGNK

SEQ ID NO: 2635483 - protein, 6 aa, Entamoeba histolytica
KSIDKK

SEQ ID NO: 2635484 - protein, 15 aa, Entamoeba histolytica
KSIEDEKSETSNSNS

SEQ ID NO: 2635485 - protein, 6 aa, Entamoeba histolytica
KSIEEA

SEQ ID NO: 2635486 - protein, 6 aa, Entamoeba histolytica
KSIEEQ

SEQ ID NO: 2635487 - protein, 13 aa, Entamoeba histolytica
KSIEERLSSKQGR

SEQ ID NO: 2635488 - protein, 8 aa, Entamoeba histolytica
KSIEESIE

SEQ ID NO: 2635489 - protein, 13 aa, Entamoeba histolytica
KSIEESVQQGNKT

SEQ ID NO: 2635490 - protein, 32 aa, Entamoeba histolytica
KSIEEYKNDRQSECSRKGSVSGTDSPSSFKPK

SEQ ID NO: 2635491 - protein, 5 aa, Entamoeba histolytica
KSIEG

SEQ ID NO: 2635492 - protein, 56 aa, Entamoeba histolytica
KSIEGGITEKRESIKMQERANERKKAISSGRRSVSTIQEDACDDIKKQVEEKRNTI

SEQ ID NO: 2635493 - protein, 15 aa, Entamoeba histolytica
KSIEGKTTSLKEYRK

SEQ ID NO: 2635494 - protein, 8 aa, Entamoeba histolytica
KSIEGQEN

SEQ ID NO: 2635495 - protein, 23 aa, Entamoeba histolytica
KSIEKEGKKERKKEEESEEELGD

SEQ ID NO: 2635496 - protein, 6 aa, Entamoeba histolytica
KSIEKI

SEQ ID NO: 2635497 - protein, 19 aa, Entamoeba histolytica
KSIEKQNGTITAKNTRSTV

SEQ ID NO: 2635498 - protein, 18 aa, Entamoeba histolytica
KSIEKTKSKRKGGTISGI

SEQ ID NO: 2635499 - protein, 5 aa, Entamoeba histolytica
KSIEN

SEQ ID NO: 2635500 - protein, 13 aa, Entamoeba histolytica
KSIETNPPNYTTI

SEQ ID NO: 2635501 - protein, 13 aa, Entamoeba histolytica
KSIEVEENQLSEK

SEQ ID NO: 2635502 - protein, 4 aa, Entamoeba histolytica
KSIG

SEQ ID NO: 2635503 - protein, 9 aa, Entamoeba histolytica
KSIGKKGVK

SEQ ID NO: 2635504 - protein, 6 aa, Entamoeba histolytica
KSIGRE

SEQ ID NO: 2635505 - protein, 29 aa, Entamoeba histolytica
KSIGVNTDTGGGNRPITNSASVVKKQKKI

SEQ ID NO: 2635506 - protein, 4 aa, Entamoeba histolytica
KSII

SEQ ID NO: 2635507 - protein, 10 aa, Entamoeba histolytica
KSIKEYASKE

SEQ ID NO: 2635508 - protein, 10 aa, Entamoeba histolytica
KSIKPENERG

SEQ ID NO: 2635509 - protein, 9 aa, Entamoeba histolytica
KSIKRTKSF

SEQ ID NO: 2635510 - protein, 5 aa, Entamoeba histolytica
KSILE

SEQ ID NO: 2635511 - protein, 18 aa, Entamoeba histolytica
KSINDTKQNSLKQQPEIP

SEQ ID NO: 2635512 - protein, 7 aa, Entamoeba histolytica
KSINHTE

SEQ ID NO: 2635513 - protein, 7 aa, Entamoeba histolytica
KSIPEGK

SEQ ID NO: 2635514 - protein, 8 aa, Entamoeba histolytica
KSIPIESY

SEQ ID NO: 2635515 - protein, 9 aa, Entamoeba histolytica
KSIPPKPNK

SEQ ID NO: 2635516 - protein, 5 aa, Entamoeba histolytica
KSIPS

SEQ ID NO: 2635517 - protein, 5 aa, Entamoeba histolytica
KSIPT

SEQ ID NO: 2635518 - protein, 6 aa, Entamoeba histolytica
KSIPTE

SEQ ID NO: 2635519 - protein, 6 aa, Entamoeba histolytica
KSIPTT

SEQ ID NO: 2635520 - protein, 6 aa, Entamoeba histolytica
KSIRSE

SEQ ID NO: 2635521 - protein, 5 aa, Entamoeba histolytica
KSISF

SEQ ID NO: 2635522 - protein, 34 aa, Entamoeba histolytica
KSISNNQNDIEKKTDQIKEQQEINKEVKQDEEFS

SEQ ID NO: 2635523 - protein, 6 aa, Entamoeba histolytica
KSISNR

SEQ ID NO: 2635524 - protein, 5 aa, Entamoeba histolytica
KSISS

SEQ ID NO: 2635525 - protein, 16 aa, Entamoeba histolytica
KSISSLEKEQTQLKED

SEQ ID NO: 2635526 - protein, 16 aa, Entamoeba histolytica
KSISSPPKSRWEAVQN

SEQ ID NO: 2635527 - protein, 7 aa, Entamoeba histolytica
KSISSQV

SEQ ID NO: 2635528 - protein, 10 aa, Entamoeba histolytica
KSISTPPNSV

SEQ ID NO: 2635529 - protein, 6 aa, Entamoeba histolytica
KSITDG

SEQ ID NO: 2635530 - protein, 7 aa, Entamoeba histolytica
KSITEQQ

SEQ ID NO: 2635531 - protein, 8 aa, Entamoeba histolytica
KSITGNDN

SEQ ID NO: 2635532 - protein, 6 aa, Entamoeba histolytica
KSITKQ

SEQ ID NO: 2635533 - protein, 7 aa, Entamoeba histolytica
KSITNEE

SEQ ID NO: 2635534 - protein, 27 aa, Entamoeba histolytica
KSITRKDEEENTKPTTDISLPSKESQQ

SEQ ID NO: 2635535 - protein, 6 aa, Entamoeba histolytica
KSITTT

SEQ ID NO: 2635536 - protein, 5 aa, Entamoeba histolytica
KSIYN

SEQ ID NO: 2635537 - protein, 7 aa, Entamoeba histolytica
KSKALEI

SEQ ID NO: 2635538 - protein, 6 aa, Entamoeba histolytica
KSKAPA

SEQ ID NO: 2635539 - protein, 14 aa, Entamoeba histolytica
KSKASKEQIDIVFG

SEQ ID NO: 2635540 - protein, 13 aa, Entamoeba histolytica
KSKCSELLSIEKS

SEQ ID NO: 2635541 - protein, 16 aa, Entamoeba histolytica
KSKDEEKKPKKVETKD

SEQ ID NO: 2635542 - protein, 6 aa, Entamoeba histolytica
KSKDEQ

SEQ ID NO: 2635543 - protein, 9 aa, Entamoeba histolytica
KSKDFNSSH

SEQ ID NO: 2635544 - protein, 8 aa, Entamoeba histolytica
KSKEEDFK

SEQ ID NO: 2635545 - protein, 14 aa, Entamoeba histolytica
KSKEEDNKTQQLEK

SEQ ID NO: 2635546 - protein, 8 aa, Entamoeba histolytica
KSKEEEIP

SEQ ID NO: 2635547 - protein, 10 aa, Entamoeba histolytica
KSKEERKKEW

SEQ ID NO: 2635548 - protein, 6 aa, Entamoeba histolytica
KSKELV

SEQ ID NO: 2635549 - protein, 5 aa, Entamoeba histolytica
KSKEM

SEQ ID NO: 2635550 - protein, 73 aa, Entamoeba histolytica
KSKEMKKALNHQKQHNIEKKVEESKSQKIEKKVEETKPRKIEKKKTRKEKKQERKLKKQIKRNIKKEAKEKQL

SEQ ID NO: 2635551 - protein, 19 aa, Entamoeba histolytica
KSKENSTGNKKDKDKGCNL

SEQ ID NO: 2635552 - protein, 8 aa, Entamoeba histolytica
KSKGGVES

SEQ ID NO: 2635553 - protein, 6 aa, Entamoeba histolytica
KSKGKK

SEQ ID NO: 2635554 - protein, 6 aa, Entamoeba histolytica
KSKGMK

SEQ ID NO: 2635555 - protein, 9 aa, Entamoeba histolytica
KSKGTNIPS

SEQ ID NO: 2635556 - protein, 6 aa, Entamoeba histolytica
KSKHGR

SEQ ID NO: 2635557 - protein, 9 aa, Entamoeba histolytica
KSKIEQDAN

SEQ ID NO: 2635558 - protein, 6 aa, Entamoeba histolytica
KSKIER

SEQ ID NO: 2635559 - protein, 6 aa, Entamoeba histolytica
KSKIIK

SEQ ID NO: 2635560 - protein, 6 aa, Entamoeba histolytica
KSKING

SEQ ID NO: 2635561 - protein, 9 aa, Entamoeba histolytica
KSKINGKEL

SEQ ID NO: 2635562 - protein, 10 aa, Entamoeba histolytica
KSKKENKQIG

SEQ ID NO: 2635563 - protein, 9 aa, Entamoeba histolytica
KSKKEYEEM

SEQ ID NO: 2635564 - protein, 8 aa, Entamoeba histolytica
KSKKGFGY

SEQ ID NO: 2635565 - protein, 8 aa, Entamoeba histolytica
KSKKGTII

SEQ ID NO: 2635566 - protein, 11 aa, Entamoeba histolytica
KSKKPKGPNPL

SEQ ID NO: 2635567 - protein, 19 aa, Entamoeba histolytica
KSKKRKAEKAIERQEQEER

SEQ ID NO: 2635568 - protein, 10 aa, Entamoeba histolytica
KSKKTEEPFS

SEQ ID NO: 2635569 - protein, 6 aa, Entamoeba histolytica
KSKKVT

SEQ ID NO: 2635570 - protein, 5 aa, Entamoeba histolytica
KSKLQ

SEQ ID NO: 2635571 - protein, 13 aa, Entamoeba histolytica
KSKLVNAVKKLMP

SEQ ID NO: 2635572 - protein, 8 aa, Entamoeba histolytica
KSKMGYTD

SEQ ID NO: 2635573 - protein, 4 aa, Entamoeba histolytica
KSKN

SEQ ID NO: 2635574 - protein, 5 aa, Entamoeba histolytica
KSKNI

SEQ ID NO: 2635575 - protein, 7 aa, Entamoeba histolytica
KSKNIPS

SEQ ID NO: 2635576 - protein, 8 aa, Entamoeba histolytica
KSKNPKNL

SEQ ID NO: 2635577 - protein, 5 aa, Entamoeba histolytica
KSKNY

SEQ ID NO: 2635578 - protein, 4 aa, Entamoeba histolytica
KSKP

SEQ ID NO: 2635579 - protein, 13 aa, Entamoeba histolytica
KSKPKFFGKKGKR

SEQ ID NO: 2635580 - protein, 13 aa, Entamoeba histolytica
KSKPLASYNPLPN

SEQ ID NO: 2635581 - protein, 30 aa, Entamoeba histolytica
KSKPQQLNPTQKINEPTFDRTKGITIVGGS

SEQ ID NO: 2635582 - protein, 15 aa, Entamoeba histolytica
KSKQEKEKINNQITE

SEQ ID NO: 2635583 - protein, 20 aa, Entamoeba histolytica
KSKRDKNEQKIEESQRNTYA

SEQ ID NO: 2635584 - protein, 14 aa, Entamoeba histolytica
KSKRGGPVKPGNAK

SEQ ID NO: 2635585 - protein, 44 aa, Entamoeba histolytica
KSKRNRKRNENKPKKNNQSSEKHQQQTPQSEKMKTQNENDTITK

SEQ ID NO: 2635586 - protein, 6 aa, Entamoeba histolytica
KSKRSL

SEQ ID NO: 2635587 - protein, 12 aa, Entamoeba histolytica
KSKRTKKHITTN

SEQ ID NO: 2635588 - protein, 11 aa, Entamoeba histolytica
KSKRVSEYKRY

SEQ ID NO: 2635589 - protein, 13 aa, Entamoeba histolytica
KSKSALKKEEQIQ

SEQ ID NO: 2635590 - protein, 8 aa, Entamoeba histolytica
KSKSEKFK

SEQ ID NO: 2635591 - protein, 8 aa, Entamoeba histolytica
KSKSKWSK

SEQ ID NO: 2635592 - protein, 7 aa, Entamoeba histolytica
KSKTASV

SEQ ID NO: 2635593 - protein, 5 aa, Entamoeba histolytica
KSKTH

SEQ ID NO: 2635594 - protein, 12 aa, Entamoeba histolytica
KSKTKKSVTLSG

SEQ ID NO: 2635595 - protein, 6 aa, Entamoeba histolytica
KSKTLT

SEQ ID NO: 2635596 - protein, 7 aa, Entamoeba histolytica
KSKTSLN

SEQ ID NO: 2635597 - protein, 16 aa, Entamoeba histolytica
KSKTSPSPINSGSFSR

SEQ ID NO: 2635598 - protein, 9 aa, Entamoeba histolytica
KSKTTQFEL

SEQ ID NO: 2635599 - protein, 7 aa, Entamoeba histolytica
KSKVGTK

SEQ ID NO: 2635600 - protein, 13 aa, Entamoeba histolytica
KSKVNDLPKSEED

SEQ ID NO: 2635601 - protein, 25 aa, Entamoeba histolytica
KSKVSKRKQEKKEEGKEEKKEKSVP

SEQ ID NO: 2635602 - protein, 8 aa, Entamoeba histolytica
KSKVYTSN

SEQ ID NO: 2635603 - protein, 7 aa, Entamoeba histolytica
KSKYETQ

SEQ ID NO: 2635604 - protein, 10 aa, Entamoeba histolytica
KSLAPKRSGK

SEQ ID NO: 2635605 - protein, 9 aa, Entamoeba histolytica
KSLDNKDSF

SEQ ID NO: 2635606 - protein, 8 aa, Entamoeba histolytica
KSLDSHQK

SEQ ID NO: 2635607 - protein, 4 aa, Entamoeba histolytica
KSLE

SEQ ID NO: 2635608 - protein, 21 aa, Entamoeba histolytica
KSLEEKRDHCKEKKEDQNKIY

SEQ ID NO: 2635609 - protein, 20 aa, Entamoeba histolytica
KSLEGYYQESGRAGRDGEPA

SEQ ID NO: 2635610 - protein, 6 aa, Entamoeba histolytica
KSLEKS

SEQ ID NO: 2635611 - protein, 5 aa, Entamoeba histolytica
KSLEL

SEQ ID NO: 2635612 - protein, 6 aa, Entamoeba histolytica
KSLESL

SEQ ID NO: 2635613 - protein, 9 aa, Entamoeba histolytica
KSLHPSRAI

SEQ ID NO: 2635614 - protein, 15 aa, Entamoeba histolytica
KSLKDGAAKNEQNKL

SEQ ID NO: 2635615 - protein, 7 aa, Entamoeba histolytica
KSLKNNR

SEQ ID NO: 2635616 - protein, 8 aa, Entamoeba histolytica
KSLKRNDA

SEQ ID NO: 2635617 - protein, 7 aa, Entamoeba histolytica
KSLLETK

SEQ ID NO: 2635618 - protein, 14 aa, Entamoeba histolytica
KSLNKSGINGRDAV

SEQ ID NO: 2635619 - protein, 14 aa, Entamoeba histolytica
KSLNPDGNEELSKK

SEQ ID NO: 2635620 - protein, 9 aa, Entamoeba histolytica
KSLNTSGVN

SEQ ID NO: 2635621 - protein, 10 aa, Entamoeba histolytica
KSLPINNEVT

SEQ ID NO: 2635622 - protein, 7 aa, Entamoeba histolytica
KSLPKKE

SEQ ID NO: 2635623 - protein, 24 aa, Entamoeba histolytica
KSLPNVKNRKNKENNVKISSPQIP

SEQ ID NO: 2635624 - protein, 7 aa, Entamoeba histolytica
KSLPPNC

SEQ ID NO: 2635625 - protein, 13 aa, Entamoeba histolytica
KSLPRRKKSNPIE

SEQ ID NO: 2635626 - protein, 5 aa, Entamoeba histolytica
KSLPY

SEQ ID NO: 2635627 - protein, 15 aa, Entamoeba histolytica
KSLQRKSKSSLKRKS

SEQ ID NO: 2635628 - protein, 30 aa, Entamoeba histolytica
KSLRAKEYQERKQKEAEDIRRTKEQQRISS

SEQ ID NO: 2635629 - protein, 16 aa, Entamoeba histolytica
KSLRAKEYQERVCLVH

SEQ ID NO: 2635630 - protein, 13 aa, Entamoeba histolytica
KSLRQSEENSQNI

SEQ ID NO: 2635631 - protein, 6 aa, Entamoeba histolytica
KSLSPT

SEQ ID NO: 2635632 - protein, 5 aa, Entamoeba histolytica
KSLTD

SEQ ID NO: 2635633 - protein, 7 aa, Entamoeba histolytica
KSLTEPD

SEQ ID NO: 2635634 - protein, 6 aa, Entamoeba histolytica
KSLTMQ

SEQ ID NO: 2635635 - protein, 6 aa, Entamoeba histolytica
KSLTPI

SEQ ID NO: 2635636 - protein, 7 aa, Entamoeba histolytica
KSLYGID

SEQ ID NO: 2635637 - protein, 5 aa, Entamoeba histolytica
KSMIS

SEQ ID NO: 2635638 - protein, 9 aa, Entamoeba histolytica
KSMKENEIR

SEQ ID NO: 2635639 - protein, 9 aa, Entamoeba histolytica
KSMKETEEY

SEQ ID NO: 2635640 - protein, 6 aa, Entamoeba histolytica
KSMLSG

SEQ ID NO: 2635641 - protein, 6 aa, Entamoeba histolytica
KSNADY

SEQ ID NO: 2635642 - protein, 9 aa, Entamoeba histolytica
KSNAKTQVR

SEQ ID NO: 2635643 - protein, 26 aa, Entamoeba histolytica
KSNASRTKQPPSKEKTSLNPFFNQAL

SEQ ID NO: 2635644 - protein, 4 aa, Entamoeba histolytica
KSND

SEQ ID NO: 2635645 - protein, 5 aa, Entamoeba histolytica
KSNDI

SEQ ID NO: 2635646 - protein, 6 aa, Entamoeba histolytica
KSNDKK

SEQ ID NO: 2635647 - protein, 8 aa, Entamoeba histolytica
KSNDKRDV

SEQ ID NO: 2635648 - protein, 9 aa, Entamoeba histolytica
KSNDNTNTH

SEQ ID NO: 2635649 - protein, 10 aa, Entamoeba histolytica
KSNDPGLSSE

SEQ ID NO: 2635650 - protein, 7 aa, Entamoeba histolytica
KSNEEIN

SEQ ID NO: 2635651 - protein, 13 aa, Entamoeba histolytica
KSNEEYDKYKPTI

SEQ ID NO: 2635652 - protein, 6 aa, Entamoeba histolytica
KSNEFQ

SEQ ID NO: 2635653 - protein, 7 aa, Entamoeba histolytica
KSNEISD

SEQ ID NO: 2635654 - protein, 8 aa, Entamoeba histolytica
KSNEKEKG

SEQ ID NO: 2635655 - protein, 13 aa, Entamoeba histolytica
KSNEKNPPKSCTG

SEQ ID NO: 2635656 - protein, 9 aa, Entamoeba histolytica
KSNEQEDKL

SEQ ID NO: 2635657 - protein, 17 aa, Entamoeba histolytica
KSNEQLEKEKQEQTKRA

SEQ ID NO: 2635658 - protein, 9 aa, Entamoeba histolytica
KSNESDNTT

SEQ ID NO: 2635659 - protein, 9 aa, Entamoeba histolytica
KSNESKKSL

SEQ ID NO: 2635660 - protein, 7 aa, Entamoeba histolytica
KSNETAI

SEQ ID NO: 2635661 - protein, 30 aa, Entamoeba histolytica
KSNETPKQNDIKNHDKDQDLIEENQGDLPT

SEQ ID NO: 2635662 - protein, 7 aa, Entamoeba histolytica
KSNFGTP

SEQ ID NO: 2635663 - protein, 6 aa, Entamoeba histolytica
KSNGDG

SEQ ID NO: 2635664 - protein, 7 aa, Entamoeba histolytica
KSNGDVN

SEQ ID NO: 2635665 - protein, 6 aa, Entamoeba histolytica
KSNGFG

SEQ ID NO: 2635666 - protein, 7 aa, Entamoeba histolytica
KSNGGGS

SEQ ID NO: 2635667 - protein, 5 aa, Entamoeba histolytica
KSNGK

SEQ ID NO: 2635668 - protein, 14 aa, Entamoeba histolytica
KSNGTILPPFNSDN

SEQ ID NO: 2635669 - protein, 7 aa, Entamoeba histolytica
KSNGTRT

SEQ ID NO: 2635670 - protein, 5 aa, Entamoeba histolytica
KSNHL

SEQ ID NO: 2635671 - protein, 7 aa, Entamoeba histolytica
KSNHPKQ

SEQ ID NO: 2635672 - protein, 26 aa, Entamoeba histolytica
KSNIENELTKKQEEGKEYIKQRNRNV

SEQ ID NO: 2635673 - protein, 14 aa, Entamoeba histolytica
KSNIGTKVADGEDP

SEQ ID NO: 2635674 - protein, 6 aa, Entamoeba histolytica
KSNKEL

SEQ ID NO: 2635675 - protein, 7 aa, Entamoeba histolytica
KSNKIGG

SEQ ID NO: 2635676 - protein, 10 aa, Entamoeba histolytica
KSNKNASLGK

SEQ ID NO: 2635677 - protein, 6 aa, Entamoeba histolytica
KSNKPR

SEQ ID NO: 2635678 - protein, 8 aa, Entamoeba histolytica
KSNKQLNY

SEQ ID NO: 2635679 - protein, 11 aa, Entamoeba histolytica
KSNLPSSNEQI

SEQ ID NO: 2635680 - protein, 7 aa, Entamoeba histolytica
KSNLQLS

SEQ ID NO: 2635681 - protein, 6 aa, Entamoeba histolytica
KSNLTK

SEQ ID NO: 2635682 - protein, 9 aa, Entamoeba histolytica
KSNNEFTSF

SEQ ID NO: 2635683 - protein, 10 aa, Entamoeba histolytica
KSNNGEGQDI

SEQ ID NO: 2635684 - protein, 8 aa, Entamoeba histolytica
KSNNNSIK

SEQ ID NO: 2635685 - protein, 5 aa, Entamoeba histolytica
KSNNQ

SEQ ID NO: 2635686 - protein, 22 aa, Entamoeba histolytica
KSNNQLPETDSKINKPSNDELK

SEQ ID NO: 2635687 - protein, 18 aa, Entamoeba histolytica
KSNNSLTLSSKKDDKRST

SEQ ID NO: 2635688 - protein, 12 aa, Entamoeba histolytica
KSNNSTVTDDDV

SEQ ID NO: 2635689 - protein, 6 aa, Entamoeba histolytica
KSNNTS

SEQ ID NO: 2635690 - protein, 7 aa, Entamoeba histolytica
KSNPEKL

SEQ ID NO: 2635691 - protein, 6 aa, Entamoeba histolytica
KSNPEW

SEQ ID NO: 2635692 - protein, 5 aa, Entamoeba histolytica
KSNPI

SEQ ID NO: 2635693 - protein, 7 aa, Entamoeba histolytica
KSNPKRK

SEQ ID NO: 2635694 - protein, 6 aa, Entamoeba histolytica
KSNPRK

SEQ ID NO: 2635695 - protein, 5 aa, Entamoeba histolytica
KSNPS

SEQ ID NO: 2635696 - protein, 4 aa, Entamoeba histolytica
KSNQ

SEQ ID NO: 2635697 - protein, 29 aa, Entamoeba histolytica
KSNQFNELSEGKKKPKLPKTEQDKEKHRK

SEQ ID NO: 2635698 - protein, 6 aa, Entamoeba histolytica
KSNQLK

SEQ ID NO: 2635699 - protein, 7 aa, Entamoeba histolytica
KSNQSRA

SEQ ID NO: 2635700 - protein, 18 aa, Entamoeba histolytica
KSNQTRTAKEFNEAIEGK

SEQ ID NO: 2635701 - protein, 6 aa, Entamoeba histolytica
KSNQYT

SEQ ID NO: 2635702 - protein, 4 aa, Entamoeba histolytica
KSNS

SEQ ID NO: 2635703 - protein, 8 aa, Entamoeba histolytica
KSNSKSNQ

SEQ ID NO: 2635704 - protein, 8 aa, Entamoeba histolytica
KSNSLSPE

SEQ ID NO: 2635705 - protein, 6 aa, Entamoeba histolytica
KSNSNW

SEQ ID NO: 2635706 - protein, 7 aa, Entamoeba histolytica
KSNSTDI

SEQ ID NO: 2635707 - protein, 10 aa, Entamoeba histolytica
KSNSTSLSEQ

SEQ ID NO: 2635708 - protein, 12 aa, Entamoeba histolytica
KSNSYGDELMTG

SEQ ID NO: 2635709 - protein, 8 aa, Entamoeba histolytica
KSNTLPNN

SEQ ID NO: 2635710 - protein, 9 aa, Entamoeba histolytica
KSNTNSDMQ

SEQ ID NO: 2635711 - protein, 8 aa, Entamoeba histolytica
KSNTTAVA

SEQ ID NO: 2635712 - protein, 6 aa, Entamoeba histolytica
KSNTTN

SEQ ID NO: 2635713 - protein, 14 aa, Entamoeba histolytica
KSNTWTGAKSFNGY

SEQ ID NO: 2635714 - protein, 8 aa, Entamoeba histolytica
KSNTWTGK

SEQ ID NO: 2635715 - protein, 11 aa, Entamoeba histolytica
KSNTWTGQHSF

SEQ ID NO: 2635716 - protein, 19 aa, Entamoeba histolytica
KSPALEPVAPKQKPQPTVD

SEQ ID NO: 2635717 - protein, 7 aa, Entamoeba histolytica
KSPASFN

SEQ ID NO: 2635718 - protein, 6 aa, Entamoeba histolytica
KSPCYE

SEQ ID NO: 2635719 - protein, 5 aa, Entamoeba histolytica
KSPDF

SEQ ID NO: 2635720 - protein, 7 aa, Entamoeba histolytica
KSPELDR

SEQ ID NO: 2635721 - protein, 4 aa, Entamoeba histolytica
KSPF

SEQ ID NO: 2635722 - protein, 6 aa, Entamoeba histolytica
KSPFED

SEQ ID NO: 2635723 - protein, 6 aa, Entamoeba histolytica
KSPFKL

SEQ ID NO: 2635724 - protein, 6 aa, Entamoeba histolytica
KSPGGA

SEQ ID NO: 2635725 - protein, 12 aa, Entamoeba histolytica
KSPGLPSSGQSM

SEQ ID NO: 2635726 - protein, 6 aa, Entamoeba histolytica
KSPHRI

SEQ ID NO: 2635727 - protein, 7 aa, Entamoeba histolytica
KSPHVQS

SEQ ID NO: 2635728 - protein, 4 aa, Entamoeba histolytica
KSPI

SEQ ID NO: 2635729 - protein, 9 aa, Entamoeba histolytica
KSPIGSPRL

SEQ ID NO: 2635730 - protein, 5 aa, Entamoeba histolytica
KSPKD

SEQ ID NO: 2635731 - protein, 6 aa, Entamoeba histolytica
KSPKDL

SEQ ID NO: 2635732 - protein, 16 aa, Entamoeba histolytica
KSPKIFSSKTTSPGLT

SEQ ID NO: 2635733 - protein, 7 aa, Entamoeba histolytica
KSPKIKN

SEQ ID NO: 2635734 - protein, 22 aa, Entamoeba histolytica
KSPKKEAKPQEKKEKGVAEEDG

SEQ ID NO: 2635735 - protein, 7 aa, Entamoeba histolytica
KSPKKGV

SEQ ID NO: 2635736 - protein, 10 aa, Entamoeba histolytica
KSPKNTPKTT

SEQ ID NO: 2635737 - protein, 6 aa, Entamoeba histolytica
KSPKVT

SEQ ID NO: 2635738 - protein, 6 aa, Entamoeba histolytica
KSPKYK

SEQ ID NO: 2635739 - protein, 7 aa, Entamoeba histolytica
KSPLGNE

SEQ ID NO: 2635740 - protein, 4 aa, Entamoeba histolytica
KSPN

SEQ ID NO: 2635741 - protein, 7 aa, Entamoeba histolytica
KSPNKKK

SEQ ID NO: 2635742 - protein, 9 aa, Entamoeba histolytica
KSPNPTSNS

SEQ ID NO: 2635743 - protein, 5 aa, Entamoeba histolytica
KSPQW

SEQ ID NO: 2635744 - protein, 8 aa, Entamoeba histolytica
KSPRLQKA

SEQ ID NO: 2635745 - protein, 5 aa, Entamoeba histolytica
KSPSI

SEQ ID NO: 2635746 - protein, 17 aa, Entamoeba histolytica
KSPSLSEDGTDEENDQL

SEQ ID NO: 2635747 - protein, 18 aa, Entamoeba histolytica
KSPSPNELVQEIPKKQFF

SEQ ID NO: 2635748 - protein, 11 aa, Entamoeba histolytica
KSPSPTNQPRR

SEQ ID NO: 2635749 - protein, 16 aa, Entamoeba histolytica
KSPSQIKDKINNTKAG

SEQ ID NO: 2635750 - protein, 11 aa, Entamoeba histolytica
KSPTLQNKNEM

SEQ ID NO: 2635751 - protein, 19 aa, Entamoeba histolytica
KSPTQIRDKINNTKSSYAN

SEQ ID NO: 2635752 - protein, 14 aa, Entamoeba histolytica
KSPVDNRSDDEDIE

SEQ ID NO: 2635753 - protein, 5 aa, Entamoeba histolytica
KSPYQ

SEQ ID NO: 2635754 - protein, 4 aa, Entamoeba histolytica
KSQE

SEQ ID NO: 2635755 - protein, 9 aa, Entamoeba histolytica
KSQEGVVPP

SEQ ID NO: 2635756 - protein, 9 aa, Entamoeba histolytica
KSQENATEI

SEQ ID NO: 2635757 - protein, 4 aa, Entamoeba histolytica
KSQF

SEQ ID NO: 2635758 - protein, 8 aa, Entamoeba histolytica
KSQGMTSE

SEQ ID NO: 2635759 - protein, 9 aa, Entamoeba histolytica
KSQGRGSWN

SEQ ID NO: 2635760 - protein, 6 aa, Entamoeba histolytica
KSQGVA

SEQ ID NO: 2635761 - protein, 17 aa, Entamoeba histolytica
KSQIENAKKELKSKKLK

SEQ ID NO: 2635762 - protein, 9 aa, Entamoeba histolytica
KSQIEQIST

SEQ ID NO: 2635763 - protein, 35 aa, Entamoeba histolytica
KSQKLQEKELKTKEIESLNSQLGDLQKESRRKENY

SEQ ID NO: 2635764 - protein, 20 aa, Entamoeba histolytica
KSQKSYPTQPVNKQTLSAQK

SEQ ID NO: 2635765 - protein, 6 aa, Entamoeba histolytica
KSQMAQ

SEQ ID NO: 2635766 - protein, 10 aa, Entamoeba histolytica
KSQMTKKPKD

SEQ ID NO: 2635767 - protein, 5 aa, Entamoeba histolytica
KSQNL

SEQ ID NO: 2635768 - protein, 4 aa, Entamoeba histolytica
KSQQ

SEQ ID NO: 2635769 - protein, 10 aa, Entamoeba histolytica
KSQQKNPNFQ

SEQ ID NO: 2635770 - protein, 6 aa, Entamoeba histolytica
KSQQYY

SEQ ID NO: 2635771 - protein, 8 aa, Entamoeba histolytica
KSQRNSNA

SEQ ID NO: 2635772 - protein, 6 aa, Entamoeba histolytica
KSQSFN

SEQ ID NO: 2635773 - protein, 8 aa, Entamoeba histolytica
KSQTEDGE

SEQ ID NO: 2635774 - protein, 15 aa, Entamoeba histolytica
KSQTLNDMIHDFVHY

SEQ ID NO: 2635775 - protein, 9 aa, Entamoeba histolytica
KSRESNGGI

SEQ ID NO: 2635776 - protein, 10 aa, Entamoeba histolytica
KSRETEDESL

SEQ ID NO: 2635777 - protein, 14 aa, Entamoeba histolytica
KSRFPTESIKNRES

SEQ ID NO: 2635778 - protein, 8 aa, Entamoeba histolytica
KSRGYTES

SEQ ID NO: 2635779 - protein, 14 aa, Entamoeba histolytica
KSRKEAEAKEKSRL

SEQ ID NO: 2635780 - protein, 8 aa, Entamoeba histolytica
KSRKEGYP

SEQ ID NO: 2635781 - protein, 6 aa, Entamoeba histolytica
KSRKKV

SEQ ID NO: 2635782 - protein, 11 aa, Entamoeba histolytica
KSRKVSGKAEG

SEQ ID NO: 2635783 - protein, 8 aa, Entamoeba histolytica
KSRNDPYH

SEQ ID NO: 2635784 - protein, 8 aa, Entamoeba histolytica
KSRNNGSA

SEQ ID NO: 2635785 - protein, 7 aa, Entamoeba histolytica
KSRQKIS

SEQ ID NO: 2635786 - protein, 7 aa, Entamoeba histolytica
KSRRREL

SEQ ID NO: 2635787 - protein, 9 aa, Entamoeba histolytica
KSRSDKDLK

SEQ ID NO: 2635788 - protein, 11 aa, Entamoeba histolytica
KSRSISEYTDP

SEQ ID NO: 2635789 - protein, 8 aa, Entamoeba histolytica
KSRSTAAL

SEQ ID NO: 2635790 - protein, 6 aa, Entamoeba histolytica
KSRTNF

SEQ ID NO: 2635791 - protein, 7 aa, Entamoeba histolytica
KSRTNFK

SEQ ID NO: 2635792 - protein, 8 aa, Entamoeba histolytica
KSRYNKSA

SEQ ID NO: 2635793 - protein, 15 aa, Entamoeba histolytica
KSRYSDAVSDKVNSI

SEQ ID NO: 2635794 - protein, 14 aa, Entamoeba histolytica
KSSAQFSKEKNLPL

SEQ ID NO: 2635795 - protein, 4 aa, Entamoeba histolytica
KSSC

SEQ ID NO: 2635796 - protein, 16 aa, Entamoeba histolytica
KSSDTKSIKKMKEKRM

SEQ ID NO: 2635797 - protein, 7 aa, Entamoeba histolytica
KSSEALN

SEQ ID NO: 2635798 - protein, 30 aa, Entamoeba histolytica
KSSEEVNKKDKSSSSSSDEEENEKKENGKL

SEQ ID NO: 2635799 - protein, 6 aa, Entamoeba histolytica
KSSEKA

SEQ ID NO: 2635800 - protein, 8 aa, Entamoeba histolytica
KSSEKDFI

SEQ ID NO: 2635801 - protein, 43 aa, Entamoeba histolytica
KSSEKKTNSSVPSSSYGESVESQNSTGKSSWFENEKDYNPHSN

SEQ ID NO: 2635802 - protein, 8 aa, Entamoeba histolytica
KSSENNTW

SEQ ID NO: 2635803 - protein, 8 aa, Entamoeba histolytica
KSSESALT

SEQ ID NO: 2635804 - protein, 7 aa, Entamoeba histolytica
KSSETFP

SEQ ID NO: 2635805 - protein, 5 aa, Entamoeba histolytica
KSSEV

SEQ ID NO: 2635806 - protein, 6 aa, Entamoeba histolytica
KSSFGT

SEQ ID NO: 2635807 - protein, 6 aa, Entamoeba histolytica
KSSFSS

SEQ ID NO: 2635808 - protein, 9 aa, Entamoeba histolytica
KSSFTNDTY

SEQ ID NO: 2635809 - protein, 14 aa, Entamoeba histolytica
KSSGITEKEIKAHP

SEQ ID NO: 2635810 - protein, 10 aa, Entamoeba histolytica
KSSGKLTKPY

SEQ ID NO: 2635811 - protein, 7 aa, Entamoeba histolytica
KSSGKRT

SEQ ID NO: 2635812 - protein, 8 aa, Entamoeba histolytica
KSSGQRIN

SEQ ID NO: 2635813 - protein, 20 aa, Entamoeba histolytica
KSSGQRRTAATDINTNSSRS

SEQ ID NO: 2635814 - protein, 10 aa, Entamoeba histolytica
KSSGVSLPKL

SEQ ID NO: 2635815 - protein, 6 aa, Entamoeba histolytica
KSSHGI

SEQ ID NO: 2635816 - protein, 6 aa, Entamoeba histolytica
KSSHIN

SEQ ID NO: 2635817 - protein, 6 aa, Entamoeba histolytica
KSSHIT

SEQ ID NO: 2635818 - protein, 11 aa, Entamoeba histolytica
KSSHKSNSVNS

SEQ ID NO: 2635819 - protein, 8 aa, Entamoeba histolytica
KSSHPNVS

SEQ ID NO: 2635820 - protein, 5 aa, Entamoeba histolytica
KSSHV

SEQ ID NO: 2635821 - protein, 4 aa, Entamoeba histolytica
KSSI

SEQ ID NO: 2635822 - protein, 10 aa, Entamoeba histolytica
KSSIEDKDKL

SEQ ID NO: 2635823 - protein, 11 aa, Entamoeba histolytica
KSSIETNSDIK

SEQ ID NO: 2635824 - protein, 7 aa, Entamoeba histolytica
KSSIKNK

SEQ ID NO: 2635825 - protein, 5 aa, Entamoeba histolytica
KSSIN

SEQ ID NO: 2635826 - protein, 6 aa, Entamoeba histolytica
KSSKFN

SEQ ID NO: 2635827 - protein, 8 aa, Entamoeba histolytica
KSSKGDAE

SEQ ID NO: 2635828 - protein, 8 aa, Entamoeba histolytica
KSSKGDTA

SEQ ID NO: 2635829 - protein, 10 aa, Entamoeba histolytica
KSSKGKIEWE

SEQ ID NO: 2635830 - protein, 16 aa, Entamoeba histolytica
KSSKKAKNENKPPNTI

SEQ ID NO: 2635831 - protein, 9 aa, Entamoeba histolytica
KSSKYNDLK

SEQ ID NO: 2635832 - protein, 23 aa, Entamoeba histolytica
KSSLIEENDDQGIKEGKEEIQQQ

SEQ ID NO: 2635833 - protein, 6 aa, Entamoeba histolytica
KSSLKE

SEQ ID NO: 2635834 - protein, 13 aa, Entamoeba histolytica
KSSLKKRKSGVNF

SEQ ID NO: 2635835 - protein, 7 aa, Entamoeba histolytica
KSSLQQS

SEQ ID NO: 2635836 - protein, 17 aa, Entamoeba histolytica
KSSNELKKRKASTSIRN

SEQ ID NO: 2635837 - protein, 5 aa, Entamoeba histolytica
KSSNY

SEQ ID NO: 2635838 - protein, 22 aa, Entamoeba histolytica
KSSPTSSSPSNTNNSDKEKVDL

SEQ ID NO: 2635839 - protein, 44 aa, Entamoeba histolytica
KSSQEETAATPSTTAPSQTQQESQSNSEDNKKSKKEKKKGKCIL

SEQ ID NO: 2635840 - protein, 6 aa, Entamoeba histolytica
KSSQIR

SEQ ID NO: 2635841 - protein, 8 aa, Entamoeba histolytica
KSSQNTEI

SEQ ID NO: 2635842 - protein, 16 aa, Entamoeba histolytica
KSSQPQNRAGSKSYMA

SEQ ID NO: 2635843 - protein, 10 aa, Entamoeba histolytica
KSSRKQAEEV

SEQ ID NO: 2635844 - protein, 4 aa, Entamoeba histolytica
KSSS

SEQ ID NO: 2635845 - protein, 25 aa, Entamoeba histolytica
KSSSGSKTPRSPSSFSSSSRLLSRS

SEQ ID NO: 2635846 - protein, 10 aa, Entamoeba histolytica
KSSSLSPRFT

SEQ ID NO: 2635847 - protein, 6 aa, Entamoeba histolytica
KSSSSI

SEQ ID NO: 2635848 - protein, 110 aa, Entamoeba histolytica
KSSSSKEENDNKSKKPKSTSSDTKDEKKKTIKKKVTKEEKEEKEKKRKDMKKEKKTTTKSKKEKKEKTEENEDENVDEKKELKRKKTTKVESSEKSHEEKKPRKSDKRTK

SEQ ID NO: 2635849 - protein, 30 aa, Entamoeba histolytica
KSSTEYDNSSSVKQVKKNKTSREIRNSQTI

SEQ ID NO: 2635850 - protein, 5 aa, Entamoeba histolytica
KSSTS

SEQ ID NO: 2635851 - protein, 7 aa, Entamoeba histolytica
KSSTSIE

SEQ ID NO: 2635852 - protein, 6 aa, Entamoeba histolytica
KSSTVQ

SEQ ID NO: 2635853 - protein, 9 aa, Entamoeba histolytica
KSSVPSNNK

SEQ ID NO: 2635854 - protein, 5 aa, Entamoeba histolytica
KSSYP

SEQ ID NO: 2635855 - protein, 7 aa, Entamoeba histolytica
KSSYPDS

SEQ ID NO: 2635856 - protein, 42 aa, Entamoeba histolytica
KSTAPTGKKPSKGTLLPPPSSGKRAQFSAPPSVQKPAQPVAN

SEQ ID NO: 2635857 - protein, 26 aa, Entamoeba histolytica
KSTCSPDNSSEQDPFNSESASPRKVG

SEQ ID NO: 2635858 - protein, 4 aa, Entamoeba histolytica
KSTD

SEQ ID NO: 2635859 - protein, 6 aa, Entamoeba histolytica
KSTDFK

SEQ ID NO: 2635860 - protein, 9 aa, Entamoeba histolytica
KSTDNDEEK

SEQ ID NO: 2635861 - protein, 7 aa, Entamoeba histolytica
KSTDSLL

SEQ ID NO: 2635862 - protein, 7 aa, Entamoeba histolytica
KSTDTSL

SEQ ID NO: 2635863 - protein, 4 aa, Entamoeba histolytica
KSTE

SEQ ID NO: 2635864 - protein, 29 aa, Entamoeba histolytica
KSTEEKKAKKRNNKEEEQRKQEEKERDEL

SEQ ID NO: 2635865 - protein, 14 aa, Entamoeba histolytica
KSTEKESVKEIGES

SEQ ID NO: 2635866 - protein, 5 aa, Entamoeba histolytica
KSTEN

SEQ ID NO: 2635867 - protein, 10 aa, Entamoeba histolytica
KSTESGTTAT

SEQ ID NO: 2635868 - protein, 23 aa, Entamoeba histolytica
KSTETLEKERTQLQNDNAAINNA

SEQ ID NO: 2635869 - protein, 4 aa, Entamoeba histolytica
KSTF

SEQ ID NO: 2635870 - protein, 6 aa, Entamoeba histolytica
KSTGAG

SEQ ID NO: 2635871 - protein, 9 aa, Entamoeba histolytica
KSTGNEALN

SEQ ID NO: 2635872 - protein, 7 aa, Entamoeba histolytica
KSTHDIS

SEQ ID NO: 2635873 - protein, 13 aa, Entamoeba histolytica
KSTIDKTNFDCSD

SEQ ID NO: 2635874 - protein, 7 aa, Entamoeba histolytica
KSTIGGK

SEQ ID NO: 2635875 - protein, 12 aa, Entamoeba histolytica
KSTIVAQKLSEL

SEQ ID NO: 2635876 - protein, 4 aa, Entamoeba histolytica
KSTK

SEQ ID NO: 2635877 - protein, 7 aa, Entamoeba histolytica
KSTKISE

SEQ ID NO: 2635878 - protein, 9 aa, Entamoeba histolytica
KSTKPQQPS

SEQ ID NO: 2635879 - protein, 12 aa, Entamoeba histolytica
KSTKVGDETSRI

SEQ ID NO: 2635880 - protein, 7 aa, Entamoeba histolytica
KSTLPAK

SEQ ID NO: 2635881 - protein, 26 aa, Entamoeba histolytica
KSTLSDKEKNSLRAELAEKENEYNRC

SEQ ID NO: 2635882 - protein, 4 aa, Entamoeba histolytica
KSTN

SEQ ID NO: 2635883 - protein, 8 aa, Entamoeba histolytica
KSTNASSM

SEQ ID NO: 2635884 - protein, 7 aa, Entamoeba histolytica
KSTNCEP

SEQ ID NO: 2635885 - protein, 7 aa, Entamoeba histolytica
KSTNKCG

SEQ ID NO: 2635886 - protein, 5 aa, Entamoeba histolytica
KSTNL

SEQ ID NO: 2635887 - protein, 8 aa, Entamoeba histolytica
KSTNSESV

SEQ ID NO: 2635888 - protein, 8 aa, Entamoeba histolytica
KSTPDYSS

SEQ ID NO: 2635889 - protein, 19 aa, Entamoeba histolytica
KSTPIKEDISQYRSVRDSP

SEQ ID NO: 2635890 - protein, 7 aa, Entamoeba histolytica
KSTPIQC

SEQ ID NO: 2635891 - protein, 6 aa, Entamoeba histolytica
KSTPLY

SEQ ID NO: 2635892 - protein, 16 aa, Entamoeba histolytica
KSTQECGGRIGNTPNL

SEQ ID NO: 2635893 - protein, 9 aa, Entamoeba histolytica
KSTQERSLG

SEQ ID NO: 2635894 - protein, 5 aa, Entamoeba histolytica
KSTQH

SEQ ID NO: 2635895 - protein, 6 aa, Entamoeba histolytica
KSTQHE

SEQ ID NO: 2635896 - protein, 7 aa, Entamoeba histolytica
KSTQRNI

SEQ ID NO: 2635897 - protein, 7 aa, Entamoeba histolytica
KSTRSNT

SEQ ID NO: 2635898 - protein, 19 aa, Entamoeba histolytica
KSTSEFYSSAAQNKISETL

SEQ ID NO: 2635899 - protein, 7 aa, Entamoeba histolytica
KSTSLNL

SEQ ID NO: 2635900 - protein, 23 aa, Entamoeba histolytica
KSTSQQQNGFTGFGQQTQNTGLG

SEQ ID NO: 2635901 - protein, 7 aa, Entamoeba histolytica
KSTSSFV

SEQ ID NO: 2635902 - protein, 73 aa, Entamoeba histolytica
KSTSSNNLKTTNPTSTITKSSTSSSLKPVTSTNTTCSTKPTSSSSISTKKSYFESKDKEVQKEKKGKQAKEKS

SEQ ID NO: 2635903 - protein, 9 aa, Entamoeba histolytica
KSTSTTSMS

SEQ ID NO: 2635904 - protein, 4 aa, Entamoeba histolytica
KSTT

SEQ ID NO: 2635905 - protein, 14 aa, Entamoeba histolytica
KSTTETNDDGSELQ

SEQ ID NO: 2635906 - protein, 11 aa, Entamoeba histolytica
KSTTKKSKEDI

SEQ ID NO: 2635907 - protein, 18 aa, Entamoeba histolytica
KSTTKKSKEEIKAEYEVK

SEQ ID NO: 2635908 - protein, 5 aa, Entamoeba histolytica
KSTTL

SEQ ID NO: 2635909 - protein, 32 aa, Entamoeba histolytica
KSTTPTIVSEESKELEQQKTVEIKGTTQPLSV

SEQ ID NO: 2635910 - protein, 13 aa, Entamoeba histolytica
KSTVEGNRARAAL

SEQ ID NO: 2635911 - protein, 6 aa, Entamoeba histolytica
KSTVPT

SEQ ID NO: 2635912 - protein, 7 aa, Entamoeba histolytica
KSTVTVE

SEQ ID NO: 2635913 - protein, 6 aa, Entamoeba histolytica
KSTYIN

SEQ ID NO: 2635914 - protein, 11 aa, Entamoeba histolytica
KSVDEAKRKEV

SEQ ID NO: 2635915 - protein, 6 aa, Entamoeba histolytica
KSVDGE

SEQ ID NO: 2635916 - protein, 7 aa, Entamoeba histolytica
KSVEELR

SEQ ID NO: 2635917 - protein, 9 aa, Entamoeba histolytica
KSVEELSSE

SEQ ID NO: 2635918 - protein, 6 aa, Entamoeba histolytica
KSVEME

SEQ ID NO: 2635919 - protein, 7 aa, Entamoeba histolytica
KSVENIG

SEQ ID NO: 2635920 - protein, 8 aa, Entamoeba histolytica
KSVEPMEE

SEQ ID NO: 2635921 - protein, 5 aa, Entamoeba histolytica
KSVFP

SEQ ID NO: 2635922 - protein, 9 aa, Entamoeba histolytica
KSVGRTPAQ

SEQ ID NO: 2635923 - protein, 6 aa, Entamoeba histolytica
KSVKKE

SEQ ID NO: 2635924 - protein, 10 aa, Entamoeba histolytica
KSVKLSAPEY

SEQ ID NO: 2635925 - protein, 46 aa, Entamoeba histolytica
KSVKPTTTSSTTNKPSSTSTPTVSTPSSNNESSTQKSQNSSSFAPH

SEQ ID NO: 2635926 - protein, 4 aa, Entamoeba histolytica
KSVN

SEQ ID NO: 2635927 - protein, 25 aa, Entamoeba histolytica
KSVNEKQKVEKRVSVEKNNSSLDRK

SEQ ID NO: 2635928 - protein, 6 aa, Entamoeba histolytica
KSVNEQ

SEQ ID NO: 2635929 - protein, 8 aa, Entamoeba histolytica
KSVNKGKI

SEQ ID NO: 2635930 - protein, 5 aa, Entamoeba histolytica
KSVNS

SEQ ID NO: 2635931 - protein, 12 aa, Entamoeba histolytica
KSVPKPISPDGI

SEQ ID NO: 2635932 - protein, 7 aa, Entamoeba histolytica
KSVPSNM

SEQ ID NO: 2635933 - protein, 7 aa, Entamoeba histolytica
KSVPSQD

SEQ ID NO: 2635934 - protein, 4 aa, Entamoeba histolytica
KSVQ

SEQ ID NO: 2635935 - protein, 7 aa, Entamoeba histolytica
KSVQLPA

SEQ ID NO: 2635936 - protein, 4 aa, Entamoeba histolytica
KSVS

SEQ ID NO: 2635937 - protein, 8 aa, Entamoeba histolytica
KSVSENVN

SEQ ID NO: 2635938 - protein, 12 aa, Entamoeba histolytica
KSVSQVTSDNIC

SEQ ID NO: 2635939 - protein, 19 aa, Entamoeba histolytica
KSVSSLNKSPQLNSSTLSL

SEQ ID NO: 2635940 - protein, 28 aa, Entamoeba histolytica
KSVTNKGTNSEPISISSEEDFTTIQNKN

SEQ ID NO: 2635941 - protein, 4 aa, Entamoeba histolytica
KSVY

SEQ ID NO: 2635942 - protein, 6 aa, Entamoeba histolytica
KSVYEL

SEQ ID NO: 2635943 - protein, 8 aa, Entamoeba histolytica
KSWKEECE

SEQ ID NO: 2635944 - protein, 16 aa, Entamoeba histolytica
KSWNEDEVKRNTESIK

SEQ ID NO: 2635945 - protein, 6 aa, Entamoeba histolytica
KSWSKE

SEQ ID NO: 2635946 - protein, 5 aa, Entamoeba histolytica
KSYDE

SEQ ID NO: 2635947 - protein, 4 aa, Entamoeba histolytica
KSYE

SEQ ID NO: 2635948 - protein, 7 aa, Entamoeba histolytica
KSYEGHK

SEQ ID NO: 2635949 - protein, 22 aa, Entamoeba histolytica
KSYEHPEEPLSKKKQKKLAKKE

SEQ ID NO: 2635950 - protein, 4 aa, Entamoeba histolytica
KSYI

SEQ ID NO: 2635951 - protein, 35 aa, Entamoeba histolytica
KSYIESPRKRGTSLSSISRQAENNSIELSPKEIEK

SEQ ID NO: 2635952 - protein, 6 aa, Entamoeba histolytica
KSYKSL

SEQ ID NO: 2635953 - protein, 5 aa, Entamoeba histolytica
KSYQE

SEQ ID NO: 2635954 - protein, 8 aa, Entamoeba histolytica
KSYQEDQR

SEQ ID NO: 2635955 - protein, 4 aa, Entamoeba histolytica
KSYS

SEQ ID NO: 2635956 - protein, 6 aa, Entamoeba histolytica
KSYSKL

SEQ ID NO: 2635957 - protein, 6 aa, Entamoeba histolytica
KSYSSL

SEQ ID NO: 2635958 - protein, 15 aa, Entamoeba histolytica
KSYSSSSSSIKTNED

SEQ ID NO: 2635959 - protein, 7 aa, Entamoeba histolytica
KSYTSDE

SEQ ID NO: 2635960 - protein, 14 aa, Entamoeba histolytica
KTAADQASATSNGI

SEQ ID NO: 2635961 - protein, 4 aa, Entamoeba histolytica
KTAD

SEQ ID NO: 2635962 - protein, 6 aa, Entamoeba histolytica
KTADEP

SEQ ID NO: 2635963 - protein, 14 aa, Entamoeba histolytica
KTADGLNISPNTSK

SEQ ID NO: 2635964 - protein, 13 aa, Entamoeba histolytica
KTADGVRASTGKM

SEQ ID NO: 2635965 - protein, 7 aa, Entamoeba histolytica
KTAEEAK

SEQ ID NO: 2635966 - protein, 10 aa, Entamoeba histolytica
KTAEKNATYD

SEQ ID NO: 2635967 - protein, 26 aa, Entamoeba histolytica
KTAFSEPENDAKKEAAIQSYKEDRAR

SEQ ID NO: 2635968 - protein, 11 aa, Entamoeba histolytica
KTAGKKIAGIG

SEQ ID NO: 2635969 - protein, 5 aa, Entamoeba histolytica
KTAKE

SEQ ID NO: 2635970 - protein, 8 aa, Entamoeba histolytica
KTALPKGY

SEQ ID NO: 2635971 - protein, 31 aa, Entamoeba histolytica
KTANGDFDSELKEKEQAKIEQSDATTNGYSS

SEQ ID NO: 2635972 - protein, 9 aa, Entamoeba histolytica
KTAPPQPFT

SEQ ID NO: 2635973 - protein, 20 aa, Entamoeba histolytica
KTAPVSYSTYRNEQQKKDQI

SEQ ID NO: 2635974 - protein, 5 aa, Entamoeba histolytica
KTAPW

SEQ ID NO: 2635975 - protein, 5 aa, Entamoeba histolytica
KTAQN

SEQ ID NO: 2635976 - protein, 9 aa, Entamoeba histolytica
KTASSTSRG

SEQ ID NO: 2635977 - protein, 10 aa, Entamoeba histolytica
KTATRRFQNN

SEQ ID NO: 2635978 - protein, 10 aa, Entamoeba histolytica
KTATTDTVKN

SEQ ID NO: 2635979 - protein, 6 aa, Entamoeba histolytica
KTATTG

SEQ ID NO: 2635980 - protein, 4 aa, Entamoeba histolytica
KTCE

SEQ ID NO: 2635981 - protein, 19 aa, Entamoeba histolytica
KTCEETGEEYIEPPPWRPT

SEQ ID NO: 2635982 - protein, 6 aa, Entamoeba histolytica
KTCGGS

SEQ ID NO: 2635983 - protein, 8 aa, Entamoeba histolytica
KTCKTLQQ

SEQ ID NO: 2635984 - protein, 7 aa, Entamoeba histolytica
KTCNNAN

SEQ ID NO: 2635985 - protein, 6 aa, Entamoeba histolytica
KTCSCG

SEQ ID NO: 2635986 - protein, 4 aa, Entamoeba histolytica
KTDC

SEQ ID NO: 2635987 - protein, 9 aa, Entamoeba histolytica
KTDDAVAPP

SEQ ID NO: 2635988 - protein, 9 aa, Entamoeba histolytica
KTDDEAEQE

SEQ ID NO: 2635989 - protein, 19 aa, Entamoeba histolytica
KTDDEQPPKPLNSEKSKVR

SEQ ID NO: 2635990 - protein, 30 aa, Entamoeba histolytica
KTDDKTIQNTTEGFDNPLASKQIQTSNRNA

SEQ ID NO: 2635991 - protein, 8 aa, Entamoeba histolytica
KTDDSELK

SEQ ID NO: 2635992 - protein, 6 aa, Entamoeba histolytica
KTDDVK

SEQ ID NO: 2635993 - protein, 9 aa, Entamoeba histolytica
KTDEELNNN

SEQ ID NO: 2635994 - protein, 7 aa, Entamoeba histolytica
KTDEINV

SEQ ID NO: 2635995 - protein, 5 aa, Entamoeba histolytica
KTDEQ

SEQ ID NO: 2635996 - protein, 8 aa, Entamoeba histolytica
KTDEQMEN

SEQ ID NO: 2635997 - protein, 14 aa, Entamoeba histolytica
KTDETDETSTFCPT

SEQ ID NO: 2635998 - protein, 4 aa, Entamoeba histolytica
KTDG

SEQ ID NO: 2635999 - protein, 6 aa, Entamoeba histolytica
KTDGFS

SEQ ID NO: 2636000 - protein, 11 aa, Entamoeba histolytica
KTDGLSAAGSS

SEQ ID NO: 2636001 - protein, 7 aa, Entamoeba histolytica
KTDGRDS

SEQ ID NO: 2636002 - protein, 11 aa, Entamoeba histolytica
KTDKDKSGTLE

SEQ ID NO: 2636003 - protein, 9 aa, Entamoeba histolytica
KTDKIDESM

SEQ ID NO: 2636004 - protein, 5 aa, Entamoeba histolytica
KTDKL

SEQ ID NO: 2636005 - protein, 6 aa, Entamoeba histolytica
KTDKPL

SEQ ID NO: 2636006 - protein, 5 aa, Entamoeba histolytica
KTDKY

SEQ ID NO: 2636007 - protein, 18 aa, Entamoeba histolytica
KTDLEQHRTVSTEMGQSL

SEQ ID NO: 2636008 - protein, 12 aa, Entamoeba histolytica
KTDLESQINEND

SEQ ID NO: 2636009 - protein, 5 aa, Entamoeba histolytica
KTDLL

SEQ ID NO: 2636010 - protein, 18 aa, Entamoeba histolytica
KTDLRDSEDVKSKLQMEG

SEQ ID NO: 2636011 - protein, 14 aa, Entamoeba histolytica
KTDMNSARQAMGQR

SEQ ID NO: 2636012 - protein, 8 aa, Entamoeba histolytica
KTDNEKSV

SEQ ID NO: 2636013 - protein, 6 aa, Entamoeba histolytica
KTDNFS

SEQ ID NO: 2636014 - protein, 8 aa, Entamoeba histolytica
KTDNKTVA

SEQ ID NO: 2636015 - protein, 19 aa, Entamoeba histolytica
KTDNPEEVEDENNNEGEDE

SEQ ID NO: 2636016 - protein, 7 aa, Entamoeba histolytica
KTDNYLG

SEQ ID NO: 2636017 - protein, 5 aa, Entamoeba histolytica
KTDPF

SEQ ID NO: 2636018 - protein, 9 aa, Entamoeba histolytica
KTDPKDEVS

SEQ ID NO: 2636019 - protein, 6 aa, Entamoeba histolytica
KTDPKS

SEQ ID NO: 2636020 - protein, 6 aa, Entamoeba histolytica
KTDPNI

SEQ ID NO: 2636021 - protein, 12 aa, Entamoeba histolytica
KTDQELKQKKES

SEQ ID NO: 2636022 - protein, 5 aa, Entamoeba histolytica
KTDRI

SEQ ID NO: 2636023 - protein, 8 aa, Entamoeba histolytica
KTDRPTCY

SEQ ID NO: 2636024 - protein, 11 aa, Entamoeba histolytica
KTDSNYTRRPM

SEQ ID NO: 2636025 - protein, 7 aa, Entamoeba histolytica
KTDTNEI

SEQ ID NO: 2636026 - protein, 4 aa, Entamoeba histolytica
KTDY

SEQ ID NO: 2636027 - protein, 9 aa, Entamoeba histolytica
KTDYGVSKG

SEQ ID NO: 2636028 - protein, 10 aa, Entamoeba histolytica
KTEDINPRNN

SEQ ID NO: 2636029 - protein, 5 aa, Entamoeba histolytica
KTEDN

SEQ ID NO: 2636030 - protein, 8 aa, Entamoeba histolytica
KTEDPTLL

SEQ ID NO: 2636031 - protein, 6 aa, Entamoeba histolytica
KTEDQQ

SEQ ID NO: 2636032 - protein, 4 aa, Entamoeba histolytica
KTEE

SEQ ID NO: 2636033 - protein, 10 aa, Entamoeba histolytica
KTEEGQKRIA

SEQ ID NO: 2636034 - protein, 5 aa, Entamoeba histolytica
KTEEK

SEQ ID NO: 2636035 - protein, 16 aa, Entamoeba histolytica
KTEEKERLNKPDPQLQ

SEQ ID NO: 2636036 - protein, 8 aa, Entamoeba histolytica
KTEEKQLE

SEQ ID NO: 2636037 - protein, 6 aa, Entamoeba histolytica
KTEENI

SEQ ID NO: 2636038 - protein, 7 aa, Entamoeba histolytica
KTEEPIP

SEQ ID NO: 2636039 - protein, 8 aa, Entamoeba histolytica
KTEEPQKQ

SEQ ID NO: 2636040 - protein, 5 aa, Entamoeba histolytica
KTEEQ

SEQ ID NO: 2636041 - protein, 6 aa, Entamoeba histolytica
KTEETF

SEQ ID NO: 2636042 - protein, 4 aa, Entamoeba histolytica
KTEF

SEQ ID NO: 2636043 - protein, 6 aa, Entamoeba histolytica
KTEGID

SEQ ID NO: 2636044 - protein, 6 aa, Entamoeba histolytica
KTEGSV

SEQ ID NO: 2636045 - protein, 9 aa, Entamoeba histolytica
KTEIETRAK

SEQ ID NO: 2636046 - protein, 13 aa, Entamoeba histolytica
KTEIKPQKTKRYW

SEQ ID NO: 2636047 - protein, 10 aa, Entamoeba histolytica
KTEISNDPKK

SEQ ID NO: 2636048 - protein, 36 aa, Entamoeba histolytica
KTEITPEKTNEMTTKRAQPILQTSDNKNEEIKDSNN

SEQ ID NO: 2636049 - protein, 7 aa, Entamoeba histolytica
KTELENK

SEQ ID NO: 2636050 - protein, 14 aa, Entamoeba histolytica
KTELIQGPEVFPPV

SEQ ID NO: 2636051 - protein, 8 aa, Entamoeba histolytica
KTENGSKV

SEQ ID NO: 2636052 - protein, 10 aa, Entamoeba histolytica
KTENKLDSID

SEQ ID NO: 2636053 - protein, 6 aa, Entamoeba histolytica
KTENQK

SEQ ID NO: 2636054 - protein, 18 aa, Entamoeba histolytica
KTENSLLENTDTIEEGKE

SEQ ID NO: 2636055 - protein, 4 aa, Entamoeba histolytica
KTEP

SEQ ID NO: 2636056 - protein, 9 aa, Entamoeba histolytica
KTEPLPEKK

SEQ ID NO: 2636057 - protein, 10 aa, Entamoeba histolytica
KTEPPPISDS

SEQ ID NO: 2636058 - protein, 8 aa, Entamoeba histolytica
KTEPTELK

SEQ ID NO: 2636059 - protein, 13 aa, Entamoeba histolytica
KTEQDYKNYSQIN

SEQ ID NO: 2636060 - protein, 6 aa, Entamoeba histolytica
KTEQEQ

SEQ ID NO: 2636061 - protein, 9 aa, Entamoeba histolytica
KTEQSEYKK

SEQ ID NO: 2636062 - protein, 15 aa, Entamoeba histolytica
KTERDPRTIKSNEKT

SEQ ID NO: 2636063 - protein, 28 aa, Entamoeba histolytica
KTERITSRISQDLSSQHNQEVKKNPEVV

SEQ ID NO: 2636064 - protein, 5 aa, Entamoeba histolytica
KTERM

SEQ ID NO: 2636065 - protein, 7 aa, Entamoeba histolytica
KTERNEW

SEQ ID NO: 2636066 - protein, 9 aa, Entamoeba histolytica
KTESGSTGT

SEQ ID NO: 2636067 - protein, 7 aa, Entamoeba histolytica
KTESGTR

SEQ ID NO: 2636068 - protein, 10 aa, Entamoeba histolytica
KTESQRQQIH

SEQ ID NO: 2636069 - protein, 10 aa, Entamoeba histolytica
KTESVKDTQK

SEQ ID NO: 2636070 - protein, 7 aa, Entamoeba histolytica
KTESWAN

SEQ ID NO: 2636071 - protein, 9 aa, Entamoeba histolytica
KTETANSTL

SEQ ID NO: 2636072 - protein, 14 aa, Entamoeba histolytica
KTETTPPISRTGTI

SEQ ID NO: 2636073 - protein, 13 aa, Entamoeba histolytica
KTEVTDTSPNNIE

SEQ ID NO: 2636074 - protein, 6 aa, Entamoeba histolytica
KTFEGN

SEQ ID NO: 2636075 - protein, 5 aa, Entamoeba histolytica
KTFET

SEQ ID NO: 2636076 - protein, 7 aa, Entamoeba histolytica
KTFETAK

SEQ ID NO: 2636077 - protein, 4 aa, Entamoeba histolytica
KTFH

SEQ ID NO: 2636078 - protein, 4 aa, Entamoeba histolytica
KTFK

SEQ ID NO: 2636079 - protein, 7 aa, Entamoeba histolytica
KTFNTTD

SEQ ID NO: 2636080 - protein, 6 aa, Entamoeba histolytica
KTFPEE

SEQ ID NO: 2636081 - protein, 6 aa, Entamoeba histolytica
KTFPSL

SEQ ID NO: 2636082 - protein, 8 aa, Entamoeba histolytica
KTFSNENE

SEQ ID NO: 2636083 - protein, 11 aa, Entamoeba histolytica
KTFTPNDEDDF

SEQ ID NO: 2636084 - protein, 10 aa, Entamoeba histolytica
KTFTSADDVN

SEQ ID NO: 2636085 - protein, 10 aa, Entamoeba histolytica
KTGDEGNLDK

SEQ ID NO: 2636086 - protein, 7 aa, Entamoeba histolytica
KTGDFRS

SEQ ID NO: 2636087 - protein, 8 aa, Entamoeba histolytica
KTGDGCKE

SEQ ID NO: 2636088 - protein, 10 aa, Entamoeba histolytica
KTGDGKSSLG

SEQ ID NO: 2636089 - protein, 12 aa, Entamoeba histolytica
KTGDIGSVAKDG

SEQ ID NO: 2636090 - protein, 8 aa, Entamoeba histolytica
KTGETYRG

SEQ ID NO: 2636091 - protein, 6 aa, Entamoeba histolytica
KTGFPQ

SEQ ID NO: 2636092 - protein, 10 aa, Entamoeba histolytica
KTGGSVNSVG

SEQ ID NO: 2636093 - protein, 14 aa, Entamoeba histolytica
KTGIRNSGNTCYAA

SEQ ID NO: 2636094 - protein, 7 aa, Entamoeba histolytica
KTGKEVD

SEQ ID NO: 2636095 - protein, 9 aa, Entamoeba histolytica
KTGKNTTNI

SEQ ID NO: 2636096 - protein, 5 aa, Entamoeba histolytica
KTGLI

SEQ ID NO: 2636097 - protein, 16 aa, Entamoeba histolytica
KTGLSPQFRESDKKIV

SEQ ID NO: 2636098 - protein, 4 aa, Entamoeba histolytica
KTGN

SEQ ID NO: 2636099 - protein, 8 aa, Entamoeba histolytica
KTGNEEAV

SEQ ID NO: 2636100 - protein, 6 aa, Entamoeba histolytica
KTGNEQ

SEQ ID NO: 2636101 - protein, 8 aa, Entamoeba histolytica
KTGNNLDG

SEQ ID NO: 2636102 - protein, 10 aa, Entamoeba histolytica
KTGQLPSEFK

SEQ ID NO: 2636103 - protein, 4 aa, Entamoeba histolytica
KTGR

SEQ ID NO: 2636104 - protein, 13 aa, Entamoeba histolytica
KTGRRSKRERYFE

SEQ ID NO: 2636105 - protein, 8 aa, Entamoeba histolytica
KTGSGKTL

SEQ ID NO: 2636106 - protein, 45 aa, Entamoeba histolytica
KTGSPINEELNGSTPSPNIPESPMPDDNPGSFDRMDPPVSESAQE

SEQ ID NO: 2636107 - protein, 4 aa, Entamoeba histolytica
KTGW

SEQ ID NO: 2636108 - protein, 5 aa, Entamoeba histolytica
KTGWN

SEQ ID NO: 2636109 - protein, 6 aa, Entamoeba histolytica
KTHANW

SEQ ID NO: 2636110 - protein, 10 aa, Entamoeba histolytica
KTHGEKTGGF

SEQ ID NO: 2636111 - protein, 9 aa, Entamoeba histolytica
KTHGSQTGG

SEQ ID NO: 2636112 - protein, 10 aa, Entamoeba histolytica
KTHGTKTGGF

SEQ ID NO: 2636113 - protein, 4 aa, Entamoeba histolytica
KTHI

SEQ ID NO: 2636114 - protein, 23 aa, Entamoeba histolytica
KTHNIQREKTEEEKEKEREAEQF

SEQ ID NO: 2636115 - protein, 7 aa, Entamoeba histolytica
KTHPLPD

SEQ ID NO: 2636116 - protein, 13 aa, Entamoeba histolytica
KTHYNRKECTDPF

SEQ ID NO: 2636117 - protein, 6 aa, Entamoeba histolytica
KTIAPK

SEQ ID NO: 2636118 - protein, 7 aa, Entamoeba histolytica
KTIDGDL

SEQ ID NO: 2636119 - protein, 5 aa, Entamoeba histolytica
KTIDL

SEQ ID NO: 2636120 - protein, 5 aa, Entamoeba histolytica
KTIDN

SEQ ID NO: 2636121 - protein, 5 aa, Entamoeba histolytica
KTIDP

SEQ ID NO: 2636122 - protein, 10 aa, Entamoeba histolytica
KTIDSNKEVE

SEQ ID NO: 2636123 - protein, 4 aa, Entamoeba histolytica
KTIE

SEQ ID NO: 2636124 - protein, 7 aa, Entamoeba histolytica
KTIEESF

SEQ ID NO: 2636125 - protein, 5 aa, Entamoeba histolytica
KTIES

SEQ ID NO: 2636126 - protein, 6 aa, Entamoeba histolytica
KTIETN

SEQ ID NO: 2636127 - protein, 10 aa, Entamoeba histolytica
KTIETYPSSM

SEQ ID NO: 2636128 - protein, 5 aa, Entamoeba histolytica
KTIKE

SEQ ID NO: 2636129 - protein, 6 aa, Entamoeba histolytica
KTIKEE

SEQ ID NO: 2636130 - protein, 9 aa, Entamoeba histolytica
KTIKESPVA

SEQ ID NO: 2636131 - protein, 10 aa, Entamoeba histolytica
KTIKGEKKRV

SEQ ID NO: 2636132 - protein, 13 aa, Entamoeba histolytica
KTIKNTPKQNASV

SEQ ID NO: 2636133 - protein, 24 aa, Entamoeba histolytica
KTIKQDDLSDNNSLEEIKNENHNL

SEQ ID NO: 2636134 - protein, 6 aa, Entamoeba histolytica
KTIKTN

SEQ ID NO: 2636135 - protein, 4 aa, Entamoeba histolytica
KTIL

SEQ ID NO: 2636136 - protein, 4 aa, Entamoeba histolytica
KTIN

SEQ ID NO: 2636137 - protein, 10 aa, Entamoeba histolytica
KTINGDDTEG

SEQ ID NO: 2636138 - protein, 8 aa, Entamoeba histolytica
KTINGEDP

SEQ ID NO: 2636139 - protein, 12 aa, Entamoeba histolytica
KTINGKSIEKKD

SEQ ID NO: 2636140 - protein, 5 aa, Entamoeba histolytica
KTINP

SEQ ID NO: 2636141 - protein, 9 aa, Entamoeba histolytica
KTINPSATQ

SEQ ID NO: 2636142 - protein, 4 aa, Entamoeba histolytica
KTIP

SEQ ID NO: 2636143 - protein, 16 aa, Entamoeba histolytica
KTIPKKEIKRINNKQY

SEQ ID NO: 2636144 - protein, 5 aa, Entamoeba histolytica
KTIQK

SEQ ID NO: 2636145 - protein, 10 aa, Entamoeba histolytica
KTIQKNCDKN

SEQ ID NO: 2636146 - protein, 22 aa, Entamoeba histolytica
KTIQPTSSVSPISNTTNVSNND

SEQ ID NO: 2636147 - protein, 6 aa, Entamoeba histolytica
KTIREQ

SEQ ID NO: 2636148 - protein, 15 aa, Entamoeba histolytica
KTIRGGMTPGGRRRM

SEQ ID NO: 2636149 - protein, 6 aa, Entamoeba histolytica
KTISPP

SEQ ID NO: 2636150 - protein, 9 aa, Entamoeba histolytica
KTISQQQTQ

SEQ ID NO: 2636151 - protein, 6 aa, Entamoeba histolytica
KTISSE

SEQ ID NO: 2636152 - protein, 9 aa, Entamoeba histolytica
KTISSPNVN

SEQ ID NO: 2636153 - protein, 16 aa, Entamoeba histolytica
KTISVQPPIQPPQKSI

SEQ ID NO: 2636154 - protein, 4 aa, Entamoeba histolytica
KTIT

SEQ ID NO: 2636155 - protein, 7 aa, Entamoeba histolytica
KTITEQD

SEQ ID NO: 2636156 - protein, 6 aa, Entamoeba histolytica
KTITNI

SEQ ID NO: 2636157 - protein, 6 aa, Entamoeba histolytica
KTITSA

SEQ ID NO: 2636158 - protein, 7 aa, Entamoeba histolytica
KTITSKE

SEQ ID NO: 2636159 - protein, 5 aa, Entamoeba histolytica
KTITT

SEQ ID NO: 2636160 - protein, 16 aa, Entamoeba histolytica
KTKAKSVKLPGESQKS

SEQ ID NO: 2636161 - protein, 22 aa, Entamoeba histolytica
KTKALQSSKKVEVPEGTFNNNE

SEQ ID NO: 2636162 - protein, 11 aa, Entamoeba histolytica
KTKANDNKTFE

SEQ ID NO: 2636163 - protein, 7 aa, Entamoeba histolytica
KTKANFN

SEQ ID NO: 2636164 - protein, 7 aa, Entamoeba histolytica
KTKAQNK

SEQ ID NO: 2636165 - protein, 5 aa, Entamoeba histolytica
KTKCN

SEQ ID NO: 2636166 - protein, 7 aa, Entamoeba histolytica
KTKDEYI

SEQ ID NO: 2636167 - protein, 7 aa, Entamoeba histolytica
KTKDGPV

SEQ ID NO: 2636168 - protein, 13 aa, Entamoeba histolytica
KTKEAPPEETEEF

SEQ ID NO: 2636169 - protein, 5 aa, Entamoeba histolytica
KTKED

SEQ ID NO: 2636170 - protein, 12 aa, Entamoeba histolytica
KTKEDAQKNYQQ

SEQ ID NO: 2636171 - protein, 23 aa, Entamoeba histolytica
KTKEEEKGTTELELKENQKSIQE

SEQ ID NO: 2636172 - protein, 8 aa, Entamoeba histolytica
KTKEEIDN

SEQ ID NO: 2636173 - protein, 9 aa, Entamoeba histolytica
KTKEELDEV

SEQ ID NO: 2636174 - protein, 17 aa, Entamoeba histolytica
KTKEKGKEKINKKEYKE

SEQ ID NO: 2636175 - protein, 7 aa, Entamoeba histolytica
KTKELPQ

SEQ ID NO: 2636176 - protein, 44 aa, Entamoeba histolytica
KTKEQEIRTNAEQECEREKATYIEKERNKLEADYQRRVKEAEVK

SEQ ID NO: 2636177 - protein, 15 aa, Entamoeba histolytica
KTKEQENKKDVKKKG

SEQ ID NO: 2636178 - protein, 12 aa, Entamoeba histolytica
KTKEQLQSFVTS

SEQ ID NO: 2636179 - protein, 12 aa, Entamoeba histolytica
KTKEQRELKAEG

SEQ ID NO: 2636180 - protein, 16 aa, Entamoeba histolytica
KTKEYEVDEANEKAEQ

SEQ ID NO: 2636181 - protein, 8 aa, Entamoeba histolytica
KTKEYKNE

SEQ ID NO: 2636182 - protein, 31 aa, Entamoeba histolytica
KTKFSAKEAKLELDGQKHDINDGTLTSTIET

SEQ ID NO: 2636183 - protein, 7 aa, Entamoeba histolytica
KTKGFNP

SEQ ID NO: 2636184 - protein, 8 aa, Entamoeba histolytica
KTKGIPES

SEQ ID NO: 2636185 - protein, 7 aa, Entamoeba histolytica
KTKGKYT

SEQ ID NO: 2636186 - protein, 10 aa, Entamoeba histolytica
KTKGLTHSNT

SEQ ID NO: 2636187 - protein, 6 aa, Entamoeba histolytica
KTKGVI

SEQ ID NO: 2636188 - protein, 8 aa, Entamoeba histolytica
KTKHQEFT

SEQ ID NO: 2636189 - protein, 4 aa, Entamoeba histolytica
KTKI

SEQ ID NO: 2636190 - protein, 6 aa, Entamoeba histolytica
KTKIIN

SEQ ID NO: 2636191 - protein, 5 aa, Entamoeba histolytica
KTKIL

SEQ ID NO: 2636192 - protein, 7 aa, Entamoeba histolytica
KTKIPPP

SEQ ID NO: 2636193 - protein, 14 aa, Entamoeba histolytica
KTKKDVPQTERINE

SEQ ID NO: 2636194 - protein, 8 aa, Entamoeba histolytica
KTKKEQEM

SEQ ID NO: 2636195 - protein, 5 aa, Entamoeba histolytica
KTKKF

SEQ ID NO: 2636196 - protein, 8 aa, Entamoeba histolytica
KTKKGQPI

SEQ ID NO: 2636197 - protein, 17 aa, Entamoeba histolytica
KTKKHSRKTMNFLCNAI

SEQ ID NO: 2636198 - protein, 8 aa, Entamoeba histolytica
KTKKKYQL

SEQ ID NO: 2636199 - protein, 18 aa, Entamoeba histolytica
KTKKMEEDGTEEEDDDFL

SEQ ID NO: 2636200 - protein, 5 aa, Entamoeba histolytica
KTKKS

SEQ ID NO: 2636201 - protein, 9 aa, Entamoeba histolytica
KTKKSESLQ

SEQ ID NO: 2636202 - protein, 10 aa, Entamoeba histolytica
KTKKSSYAKK

SEQ ID NO: 2636203 - protein, 24 aa, Entamoeba histolytica
KTKKTSCFTNEEDTSQQKREIYSK

SEQ ID NO: 2636204 - protein, 9 aa, Entamoeba histolytica
KTKKYRKSI

SEQ ID NO: 2636205 - protein, 9 aa, Entamoeba histolytica
KTKLNEKRI

SEQ ID NO: 2636206 - protein, 9 aa, Entamoeba histolytica
KTKLSDDDL

SEQ ID NO: 2636207 - protein, 4 aa, Entamoeba histolytica
KTKN

SEQ ID NO: 2636208 - protein, 9 aa, Entamoeba histolytica
KTKNGDNYF

SEQ ID NO: 2636209 - protein, 19 aa, Entamoeba histolytica
KTKNGNESKRFQTITSNSK

SEQ ID NO: 2636210 - protein, 7 aa, Entamoeba histolytica
KTKNQQL

SEQ ID NO: 2636211 - protein, 6 aa, Entamoeba histolytica
KTKNVV

SEQ ID NO: 2636212 - protein, 8 aa, Entamoeba histolytica
KTKPGSLA

SEQ ID NO: 2636213 - protein, 8 aa, Entamoeba histolytica
KTKPKEAI

SEQ ID NO: 2636214 - protein, 7 aa, Entamoeba histolytica
KTKPKKR

SEQ ID NO: 2636215 - protein, 10 aa, Entamoeba histolytica
KTKPLNQMNE

SEQ ID NO: 2636216 - protein, 6 aa, Entamoeba histolytica
KTKQDG

SEQ ID NO: 2636217 - protein, 7 aa, Entamoeba histolytica
KTKQIKQ

SEQ ID NO: 2636218 - protein, 10 aa, Entamoeba histolytica
KTKQKDRDEL

SEQ ID NO: 2636219 - protein, 8 aa, Entamoeba histolytica
KTKQKPKV

SEQ ID NO: 2636220 - protein, 12 aa, Entamoeba histolytica
KTKQSDGKYNNS

SEQ ID NO: 2636221 - protein, 11 aa, Entamoeba histolytica
KTKQVPPPKEE

SEQ ID NO: 2636222 - protein, 6 aa, Entamoeba histolytica
KTKRLR

SEQ ID NO: 2636223 - protein, 7 aa, Entamoeba histolytica
KTKRTGV

SEQ ID NO: 2636224 - protein, 8 aa, Entamoeba histolytica
KTKRTPPI

SEQ ID NO: 2636225 - protein, 9 aa, Entamoeba histolytica
KTKSDEQER

SEQ ID NO: 2636226 - protein, 9 aa, Entamoeba histolytica
KTKSDSKYS

SEQ ID NO: 2636227 - protein, 5 aa, Entamoeba histolytica
KTKSI

SEQ ID NO: 2636228 - protein, 43 aa, Entamoeba histolytica
KTKSKSKEDISNSTPTTPGKKGVDKENSHDNNNTKDHGKQTTK

SEQ ID NO: 2636229 - protein, 52 aa, Entamoeba histolytica
KTKSLDVTSYNDSEYEFDSVSDPKKINFSEGDTEFKKELSPEDEESKTMDNL

SEQ ID NO: 2636230 - protein, 8 aa, Entamoeba histolytica
KTKSLEEQ

SEQ ID NO: 2636231 - protein, 8 aa, Entamoeba histolytica
KTKSSGGL

SEQ ID NO: 2636232 - protein, 5 aa, Entamoeba histolytica
KTKSY

SEQ ID NO: 2636233 - protein, 4 aa, Entamoeba histolytica
KTKT

SEQ ID NO: 2636234 - protein, 9 aa, Entamoeba histolytica
KTKTAKVTL

SEQ ID NO: 2636235 - protein, 7 aa, Entamoeba histolytica
KTKTASM

SEQ ID NO: 2636236 - protein, 12 aa, Entamoeba histolytica
KTKTEVKKEKAI

SEQ ID NO: 2636237 - protein, 9 aa, Entamoeba histolytica
KTKTGKTEF

SEQ ID NO: 2636238 - protein, 13 aa, Entamoeba histolytica
KTKTNNEKTEDHI

SEQ ID NO: 2636239 - protein, 7 aa, Entamoeba histolytica
KTKTNSS

SEQ ID NO: 2636240 - protein, 17 aa, Entamoeba histolytica
KTKTPKKDEKKTTTLES

SEQ ID NO: 2636241 - protein, 7 aa, Entamoeba histolytica
KTKTPTL

SEQ ID NO: 2636242 - protein, 10 aa, Entamoeba histolytica
KTKTQKKEME

SEQ ID NO: 2636243 - protein, 12 aa, Entamoeba histolytica
KTKTYDVDEPRE

SEQ ID NO: 2636244 - protein, 5 aa, Entamoeba histolytica
KTKVK

SEQ ID NO: 2636245 - protein, 11 aa, Entamoeba histolytica
KTKVKKTYSEM

SEQ ID NO: 2636246 - protein, 10 aa, Entamoeba histolytica
KTKYEPNDEV

SEQ ID NO: 2636247 - protein, 10 aa, Entamoeba histolytica
KTLAQRKKRN

SEQ ID NO: 2636248 - protein, 5 aa, Entamoeba histolytica
KTLDN

SEQ ID NO: 2636249 - protein, 5 aa, Entamoeba histolytica
KTLEE

SEQ ID NO: 2636250 - protein, 8 aa, Entamoeba histolytica
KTLEGLQE

SEQ ID NO: 2636251 - protein, 7 aa, Entamoeba histolytica
KTLEKNN

SEQ ID NO: 2636252 - protein, 12 aa, Entamoeba histolytica
KTLGNNKHNSSI

SEQ ID NO: 2636253 - protein, 29 aa, Entamoeba histolytica
KTLKDQSTLKQTVESFKEEDKKKKSSEPL

SEQ ID NO: 2636254 - protein, 6 aa, Entamoeba histolytica
KTLKEA

SEQ ID NO: 2636255 - protein, 21 aa, Entamoeba histolytica
KTLKGKLGWSGAGSSKTTNQI

SEQ ID NO: 2636256 - protein, 11 aa, Entamoeba histolytica
KTLKSEEPDVY

SEQ ID NO: 2636257 - protein, 7 aa, Entamoeba histolytica
KTLNEDK

SEQ ID NO: 2636258 - protein, 6 aa, Entamoeba histolytica
KTLNPH

SEQ ID NO: 2636259 - protein, 5 aa, Entamoeba histolytica
KTLPI

SEQ ID NO: 2636260 - protein, 17 aa, Entamoeba histolytica
KTLPSFPRYDTSARAGG

SEQ ID NO: 2636261 - protein, 9 aa, Entamoeba histolytica
KTLPSQISS

SEQ ID NO: 2636262 - protein, 10 aa, Entamoeba histolytica
KTLQESVNSL

SEQ ID NO: 2636263 - protein, 10 aa, Entamoeba histolytica
KTLQQSPSLS

SEQ ID NO: 2636264 - protein, 5 aa, Entamoeba histolytica
KTLQT

SEQ ID NO: 2636265 - protein, 7 aa, Entamoeba histolytica
KTLRGKK

SEQ ID NO: 2636266 - protein, 4 aa, Entamoeba histolytica
KTLS

SEQ ID NO: 2636267 - protein, 10 aa, Entamoeba histolytica
KTLSKTTDPF

SEQ ID NO: 2636268 - protein, 13 aa, Entamoeba histolytica
KTLSREINSSTSV

SEQ ID NO: 2636269 - protein, 6 aa, Entamoeba histolytica
KTLSSL

SEQ ID NO: 2636270 - protein, 6 aa, Entamoeba histolytica
KTLSSS

SEQ ID NO: 2636271 - protein, 5 aa, Entamoeba histolytica
KTMEA

SEQ ID NO: 2636272 - protein, 23 aa, Entamoeba histolytica
KTMEDEHSEDIENKTETSQDIED

SEQ ID NO: 2636273 - protein, 5 aa, Entamoeba histolytica
KTMEQ

SEQ ID NO: 2636274 - protein, 5 aa, Entamoeba histolytica
KTMET

SEQ ID NO: 2636275 - protein, 13 aa, Entamoeba histolytica
KTMQKKGIRKESV

SEQ ID NO: 2636276 - protein, 5 aa, Entamoeba histolytica
KTNAF

SEQ ID NO: 2636277 - protein, 5 aa, Entamoeba histolytica
KTNDE

SEQ ID NO: 2636278 - protein, 14 aa, Entamoeba histolytica
KTNDKSQLDSLQKA

SEQ ID NO: 2636279 - protein, 8 aa, Entamoeba histolytica
KTNDNTTL

SEQ ID NO: 2636280 - protein, 8 aa, Entamoeba histolytica
KTNDQVKT

SEQ ID NO: 2636281 - protein, 12 aa, Entamoeba histolytica
KTNDTKINNTEK

SEQ ID NO: 2636282 - protein, 7 aa, Entamoeba histolytica
KTNECNR

SEQ ID NO: 2636283 - protein, 7 aa, Entamoeba histolytica
KTNEEYK

SEQ ID NO: 2636284 - protein, 6 aa, Entamoeba histolytica
KTNEIS

SEQ ID NO: 2636285 - protein, 63 aa, Entamoeba histolytica
KTNEKTTVSESPKKSHKDKKKEGGEEEEEENPKRKVFKKNKKQQMLKQSKSEIITKKSEEIDS

SEQ ID NO: 2636286 - protein, 35 aa, Entamoeba histolytica
KTNEKTTVSESPKKSHKDKKKEGGEEEEENPKRKV

SEQ ID NO: 2636287 - protein, 7 aa, Entamoeba histolytica
KTNESEY

SEQ ID NO: 2636288 - protein, 7 aa, Entamoeba histolytica
KTNGKVK

SEQ ID NO: 2636289 - protein, 7 aa, Entamoeba histolytica
KTNGRFG

SEQ ID NO: 2636290 - protein, 8 aa, Entamoeba histolytica
KTNGTKIY

SEQ ID NO: 2636291 - protein, 6 aa, Entamoeba histolytica
KTNHEN

SEQ ID NO: 2636292 - protein, 16 aa, Entamoeba histolytica
KTNHKKQSIQYSQELS

SEQ ID NO: 2636293 - protein, 6 aa, Entamoeba histolytica
KTNIQE

SEQ ID NO: 2636294 - protein, 9 aa, Entamoeba histolytica
KTNIQQPST

SEQ ID NO: 2636295 - protein, 11 aa, Entamoeba histolytica
KTNIRTDGRAN

SEQ ID NO: 2636296 - protein, 4 aa, Entamoeba histolytica
KTNK

SEQ ID NO: 2636297 - protein, 7 aa, Entamoeba histolytica
KTNKENI

SEQ ID NO: 2636298 - protein, 9 aa, Entamoeba histolytica
KTNKETKQL

SEQ ID NO: 2636299 - protein, 6 aa, Entamoeba histolytica
KTNKHG

SEQ ID NO: 2636300 - protein, 17 aa, Entamoeba histolytica
KTNKILSSQLSNEELEK

SEQ ID NO: 2636301 - protein, 12 aa, Entamoeba histolytica
KTNKQSNSLDPV

SEQ ID NO: 2636302 - protein, 10 aa, Entamoeba histolytica
KTNKSSEFAQ

SEQ ID NO: 2636303 - protein, 6 aa, Entamoeba histolytica
KTNKTD

SEQ ID NO: 2636304 - protein, 8 aa, Entamoeba histolytica
KTNKTKEI

SEQ ID NO: 2636305 - protein, 8 aa, Entamoeba histolytica
KTNKTNNC

SEQ ID NO: 2636306 - protein, 4 aa, Entamoeba histolytica
KTNL

SEQ ID NO: 2636307 - protein, 6 aa, Entamoeba histolytica
KTNNDI

SEQ ID NO: 2636308 - protein, 6 aa, Entamoeba histolytica
KTNNGL

SEQ ID NO: 2636309 - protein, 9 aa, Entamoeba histolytica
KTNNITNEV

SEQ ID NO: 2636310 - protein, 7 aa, Entamoeba histolytica
KTNNKEF

SEQ ID NO: 2636311 - protein, 5 aa, Entamoeba histolytica
KTNNQ

SEQ ID NO: 2636312 - protein, 8 aa, Entamoeba histolytica
KTNNTFDS

SEQ ID NO: 2636313 - protein, 4 aa, Entamoeba histolytica
KTNP

SEQ ID NO: 2636314 - protein, 14 aa, Entamoeba histolytica
KTNPLEKKQTYVNE

SEQ ID NO: 2636315 - protein, 7 aa, Entamoeba histolytica
KTNPNEF

SEQ ID NO: 2636316 - protein, 9 aa, Entamoeba histolytica
KTNQEPDIA

SEQ ID NO: 2636317 - protein, 7 aa, Entamoeba histolytica
KTNQKTV

SEQ ID NO: 2636318 - protein, 8 aa, Entamoeba histolytica
KTNQLNTI

SEQ ID NO: 2636319 - protein, 7 aa, Entamoeba histolytica
KTNQNTL

SEQ ID NO: 2636320 - protein, 12 aa, Entamoeba histolytica
KTNRIEKRNQKI

SEQ ID NO: 2636321 - protein, 15 aa, Entamoeba histolytica
KTNRTEKQTTRQYEK

SEQ ID NO: 2636322 - protein, 15 aa, Entamoeba histolytica
KTNSGEFKRISVWVC

SEQ ID NO: 2636323 - protein, 8 aa, Entamoeba histolytica
KTNSSSSL

SEQ ID NO: 2636324 - protein, 14 aa, Entamoeba histolytica
KTNSSYLLIVGCDI

SEQ ID NO: 2636325 - protein, 4 aa, Entamoeba histolytica
KTNT

SEQ ID NO: 2636326 - protein, 8 aa, Entamoeba histolytica
KTNTDLDD

SEQ ID NO: 2636327 - protein, 6 aa, Entamoeba histolytica
KTNTKE

SEQ ID NO: 2636328 - protein, 13 aa, Entamoeba histolytica
KTNTQNTSDNSSI

SEQ ID NO: 2636329 - protein, 7 aa, Entamoeba histolytica
KTNTTYP

SEQ ID NO: 2636330 - protein, 6 aa, Entamoeba histolytica
KTNTVS

SEQ ID NO: 2636331 - protein, 15 aa, Entamoeba histolytica
KTNVKKKRSRAGMND

SEQ ID NO: 2636332 - protein, 12 aa, Entamoeba histolytica
KTNYGKRTTLRD

SEQ ID NO: 2636333 - protein, 5 aa, Entamoeba histolytica
KTPAP

SEQ ID NO: 2636334 - protein, 5 aa, Entamoeba histolytica
KTPDG

SEQ ID NO: 2636335 - protein, 7 aa, Entamoeba histolytica
KTPEECT

SEQ ID NO: 2636336 - protein, 31 aa, Entamoeba histolytica
KTPELEKQKEEEYKKREEMIESKKQSKAQKN

SEQ ID NO: 2636337 - protein, 5 aa, Entamoeba histolytica
KTPEP

SEQ ID NO: 2636338 - protein, 9 aa, Entamoeba histolytica
KTPETRKEI

SEQ ID NO: 2636339 - protein, 7 aa, Entamoeba histolytica
KTPEYKG

SEQ ID NO: 2636340 - protein, 8 aa, Entamoeba histolytica
KTPFEEDD

SEQ ID NO: 2636341 - protein, 12 aa, Entamoeba histolytica
KTPFGSKDANEQ

SEQ ID NO: 2636342 - protein, 7 aa, Entamoeba histolytica
KTPGKFM

SEQ ID NO: 2636343 - protein, 14 aa, Entamoeba histolytica
KTPGPKPPNMTNSP

SEQ ID NO: 2636344 - protein, 9 aa, Entamoeba histolytica
KTPKAASLA

SEQ ID NO: 2636345 - protein, 6 aa, Entamoeba histolytica
KTPKEN

SEQ ID NO: 2636346 - protein, 10 aa, Entamoeba histolytica
KTPKPSPSPM

SEQ ID NO: 2636347 - protein, 7 aa, Entamoeba histolytica
KTPKSEV

SEQ ID NO: 2636348 - protein, 7 aa, Entamoeba histolytica
KTPKTIP

SEQ ID NO: 2636349 - protein, 8 aa, Entamoeba histolytica
KTPKTNSY

SEQ ID NO: 2636350 - protein, 4 aa, Entamoeba histolytica
KTPL

SEQ ID NO: 2636351 - protein, 6 aa, Entamoeba histolytica
KTPLLR

SEQ ID NO: 2636352 - protein, 5 aa, Entamoeba histolytica
KTPLN

SEQ ID NO: 2636353 - protein, 6 aa, Entamoeba histolytica
KTPLNT

SEQ ID NO: 2636354 - protein, 4 aa, Entamoeba histolytica
KTPN

SEQ ID NO: 2636355 - protein, 6 aa, Entamoeba histolytica
KTPNAG

SEQ ID NO: 2636356 - protein, 8 aa, Entamoeba histolytica
KTPNATQQ

SEQ ID NO: 2636357 - protein, 7 aa, Entamoeba histolytica
KTPPENQ

SEQ ID NO: 2636358 - protein, 6 aa, Entamoeba histolytica
KTPPNT

SEQ ID NO: 2636359 - protein, 10 aa, Entamoeba histolytica
KTPPTNNKGI

SEQ ID NO: 2636360 - protein, 6 aa, Entamoeba histolytica
KTPPTQ

SEQ ID NO: 2636361 - protein, 7 aa, Entamoeba histolytica
KTPQQHL

SEQ ID NO: 2636362 - protein, 5 aa, Entamoeba histolytica
KTPQS

SEQ ID NO: 2636363 - protein, 8 aa, Entamoeba histolytica
KTPQTELI

SEQ ID NO: 2636364 - protein, 4 aa, Entamoeba histolytica
KTPR

SEQ ID NO: 2636365 - protein, 12 aa, Entamoeba histolytica
KTPSDLADSDFS

SEQ ID NO: 2636366 - protein, 6 aa, Entamoeba histolytica
KTPSGG

SEQ ID NO: 2636367 - protein, 15 aa, Entamoeba histolytica
KTPSIPSPKPTSLPN

SEQ ID NO: 2636368 - protein, 4 aa, Entamoeba histolytica
KTPT

SEQ ID NO: 2636369 - protein, 8 aa, Entamoeba histolytica
KTPTEKLN

SEQ ID NO: 2636370 - protein, 7 aa, Entamoeba histolytica
KTPTITQ

SEQ ID NO: 2636371 - protein, 53 aa, Entamoeba histolytica
KTPTLLENKEGSTTNLNSQSLSTPYLTPSQSPCPMSPVNSNNAISVQTPPKQI

SEQ ID NO: 2636372 - protein, 9 aa, Entamoeba histolytica
KTPTPTIPT

SEQ ID NO: 2636373 - protein, 6 aa, Entamoeba histolytica
KTPTSV

SEQ ID NO: 2636374 - protein, 13 aa, Entamoeba histolytica
KTQAISSNGTISK

SEQ ID NO: 2636375 - protein, 6 aa, Entamoeba histolytica
KTQDQR

SEQ ID NO: 2636376 - protein, 15 aa, Entamoeba histolytica
KTQEELDKQKVSAHD

SEQ ID NO: 2636377 - protein, 6 aa, Entamoeba histolytica
KTQEER

SEQ ID NO: 2636378 - protein, 7 aa, Entamoeba histolytica
KTQEIKQ

SEQ ID NO: 2636379 - protein, 18 aa, Entamoeba histolytica
KTQERLEKTSSQAKESSD

SEQ ID NO: 2636380 - protein, 8 aa, Entamoeba histolytica
KTQFNKQP

SEQ ID NO: 2636381 - protein, 6 aa, Entamoeba histolytica
KTQFPD

SEQ ID NO: 2636382 - protein, 7 aa, Entamoeba histolytica
KTQFTPS

SEQ ID NO: 2636383 - protein, 11 aa, Entamoeba histolytica
KTQGIGRSSCE

SEQ ID NO: 2636384 - protein, 7 aa, Entamoeba histolytica
KTQHDKI

SEQ ID NO: 2636385 - protein, 20 aa, Entamoeba histolytica
KTQHEPRTIKEKKEKLIKNM

SEQ ID NO: 2636386 - protein, 15 aa, Entamoeba histolytica
KTQHPEMDFSNAKMM

SEQ ID NO: 2636387 - protein, 11 aa, Entamoeba histolytica
KTQIDSVKSQI

SEQ ID NO: 2636388 - protein, 6 aa, Entamoeba histolytica
KTQINK

SEQ ID NO: 2636389 - protein, 6 aa, Entamoeba histolytica
KTQIQE

SEQ ID NO: 2636390 - protein, 5 aa, Entamoeba histolytica
KTQKD

SEQ ID NO: 2636391 - protein, 18 aa, Entamoeba histolytica
KTQKENELNKLKEEKEQI

SEQ ID NO: 2636392 - protein, 6 aa, Entamoeba histolytica
KTQKPQ

SEQ ID NO: 2636393 - protein, 11 aa, Entamoeba histolytica
KTQKSQPQEDW

SEQ ID NO: 2636394 - protein, 6 aa, Entamoeba histolytica
KTQKVE

SEQ ID NO: 2636395 - protein, 9 aa, Entamoeba histolytica
KTQLTSSNS

SEQ ID NO: 2636396 - protein, 5 aa, Entamoeba histolytica
KTQNA

SEQ ID NO: 2636397 - protein, 9 aa, Entamoeba histolytica
KTQNDENKK

SEQ ID NO: 2636398 - protein, 6 aa, Entamoeba histolytica
KTQNES

SEQ ID NO: 2636399 - protein, 13 aa, Entamoeba histolytica
KTQNFNTQQYTNG

SEQ ID NO: 2636400 - protein, 34 aa, Entamoeba histolytica
KTQNGNDNQCNKGVENSNNTPFRKVSQDEFEVVS

SEQ ID NO: 2636401 - protein, 6 aa, Entamoeba histolytica
KTQNKN

SEQ ID NO: 2636402 - protein, 9 aa, Entamoeba histolytica
KTQNNDNEY

SEQ ID NO: 2636403 - protein, 6 aa, Entamoeba histolytica
KTQNPQ

SEQ ID NO: 2636404 - protein, 9 aa, Entamoeba histolytica
KTQNYNDGD

SEQ ID NO: 2636405 - protein, 8 aa, Entamoeba histolytica
KTQPKTER

SEQ ID NO: 2636406 - protein, 5 aa, Entamoeba histolytica
KTQPS

SEQ ID NO: 2636407 - protein, 10 aa, Entamoeba histolytica
KTQQNDNDKS

SEQ ID NO: 2636408 - protein, 6 aa, Entamoeba histolytica
KTQQSF

SEQ ID NO: 2636409 - protein, 7 aa, Entamoeba histolytica
KTQRENI

SEQ ID NO: 2636410 - protein, 4 aa, Entamoeba histolytica
KTQS

SEQ ID NO: 2636411 - protein, 6 aa, Entamoeba histolytica
KTQSNN

SEQ ID NO: 2636412 - protein, 5 aa, Entamoeba histolytica
KTQSR

SEQ ID NO: 2636413 - protein, 6 aa, Entamoeba histolytica
KTQSSK

SEQ ID NO: 2636414 - protein, 10 aa, Entamoeba histolytica
KTQSSLPSGL

SEQ ID NO: 2636415 - protein, 21 aa, Entamoeba histolytica
KTQSSNEPKEIEEYHSKRGVS

SEQ ID NO: 2636416 - protein, 12 aa, Entamoeba histolytica
KTQTCNKPSPLS

SEQ ID NO: 2636417 - protein, 25 aa, Entamoeba histolytica
KTQTENSTKISELEEKLKDSQKELG

SEQ ID NO: 2636418 - protein, 8 aa, Entamoeba histolytica
KTQTENYK

SEQ ID NO: 2636419 - protein, 5 aa, Entamoeba histolytica
KTQTI

SEQ ID NO: 2636420 - protein, 22 aa, Entamoeba histolytica
KTQTIETLETERQERKKEEIEE

SEQ ID NO: 2636421 - protein, 18 aa, Entamoeba histolytica
KTQTQEESIPKSIGNNST

SEQ ID NO: 2636422 - protein, 6 aa, Entamoeba histolytica
KTQTQQ

SEQ ID NO: 2636423 - protein, 21 aa, Entamoeba histolytica
KTQTSEEKKEPAINKTQSDIS

SEQ ID NO: 2636424 - protein, 14 aa, Entamoeba histolytica
KTQVGQLKPSVKEG

SEQ ID NO: 2636425 - protein, 6 aa, Entamoeba histolytica
KTQVNI

SEQ ID NO: 2636426 - protein, 12 aa, Entamoeba histolytica
KTQYEMATEDYE

SEQ ID NO: 2636427 - protein, 6 aa, Entamoeba histolytica
KTRAGL

SEQ ID NO: 2636428 - protein, 7 aa, Entamoeba histolytica
KTRAPNL

SEQ ID NO: 2636429 - protein, 8 aa, Entamoeba histolytica
KTRAPSLA

SEQ ID NO: 2636430 - protein, 9 aa, Entamoeba histolytica
KTRDNDSHG

SEQ ID NO: 2636431 - protein, 10 aa, Entamoeba histolytica
KTRDYQSQQE

SEQ ID NO: 2636432 - protein, 8 aa, Entamoeba histolytica
KTREKDDL

SEQ ID NO: 2636433 - protein, 9 aa, Entamoeba histolytica
KTREKQTEN

SEQ ID NO: 2636434 - protein, 36 aa, Entamoeba histolytica
KTRERKKTIKSDVGEAIKPKTVNADEWSAAKETPER

SEQ ID NO: 2636435 - protein, 6 aa, Entamoeba histolytica
KTRESD

SEQ ID NO: 2636436 - protein, 14 aa, Entamoeba histolytica
KTRGSSNTVKRERI

SEQ ID NO: 2636437 - protein, 6 aa, Entamoeba histolytica
KTRKAE

SEQ ID NO: 2636438 - protein, 8 aa, Entamoeba histolytica
KTRKDERE

SEQ ID NO: 2636439 - protein, 7 aa, Entamoeba histolytica
KTRKDIP

SEQ ID NO: 2636440 - protein, 15 aa, Entamoeba histolytica
KTRKMSSGYYGDEQL

SEQ ID NO: 2636441 - protein, 6 aa, Entamoeba histolytica
KTRKNE

SEQ ID NO: 2636442 - protein, 7 aa, Entamoeba histolytica
KTRNDET

SEQ ID NO: 2636443 - protein, 7 aa, Entamoeba histolytica
KTRNEFN

SEQ ID NO: 2636444 - protein, 31 aa, Entamoeba histolytica
KTRNGLSEEQAKKRIQSQPTQEEYDNKSQVQ

SEQ ID NO: 2636445 - protein, 6 aa, Entamoeba histolytica
KTRNSI

SEQ ID NO: 2636446 - protein, 7 aa, Entamoeba histolytica
KTRPCHK

SEQ ID NO: 2636447 - protein, 6 aa, Entamoeba histolytica
KTRPIQ

SEQ ID NO: 2636448 - protein, 25 aa, Entamoeba histolytica
KTRSAAESIERAKSQSDKEQAILTG

SEQ ID NO: 2636449 - protein, 6 aa, Entamoeba histolytica
KTRSTR

SEQ ID NO: 2636450 - protein, 12 aa, Entamoeba histolytica
KTRTPKAAPTHP

SEQ ID NO: 2636451 - protein, 6 aa, Entamoeba histolytica
KTSAGF

SEQ ID NO: 2636452 - protein, 6 aa, Entamoeba histolytica
KTSANE

SEQ ID NO: 2636453 - protein, 8 aa, Entamoeba histolytica
KTSDNSEY

SEQ ID NO: 2636454 - protein, 5 aa, Entamoeba histolytica
KTSDV

SEQ ID NO: 2636455 - protein, 8 aa, Entamoeba histolytica
KTSEERKK

SEQ ID NO: 2636456 - protein, 10 aa, Entamoeba histolytica
KTSEETPERR

SEQ ID NO: 2636457 - protein, 7 aa, Entamoeba histolytica
KTSEEYI

SEQ ID NO: 2636458 - protein, 17 aa, Entamoeba histolytica
KTSEGEYQFTSNDSKEL

SEQ ID NO: 2636459 - protein, 7 aa, Entamoeba histolytica
KTSEKQS

SEQ ID NO: 2636460 - protein, 12 aa, Entamoeba histolytica
KTSELQKENDQI

SEQ ID NO: 2636461 - protein, 8 aa, Entamoeba histolytica
KTSEPSQI

SEQ ID NO: 2636462 - protein, 8 aa, Entamoeba histolytica
KTSEYQVS

SEQ ID NO: 2636463 - protein, 6 aa, Entamoeba histolytica
KTSFES

SEQ ID NO: 2636464 - protein, 11 aa, Entamoeba histolytica
KTSFTAEETQG

SEQ ID NO: 2636465 - protein, 9 aa, Entamoeba histolytica
KTSFTPEEV

SEQ ID NO: 2636466 - protein, 15 aa, Entamoeba histolytica
KTSGARQQKIDNQLG

SEQ ID NO: 2636467 - protein, 4 aa, Entamoeba histolytica
KTSH

SEQ ID NO: 2636468 - protein, 8 aa, Entamoeba histolytica
KTSHIPDK

SEQ ID NO: 2636469 - protein, 16 aa, Entamoeba histolytica
KTSIDTHTLLQSFSNA

SEQ ID NO: 2636470 - protein, 10 aa, Entamoeba histolytica
KTSISRKGKI

SEQ ID NO: 2636471 - protein, 8 aa, Entamoeba histolytica
KTSITSAL

SEQ ID NO: 2636472 - protein, 11 aa, Entamoeba histolytica
KTSKEEPTSET

SEQ ID NO: 2636473 - protein, 10 aa, Entamoeba histolytica
KTSKEKVRNF

SEQ ID NO: 2636474 - protein, 10 aa, Entamoeba histolytica
KTSKGLPQKY

SEQ ID NO: 2636475 - protein, 10 aa, Entamoeba histolytica
KTSKLNESSI

SEQ ID NO: 2636476 - protein, 8 aa, Entamoeba histolytica
KTSKMDLQ

SEQ ID NO: 2636477 - protein, 6 aa, Entamoeba histolytica
KTSLDL

SEQ ID NO: 2636478 - protein, 5 aa, Entamoeba histolytica
KTSLI

SEQ ID NO: 2636479 - protein, 6 aa, Entamoeba histolytica
KTSLQP

SEQ ID NO: 2636480 - protein, 5 aa, Entamoeba histolytica
KTSNE

SEQ ID NO: 2636481 - protein, 7 aa, Entamoeba histolytica
KTSNEDY

SEQ ID NO: 2636482 - protein, 7 aa, Entamoeba histolytica
KTSNIPI

SEQ ID NO: 2636483 - protein, 11 aa, Entamoeba histolytica
KTSNKRKISET

SEQ ID NO: 2636484 - protein, 7 aa, Entamoeba histolytica
KTSNSSC

SEQ ID NO: 2636485 - protein, 11 aa, Entamoeba histolytica
KTSPEKAKEYV

SEQ ID NO: 2636486 - protein, 6 aa, Entamoeba histolytica
KTSPFD

SEQ ID NO: 2636487 - protein, 8 aa, Entamoeba histolytica
KTSPIEKQ

SEQ ID NO: 2636488 - protein, 10 aa, Entamoeba histolytica
KTSPLQNPPF

SEQ ID NO: 2636489 - protein, 7 aa, Entamoeba histolytica
KTSPNRH

SEQ ID NO: 2636490 - protein, 28 aa, Entamoeba histolytica
KTSPTQINTSINKKTETQKKEEQNTIKT

SEQ ID NO: 2636491 - protein, 16 aa, Entamoeba histolytica
KTSQHSHKKRNCASSP

SEQ ID NO: 2636492 - protein, 8 aa, Entamoeba histolytica
KTSQLRNS

SEQ ID NO: 2636493 - protein, 8 aa, Entamoeba histolytica
KTSQPNKQ

SEQ ID NO: 2636494 - protein, 17 aa, Entamoeba histolytica
KTSQQKSRIGLSKSKSE

SEQ ID NO: 2636495 - protein, 7 aa, Entamoeba histolytica
KTSQYQG

SEQ ID NO: 2636496 - protein, 13 aa, Entamoeba histolytica
KTSRSDQRKETKI

SEQ ID NO: 2636497 - protein, 5 aa, Entamoeba histolytica
KTSSI

SEQ ID NO: 2636498 - protein, 10 aa, Entamoeba histolytica
KTSSNSPVSH

SEQ ID NO: 2636499 - protein, 8 aa, Entamoeba histolytica
KTSSQGEK

SEQ ID NO: 2636500 - protein, 11 aa, Entamoeba histolytica
KTSSRGKLVTN

SEQ ID NO: 2636501 - protein, 10 aa, Entamoeba histolytica
KTSSSVTPLK

SEQ ID NO: 2636502 - protein, 7 aa, Entamoeba histolytica
KTSTETS

SEQ ID NO: 2636503 - protein, 8 aa, Entamoeba histolytica
KTSTQIRD

SEQ ID NO: 2636504 - protein, 47 aa, Entamoeba histolytica
KTSTSPSIKFGQTPTKQQTNVENSPTRIKTPEKPTLTNSKSPESQQL

SEQ ID NO: 2636505 - protein, 25 aa, Entamoeba histolytica
KTSTTNPFNDDSDNEKQKTQNVTDL

SEQ ID NO: 2636506 - protein, 18 aa, Entamoeba histolytica
KTSTTPTTSSSSNSRLQP

SEQ ID NO: 2636507 - protein, 6 aa, Entamoeba histolytica
KTSVDD

SEQ ID NO: 2636508 - protein, 5 aa, Entamoeba histolytica
KTSYD

SEQ ID NO: 2636509 - protein, 5 aa, Entamoeba histolytica
KTSYS

SEQ ID NO: 2636510 - protein, 8 aa, Entamoeba histolytica
KTTDENVQ

SEQ ID NO: 2636511 - protein, 5 aa, Entamoeba histolytica
KTTDL

SEQ ID NO: 2636512 - protein, 6 aa, Entamoeba histolytica
KTTDND

SEQ ID NO: 2636513 - protein, 5 aa, Entamoeba histolytica
KTTDP

SEQ ID NO: 2636514 - protein, 5 aa, Entamoeba histolytica
KTTDV

SEQ ID NO: 2636515 - protein, 10 aa, Entamoeba histolytica
KTTEEEKKYV

SEQ ID NO: 2636516 - protein, 7 aa, Entamoeba histolytica
KTTEENL

SEQ ID NO: 2636517 - protein, 9 aa, Entamoeba histolytica
KTTEKDKAV

SEQ ID NO: 2636518 - protein, 8 aa, Entamoeba histolytica
KTTENNEK

SEQ ID NO: 2636519 - protein, 11 aa, Entamoeba histolytica
KTTFASGQVND

SEQ ID NO: 2636520 - protein, 5 aa, Entamoeba histolytica
KTTFT

SEQ ID NO: 2636521 - protein, 8 aa, Entamoeba histolytica
KTTGNVDE

SEQ ID NO: 2636522 - protein, 19 aa, Entamoeba histolytica
KTTGPKRKAAYKSLGELTP

SEQ ID NO: 2636523 - protein, 5 aa, Entamoeba histolytica
KTTGV

SEQ ID NO: 2636524 - protein, 7 aa, Entamoeba histolytica
KTTIENS

SEQ ID NO: 2636525 - protein, 5 aa, Entamoeba histolytica
KTTIN

SEQ ID NO: 2636526 - protein, 6 aa, Entamoeba histolytica
KTTIPK

SEQ ID NO: 2636527 - protein, 8 aa, Entamoeba histolytica
KTTIQSYD

SEQ ID NO: 2636528 - protein, 4 aa, Entamoeba histolytica
KTTK

SEQ ID NO: 2636529 - protein, 5 aa, Entamoeba histolytica
KTTKI

SEQ ID NO: 2636530 - protein, 8 aa, Entamoeba histolytica
KTTKQKYV

SEQ ID NO: 2636531 - protein, 11 aa, Entamoeba histolytica
KTTKSKEKKTY

SEQ ID NO: 2636532 - protein, 48 aa, Entamoeba histolytica
KTTLEAAQRKAAKAVKIATEAKEKAESDSQVAEKAVEDTQKKVAEAEA

SEQ ID NO: 2636533 - protein, 16 aa, Entamoeba histolytica
KTTLNSSTETFSPSTS

SEQ ID NO: 2636534 - protein, 4 aa, Entamoeba histolytica
KTTN

SEQ ID NO: 2636535 - protein, 12 aa, Entamoeba histolytica
KTTNEITDKKEE

SEQ ID NO: 2636536 - protein, 5 aa, Entamoeba histolytica
KTTNS

SEQ ID NO: 2636537 - protein, 6 aa, Entamoeba histolytica
KTTNTV

SEQ ID NO: 2636538 - protein, 9 aa, Entamoeba histolytica
KTTPEGERC

SEQ ID NO: 2636539 - protein, 6 aa, Entamoeba histolytica
KTTPEI

SEQ ID NO: 2636540 - protein, 6 aa, Entamoeba histolytica
KTTPEL

SEQ ID NO: 2636541 - protein, 9 aa, Entamoeba histolytica
KTTPETVKE

SEQ ID NO: 2636542 - protein, 7 aa, Entamoeba histolytica
KTTPNDY

SEQ ID NO: 2636543 - protein, 5 aa, Entamoeba histolytica
KTTPQ

SEQ ID NO: 2636544 - protein, 14 aa, Entamoeba histolytica
KTTPTTNRKTEKLT

SEQ ID NO: 2636545 - protein, 12 aa, Entamoeba histolytica
KTTQKKLSKLAL

SEQ ID NO: 2636546 - protein, 6 aa, Entamoeba histolytica
KTTQRI

SEQ ID NO: 2636547 - protein, 7 aa, Entamoeba histolytica
KTTQTTD

SEQ ID NO: 2636548 - protein, 5 aa, Entamoeba histolytica
KTTRT

SEQ ID NO: 2636549 - protein, 4 aa, Entamoeba histolytica
KTTS

SEQ ID NO: 2636550 - protein, 10 aa, Entamoeba histolytica
KTTSEVMNET

SEQ ID NO: 2636551 - protein, 6 aa, Entamoeba histolytica
KTTSFF

SEQ ID NO: 2636552 - protein, 12 aa, Entamoeba histolytica
KTTSTPHIPSHS

SEQ ID NO: 2636553 - protein, 16 aa, Entamoeba histolytica
KTTSTSKSNKHSIPDQ

SEQ ID NO: 2636554 - protein, 6 aa, Entamoeba histolytica
KTTTDI

SEQ ID NO: 2636555 - protein, 6 aa, Entamoeba histolytica
KTTTIK

SEQ ID NO: 2636556 - protein, 7 aa, Entamoeba histolytica
KTTTRFD

SEQ ID NO: 2636557 - protein, 12 aa, Entamoeba histolytica
KTTTTPASQKIN

SEQ ID NO: 2636558 - protein, 19 aa, Entamoeba histolytica
KTTVKKENIPEKKSQEEIP

SEQ ID NO: 2636559 - protein, 6 aa, Entamoeba histolytica
KTTVLQ

SEQ ID NO: 2636560 - protein, 5 aa, Entamoeba histolytica
KTTVN

SEQ ID NO: 2636561 - protein, 6 aa, Entamoeba histolytica
KTTYPE

SEQ ID NO: 2636562 - protein, 5 aa, Entamoeba histolytica
KTVDQ

SEQ ID NO: 2636563 - protein, 4 aa, Entamoeba histolytica
KTVE

SEQ ID NO: 2636564 - protein, 17 aa, Entamoeba histolytica
KTVEGNTVSINEERRQS

SEQ ID NO: 2636565 - protein, 8 aa, Entamoeba histolytica
KTVEGQQY

SEQ ID NO: 2636566 - protein, 6 aa, Entamoeba histolytica
KTVERN

SEQ ID NO: 2636567 - protein, 7 aa, Entamoeba histolytica
KTVETKP

SEQ ID NO: 2636568 - protein, 5 aa, Entamoeba histolytica
KTVGE

SEQ ID NO: 2636569 - protein, 6 aa, Entamoeba histolytica
KTVGTV

SEQ ID NO: 2636570 - protein, 8 aa, Entamoeba histolytica
KTVIEKQR

SEQ ID NO: 2636571 - protein, 5 aa, Entamoeba histolytica
KTVNE

SEQ ID NO: 2636572 - protein, 5 aa, Entamoeba histolytica
KTVNH

SEQ ID NO: 2636573 - protein, 15 aa, Entamoeba histolytica
KTVNKIKDEKNDPRK

SEQ ID NO: 2636574 - protein, 12 aa, Entamoeba histolytica
KTVNQLYKKRTI

SEQ ID NO: 2636575 - protein, 5 aa, Entamoeba histolytica
KTVPD

SEQ ID NO: 2636576 - protein, 7 aa, Entamoeba histolytica
KTVPSEE

SEQ ID NO: 2636577 - protein, 5 aa, Entamoeba histolytica
KTVQE

SEQ ID NO: 2636578 - protein, 15 aa, Entamoeba histolytica
KTVSDEELKKAYRKK

SEQ ID NO: 2636579 - protein, 8 aa, Entamoeba histolytica
KTVSENIN

SEQ ID NO: 2636580 - protein, 6 aa, Entamoeba histolytica
KTVSPG

SEQ ID NO: 2636581 - protein, 6 aa, Entamoeba histolytica
KTVSTM

SEQ ID NO: 2636582 - protein, 6 aa, Entamoeba histolytica
KTVTEE

SEQ ID NO: 2636583 - protein, 8 aa, Entamoeba histolytica
KTVTNSHS

SEQ ID NO: 2636584 - protein, 10 aa, Entamoeba histolytica
KTWKRSKPIE

SEQ ID NO: 2636585 - protein, 5 aa, Entamoeba histolytica
KTYAD

SEQ ID NO: 2636586 - protein, 13 aa, Entamoeba histolytica
KTYDFNKNPNTTG

SEQ ID NO: 2636587 - protein, 10 aa, Entamoeba histolytica
KTYDGNEISG

SEQ ID NO: 2636588 - protein, 5 aa, Entamoeba histolytica
KTYDL

SEQ ID NO: 2636589 - protein, 6 aa, Entamoeba histolytica
KTYDMS

SEQ ID NO: 2636590 - protein, 5 aa, Entamoeba histolytica
KTYHP

SEQ ID NO: 2636591 - protein, 4 aa, Entamoeba histolytica
KTYK

SEQ ID NO: 2636592 - protein, 8 aa, Entamoeba histolytica
KTYKGKKR

SEQ ID NO: 2636593 - protein, 10 aa, Entamoeba histolytica
KTYKQKKCNN

SEQ ID NO: 2636594 - protein, 6 aa, Entamoeba histolytica
KTYLQN

SEQ ID NO: 2636595 - protein, 8 aa, Entamoeba histolytica
KTYNGING

SEQ ID NO: 2636596 - protein, 7 aa, Entamoeba histolytica
KTYNPKE

SEQ ID NO: 2636597 - protein, 6 aa, Entamoeba histolytica
KTYNSV

SEQ ID NO: 2636598 - protein, 4 aa, Entamoeba histolytica
KTYP

SEQ ID NO: 2636599 - protein, 6 aa, Entamoeba histolytica
KTYPGG

SEQ ID NO: 2636600 - protein, 7 aa, Entamoeba histolytica
KTYPQEF

SEQ ID NO: 2636601 - protein, 4 aa, Entamoeba histolytica
KTYS

SEQ ID NO: 2636602 - protein, 6 aa, Entamoeba histolytica
KTYSSF

SEQ ID NO: 2636603 - protein, 7 aa, Entamoeba histolytica
KTYSSPC

SEQ ID NO: 2636604 - protein, 5 aa, Entamoeba histolytica
KTYSY

SEQ ID NO: 2636605 - protein, 5 aa, Entamoeba histolytica
KTYTI

SEQ ID NO: 2636606 - protein, 18 aa, Entamoeba histolytica
KVAEEESPKVEEKTTNKA

SEQ ID NO: 2636607 - protein, 13 aa, Entamoeba histolytica
KVAEGKLSGKVDG

SEQ ID NO: 2636608 - protein, 4 aa, Entamoeba histolytica
KVAK

SEQ ID NO: 2636609 - protein, 13 aa, Entamoeba histolytica
KVANEVREETEKE

SEQ ID NO: 2636610 - protein, 7 aa, Entamoeba histolytica
KVARSTH

SEQ ID NO: 2636611 - protein, 13 aa, Entamoeba histolytica
KVATGEKNALKKQ

SEQ ID NO: 2636612 - protein, 5 aa, Entamoeba histolytica
KVCPD

SEQ ID NO: 2636613 - protein, 5 aa, Entamoeba histolytica
KVDAI

SEQ ID NO: 2636614 - protein, 6 aa, Entamoeba histolytica
KVDDEE

SEQ ID NO: 2636615 - protein, 5 aa, Entamoeba histolytica
KVDDV

SEQ ID NO: 2636616 - protein, 6 aa, Entamoeba histolytica
KVDEAE

SEQ ID NO: 2636617 - protein, 39 aa, Entamoeba histolytica
KVDEDAAKRVVTNEQAKDWCENNGDIPYYETSAKSGLNV

SEQ ID NO: 2636618 - protein, 5 aa, Entamoeba histolytica
KVDEE

SEQ ID NO: 2636619 - protein, 6 aa, Entamoeba histolytica
KVDEGL

SEQ ID NO: 2636620 - protein, 7 aa, Entamoeba histolytica
KVDEGQL

SEQ ID NO: 2636621 - protein, 6 aa, Entamoeba histolytica
KVDERD

SEQ ID NO: 2636622 - protein, 6 aa, Entamoeba histolytica
KVDFPQ

SEQ ID NO: 2636623 - protein, 6 aa, Entamoeba histolytica
KVDGAD

SEQ ID NO: 2636624 - protein, 7 aa, Entamoeba histolytica
KVDGRSN

SEQ ID NO: 2636625 - protein, 7 aa, Entamoeba histolytica
KVDGSNK

SEQ ID NO: 2636626 - protein, 6 aa, Entamoeba histolytica
KVDKSH

SEQ ID NO: 2636627 - protein, 5 aa, Entamoeba histolytica
KVDNI

SEQ ID NO: 2636628 - protein, 7 aa, Entamoeba histolytica
KVDNYQD

SEQ ID NO: 2636629 - protein, 15 aa, Entamoeba histolytica
KVDSEEWKEKPIETK

SEQ ID NO: 2636630 - protein, 13 aa, Entamoeba histolytica
KVDSSVKPTKPLP

SEQ ID NO: 2636631 - protein, 6 aa, Entamoeba histolytica
KVDSVS

SEQ ID NO: 2636632 - protein, 8 aa, Entamoeba histolytica
KVDTNKVN

SEQ ID NO: 2636633 - protein, 19 aa, Entamoeba histolytica
KVDTNTDVKPFKEEDLQER

SEQ ID NO: 2636634 - protein, 8 aa, Entamoeba histolytica
KVDTQQNT

SEQ ID NO: 2636635 - protein, 14 aa, Entamoeba histolytica
KVDVNAQDEQGNTA

SEQ ID NO: 2636636 - protein, 7 aa, Entamoeba histolytica
KVEARDV

SEQ ID NO: 2636637 - protein, 7 aa, Entamoeba histolytica
KVECKGA

SEQ ID NO: 2636638 - protein, 10 aa, Entamoeba histolytica
KVEDDEDNIK

SEQ ID NO: 2636639 - protein, 7 aa, Entamoeba histolytica
KVEDEYK

SEQ ID NO: 2636640 - protein, 13 aa, Entamoeba histolytica
KVEDKKVLSKSPT

SEQ ID NO: 2636641 - protein, 42 aa, Entamoeba histolytica
KVEDNKDKEEENKEDNKETEEKKEEAPINENDSLCPKAVVAK

SEQ ID NO: 2636642 - protein, 6 aa, Entamoeba histolytica
KVEDPV

SEQ ID NO: 2636643 - protein, 5 aa, Entamoeba histolytica
KVEDQ

SEQ ID NO: 2636644 - protein, 9 aa, Entamoeba histolytica
KVEDTKKNL

SEQ ID NO: 2636645 - protein, 6 aa, Entamoeba histolytica
KVEEAQ

SEQ ID NO: 2636646 - protein, 7 aa, Entamoeba histolytica
KVEEGNE

SEQ ID NO: 2636647 - protein, 49 aa, Entamoeba histolytica
KVEEKEEKTNEEQEKETPNNENRSEDKEEITDSQDKKRKGKKPLHKEEK

SEQ ID NO: 2636648 - protein, 7 aa, Entamoeba histolytica
KVEEKEI

SEQ ID NO: 2636649 - protein, 15 aa, Entamoeba histolytica
KVEEKEKKPAKKNRK

SEQ ID NO: 2636650 - protein, 7 aa, Entamoeba histolytica
KVEELQK

SEQ ID NO: 2636651 - protein, 19 aa, Entamoeba histolytica
KVEEMTEEQFNKAAQAQIE

SEQ ID NO: 2636652 - protein, 20 aa, Entamoeba histolytica
KVEEMTEEQFNKAAQAQIEE

SEQ ID NO: 2636653 - protein, 10 aa, Entamoeba histolytica
KVEENLQEDR

SEQ ID NO: 2636654 - protein, 7 aa, Entamoeba histolytica
KVEEQND

SEQ ID NO: 2636655 - protein, 8 aa, Entamoeba histolytica
KVEEQQEK

SEQ ID NO: 2636656 - protein, 12 aa, Entamoeba histolytica
KVEEQRKKEAEL

SEQ ID NO: 2636657 - protein, 10 aa, Entamoeba histolytica
KVEEQRQIEE

SEQ ID NO: 2636658 - protein, 19 aa, Entamoeba histolytica
KVEESVKGYYEKKRGMTQK

SEQ ID NO: 2636659 - protein, 12 aa, Entamoeba histolytica
KVEETEEQKRER

SEQ ID NO: 2636660 - protein, 5 aa, Entamoeba histolytica
KVEEV

SEQ ID NO: 2636661 - protein, 12 aa, Entamoeba histolytica
KVEEVPSDTPVG

SEQ ID NO: 2636662 - protein, 5 aa, Entamoeba histolytica
KVEEY

SEQ ID NO: 2636663 - protein, 14 aa, Entamoeba histolytica
KVEGVEQKKQTEKE

SEQ ID NO: 2636664 - protein, 13 aa, Entamoeba histolytica
KVEKKQREKKEVQ

SEQ ID NO: 2636665 - protein, 9 aa, Entamoeba histolytica
KVEKSKGDV

SEQ ID NO: 2636666 - protein, 4 aa, Entamoeba histolytica
KVEM

SEQ ID NO: 2636667 - protein, 12 aa, Entamoeba histolytica
KVENERLEQEIR

SEQ ID NO: 2636668 - protein, 23 aa, Entamoeba histolytica
KVEPEEMKDQPPLESSTINESSH

SEQ ID NO: 2636669 - protein, 6 aa, Entamoeba histolytica
KVEPSR

SEQ ID NO: 2636670 - protein, 12 aa, Entamoeba histolytica
KVEQRRSKSKME

SEQ ID NO: 2636671 - protein, 8 aa, Entamoeba histolytica
KVERKNGT

SEQ ID NO: 2636672 - protein, 6 aa, Entamoeba histolytica
KVESAA

SEQ ID NO: 2636673 - protein, 14 aa, Entamoeba histolytica
KVESPNYKHGNKLR

SEQ ID NO: 2636674 - protein, 6 aa, Entamoeba histolytica
KVETFD

SEQ ID NO: 2636675 - protein, 13 aa, Entamoeba histolytica
KVETSKGTGEDYI

SEQ ID NO: 2636676 - protein, 91 aa, Entamoeba histolytica
KVETTEEVKESLPTENIKNNEEKEEHKLDEKEEHNSEEKVKEESAEELFPSGDEDIKDEFSEEETPFEQNAKKTNLKEAKIKAEAAEEMQT

SEQ ID NO: 2636677 - protein, 6 aa, Entamoeba histolytica
KVETTL

SEQ ID NO: 2636678 - protein, 6 aa, Entamoeba histolytica
KVGDDV

SEQ ID NO: 2636679 - protein, 19 aa, Entamoeba histolytica
KVGDSTIGALKEDKKNVPI

SEQ ID NO: 2636680 - protein, 6 aa, Entamoeba histolytica
KVGDYT

SEQ ID NO: 2636681 - protein, 17 aa, Entamoeba histolytica
KVGEDQTSNDADDGGSE

SEQ ID NO: 2636682 - protein, 16 aa, Entamoeba histolytica
KVGELNDSITQKEKSY

SEQ ID NO: 2636683 - protein, 7 aa, Entamoeba histolytica
KVGEQGG

SEQ ID NO: 2636684 - protein, 9 aa, Entamoeba histolytica
KVGIDTEGL

SEQ ID NO: 2636685 - protein, 13 aa, Entamoeba histolytica
KVGKEYATSTDSD

SEQ ID NO: 2636686 - protein, 6 aa, Entamoeba histolytica
KVGKNE

SEQ ID NO: 2636687 - protein, 6 aa, Entamoeba histolytica
KVGKST

SEQ ID NO: 2636688 - protein, 10 aa, Entamoeba histolytica
KVGRETKSRF

SEQ ID NO: 2636689 - protein, 5 aa, Entamoeba histolytica
KVGRQ

SEQ ID NO: 2636690 - protein, 8 aa, Entamoeba histolytica
KVHTTGDF

SEQ ID NO: 2636691 - protein, 8 aa, Entamoeba histolytica
KVIPQGKE

SEQ ID NO: 2636692 - protein, 4 aa, Entamoeba histolytica
KVIS

SEQ ID NO: 2636693 - protein, 33 aa, Entamoeba histolytica
KVKDNQKNKEEKEKESKPKKFKSNSPLPKEDAF

SEQ ID NO: 2636694 - protein, 6 aa, Entamoeba histolytica
KVKEEK

SEQ ID NO: 2636695 - protein, 25 aa, Entamoeba histolytica
KVKETKASLEQKKQENQKLKNERDE

SEQ ID NO: 2636696 - protein, 8 aa, Entamoeba histolytica
KVKNNEDF

SEQ ID NO: 2636697 - protein, 8 aa, Entamoeba histolytica
KVKNNKEF

SEQ ID NO: 2636698 - protein, 9 aa, Entamoeba histolytica
KVKPSSQHG

SEQ ID NO: 2636699 - protein, 4 aa, Entamoeba histolytica
KVKS

SEQ ID NO: 2636700 - protein, 9 aa, Entamoeba histolytica
KVKSKAKTI

SEQ ID NO: 2636701 - protein, 8 aa, Entamoeba histolytica
KVKSYPTI

SEQ ID NO: 2636702 - protein, 12 aa, Entamoeba histolytica
KVKTQQTGIQSK

SEQ ID NO: 2636703 - protein, 7 aa, Entamoeba histolytica
KVLENND

SEQ ID NO: 2636704 - protein, 13 aa, Entamoeba histolytica
KVLGESKEYKGEK

SEQ ID NO: 2636705 - protein, 16 aa, Entamoeba histolytica
KVLNPKKKTIGGATSN

SEQ ID NO: 2636706 - protein, 16 aa, Entamoeba histolytica
KVMKTKQQKHTNDEKK

SEQ ID NO: 2636707 - protein, 9 aa, Entamoeba histolytica
KVMPQGDSS

SEQ ID NO: 2636708 - protein, 8 aa, Entamoeba histolytica
KVNAGGVD

SEQ ID NO: 2636709 - protein, 7 aa, Entamoeba histolytica
KVNAGTT

SEQ ID NO: 2636710 - protein, 43 aa, Entamoeba histolytica
KVNDDIKKNERLDSPKINMSANKEELLSAKSDTILTERKQQSL

SEQ ID NO: 2636711 - protein, 5 aa, Entamoeba histolytica
KVNEK

SEQ ID NO: 2636712 - protein, 6 aa, Entamoeba histolytica
KVNEKG

SEQ ID NO: 2636713 - protein, 8 aa, Entamoeba histolytica
KVNEKTDM

SEQ ID NO: 2636714 - protein, 8 aa, Entamoeba histolytica
KVNENTLP

SEQ ID NO: 2636715 - protein, 8 aa, Entamoeba histolytica
KVNESKER

SEQ ID NO: 2636716 - protein, 11 aa, Entamoeba histolytica
KVNGQYVGENE

SEQ ID NO: 2636717 - protein, 4 aa, Entamoeba histolytica
KVNK

SEQ ID NO: 2636718 - protein, 6 aa, Entamoeba histolytica
KVNKER

SEQ ID NO: 2636719 - protein, 5 aa, Entamoeba histolytica
KVNND

SEQ ID NO: 2636720 - protein, 10 aa, Entamoeba histolytica
KVNNNKSEHR

SEQ ID NO: 2636721 - protein, 8 aa, Entamoeba histolytica
KVNPAQAK

SEQ ID NO: 2636722 - protein, 7 aa, Entamoeba histolytica
KVNPPPF

SEQ ID NO: 2636723 - protein, 4 aa, Entamoeba histolytica
KVNQ

SEQ ID NO: 2636724 - protein, 5 aa, Entamoeba histolytica
KVNSP

SEQ ID NO: 2636725 - protein, 4 aa, Entamoeba histolytica
KVNT

SEQ ID NO: 2636726 - protein, 5 aa, Entamoeba histolytica
KVPAD

SEQ ID NO: 2636727 - protein, 9 aa, Entamoeba histolytica
KVPAPLPNE

SEQ ID NO: 2636728 - protein, 12 aa, Entamoeba histolytica
KVPEKTKTSFDS

SEQ ID NO: 2636729 - protein, 4 aa, Entamoeba histolytica
KVPG

SEQ ID NO: 2636730 - protein, 10 aa, Entamoeba histolytica
KVPGNDNTSK

SEQ ID NO: 2636731 - protein, 14 aa, Entamoeba histolytica
KVPHDFSKKGVDYE

SEQ ID NO: 2636732 - protein, 6 aa, Entamoeba histolytica
KVPHTK

SEQ ID NO: 2636733 - protein, 11 aa, Entamoeba histolytica
KVPKTKSSSGI

SEQ ID NO: 2636734 - protein, 9 aa, Entamoeba histolytica
KVPNGVTEL

SEQ ID NO: 2636735 - protein, 8 aa, Entamoeba histolytica
KVPNNSCP

SEQ ID NO: 2636736 - protein, 35 aa, Entamoeba histolytica
KVPNYEKKTNRSRRKNDAIEEDKPKNIKEKKEKMV

SEQ ID NO: 2636737 - protein, 7 aa, Entamoeba histolytica
KVPPAGL

SEQ ID NO: 2636738 - protein, 6 aa, Entamoeba histolytica
KVPPNK

SEQ ID NO: 2636739 - protein, 21 aa, Entamoeba histolytica
KVPPSDELKSDSIETNGMKES

SEQ ID NO: 2636740 - protein, 6 aa, Entamoeba histolytica
KVPQPL

SEQ ID NO: 2636741 - protein, 13 aa, Entamoeba histolytica
KVPQREYDPEKDD

SEQ ID NO: 2636742 - protein, 4 aa, Entamoeba histolytica
KVPR

SEQ ID NO: 2636743 - protein, 7 aa, Entamoeba histolytica
KVPRAKK

SEQ ID NO: 2636744 - protein, 8 aa, Entamoeba histolytica
KVPSKSIN

SEQ ID NO: 2636745 - protein, 12 aa, Entamoeba histolytica
KVPSLGSLNSSQ

SEQ ID NO: 2636746 - protein, 13 aa, Entamoeba histolytica
KVPSVSKQNKSEI

SEQ ID NO: 2636747 - protein, 11 aa, Entamoeba histolytica
KVPTKEEERSD

SEQ ID NO: 2636748 - protein, 16 aa, Entamoeba histolytica
KVQAERDRALSDFKSG

SEQ ID NO: 2636749 - protein, 16 aa, Entamoeba histolytica
KVQEETKEKEEAKASL

SEQ ID NO: 2636750 - protein, 22 aa, Entamoeba histolytica
KVQEKQIKAAQKQQKKSEKKIE

SEQ ID NO: 2636751 - protein, 27 aa, Entamoeba histolytica
KVQNAYNKKKKTKGPQQRNETNPFYKD

SEQ ID NO: 2636752 - protein, 6 aa, Entamoeba histolytica
KVQPFG

SEQ ID NO: 2636753 - protein, 7 aa, Entamoeba histolytica
KVQPNGI

SEQ ID NO: 2636754 - protein, 9 aa, Entamoeba histolytica
KVQQETQNK

SEQ ID NO: 2636755 - protein, 9 aa, Entamoeba histolytica
KVQQKQQND

SEQ ID NO: 2636756 - protein, 7 aa, Entamoeba histolytica
KVQQNES

SEQ ID NO: 2636757 - protein, 10 aa, Entamoeba histolytica
KVQRSTSIPK

SEQ ID NO: 2636758 - protein, 5 aa, Entamoeba histolytica
KVQTQ

SEQ ID NO: 2636759 - protein, 6 aa, Entamoeba histolytica
KVRAES

SEQ ID NO: 2636760 - protein, 9 aa, Entamoeba histolytica
KVRARNQLK

SEQ ID NO: 2636761 - protein, 10 aa, Entamoeba histolytica
KVRDEVKTKE

SEQ ID NO: 2636762 - protein, 16 aa, Entamoeba histolytica
KVRGAIPREKEKKGEI

SEQ ID NO: 2636763 - protein, 8 aa, Entamoeba histolytica
KVRKGDYH

SEQ ID NO: 2636764 - protein, 4 aa, Entamoeba histolytica
KVRL

SEQ ID NO: 2636765 - protein, 5 aa, Entamoeba histolytica
KVRNG

SEQ ID NO: 2636766 - protein, 6 aa, Entamoeba histolytica
KVRPKK

SEQ ID NO: 2636767 - protein, 11 aa, Entamoeba histolytica
KVRREGTALDY

SEQ ID NO: 2636768 - protein, 16 aa, Entamoeba histolytica
KVRRGSRGNQKAKKIR

SEQ ID NO: 2636769 - protein, 5 aa, Entamoeba histolytica
KVRSE

SEQ ID NO: 2636770 - protein, 7 aa, Entamoeba histolytica
KVSDKKN

SEQ ID NO: 2636771 - protein, 6 aa, Entamoeba histolytica
KVSDMK

SEQ ID NO: 2636772 - protein, 5 aa, Entamoeba histolytica
KVSDY

SEQ ID NO: 2636773 - protein, 14 aa, Entamoeba histolytica
KVSEIQNGTLGENA

SEQ ID NO: 2636774 - protein, 10 aa, Entamoeba histolytica
KVSESRYQTK

SEQ ID NO: 2636775 - protein, 15 aa, Entamoeba histolytica
KVSISTESSKENKKC

SEQ ID NO: 2636776 - protein, 5 aa, Entamoeba histolytica
KVSKE

SEQ ID NO: 2636777 - protein, 18 aa, Entamoeba histolytica
KVSKKSVISSKLDAQSLK

SEQ ID NO: 2636778 - protein, 7 aa, Entamoeba histolytica
KVSKNEK

SEQ ID NO: 2636779 - protein, 9 aa, Entamoeba histolytica
KVSKNGVSM

SEQ ID NO: 2636780 - protein, 4 aa, Entamoeba histolytica
KVSP

SEQ ID NO: 2636781 - protein, 11 aa, Entamoeba histolytica
KVSPDPFENEK

SEQ ID NO: 2636782 - protein, 8 aa, Entamoeba histolytica
KVSPESHD

SEQ ID NO: 2636783 - protein, 5 aa, Entamoeba histolytica
KVSPN

SEQ ID NO: 2636784 - protein, 8 aa, Entamoeba histolytica
KVSPPKIN

SEQ ID NO: 2636785 - protein, 7 aa, Entamoeba histolytica
KVSPSQI

SEQ ID NO: 2636786 - protein, 11 aa, Entamoeba histolytica
KVSQGKTSSSL

SEQ ID NO: 2636787 - protein, 9 aa, Entamoeba histolytica
KVSRHGNGY

SEQ ID NO: 2636788 - protein, 10 aa, Entamoeba histolytica
KVSSDDKSEE

SEQ ID NO: 2636789 - protein, 6 aa, Entamoeba histolytica
KVSSKN

SEQ ID NO: 2636790 - protein, 13 aa, Entamoeba histolytica
KVSSLRSSFSERK

SEQ ID NO: 2636791 - protein, 21 aa, Entamoeba histolytica
KVSTNEINRGGYQTKKERKLM

SEQ ID NO: 2636792 - protein, 7 aa, Entamoeba histolytica
KVSTPNE

SEQ ID NO: 2636793 - protein, 20 aa, Entamoeba histolytica
KVSTQKVSNTKLKKRVEELE

SEQ ID NO: 2636794 - protein, 6 aa, Entamoeba histolytica
KVTDNV

SEQ ID NO: 2636795 - protein, 5 aa, Entamoeba histolytica
KVTDP

SEQ ID NO: 2636796 - protein, 7 aa, Entamoeba histolytica
KVTEEKA

SEQ ID NO: 2636797 - protein, 8 aa, Entamoeba histolytica
KVTEENKI

SEQ ID NO: 2636798 - protein, 6 aa, Entamoeba histolytica
KVTELT

SEQ ID NO: 2636799 - protein, 13 aa, Entamoeba histolytica
KVTESLSDVSTEN

SEQ ID NO: 2636800 - protein, 7 aa, Entamoeba histolytica
KVTETQR

SEQ ID NO: 2636801 - protein, 7 aa, Entamoeba histolytica
KVTETSS

SEQ ID NO: 2636802 - protein, 10 aa, Entamoeba histolytica
KVTGKEGNCI

SEQ ID NO: 2636803 - protein, 6 aa, Entamoeba histolytica
KVTGKT

SEQ ID NO: 2636804 - protein, 5 aa, Entamoeba histolytica
KVTGL

SEQ ID NO: 2636805 - protein, 10 aa, Entamoeba histolytica
KVTGPRGSLT

SEQ ID NO: 2636806 - protein, 9 aa, Entamoeba histolytica
KVTITTSSA

SEQ ID NO: 2636807 - protein, 6 aa, Entamoeba histolytica
KVTKKD

SEQ ID NO: 2636808 - protein, 23 aa, Entamoeba histolytica
KVTKLEEVPTGSDDAYVLYYRLI

SEQ ID NO: 2636809 - protein, 15 aa, Entamoeba histolytica
KVTKTISNKAQEVDE

SEQ ID NO: 2636810 - protein, 10 aa, Entamoeba histolytica
KVTPSAQQQL

SEQ ID NO: 2636811 - protein, 19 aa, Entamoeba histolytica
KVTQEKAKAATKKTETLKQ

SEQ ID NO: 2636812 - protein, 27 aa, Entamoeba histolytica
KVTQEQIQNQEEEQKNQQIENENQKKM

SEQ ID NO: 2636813 - protein, 8 aa, Entamoeba histolytica
KVTSNNPV

SEQ ID NO: 2636814 - protein, 27 aa, Entamoeba histolytica
KVTSYEKEQRKTENENEKIEDMSPEEI

SEQ ID NO: 2636815 - protein, 6 aa, Entamoeba histolytica
KVTTEL

SEQ ID NO: 2636816 - protein, 278 aa, Entamoeba histolytica
KVTTEPIKQEETFGGQTIPKEKPTTQETERVKESKETSTVNGASETAGDNQKKEDVKESEKQSTGENGKGSKEEHQDTERPSGQEADTTHNEQNKQKVDENHENQNGNEKNQEKNQENPSEKEGKAEHIKDEKNDNPQDDKGKEQSQESDASEKKKGGETKDNESDNENSQKNKDKNEEKKNEEETSNQGQEKKNNEQEKENKDSNNQQKSQQQDKNTEEKNNEQKDESKDNNKQNKPEDGKNNEQKDESKESENKTTDSSESESDDDINNHKNIDGT

SEQ ID NO: 2636817 - protein, 278 aa, Entamoeba histolytica
KVTTEPIKQEETVSGQTVPKEKPTIQETEKVKESKETSTVNGASETAGDNQKKEDVKESEKQSTGENGKGSKEEHQDTERPSGQEADTTHNEQNKQKVDENHENQNGNEKNQEKNQENPSEKEGKAEHIKDEKNDNPQDDKGKEQSQESDASEKKKGGETKDNESDNEDSQKNKDKNEEKKNEEETSNQGQEKKNNEQEKENKDSNNQQKSKQQDKNAEEKHDEQKDESKDNNKQNKPEDGKNNEQKDESKESEDKATDSSESESDDDINNHKNIDGT

SEQ ID NO: 2636818 - protein, 13 aa, Entamoeba histolytica
KVTTINEQNYEGI

SEQ ID NO: 2636819 - protein, 7 aa, Entamoeba histolytica
KVTTKEL

SEQ ID NO: 2636820 - protein, 19 aa, Entamoeba histolytica
KVTTSLRERGERRSNRMSE

SEQ ID NO: 2636821 - protein, 10 aa, Entamoeba histolytica
KVTTTEEEQQ

SEQ ID NO: 2636822 - protein, 33 aa, Entamoeba histolytica
KVVEDDKDLEKATEVQLTKQKKTAAVKSTVTKT

SEQ ID NO: 2636823 - protein, 8 aa, Entamoeba histolytica
KVVQESIE

SEQ ID NO: 2636824 - protein, 8 aa, Entamoeba histolytica
KVYDGPIG

SEQ ID NO: 2636825 - protein, 14 aa, Entamoeba histolytica
KVYQEQKEKLESEL

SEQ ID NO: 2636826 - protein, 10 aa, Entamoeba histolytica
KVYQSGSPVT

SEQ ID NO: 2636827 - protein, 5 aa, Entamoeba histolytica
KVYSQ

SEQ ID NO: 2636828 - protein, 10 aa, Entamoeba histolytica
KVYSVTSEGT

SEQ ID NO: 2636829 - protein, 7 aa, Entamoeba histolytica
KWEEESK

SEQ ID NO: 2636830 - protein, 6 aa, Entamoeba histolytica
KWGKDR

SEQ ID NO: 2636831 - protein, 12 aa, Entamoeba histolytica
KWGTKNYDCSKD

SEQ ID NO: 2636832 - protein, 8 aa, Entamoeba histolytica
KWKHNKKD

SEQ ID NO: 2636833 - protein, 5 aa, Entamoeba histolytica
KWKPE

SEQ ID NO: 2636834 - protein, 14 aa, Entamoeba histolytica
KWNHATESAIKRST

SEQ ID NO: 2636835 - protein, 8 aa, Entamoeba histolytica
KWNKEKKP

SEQ ID NO: 2636836 - protein, 5 aa, Entamoeba histolytica
KWNND

SEQ ID NO: 2636837 - protein, 5 aa, Entamoeba histolytica
KWNNE

SEQ ID NO: 2636838 - protein, 7 aa, Entamoeba histolytica
KWPEDNT

SEQ ID NO: 2636839 - protein, 5 aa, Entamoeba histolytica
KWQPE

SEQ ID NO: 2636840 - protein, 12 aa, Entamoeba histolytica
KWRDDDPAWTES

SEQ ID NO: 2636841 - protein, 8 aa, Entamoeba histolytica
KWRTNNEK

SEQ ID NO: 2636842 - protein, 19 aa, Entamoeba histolytica
KWSEISKKLSGRTARAVRN

SEQ ID NO: 2636843 - protein, 9 aa, Entamoeba histolytica
KWSESKYKS

SEQ ID NO: 2636844 - protein, 8 aa, Entamoeba histolytica
KWTKEEDS

SEQ ID NO: 2636845 - protein, 9 aa, Entamoeba histolytica
KWTQTPEDV

SEQ ID NO: 2636846 - protein, 4 aa, Entamoeba histolytica
KYAE

SEQ ID NO: 2636847 - protein, 25 aa, Entamoeba histolytica
KYANENNRRVAEEAAKRIDQRPATI

SEQ ID NO: 2636848 - protein, 4 aa, Entamoeba histolytica
KYAP

SEQ ID NO: 2636849 - protein, 10 aa, Entamoeba histolytica
KYAQADEAGI

SEQ ID NO: 2636850 - protein, 5 aa, Entamoeba histolytica
KYCEG

SEQ ID NO: 2636851 - protein, 9 aa, Entamoeba histolytica
KYDEENKKS

SEQ ID NO: 2636852 - protein, 8 aa, Entamoeba histolytica
KYDEERKE

SEQ ID NO: 2636853 - protein, 7 aa, Entamoeba histolytica
KYDEMQQ

SEQ ID NO: 2636854 - protein, 7 aa, Entamoeba histolytica
KYDETNG

SEQ ID NO: 2636855 - protein, 8 aa, Entamoeba histolytica
KYDGERGQ

SEQ ID NO: 2636856 - protein, 6 aa, Entamoeba histolytica
KYDGGD

SEQ ID NO: 2636857 - protein, 11 aa, Entamoeba histolytica
KYDGKETRYLR

SEQ ID NO: 2636858 - protein, 4 aa, Entamoeba histolytica
KYDK

SEQ ID NO: 2636859 - protein, 8 aa, Entamoeba histolytica
KYDKENEE

SEQ ID NO: 2636860 - protein, 6 aa, Entamoeba histolytica
KYDLEP

SEQ ID NO: 2636861 - protein, 9 aa, Entamoeba histolytica
KYDNGETVD

SEQ ID NO: 2636862 - protein, 14 aa, Entamoeba histolytica
KYDNPDDKLPTAHT

SEQ ID NO: 2636863 - protein, 7 aa, Entamoeba histolytica
KYDNSQS

SEQ ID NO: 2636864 - protein, 8 aa, Entamoeba histolytica
KYDNTLPS

SEQ ID NO: 2636865 - protein, 8 aa, Entamoeba histolytica
KYDPEHAS

SEQ ID NO: 2636866 - protein, 13 aa, Entamoeba histolytica
KYDPETEGEELEI

SEQ ID NO: 2636867 - protein, 13 aa, Entamoeba histolytica
KYDPTISNAADKI

SEQ ID NO: 2636868 - protein, 7 aa, Entamoeba histolytica
KYDQQIQ

SEQ ID NO: 2636869 - protein, 5 aa, Entamoeba histolytica
KYDQS

SEQ ID NO: 2636870 - protein, 6 aa, Entamoeba histolytica
KYDSHS

SEQ ID NO: 2636871 - protein, 14 aa, Entamoeba histolytica
KYDSRMKEYEQANQ

SEQ ID NO: 2636872 - protein, 11 aa, Entamoeba histolytica
KYDSTGKKVDT

SEQ ID NO: 2636873 - protein, 13 aa, Entamoeba histolytica
KYEEERRKKREEI

SEQ ID NO: 2636874 - protein, 8 aa, Entamoeba histolytica
KYEEEVDK

SEQ ID NO: 2636875 - protein, 11 aa, Entamoeba histolytica
KYEEKQQTQEV

SEQ ID NO: 2636876 - protein, 13 aa, Entamoeba histolytica
KYEENSKSSDNKL

SEQ ID NO: 2636877 - protein, 5 aa, Entamoeba histolytica
KYEGN

SEQ ID NO: 2636878 - protein, 7 aa, Entamoeba histolytica
KYEIDQP

SEQ ID NO: 2636879 - protein, 12 aa, Entamoeba histolytica
KYEISPHPPFEN

SEQ ID NO: 2636880 - protein, 4 aa, Entamoeba histolytica
KYEK

SEQ ID NO: 2636881 - protein, 9 aa, Entamoeba histolytica
KYEKEGKQI

SEQ ID NO: 2636882 - protein, 7 aa, Entamoeba histolytica
KYEKNKG

SEQ ID NO: 2636883 - protein, 13 aa, Entamoeba histolytica
KYEKSLKTEPRVK

SEQ ID NO: 2636884 - protein, 13 aa, Entamoeba histolytica
KYENGKEMSTESV

SEQ ID NO: 2636885 - protein, 5 aa, Entamoeba histolytica
KYENK

SEQ ID NO: 2636886 - protein, 16 aa, Entamoeba histolytica
KYENKVANKKASINKL

SEQ ID NO: 2636887 - protein, 14 aa, Entamoeba histolytica
KYENSNSSCIYKNL

SEQ ID NO: 2636888 - protein, 5 aa, Entamoeba histolytica
KYEPH

SEQ ID NO: 2636889 - protein, 7 aa, Entamoeba histolytica
KYEQDND

SEQ ID NO: 2636890 - protein, 5 aa, Entamoeba histolytica
KYEQI

SEQ ID NO: 2636891 - protein, 5 aa, Entamoeba histolytica
KYESD

SEQ ID NO: 2636892 - protein, 7 aa, Entamoeba histolytica
KYETNHD

SEQ ID NO: 2636893 - protein, 4 aa, Entamoeba histolytica
KYEV

SEQ ID NO: 2636894 - protein, 5 aa, Entamoeba histolytica
KYGAK

SEQ ID NO: 2636895 - protein, 7 aa, Entamoeba histolytica
KYGEADW

SEQ ID NO: 2636896 - protein, 5 aa, Entamoeba histolytica
KYGED

SEQ ID NO: 2636897 - protein, 5 aa, Entamoeba histolytica
KYGEI

SEQ ID NO: 2636898 - protein, 5 aa, Entamoeba histolytica
KYGGF

SEQ ID NO: 2636899 - protein, 7 aa, Entamoeba histolytica
KYGHNEG

SEQ ID NO: 2636900 - protein, 7 aa, Entamoeba histolytica
KYGIPTD

SEQ ID NO: 2636901 - protein, 4 aa, Entamoeba histolytica
KYGK

SEQ ID NO: 2636902 - protein, 5 aa, Entamoeba histolytica
KYGKE

SEQ ID NO: 2636903 - protein, 8 aa, Entamoeba histolytica
KYGKENWK

SEQ ID NO: 2636904 - protein, 18 aa, Entamoeba histolytica
KYGKGDWKSVETEIEGRT

SEQ ID NO: 2636905 - protein, 7 aa, Entamoeba histolytica
KYGKPAD

SEQ ID NO: 2636906 - protein, 6 aa, Entamoeba histolytica
KYGNSD

SEQ ID NO: 2636907 - protein, 7 aa, Entamoeba histolytica
KYGPDEH

SEQ ID NO: 2636908 - protein, 13 aa, Entamoeba histolytica
KYGPFSKEEDEKI

SEQ ID NO: 2636909 - protein, 11 aa, Entamoeba histolytica
KYGPNSGSSIK

SEQ ID NO: 2636910 - protein, 9 aa, Entamoeba histolytica
KYGPPPSYR

SEQ ID NO: 2636911 - protein, 24 aa, Entamoeba histolytica
KYGQDATNVGDEGGFAPNVSGARE

SEQ ID NO: 2636912 - protein, 9 aa, Entamoeba histolytica
KYGSEIRSG

SEQ ID NO: 2636913 - protein, 6 aa, Entamoeba histolytica
KYGSIQ

SEQ ID NO: 2636914 - protein, 8 aa, Entamoeba histolytica
KYGSKNSW

SEQ ID NO: 2636915 - protein, 6 aa, Entamoeba histolytica
KYGSQD

SEQ ID NO: 2636916 - protein, 7 aa, Entamoeba histolytica
KYGSSDA

SEQ ID NO: 2636917 - protein, 5 aa, Entamoeba histolytica
KYGTD

SEQ ID NO: 2636918 - protein, 14 aa, Entamoeba histolytica
KYGTQGKRENYKPL

SEQ ID NO: 2636919 - protein, 10 aa, Entamoeba histolytica
KYGYAPKGSS

SEQ ID NO: 2636920 - protein, 6 aa, Entamoeba histolytica
KYGYEK

SEQ ID NO: 2636921 - protein, 4 aa, Entamoeba histolytica
KYHP

SEQ ID NO: 2636922 - protein, 19 aa, Entamoeba histolytica
KYHPDKNPGDKQAEEKFKE

SEQ ID NO: 2636923 - protein, 7 aa, Entamoeba histolytica
KYHPTKI

SEQ ID NO: 2636924 - protein, 5 aa, Entamoeba histolytica
KYIPG

SEQ ID NO: 2636925 - protein, 34 aa, Entamoeba histolytica
KYIPPKPEKAPPSPGKKTIHKSNSIEKKRLSEGY

SEQ ID NO: 2636926 - protein, 8 aa, Entamoeba histolytica
KYIQQEGK

SEQ ID NO: 2636927 - protein, 10 aa, Entamoeba histolytica
KYKAESAAES

SEQ ID NO: 2636928 - protein, 9 aa, Entamoeba histolytica
KYKAQRAAE

SEQ ID NO: 2636929 - protein, 4 aa, Entamoeba histolytica
KYKD

SEQ ID NO: 2636930 - protein, 4 aa, Entamoeba histolytica
KYKE

SEQ ID NO: 2636931 - protein, 40 aa, Entamoeba histolytica; identical to SEQ ID NO: 2441645

SEQ ID NO: 2636932 - protein, 7 aa, Entamoeba histolytica
KYKEKEF

SEQ ID NO: 2636933 - protein, 18 aa, Entamoeba histolytica
KYKEMEQNITESLENSND

SEQ ID NO: 2636934 - protein, 5 aa, Entamoeba histolytica
KYKES

SEQ ID NO: 2636935 - protein, 20 aa, Entamoeba histolytica
KYKETERSTNTNTQQIERNK

SEQ ID NO: 2636936 - protein, 16 aa, Entamoeba histolytica
KYKGIDNDDLNNTNNE

SEQ ID NO: 2636937 - protein, 11 aa, Entamoeba histolytica
KYKGNSQWDGN

SEQ ID NO: 2636938 - protein, 6 aa, Entamoeba histolytica
KYKGQS

SEQ ID NO: 2636939 - protein, 7 aa, Entamoeba histolytica
KYKGTAF

SEQ ID NO: 2636940 - protein, 6 aa, Entamoeba histolytica
KYKKQQ

SEQ ID NO: 2636941 - protein, 6 aa, Entamoeba histolytica
KYKMPA

SEQ ID NO: 2636942 - protein, 7 aa, Entamoeba histolytica
KYKNEEI

SEQ ID NO: 2636943 - protein, 13 aa, Entamoeba histolytica
KYKNQIGVEEEKH

SEQ ID NO: 2636944 - protein, 7 aa, Entamoeba histolytica
KYKPKEH

SEQ ID NO: 2636945 - protein, 6 aa, Entamoeba histolytica
KYKQTV

SEQ ID NO: 2636946 - protein, 8 aa, Entamoeba histolytica
KYKSNNEN

SEQ ID NO: 2636947 - protein, 26 aa, Entamoeba histolytica
KYKTKDIKTQESNKLCSSKNRLRNTH

SEQ ID NO: 2636948 - protein, 5 aa, Entamoeba histolytica
KYKTY

SEQ ID NO: 2636949 - protein, 13 aa, Entamoeba histolytica
KYLKQKKENKDLE

SEQ ID NO: 2636950 - protein, 7 aa, Entamoeba histolytica
KYLPEND

SEQ ID NO: 2636951 - protein, 4 aa, Entamoeba histolytica
KYND

SEQ ID NO: 2636952 - protein, 7 aa, Entamoeba histolytica
KYNDEQN

SEQ ID NO: 2636953 - protein, 11 aa, Entamoeba histolytica
KYNEEIDDQEW

SEQ ID NO: 2636954 - protein, 7 aa, Entamoeba histolytica
KYNEEIK

SEQ ID NO: 2636955 - protein, 8 aa, Entamoeba histolytica
KYNEMRER

SEQ ID NO: 2636956 - protein, 16 aa, Entamoeba histolytica
KYNEYGAKVTKELNDA

SEQ ID NO: 2636957 - protein, 6 aa, Entamoeba histolytica
KYNGEC

SEQ ID NO: 2636958 - protein, 7 aa, Entamoeba histolytica
KYNGEEV

SEQ ID NO: 2636959 - protein, 13 aa, Entamoeba histolytica
KYNGQKIKDAKVP

SEQ ID NO: 2636960 - protein, 8 aa, Entamoeba histolytica
KYNGRTDE

SEQ ID NO: 2636961 - protein, 9 aa, Entamoeba histolytica
KYNISKEDI

SEQ ID NO: 2636962 - protein, 18 aa, Entamoeba histolytica
KYNKASSFKQRIKENQVD

SEQ ID NO: 2636963 - protein, 15 aa, Entamoeba histolytica
KYNKEESLTGSYSDA

SEQ ID NO: 2636964 - protein, 6 aa, Entamoeba histolytica
KYNKKC

SEQ ID NO: 2636965 - protein, 8 aa, Entamoeba histolytica
KYNKPTQQ

SEQ ID NO: 2636966 - protein, 13 aa, Entamoeba histolytica
KYNKSRDEIAQPL

SEQ ID NO: 2636967 - protein, 7 aa, Entamoeba histolytica
KYNKTTA

SEQ ID NO: 2636968 - protein, 5 aa, Entamoeba histolytica
KYNND

SEQ ID NO: 2636969 - protein, 10 aa, Entamoeba histolytica
KYNNGQTPID

SEQ ID NO: 2636970 - protein, 11 aa, Entamoeba histolytica
KYNNNENNSRE

SEQ ID NO: 2636971 - protein, 6 aa, Entamoeba histolytica
KYNPGN

SEQ ID NO: 2636972 - protein, 6 aa, Entamoeba histolytica
KYNPHR

SEQ ID NO: 2636973 - protein, 7 aa, Entamoeba histolytica
KYNPPRN

SEQ ID NO: 2636974 - protein, 10 aa, Entamoeba histolytica
KYNQENETIR

SEQ ID NO: 2636975 - protein, 6 aa, Entamoeba histolytica
KYNRNK

SEQ ID NO: 2636976 - protein, 10 aa, Entamoeba histolytica
KYNSNNSSVN

SEQ ID NO: 2636977 - protein, 8 aa, Entamoeba histolytica
KYNTNETE

SEQ ID NO: 2636978 - protein, 6 aa, Entamoeba histolytica
KYPAST

SEQ ID NO: 2636979 - protein, 6 aa, Entamoeba histolytica
KYPATY

SEQ ID NO: 2636980 - protein, 10 aa, Entamoeba histolytica
KYPDNQALPI

SEQ ID NO: 2636981 - protein, 6 aa, Entamoeba histolytica
KYPDQY

SEQ ID NO: 2636982 - protein, 6 aa, Entamoeba histolytica
KYPDTS

SEQ ID NO: 2636983 - protein, 4 aa, Entamoeba histolytica
KYPE

SEQ ID NO: 2636984 - protein, 8 aa, Entamoeba histolytica
KYPEAESV

SEQ ID NO: 2636985 - protein, 5 aa, Entamoeba histolytica
KYPEG

SEQ ID NO: 2636986 - protein, 9 aa, Entamoeba histolytica
KYPEKTVQE

SEQ ID NO: 2636987 - protein, 6 aa, Entamoeba histolytica
KYPEVD

SEQ ID NO: 2636988 - protein, 8 aa, Entamoeba histolytica
KYPEYREQ

SEQ ID NO: 2636989 - protein, 4 aa, Entamoeba histolytica
KYPF

SEQ ID NO: 2636990 - protein, 7 aa, Entamoeba histolytica
KYPFARG

SEQ ID NO: 2636991 - protein, 7 aa, Entamoeba histolytica
KYPFTET

SEQ ID NO: 2636992 - protein, 6 aa, Entamoeba histolytica
KYPGQK

SEQ ID NO: 2636993 - protein, 19 aa, Entamoeba histolytica
KYPHDPPLSSEGIQQAKDL

SEQ ID NO: 2636994 - protein, 5 aa, Entamoeba histolytica
KYPIN

SEQ ID NO: 2636995 - protein, 5 aa, Entamoeba histolytica
KYPNS

SEQ ID NO: 2636996 - protein, 6 aa, Entamoeba histolytica
KYPNSY

SEQ ID NO: 2636997 - protein, 7 aa, Entamoeba histolytica
KYPPNYN

SEQ ID NO: 2636998 - protein, 7 aa, Entamoeba histolytica
KYPPPTF

SEQ ID NO: 2636999 - protein, 20 aa, Entamoeba histolytica
KYPQKPKSGKPKKHFKKMAK

SEQ ID NO: 2637000 - protein, 6 aa, Entamoeba histolytica
KYPQKT

SEQ ID NO: 2637001 - protein, 5 aa, Entamoeba histolytica
KYPQQ

SEQ ID NO: 2637002 - protein, 4 aa, Entamoeba histolytica
KYPR

SEQ ID NO: 2637003 - protein, 6 aa, Entamoeba histolytica
KYPSET

SEQ ID NO: 2637004 - protein, 5 aa, Entamoeba histolytica
KYPSI

SEQ ID NO: 2637005 - protein, 5 aa, Entamoeba histolytica
KYPTF

SEQ ID NO: 2637006 - protein, 8 aa, Entamoeba histolytica
KYPTNRRL

SEQ ID NO: 2637007 - protein, 8 aa, Entamoeba histolytica
KYPTPLKR

SEQ ID NO: 2637008 - protein, 6 aa, Entamoeba histolytica
KYPTTL

SEQ ID NO: 2637009 - protein, 5 aa, Entamoeba histolytica
KYPTV

SEQ ID NO: 2637010 - protein, 5 aa, Entamoeba histolytica
KYPVP

SEQ ID NO: 2637011 - protein, 4 aa, Entamoeba histolytica
KYPY

SEQ ID NO: 2637012 - protein, 5 aa, Entamoeba histolytica
KYQEM

SEQ ID NO: 2637013 - protein, 9 aa, Entamoeba histolytica
KYQESEIRE

SEQ ID NO: 2637014 - protein, 10 aa, Entamoeba histolytica
KYQGTNRDYD

SEQ ID NO: 2637015 - protein, 9 aa, Entamoeba histolytica
KYQKSYDDY

SEQ ID NO: 2637016 - protein, 7 aa, Entamoeba histolytica
KYQLTGE

SEQ ID NO: 2637017 - protein, 13 aa, Entamoeba histolytica
KYQQTENINQKEE

SEQ ID NO: 2637018 - protein, 6 aa, Entamoeba histolytica
KYQRNK

SEQ ID NO: 2637019 - protein, 11 aa, Entamoeba histolytica
KYQSKGKNSKD

SEQ ID NO: 2637020 - protein, 7 aa, Entamoeba histolytica
KYQTQGI

SEQ ID NO: 2637021 - protein, 8 aa, Entamoeba histolytica
KYQTTSRE

SEQ ID NO: 2637022 - protein, 19 aa, Entamoeba histolytica
KYRDGRTKKHIEYNEDKNL

SEQ ID NO: 2637023 - protein, 7 aa, Entamoeba histolytica
KYRGDEV

SEQ ID NO: 2637024 - protein, 31 aa, Entamoeba histolytica
KYRKDKKRRERKEKERGKNIKGKNEDNEEDI

SEQ ID NO: 2637025 - protein, 4 aa, Entamoeba histolytica
KYRN

SEQ ID NO: 2637026 - protein, 6 aa, Entamoeba histolytica
KYRNSW

SEQ ID NO: 2637027 - protein, 12 aa, Entamoeba histolytica
KYRSCSGSPTEE

SEQ ID NO: 2637028 - protein, 45 aa, Entamoeba histolytica
KYRSCSYSPRGASSASNSSCEEGQPTNSTPQRTVKKRRSKKTECP

SEQ ID NO: 2637029 - protein, 6 aa, Entamoeba histolytica
KYRYQG

SEQ ID NO: 2637030 - protein, 7 aa, Entamoeba histolytica
KYSAGIT

SEQ ID NO: 2637031 - protein, 11 aa, Entamoeba histolytica
KYSCSGSGEEL

SEQ ID NO: 2637032 - protein, 10 aa, Entamoeba histolytica
KYSDKTHSFG

SEQ ID NO: 2637033 - protein, 7 aa, Entamoeba histolytica
KYSDKVD

SEQ ID NO: 2637034 - protein, 40 aa, Entamoeba histolytica
KYSDTKKSVVGQPGKTKKCPDCEAEVEEGTRFCTSCGYKF

SEQ ID NO: 2637035 - protein, 8 aa, Entamoeba histolytica
KYSEEVKN

SEQ ID NO: 2637036 - protein, 9 aa, Entamoeba histolytica
KYSIQSNNY

SEQ ID NO: 2637037 - protein, 13 aa, Entamoeba histolytica
KYSKKEDDSKVKA

SEQ ID NO: 2637038 - protein, 7 aa, Entamoeba histolytica
KYSNPNT

SEQ ID NO: 2637039 - protein, 7 aa, Entamoeba histolytica
KYSNSNI

SEQ ID NO: 2637040 - protein, 5 aa, Entamoeba histolytica
KYSNY

SEQ ID NO: 2637041 - protein, 5 aa, Entamoeba histolytica
KYSPD

SEQ ID NO: 2637042 - protein, 7 aa, Entamoeba histolytica
KYSPSQM

SEQ ID NO: 2637043 - protein, 10 aa, Entamoeba histolytica
KYSPTVKSSN

SEQ ID NO: 2637044 - protein, 4 aa, Entamoeba histolytica
KYSR

SEQ ID NO: 2637045 - protein, 5 aa, Entamoeba histolytica
KYSRE

SEQ ID NO: 2637046 - protein, 11 aa, Entamoeba histolytica
KYSRKSKQTLQ

SEQ ID NO: 2637047 - protein, 10 aa, Entamoeba histolytica
KYSSEYKSTI

SEQ ID NO: 2637048 - protein, 6 aa, Entamoeba histolytica
KYSSKN

SEQ ID NO: 2637049 - protein, 8 aa, Entamoeba histolytica
KYSSQIQQ

SEQ ID NO: 2637050 - protein, 8 aa, Entamoeba histolytica
KYSSTENE

SEQ ID NO: 2637051 - protein, 8 aa, Entamoeba histolytica
KYSSYNKE

SEQ ID NO: 2637052 - protein, 4 aa, Entamoeba histolytica
KYST

SEQ ID NO: 2637053 - protein, 22 aa, Entamoeba histolytica
KYSTKSSSSSDEETDQMTLEGR

SEQ ID NO: 2637054 - protein, 7 aa, Entamoeba histolytica
KYSTNDQ

SEQ ID NO: 2637055 - protein, 13 aa, Entamoeba histolytica
KYSTRRKSADMTP

SEQ ID NO: 2637056 - protein, 7 aa, Entamoeba histolytica
KYTDMKE

SEQ ID NO: 2637057 - protein, 18 aa, Entamoeba histolytica
KYTESYNQKQVETQEETL

SEQ ID NO: 2637058 - protein, 7 aa, Entamoeba histolytica
KYTGEQV

SEQ ID NO: 2637059 - protein, 5 aa, Entamoeba histolytica
KYTKK

SEQ ID NO: 2637060 - protein, 11 aa, Entamoeba histolytica
KYTNTSKKNWT

SEQ ID NO: 2637061 - protein, 10 aa, Entamoeba histolytica
KYTQEDRIKY

SEQ ID NO: 2637062 - protein, 13 aa, Entamoeba histolytica
KYTQKKYKKSLSS

SEQ ID NO: 2637063 - protein, 7 aa, Entamoeba histolytica
KYTREEF

SEQ ID NO: 2637064 - protein, 6 aa, Entamoeba histolytica
KYTTNS

SEQ ID NO: 2637065 - protein, 7 aa, Entamoeba histolytica
KYTTQQL

SEQ ID NO: 2637066 - protein, 5 aa, Entamoeba histolytica
KYVSP

SEQ ID NO: 2637067 - protein, 18 aa, Entamoeba histolytica
KYVVGQPTKITVPTNSDV

SEQ ID NO: 2637068 - protein, 5 aa, Entamoeba histolytica
KYWQN

SEQ ID NO: 2637069 - protein, 4 aa, Entamoeba histolytica
KYYE

SEQ ID NO: 2637070 - protein, 29 aa, Entamoeba histolytica
KYYQEENNSKEEEIKEENNNNNNKEGVIE

SEQ ID NO: 2637071 - protein, 6 aa, Entamoeba histolytica
KYYTNN

SEQ ID NO: 2637072 - protein, 7 aa, Entamoeba histolytica
KYYTPQK

SEQ ID NO: 2637073 - protein, 11 aa, Entamoeba histolytica
LAAGEETQTFC

SEQ ID NO: 2637074 - protein, 14 aa, Entamoeba histolytica
LADEKNTATPEKSI

SEQ ID NO: 2637075 - protein, 18 aa, Entamoeba histolytica
LADNADSSMGEKGKEMVE

SEQ ID NO: 2637076 - protein, 8 aa, Entamoeba histolytica
LADNDGRL

SEQ ID NO: 2637077 - protein, 30 aa, Entamoeba histolytica
LADNETKSAQHTPREEDEASRRKTMQPNGL

SEQ ID NO: 2637078 - protein, 11 aa, Entamoeba histolytica
LADTKSNDNQK

SEQ ID NO: 2637079 - protein, 11 aa, Entamoeba histolytica
LAEEDYEEYPD

SEQ ID NO: 2637080 - protein, 9 aa, Entamoeba histolytica
LAEEQTKRI

SEQ ID NO: 2637081 - protein, 13 aa, Entamoeba histolytica
LAEGAIGSLQTGA

SEQ ID NO: 2637082 - protein, 11 aa, Entamoeba histolytica
LAEGKSPYRED

SEQ ID NO: 2637083 - protein, 19 aa, Entamoeba histolytica
LAEKDKEEAEGKEEKEEED

SEQ ID NO: 2637084 - protein, 27 aa, Entamoeba histolytica
LAEKDKKPENEEHEESIEEEDIEPPYD

SEQ ID NO: 2637085 - protein, 11 aa, Entamoeba histolytica
LAEKKAAEDEC

SEQ ID NO: 2637086 - protein, 8 aa, Entamoeba histolytica
LAEKNPSL

SEQ ID NO: 2637087 - protein, 10 aa, Entamoeba histolytica
LAEKQANDLL

SEQ ID NO: 2637088 - protein, 26 aa, Entamoeba histolytica
LAEKTQGDLPEGVEIDPTDVKNWDGK

SEQ ID NO: 2637089 - protein, 7 aa, Entamoeba histolytica
LAENTQK

SEQ ID NO: 2637090 - protein, 6 aa, Entamoeba histolytica
LAEPEI

SEQ ID NO: 2637091 - protein, 6 aa, Entamoeba histolytica
LAEPET

SEQ ID NO: 2637092 - protein, 13 aa, Entamoeba histolytica
LAEQAKKTTDAMR

SEQ ID NO: 2637093 - protein, 14 aa, Entamoeba histolytica
LAEQQKKATGAGQG

SEQ ID NO: 2637094 - protein, 9 aa, Entamoeba histolytica
LAEQSERYD

SEQ ID NO: 2637095 - protein, 8 aa, Entamoeba histolytica
LAERVSEE

SEQ ID NO: 2637096 - protein, 12 aa, Entamoeba histolytica
LAETAAARKERL

SEQ ID NO: 2637097 - protein, 11 aa, Entamoeba histolytica
LAGELQRTINE

SEQ ID NO: 2637098 - protein, 8 aa, Entamoeba histolytica
LAGGKNDE

SEQ ID NO: 2637099 - protein, 11 aa, Entamoeba histolytica
LAGKEDSAKLK

SEQ ID NO: 2637100 - protein, 10 aa, Entamoeba histolytica
LAGKSQKVDN

SEQ ID NO: 2637101 - protein, 5 aa, Entamoeba histolytica
LAGPI

SEQ ID NO: 2637102 - protein, 8 aa, Entamoeba histolytica
LAGTETTY

SEQ ID NO: 2637103 - protein, 6 aa, Entamoeba histolytica
LAGYAP

SEQ ID NO: 2637104 - protein, 5 aa, Entamoeba histolytica
LAHDG

SEQ ID NO: 2637105 - protein, 13 aa, Entamoeba histolytica
LAKATKFDTNPYK

SEQ ID NO: 2637106 - protein, 6 aa, Entamoeba histolytica
LAKDSE

SEQ ID NO: 2637107 - protein, 4 aa, Entamoeba histolytica
LAKE

SEQ ID NO: 2637108 - protein, 8 aa, Entamoeba histolytica
LAKEESQL

SEQ ID NO: 2637109 - protein, 71 aa, Entamoeba histolytica
LAKEKASGAFGEYGAGTISARLSGDRPVSGASPTTPSFSPDPLNDPSQDAPMNPPEETPFVPTNDPPNDAQ

SEQ ID NO: 2637110 - protein, 60 aa, Entamoeba histolytica
LAKEKASGAIGEYGAGTISARLSGDRSVSGASPTTPSFSPDPLNDPSQDAPMNPPEETPF

SEQ ID NO: 2637111 - protein, 60 aa, Entamoeba histolytica
LAKEKASGTIGEYGAGAISARLSGDRSVSGASPTTPSFSPDPLNDPSQDAPMNPPEETPF

SEQ ID NO: 2637112 - protein, 19 aa, Entamoeba histolytica
LAKKDAQIAELQSKLAAGS

SEQ ID NO: 2637113 - protein, 16 aa, Entamoeba histolytica
LAKKDQKKVIQSDGSV

SEQ ID NO: 2637114 - protein, 24 aa, Entamoeba histolytica
LAKKPKRKERKSHTNKKEVKSKDL

SEQ ID NO: 2637115 - protein, 30 aa, Entamoeba histolytica
LAKNTQPTLVTPQQPQDKAPAQIILGDTLP

SEQ ID NO: 2637116 - protein, 6 aa, Entamoeba histolytica
LAKPAR

SEQ ID NO: 2637117 - protein, 9 aa, Entamoeba histolytica
LAKPQSDNH

SEQ ID NO: 2637118 - protein, 11 aa, Entamoeba histolytica
LAKPSGKRTKK

SEQ ID NO: 2637119 - protein, 7 aa, Entamoeba histolytica
LAKPSSL

SEQ ID NO: 2637120 - protein, 10 aa, Entamoeba histolytica
LAKRKELAES

SEQ ID NO: 2637121 - protein, 8 aa, Entamoeba histolytica
LAKRKKDM

SEQ ID NO: 2637122 - protein, 13 aa, Entamoeba histolytica
LAKTANQSSEPEI

SEQ ID NO: 2637123 - protein, 4 aa, Entamoeba histolytica
LAMD

SEQ ID NO: 2637124 - protein, 7 aa, Entamoeba histolytica
LANEPTA

SEQ ID NO: 2637125 - protein, 6 aa, Entamoeba histolytica
LANGDA

SEQ ID NO: 2637126 - protein, 6 aa, Entamoeba histolytica
LANKGG

SEQ ID NO: 2637127 - protein, 8 aa, Entamoeba histolytica
LANNSGDD

SEQ ID NO: 2637128 - protein, 34 aa, Entamoeba histolytica; identical to SEQ ID NO: 2441855

SEQ ID NO: 2637129 - protein, 27 aa, Entamoeba histolytica
LAPETKEETKIVSNKELKEAKKNNVKV

SEQ ID NO: 2637130 - protein, 4 aa, Entamoeba histolytica
LAPG

SEQ ID NO: 2637131 - protein, 8 aa, Entamoeba histolytica
LAPKPVSM

SEQ ID NO: 2637132 - protein, 14 aa, Entamoeba histolytica
LAPKRSEDSSGVSR

SEQ ID NO: 2637133 - protein, 11 aa, Entamoeba histolytica
LAPLAPKCTEA

SEQ ID NO: 2637134 - protein, 9 aa, Entamoeba histolytica
LAPNKEDPL

SEQ ID NO: 2637135 - protein, 13 aa, Entamoeba histolytica
LAPNTTQQEQEEI

SEQ ID NO: 2637136 - protein, 11 aa, Entamoeba histolytica
LAPPPSRGQPI

SEQ ID NO: 2637137 - protein, 10 aa, Entamoeba histolytica
LAPPTEDPEI

SEQ ID NO: 2637138 - protein, 14 aa, Entamoeba histolytica
LAPRGSSNANDLKK

SEQ ID NO: 2637139 - protein, 5 aa, Entamoeba histolytica
LAPTN

SEQ ID NO: 2637140 - protein, 4 aa, Entamoeba histolytica
LAQE

SEQ ID NO: 2637141 - protein, 17 aa, Entamoeba histolytica
LAQENSENTKMEEHPNI

SEQ ID NO: 2637142 - protein, 8 aa, Entamoeba histolytica
LAQHTEQP

SEQ ID NO: 2637143 - protein, 8 aa, Entamoeba histolytica
LAQKERVA

SEQ ID NO: 2637144 - protein, 20 aa, Entamoeba histolytica
LAQNATHGAASSISGITGSV

SEQ ID NO: 2637145 - protein, 7 aa, Entamoeba histolytica
LAQNGEN

SEQ ID NO: 2637146 - protein, 8 aa, Entamoeba histolytica
LAQNNAKI

SEQ ID NO: 2637147 - protein, 20 aa, Entamoeba histolytica
LAQQEKAKATKDYRAADGEL

SEQ ID NO: 2637148 - protein, 5 aa, Entamoeba histolytica
LAQRK

SEQ ID NO: 2637149 - protein, 5 aa, Entamoeba histolytica
LAQRN

SEQ ID NO: 2637150 - protein, 7 aa, Entamoeba histolytica
LAQSPQL

SEQ ID NO: 2637151 - protein, 9 aa, Entamoeba histolytica
LARKKRSTK

SEQ ID NO: 2637152 - protein, 4 aa, Entamoeba histolytica
LARP

SEQ ID NO: 2637153 - protein, 5 aa, Entamoeba histolytica
LARQT

SEQ ID NO: 2637154 - protein, 12 aa, Entamoeba histolytica
LASAYKTSKVAT

SEQ ID NO: 2637155 - protein, 29 aa, Entamoeba histolytica
LASGVSPYSMGKGCDSPRIKESDYHASPK

SEQ ID NO: 2637156 - protein, 9 aa, Entamoeba histolytica
LASKDAEDL

SEQ ID NO: 2637157 - protein, 12 aa, Entamoeba histolytica
LASKYDSEKLKQ

SEQ ID NO: 2637158 - protein, 11 aa, Entamoeba histolytica
LASKYKSGIKV

SEQ ID NO: 2637159 - protein, 13 aa, Entamoeba histolytica
LASKYKTLHKTNS

SEQ ID NO: 2637160 - protein, 4 aa, Entamoeba histolytica
LASN

SEQ ID NO: 2637161 - protein, 8 aa, Entamoeba histolytica
LASPGRLT

SEQ ID NO: 2637162 - protein, 18 aa, Entamoeba histolytica
LASPRNRGNKPLTPTISS

SEQ ID NO: 2637163 - protein, 15 aa, Entamoeba histolytica
LASQMKGDYRTGKKI

SEQ ID NO: 2637164 - protein, 7 aa, Entamoeba histolytica
LASRNED

SEQ ID NO: 2637165 - protein, 7 aa, Entamoeba histolytica
LASRNTS

SEQ ID NO: 2637166 - protein, 42 aa, Entamoeba histolytica
LASRPTGAAPSLPGRPLGAPPRKPAAKPKHKQQINPAQSSLV

SEQ ID NO: 2637167 - protein, 9 aa, Entamoeba histolytica
LASSEDDSI

SEQ ID NO: 2637168 - protein, 5 aa, Entamoeba histolytica
LASSH

SEQ ID NO: 2637169 - protein, 10 aa, Entamoeba histolytica
LASSSADNTV

SEQ ID NO: 2637170 - protein, 8 aa, Entamoeba histolytica
LASSSHSR

SEQ ID NO: 2637171 - protein, 14 aa, Entamoeba histolytica
LASTIKKITDSQSA

SEQ ID NO: 2637172 - protein, 6 aa, Entamoeba histolytica
LATGSA

SEQ ID NO: 2637173 - protein, 9 aa, Entamoeba histolytica
LATKDEQKQ

SEQ ID NO: 2637174 - protein, 11 aa, Entamoeba histolytica
LATNLRKGTTT

SEQ ID NO: 2637175 - protein, 6 aa, Entamoeba histolytica
LATTGM

SEQ ID NO: 2637176 - protein, 7 aa, Entamoeba histolytica
LAVRDGE

SEQ ID NO: 2637177 - protein, 4 aa, Entamoeba histolytica
LCDN

SEQ ID NO: 2637178 - protein, 5 aa, Entamoeba histolytica
LCNPE

SEQ ID NO: 2637179 - protein, 20 aa, Entamoeba histolytica
LDAAEKKLKDLNKQRYERQN

SEQ ID NO: 2637180 - protein, 9 aa, Entamoeba histolytica
LDADDINED

SEQ ID NO: 2637181 - protein, 10 aa, Entamoeba histolytica
LDADTAESRI

SEQ ID NO: 2637182 - protein, 13 aa, Entamoeba histolytica
LDAKESGRGVNQT

SEQ ID NO: 2637183 - protein, 24 aa, Entamoeba histolytica
LDAKKSCKKDKKPISDENISDMQK

SEQ ID NO: 2637184 - protein, 18 aa, Entamoeba histolytica
LDAKPKEEPKPKKADDLD

SEQ ID NO: 2637185 - protein, 10 aa, Entamoeba histolytica
LDAPSQTQIE

SEQ ID NO: 2637186 - protein, 5 aa, Entamoeba histolytica
LDCGE

SEQ ID NO: 2637187 - protein, 16 aa, Entamoeba histolytica
LDDARKKEQEEEQKKW

SEQ ID NO: 2637188 - protein, 8 aa, Entamoeba histolytica
LDDDEEHY

SEQ ID NO: 2637189 - protein, 11 aa, Entamoeba histolytica
LDDDGKLTQLG

SEQ ID NO: 2637190 - protein, 7 aa, Entamoeba histolytica
LDDDKDG

SEQ ID NO: 2637191 - protein, 14 aa, Entamoeba histolytica
LDDDQKLKKEENKE

SEQ ID NO: 2637192 - protein, 7 aa, Entamoeba histolytica
LDDEEIR

SEQ ID NO: 2637193 - protein, 5 aa, Entamoeba histolytica
LDDEL

SEQ ID NO: 2637194 - protein, 17 aa, Entamoeba histolytica
LDDERRKELNNNNEIQK

SEQ ID NO: 2637195 - protein, 7 aa, Entamoeba histolytica
LDDESQL

SEQ ID NO: 2637196 - protein, 5 aa, Entamoeba histolytica
LDDET

SEQ ID NO: 2637197 - protein, 12 aa, Entamoeba histolytica
LDDETKETLTNE

SEQ ID NO: 2637198 - protein, 6 aa, Entamoeba histolytica
LDDGGR

SEQ ID NO: 2637199 - protein, 7 aa, Entamoeba histolytica
LDDGRGL

SEQ ID NO: 2637200 - protein, 10 aa, Entamoeba histolytica
LDDGTGTTAS

SEQ ID NO: 2637201 - protein, 9 aa, Entamoeba histolytica
LDDKDIEPH

SEQ ID NO: 2637202 - protein, 5 aa, Entamoeba histolytica
LDDKL

SEQ ID NO: 2637203 - protein, 10 aa, Entamoeba histolytica
LDDKPEGSIE

SEQ ID NO: 2637204 - protein, 20 aa, Entamoeba histolytica
LDDKPKPAAKPVQKKDDLDD

SEQ ID NO: 2637205 - protein, 19 aa, Entamoeba histolytica
LDDKPKPTPQPAQKKDDLD

SEQ ID NO: 2637206 - protein, 24 aa, Entamoeba histolytica
LDDKPKPTSSQSSTKATTKKDDLD

SEQ ID NO: 2637207 - protein, 9 aa, Entamoeba histolytica
LDDNDPYVR

SEQ ID NO: 2637208 - protein, 14 aa, Entamoeba histolytica
LDDPELDEETRNQI

SEQ ID NO: 2637209 - protein, 9 aa, Entamoeba histolytica
LDDPTRESN

SEQ ID NO: 2637210 - protein, 16 aa, Entamoeba histolytica
LDDSDNKLPKKIRNAQ

SEQ ID NO: 2637211 - protein, 15 aa, Entamoeba histolytica
LDDSEEIKQEKMKRQ

SEQ ID NO: 2637212 - protein, 9 aa, Entamoeba histolytica
LDEAGLPER

SEQ ID NO: 2637213 - protein, 6 aa, Entamoeba histolytica
LDEASQ

SEQ ID NO: 2637214 - protein, 5 aa, Entamoeba histolytica
LDEED

SEQ ID NO: 2637215 - protein, 26 aa, Entamoeba histolytica
LDEEDDEASFETTTTAIPPPPPSVTS

SEQ ID NO: 2637216 - protein, 24 aa, Entamoeba histolytica
LDEEEDKIEEKEVHNKKKGKDDQL

SEQ ID NO: 2637217 - protein, 24 aa, Entamoeba histolytica
LDEEEQKLAEAQAEIEEKKALKAK

SEQ ID NO: 2637218 - protein, 5 aa, Entamoeba histolytica
LDEEK

SEQ ID NO: 2637219 - protein, 16 aa, Entamoeba histolytica
LDEEKAEVQQIREQHD

SEQ ID NO: 2637220 - protein, 6 aa, Entamoeba histolytica
LDEENG

SEQ ID NO: 2637221 - protein, 6 aa, Entamoeba histolytica
LDEENY

SEQ ID NO: 2637222 - protein, 12 aa, Entamoeba histolytica
LDEGTEKEKELE

SEQ ID NO: 2637223 - protein, 15 aa, Entamoeba histolytica
LDEIKEKLEQENPDI

SEQ ID NO: 2637224 - protein, 4 aa, Entamoeba histolytica
LDEK

SEQ ID NO: 2637225 - protein, 6 aa, Entamoeba histolytica
LDEKDG

SEQ ID NO: 2637226 - protein, 11 aa, Entamoeba histolytica
LDEKKEEAIER

SEQ ID NO: 2637227 - protein, 12 aa, Entamoeba histolytica
LDEKVTKNDRFK

SEQ ID NO: 2637228 - protein, 5 aa, Entamoeba histolytica
LDEMR

SEQ ID NO: 2637229 - protein, 8 aa, Entamoeba histolytica
LDENGDGV

SEQ ID NO: 2637230 - protein, 15 aa, Entamoeba histolytica
LDENREKVKKNENFT

SEQ ID NO: 2637231 - protein, 11 aa, Entamoeba histolytica
LDENSKQAYQI

SEQ ID NO: 2637232 - protein, 5 aa, Entamoeba histolytica
LDENT

SEQ ID NO: 2637233 - protein, 27 aa, Entamoeba histolytica
LDEPKQFSHSSNSTKSQQPEQHKTTSG

SEQ ID NO: 2637234 - protein, 16 aa, Entamoeba histolytica
LDEPPEEDLDSESAEN

SEQ ID NO: 2637235 - protein, 37 aa, Entamoeba histolytica
LDEQADKIPKRIDTSHEYSNGLNNSNQQTINKNGSNI

SEQ ID NO: 2637236 - protein, 9 aa, Entamoeba histolytica
LDEQEDELA

SEQ ID NO: 2637237 - protein, 6 aa, Entamoeba histolytica
LDEQSK

SEQ ID NO: 2637238 - protein, 5 aa, Entamoeba histolytica
LDERK

SEQ ID NO: 2637239 - protein, 11 aa, Entamoeba histolytica
LDESDVTQEAI

SEQ ID NO: 2637240 - protein, 7 aa, Entamoeba histolytica
LDESPEK

SEQ ID NO: 2637241 - protein, 7 aa, Entamoeba histolytica
LDETNEK

SEQ ID NO: 2637242 - protein, 8 aa, Entamoeba histolytica
LDETSTIG

SEQ ID NO: 2637243 - protein, 8 aa, Entamoeba histolytica
LDETTAKI

SEQ ID NO: 2637244 - protein, 12 aa, Entamoeba histolytica
LDFDKKSDNHYL

SEQ ID NO: 2637245 - protein, 6 aa, Entamoeba histolytica
LDFEDE

SEQ ID NO: 2637246 - protein, 9 aa, Entamoeba histolytica
LDGCDPASH

SEQ ID NO: 2637247 - protein, 10 aa, Entamoeba histolytica
LDGDEPSNEI

SEQ ID NO: 2637248 - protein, 7 aa, Entamoeba histolytica
LDGEQHT

SEQ ID NO: 2637249 - protein, 7 aa, Entamoeba histolytica
LDGETEK

SEQ ID NO: 2637250 - protein, 6 aa, Entamoeba histolytica
LDGGAS

SEQ ID NO: 2637251 - protein, 4 aa, Entamoeba histolytica
LDGN

SEQ ID NO: 2637252 - protein, 6 aa, Entamoeba histolytica
LDGNSS

SEQ ID NO: 2637253 - protein, 12 aa, Entamoeba histolytica
LDGPNGKLEEQK

SEQ ID NO: 2637254 - protein, 16 aa, Entamoeba histolytica
LDGQGKRAIDYTSEGS

SEQ ID NO: 2637255 - protein, 8 aa, Entamoeba histolytica
LDGQKNNL

SEQ ID NO: 2637256 - protein, 19 aa, Entamoeba histolytica
LDGQPCADHDRASGEGVIP

SEQ ID NO: 2637257 - protein, 11 aa, Entamoeba histolytica
LDGSKTSISSV

SEQ ID NO: 2637258 - protein, 14 aa, Entamoeba histolytica
LDGSKVAVSSPSGN

SEQ ID NO: 2637259 - protein, 7 aa, Entamoeba histolytica
LDGSNEW

SEQ ID NO: 2637260 - protein, 8 aa, Entamoeba histolytica
LDGTATGD

SEQ ID NO: 2637261 - protein, 12 aa, Entamoeba histolytica
LDGTDQLNETSE

SEQ ID NO: 2637262 - protein, 13 aa, Entamoeba histolytica
LDGTEPNSQRGNS

SEQ ID NO: 2637263 - protein, 9 aa, Entamoeba histolytica
LDGTKQQQA

SEQ ID NO: 2637264 - protein, 6 aa, Entamoeba histolytica
LDGTNI

SEQ ID NO: 2637265 - protein, 7 aa, Entamoeba histolytica
LDGTNIT

SEQ ID NO: 2637266 - protein, 6 aa, Entamoeba histolytica
LDGTNQ

SEQ ID NO: 2637267 - protein, 8 aa, Entamoeba histolytica
LDGTNVET

SEQ ID NO: 2637268 - protein, 7 aa, Entamoeba histolytica
LDGTTKN

SEQ ID NO: 2637269 - protein, 5 aa, Entamoeba histolytica
LDHEG

SEQ ID NO: 2637270 - protein, 10 aa, Entamoeba histolytica
LDKASKEGQM

SEQ ID NO: 2637271 - protein, 9 aa, Entamoeba histolytica
LDKEDEHNK

SEQ ID NO: 2637272 - protein, 9 aa, Entamoeba histolytica
LDKEEANYF

SEQ ID NO: 2637273 - protein, 23 aa, Entamoeba histolytica
LDKETGKKTGIQVKSNGGLNEEE

SEQ ID NO: 2637274 - protein, 9 aa, Entamoeba histolytica
LDKETLQTD

SEQ ID NO: 2637275 - protein, 10 aa, Entamoeba histolytica
LDKETTGKED

SEQ ID NO: 2637276 - protein, 7 aa, Entamoeba histolytica
LDKGPNV

SEQ ID NO: 2637277 - protein, 9 aa, Entamoeba histolytica
LDKGSKTTK

SEQ ID NO: 2637278 - protein, 24 aa, Entamoeba histolytica
LDKGTGKKTGIQVKSNGGLNEEEI

SEQ ID NO: 2637279 - protein, 27 aa, Entamoeba histolytica
LDKKGISQSDNNQSMKMEDEESDVDDY

SEQ ID NO: 2637280 - protein, 15 aa, Entamoeba histolytica
LDKKSKKGKKDIFYE

SEQ ID NO: 2637281 - protein, 17 aa, Entamoeba histolytica
LDKKTSVTYTLDLKEYE

SEQ ID NO: 2637282 - protein, 20 aa, Entamoeba histolytica
LDKLTQEHEEMEKAKNTAEK

SEQ ID NO: 2637283 - protein, 18 aa, Entamoeba histolytica
LDKNKRKKKVKKDEWGSI

SEQ ID NO: 2637284 - protein, 7 aa, Entamoeba histolytica
LDKQEDK

SEQ ID NO: 2637285 - protein, 11 aa, Entamoeba histolytica
LDKQNEQFPTP

SEQ ID NO: 2637286 - protein, 12 aa, Entamoeba histolytica
LDKSAEQVNKLQ

SEQ ID NO: 2637287 - protein, 11 aa, Entamoeba histolytica
LDKSAKKTIQN

SEQ ID NO: 2637288 - protein, 12 aa, Entamoeba histolytica
LDKSEDKYVSSE

SEQ ID NO: 2637289 - protein, 8 aa, Entamoeba histolytica
LDKSGKVK

SEQ ID NO: 2637290 - protein, 9 aa, Entamoeba histolytica
LDKSKQNSI

SEQ ID NO: 2637291 - protein, 8 aa, Entamoeba histolytica
LDKTDFKG

SEQ ID NO: 2637292 - protein, 8 aa, Entamoeba histolytica
LDKTNDEI

SEQ ID NO: 2637293 - protein, 11 aa, Entamoeba histolytica
LDLPDDHGQTP

SEQ ID NO: 2637294 - protein, 12 aa, Entamoeba histolytica
LDLSGNKLKGKA

SEQ ID NO: 2637295 - protein, 6 aa, Entamoeba histolytica
LDLSKQ

SEQ ID NO: 2637296 - protein, 4 aa, Entamoeba histolytica
LDMA

SEQ ID NO: 2637297 - protein, 6 aa, Entamoeba histolytica
LDNAED

SEQ ID NO: 2637298 - protein, 10 aa, Entamoeba histolytica
LDNDDVDDEI

SEQ ID NO: 2637299 - protein, 12 aa, Entamoeba histolytica
LDNDEEKEQFEN

SEQ ID NO: 2637300 - protein, 8 aa, Entamoeba histolytica
LDNDKKIE

SEQ ID NO: 2637301 - protein, 79 aa, Entamoeba histolytica
LDNDSDDEDIESNTPLSIPPPPPSLSISQPSSSFNPPPPPPQITTSIQQPPQIVPPPPSTIPNTPQPKDITPEAKSAIQ

SEQ ID NO: 2637302 - protein, 108 aa, Entamoeba histolytica
LDNEDDLPLRKAKTTLEAAQRKAAKPVKLATEAREKASATAKEATEAKNKADNAKAEAEAALQAANEAKNQADLSKEQAEEAEVQAVEASKEAEQAVEEANKKVAEAE

SEQ ID NO: 2637303 - protein, 22 aa, Entamoeba histolytica
LDNGTTLATYQEDIGEEVCLIH

SEQ ID NO: 2637304 - protein, 7 aa, Entamoeba histolytica
LDNKKTF

SEQ ID NO: 2637305 - protein, 10 aa, Entamoeba histolytica
LDNLENDRKD

SEQ ID NO: 2637306 - protein, 26 aa, Entamoeba histolytica
LDNLKTPKIRNGTINQITQEKRINKE

SEQ ID NO: 2637307 - protein, 12 aa, Entamoeba histolytica
LDNNKRNNAKSQ

SEQ ID NO: 2637308 - protein, 6 aa, Entamoeba histolytica
LDNNKT

SEQ ID NO: 2637309 - protein, 8 aa, Entamoeba histolytica
LDNPQSRG

SEQ ID NO: 2637310 - protein, 5 aa, Entamoeba histolytica
LDNPR

SEQ ID NO: 2637311 - protein, 9 aa, Entamoeba histolytica
LDNQVTNTI

SEQ ID NO: 2637312 - protein, 5 aa, Entamoeba histolytica
LDNRT

SEQ ID NO: 2637313 - protein, 17 aa, Entamoeba histolytica
LDNSNNSKERISSEDDV

SEQ ID NO: 2637314 - protein, 7 aa, Entamoeba histolytica
LDNSQVE

SEQ ID NO: 2637315 - protein, 13 aa, Entamoeba histolytica
LDNTEGGSSKNYT

SEQ ID NO: 2637316 - protein, 4 aa, Entamoeba histolytica
LDNW

SEQ ID NO: 2637317 - protein, 6 aa, Entamoeba histolytica
LDPEKI

SEQ ID NO: 2637318 - protein, 10 aa, Entamoeba histolytica
LDPEKQKTFA

SEQ ID NO: 2637319 - protein, 4 aa, Entamoeba histolytica
LDPI

SEQ ID NO: 2637320 - protein, 9 aa, Entamoeba histolytica
LDPKGSPYE

SEQ ID NO: 2637321 - protein, 4 aa, Entamoeba histolytica
LDPN

SEQ ID NO: 2637322 - protein, 32 aa, Entamoeba histolytica
LDPNASKEGYLKEEKKKKTQIIKNQSKRSNYK

SEQ ID NO: 2637323 - protein, 10 aa, Entamoeba histolytica
LDPNATKEQL

SEQ ID NO: 2637324 - protein, 26 aa, Entamoeba histolytica
LDPNESKDDILKGQKENIEKETDIEI

SEQ ID NO: 2637325 - protein, 4 aa, Entamoeba histolytica
LDPP

SEQ ID NO: 2637326 - protein, 6 aa, Entamoeba histolytica
LDPQKD

SEQ ID NO: 2637327 - protein, 13 aa, Entamoeba histolytica
LDPRHQQPHEKAA

SEQ ID NO: 2637328 - protein, 10 aa, Entamoeba histolytica
LDPSEREESV

SEQ ID NO: 2637329 - protein, 12 aa, Entamoeba histolytica
LDPSKSPLKGCT

SEQ ID NO: 2637330 - protein, 7 aa, Entamoeba histolytica
LDPTDWN

SEQ ID NO: 2637331 - protein, 6 aa, Entamoeba histolytica
LDQDKV

SEQ ID NO: 2637332 - protein, 5 aa, Entamoeba histolytica
LDQER

SEQ ID NO: 2637333 - protein, 8 aa, Entamoeba histolytica
LDQGTKTR

SEQ ID NO: 2637334 - protein, 6 aa, Entamoeba histolytica
LDQNTS

SEQ ID NO: 2637335 - protein, 11 aa, Entamoeba histolytica
LDQPHPESMDK

SEQ ID NO: 2637336 - protein, 19 aa, Entamoeba histolytica
LDQPTIGSNSNSIARQSSF

SEQ ID NO: 2637337 - protein, 7 aa, Entamoeba histolytica
LDQQSEV

SEQ ID NO: 2637338 - protein, 10 aa, Entamoeba histolytica
LDQSKKENFI

SEQ ID NO: 2637339 - protein, 5 aa, Entamoeba histolytica
LDRDE

SEQ ID NO: 2637340 - protein, 4 aa, Entamoeba histolytica
LDRI

SEQ ID NO: 2637341 - protein, 14 aa, Entamoeba histolytica
LDRSGNTLPPPNKE

SEQ ID NO: 2637342 - protein, 10 aa, Entamoeba histolytica
LDRSSIDSSQ

SEQ ID NO: 2637343 - protein, 6 aa, Entamoeba histolytica
LDSAQN

SEQ ID NO: 2637344 - protein, 9 aa, Entamoeba histolytica
LDSDDGQSW

SEQ ID NO: 2637345 - protein, 10 aa, Entamoeba histolytica
LDSEDDLPLR

SEQ ID NO: 2637346 - protein, 11 aa, Entamoeba histolytica
LDSEKKKLSKT

SEQ ID NO: 2637347 - protein, 7 aa, Entamoeba histolytica
LDSETSD

SEQ ID NO: 2637348 - protein, 5 aa, Entamoeba histolytica
LDSGD

SEQ ID NO: 2637349 - protein, 7 aa, Entamoeba histolytica
LDSKTYS

SEQ ID NO: 2637350 - protein, 5 aa, Entamoeba histolytica
LDSLT

SEQ ID NO: 2637351 - protein, 8 aa, Entamoeba histolytica
LDSNGNYK

SEQ ID NO: 2637352 - protein, 8 aa, Entamoeba histolytica
LDSNGTIK

SEQ ID NO: 2637353 - protein, 5 aa, Entamoeba histolytica
LDSPF

SEQ ID NO: 2637354 - protein, 18 aa, Entamoeba histolytica
LDSPSLKLKPNPFKESEE

SEQ ID NO: 2637355 - protein, 9 aa, Entamoeba histolytica
LDSQKQFND

SEQ ID NO: 2637356 - protein, 5 aa, Entamoeba histolytica
LDSRG

SEQ ID NO: 2637357 - protein, 32 aa, Entamoeba histolytica
LDSRKSSETMPTSETNSLTESKIYKGTKEVKS

SEQ ID NO: 2637358 - protein, 11 aa, Entamoeba histolytica
LDSSEMDESQL

SEQ ID NO: 2637359 - protein, 24 aa, Entamoeba histolytica
LDSSFDESDYDDEDNHDNDDYFMF

SEQ ID NO: 2637360 - protein, 10 aa, Entamoeba histolytica
LDSSNPYLQP

SEQ ID NO: 2637361 - protein, 11 aa, Entamoeba histolytica
LDSSQKWENKL

SEQ ID NO: 2637362 - protein, 7 aa, Entamoeba histolytica
LDSTNSD

SEQ ID NO: 2637363 - protein, 7 aa, Entamoeba histolytica
LDSTRNR

SEQ ID NO: 2637364 - protein, 7 aa, Entamoeba histolytica
LDSVEDT

SEQ ID NO: 2637365 - protein, 10 aa, Entamoeba histolytica
LDSYQDYGEL

SEQ ID NO: 2637366 - protein, 11 aa, Entamoeba histolytica
LDTEEEMGDEN

SEQ ID NO: 2637367 - protein, 6 aa, Entamoeba histolytica
LDTENG

SEQ ID NO: 2637368 - protein, 7 aa, Entamoeba histolytica
LDTETRK

SEQ ID NO: 2637369 - protein, 38 aa, Entamoeba histolytica
LDTKIKNDDLVDGPPSRSVSSVPDDERNIRKEDFSSSV

SEQ ID NO: 2637370 - protein, 6 aa, Entamoeba histolytica
LDTKNR

SEQ ID NO: 2637371 - protein, 4 aa, Entamoeba histolytica
LDTL

SEQ ID NO: 2637372 - protein, 15 aa, Entamoeba histolytica
LDTNDEAMKKKKEKF

SEQ ID NO: 2637373 - protein, 4 aa, Entamoeba histolytica
LDTR

SEQ ID NO: 2637374 - protein, 8 aa, Entamoeba histolytica
LDTRNDPA

SEQ ID NO: 2637375 - protein, 10 aa, Entamoeba histolytica
LDTSSDLTKY

SEQ ID NO: 2637376 - protein, 7 aa, Entamoeba histolytica
LDTSTPN

SEQ ID NO: 2637377 - protein, 7 aa, Entamoeba histolytica
LDTTQQE

SEQ ID NO: 2637378 - protein, 12 aa, Entamoeba histolytica
LDVKSGSTGTHS

SEQ ID NO: 2637379 - protein, 9 aa, Entamoeba histolytica
LDYDDNTYE

SEQ ID NO: 2637380 - protein, 11 aa, Entamoeba histolytica
LDYKSKRKSMK

SEQ ID NO: 2637381 - protein, 19 aa, Entamoeba histolytica
LEAAKKKKADLEELAKSFQ

SEQ ID NO: 2637382 - protein, 4 aa, Entamoeba histolytica
LEAE

SEQ ID NO: 2637383 - protein, 11 aa, Entamoeba histolytica
LEAKNQKPIFP

SEQ ID NO: 2637384 - protein, 13 aa, Entamoeba histolytica
LEAKRRKFEEANR

SEQ ID NO: 2637385 - protein, 10 aa, Entamoeba histolytica
LEAPQTPVIQ

SEQ ID NO: 2637386 - protein, 7 aa, Entamoeba histolytica
LEASNSQ

SEQ ID NO: 2637387 - protein, 14 aa, Entamoeba histolytica
LEASVKKKLSRDER

SEQ ID NO: 2637388 - protein, 12 aa, Entamoeba histolytica
LEATNTALEETI

SEQ ID NO: 2637389 - protein, 8 aa, Entamoeba histolytica
LEAVRKDS

SEQ ID NO: 2637390 - protein, 4 aa, Entamoeba histolytica
LEDD

SEQ ID NO: 2637391 - protein, 7 aa, Entamoeba histolytica
LEDDNKN

SEQ ID NO: 2637392 - protein, 6 aa, Entamoeba histolytica
LEDDPI

SEQ ID NO: 2637393 - protein, 5 aa, Entamoeba histolytica
LEDEE

SEQ ID NO: 2637394 - protein, 12 aa, Entamoeba histolytica
LEDEEASKNGIK

SEQ ID NO: 2637395 - protein, 8 aa, Entamoeba histolytica
LEDEESVK

SEQ ID NO: 2637396 - protein, 21 aa, Entamoeba histolytica
LEDENKKEIKDNEFKQQDEKK

SEQ ID NO: 2637397 - protein, 12 aa, Entamoeba histolytica
LEDGEIQKQTMK

SEQ ID NO: 2637398 - protein, 17 aa, Entamoeba histolytica
LEDGENEGEMKERINGE

SEQ ID NO: 2637399 - protein, 6 aa, Entamoeba histolytica
LEDGVD

SEQ ID NO: 2637400 - protein, 15 aa, Entamoeba histolytica
LEDIEKEKNGYGDSI

SEQ ID NO: 2637401 - protein, 4 aa, Entamoeba histolytica
LEDK

SEQ ID NO: 2637402 - protein, 9 aa, Entamoeba histolytica
LEDKGTNSM

SEQ ID NO: 2637403 - protein, 20 aa, Entamoeba histolytica
LEDKPKPAAKPKAAPKDDLD

SEQ ID NO: 2637404 - protein, 19 aa, Entamoeba histolytica
LEDKPKPTSQPAQKKDDLD

SEQ ID NO: 2637405 - protein, 6 aa, Entamoeba histolytica
LEDNET

SEQ ID NO: 2637406 - protein, 21 aa, Entamoeba histolytica
LEDNNEEILEEEEDELEKDIT

SEQ ID NO: 2637407 - protein, 9 aa, Entamoeba histolytica
LEDNNPQTT

SEQ ID NO: 2637408 - protein, 18 aa, Entamoeba histolytica
LEDNVNELTDQQKEENKK

SEQ ID NO: 2637409 - protein, 9 aa, Entamoeba histolytica
LEDPDNEKL

SEQ ID NO: 2637410 - protein, 14 aa, Entamoeba histolytica
LEDPKKETRDAATE

SEQ ID NO: 2637411 - protein, 4 aa, Entamoeba histolytica
LEDQ

SEQ ID NO: 2637412 - protein, 5 aa, Entamoeba histolytica
LEDQE

SEQ ID NO: 2637413 - protein, 18 aa, Entamoeba histolytica
LEDQPLGPPPMPENETTI

SEQ ID NO: 2637414 - protein, 6 aa, Entamoeba histolytica
LEDRKK

SEQ ID NO: 2637415 - protein, 10 aa, Entamoeba histolytica
LEDSESCAFT

SEQ ID NO: 2637416 - protein, 12 aa, Entamoeba histolytica
LEDSSKKVRGNS

SEQ ID NO: 2637417 - protein, 11 aa, Entamoeba histolytica
LEDSSQEPIES

SEQ ID NO: 2637418 - protein, 4 aa, Entamoeba histolytica
LEDT

SEQ ID NO: 2637419 - protein, 5 aa, Entamoeba histolytica
LEDTT

SEQ ID NO: 2637420 - protein, 6 aa, Entamoeba histolytica
LEDVES

SEQ ID NO: 2637421 - protein, 4 aa, Entamoeba histolytica
LEEA

SEQ ID NO: 2637422 - protein, 7 aa, Entamoeba histolytica
LEEAGYT

SEQ ID NO: 2637423 - protein, 6 aa, Entamoeba histolytica
LEEASK

SEQ ID NO: 2637424 - protein, 9 aa, Entamoeba histolytica
LEEDEDLRS

SEQ ID NO: 2637425 - protein, 26 aa, Entamoeba histolytica
LEEDKDEDDEMEFEESDDEEFEDPSS

SEQ ID NO: 2637426 - protein, 9 aa, Entamoeba histolytica
LEEDPSNKI

SEQ ID NO: 2637427 - protein, 4 aa, Entamoeba histolytica
LEEE

SEQ ID NO: 2637428 - protein, 24 aa, Entamoeba histolytica
LEEEEEQRKKEEEENEKRAEQERL

SEQ ID NO: 2637429 - protein, 7 aa, Entamoeba histolytica
LEEEGEY

SEQ ID NO: 2637430 - protein, 16 aa, Entamoeba histolytica
LEEEKEKRKEEEDDDI

SEQ ID NO: 2637431 - protein, 8 aa, Entamoeba histolytica
LEEEMREA

SEQ ID NO: 2637432 - protein, 19 aa, Entamoeba histolytica
LEEENNDNNCHSSQIHQSD

SEQ ID NO: 2637433 - protein, 93 aa, Entamoeba histolytica
LEEEQMKEGEESDNESSEKTKTKENDETNKRNESERSHSSSKKKNNSKGKKKGSKKKGGSKKQNVSPSINEPKKSDVLEPSSKPPSRPIPNNK

SEQ ID NO: 2637434 - protein, 45 aa, Entamoeba histolytica
LEEERLRKENEEEERKMKEEEERLNKEAEKLQKELEAEEKEEKKD

SEQ ID NO: 2637435 - protein, 7 aa, Entamoeba histolytica
LEEESKK

SEQ ID NO: 2637436 - protein, 9 aa, Entamoeba histolytica
LEEESKKQI

SEQ ID NO: 2637437 - protein, 6 aa, Entamoeba histolytica
LEEETK

SEQ ID NO: 2637438 - protein, 41 aa, Entamoeba histolytica
LEEEYENKITEEEHETEEEHETEEENKTEEEKENQKGHAEV

SEQ ID NO: 2637439 - protein, 10 aa, Entamoeba histolytica
LEEFESSKIK

SEQ ID NO: 2637440 - protein, 10 aa, Entamoeba histolytica
LEEGDLSQKT

SEQ ID NO: 2637441 - protein, 6 aa, Entamoeba histolytica
LEEGKI

SEQ ID NO: 2637442 - protein, 10 aa, Entamoeba histolytica
LEEGKPFSQV

SEQ ID NO: 2637443 - protein, 8 aa, Entamoeba histolytica
LEEGRGDI

SEQ ID NO: 2637444 - protein, 4 aa, Entamoeba histolytica
LEEI

SEQ ID NO: 2637445 - protein, 10 aa, Entamoeba histolytica
LEEIKDRNKQ

SEQ ID NO: 2637446 - protein, 18 aa, Entamoeba histolytica
LEEIKEEEGQCNNEIQEK

SEQ ID NO: 2637447 - protein, 28 aa, Entamoeba histolytica
LEEIKKSYEEERESNDKQNKLQKEEIQS

SEQ ID NO: 2637448 - protein, 16 aa, Entamoeba histolytica
LEEIPSKRTKQDEMNE

SEQ ID NO: 2637449 - protein, 4 aa, Entamoeba histolytica
LEEK

SEQ ID NO: 2637450 - protein, 6 aa, Entamoeba histolytica
LEEKDE

SEQ ID NO: 2637451 - protein, 9 aa, Entamoeba histolytica
LEEKEEGNI

SEQ ID NO: 2637452 - protein, 9 aa, Entamoeba histolytica
LEEKEEMNE

SEQ ID NO: 2637453 - protein, 10 aa, Entamoeba histolytica
LEEKEEMNEY

SEQ ID NO: 2637454 - protein, 10 aa, Entamoeba histolytica
LEEKEKGNVC

SEQ ID NO: 2637455 - protein, 8 aa, Entamoeba histolytica
LEEKEQTI

SEQ ID NO: 2637456 - protein, 12 aa, Entamoeba histolytica
LEEKKEKNEYKN

SEQ ID NO: 2637457 - protein, 7 aa, Entamoeba histolytica
LEEKNEV

SEQ ID NO: 2637458 - protein, 9 aa, Entamoeba histolytica
LEEKPEYAG

SEQ ID NO: 2637459 - protein, 5 aa, Entamoeba histolytica
LEEKT

SEQ ID NO: 2637460 - protein, 12 aa, Entamoeba histolytica
LEELEKEEQEQL

SEQ ID NO: 2637461 - protein, 14 aa, Entamoeba histolytica
LEELQDRKESIEQE

SEQ ID NO: 2637462 - protein, 4 aa, Entamoeba histolytica
LEEN

SEQ ID NO: 2637463 - protein, 5 aa, Entamoeba histolytica
LEENE

SEQ ID NO: 2637464 - protein, 10 aa, Entamoeba histolytica
LEENKLKQQE

SEQ ID NO: 2637465 - protein, 12 aa, Entamoeba histolytica
LEENKRKKFQRK

SEQ ID NO: 2637466 - protein, 6 aa, Entamoeba histolytica
LEENNQ

SEQ ID NO: 2637467 - protein, 6 aa, Entamoeba histolytica
LEENPA

SEQ ID NO: 2637468 - protein, 16 aa, Entamoeba histolytica
LEENSEGKVETIQEAK

SEQ ID NO: 2637469 - protein, 6 aa, Entamoeba histolytica
LEEPEQ

SEQ ID NO: 2637470 - protein, 12 aa, Entamoeba histolytica
LEEPQHPETMEK

SEQ ID NO: 2637471 - protein, 5 aa, Entamoeba histolytica
LEEPR

SEQ ID NO: 2637472 - protein, 6 aa, Entamoeba histolytica
LEEQEN

SEQ ID NO: 2637473 - protein, 33 aa, Entamoeba histolytica
LEEQKKKEDLKPKKNKTNDSHSKKITDFFQVKK

SEQ ID NO: 2637474 - protein, 11 aa, Entamoeba histolytica
LEEQKRIAAEN

SEQ ID NO: 2637475 - protein, 8 aa, Entamoeba histolytica
LEEQPEYA

SEQ ID NO: 2637476 - protein, 36 aa, Entamoeba histolytica
LEEQRKREEEKKRQEEEAFKRNQERIEKQQSSDEVY

SEQ ID NO: 2637477 - protein, 4 aa, Entamoeba histolytica
LEER

SEQ ID NO: 2637478 - protein, 6 aa, Entamoeba histolytica
LEERAS

SEQ ID NO: 2637479 - protein, 5 aa, Entamoeba histolytica
LEERE

SEQ ID NO: 2637480 - protein, 5 aa, Entamoeba histolytica
LEERK

SEQ ID NO: 2637481 - protein, 22 aa, Entamoeba histolytica
LEERKKVEKVAKKESVRQRRNR

SEQ ID NO: 2637482 - protein, 7 aa, Entamoeba histolytica
LEERPTD

SEQ ID NO: 2637483 - protein, 40 aa, Entamoeba histolytica
LEERQDEKTEENGSPLLSGSSKTDTSEEEVKEKKGKKNFL

SEQ ID NO: 2637484 - protein, 11 aa, Entamoeba histolytica
LEESDNTMPGV

SEQ ID NO: 2637485 - protein, 9 aa, Entamoeba histolytica
LEESDQKQK

SEQ ID NO: 2637486 - protein, 8 aa, Entamoeba histolytica
LEESGNNE

SEQ ID NO: 2637487 - protein, 30 aa, Entamoeba histolytica
LEESKSHDARDNELAKQDKADKIKKAENEI

SEQ ID NO: 2637488 - protein, 13 aa, Entamoeba histolytica
LEESSRQNEKTIK

SEQ ID NO: 2637489 - protein, 9 aa, Entamoeba histolytica
LEETNKEDH

SEQ ID NO: 2637490 - protein, 106 aa, Entamoeba histolytica
LEETQRQKQEEIQRQKQEEIQRQKQEEIQRQEEEERKKQEEIQREEEERQKQEEIQRQREERKRKEEIQRQREEERKRKEEEIQRQKEEERKRKEEEREKKEREWK

SEQ ID NO: 2637491 - protein, 23 aa, Entamoeba histolytica
LEETRKRKRENRANANRNDYGNE

SEQ ID NO: 2637492 - protein, 13 aa, Entamoeba histolytica
LEEYQSENPLGMT

SEQ ID NO: 2637493 - protein, 14 aa, Entamoeba histolytica
LEEYQTDNPLGLSR

SEQ ID NO: 2637494 - protein, 8 aa, Entamoeba histolytica
LEFSNGSK

SEQ ID NO: 2637495 - protein, 7 aa, Entamoeba histolytica
LEGATYK

SEQ ID NO: 2637496 - protein, 4 aa, Entamoeba histolytica
LEGE

SEQ ID NO: 2637497 - protein, 6 aa, Entamoeba histolytica
LEGEEC

SEQ ID NO: 2637498 - protein, 8 aa, Entamoeba histolytica
LEGEELKG

SEQ ID NO: 2637499 - protein, 7 aa, Entamoeba histolytica
LEGETTV

SEQ ID NO: 2637500 - protein, 25 aa, Entamoeba histolytica
LEGGKNKKSKKKDTSKPKHKKHVNK

SEQ ID NO: 2637501 - protein, 13 aa, Entamoeba histolytica
LEGGVGTAAFGSG

SEQ ID NO: 2637502 - protein, 6 aa, Entamoeba histolytica
LEGKYD

SEQ ID NO: 2637503 - protein, 27 aa, Entamoeba histolytica
LEGNTTNSTKSSTSNSTCECGDVPKAV

SEQ ID NO: 2637504 - protein, 6 aa, Entamoeba histolytica
LEGPEK

SEQ ID NO: 2637505 - protein, 28 aa, Entamoeba histolytica
LEGYQNYSGGLDTHTNVTGKESYATQYD

SEQ ID NO: 2637506 - protein, 32 aa, Entamoeba histolytica
LEHEESPINQDIEKKESNETKLPPNSPTKYTN

SEQ ID NO: 2637507 - protein, 6 aa, Entamoeba histolytica
LEHENN

SEQ ID NO: 2637508 - protein, 7 aa, Entamoeba histolytica
LEHNNST

SEQ ID NO: 2637509 - protein, 4 aa, Entamoeba histolytica
LEHP

SEQ ID NO: 2637510 - protein, 8 aa, Entamoeba histolytica
LEHPSTLN

SEQ ID NO: 2637511 - protein, 7 aa, Entamoeba histolytica
LEIPQST

SEQ ID NO: 2637512 - protein, 11 aa, Entamoeba histolytica
LEISSNNNKPI

SEQ ID NO: 2637513 - protein, 5 aa, Entamoeba histolytica
LEKAK

SEQ ID NO: 2637514 - protein, 9 aa, Entamoeba histolytica
LEKAQQDGL

SEQ ID NO: 2637515 - protein, 58 aa, Entamoeba histolytica
LEKDDEVSTGDDKSSEEDNITSEEEDKSSEEEDKSSEEEDGSYSIDEEERIANQNKKY

SEQ ID NO: 2637516 - protein, 6 aa, Entamoeba histolytica
LEKEED

SEQ ID NO: 2637517 - protein, 7 aa, Entamoeba histolytica
LEKEEPI

SEQ ID NO: 2637518 - protein, 35 aa, Entamoeba histolytica; identical to SEQ ID NO: 2442262

SEQ ID NO: 2637519 - protein, 8 aa, Entamoeba histolytica
LEKEGTKI

SEQ ID NO: 2637520 - protein, 7 aa, Entamoeba histolytica
LEKENNI

SEQ ID NO: 2637521 - protein, 8 aa, Entamoeba histolytica
LEKEPTRI

SEQ ID NO: 2637522 - protein, 10 aa, Entamoeba histolytica
LEKGANEEQV

SEQ ID NO: 2637523 - protein, 6 aa, Entamoeba histolytica
LEKGSQ

SEQ ID NO: 2637524 - protein, 10 aa, Entamoeba histolytica
LEKKEYHSGE

SEQ ID NO: 2637525 - protein, 9 aa, Entamoeba histolytica
LEKKKQEVV

SEQ ID NO: 2637526 - protein, 10 aa, Entamoeba histolytica
LEKKLGSGSF

SEQ ID NO: 2637527 - protein, 9 aa, Entamoeba histolytica
LEKKQNSIN

SEQ ID NO: 2637528 - protein, 7 aa, Entamoeba histolytica
LEKKREP

SEQ ID NO: 2637529 - protein, 15 aa, Entamoeba histolytica
LEKNGKKGGEGRYRD

SEQ ID NO: 2637530 - protein, 7 aa, Entamoeba histolytica
LEKNPKY

SEQ ID NO: 2637531 - protein, 4 aa, Entamoeba histolytica
LEKP

SEQ ID NO: 2637532 - protein, 14 aa, Entamoeba histolytica
LEKPDVEQQSSKQC

SEQ ID NO: 2637533 - protein, 12 aa, Entamoeba histolytica
LEKPKEKGNLTH

SEQ ID NO: 2637534 - protein, 4 aa, Entamoeba histolytica
LEKQ

SEQ ID NO: 2637535 - protein, 10 aa, Entamoeba histolytica
LEKSESLDAR

SEQ ID NO: 2637536 - protein, 5 aa, Entamoeba histolytica
LEKSS

SEQ ID NO: 2637537 - protein, 8 aa, Entamoeba histolytica
LEKSSSEI

SEQ ID NO: 2637538 - protein, 7 aa, Entamoeba histolytica
LEKSVSE

SEQ ID NO: 2637539 - protein, 14 aa, Entamoeba histolytica
LEKTAKRRSDTNRI

SEQ ID NO: 2637540 - protein, 17 aa, Entamoeba histolytica
LEKTTTISHGSAGFETI

SEQ ID NO: 2637541 - protein, 17 aa, Entamoeba histolytica
LEKTTTRSYGSAGFETI

SEQ ID NO: 2637542 - protein, 18 aa, Entamoeba histolytica
LEKTTVTSKIGRKRIDDK

SEQ ID NO: 2637543 - protein, 7 aa, Entamoeba histolytica
LEKYDDD

SEQ ID NO: 2637544 - protein, 14 aa, Entamoeba histolytica
LEKYPTTKDKSKGE

SEQ ID NO: 2637545 - protein, 27 aa, Entamoeba histolytica
LELPKTKDSSKYKQSSKPKLNENHEQK

SEQ ID NO: 2637546 - protein, 7 aa, Entamoeba histolytica
LEMSQKN

SEQ ID NO: 2637547 - protein, 5 aa, Entamoeba histolytica
LENAE

SEQ ID NO: 2637548 - protein, 6 aa, Entamoeba histolytica
LENAKR

SEQ ID NO: 2637549 - protein, 10 aa, Entamoeba histolytica
LENDKKKIAK

SEQ ID NO: 2637550 - protein, 13 aa, Entamoeba histolytica
LENDQKNQQQQSV

SEQ ID NO: 2637551 - protein, 35 aa, Entamoeba histolytica
LENDSPKANTPTASPRSSRRDSNSDAVLRDHSSED

SEQ ID NO: 2637552 - protein, 4 aa, Entamoeba histolytica
LENE

SEQ ID NO: 2637553 - protein, 13 aa, Entamoeba histolytica
LENEALKTERDNL

SEQ ID NO: 2637554 - protein, 16 aa, Entamoeba histolytica
LENEEISSEEKSEEHQ

SEQ ID NO: 2637555 - protein, 12 aa, Entamoeba histolytica
LENEEKKEGLKT

SEQ ID NO: 2637556 - protein, 8 aa, Entamoeba histolytica
LENEGCKT

SEQ ID NO: 2637557 - protein, 16 aa, Entamoeba histolytica
LENEHQKDDAKKSILQ

SEQ ID NO: 2637558 - protein, 12 aa, Entamoeba histolytica
LENENTSDETKK

SEQ ID NO: 2637559 - protein, 6 aa, Entamoeba histolytica
LENEPK

SEQ ID NO: 2637560 - protein, 10 aa, Entamoeba histolytica
LENFKNKRKE

SEQ ID NO: 2637561 - protein, 7 aa, Entamoeba histolytica
LENGERD

SEQ ID NO: 2637562 - protein, 5 aa, Entamoeba histolytica
LENGL

SEQ ID NO: 2637563 - protein, 12 aa, Entamoeba histolytica
LENGVSSDDRFD

SEQ ID NO: 2637564 - protein, 7 aa, Entamoeba histolytica
LENIAGR

SEQ ID NO: 2637565 - protein, 4 aa, Entamoeba histolytica
LENK

SEQ ID NO: 2637566 - protein, 10 aa, Entamoeba histolytica
LENKTKDNEL

SEQ ID NO: 2637567 - protein, 4 aa, Entamoeba histolytica
LENN

SEQ ID NO: 2637568 - protein, 5 aa, Entamoeba histolytica
LENND

SEQ ID NO: 2637569 - protein, 28 aa, Entamoeba histolytica
LENNTKENSEEIQKKELNKSNKLEEQNE

SEQ ID NO: 2637570 - protein, 4 aa, Entamoeba histolytica
LENP

SEQ ID NO: 2637571 - protein, 5 aa, Entamoeba histolytica
LENPA

SEQ ID NO: 2637572 - protein, 6 aa, Entamoeba histolytica
LENPDD

SEQ ID NO: 2637573 - protein, 6 aa, Entamoeba histolytica
LENPNV

SEQ ID NO: 2637574 - protein, 7 aa, Entamoeba histolytica
LENPQQY

SEQ ID NO: 2637575 - protein, 16 aa, Entamoeba histolytica
LENQKFSKSMRKTKKF

SEQ ID NO: 2637576 - protein, 10 aa, Entamoeba histolytica
LENQSKDTIN

SEQ ID NO: 2637577 - protein, 9 aa, Entamoeba histolytica
LENSKENDW

SEQ ID NO: 2637578 - protein, 10 aa, Entamoeba histolytica
LENSKNGNLP

SEQ ID NO: 2637579 - protein, 8 aa, Entamoeba histolytica
LENSPSEG

SEQ ID NO: 2637580 - protein, 4 aa, Entamoeba histolytica
LENT

SEQ ID NO: 2637581 - protein, 12 aa, Entamoeba histolytica
LENTGASVRTQS

SEQ ID NO: 2637582 - protein, 19 aa, Entamoeba histolytica
LENTTTQAEKFAKDSKEQL

SEQ ID NO: 2637583 - protein, 8 aa, Entamoeba histolytica
LEPAKTKN

SEQ ID NO: 2637584 - protein, 9 aa, Entamoeba histolytica
LEPASSTPI

SEQ ID NO: 2637585 - protein, 7 aa, Entamoeba histolytica
LEPEESD

SEQ ID NO: 2637586 - protein, 24 aa, Entamoeba histolytica
LEPELSTKLPQQSTSPKRKRAITP

SEQ ID NO: 2637587 - protein, 5 aa, Entamoeba histolytica
LEPEQ

SEQ ID NO: 2637588 - protein, 6 aa, Entamoeba histolytica
LEPGEY

SEQ ID NO: 2637589 - protein, 6 aa, Entamoeba histolytica
LEPGTL

SEQ ID NO: 2637590 - protein, 13 aa, Entamoeba histolytica
LEPGTLDTIKSGK

SEQ ID NO: 2637591 - protein, 64 aa, Entamoeba histolytica
LEPIKQPEVKISSEQPLITNETPEENTNQNISSKLPQKVDNPESVIETPQPGVTEDNAKDSELA

SEQ ID NO: 2637592 - protein, 9 aa, Entamoeba histolytica
LEPKEAPKA

SEQ ID NO: 2637593 - protein, 8 aa, Entamoeba histolytica
LEPKEQEK

SEQ ID NO: 2637594 - protein, 11 aa, Entamoeba histolytica
LEPLQSQQEDL

SEQ ID NO: 2637595 - protein, 5 aa, Entamoeba histolytica
LEPMD

SEQ ID NO: 2637596 - protein, 4 aa, Entamoeba histolytica
LEPN

SEQ ID NO: 2637597 - protein, 6 aa, Entamoeba histolytica
LEPNEF

SEQ ID NO: 2637598 - protein, 19 aa, Entamoeba histolytica
LEPNENEEKIKEDNEIEEH

SEQ ID NO: 2637599 - protein, 5 aa, Entamoeba histolytica
LEPNR

SEQ ID NO: 2637600 - protein, 7 aa, Entamoeba histolytica
LEPPQTV

SEQ ID NO: 2637601 - protein, 7 aa, Entamoeba histolytica
LEPSEID

SEQ ID NO: 2637602 - protein, 10 aa, Entamoeba histolytica
LEPTESQPNY

SEQ ID NO: 2637603 - protein, 5 aa, Entamoeba histolytica
LEQEM

SEQ ID NO: 2637604 - protein, 6 aa, Entamoeba histolytica
LEQENK

SEQ ID NO: 2637605 - protein, 4 aa, Entamoeba histolytica
LEQH

SEQ ID NO: 2637606 - protein, 8 aa, Entamoeba histolytica
LEQIPDPI

SEQ ID NO: 2637607 - protein, 21 aa, Entamoeba histolytica
LEQLDDNAKQYWTKSDNPDDE

SEQ ID NO: 2637608 - protein, 12 aa, Entamoeba histolytica
LEQLSNKKEWTR

SEQ ID NO: 2637609 - protein, 13 aa, Entamoeba histolytica
LEQNEERRKGYSL

SEQ ID NO: 2637610 - protein, 26 aa, Entamoeba histolytica
LEQNPKKHHHNQPKQRKEKKITKEDL

SEQ ID NO: 2637611 - protein, 19 aa, Entamoeba histolytica
LEQNPQQVELNEEELEKEL

SEQ ID NO: 2637612 - protein, 4 aa, Entamoeba histolytica
LEQP

SEQ ID NO: 2637613 - protein, 10 aa, Entamoeba histolytica
LEQPALDPRN

SEQ ID NO: 2637614 - protein, 4 aa, Entamoeba histolytica
LEQQ

SEQ ID NO: 2637615 - protein, 16 aa, Entamoeba histolytica
LEQQRQERGKKRKEKG

SEQ ID NO: 2637616 - protein, 4 aa, Entamoeba histolytica
LEQS

SEQ ID NO: 2637617 - protein, 15 aa, Entamoeba histolytica
LEQSESTENKSTKTV

SEQ ID NO: 2637618 - protein, 7 aa, Entamoeba histolytica
LEQSGLS

SEQ ID NO: 2637619 - protein, 5 aa, Entamoeba histolytica
LEQTH

SEQ ID NO: 2637620 - protein, 5 aa, Entamoeba histolytica
LEQTI

SEQ ID NO: 2637621 - protein, 7 aa, Entamoeba histolytica
LEQVPKV

SEQ ID NO: 2637622 - protein, 54 aa, Entamoeba histolytica
LERDKRKEMKTKLSEEESEELLNPEDEKQKIEEENEERKRRITDDGLTEEERKQ

SEQ ID NO: 2637623 - protein, 9 aa, Entamoeba histolytica
LEREPEEKI

SEQ ID NO: 2637624 - protein, 4 aa, Entamoeba histolytica
LERG

SEQ ID NO: 2637625 - protein, 19 aa, Entamoeba histolytica
LERGSESSSLISPRGISQT

SEQ ID NO: 2637626 - protein, 5 aa, Entamoeba histolytica
LERIG

SEQ ID NO: 2637627 - protein, 10 aa, Entamoeba histolytica
LERKASAQKV

SEQ ID NO: 2637628 - protein, 6 aa, Entamoeba histolytica
LERKKE

SEQ ID NO: 2637629 - protein, 8 aa, Entamoeba histolytica
LERLNNNQ

SEQ ID NO: 2637630 - protein, 17 aa, Entamoeba histolytica
LERNRGPLKECPAPEQL

SEQ ID NO: 2637631 - protein, 13 aa, Entamoeba histolytica
LERPPIESDSDDE

SEQ ID NO: 2637632 - protein, 8 aa, Entamoeba histolytica
LERQHKEL

SEQ ID NO: 2637633 - protein, 12 aa, Entamoeba histolytica
LERQKKEEEELR

SEQ ID NO: 2637634 - protein, 6 aa, Entamoeba histolytica
LERREK

SEQ ID NO: 2637635 - protein, 10 aa, Entamoeba histolytica
LERRKSPTID

SEQ ID NO: 2637636 - protein, 5 aa, Entamoeba histolytica
LERRT

SEQ ID NO: 2637637 - protein, 10 aa, Entamoeba histolytica
LERSGSKIAR

SEQ ID NO: 2637638 - protein, 30 aa, Entamoeba histolytica
LERSKKEQHEDTSFNEEKQTNESDNSTDQQ

SEQ ID NO: 2637639 - protein, 5 aa, Entamoeba histolytica
LERSP

SEQ ID NO: 2637640 - protein, 16 aa, Entamoeba histolytica
LERSPKKGVKSYSTTK

SEQ ID NO: 2637641 - protein, 20 aa, Entamoeba histolytica
LESADQDTFESRAARSGLET

SEQ ID NO: 2637642 - protein, 5 aa, Entamoeba histolytica
LESAG

SEQ ID NO: 2637643 - protein, 6 aa, Entamoeba histolytica
LESDDI

SEQ ID NO: 2637644 - protein, 8 aa, Entamoeba histolytica
LESEGRPY

SEQ ID NO: 2637645 - protein, 6 aa, Entamoeba histolytica
LESEKE

SEQ ID NO: 2637646 - protein, 6 aa, Entamoeba histolytica
LESESK

SEQ ID NO: 2637647 - protein, 4 aa, Entamoeba histolytica
LESG

SEQ ID NO: 2637648 - protein, 9 aa, Entamoeba histolytica
LESGERGEL

SEQ ID NO: 2637649 - protein, 5 aa, Entamoeba histolytica
LESGG

SEQ ID NO: 2637650 - protein, 18 aa, Entamoeba histolytica
LESIGEDETMQMEEEEPI

SEQ ID NO: 2637651 - protein, 12 aa, Entamoeba histolytica
LESKSAVEAESL

SEQ ID NO: 2637652 - protein, 7 aa, Entamoeba histolytica
LESKSSF

SEQ ID NO: 2637653 - protein, 12 aa, Entamoeba histolytica
LESNADQSTNNI

SEQ ID NO: 2637654 - protein, 5 aa, Entamoeba histolytica
LESNE

SEQ ID NO: 2637655 - protein, 5 aa, Entamoeba histolytica
LESNG

SEQ ID NO: 2637656 - protein, 26 aa, Entamoeba histolytica
LESNNQEKKPIQRTKTHPKSLSKKQS

SEQ ID NO: 2637657 - protein, 8 aa, Entamoeba histolytica
LESNQEKF

SEQ ID NO: 2637658 - protein, 8 aa, Entamoeba histolytica
LESPKKYN

SEQ ID NO: 2637659 - protein, 7 aa, Entamoeba histolytica
LESPTNS

SEQ ID NO: 2637660 - protein, 9 aa, Entamoeba histolytica
LESQEVGQT

SEQ ID NO: 2637661 - protein, 9 aa, Entamoeba histolytica
LESQSIDSI

SEQ ID NO: 2637662 - protein, 17 aa, Entamoeba histolytica
LESQYSKYNPKKATVPE

SEQ ID NO: 2637663 - protein, 5 aa, Entamoeba histolytica
LESSN

SEQ ID NO: 2637664 - protein, 7 aa, Entamoeba histolytica
LESSSKP

SEQ ID NO: 2637665 - protein, 10 aa, Entamoeba histolytica
LESYTSKSSL

SEQ ID NO: 2637666 - protein, 4 aa, Entamoeba histolytica
LETA

SEQ ID NO: 2637667 - protein, 17 aa, Entamoeba histolytica
LETELNEKVEEEQNNTT

SEQ ID NO: 2637668 - protein, 7 aa, Entamoeba histolytica
LETESNV

SEQ ID NO: 2637669 - protein, 7 aa, Entamoeba histolytica
LETGDAE

SEQ ID NO: 2637670 - protein, 14 aa, Entamoeba histolytica
LETGKKMSTNIENE

SEQ ID NO: 2637671 - protein, 8 aa, Entamoeba histolytica
LETIPSKN

SEQ ID NO: 2637672 - protein, 10 aa, Entamoeba histolytica
LETKELPAQM

SEQ ID NO: 2637673 - protein, 7 aa, Entamoeba histolytica
LETKEVG

SEQ ID NO: 2637674 - protein, 11 aa, Entamoeba histolytica
LETKNKPSVTI

SEQ ID NO: 2637675 - protein, 13 aa, Entamoeba histolytica
LETMGGSPDDPIC

SEQ ID NO: 2637676 - protein, 9 aa, Entamoeba histolytica
LETNKEKQK

SEQ ID NO: 2637677 - protein, 13 aa, Entamoeba histolytica
LETPRSGNNTPPH

SEQ ID NO: 2637678 - protein, 8 aa, Entamoeba histolytica
LETPSKIK

SEQ ID NO: 2637679 - protein, 8 aa, Entamoeba histolytica
LETQNNNW

SEQ ID NO: 2637680 - protein, 5 aa, Entamoeba histolytica
LETQP

SEQ ID NO: 2637681 - protein, 7 aa, Entamoeba histolytica
LETSQEG

SEQ ID NO: 2637682 - protein, 5 aa, Entamoeba histolytica
LETTT

SEQ ID NO: 2637683 - protein, 4 aa, Entamoeba histolytica
LETY

SEQ ID NO: 2637684 - protein, 9 aa, Entamoeba histolytica
LEVENAEDE

SEQ ID NO: 2637685 - protein, 14 aa, Entamoeba histolytica
LEYDPAKRLTPSEA

SEQ ID NO: 2637686 - protein, 24 aa, Entamoeba histolytica
LEYERKRTKSANENESQSKKELAK

SEQ ID NO: 2637687 - protein, 4 aa, Entamoeba histolytica
LEYY

SEQ ID NO: 2637688 - protein, 10 aa, Entamoeba histolytica
LFEEAENSYH

SEQ ID NO: 2637689 - protein, 6 aa, Entamoeba histolytica
LFEPKE

SEQ ID NO: 2637690 - protein, 12 aa, Entamoeba histolytica
LFEPTKQHEITA

SEQ ID NO: 2637691 - protein, 4 aa, Entamoeba histolytica
LFER

SEQ ID NO: 2637692 - protein, 13 aa, Entamoeba histolytica
LFGGQQNGFGQQQ

SEQ ID NO: 2637693 - protein, 4 aa, Entamoeba histolytica
LFGN

SEQ ID NO: 2637694 - protein, 22 aa, Entamoeba histolytica
LFPSEEEKESVSTNSYSKMEQK

SEQ ID NO: 2637695 - protein, 12 aa, Entamoeba histolytica
LFPTPSQQTQQL

SEQ ID NO: 2637696 - protein, 12 aa, Entamoeba histolytica
LFRKEKKNEYPF

SEQ ID NO: 2637697 - protein, 7 aa, Entamoeba histolytica
LGAPEAV

SEQ ID NO: 2637698 - protein, 5 aa, Entamoeba histolytica
LGAPS

SEQ ID NO: 2637699 - protein, 5 aa, Entamoeba histolytica
LGATI

SEQ ID NO: 2637700 - protein, 12 aa, Entamoeba histolytica
LGCEKKKEEIEK

SEQ ID NO: 2637701 - protein, 16 aa, Entamoeba histolytica
LGDAEGNDDISKDDNG

SEQ ID NO: 2637702 - protein, 4 aa, Entamoeba histolytica
LGDD

SEQ ID NO: 2637703 - protein, 6 aa, Entamoeba histolytica
LGDDGK

SEQ ID NO: 2637704 - protein, 5 aa, Entamoeba histolytica
LGDES

SEQ ID NO: 2637705 - protein, 7 aa, Entamoeba histolytica
LGDGDLD

SEQ ID NO: 2637706 - protein, 10 aa, Entamoeba histolytica
LGDGGEGTMD

SEQ ID NO: 2637707 - protein, 5 aa, Entamoeba histolytica
LGDKD

SEQ ID NO: 2637708 - protein, 14 aa, Entamoeba histolytica
LGDKSLHPPLTNEP

SEQ ID NO: 2637709 - protein, 5 aa, Entamoeba histolytica
LGDNK

SEQ ID NO: 2637710 - protein, 4 aa, Entamoeba histolytica
LGDQ

SEQ ID NO: 2637711 - protein, 8 aa, Entamoeba histolytica
LGDQKEEV

SEQ ID NO: 2637712 - protein, 11 aa, Entamoeba histolytica
LGDRNKTKEIN

SEQ ID NO: 2637713 - protein, 8 aa, Entamoeba histolytica
LGDSENSQ

SEQ ID NO: 2637714 - protein, 9 aa, Entamoeba histolytica
LGDTTGKEY

SEQ ID NO: 2637715 - protein, 7 aa, Entamoeba histolytica
LGDYNNE

SEQ ID NO: 2637716 - protein, 4 aa, Entamoeba histolytica
LGEA

SEQ ID NO: 2637717 - protein, 6 aa, Entamoeba histolytica
LGEDTP

SEQ ID NO: 2637718 - protein, 36 aa, Entamoeba histolytica
LGEENGDENNEENGDENNDENSEEENRDDGNSENME

SEQ ID NO: 2637719 - protein, 6 aa, Entamoeba histolytica
LGEETC

SEQ ID NO: 2637720 - protein, 7 aa, Entamoeba histolytica
LGEGATG

SEQ ID NO: 2637721 - protein, 12 aa, Entamoeba histolytica
LGEGDNIDIPRS

SEQ ID NO: 2637722 - protein, 9 aa, Entamoeba histolytica
LGEGQQGEF

SEQ ID NO: 2637723 - protein, 5 aa, Entamoeba histolytica
LGEGR

SEQ ID NO: 2637724 - protein, 6 aa, Entamoeba histolytica
LGEGSF

SEQ ID NO: 2637725 - protein, 7 aa, Entamoeba histolytica
LGEGSYG

SEQ ID NO: 2637726 - protein, 4 aa, Entamoeba histolytica
LGEI

SEQ ID NO: 2637727 - protein, 10 aa, Entamoeba histolytica
LGEKDEQGKT

SEQ ID NO: 2637728 - protein, 8 aa, Entamoeba histolytica
LGEKNEDV

SEQ ID NO: 2637729 - protein, 53 aa, Entamoeba histolytica; identical to SEQ ID NO: 2442480

SEQ ID NO: 2637730 - protein, 4 aa, Entamoeba histolytica
LGEM

SEQ ID NO: 2637731 - protein, 13 aa, Entamoeba histolytica
LGEPSVLTPESGR

SEQ ID NO: 2637732 - protein, 10 aa, Entamoeba histolytica
LGEQGYEERY

SEQ ID NO: 2637733 - protein, 4 aa, Entamoeba histolytica
LGET

SEQ ID NO: 2637734 - protein, 7 aa, Entamoeba histolytica
LGETITP

SEQ ID NO: 2637735 - protein, 26 aa, Entamoeba histolytica
LGEVDEEQKKLQEAQEEQRKKEWEEI

SEQ ID NO: 2637736 - protein, 18 aa, Entamoeba histolytica
LGFNSGSFKGYKSAVEKV

SEQ ID NO: 2637737 - protein, 15 aa, Entamoeba histolytica
LGFPQGEKKVNTTGD

SEQ ID NO: 2637738 - protein, 17 aa, Entamoeba histolytica
LGGAGQPKIPPAKKLEM

SEQ ID NO: 2637739 - protein, 5 aa, Entamoeba histolytica
LGGAS

SEQ ID NO: 2637740 - protein, 8 aa, Entamoeba histolytica
LGGATSNI

SEQ ID NO: 2637741 - protein, 11 aa, Entamoeba histolytica
LGGDETLKEDI

SEQ ID NO: 2637742 - protein, 4 aa, Entamoeba histolytica
LGGE

SEQ ID NO: 2637743 - protein, 9 aa, Entamoeba histolytica
LGGENNKSM

SEQ ID NO: 2637744 - protein, 5 aa, Entamoeba histolytica
LGGES

SEQ ID NO: 2637745 - protein, 5 aa, Entamoeba histolytica
LGGHD

SEQ ID NO: 2637746 - protein, 17 aa, Entamoeba histolytica
LGGKGGSQPAQKSEGGC

SEQ ID NO: 2637747 - protein, 5 aa, Entamoeba histolytica
LGGNC

SEQ ID NO: 2637748 - protein, 6 aa, Entamoeba histolytica
LGGNEK

SEQ ID NO: 2637749 - protein, 6 aa, Entamoeba histolytica
LGGRKA

SEQ ID NO: 2637750 - protein, 9 aa, Entamoeba histolytica
LGGSGGGHF

SEQ ID NO: 2637751 - protein, 9 aa, Entamoeba histolytica
LGGSKGPIK

SEQ ID NO: 2637752 - protein, 6 aa, Entamoeba histolytica
LGHDPF

SEQ ID NO: 2637753 - protein, 13 aa, Entamoeba histolytica
LGHRRDGEKTDSV

SEQ ID NO: 2637754 - protein, 8 aa, Entamoeba histolytica
LGHSTQSR

SEQ ID NO: 2637755 - protein, 10 aa, Entamoeba histolytica
LGIGSKNRVT

SEQ ID NO: 2637756 - protein, 18 aa, Entamoeba histolytica
LGKCNRKKGKSRKSDYKS

SEQ ID NO: 2637757 - protein, 7 aa, Entamoeba histolytica
LGKDKSK

SEQ ID NO: 2637758 - protein, 8 aa, Entamoeba histolytica
LGKDTVKK

SEQ ID NO: 2637759 - protein, 4 aa, Entamoeba histolytica
LGKE

SEQ ID NO: 2637760 - protein, 4 aa, Entamoeba histolytica
LGKG

SEQ ID NO: 2637761 - protein, 6 aa, Entamoeba histolytica
LGKGTY

SEQ ID NO: 2637762 - protein, 28 aa, Entamoeba histolytica
LGKKDKKEKQEEQNEERKKFKKSSLKRT

SEQ ID NO: 2637763 - protein, 9 aa, Entamoeba histolytica
LGKKEENFQ

SEQ ID NO: 2637764 - protein, 8 aa, Entamoeba histolytica
LGKKRDEL

SEQ ID NO: 2637765 - protein, 5 aa, Entamoeba histolytica
LGKNM

SEQ ID NO: 2637766 - protein, 8 aa, Entamoeba histolytica
LGKNYKQT

SEQ ID NO: 2637767 - protein, 12 aa, Entamoeba histolytica
LGKPNKVTKEQQ

SEQ ID NO: 2637768 - protein, 11 aa, Entamoeba histolytica
LGKQVASDEEM

SEQ ID NO: 2637769 - protein, 10 aa, Entamoeba histolytica
LGKRANHSIT

SEQ ID NO: 2637770 - protein, 9 aa, Entamoeba histolytica
LGKSPQDYG

SEQ ID NO: 2637771 - protein, 7 aa, Entamoeba histolytica
LGKTKHR

SEQ ID NO: 2637772 - protein, 7 aa, Entamoeba histolytica
LGKTNEF

SEQ ID NO: 2637773 - protein, 8 aa, Entamoeba histolytica
LGKYAKKL

SEQ ID NO: 2637774 - protein, 4 aa, Entamoeba histolytica
LGLS

SEQ ID NO: 2637775 - protein, 21 aa, Entamoeba histolytica
LGLSRKSETGEYAAKSTAKTM

SEQ ID NO: 2637776 - protein, 7 aa, Entamoeba histolytica
LGNAAQY

SEQ ID NO: 2637777 - protein, 9 aa, Entamoeba histolytica
LGNCSQKTV

SEQ ID NO: 2637778 - protein, 8 aa, Entamoeba histolytica
LGNDPPQL

SEQ ID NO: 2637779 - protein, 8 aa, Entamoeba histolytica
LGNEDISR

SEQ ID NO: 2637780 - protein, 9 aa, Entamoeba histolytica
LGNENDRQR

SEQ ID NO: 2637781 - protein, 20 aa, Entamoeba histolytica
LGNGNVVNPSDVCGQPSSPG

SEQ ID NO: 2637782 - protein, 6 aa, Entamoeba histolytica
LGNHAT

SEQ ID NO: 2637783 - protein, 6 aa, Entamoeba histolytica
LGNKDA

SEQ ID NO: 2637784 - protein, 9 aa, Entamoeba histolytica
LGNKTKCMR

SEQ ID NO: 2637785 - protein, 6 aa, Entamoeba histolytica
LGNKTV

SEQ ID NO: 2637786 - protein, 4 aa, Entamoeba histolytica
LGNN

SEQ ID NO: 2637787 - protein, 6 aa, Entamoeba histolytica
LGNPQL

SEQ ID NO: 2637788 - protein, 6 aa, Entamoeba histolytica
LGNPQN

SEQ ID NO: 2637789 - protein, 8 aa, Entamoeba histolytica
LGNSDGDI

SEQ ID NO: 2637790 - protein, 8 aa, Entamoeba histolytica
LGNSIQQR

SEQ ID NO: 2637791 - protein, 10 aa, Entamoeba histolytica
LGNSTGGKGR

SEQ ID NO: 2637792 - protein, 16 aa, Entamoeba histolytica
LGNTTGKMKYHALLPN

SEQ ID NO: 2637793 - protein, 7 aa, Entamoeba histolytica
LGPARQA

SEQ ID NO: 2637794 - protein, 6 aa, Entamoeba histolytica
LGPNAL

SEQ ID NO: 2637795 - protein, 5 aa, Entamoeba histolytica
LGPQR

SEQ ID NO: 2637796 - protein, 6 aa, Entamoeba histolytica
LGQGGF

SEQ ID NO: 2637797 - protein, 7 aa, Entamoeba histolytica
LGQGGYG

SEQ ID NO: 2637798 - protein, 7 aa, Entamoeba histolytica
LGQGTTA

SEQ ID NO: 2637799 - protein, 8 aa, Entamoeba histolytica
LGQKRGEC

SEQ ID NO: 2637800 - protein, 13 aa, Entamoeba histolytica
LGQLRSKSECDTQ

SEQ ID NO: 2637801 - protein, 9 aa, Entamoeba histolytica
LGQNTSDIS

SEQ ID NO: 2637802 - protein, 5 aa, Entamoeba histolytica
LGQQL

SEQ ID NO: 2637803 - protein, 6 aa, Entamoeba histolytica
LGRDGG

SEQ ID NO: 2637804 - protein, 9 aa, Entamoeba histolytica
LGREDGKNY

SEQ ID NO: 2637805 - protein, 5 aa, Entamoeba histolytica
LGREE

SEQ ID NO: 2637806 - protein, 12 aa, Entamoeba histolytica
LGREQSRRDDME

SEQ ID NO: 2637807 - protein, 15 aa, Entamoeba histolytica
LGRESSAPSLINRTR

SEQ ID NO: 2637808 - protein, 9 aa, Entamoeba histolytica
LGRGSAKAM

SEQ ID NO: 2637809 - protein, 6 aa, Entamoeba histolytica
LGRNGT

SEQ ID NO: 2637810 - protein, 6 aa, Entamoeba histolytica
LGRPDG

SEQ ID NO: 2637811 - protein, 60 aa, Entamoeba histolytica
LGRRSTTNIPSEDYQQEQPTPPPPPPENLYNETQQSDIGEEDKLNEVPPVPAPRNGLAHD

SEQ ID NO: 2637812 - protein, 7 aa, Entamoeba histolytica
LGRSPST

SEQ ID NO: 2637813 - protein, 6 aa, Entamoeba histolytica
LGRTNT

SEQ ID NO: 2637814 - protein, 13 aa, Entamoeba histolytica
LGRTRHKPTPSEY

SEQ ID NO: 2637815 - protein, 7 aa, Entamoeba histolytica
LGRTTPN

SEQ ID NO: 2637816 - protein, 6 aa, Entamoeba histolytica
LGSAIS

SEQ ID NO: 2637817 - protein, 11 aa, Entamoeba histolytica
LGSATSYEGRY

SEQ ID NO: 2637818 - protein, 52 aa, Entamoeba histolytica
LGSEDLEEIEEEEKEMEEENQNETNSESDKEEKNDNLQTNTKPINEENEEPH

SEQ ID NO: 2637819 - protein, 7 aa, Entamoeba histolytica
LGSFNPK

SEQ ID NO: 2637820 - protein, 4 aa, Entamoeba histolytica
LGSG

SEQ ID NO: 2637821 - protein, 6 aa, Entamoeba histolytica
LGSGGF

SEQ ID NO: 2637822 - protein, 12 aa, Entamoeba histolytica
LGSGLSSSASIE

SEQ ID NO: 2637823 - protein, 6 aa, Entamoeba histolytica
LGSGSF

SEQ ID NO: 2637824 - protein, 5 aa, Entamoeba histolytica
LGSGY

SEQ ID NO: 2637825 - protein, 6 aa, Entamoeba histolytica
LGSKDN

SEQ ID NO: 2637826 - protein, 7 aa, Entamoeba histolytica
LGSLRSQ

SEQ ID NO: 2637827 - protein, 9 aa, Entamoeba histolytica
LGSNAPKTI

SEQ ID NO: 2637828 - protein, 6 aa, Entamoeba histolytica
LGSNEI

SEQ ID NO: 2637829 - protein, 5 aa, Entamoeba histolytica
LGSQI

SEQ ID NO: 2637830 - protein, 4 aa, Entamoeba histolytica
LGSS

SEQ ID NO: 2637831 - protein, 6 aa, Entamoeba histolytica
LGSSAL

SEQ ID NO: 2637832 - protein, 17 aa, Entamoeba histolytica
LGSSGPSTLKKSASGII

SEQ ID NO: 2637833 - protein, 10 aa, Entamoeba histolytica
LGSSHDCARD

SEQ ID NO: 2637834 - protein, 5 aa, Entamoeba histolytica
LGSTE

SEQ ID NO: 2637835 - protein, 9 aa, Entamoeba histolytica
LGSTSDDGR

SEQ ID NO: 2637836 - protein, 6 aa, Entamoeba histolytica
LGTAAC

SEQ ID NO: 2637837 - protein, 15 aa, Entamoeba histolytica
LGTEQKIKDITEASI

SEQ ID NO: 2637838 - protein, 9 aa, Entamoeba histolytica
LGTGNDLSN

SEQ ID NO: 2637839 - protein, 8 aa, Entamoeba histolytica
LGTGNNNK

SEQ ID NO: 2637840 - protein, 6 aa, Entamoeba histolytica
LGTITP

SEQ ID NO: 2637841 - protein, 14 aa, Entamoeba histolytica
LGTKTSDYVSETYG

SEQ ID NO: 2637842 - protein, 6 aa, Entamoeba histolytica
LGTKYI

SEQ ID NO: 2637843 - protein, 7 aa, Entamoeba histolytica
LGTPTED

SEQ ID NO: 2637844 - protein, 4 aa, Entamoeba histolytica
LGTT

SEQ ID NO: 2637845 - protein, 13 aa, Entamoeba histolytica
LGTTIKKQRRPAQ

SEQ ID NO: 2637846 - protein, 7 aa, Entamoeba histolytica
LGTTNPE

SEQ ID NO: 2637847 - protein, 8 aa, Entamoeba histolytica
LGTTTEDI

SEQ ID NO: 2637848 - protein, 24 aa, Entamoeba histolytica
LGWEPQQETTQDNYPNENAEQTMV

SEQ ID NO: 2637849 - protein, 6 aa, Entamoeba histolytica
LGYKSV

SEQ ID NO: 2637850 - protein, 5 aa, Entamoeba histolytica
LGYNG

SEQ ID NO: 2637851 - protein, 4 aa, Entamoeba histolytica
LHEA

SEQ ID NO: 2637852 - protein, 37 aa, Entamoeba histolytica
LHESSPETTSPRTSSFEKSPEKSNEKTDLSKQTERLD

SEQ ID NO: 2637853 - protein, 6 aa, Entamoeba histolytica
LHGESI

SEQ ID NO: 2637854 - protein, 4 aa, Entamoeba histolytica
LHKD

SEQ ID NO: 2637855 - protein, 49 aa, Entamoeba histolytica
LHPDSYEANNYFDPDNEPERVNKPDLINEDYSKTEESIFDDPDYEEYNK

SEQ ID NO: 2637856 - protein, 26 aa, Entamoeba histolytica
LHPDSYQSNNYFDPDNEPERVNKPDL

SEQ ID NO: 2637857 - protein, 26 aa, Entamoeba histolytica
LHPDSYQSSTYFDPDNEPDRVNKPDI

SEQ ID NO: 2637858 - protein, 10 aa, Entamoeba histolytica
LHPKDEQTEH

SEQ ID NO: 2637859 - protein, 4 aa, Entamoeba histolytica
LHPN

SEQ ID NO: 2637860 - protein, 26 aa, Entamoeba histolytica
LHPNSYEANNYFDPDNESERVNKPDL

SEQ ID NO: 2637861 - protein, 13 aa, Entamoeba histolytica
LHPNYQPPHLPEP

SEQ ID NO: 2637862 - protein, 8 aa, Entamoeba histolytica
LHPPISSN

SEQ ID NO: 2637863 - protein, 12 aa, Entamoeba histolytica
LHQKGDSKENEF

SEQ ID NO: 2637864 - protein, 9 aa, Entamoeba histolytica
LHQSSNNES

SEQ ID NO: 2637865 - protein, 10 aa, Entamoeba histolytica
LHRSQQKKEG

SEQ ID NO: 2637866 - protein, 15 aa, Entamoeba histolytica
LHRTKSSASNPSILL

SEQ ID NO: 2637867 - protein, 6 aa, Entamoeba histolytica
LHSESG

SEQ ID NO: 2637868 - protein, 38 aa, Entamoeba histolytica
LHSKDEKTIIKESQKERIAEKEKRENNEKRKLKRKAEE

SEQ ID NO: 2637869 - protein, 19 aa, Entamoeba histolytica
LHSPQSSVESQPKDDMNQK

SEQ ID NO: 2637870 - protein, 5 aa, Entamoeba histolytica
LHSTP

SEQ ID NO: 2637871 - protein, 7 aa, Entamoeba histolytica
LHTAPKQ

SEQ ID NO: 2637872 - protein, 6 aa, Entamoeba histolytica
LHTSHN

SEQ ID NO: 2637873 - protein, 4 aa, Entamoeba histolytica
LIDP

SEQ ID NO: 2637874 - protein, 6 aa, Entamoeba histolytica
LIEETE

SEQ ID NO: 2637875 - protein, 11 aa, Entamoeba histolytica
LIEPGKPSNYT

SEQ ID NO: 2637876 - protein, 6 aa, Entamoeba histolytica
LIESNK

SEQ ID NO: 2637877 - protein, 51 aa, Entamoeba histolytica
LIESQNKYTQINEEKDCVEQERNKINEEYKTVNEELEKNKKELNDLQTKYD

SEQ ID NO: 2637878 - protein, 7 aa, Entamoeba histolytica
LIGDSPE

SEQ ID NO: 2637879 - protein, 8 aa, Entamoeba histolytica
LIGNESSS

SEQ ID NO: 2637880 - protein, 12 aa, Entamoeba histolytica
LIKKTKETMETA

SEQ ID NO: 2637881 - protein, 10 aa, Entamoeba histolytica
LIKNESEGKG

SEQ ID NO: 2637882 - protein, 12 aa, Entamoeba histolytica
LINDTNKSINSH

SEQ ID NO: 2637883 - protein, 29 aa, Entamoeba histolytica
LINEETKKKMEEKRQQLKEKAKENYLDPR

SEQ ID NO: 2637884 - protein, 15 aa, Entamoeba histolytica
LINNTPRGSRKKQYL

SEQ ID NO: 2637885 - protein, 8 aa, Entamoeba histolytica
LINPGEPV

SEQ ID NO: 2637886 - protein, 25 aa, Entamoeba histolytica
LINPKQKHLKNSLNGPQKLTQQSLD

SEQ ID NO: 2637887 - protein, 21 aa, Entamoeba histolytica
LINQRSKSCRTLKENEEADKM

SEQ ID NO: 2637888 - protein, 5 aa, Entamoeba histolytica
LIPEE

SEQ ID NO: 2637889 - protein, 5 aa, Entamoeba histolytica
LIPEK

SEQ ID NO: 2637890 - protein, 9 aa, Entamoeba histolytica
LIPEQKENE

SEQ ID NO: 2637891 - protein, 6 aa, Entamoeba histolytica
LIPKSG

SEQ ID NO: 2637892 - protein, 4 aa, Entamoeba histolytica
LIPN

SEQ ID NO: 2637893 - protein, 5 aa, Entamoeba histolytica
LIPPS

SEQ ID NO: 2637894 - protein, 5 aa, Entamoeba histolytica
LIPTD

SEQ ID NO: 2637895 - protein, 5 aa, Entamoeba histolytica
LIPTP

SEQ ID NO: 2637896 - protein, 15 aa, Entamoeba histolytica
LIQQNDDKQSDKDDL

SEQ ID NO: 2637897 - protein, 5 aa, Entamoeba histolytica
LIRKD

SEQ ID NO: 2637898 - protein, 6 aa, Entamoeba histolytica
LISEED

SEQ ID NO: 2637899 - protein, 11 aa, Entamoeba histolytica
LISGDEVNAPS

SEQ ID NO: 2637900 - protein, 9 aa, Entamoeba histolytica
LISSDNTIP

SEQ ID NO: 2637901 - protein, 29 aa, Entamoeba histolytica
LISSSQEKSTQSPLLDKPQTQAPKPQKKA

SEQ ID NO: 2637902 - protein, 5 aa, Entamoeba histolytica
LITEK

SEQ ID NO: 2637903 - protein, 14 aa, Entamoeba histolytica
LITPTKENQQLFNL

SEQ ID NO: 2637904 - protein, 12 aa, Entamoeba histolytica
LITTPNKNDLQL

SEQ ID NO: 2637905 - protein, 7 aa, Entamoeba histolytica
LKADTEK

SEQ ID NO: 2637906 - protein, 6 aa, Entamoeba histolytica
LKAEDV

SEQ ID NO: 2637907 - protein, 19 aa, Entamoeba histolytica
LKAEKDKEIEDAVKEKDIQ

SEQ ID NO: 2637908 - protein, 8 aa, Entamoeba histolytica
LKAGSLKE

SEQ ID NO: 2637909 - protein, 22 aa, Entamoeba histolytica
LKAKGRPIPPPIKEKKSGKCAL

SEQ ID NO: 2637910 - protein, 8 aa, Entamoeba histolytica
LKAKTLTG

SEQ ID NO: 2637911 - protein, 70 aa, Entamoeba histolytica
  misc_feature (21)..(54): Xaa can be any naturally occurring amino acid
LKANSYEGFDSANYPALAMFXXXXXXXXXXXXXXXXXXXXXXXXXXXXXXXXXXYILFQCFNLQHLLKVF

SEQ ID NO: 2637912 - protein, 19 aa, Entamoeba histolytica
LKANTASNKRNGLNLPPSF

SEQ ID NO: 2637913 - protein, 9 aa, Entamoeba histolytica
LKAQKGNEK

SEQ ID NO: 2637914 - protein, 9 aa, Entamoeba histolytica
LKARSDALN

SEQ ID NO: 2637915 - protein, 9 aa, Entamoeba histolytica
LKASNNPLE

SEQ ID NO: 2637916 - protein, 7 aa, Entamoeba histolytica
LKASSFS

SEQ ID NO: 2637917 - protein, 15 aa, Entamoeba histolytica
LKATGGRRKSFSQQF

SEQ ID NO: 2637918 - protein, 5 aa, Entamoeba histolytica
LKATN

SEQ ID NO: 2637919 - protein, 6 aa, Entamoeba histolytica
LKATRK

SEQ ID NO: 2637920 - protein, 5 aa, Entamoeba histolytica
LKDDA

SEQ ID NO: 2637921 - protein, 5 aa, Entamoeba histolytica
LKDDE

SEQ ID NO: 2637922 - protein, 7 aa, Entamoeba histolytica
LKDDSEI

SEQ ID NO: 2637923 - protein, 17 aa, Entamoeba histolytica
LKDEAKEYRIAQNTETN

SEQ ID NO: 2637924 - protein, 16 aa, Entamoeba histolytica
LKDEATGDDCSGLREK

SEQ ID NO: 2637925 - protein, 9 aa, Entamoeba histolytica
LKDENEEEL

SEQ ID NO: 2637926 - protein, 7 aa, Entamoeba histolytica
LKDESLI

SEQ ID NO: 2637927 - protein, 7 aa, Entamoeba histolytica
LKDKQIE

SEQ ID NO: 2637928 - protein, 7 aa, Entamoeba histolytica
LKDNKEN

SEQ ID NO: 2637929 - protein, 12 aa, Entamoeba histolytica
LKDPEATENDKT

SEQ ID NO: 2637930 - protein, 7 aa, Entamoeba histolytica
LKDRNRC

SEQ ID NO: 2637931 - protein, 6 aa, Entamoeba histolytica
LKDSLT

SEQ ID NO: 2637932 - protein, 21 aa, Entamoeba histolytica
LKDSSTKGNEEQQFGLSPPKV

SEQ ID NO: 2637933 - protein, 7 aa, Entamoeba histolytica
LKDSTSD

SEQ ID NO: 2637934 - protein, 8 aa, Entamoeba histolytica
LKDTHQED

SEQ ID NO: 2637935 - protein, 12 aa, Entamoeba histolytica
LKDTKSKRGDEK

SEQ ID NO: 2637936 - protein, 19 aa, Entamoeba histolytica
LKDVPEEEKEEKVNKAKKY

SEQ ID NO: 2637937 - protein, 19 aa, Entamoeba histolytica
LKEAERKRREEEMKRKQEL

SEQ ID NO: 2637938 - protein, 17 aa, Entamoeba histolytica
LKEAETKKKISHSQELS

SEQ ID NO: 2637939 - protein, 4 aa, Entamoeba histolytica
LKED

SEQ ID NO: 2637940 - protein, 10 aa, Entamoeba histolytica
LKEDEDKVPQ

SEQ ID NO: 2637941 - protein, 10 aa, Entamoeba histolytica
LKEDKKNYNH

SEQ ID NO: 2637942 - protein, 12 aa, Entamoeba histolytica
LKEDNSNRTTHQ

SEQ ID NO: 2637943 - protein, 7 aa, Entamoeba histolytica
LKEDSSW

SEQ ID NO: 2637944 - protein, 26 aa, Entamoeba histolytica
LKEEAQKKKEKLQKGQKKLHEEEDEE

SEQ ID NO: 2637945 - protein, 15 aa, Entamoeba histolytica
LKEEDKALASEAQKR

SEQ ID NO: 2637946 - protein, 62 aa, Entamoeba histolytica
LKEEEEKKKATKRETKLTKKELEELEKQKKTEEEEEKRKQKEEEERKKKEELKKQKEEEERI

SEQ ID NO: 2637947 - protein, 20 aa, Entamoeba histolytica
LKEEEKLKNEKEKKENRKRC

SEQ ID NO: 2637948 - protein, 24 aa, Entamoeba histolytica
LKEEEKNMNNITEEELEDKSQPLS

SEQ ID NO: 2637949 - protein, 307 aa, Entamoeba histolytica
LKEEEKRKKEEEKKKKEEEKKKKKEEEKKKKEEEKRKKEEEKKRKEEEKKHRDHKHDDKKHEEKDENDKKLKKAEEEKKKKAEEEDRQKAEEEEKKKKAEEARQKAEEEAKQKAEEEAKQKAEEEAKQKAEEEAKQKAEEEAKQKAEEEEKKKKAEEEEAKQKAEEEEAKQKAEEEAKQKAEEEAKQKAEEEEKKKKAEEEAKQKAEEEAKQKAEEEAKQKAEEAKKKAEEEEAKKKAEEEEKKKKAEEEAKQKAEEEAKQKAEEEAKQRAEEEAKQKAEEEAKKKAEEEEAKTLNTCKPNGIGQSA

SEQ ID NO: 2637950 - protein, 15 aa, Entamoeba histolytica
LKEEEKSKMKKIDEV

SEQ ID NO: 2637951 - protein, 6 aa, Entamoeba histolytica
LKEEEQ

SEQ ID NO: 2637952 - protein, 153 aa, Entamoeba histolytica
LKEEERRKKEEELKRKQEEEKRKAEAERKRKEEEERKRKEEEERKRKEEEKRKAEEERKRKEEELRKKKEAEEKKRKLEEEHKKKEEELRKKKEEEEKRRQEEEKRKAEEERKRKEEEEKARKEEEERIKREEEERKKQEEEERKKKEEEELR

SEQ ID NO: 2637953 - protein, 8 aa, Entamoeba histolytica
LKEEKDSM

SEQ ID NO: 2637954 - protein, 13 aa, Entamoeba histolytica
LKEEKEKSTPEIN

SEQ ID NO: 2637955 - protein, 13 aa, Entamoeba histolytica
LKEEKENKSEIND

SEQ ID NO: 2637956 - protein, 12 aa, Entamoeba histolytica
LKEEKENTPEIN

SEQ ID NO: 2637957 - protein, 16 aa, Entamoeba histolytica
LKEEKENTPEVEPNVP

SEQ ID NO: 2637958 - protein, 14 aa, Entamoeba histolytica
LKEEKENTSEEENV

SEQ ID NO: 2637959 - protein, 14 aa, Entamoeba histolytica
LKEEKFEEEELNPL

SEQ ID NO: 2637960 - protein, 11 aa, Entamoeba histolytica
LKEEKGTVSTR

SEQ ID NO: 2637961 - protein, 15 aa, Entamoeba histolytica
LKEEKKGKSGKTYQK

SEQ ID NO: 2637962 - protein, 29 aa, Entamoeba histolytica
LKEEKKVDKEEEKKLRKEHKKQYKIERRE

SEQ ID NO: 2637963 - protein, 23 aa, Entamoeba histolytica
LKEELSQGVSRKTAQRRSENYKI

SEQ ID NO: 2637964 - protein, 12 aa, Entamoeba histolytica
LKEENDKKFKEE

SEQ ID NO: 2637965 - protein, 19 aa, Entamoeba histolytica
LKEENEIKVKEEPKENKNV

SEQ ID NO: 2637966 - protein, 21 aa, Entamoeba histolytica
LKEEPPEKKNELSIKDDGKDF

SEQ ID NO: 2637967 - protein, 12 aa, Entamoeba histolytica
LKEEREVTQEDA

SEQ ID NO: 2637968 - protein, 5 aa, Entamoeba histolytica
LKEES

SEQ ID NO: 2637969 - protein, 19 aa, Entamoeba histolytica
LKEESDDKKVKEKNKDLKD

SEQ ID NO: 2637970 - protein, 6 aa, Entamoeba histolytica
LKEETL

SEQ ID NO: 2637971 - protein, 5 aa, Entamoeba histolytica
LKEGD

SEQ ID NO: 2637972 - protein, 6 aa, Entamoeba histolytica
LKEGEV

SEQ ID NO: 2637973 - protein, 14 aa, Entamoeba histolytica
LKEGNENNNGLSGI

SEQ ID NO: 2637974 - protein, 6 aa, Entamoeba histolytica
LKEGNM

SEQ ID NO: 2637975 - protein, 8 aa, Entamoeba histolytica
LKEGTQDE

SEQ ID NO: 2637976 - protein, 13 aa, Entamoeba histolytica
LKEGYGEYINDEQ

SEQ ID NO: 2637977 - protein, 8 aa, Entamoeba histolytica
LKEIKDNK

SEQ ID NO: 2637978 - protein, 9 aa, Entamoeba histolytica
LKEKEEGNI

SEQ ID NO: 2637979 - protein, 31 aa, Entamoeba histolytica
LKEKEESNNQYQQINEEMKEKLKEKENEIKI

SEQ ID NO: 2637980 - protein, 8 aa, Entamoeba histolytica
LKEKENAI

SEQ ID NO: 2637981 - protein, 10 aa, Entamoeba histolytica
LKEKEPFTYG

SEQ ID NO: 2637982 - protein, 10 aa, Entamoeba histolytica
LKEKEQKQLQ

SEQ ID NO: 2637983 - protein, 10 aa, Entamoeba histolytica
LKEKGSFTLK

SEQ ID NO: 2637984 - protein, 37 aa, Entamoeba histolytica
LKEKKGTKKTNMSKKTHPTDEEDENSEKEKQTSQEKI

SEQ ID NO: 2637985 - protein, 20 aa, Entamoeba histolytica
LKEKNENKQIKEENVNKKEE

SEQ ID NO: 2637986 - protein, 28 aa, Entamoeba histolytica
LKEKRKSNETISAQRDKWTINGKEEALK

SEQ ID NO: 2637987 - protein, 7 aa, Entamoeba histolytica
LKEKRRE

SEQ ID NO: 2637988 - protein, 12 aa, Entamoeba histolytica
LKEKSTDEQELY

SEQ ID NO: 2637989 - protein, 8 aa, Entamoeba histolytica
LKEKYGDN

SEQ ID NO: 2637990 - protein, 9 aa, Entamoeba histolytica
LKELKDSTF

SEQ ID NO: 2637991 - protein, 10 aa, Entamoeba histolytica
LKELKEKDPD

SEQ ID NO: 2637992 - protein, 10 aa, Entamoeba histolytica
LKELPKPKEL

SEQ ID NO: 2637993 - protein, 5 aa, Entamoeba histolytica
LKELQ

SEQ ID NO: 2637994 - protein, 5 aa, Entamoeba histolytica
LKENE

SEQ ID NO: 2637995 - protein, 24 aa, Entamoeba histolytica
LKENECHKESRPINSKKKTGNGLN

SEQ ID NO: 2637996 - protein, 9 aa, Entamoeba histolytica
LKENKERIE

SEQ ID NO: 2637997 - protein, 10 aa, Entamoeba histolytica
LKENKPPTRL

SEQ ID NO: 2637998 - protein, 11 aa, Entamoeba histolytica
LKENKYKPKEM

SEQ ID NO: 2637999 - protein, 14 aa, Entamoeba histolytica
LKENQDKVKNNENF

SEQ ID NO: 2638000 - protein, 22 aa, Entamoeba histolytica
LKENQNTDQPRENNGVLKQQTE

SEQ ID NO: 2638001 - protein, 11 aa, Entamoeba histolytica
LKENSGNNFIG

SEQ ID NO: 2638002 - protein, 5 aa, Entamoeba histolytica
LKENY

SEQ ID NO: 2638003 - protein, 4 aa, Entamoeba histolytica
LKEP

SEQ ID NO: 2638004 - protein, 10 aa, Entamoeba histolytica
LKEPKEAFRQ

SEQ ID NO: 2638005 - protein, 18 aa, Entamoeba histolytica
LKEQERINKEIKEKEVKE

SEQ ID NO: 2638006 - protein, 13 aa, Entamoeba histolytica
LKEQFSQGNLFIS

SEQ ID NO: 2638007 - protein, 28 aa, Entamoeba histolytica
LKEQKAKEENENKEHQIEEEKVQEKEIE

SEQ ID NO: 2638008 - protein, 17 aa, Entamoeba histolytica
LKEQLKDDFKREEIRTT

SEQ ID NO: 2638009 - protein, 6 aa, Entamoeba histolytica
LKEQNE

SEQ ID NO: 2638010 - protein, 13 aa, Entamoeba histolytica
LKEQRKKYSFSQA

SEQ ID NO: 2638011 - protein, 5 aa, Entamoeba histolytica
LKEQS

SEQ ID NO: 2638012 - protein, 7 aa, Entamoeba histolytica
LKEQSQL

SEQ ID NO: 2638013 - protein, 8 aa, Entamoeba histolytica
LKEQTKVH

SEQ ID NO: 2638014 - protein, 7 aa, Entamoeba histolytica
LKEQTQK

SEQ ID NO: 2638015 - protein, 8 aa, Entamoeba histolytica
LKERDDEI

SEQ ID NO: 2638016 - protein, 7 aa, Entamoeba histolytica
LKERGEG

SEQ ID NO: 2638017 - protein, 36 aa, Entamoeba histolytica
LKERKHSDFTKPLNPKSLSNSQNSQHTSSDEPVPLK

SEQ ID NO: 2638018 - protein, 13 aa, Entamoeba histolytica
LKESDEEKQRKYQ

SEQ ID NO: 2638019 - protein, 43 aa, Entamoeba histolytica
LKESGDSNEKEEEEKEEDNDLKEQKSDSDISLNSDDEKVATAN

SEQ ID NO: 2638020 - protein, 8 aa, Entamoeba histolytica
LKESISQE

SEQ ID NO: 2638021 - protein, 9 aa, Entamoeba histolytica
LKESKKKNA

SEQ ID NO: 2638022 - protein, 12 aa, Entamoeba histolytica
LKESKKNENQVI

SEQ ID NO: 2638023 - protein, 6 aa, Entamoeba histolytica
LKESNK

SEQ ID NO: 2638024 - protein, 6 aa, Entamoeba histolytica
LKESPE

SEQ ID NO: 2638025 - protein, 7 aa, Entamoeba histolytica
LKESQCG

SEQ ID NO: 2638026 - protein, 6 aa, Entamoeba histolytica
LKESQI

SEQ ID NO: 2638027 - protein, 11 aa, Entamoeba histolytica
LKESTDKSIQE

SEQ ID NO: 2638028 - protein, 6 aa, Entamoeba histolytica
LKETDD

SEQ ID NO: 2638029 - protein, 10 aa, Entamoeba histolytica
LKETKPGELP

SEQ ID NO: 2638030 - protein, 7 aa, Entamoeba histolytica
LKETRTN

SEQ ID NO: 2638031 - protein, 5 aa, Entamoeba histolytica
LKETS

SEQ ID NO: 2638032 - protein, 40 aa, Entamoeba histolytica; identical to SEQ ID NO: 2442789

SEQ ID NO: 2638033 - protein, 9 aa, Entamoeba histolytica
LKFSSTKDE

SEQ ID NO: 2638034 - protein, 4 aa, Entamoeba histolytica
LKGD

SEQ ID NO: 2638035 - protein, 10 aa, Entamoeba histolytica
LKGDENYLAP

SEQ ID NO: 2638036 - protein, 21 aa, Entamoeba histolytica
LKGDLKDSKLKGEDLEDEITE

SEQ ID NO: 2638037 - protein, 4 aa, Entamoeba histolytica
LKGE

SEQ ID NO: 2638038 - protein, 5 aa, Entamoeba histolytica
LKGES

SEQ ID NO: 2638039 - protein, 7 aa, Entamoeba histolytica
LKGETPL

SEQ ID NO: 2638040 - protein, 14 aa, Entamoeba histolytica
LKGGGQTVDPPEPN

SEQ ID NO: 2638041 - protein, 11 aa, Entamoeba histolytica
LKGGNPEKTGL

SEQ ID NO: 2638042 - protein, 9 aa, Entamoeba histolytica
LKGKAKTKL

SEQ ID NO: 2638043 - protein, 5 aa, Entamoeba histolytica
LKGKE

SEQ ID NO: 2638044 - protein, 30 aa, Entamoeba histolytica
LKGKKVGEENKAEEIKEEKPKEPSQPLPVE

SEQ ID NO: 2638045 - protein, 14 aa, Entamoeba histolytica
LKGKPYKDIGGEPY

SEQ ID NO: 2638046 - protein, 5 aa, Entamoeba histolytica
LKGKQ

SEQ ID NO: 2638047 - protein, 7 aa, Entamoeba histolytica
LKGKTDV

SEQ ID NO: 2638048 - protein, 19 aa, Entamoeba histolytica
LKGLEKEMEREKRRDVTES

SEQ ID NO: 2638049 - protein, 4 aa, Entamoeba histolytica
LKGN

SEQ ID NO: 2638050 - protein, 46 aa, Entamoeba histolytica
LKGNEIKEIENEENEENEEHERNEGKKEEARDSEDLADYKDELAQI

SEQ ID NO: 2638051 - protein, 7 aa, Entamoeba histolytica
LKGNLDD

SEQ ID NO: 2638052 - protein, 9 aa, Entamoeba histolytica
LKGNTEAET

SEQ ID NO: 2638053 - protein, 9 aa, Entamoeba histolytica
LKGPNQTDL

SEQ ID NO: 2638054 - protein, 5 aa, Entamoeba histolytica
LKGQP

SEQ ID NO: 2638055 - protein, 8 aa, Entamoeba histolytica
LKGRASLP

SEQ ID NO: 2638056 - protein, 6 aa, Entamoeba histolytica
LKGSPL

SEQ ID NO: 2638057 - protein, 7 aa, Entamoeba histolytica
LKGSSTS

SEQ ID NO: 2638058 - protein, 9 aa, Entamoeba histolytica
LKGTNKEKI

SEQ ID NO: 2638059 - protein, 10 aa, Entamoeba histolytica
LKHEENNKKE

SEQ ID NO: 2638060 - protein, 10 aa, Entamoeba histolytica
LKHEKSVNEL

SEQ ID NO: 2638061 - protein, 4 aa, Entamoeba histolytica
LKHP

SEQ ID NO: 2638062 - protein, 15 aa, Entamoeba histolytica
LKHSHDKSSKKLVCF

SEQ ID NO: 2638063 - protein, 7 aa, Entamoeba histolytica
LKIPGPL

SEQ ID NO: 2638064 - protein, 4 aa, Entamoeba histolytica
LKIQ

SEQ ID NO: 2638065 - protein, 20 aa, Entamoeba histolytica
LKIQKKENKNIVSIIIQTDD

SEQ ID NO: 2638066 - protein, 36 aa, Entamoeba histolytica
LKIQRKKSSKSSSSSEEITASKTPQKTFKPAKQQGK

SEQ ID NO: 2638067 - protein, 11 aa, Entamoeba histolytica
LKKAAASFTGG

SEQ ID NO: 2638068 - protein, 8 aa, Entamoeba histolytica
LKKAETKD

SEQ ID NO: 2638069 - protein, 7 aa, Entamoeba histolytica
LKKAGIR

SEQ ID NO: 2638070 - protein, 19 aa, Entamoeba histolytica
LKKASSSYSKLPDAGRSST

SEQ ID NO: 2638071 - protein, 16 aa, Entamoeba histolytica
LKKCNKGSVEQKDGQK

SEQ ID NO: 2638072 - protein, 6 aa, Entamoeba histolytica
LKKDEE

SEQ ID NO: 2638073 - protein, 6 aa, Entamoeba histolytica
LKKDKE

SEQ ID NO: 2638074 - protein, 8 aa, Entamoeba histolytica
LKKEAERV

SEQ ID NO: 2638075 - protein, 32 aa, Entamoeba histolytica
LKKEEEKKKREEERRKKKEEKKEKKIETVDEG

SEQ ID NO: 2638076 - protein, 13 aa, Entamoeba histolytica
LKKEEQESKQRQL

SEQ ID NO: 2638077 - protein, 8 aa, Entamoeba histolytica
LKKEEVKE

SEQ ID NO: 2638078 - protein, 9 aa, Entamoeba histolytica
LKKEGVDEL

SEQ ID NO: 2638079 - protein, 20 aa, Entamoeba histolytica
LKKEIDNKKTLVKPKRSRPL

SEQ ID NO: 2638080 - protein, 12 aa, Entamoeba histolytica
LKKEKEQLTNEV

SEQ ID NO: 2638081 - protein, 5 aa, Entamoeba histolytica
LKKEN

SEQ ID NO: 2638082 - protein, 12 aa, Entamoeba histolytica
LKKENEENGNAY

SEQ ID NO: 2638083 - protein, 15 aa, Entamoeba histolytica
LKKEQLQETNNVNRD

SEQ ID NO: 2638084 - protein, 10 aa, Entamoeba histolytica
LKKEQNNKGH

SEQ ID NO: 2638085 - protein, 9 aa, Entamoeba histolytica
LKKERTEKQ

SEQ ID NO: 2638086 - protein, 11 aa, Entamoeba histolytica
LKKESSGGKSF

SEQ ID NO: 2638087 - protein, 8 aa, Entamoeba histolytica
LKKETKGF

SEQ ID NO: 2638088 - protein, 5 aa, Entamoeba histolytica
LKKEW

SEQ ID NO: 2638089 - protein, 8 aa, Entamoeba histolytica
LKKGDKRK

SEQ ID NO: 2638090 - protein, 42 aa, Entamoeba histolytica
LKKGKEVHGISKDDLKSSNLSFGSSELKSNQKKKSSLSDSSL

SEQ ID NO: 2638091 - protein, 10 aa, Entamoeba histolytica
LKKGKISVSY

SEQ ID NO: 2638092 - protein, 24 aa, Entamoeba histolytica
LKKGKKTSFFGKKDEAQQEAERSQ

SEQ ID NO: 2638093 - protein, 8 aa, Entamoeba histolytica
LKKKETTL

SEQ ID NO: 2638094 - protein, 9 aa, Entamoeba histolytica
LKKKGEKFR

SEQ ID NO: 2638095 - protein, 26 aa, Entamoeba histolytica
LKKKKREQQMATTPTSNFVSGTNYIP

SEQ ID NO: 2638096 - protein, 5 aa, Entamoeba histolytica
LKKKN

SEQ ID NO: 2638097 - protein, 9 aa, Entamoeba histolytica
LKKKQISSE

SEQ ID NO: 2638098 - protein, 10 aa, Entamoeba histolytica
LKKKRTKKLS

SEQ ID NO: 2638099 - protein, 7 aa, Entamoeba histolytica
LKKKSED

SEQ ID NO: 2638100 - protein, 10 aa, Entamoeba histolytica
LKKKTTPPYQ

SEQ ID NO: 2638101 - protein, 5 aa, Entamoeba histolytica
LKKLT

SEQ ID NO: 2638102 - protein, 4 aa, Entamoeba histolytica
LKKN

SEQ ID NO: 2638103 - protein, 8 aa, Entamoeba histolytica
LKKNEDEH

SEQ ID NO: 2638104 - protein, 5 aa, Entamoeba histolytica
LKKNQ

SEQ ID NO: 2638105 - protein, 10 aa, Entamoeba histolytica
LKKNTENVGS

SEQ ID NO: 2638106 - protein, 7 aa, Entamoeba histolytica
LKKNVSK

SEQ ID NO: 2638107 - protein, 15 aa, Entamoeba histolytica
LKKPIKEAKKNEINE

SEQ ID NO: 2638108 - protein, 7 aa, Entamoeba histolytica
LKKPKDV

SEQ ID NO: 2638109 - protein, 25 aa, Entamoeba histolytica
LKKPKKNAVTPKKKKKSQKKRVFEK

SEQ ID NO: 2638110 - protein, 10 aa, Entamoeba histolytica
LKKQGKDLVK

SEQ ID NO: 2638111 - protein, 11 aa, Entamoeba histolytica
LKKQRKVSALE

SEQ ID NO: 2638112 - protein, 32 aa, Entamoeba histolytica
LKKRKEREDRLDRLEKKKKEEETKPERRKTRP

SEQ ID NO: 2638113 - protein, 8 aa, Entamoeba histolytica
LKKRRKAL

SEQ ID NO: 2638114 - protein, 9 aa, Entamoeba histolytica
LKKRSNGKY

SEQ ID NO: 2638115 - protein, 9 aa, Entamoeba histolytica
LKKSAKRQL

SEQ ID NO: 2638116 - protein, 6 aa, Entamoeba histolytica
LKKSGS

SEQ ID NO: 2638117 - protein, 10 aa, Entamoeba histolytica
LKKSKGVKEL

SEQ ID NO: 2638118 - protein, 7 aa, Entamoeba histolytica
LKKSKRI

SEQ ID NO: 2638119 - protein, 9 aa, Entamoeba histolytica
LKKSKSENL

SEQ ID NO: 2638120 - protein, 6 aa, Entamoeba histolytica
LKKSNN

SEQ ID NO: 2638121 - protein, 9 aa, Entamoeba histolytica
LKKSRPVGL

SEQ ID NO: 2638122 - protein, 10 aa, Entamoeba histolytica
LKKSSTKAGV

SEQ ID NO: 2638123 - protein, 12 aa, Entamoeba histolytica
LKKTKQRNNELE

SEQ ID NO: 2638124 - protein, 9 aa, Entamoeba histolytica
LKLDNNQDL

SEQ ID NO: 2638125 - protein, 14 aa, Entamoeba histolytica
LKLPQSSADKINYN

SEQ ID NO: 2638126 - protein, 8 aa, Entamoeba histolytica
LKLQKGKT

SEQ ID NO: 2638127 - protein, 6 aa, Entamoeba histolytica
LKMSES

SEQ ID NO: 2638128 - protein, 4 aa, Entamoeba histolytica
LKND

SEQ ID NO: 2638129 - protein, 11 aa, Entamoeba histolytica
LKNDRDQGFPV

SEQ ID NO: 2638130 - protein, 14 aa, Entamoeba histolytica
LKNEENKQTKSPIK

SEQ ID NO: 2638131 - protein, 9 aa, Entamoeba histolytica
LKNEEPKNH

SEQ ID NO: 2638132 - protein, 8 aa, Entamoeba histolytica
LKNEKEDL

SEQ ID NO: 2638133 - protein, 9 aa, Entamoeba histolytica
LKNEKERKD

SEQ ID NO: 2638134 - protein, 11 aa, Entamoeba histolytica
LKNERNEKEAF

SEQ ID NO: 2638135 - protein, 16 aa, Entamoeba histolytica
LKNETKEEQNDSLSEL

SEQ ID NO: 2638136 - protein, 10 aa, Entamoeba histolytica
LKNEVSPEIA

SEQ ID NO: 2638137 - protein, 9 aa, Entamoeba histolytica
LKNGKSKKL

SEQ ID NO: 2638138 - protein, 7 aa, Entamoeba histolytica
LKNGQYD

SEQ ID NO: 2638139 - protein, 9 aa, Entamoeba histolytica
LKNGSDEKR

SEQ ID NO: 2638140 - protein, 22 aa, Entamoeba histolytica
LKNKESQVRRNTLGEEETTEEQ

SEQ ID NO: 2638141 - protein, 15 aa, Entamoeba histolytica
LKNKNTSIEGNRTKT

SEQ ID NO: 2638142 - protein, 4 aa, Entamoeba histolytica
LKNN

SEQ ID NO: 2638143 - protein, 9 aa, Entamoeba histolytica
LKNNKLVGK

SEQ ID NO: 2638144 - protein, 9 aa, Entamoeba histolytica
LKNNNTENT

SEQ ID NO: 2638145 - protein, 5 aa, Entamoeba histolytica
LKNNQ

SEQ ID NO: 2638146 - protein, 11 aa, Entamoeba histolytica
LKNQAKKEKEA

SEQ ID NO: 2638147 - protein, 9 aa, Entamoeba histolytica
LKNQKKDGN

SEQ ID NO: 2638148 - protein, 7 aa, Entamoeba histolytica
LKNRNDA

SEQ ID NO: 2638149 - protein, 9 aa, Entamoeba histolytica
LKNSRKEFT

SEQ ID NO: 2638150 - protein, 15 aa, Entamoeba histolytica
LKNSTNQSGEKKMEE

SEQ ID NO: 2638151 - protein, 8 aa, Entamoeba histolytica
LKNTKTGV

SEQ ID NO: 2638152 - protein, 7 aa, Entamoeba histolytica
LKNTKTI

SEQ ID NO: 2638153 - protein, 8 aa, Entamoeba histolytica
LKPDEEEK

SEQ ID NO: 2638154 - protein, 6 aa, Entamoeba histolytica
LKPDEY

SEQ ID NO: 2638155 - protein, 6 aa, Entamoeba histolytica
LKPETV

SEQ ID NO: 2638156 - protein, 9 aa, Entamoeba histolytica
LKPGDIPAE

SEQ ID NO: 2638157 - protein, 13 aa, Entamoeba histolytica
LKPGDKTLYDNNT

SEQ ID NO: 2638158 - protein, 16 aa, Entamoeba histolytica
LKPGESTTVSTSNGEA

SEQ ID NO: 2638159 - protein, 11 aa, Entamoeba histolytica
LKPIENSDRRK

SEQ ID NO: 2638160 - protein, 6 aa, Entamoeba histolytica
LKPINE

SEQ ID NO: 2638161 - protein, 7 aa, Entamoeba histolytica
LKPITEE

SEQ ID NO: 2638162 - protein, 14 aa, Entamoeba histolytica
LKPKGRTGVSPKSA

SEQ ID NO: 2638163 - protein, 8 aa, Entamoeba histolytica
LKPKHEKG

SEQ ID NO: 2638164 - protein, 10 aa, Entamoeba histolytica
LKPKSVESQQ

SEQ ID NO: 2638165 - protein, 9 aa, Entamoeba histolytica
LKPKTIKQP

SEQ ID NO: 2638166 - protein, 7 aa, Entamoeba histolytica
LKPMKSK

SEQ ID NO: 2638167 - protein, 4 aa, Entamoeba histolytica
LKPN

SEQ ID NO: 2638168 - protein, 6 aa, Entamoeba histolytica
LKPNEL

SEQ ID NO: 2638169 - protein, 22 aa, Entamoeba histolytica
LKPSASKHYKTLTKPPINSTDP

SEQ ID NO: 2638170 - protein, 12 aa, Entamoeba histolytica
LKPSDNTNEEDK

SEQ ID NO: 2638171 - protein, 7 aa, Entamoeba histolytica
LKPSEME

SEQ ID NO: 2638172 - protein, 13 aa, Entamoeba histolytica
LKPSFTLKQVLMI

SEQ ID NO: 2638173 - protein, 6 aa, Entamoeba histolytica
LKPTAM

SEQ ID NO: 2638174 - protein, 8 aa, Entamoeba histolytica
LKPTKTIP

SEQ ID NO: 2638175 - protein, 9 aa, Entamoeba histolytica
LKPTSEQPH

SEQ ID NO: 2638176 - protein, 8 aa, Entamoeba histolytica
LKPYDRNE

SEQ ID NO: 2638177 - protein, 8 aa, Entamoeba histolytica
LKQAESIK

SEQ ID NO: 2638178 - protein, 9 aa, Entamoeba histolytica
LKQDGRKTF

SEQ ID NO: 2638179 - protein, 8 aa, Entamoeba histolytica
LKQEESKY

SEQ ID NO: 2638180 - protein, 15 aa, Entamoeba histolytica
LKQEKEEKENELKEQ

SEQ ID NO: 2638181 - protein, 10 aa, Entamoeba histolytica
LKQEKENKEN

SEQ ID NO: 2638182 - protein, 39 aa, Entamoeba histolytica
LKQENEGLKQENEGLKQENEGLKQENEELNNKTKELEND

SEQ ID NO: 2638183 - protein, 4 aa, Entamoeba histolytica
LKQG

SEQ ID NO: 2638184 - protein, 27 aa, Entamoeba histolytica
LKQGPSDDRTSQWKERNFTNSQPPFPL

SEQ ID NO: 2638185 - protein, 9 aa, Entamoeba histolytica
LKQINSDNK

SEQ ID NO: 2638186 - protein, 9 aa, Entamoeba histolytica
LKQKEQSKQ

SEQ ID NO: 2638187 - protein, 8 aa, Entamoeba histolytica
LKQKRRDG

SEQ ID NO: 2638188 - protein, 9 aa, Entamoeba histolytica
LKQNGDECR

SEQ ID NO: 2638189 - protein, 16 aa, Entamoeba histolytica
LKQNKNINDNQQKQLQ

SEQ ID NO: 2638190 - protein, 15 aa, Entamoeba histolytica
LKQNTVTELTSQGKQ

SEQ ID NO: 2638191 - protein, 7 aa, Entamoeba histolytica
LKQPSPL

SEQ ID NO: 2638192 - protein, 18 aa, Entamoeba histolytica
LKQPTPSLDESTESESPF

SEQ ID NO: 2638193 - protein, 138 aa, Entamoeba histolytica
LKQQEEEKLKQQEEAARLKREEEVKKKEEEAKKKEELEKKKKEDEIKKKSNTSDNLKKQQEAEKRKEEEIKKKKEEEERKKKEEEKKKAEKEKRKKQELKEKEKEKKEKEKEKKEKEKEKKKKEEEKKKKEKEKQKAK

SEQ ID NO: 2638194 - protein, 7 aa, Entamoeba histolytica
LKQQINS

SEQ ID NO: 2638195 - protein, 44 aa, Entamoeba histolytica
LKQQKDEKGEKPNEEKKDIKKEETKTDEQTQQDFNQEENEEEKL

SEQ ID NO: 2638196 - protein, 14 aa, Entamoeba histolytica
LKQQQQQQEPVTEE

SEQ ID NO: 2638197 - protein, 15 aa, Entamoeba histolytica
LKQQQVNKNEPLPDV

SEQ ID NO: 2638198 - protein, 9 aa, Entamoeba histolytica
LKQSEMNKL

SEQ ID NO: 2638199 - protein, 16 aa, Entamoeba histolytica
LKQSNEKIDKLSEEQI

SEQ ID NO: 2638200 - protein, 30 aa, Entamoeba histolytica; identical to SEQ ID NO: 2442971

SEQ ID NO: 2638201 - protein, 10 aa, Entamoeba histolytica
LKQTKHAEKT

SEQ ID NO: 2638202 - protein, 7 aa, Entamoeba histolytica
LKQTQKN

SEQ ID NO: 2638203 - protein, 15 aa, Entamoeba histolytica
LKQYGDKSVSQTSQV

SEQ ID NO: 2638204 - protein, 9 aa, Entamoeba histolytica
LKRAKEDGY

SEQ ID NO: 2638205 - protein, 17 aa, Entamoeba histolytica
LKREEEQWEEQFYDEQG

SEQ ID NO: 2638206 - protein, 10 aa, Entamoeba histolytica
LKRGKCNSQI

SEQ ID NO: 2638207 - protein, 5 aa, Entamoeba histolytica
LKRGQ

SEQ ID NO: 2638208 - protein, 7 aa, Entamoeba histolytica
LKRGSMD

SEQ ID NO: 2638209 - protein, 18 aa, Entamoeba histolytica
LKRGSMDNHTAIVVFFKW

SEQ ID NO: 2638210 - protein, 11 aa, Entamoeba histolytica
LKRHSDKNRVS

SEQ ID NO: 2638211 - protein, 6 aa, Entamoeba histolytica
LKRKES

SEQ ID NO: 2638212 - protein, 12 aa, Entamoeba histolytica
LKRKGPYEALRS

SEQ ID NO: 2638213 - protein, 11 aa, Entamoeba histolytica
LKRKSQKPSEI

SEQ ID NO: 2638214 - protein, 4 aa, Entamoeba histolytica
LKRN

SEQ ID NO: 2638215 - protein, 9 aa, Entamoeba histolytica
LKRNDKNKI

SEQ ID NO: 2638216 - protein, 6 aa, Entamoeba histolytica
LKRNDQ

SEQ ID NO: 2638217 - protein, 14 aa, Entamoeba histolytica
LKRNENNSSMIVYL

SEQ ID NO: 2638218 - protein, 17 aa, Entamoeba histolytica
LKRREKERKAREEQRIK

SEQ ID NO: 2638219 - protein, 5 aa, Entamoeba histolytica
LKRRK

SEQ ID NO: 2638220 - protein, 10 aa, Entamoeba histolytica
LKRRSTGQMG

SEQ ID NO: 2638221 - protein, 8 aa, Entamoeba histolytica
LKRSDDKD

SEQ ID NO: 2638222 - protein, 9 aa, Entamoeba histolytica
LKRSSKTFE

SEQ ID NO: 2638223 - protein, 8 aa, Entamoeba histolytica
LKRSSVTR

SEQ ID NO: 2638224 - protein, 9 aa, Entamoeba histolytica
LKRTEGHKI

SEQ ID NO: 2638225 - protein, 13 aa, Entamoeba histolytica
LKRTRESSGTQRR

SEQ ID NO: 2638226 - protein, 8 aa, Entamoeba histolytica
LKRTSDVQ

SEQ ID NO: 2638227 - protein, 7 aa, Entamoeba histolytica
LKRTSVT

SEQ ID NO: 2638228 - protein, 8 aa, Entamoeba histolytica
LKSAAPAL

SEQ ID NO: 2638229 - protein, 7 aa, Entamoeba histolytica
LKSDNND

SEQ ID NO: 2638230 - protein, 7 aa, Entamoeba histolytica
LKSDNSP

SEQ ID NO: 2638231 - protein, 15 aa, Entamoeba histolytica
LKSDQNSEDITTDKK

SEQ ID NO: 2638232 - protein, 8 aa, Entamoeba histolytica
LKSDTKEM

SEQ ID NO: 2638233 - protein, 8 aa, Entamoeba histolytica
LKSEERGY

SEQ ID NO: 2638234 - protein, 7 aa, Entamoeba histolytica
LKSEETY

SEQ ID NO: 2638235 - protein, 7 aa, Entamoeba histolytica
LKSENDY

SEQ ID NO: 2638236 - protein, 8 aa, Entamoeba histolytica
LKSEPSEE

SEQ ID NO: 2638237 - protein, 16 aa, Entamoeba histolytica
LKSESRIDNLSDTNNI

SEQ ID NO: 2638238 - protein, 11 aa, Entamoeba histolytica
LKSETEQDDES

SEQ ID NO: 2638239 - protein, 12 aa, Entamoeba histolytica
LKSETKKKYRSL

SEQ ID NO: 2638240 - protein, 7 aa, Entamoeba histolytica
LKSGDMP

SEQ ID NO: 2638241 - protein, 9 aa, Entamoeba histolytica
LKSGESATN

SEQ ID NO: 2638242 - protein, 17 aa, Entamoeba histolytica
LKSKDEEKKPKKAETKD

SEQ ID NO: 2638243 - protein, 11 aa, Entamoeba histolytica
LKSKNEQDDEM

SEQ ID NO: 2638244 - protein, 15 aa, Entamoeba histolytica
LKSLQQQDDIQNKDI

SEQ ID NO: 2638245 - protein, 4 aa, Entamoeba histolytica
LKSN

SEQ ID NO: 2638246 - protein, 5 aa, Entamoeba histolytica
LKSND

SEQ ID NO: 2638247 - protein, 14 aa, Entamoeba histolytica
LKSPSPNYSNQPPS

SEQ ID NO: 2638248 - protein, 8 aa, Entamoeba histolytica
LKSQISKS

SEQ ID NO: 2638249 - protein, 41 aa, Entamoeba histolytica
LKSQKKNANETSEIKSGSQKRDTQYTSSDELKQNEEPKKII

SEQ ID NO: 2638250 - protein, 9 aa, Entamoeba histolytica
LKSQKLSKE

SEQ ID NO: 2638251 - protein, 12 aa, Entamoeba histolytica
LKSQNSLSNDDM

SEQ ID NO: 2638252 - protein, 7 aa, Entamoeba histolytica
LKSQQDL

SEQ ID NO: 2638253 - protein, 8 aa, Entamoeba histolytica
LKSRRINK

SEQ ID NO: 2638254 - protein, 20 aa, Entamoeba histolytica
LKSSEEKKMLPQEEYNPTLD

SEQ ID NO: 2638255 - protein, 12 aa, Entamoeba histolytica
LKSSKHYKAGDQ

SEQ ID NO: 2638256 - protein, 8 aa, Entamoeba histolytica
LKSSKQQL

SEQ ID NO: 2638257 - protein, 8 aa, Entamoeba histolytica
LKSSLPSM

SEQ ID NO: 2638258 - protein, 29 aa, Entamoeba histolytica
LKSSTNKRNKEKADSANQSSSSHRIDNSN

SEQ ID NO: 2638259 - protein, 8 aa, Entamoeba histolytica
LKSSTVNT

SEQ ID NO: 2638260 - protein, 23 aa, Entamoeba histolytica
LKSTEGMNELTPEQQEQLKTQEA

SEQ ID NO: 2638261 - protein, 7 aa, Entamoeba histolytica
LKSTEWK

SEQ ID NO: 2638262 - protein, 7 aa, Entamoeba histolytica
LKSTKKE

SEQ ID NO: 2638263 - protein, 40 aa, Entamoeba histolytica
LKSTLESSCPSSPLQTTPSLPNPDNRRSVDIPSTKSILLF

SEQ ID NO: 2638264 - protein, 16 aa, Entamoeba histolytica
LKSTPSTDKPAVPQRN

SEQ ID NO: 2638265 - protein, 11 aa, Entamoeba histolytica
LKSTQTKVTAI

SEQ ID NO: 2638266 - protein, 5 aa, Entamoeba histolytica
LKTAN

SEQ ID NO: 2638267 - protein, 30 aa, Entamoeba histolytica
LKTEKKEKKKDIKDKDSKGLDKTPEKKRKK

SEQ ID NO: 2638268 - protein, 8 aa, Entamoeba histolytica
LKTENESM

SEQ ID NO: 2638269 - protein, 11 aa, Entamoeba histolytica
LKTENGKIPKN

SEQ ID NO: 2638270 - protein, 10 aa, Entamoeba histolytica
LKTETPSSQK

SEQ ID NO: 2638271 - protein, 4 aa, Entamoeba histolytica
LKTG

SEQ ID NO: 2638272 - protein, 7 aa, Entamoeba histolytica
LKTGEHE

SEQ ID NO: 2638273 - protein, 8 aa, Entamoeba histolytica
LKTGLDEL

SEQ ID NO: 2638274 - protein, 12 aa, Entamoeba histolytica
LKTKDKEVEKKH

SEQ ID NO: 2638275 - protein, 12 aa, Entamoeba histolytica
LKTKDKKKPDWE

SEQ ID NO: 2638276 - protein, 10 aa, Entamoeba histolytica
LKTKDNEEID

SEQ ID NO: 2638277 - protein, 10 aa, Entamoeba histolytica
LKTKEPINIS

SEQ ID NO: 2638278 - protein, 5 aa, Entamoeba histolytica
LKTKG

SEQ ID NO: 2638279 - protein, 8 aa, Entamoeba histolytica
LKTKNPGK

SEQ ID NO: 2638280 - protein, 5 aa, Entamoeba histolytica
LKTLG

SEQ ID NO: 2638281 - protein, 11 aa, Entamoeba histolytica
LKTNANTFKST

SEQ ID NO: 2638282 - protein, 6 aa, Entamoeba histolytica
LKTNGI

SEQ ID NO: 2638283 - protein, 9 aa, Entamoeba histolytica
LKTNKGNVN

SEQ ID NO: 2638284 - protein, 11 aa, Entamoeba histolytica
LKTNQKSQEEI

SEQ ID NO: 2638285 - protein, 5 aa, Entamoeba histolytica
LKTNT

SEQ ID NO: 2638286 - protein, 7 aa, Entamoeba histolytica
LKTNTKE

SEQ ID NO: 2638287 - protein, 6 aa, Entamoeba histolytica
LKTPRI

SEQ ID NO: 2638288 - protein, 16 aa, Entamoeba histolytica
LKTQDNIPRKDVPDSL

SEQ ID NO: 2638289 - protein, 5 aa, Entamoeba histolytica
LKTQE

SEQ ID NO: 2638290 - protein, 8 aa, Entamoeba histolytica
LKTQETKV

SEQ ID NO: 2638291 - protein, 7 aa, Entamoeba histolytica
LKTQGTK

SEQ ID NO: 2638292 - protein, 12 aa, Entamoeba histolytica
LKTSKNPTTTQK

SEQ ID NO: 2638293 - protein, 6 aa, Entamoeba histolytica
LKTSNG

SEQ ID NO: 2638294 - protein, 6 aa, Entamoeba histolytica
LKTSQI

SEQ ID NO: 2638295 - protein, 10 aa, Entamoeba histolytica
LKTTKGYKVG

SEQ ID NO: 2638296 - protein, 13 aa, Entamoeba histolytica
LKVDSPSKTKVDE

SEQ ID NO: 2638297 - protein, 15 aa, Entamoeba histolytica
LKYDEAKHTVDGGSL

SEQ ID NO: 2638298 - protein, 8 aa, Entamoeba histolytica
LKYEGHNG

SEQ ID NO: 2638299 - protein, 4 aa, Entamoeba histolytica
LKYP

SEQ ID NO: 2638300 - protein, 8 aa, Entamoeba histolytica
LKYPYEGN

SEQ ID NO: 2638301 - protein, 5 aa, Entamoeba histolytica
LLDNT

SEQ ID NO: 2638302 - protein, 6 aa, Entamoeba histolytica
LLEDEK

SEQ ID NO: 2638303 - protein, 73 aa, Entamoeba histolytica
LLEEEQKRLEEEERKAEEERKRVEAERKRKEEEERKRKEEEERKRKEEERKRKEEEERKRKEEEEKRKKELEE

SEQ ID NO: 2638304 - protein, 9 aa, Entamoeba histolytica
LLGPSPRTY

SEQ ID NO: 2638305 - protein, 11 aa, Entamoeba histolytica
LLGRSKTKERT

SEQ ID NO: 2638306 - protein, 15 aa, Entamoeba histolytica
LLKTDEEKDAAAAKL

SEQ ID NO: 2638307 - protein, 5 aa, Entamoeba histolytica
LLPDE

SEQ ID NO: 2638308 - protein, 4 aa, Entamoeba histolytica
LLPP

SEQ ID NO: 2638309 - protein, 6 aa, Entamoeba histolytica
LLPPTD

SEQ ID NO: 2638310 - protein, 10 aa, Entamoeba histolytica
LLPRPESTPI

SEQ ID NO: 2638311 - protein, 18 aa, Entamoeba histolytica
LLPSTSTEEINNETETSV

SEQ ID NO: 2638312 - protein, 6 aa, Entamoeba histolytica
LLQDKN

SEQ ID NO: 2638313 - protein, 50 aa, Entamoeba histolytica
LLQDTKKPVIKTEKEKKKDKKVSKKEDEKKASEKSTPKKDENKPKKPKNA

SEQ ID NO: 2638314 - protein, 13 aa, Entamoeba histolytica
LLSENSDDDVKEI

SEQ ID NO: 2638315 - protein, 13 aa, Entamoeba histolytica
LLSNSTGKEFKPD

SEQ ID NO: 2638316 - protein, 13 aa, Entamoeba histolytica
LLTEDEQKDSKAL

SEQ ID NO: 2638317 - protein, 6 aa, Entamoeba histolytica
LLTNEE

SEQ ID NO: 2638318 - protein, 13 aa, Entamoeba histolytica
LLTPPGKIEDATN

SEQ ID NO: 2638319 - protein, 14 aa, Entamoeba histolytica
LLTSPEPEIEKEEA

SEQ ID NO: 2638320 - protein, 7 aa, Entamoeba histolytica
LMKTERG

SEQ ID NO: 2638321 - protein, 4 aa, Entamoeba histolytica
LMTT

SEQ ID NO: 2638322 - protein, 11 aa, Entamoeba histolytica
LNAAKEEQIRK

SEQ ID NO: 2638323 - protein, 5 aa, Entamoeba histolytica
LNADG

SEQ ID NO: 2638324 - protein, 4 aa, Entamoeba histolytica
LNAE

SEQ ID NO: 2638325 - protein, 7 aa, Entamoeba histolytica
LNAMTNP

SEQ ID NO: 2638326 - protein, 24 aa, Entamoeba histolytica
LNAPKKEAENIGTVQKGAGGKPHS

SEQ ID NO: 2638327 - protein, 12 aa, Entamoeba histolytica
LNAPQSSLSNID

SEQ ID NO: 2638328 - protein, 8 aa, Entamoeba histolytica
LNASTQNT

SEQ ID NO: 2638329 - protein, 20 aa, Entamoeba histolytica
LNDDEQPKKETTKSSVQKKK

SEQ ID NO: 2638330 - protein, 7 aa, Entamoeba histolytica
LNDEKQQ

SEQ ID NO: 2638331 - protein, 39 aa, Entamoeba histolytica; identical to SEQ ID NO: 2443107

SEQ ID NO: 2638332 - protein, 10 aa, Entamoeba histolytica
LNDGGKNSFE

SEQ ID NO: 2638333 - protein, 15 aa, Entamoeba histolytica
LNDIDSAIRNLILLK

SEQ ID NO: 2638334 - protein, 12 aa, Entamoeba histolytica
LNDKTNQEIKKS

SEQ ID NO: 2638335 - protein, 8 aa, Entamoeba histolytica
LNDKTRHH

SEQ ID NO: 2638336 - protein, 10 aa, Entamoeba histolytica
LNDNEQNQGT

SEQ ID NO: 2638337 - protein, 5 aa, Entamoeba histolytica
LNDNK

SEQ ID NO: 2638338 - protein, 4 aa, Entamoeba histolytica
LNDP

SEQ ID NO: 2638339 - protein, 7 aa, Entamoeba histolytica
LNDPIKS

SEQ ID NO: 2638340 - protein, 6 aa, Entamoeba histolytica
LNDQED

SEQ ID NO: 2638341 - protein, 9 aa, Entamoeba histolytica
LNDSQQQIN

SEQ ID NO: 2638342 - protein, 6 aa, Entamoeba histolytica
LNDTTS

SEQ ID NO: 2638343 - protein, 15 aa, Entamoeba histolytica
LNDYQDNNPLGMTEE

SEQ ID NO: 2638344 - protein, 16 aa, Entamoeba histolytica
LNEDDQSTPHCNPPSY

SEQ ID NO: 2638345 - protein, 7 aa, Entamoeba histolytica
LNEDHPQ

SEQ ID NO: 2638346 - protein, 7 aa, Entamoeba histolytica
LNEDNRR

SEQ ID NO: 2638347 - protein, 8 aa, Entamoeba histolytica
LNEEDELT

SEQ ID NO: 2638348 - protein, 15 aa, Entamoeba histolytica
LNEEDTQKEKKIKQL

SEQ ID NO: 2638349 - protein, 9 aa, Entamoeba histolytica
LNEEEKEHK

SEQ ID NO: 2638350 - protein, 12 aa, Entamoeba histolytica
LNEEEKKVLQSE

SEQ ID NO: 2638351 - protein, 7 aa, Entamoeba histolytica
LNEEEKN

SEQ ID NO: 2638352 - protein, 10 aa, Entamoeba histolytica
LNEEEKSDAL

SEQ ID NO: 2638353 - protein, 7 aa, Entamoeba histolytica
LNEEEPR

SEQ ID NO: 2638354 - protein, 8 aa, Entamoeba histolytica
LNEEERNK

SEQ ID NO: 2638355 - protein, 6 aa, Entamoeba histolytica
LNEEND

SEQ ID NO: 2638356 - protein, 8 aa, Entamoeba histolytica
LNEENGDV

SEQ ID NO: 2638357 - protein, 7 aa, Entamoeba histolytica
LNEEQEK

SEQ ID NO: 2638358 - protein, 7 aa, Entamoeba histolytica
LNEEQLK

SEQ ID NO: 2638359 - protein, 6 aa, Entamoeba histolytica
LNEESM

SEQ ID NO: 2638360 - protein, 9 aa, Entamoeba histolytica
LNEESSNKF

SEQ ID NO: 2638361 - protein, 5 aa, Entamoeba histolytica
LNEFS

SEQ ID NO: 2638362 - protein, 4 aa, Entamoeba histolytica
LNEG

SEQ ID NO: 2638363 - protein, 7 aa, Entamoeba histolytica
LNEGESA

SEQ ID NO: 2638364 - protein, 8 aa, Entamoeba histolytica
LNEIPESV

SEQ ID NO: 2638365 - protein, 7 aa, Entamoeba histolytica
LNEKEAE

SEQ ID NO: 2638366 - protein, 17 aa, Entamoeba histolytica
LNEKEENIIQDETKTNT

SEQ ID NO: 2638367 - protein, 10 aa, Entamoeba histolytica
LNEKGSSIST

SEQ ID NO: 2638368 - protein, 5 aa, Entamoeba histolytica
LNEKH

SEQ ID NO: 2638369 - protein, 5 aa, Entamoeba histolytica
LNEKT

SEQ ID NO: 2638370 - protein, 16 aa, Entamoeba histolytica
LNELEGITSQKEGMSN

SEQ ID NO: 2638371 - protein, 4 aa, Entamoeba histolytica
LNEN

SEQ ID NO: 2638372 - protein, 5 aa, Entamoeba histolytica
LNENE

SEQ ID NO: 2638373 - protein, 6 aa, Entamoeba histolytica
LNENEK

SEQ ID NO: 2638374 - protein, 13 aa, Entamoeba histolytica
LNENESPRRRNTI

SEQ ID NO: 2638375 - protein, 8 aa, Entamoeba histolytica
LNENGKEP

SEQ ID NO: 2638376 - protein, 15 aa, Entamoeba histolytica
LNENREKVKKNENFT

SEQ ID NO: 2638377 - protein, 15 aa, Entamoeba histolytica
LNENREKVKNNENFT

SEQ ID NO: 2638378 - protein, 8 aa, Entamoeba histolytica
LNEPSIDK

SEQ ID NO: 2638379 - protein, 7 aa, Entamoeba histolytica
LNEPSKG

SEQ ID NO: 2638380 - protein, 6 aa, Entamoeba histolytica
LNEPSL

SEQ ID NO: 2638381 - protein, 6 aa, Entamoeba histolytica
LNEPST

SEQ ID NO: 2638382 - protein, 6 aa, Entamoeba histolytica
LNEPTY

SEQ ID NO: 2638383 - protein, 5 aa, Entamoeba histolytica
LNEQR

SEQ ID NO: 2638384 - protein, 13 aa, Entamoeba histolytica
LNEQYKKEPIDKE

SEQ ID NO: 2638385 - protein, 5 aa, Entamoeba histolytica
LNERG

SEQ ID NO: 2638386 - protein, 6 aa, Entamoeba histolytica
LNERKE

SEQ ID NO: 2638387 - protein, 9 aa, Entamoeba histolytica
LNERKGIET

SEQ ID NO: 2638388 - protein, 7 aa, Entamoeba histolytica
LNERNVP

SEQ ID NO: 2638389 - protein, 5 aa, Entamoeba histolytica
LNERQ

SEQ ID NO: 2638390 - protein, 13 aa, Entamoeba histolytica
LNERRKPRRTRMP

SEQ ID NO: 2638391 - protein, 8 aa, Entamoeba histolytica
LNESEQNK

SEQ ID NO: 2638392 - protein, 25 aa, Entamoeba histolytica
LNESKTKSSGNGLNPNQKKSVSIPY

SEQ ID NO: 2638393 - protein, 10 aa, Entamoeba histolytica
LNESKYNKSV

SEQ ID NO: 2638394 - protein, 14 aa, Entamoeba histolytica
LNESLSMNESQMKK

SEQ ID NO: 2638395 - protein, 4 aa, Entamoeba histolytica
LNET

SEQ ID NO: 2638396 - protein, 16 aa, Entamoeba histolytica
LNETDYTTLTQSNTLE

SEQ ID NO: 2638397 - protein, 10 aa, Entamoeba histolytica
LNETETSYDD

SEQ ID NO: 2638398 - protein, 9 aa, Entamoeba histolytica
LNETINKNE

SEQ ID NO: 2638399 - protein, 14 aa, Entamoeba histolytica
LNETMKQPINTKKK

SEQ ID NO: 2638400 - protein, 6 aa, Entamoeba histolytica
LNETRK

SEQ ID NO: 2638401 - protein, 11 aa, Entamoeba histolytica
LNETRRNNENI

SEQ ID NO: 2638402 - protein, 12 aa, Entamoeba histolytica
LNEVRKEQMKYQ

SEQ ID NO: 2638403 - protein, 13 aa, Entamoeba histolytica
LNEVSSRKPQGDF

SEQ ID NO: 2638404 - protein, 4 aa, Entamoeba histolytica
LNEY

SEQ ID NO: 2638405 - protein, 7 aa, Entamoeba histolytica
LNEYNSK

SEQ ID NO: 2638406 - protein, 13 aa, Entamoeba histolytica
LNEYQNDNPLGMT

SEQ ID NO: 2638407 - protein, 12 aa, Entamoeba histolytica
LNFTDKPDNFSV

SEQ ID NO: 2638408 - protein, 13 aa, Entamoeba histolytica
LNGDGVPKDVNKA

SEQ ID NO: 2638409 - protein, 23 aa, Entamoeba histolytica
LNGDNQEMKEQKEVLSQENEALT

SEQ ID NO: 2638410 - protein, 10 aa, Entamoeba histolytica
LNGEDTKTYE

SEQ ID NO: 2638411 - protein, 8 aa, Entamoeba histolytica
LNGEKSEK

SEQ ID NO: 2638412 - protein, 5 aa, Entamoeba histolytica
LNGEQ

SEQ ID NO: 2638413 - protein, 20 aa, Entamoeba histolytica
LNGGKTKKKKRDIANEDVEE

SEQ ID NO: 2638414 - protein, 13 aa, Entamoeba histolytica
LNGGNQTRGQADG

SEQ ID NO: 2638415 - protein, 13 aa, Entamoeba histolytica
LNGKANLISTSPD

SEQ ID NO: 2638416 - protein, 57 aa, Entamoeba histolytica
LNGKEIGKARSKRFNEEYKRRKINDEDINTIGKKDRGRVNEKSCDRKRISSEERNEM

SEQ ID NO: 2638417 - protein, 10 aa, Entamoeba histolytica
LNGKEKGLKG

SEQ ID NO: 2638418 - protein, 8 aa, Entamoeba histolytica
LNGKNASD

SEQ ID NO: 2638419 - protein, 9 aa, Entamoeba histolytica
LNGKPYSEN

SEQ ID NO: 2638420 - protein, 19 aa, Entamoeba histolytica
LNGNESEMNNEEDYDIEDY

SEQ ID NO: 2638421 - protein, 6 aa, Entamoeba histolytica
LNGNGI

SEQ ID NO: 2638422 - protein, 15 aa, Entamoeba histolytica
LNGQEGWIPNNYVKE

SEQ ID NO: 2638423 - protein, 13 aa, Entamoeba histolytica
LNGRKEEWYPPGH

SEQ ID NO: 2638424 - protein, 11 aa, Entamoeba histolytica
LNGRKTDSPLS

SEQ ID NO: 2638425 - protein, 9 aa, Entamoeba histolytica
LNGRNKVRL

SEQ ID NO: 2638426 - protein, 10 aa, Entamoeba histolytica
LNGSKCQKKE

SEQ ID NO: 2638427 - protein, 8 aa, Entamoeba histolytica
LNGTGVKE

SEQ ID NO: 2638428 - protein, 7 aa, Entamoeba histolytica
LNGYGDD

SEQ ID NO: 2638429 - protein, 4 aa, Entamoeba histolytica
LNHP

SEQ ID NO: 2638430 - protein, 8 aa, Entamoeba histolytica
LNHTQNKK

SEQ ID NO: 2638431 - protein, 8 aa, Entamoeba histolytica
LNHTSSTG

SEQ ID NO: 2638432 - protein, 8 aa, Entamoeba histolytica
LNKDPKEV

SEQ ID NO: 2638433 - protein, 14 aa, Entamoeba histolytica
LNKDPQSYPQKTDH

SEQ ID NO: 2638434 - protein, 5 aa, Entamoeba histolytica
LNKDQ

SEQ ID NO: 2638435 - protein, 8 aa, Entamoeba histolytica
LNKGTEEY

SEQ ID NO: 2638436 - protein, 18 aa, Entamoeba histolytica
LNKKRQSNRFEEVNSQPI

SEQ ID NO: 2638437 - protein, 8 aa, Entamoeba histolytica
LNKLQSKT

SEQ ID NO: 2638438 - protein, 8 aa, Entamoeba histolytica
LNKNKREL

SEQ ID NO: 2638439 - protein, 8 aa, Entamoeba histolytica
LNKNSDAV

SEQ ID NO: 2638440 - protein, 9 aa, Entamoeba histolytica
LNKNTSLAN

SEQ ID NO: 2638441 - protein, 11 aa, Entamoeba histolytica
LNKPSQPPFYQ

SEQ ID NO: 2638442 - protein, 20 aa, Entamoeba histolytica
LNKQKEEELQKKRDAMAQED

SEQ ID NO: 2638443 - protein, 8 aa, Entamoeba histolytica
LNKRGIKS

SEQ ID NO: 2638444 - protein, 9 aa, Entamoeba histolytica
LNKRTSSSK

SEQ ID NO: 2638445 - protein, 11 aa, Entamoeba histolytica
LNKSGSQFKDH

SEQ ID NO: 2638446 - protein, 12 aa, Entamoeba histolytica
LNKSHDNKTSSL

SEQ ID NO: 2638447 - protein, 15 aa, Entamoeba histolytica
LNKSIKQSNEQCEQP

SEQ ID NO: 2638448 - protein, 12 aa, Entamoeba histolytica
LNKSQESNSQEL

SEQ ID NO: 2638449 - protein, 8 aa, Entamoeba histolytica
LNKSTNSF

SEQ ID NO: 2638450 - protein, 9 aa, Entamoeba histolytica
LNKTEEEPF

SEQ ID NO: 2638451 - protein, 12 aa, Entamoeba histolytica
LNKTEKKETNPF

SEQ ID NO: 2638452 - protein, 12 aa, Entamoeba histolytica
LNKTENSSIKVE

SEQ ID NO: 2638453 - protein, 10 aa, Entamoeba histolytica
LNKTYYNGGS

SEQ ID NO: 2638454 - protein, 16 aa, Entamoeba histolytica
LNNAINNNSNLSDEKR

SEQ ID NO: 2638455 - protein, 16 aa, Entamoeba histolytica
LNNDNTRKSPITLSGN

SEQ ID NO: 2638456 - protein, 20 aa, Entamoeba histolytica
LNNEKEKVVSSTKENDKKIN

SEQ ID NO: 2638457 - protein, 8 aa, Entamoeba histolytica
LNNELKQQ

SEQ ID NO: 2638458 - protein, 6 aa, Entamoeba histolytica
LNNENA

SEQ ID NO: 2638459 - protein, 7 aa, Entamoeba histolytica
LNNEQTK

SEQ ID NO: 2638460 - protein, 16 aa, Entamoeba histolytica
LNNERTVQKEKGLTFA

SEQ ID NO: 2638461 - protein, 6 aa, Entamoeba histolytica
LNNETA

SEQ ID NO: 2638462 - protein, 9 aa, Entamoeba histolytica
LNNGEKENY

SEQ ID NO: 2638463 - protein, 8 aa, Entamoeba histolytica
LNNGNVSE

SEQ ID NO: 2638464 - protein, 8 aa, Entamoeba histolytica
LNNKSGSL

SEQ ID NO: 2638465 - protein, 4 aa, Entamoeba histolytica
LNNL

SEQ ID NO: 2638466 - protein, 8 aa, Entamoeba histolytica
LNNNDQSR

SEQ ID NO: 2638467 - protein, 6 aa, Entamoeba histolytica
LNNNEE

SEQ ID NO: 2638468 - protein, 8 aa, Entamoeba histolytica
LNNNEIST

SEQ ID NO: 2638469 - protein, 7 aa, Entamoeba histolytica
LNNNKEK

SEQ ID NO: 2638470 - protein, 6 aa, Entamoeba histolytica
LNNNKN

SEQ ID NO: 2638471 - protein, 10 aa, Entamoeba histolytica
LNNNPSPSVP

SEQ ID NO: 2638472 - protein, 6 aa, Entamoeba histolytica
LNNPQS

SEQ ID NO: 2638473 - protein, 7 aa, Entamoeba histolytica
LNNPTTP

SEQ ID NO: 2638474 - protein, 6 aa, Entamoeba histolytica
LNNQKR

SEQ ID NO: 2638475 - protein, 5 aa, Entamoeba histolytica
LNNQS

SEQ ID NO: 2638476 - protein, 19 aa, Entamoeba histolytica
LNNSKTKKNLAQEEYDERE

SEQ ID NO: 2638477 - protein, 15 aa, Entamoeba histolytica
LNNSPFENRIQTDPQ

SEQ ID NO: 2638478 - protein, 10 aa, Entamoeba histolytica
LNNSPHQSDF

SEQ ID NO: 2638479 - protein, 7 aa, Entamoeba histolytica
LNNTETL

SEQ ID NO: 2638480 - protein, 10 aa, Entamoeba histolytica
LNNTNKDKTD

SEQ ID NO: 2638481 - protein, 12 aa, Entamoeba histolytica
LNNTQTPYIPTK

SEQ ID NO: 2638482 - protein, 9 aa, Entamoeba histolytica
LNNTSPNEL

SEQ ID NO: 2638483 - protein, 4 aa, Entamoeba histolytica
LNNY

SEQ ID NO: 2638484 - protein, 9 aa, Entamoeba histolytica
LNPAQFPDR

SEQ ID NO: 2638485 - protein, 4 aa, Entamoeba histolytica
LNPD

SEQ ID NO: 2638486 - protein, 10 aa, Entamoeba histolytica
LNPDNAKAYK

SEQ ID NO: 2638487 - protein, 5 aa, Entamoeba histolytica
LNPDT

SEQ ID NO: 2638488 - protein, 7 aa, Entamoeba histolytica
LNPEKHP

SEQ ID NO: 2638489 - protein, 5 aa, Entamoeba histolytica
LNPGI

SEQ ID NO: 2638490 - protein, 13 aa, Entamoeba histolytica
LNPGRGIRENTQF

SEQ ID NO: 2638491 - protein, 7 aa, Entamoeba histolytica
LNPGVQK

SEQ ID NO: 2638492 - protein, 13 aa, Entamoeba histolytica
LNPHTRSGSKQYM

SEQ ID NO: 2638493 - protein, 5 aa, Entamoeba histolytica
LNPIG

SEQ ID NO: 2638494 - protein, 6 aa, Entamoeba histolytica
LNPKDA

SEQ ID NO: 2638495 - protein, 9 aa, Entamoeba histolytica
LNPKDPNIF

SEQ ID NO: 2638496 - protein, 11 aa, Entamoeba histolytica
LNPKGLEKRLP

SEQ ID NO: 2638497 - protein, 6 aa, Entamoeba histolytica
LNPKKL

SEQ ID NO: 2638498 - protein, 9 aa, Entamoeba histolytica
LNPKQIREK

SEQ ID NO: 2638499 - protein, 5 aa, Entamoeba histolytica
LNPLE

SEQ ID NO: 2638500 - protein, 4 aa, Entamoeba histolytica
LNPN

SEQ ID NO: 2638501 - protein, 7 aa, Entamoeba histolytica
LNPNAAT

SEQ ID NO: 2638502 - protein, 12 aa, Entamoeba histolytica
LNPNADPEKLQQ

SEQ ID NO: 2638503 - protein, 6 aa, Entamoeba histolytica
LNPPPI

SEQ ID NO: 2638504 - protein, 14 aa, Entamoeba histolytica
LNPPSVVKGNKDDV

SEQ ID NO: 2638505 - protein, 6 aa, Entamoeba histolytica
LNPQDI

SEQ ID NO: 2638506 - protein, 8 aa, Entamoeba histolytica
LNPQEEIE

SEQ ID NO: 2638507 - protein, 5 aa, Entamoeba histolytica
LNPQG

SEQ ID NO: 2638508 - protein, 5 aa, Entamoeba histolytica
LNPRR

SEQ ID NO: 2638509 - protein, 7 aa, Entamoeba histolytica
LNPSINQ

SEQ ID NO: 2638510 - protein, 5 aa, Entamoeba histolytica
LNPST

SEQ ID NO: 2638511 - protein, 12 aa, Entamoeba histolytica
LNPTPQPKQGQD

SEQ ID NO: 2638512 - protein, 5 aa, Entamoeba histolytica
LNPVT

SEQ ID NO: 2638513 - protein, 4 aa, Entamoeba histolytica
LNPY

SEQ ID NO: 2638514 - protein, 7 aa, Entamoeba histolytica
LNPYEDE

SEQ ID NO: 2638515 - protein, 5 aa, Entamoeba histolytica
LNQEE

SEQ ID NO: 2638516 - protein, 7 aa, Entamoeba histolytica
LNQEETT

SEQ ID NO: 2638517 - protein, 6 aa, Entamoeba histolytica
LNQEKS

SEQ ID NO: 2638518 - protein, 8 aa, Entamoeba histolytica
LNQGKVPQ

SEQ ID NO: 2638519 - protein, 12 aa, Entamoeba histolytica
LNQKQKNRNTVV

SEQ ID NO: 2638520 - protein, 4 aa, Entamoeba histolytica
LNQL

SEQ ID NO: 2638521 - protein, 4 aa, Entamoeba histolytica
LNQM

SEQ ID NO: 2638522 - protein, 7 aa, Entamoeba histolytica
LNQNGKI

SEQ ID NO: 2638523 - protein, 10 aa, Entamoeba histolytica
LNQNQQPTPR

SEQ ID NO: 2638524 - protein, 7 aa, Entamoeba histolytica
LNQPDEQ

SEQ ID NO: 2638525 - protein, 11 aa, Entamoeba histolytica
LNQPSQDRHSF

SEQ ID NO: 2638526 - protein, 8 aa, Entamoeba histolytica
LNQPTDND

SEQ ID NO: 2638527 - protein, 4 aa, Entamoeba histolytica
LNQQ

SEQ ID NO: 2638528 - protein, 7 aa, Entamoeba histolytica
LNQQDKQ

SEQ ID NO: 2638529 - protein, 15 aa, Entamoeba histolytica
LNQRTNDSTNQSGDC

SEQ ID NO: 2638530 - protein, 33 aa, Entamoeba histolytica
LNQSLNKKQPSYQSEQSTIPKTPITKDAIQKQT

SEQ ID NO: 2638531 - protein, 40 aa, Entamoeba histolytica
LNQSSDSYDSEDSNDENNPNNSYPTTPSSEYSEDEDDEFY

SEQ ID NO: 2638532 - protein, 12 aa, Entamoeba histolytica
LNQSSIASSNED

SEQ ID NO: 2638533 - protein, 14 aa, Entamoeba histolytica
LNQTKKELDESNKA

SEQ ID NO: 2638534 - protein, 9 aa, Entamoeba histolytica
LNQTNNQGN

SEQ ID NO: 2638535 - protein, 33 aa, Entamoeba histolytica
LNQTSRAEKKRKRKERIKKEKELNKMKQIDKNI

SEQ ID NO: 2638536 - protein, 9 aa, Entamoeba histolytica
LNSDDSLKE

SEQ ID NO: 2638537 - protein, 8 aa, Entamoeba histolytica
LNSDDSRF

SEQ ID NO: 2638538 - protein, 6 aa, Entamoeba histolytica
LNSDIS

SEQ ID NO: 2638539 - protein, 10 aa, Entamoeba histolytica
LNSEDFKKSL

SEQ ID NO: 2638540 - protein, 6 aa, Entamoeba histolytica
LNSEQQ

SEQ ID NO: 2638541 - protein, 7 aa, Entamoeba histolytica
LNSEQTN

SEQ ID NO: 2638542 - protein, 10 aa, Entamoeba histolytica
LNSGNKSVSG

SEQ ID NO: 2638543 - protein, 7 aa, Entamoeba histolytica
LNSGYST

SEQ ID NO: 2638544 - protein, 6 aa, Entamoeba histolytica
LNSKKI

SEQ ID NO: 2638545 - protein, 9 aa, Entamoeba histolytica
LNSKPSGKF

SEQ ID NO: 2638546 - protein, 12 aa, Entamoeba histolytica
LNSLNGDTQYTE

SEQ ID NO: 2638547 - protein, 9 aa, Entamoeba histolytica
LNSNGKPEI

SEQ ID NO: 2638548 - protein, 7 aa, Entamoeba histolytica
LNSNNIK

SEQ ID NO: 2638549 - protein, 6 aa, Entamoeba histolytica
LNSNNS

SEQ ID NO: 2638550 - protein, 22 aa, Entamoeba histolytica
LNSNNTKKERIESKDENSIKNK

SEQ ID NO: 2638551 - protein, 7 aa, Entamoeba histolytica
LNSPENE

SEQ ID NO: 2638552 - protein, 8 aa, Entamoeba histolytica
LNSQSKVT

SEQ ID NO: 2638553 - protein, 14 aa, Entamoeba histolytica
LNSQSTIDDLPKDI

SEQ ID NO: 2638554 - protein, 30 aa, Entamoeba histolytica
LNSQTEKKSVSLSSDIKSSKLNCNNNTNNC

SEQ ID NO: 2638555 - protein, 6 aa, Entamoeba histolytica
LNSQVT

SEQ ID NO: 2638556 - protein, 5 aa, Entamoeba histolytica
LNSSK

SEQ ID NO: 2638557 - protein, 20 aa, Entamoeba histolytica
LNSSPSTNANLSSTPTNSFD

SEQ ID NO: 2638558 - protein, 22 aa, Entamoeba histolytica
LNSSTNHNQENQNENNEQHKTM

SEQ ID NO: 2638559 - protein, 5 aa, Entamoeba histolytica
LNSTD

SEQ ID NO: 2638560 - protein, 7 aa, Entamoeba histolytica
LNSTQYV

SEQ ID NO: 2638561 - protein, 10 aa, Entamoeba histolytica
LNSVNEENDL

SEQ ID NO: 2638562 - protein, 10 aa, Entamoeba histolytica
LNTATTNIKR

SEQ ID NO: 2638563 - protein, 9 aa, Entamoeba histolytica
LNTDKDKLK

SEQ ID NO: 2638564 - protein, 6 aa, Entamoeba histolytica
LNTEKE

SEQ ID NO: 2638565 - protein, 14 aa, Entamoeba histolytica
LNTEKTPARSSSAF

SEQ ID NO: 2638566 - protein, 4 aa, Entamoeba histolytica
LNTF

SEQ ID NO: 2638567 - protein, 12 aa, Entamoeba histolytica
LNTFDPEFDPEY

SEQ ID NO: 2638568 - protein, 9 aa, Entamoeba histolytica
LNTGESTII

SEQ ID NO: 2638569 - protein, 6 aa, Entamoeba histolytica
LNTKEN

SEQ ID NO: 2638570 - protein, 5 aa, Entamoeba histolytica
LNTKG

SEQ ID NO: 2638571 - protein, 6 aa, Entamoeba histolytica
LNTKRE

SEQ ID NO: 2638572 - protein, 4 aa, Entamoeba histolytica
LNTL

SEQ ID NO: 2638573 - protein, 16 aa, Entamoeba histolytica
LNTNKNNRVIKLSSLY

SEQ ID NO: 2638574 - protein, 5 aa, Entamoeba histolytica
LNTPS

SEQ ID NO: 2638575 - protein, 10 aa, Entamoeba histolytica
LNTPSSQQNL

SEQ ID NO: 2638576 - protein, 4 aa, Entamoeba histolytica
LNTQ

SEQ ID NO: 2638577 - protein, 8 aa, Entamoeba histolytica
LNTQDKNN

SEQ ID NO: 2638578 - protein, 20 aa, Entamoeba histolytica
LNTSNQNSKSIINQKEKELI

SEQ ID NO: 2638579 - protein, 6 aa, Entamoeba histolytica
LNTSPY

SEQ ID NO: 2638580 - protein, 7 aa, Entamoeba histolytica
LNTSSID

SEQ ID NO: 2638581 - protein, 5 aa, Entamoeba histolytica
LNTSV

SEQ ID NO: 2638582 - protein, 14 aa, Entamoeba histolytica
LNTTQNTPSKMMDL

SEQ ID NO: 2638583 - protein, 8 aa, Entamoeba histolytica
LNTTVDQC

SEQ ID NO: 2638584 - protein, 5 aa, Entamoeba histolytica
LNVGG

SEQ ID NO: 2638585 - protein, 9 aa, Entamoeba histolytica
LNVSEQVNK

SEQ ID NO: 2638586 - protein, 6 aa, Entamoeba histolytica
LNVSPI

SEQ ID NO: 2638587 - protein, 12 aa, Entamoeba histolytica
LNVSTNSQQIKV

SEQ ID NO: 2638588 - protein, 32 aa, Entamoeba histolytica
LNYDDEDELLNNSEDGRTSESSEDNCNIPQNT

SEQ ID NO: 2638589 - protein, 5 aa, Entamoeba histolytica
LNYDG

SEQ ID NO: 2638590 - protein, 10 aa, Entamoeba histolytica
LNYDKRGDEH

SEQ ID NO: 2638591 - protein, 7 aa, Entamoeba histolytica
LNYGPER

SEQ ID NO: 2638592 - protein, 4 aa, Entamoeba histolytica
LNYN

SEQ ID NO: 2638593 - protein, 4 aa, Entamoeba histolytica
LNYS

SEQ ID NO: 2638594 - protein, 4 aa, Entamoeba histolytica
LNYT

SEQ ID NO: 2638595 - protein, 4 aa, Entamoeba histolytica
LPAE

SEQ ID NO: 2638596 - protein, 6 aa, Entamoeba histolytica
LPAEDG

SEQ ID NO: 2638597 - protein, 5 aa, Entamoeba histolytica
LPAEN

SEQ ID NO: 2638598 - protein, 6 aa, Entamoeba histolytica
LPAGQN

SEQ ID NO: 2638599 - protein, 18 aa, Entamoeba histolytica
LPAHSTLEEPEKHPSPVH

SEQ ID NO: 2638600 - protein, 26 aa, Entamoeba histolytica
LPAPSNSLKTSNSFSSSISSEKQQTY

SEQ ID NO: 2638601 - protein, 10 aa, Entamoeba histolytica
LPASPGAATG

SEQ ID NO: 2638602 - protein, 11 aa, Entamoeba histolytica
LPATNGSKKSI

SEQ ID NO: 2638603 - protein, 4 aa, Entamoeba histolytica
LPCE

SEQ ID NO: 2638604 - protein, 4 aa, Entamoeba histolytica
LPCS

SEQ ID NO: 2638605 - protein, 4 aa, Entamoeba histolytica
LPDA

SEQ ID NO: 2638606 - protein, 14 aa, Entamoeba histolytica
LPDARTYKNTPIYQ

SEQ ID NO: 2638607 - protein, 4 aa, Entamoeba histolytica
LPDD

SEQ ID NO: 2638608 - protein, 6 aa, Entamoeba histolytica
LPDDEI

SEQ ID NO: 2638609 - protein, 5 aa, Entamoeba histolytica
LPDDV

SEQ ID NO: 2638610 - protein, 4 aa, Entamoeba histolytica
LPDG

SEQ ID NO: 2638611 - protein, 8 aa, Entamoeba histolytica
LPDGCEDP

SEQ ID NO: 2638612 - protein, 8 aa, Entamoeba histolytica
LPDGTEFS

SEQ ID NO: 2638613 - protein, 11 aa, Entamoeba histolytica
LPDGTSLTIGN

SEQ ID NO: 2638614 - protein, 4 aa, Entamoeba histolytica
LPDN

SEQ ID NO: 2638615 - protein, 6 aa, Entamoeba histolytica
LPDNDS

SEQ ID NO: 2638616 - protein, 5 aa, Entamoeba histolytica
LPDNI

SEQ ID NO: 2638617 - protein, 4 aa, Entamoeba histolytica
LPDR

SEQ ID NO: 2638618 - protein, 5 aa, Entamoeba histolytica
LPDRL

SEQ ID NO: 2638619 - protein, 6 aa, Entamoeba histolytica
LPDRRQ

SEQ ID NO: 2638620 - protein, 4 aa, Entamoeba histolytica
LPDS

SEQ ID NO: 2638621 - protein, 11 aa, Entamoeba histolytica
LPDSEKASIGM

SEQ ID NO: 2638622 - protein, 9 aa, Entamoeba histolytica
LPDSEKEKY

SEQ ID NO: 2638623 - protein, 8 aa, Entamoeba histolytica
LPDSPKDY

SEQ ID NO: 2638624 - protein, 6 aa, Entamoeba histolytica
LPDTPE

SEQ ID NO: 2638625 - protein, 8 aa, Entamoeba histolytica
LPDTSKLA

SEQ ID NO: 2638626 - protein, 6 aa, Entamoeba histolytica
LPDVSS

SEQ ID NO: 2638627 - protein, 16 aa, Entamoeba histolytica
LPEAKELQKRNNRKLM

SEQ ID NO: 2638628 - protein, 6 aa, Entamoeba histolytica
LPEAPN

SEQ ID NO: 2638629 - protein, 11 aa, Entamoeba histolytica
LPEDAVPSTLK

SEQ ID NO: 2638630 - protein, 9 aa, Entamoeba histolytica
LPEDEQEEI

SEQ ID NO: 2638631 - protein, 23 aa, Entamoeba histolytica
LPEDGPQYGLPPNQLNKQNTNTC

SEQ ID NO: 2638632 - protein, 5 aa, Entamoeba histolytica
LPEDR

SEQ ID NO: 2638633 - protein, 7 aa, Entamoeba histolytica
LPEDTKS

SEQ ID NO: 2638634 - protein, 5 aa, Entamoeba histolytica
LPEDV

SEQ ID NO: 2638635 - protein, 16 aa, Entamoeba histolytica
LPEEDAKELSKTRIPA

SEQ ID NO: 2638636 - protein, 45 aa, Entamoeba histolytica
LPEEDKERYQELAKQNKAKDIKTNDQPAQDQPSSIPTDTQQSSLQ

SEQ ID NO: 2638637 - protein, 6 aa, Entamoeba histolytica
LPEENK

SEQ ID NO: 2638638 - protein, 6 aa, Entamoeba histolytica
LPEEPA

SEQ ID NO: 2638639 - protein, 9 aa, Entamoeba histolytica
LPEEQKKKY

SEQ ID NO: 2638640 - protein, 8 aa, Entamoeba histolytica
LPEGGDDL

SEQ ID NO: 2638641 - protein, 5 aa, Entamoeba histolytica
LPEGL

SEQ ID NO: 2638642 - protein, 7 aa, Entamoeba histolytica
LPEGSSQ

SEQ ID NO: 2638643 - protein, 12 aa, Entamoeba histolytica
LPEGSTITAYKN

SEQ ID NO: 2638644 - protein, 7 aa, Entamoeba histolytica
LPEGTLY

SEQ ID NO: 2638645 - protein, 7 aa, Entamoeba histolytica
LPEGYGT

SEQ ID NO: 2638646 - protein, 11 aa, Entamoeba histolytica
LPEKKKGKSVV

SEQ ID NO: 2638647 - protein, 7 aa, Entamoeba histolytica
LPEKKNQ

SEQ ID NO: 2638648 - protein, 8 aa, Entamoeba histolytica
LPEKSARY

SEQ ID NO: 2638649 - protein, 4 aa, Entamoeba histolytica
LPEN

SEQ ID NO: 2638650 - protein, 7 aa, Entamoeba histolytica
LPENEGN

SEQ ID NO: 2638651 - protein, 6 aa, Entamoeba histolytica
LPENGE

SEQ ID NO: 2638652 - protein, 8 aa, Entamoeba histolytica
LPENPNVA

SEQ ID NO: 2638653 - protein, 26 aa, Entamoeba histolytica
LPEQAQPEHSETLADDLEKSTKEINE

SEQ ID NO: 2638654 - protein, 11 aa, Entamoeba histolytica
LPEQPKNQECY

SEQ ID NO: 2638655 - protein, 8 aa, Entamoeba histolytica
LPEQPNSI

SEQ ID NO: 2638656 - protein, 9 aa, Entamoeba histolytica
LPEQQKETY

SEQ ID NO: 2638657 - protein, 5 aa, Entamoeba histolytica
LPEQT

SEQ ID NO: 2638658 - protein, 10 aa, Entamoeba histolytica
LPERDPDKDY

SEQ ID NO: 2638659 - protein, 12 aa, Entamoeba histolytica
LPERGKDDEQIH

SEQ ID NO: 2638660 - protein, 9 aa, Entamoeba histolytica
LPESGSPYI

SEQ ID NO: 2638661 - protein, 6 aa, Entamoeba histolytica
LPESQR

SEQ ID NO: 2638662 - protein, 6 aa, Entamoeba histolytica
LPESSE

SEQ ID NO: 2638663 - protein, 9 aa, Entamoeba histolytica
LPETDGDKA

SEQ ID NO: 2638664 - protein, 6 aa, Entamoeba histolytica
LPETEK

SEQ ID NO: 2638665 - protein, 6 aa, Entamoeba histolytica
LPETGL

SEQ ID NO: 2638666 - protein, 8 aa, Entamoeba histolytica
LPETPTGN

SEQ ID NO: 2638667 - protein, 25 aa, Entamoeba histolytica
LPETQPKKENTSEGPKEEEKKERIK

SEQ ID NO: 2638668 - protein, 19 aa, Entamoeba histolytica
LPETTEANLNTKEKQQSSC

SEQ ID NO: 2638669 - protein, 5 aa, Entamoeba histolytica
LPETV

SEQ ID NO: 2638670 - protein, 8 aa, Entamoeba histolytica
LPEVNSQS

SEQ ID NO: 2638671 - protein, 5 aa, Entamoeba histolytica
LPFSS

SEQ ID NO: 2638672 - protein, 11 aa, Entamoeba histolytica
LPGCDDKGKPL

SEQ ID NO: 2638673 - protein, 4 aa, Entamoeba histolytica
LPGD

SEQ ID NO: 2638674 - protein, 7 aa, Entamoeba histolytica
LPGDADN

SEQ ID NO: 2638675 - protein, 7 aa, Entamoeba histolytica
LPGDNQL

SEQ ID NO: 2638676 - protein, 10 aa, Entamoeba histolytica
LPGESKKGTG

SEQ ID NO: 2638677 - protein, 7 aa, Entamoeba histolytica
LPGGPYY

SEQ ID NO: 2638678 - protein, 12 aa, Entamoeba histolytica
LPGGTTGSINPY

SEQ ID NO: 2638679 - protein, 15 aa, Entamoeba histolytica
LPGIAGNDSSKTSIP

SEQ ID NO: 2638680 - protein, 6 aa, Entamoeba histolytica
LPGIGP

SEQ ID NO: 2638681 - protein, 8 aa, Entamoeba histolytica
LPGLETAS

SEQ ID NO: 2638682 - protein, 4 aa, Entamoeba histolytica
LPGP

SEQ ID NO: 2638683 - protein, 11 aa, Entamoeba histolytica
LPGRAPNSVKN

SEQ ID NO: 2638684 - protein, 11 aa, Entamoeba histolytica
LPGTNAVNTTC

SEQ ID NO: 2638685 - protein, 12 aa, Entamoeba histolytica
LPGTSPFTGEES

SEQ ID NO: 2638686 - protein, 5 aa, Entamoeba histolytica
LPGYP

SEQ ID NO: 2638687 - protein, 4 aa, Entamoeba histolytica
LPHD

SEQ ID NO: 2638688 - protein, 5 aa, Entamoeba histolytica
LPHGT

SEQ ID NO: 2638689 - protein, 8 aa, Entamoeba histolytica
LPHKSSNS

SEQ ID NO: 2638690 - protein, 4 aa, Entamoeba histolytica
LPHL

SEQ ID NO: 2638691 - protein, 4 aa, Entamoeba histolytica
LPHN

SEQ ID NO: 2638692 - protein, 5 aa, Entamoeba histolytica
LPIEE

SEQ ID NO: 2638693 - protein, 7 aa, Entamoeba histolytica
LPIEKGS

SEQ ID NO: 2638694 - protein, 11 aa, Entamoeba histolytica
LPINPTPNPTM

SEQ ID NO: 2638695 - protein, 10 aa, Entamoeba histolytica
LPIQEEETEF

SEQ ID NO: 2638696 - protein, 6 aa, Entamoeba histolytica
LPIQGS

SEQ ID NO: 2638697 - protein, 19 aa, Entamoeba histolytica
LPIQTTGPTQKSNSSQKRT

SEQ ID NO: 2638698 - protein, 4 aa, Entamoeba histolytica
LPIY

SEQ ID NO: 2638699 - protein, 14 aa, Entamoeba histolytica
LPKDLKEEQSGMRS

SEQ ID NO: 2638700 - protein, 11 aa, Entamoeba histolytica
LPKDNGKLNKG

SEQ ID NO: 2638701 - protein, 15 aa, Entamoeba histolytica
LPKEERIEADGTTKE

SEQ ID NO: 2638702 - protein, 7 aa, Entamoeba histolytica
LPKEPRE

SEQ ID NO: 2638703 - protein, 26 aa, Entamoeba histolytica
LPKEPRKMTPLSENSDNRKILPEPVS

SEQ ID NO: 2638704 - protein, 6 aa, Entamoeba histolytica
LPKEPV

SEQ ID NO: 2638705 - protein, 9 aa, Entamoeba histolytica
LPKESEEYR

SEQ ID NO: 2638706 - protein, 6 aa, Entamoeba histolytica
LPKETK

SEQ ID NO: 2638707 - protein, 7 aa, Entamoeba histolytica
LPKETNS

SEQ ID NO: 2638708 - protein, 9 aa, Entamoeba histolytica
LPKGTSNID

SEQ ID NO: 2638709 - protein, 7 aa, Entamoeba histolytica
LPKGYES

SEQ ID NO: 2638710 - protein, 4 aa, Entamoeba histolytica
LPKK

SEQ ID NO: 2638711 - protein, 5 aa, Entamoeba histolytica
LPKKC

SEQ ID NO: 2638712 - protein, 6 aa, Entamoeba histolytica
LPKKED

SEQ ID NO: 2638713 - protein, 68 aa, Entamoeba histolytica
LPKKEDTKTTRKDDNESSKDYKDDRSHKRKGNDEEYSRRDERNYRGDYRRNNSKSSRSSSRKRDRGGR

SEQ ID NO: 2638714 - protein, 7 aa, Entamoeba histolytica
LPKKEYP

SEQ ID NO: 2638715 - protein, 6 aa, Entamoeba histolytica
LPKKNY

SEQ ID NO: 2638716 - protein, 14 aa, Entamoeba histolytica
LPKKPVEEPDCQKK

SEQ ID NO: 2638717 - protein, 5 aa, Entamoeba histolytica
LPKLQ

SEQ ID NO: 2638718 - protein, 6 aa, Entamoeba histolytica
LPKLTE

SEQ ID NO: 2638719 - protein, 6 aa, Entamoeba histolytica
LPKNSK

SEQ ID NO: 2638720 - protein, 16 aa, Entamoeba histolytica
LPKPITSSSEKKLIKS

SEQ ID NO: 2638721 - protein, 7 aa, Entamoeba histolytica
LPKPNPE

SEQ ID NO: 2638722 - protein, 9 aa, Entamoeba histolytica
LPKPQDDNY

SEQ ID NO: 2638723 - protein, 12 aa, Entamoeba histolytica
LPKQNEVKNEPI

SEQ ID NO: 2638724 - protein, 6 aa, Entamoeba histolytica
LPKRDS

SEQ ID NO: 2638725 - protein, 4 aa, Entamoeba histolytica
LPKS

SEQ ID NO: 2638726 - protein, 6 aa, Entamoeba histolytica
LPKSLQ

SEQ ID NO: 2638727 - protein, 11 aa, Entamoeba histolytica
LPKSQRSNLDP

SEQ ID NO: 2638728 - protein, 6 aa, Entamoeba histolytica
LPKSTT

SEQ ID NO: 2638729 - protein, 4 aa, Entamoeba histolytica
LPKT

SEQ ID NO: 2638730 - protein, 9 aa, Entamoeba histolytica
LPKTETKGT

SEQ ID NO: 2638731 - protein, 23 aa, Entamoeba histolytica
LPKTQRERNKSKKSSKEEKEEFD

SEQ ID NO: 2638732 - protein, 11 aa, Entamoeba histolytica
LPKTSQNNISS

SEQ ID NO: 2638733 - protein, 11 aa, Entamoeba histolytica
LPKTTQKKMNN

SEQ ID NO: 2638734 - protein, 7 aa, Entamoeba histolytica
LPKTTSV

SEQ ID NO: 2638735 - protein, 7 aa, Entamoeba histolytica
LPLNPHE

SEQ ID NO: 2638736 - protein, 8 aa, Entamoeba histolytica
LPLPPKDL

SEQ ID NO: 2638737 - protein, 12 aa, Entamoeba histolytica
LPLQTSSTIEIN

SEQ ID NO: 2638738 - protein, 4 aa, Entamoeba histolytica
LPLS

SEQ ID NO: 2638739 - protein, 24 aa, Entamoeba histolytica
LPLSNSSSSTFDPLQPPSLKCTVN

SEQ ID NO: 2638740 - protein, 13 aa, Entamoeba histolytica
LPLSPDDTNQTTF

SEQ ID NO: 2638741 - protein, 13 aa, Entamoeba histolytica
LPLSRGTQPYLSS

SEQ ID NO: 2638742 - protein, 7 aa, Entamoeba histolytica
LPLSTKG

SEQ ID NO: 2638743 - protein, 5 aa, Entamoeba histolytica
LPLTT

SEQ ID NO: 2638744 - protein, 9 aa, Entamoeba histolytica
LPNASINSK

SEQ ID NO: 2638745 - protein, 10 aa, Entamoeba histolytica
LPNDEDSHYI

SEQ ID NO: 2638746 - protein, 7 aa, Entamoeba histolytica
LPNDQGR

SEQ ID NO: 2638747 - protein, 9 aa, Entamoeba histolytica
LPNDQNESL

SEQ ID NO: 2638748 - protein, 5 aa, Entamoeba histolytica
LPNEM

SEQ ID NO: 2638749 - protein, 7 aa, Entamoeba histolytica
LPNEPKS

SEQ ID NO: 2638750 - protein, 9 aa, Entamoeba histolytica
LPNERRNEL

SEQ ID NO: 2638751 - protein, 12 aa, Entamoeba histolytica
LPNETDVKEDPM

SEQ ID NO: 2638752 - protein, 4 aa, Entamoeba histolytica
LPNG

SEQ ID NO: 2638753 - protein, 16 aa, Entamoeba histolytica
LPNGSYEDWKVSELIV

SEQ ID NO: 2638754 - protein, 8 aa, Entamoeba histolytica
LPNKKQKL

SEQ ID NO: 2638755 - protein, 8 aa, Entamoeba histolytica
LPNNSLTL

SEQ ID NO: 2638756 - protein, 8 aa, Entamoeba histolytica
LPNNTTET

SEQ ID NO: 2638757 - protein, 7 aa, Entamoeba histolytica
LPNQLTD

SEQ ID NO: 2638758 - protein, 7 aa, Entamoeba histolytica
LPNQQTP

SEQ ID NO: 2638759 - protein, 5 aa, Entamoeba histolytica
LPNQS

SEQ ID NO: 2638760 - protein, 7 aa, Entamoeba histolytica
LPNSDAR

SEQ ID NO: 2638761 - protein, 21 aa, Entamoeba histolytica
LPNSNDNFTRNNYHKTNNFDT

SEQ ID NO: 2638762 - protein, 14 aa, Entamoeba histolytica
LPNSQLSKIKLKQI

SEQ ID NO: 2638763 - protein, 5 aa, Entamoeba histolytica
LPNST

SEQ ID NO: 2638764 - protein, 5 aa, Entamoeba histolytica
LPNTL

SEQ ID NO: 2638765 - protein, 13 aa, Entamoeba histolytica
LPPDVRKKANRYL

SEQ ID NO: 2638766 - protein, 4 aa, Entamoeba histolytica
LPPE

SEQ ID NO: 2638767 - protein, 16 aa, Entamoeba histolytica
LPPECNNQQLSKPEPK

SEQ ID NO: 2638768 - protein, 5 aa, Entamoeba histolytica
LPPEE

SEQ ID NO: 2638769 - protein, 7 aa, Entamoeba histolytica
LPPELQD

SEQ ID NO: 2638770 - protein, 5 aa, Entamoeba histolytica
LPPFG

SEQ ID NO: 2638771 - protein, 7 aa, Entamoeba histolytica
LPPGGNH

SEQ ID NO: 2638772 - protein, 7 aa, Entamoeba histolytica
LPPGLKA

SEQ ID NO: 2638773 - protein, 8 aa, Entamoeba histolytica
LPPGQMAT

SEQ ID NO: 2638774 - protein, 16 aa, Entamoeba histolytica
LPPGTDVKDESERPKK

SEQ ID NO: 2638775 - protein, 13 aa, Entamoeba histolytica
LPPGTETKDVSQN

SEQ ID NO: 2638776 - protein, 6 aa, Entamoeba histolytica
LPPGTY

SEQ ID NO: 2638777 - protein, 4 aa, Entamoeba histolytica
LPPH

SEQ ID NO: 2638778 - protein, 15 aa, Entamoeba histolytica
LPPINTTNKNEQHNS

SEQ ID NO: 2638779 - protein, 11 aa, Entamoeba histolytica
LPPIQEKTENF

SEQ ID NO: 2638780 - protein, 7 aa, Entamoeba histolytica
LPPKESY

SEQ ID NO: 2638781 - protein, 17 aa, Entamoeba histolytica
LPPKETTLPKTEEKDEI

SEQ ID NO: 2638782 - protein, 5 aa, Entamoeba histolytica
LPPKI

SEQ ID NO: 2638783 - protein, 7 aa, Entamoeba histolytica
LPPKPSQ

SEQ ID NO: 2638784 - protein, 18 aa, Entamoeba histolytica
LPPKPSQKEVDERNCEES

SEQ ID NO: 2638785 - protein, 16 aa, Entamoeba histolytica
LPPKQPKKKCASVSSQ

SEQ ID NO: 2638786 - protein, 5 aa, Entamoeba histolytica
LPPKT

SEQ ID NO: 2638787 - protein, 18 aa, Entamoeba histolytica
LPPLPPPKPNTNSTNPFD

SEQ ID NO: 2638788 - protein, 23 aa, Entamoeba histolytica
LPPLPTQESKTRSTETYSSEVDN

SEQ ID NO: 2638789 - protein, 6 aa, Entamoeba histolytica
LPPMNG

SEQ ID NO: 2638790 - protein, 7 aa, Entamoeba histolytica
LPPNHKQ

SEQ ID NO: 2638791 - protein, 6 aa, Entamoeba histolytica
LPPPIH

SEQ ID NO: 2638792 - protein, 16 aa, Entamoeba histolytica
LPPPNMKLNESKEEIT

SEQ ID NO: 2638793 - protein, 18 aa, Entamoeba histolytica
LPPPPPPVTEVEEEEDIE

SEQ ID NO: 2638794 - protein, 16 aa, Entamoeba histolytica
LPPPPSKSKPKKEKIP

SEQ ID NO: 2638795 - protein, 6 aa, Entamoeba histolytica
LPPPQL

SEQ ID NO: 2638796 - protein, 9 aa, Entamoeba histolytica
LPPPSSPKL

SEQ ID NO: 2638797 - protein, 14 aa, Entamoeba histolytica
LPPQHSEYNSLNNS

SEQ ID NO: 2638798 - protein, 6 aa, Entamoeba histolytica
LPPRVS

SEQ ID NO: 2638799 - protein, 8 aa, Entamoeba histolytica
LPPSENEL

SEQ ID NO: 2638800 - protein, 8 aa, Entamoeba histolytica
LPPSFQTN

SEQ ID NO: 2638801 - protein, 7 aa, Entamoeba histolytica
LPPSNKA

SEQ ID NO: 2638802 - protein, 7 aa, Entamoeba histolytica
LPPSQPI

SEQ ID NO: 2638803 - protein, 12 aa, Entamoeba histolytica
LPPSQQSTQNIR

SEQ ID NO: 2638804 - protein, 50 aa, Entamoeba histolytica
LPPSRGNTTNPSSTITNSKPLVPSRAAPKVNTQTTTPNVDVTQHENNSFK

SEQ ID NO: 2638805 - protein, 5 aa, Entamoeba histolytica
LPPST

SEQ ID NO: 2638806 - protein, 4 aa, Entamoeba histolytica
LPPT

SEQ ID NO: 2638807 - protein, 9 aa, Entamoeba histolytica
LPPTEENSK

SEQ ID NO: 2638808 - protein, 6 aa, Entamoeba histolytica
LPPTIK

SEQ ID NO: 2638809 - protein, 21 aa, Entamoeba histolytica
LPPTKVSLKTNSSENEEFPLP

SEQ ID NO: 2638810 - protein, 32 aa, Entamoeba histolytica
LPPTSTPVETIEPSLSKSSIDIENGPSTPIKT

SEQ ID NO: 2638811 - protein, 4 aa, Entamoeba histolytica
LPPV

SEQ ID NO: 2638812 - protein, 20 aa, Entamoeba histolytica
LPQAGKQLTKALEEGKGKNT

SEQ ID NO: 2638813 - protein, 12 aa, Entamoeba histolytica
LPQDDNKEIREE

SEQ ID NO: 2638814 - protein, 10 aa, Entamoeba histolytica
LPQDNQQPVV

SEQ ID NO: 2638815 - protein, 5 aa, Entamoeba histolytica
LPQEC

SEQ ID NO: 2638816 - protein, 9 aa, Entamoeba histolytica
LPQEEEEKH

SEQ ID NO: 2638817 - protein, 13 aa, Entamoeba histolytica
LPQELASVHIHRP

SEQ ID NO: 2638818 - protein, 6 aa, Entamoeba histolytica
LPQGQW

SEQ ID NO: 2638819 - protein, 17 aa, Entamoeba histolytica
LPQKKNKENKDDVPVQE

SEQ ID NO: 2638820 - protein, 22 aa, Entamoeba histolytica
LPQKTTLTEQSTNTKTNDYVKT

SEQ ID NO: 2638821 - protein, 4 aa, Entamoeba histolytica
LPQL

SEQ ID NO: 2638822 - protein, 7 aa, Entamoeba histolytica
LPQNAPS

SEQ ID NO: 2638823 - protein, 7 aa, Entamoeba histolytica
LPQPDSE

SEQ ID NO: 2638824 - protein, 27 aa, Entamoeba histolytica
LPQPGDKPGDKSDSPTIIPKPKVESIE

SEQ ID NO: 2638825 - protein, 8 aa, Entamoeba histolytica
LPQQEQQR

SEQ ID NO: 2638826 - protein, 9 aa, Entamoeba histolytica
LPQRETKGL

SEQ ID NO: 2638827 - protein, 32 aa, Entamoeba histolytica
LPQSAISPREGNKEFQPSQIGDGENGVGSPRV

SEQ ID NO: 2638828 - protein, 7 aa, Entamoeba histolytica
LPQSKEG

SEQ ID NO: 2638829 - protein, 7 aa, Entamoeba histolytica
LPQSLKS

SEQ ID NO: 2638830 - protein, 7 aa, Entamoeba histolytica
LPQSTLN

SEQ ID NO: 2638831 - protein, 7 aa, Entamoeba histolytica
LPQTDSV

SEQ ID NO: 2638832 - protein, 17 aa, Entamoeba histolytica
LPQTIPRNSIPSNEPLS

SEQ ID NO: 2638833 - protein, 5 aa, Entamoeba histolytica
LPQTM

SEQ ID NO: 2638834 - protein, 7 aa, Entamoeba histolytica
LPQTQQE

SEQ ID NO: 2638835 - protein, 14 aa, Entamoeba histolytica
LPRDVISSFKRIMK

SEQ ID NO: 2638836 - protein, 5 aa, Entamoeba histolytica
LPRGP

SEQ ID NO: 2638837 - protein, 6 aa, Entamoeba histolytica
LPRGSG

SEQ ID NO: 2638838 - protein, 10 aa, Entamoeba histolytica
LPRKEGKTIY

SEQ ID NO: 2638839 - protein, 9 aa, Entamoeba histolytica
LPRKKNDIE

SEQ ID NO: 2638840 - protein, 6 aa, Entamoeba histolytica
LPRNER

SEQ ID NO: 2638841 - protein, 5 aa, Entamoeba histolytica
LPRTI

SEQ ID NO: 2638842 - protein, 9 aa, Entamoeba histolytica
LPRTPSARK

SEQ ID NO: 2638843 - protein, 13 aa, Entamoeba histolytica
LPSAPKVNAPISQ

SEQ ID NO: 2638844 - protein, 11 aa, Entamoeba histolytica
LPSAVGGGANL

SEQ ID NO: 2638845 - protein, 5 aa, Entamoeba histolytica
LPSDF

SEQ ID NO: 2638846 - protein, 4 aa, Entamoeba histolytica
LPSE

SEQ ID NO: 2638847 - protein, 5 aa, Entamoeba histolytica
LPSEK

SEQ ID NO: 2638848 - protein, 7 aa, Entamoeba histolytica
LPSEKID

SEQ ID NO: 2638849 - protein, 8 aa, Entamoeba histolytica
LPSEKSRV

SEQ ID NO: 2638850 - protein, 6 aa, Entamoeba histolytica
LPSENG

SEQ ID NO: 2638851 - protein, 4 aa, Entamoeba histolytica
LPSF

SEQ ID NO: 2638852 - protein, 9 aa, Entamoeba histolytica
LPSGDVHQK

SEQ ID NO: 2638853 - protein, 11 aa, Entamoeba histolytica
LPSGNTVPMKD

SEQ ID NO: 2638854 - protein, 5 aa, Entamoeba histolytica
LPSIE

SEQ ID NO: 2638855 - protein, 5 aa, Entamoeba histolytica
LPSIQ

SEQ ID NO: 2638856 - protein, 4 aa, Entamoeba histolytica
LPSK

SEQ ID NO: 2638857 - protein, 8 aa, Entamoeba histolytica
LPSKEPVV

SEQ ID NO: 2638858 - protein, 39 aa, Entamoeba histolytica
LPSKITTENDRQQKRNENLKTARDTTISITERKKAYGQA

SEQ ID NO: 2638859 - protein, 5 aa, Entamoeba histolytica
LPSKS

SEQ ID NO: 2638860 - protein, 7 aa, Entamoeba histolytica
LPSKSRN

SEQ ID NO: 2638861 - protein, 5 aa, Entamoeba histolytica
LPSLD

SEQ ID NO: 2638862 - protein, 7 aa, Entamoeba histolytica
LPSLSDK

SEQ ID NO: 2638863 - protein, 7 aa, Entamoeba histolytica
LPSLSSS

SEQ ID NO: 2638864 - protein, 6 aa, Entamoeba histolytica
LPSNEN

SEQ ID NO: 2638865 - protein, 8 aa, Entamoeba histolytica
LPSNISNE

SEQ ID NO: 2638866 - protein, 6 aa, Entamoeba histolytica
LPSNNI

SEQ ID NO: 2638867 - protein, 7 aa, Entamoeba histolytica
LPSNRTD

SEQ ID NO: 2638868 - protein, 7 aa, Entamoeba histolytica
LPSPKQM

SEQ ID NO: 2638869 - protein, 8 aa, Entamoeba histolytica
LPSPLKRP

SEQ ID NO: 2638870 - protein, 6 aa, Entamoeba histolytica
LPSPNS

SEQ ID NO: 2638871 - protein, 8 aa, Entamoeba histolytica
LPSPRNPS

SEQ ID NO: 2638872 - protein, 6 aa, Entamoeba histolytica
LPSQDQ

SEQ ID NO: 2638873 - protein, 5 aa, Entamoeba histolytica
LPSQE

SEQ ID NO: 2638874 - protein, 13 aa, Entamoeba histolytica
LPSQMKQSNNSSF

SEQ ID NO: 2638875 - protein, 8 aa, Entamoeba histolytica
LPSQPTIH

SEQ ID NO: 2638876 - protein, 4 aa, Entamoeba histolytica
LPSR

SEQ ID NO: 2638877 - protein, 18 aa, Entamoeba histolytica
LPSRPKTGFGTPTKKKSR

SEQ ID NO: 2638878 - protein, 11 aa, Entamoeba histolytica
LPSRPWKGTRL

SEQ ID NO: 2638879 - protein, 5 aa, Entamoeba histolytica
LPSSD

SEQ ID NO: 2638880 - protein, 5 aa, Entamoeba histolytica
LPSSE

SEQ ID NO: 2638881 - protein, 12 aa, Entamoeba histolytica
LPSSIGQYNHSS

SEQ ID NO: 2638882 - protein, 7 aa, Entamoeba histolytica
LPSSISS

SEQ ID NO: 2638883 - protein, 5 aa, Entamoeba histolytica
LPSSL

SEQ ID NO: 2638884 - protein, 6 aa, Entamoeba histolytica
LPSSNY

SEQ ID NO: 2638885 - protein, 7 aa, Entamoeba histolytica
LPSSSVS

SEQ ID NO: 2638886 - protein, 16 aa, Entamoeba histolytica
LPSSTNQYNELEEQEL

SEQ ID NO: 2638887 - protein, 14 aa, Entamoeba histolytica
LPSSTTEEPSEGNL

SEQ ID NO: 2638888 - protein, 8 aa, Entamoeba histolytica
LPSSTYPF

SEQ ID NO: 2638889 - protein, 11 aa, Entamoeba histolytica
LPSTENNQDVN

SEQ ID NO: 2638890 - protein, 7 aa, Entamoeba histolytica
LPSTEQK

SEQ ID NO: 2638891 - protein, 5 aa, Entamoeba histolytica
LPSTI

SEQ ID NO: 2638892 - protein, 8 aa, Entamoeba histolytica
LPSTLKSI

SEQ ID NO: 2638893 - protein, 9 aa, Entamoeba histolytica
LPSTPVNGY

SEQ ID NO: 2638894 - protein, 6 aa, Entamoeba histolytica
LPSTVD

SEQ ID NO: 2638895 - protein, 4 aa, Entamoeba histolytica
LPSV

SEQ ID NO: 2638896 - protein, 5 aa, Entamoeba histolytica
LPSYK

SEQ ID NO: 2638897 - protein, 6 aa, Entamoeba histolytica
LPSYPE

SEQ ID NO: 2638898 - protein, 8 aa, Entamoeba histolytica
LPTAEDKT

SEQ ID NO: 2638899 - protein, 4 aa, Entamoeba histolytica
LPTD

SEQ ID NO: 2638900 - protein, 16 aa, Entamoeba histolytica
LPTDVDGEKIKAKYQD

SEQ ID NO: 2638901 - protein, 12 aa, Entamoeba histolytica
LPTEKKERIRTP

SEQ ID NO: 2638902 - protein, 6 aa, Entamoeba histolytica
LPTEQF

SEQ ID NO: 2638903 - protein, 4 aa, Entamoeba histolytica
LPTG

SEQ ID NO: 2638904 - protein, 4 aa, Entamoeba histolytica
LPTK

SEQ ID NO: 2638905 - protein, 18 aa, Entamoeba histolytica
LPTKNINSSEDESENDLP

SEQ ID NO: 2638906 - protein, 11 aa, Entamoeba histolytica
LPTKTPRDKAI

SEQ ID NO: 2638907 - protein, 4 aa, Entamoeba histolytica
LPTN

SEQ ID NO: 2638908 - protein, 6 aa, Entamoeba histolytica
LPTNGS

SEQ ID NO: 2638909 - protein, 33 aa, Entamoeba histolytica
LPTNVNTKKLEDMKKGEVSSSSAIESETEECKN

SEQ ID NO: 2638910 - protein, 6 aa, Entamoeba histolytica
LPTPPI

SEQ ID NO: 2638911 - protein, 17 aa, Entamoeba histolytica
LPTPQKKSFQQQEENEL

SEQ ID NO: 2638912 - protein, 7 aa, Entamoeba histolytica
LPTPQKR

SEQ ID NO: 2638913 - protein, 5 aa, Entamoeba histolytica
LPTQR

SEQ ID NO: 2638914 - protein, 8 aa, Entamoeba histolytica
LPTSITSL

SEQ ID NO: 2638915 - protein, 5 aa, Entamoeba histolytica
LPTSL

SEQ ID NO: 2638916 - protein, 7 aa, Entamoeba histolytica
LPTSQNN

SEQ ID NO: 2638917 - protein, 5 aa, Entamoeba histolytica
LPTSV

SEQ ID NO: 2638918 - protein, 5 aa, Entamoeba histolytica
LPTTE

SEQ ID NO: 2638919 - protein, 5 aa, Entamoeba histolytica
LPTTL

SEQ ID NO: 2638920 - protein, 5 aa, Entamoeba histolytica
LPTTR

SEQ ID NO: 2638921 - protein, 11 aa, Entamoeba histolytica
LPVAAGTVGNG

SEQ ID NO: 2638922 - protein, 13 aa, Entamoeba histolytica
LPVASSDKDEPGL

SEQ ID NO: 2638923 - protein, 11 aa, Entamoeba histolytica
LPVATGTVGSG

SEQ ID NO: 2638924 - protein, 13 aa, Entamoeba histolytica
LPVPPRSTQPVPF

SEQ ID NO: 2638925 - protein, 12 aa, Entamoeba histolytica
LPVTEDIKGYGS

SEQ ID NO: 2638926 - protein, 4 aa, Entamoeba histolytica
LPYE

SEQ ID NO: 2638927 - protein, 15 aa, Entamoeba histolytica
LPYESQEKQETITEN

SEQ ID NO: 2638928 - protein, 7 aa, Entamoeba histolytica
LPYGSDA

SEQ ID NO: 2638929 - protein, 7 aa, Entamoeba histolytica
LPYSPNV

SEQ ID NO: 2638930 - protein, 6 aa, Entamoeba histolytica
LPYSQR

SEQ ID NO: 2638931 - protein, 4 aa, Entamoeba histolytica
LPYT

SEQ ID NO: 2638932 - protein, 11 aa, Entamoeba histolytica
LPYTHDDGSFS

SEQ ID NO: 2638933 - protein, 19 aa, Entamoeba histolytica
LQAEIDNEETKKELDATTK

SEQ ID NO: 2638934 - protein, 29 aa, Entamoeba histolytica
LQAEMDKEKEESQTNVLSQENSTTQHEEN

SEQ ID NO: 2638935 - protein, 12 aa, Entamoeba histolytica
LQAKESGKGVNQ

SEQ ID NO: 2638936 - protein, 11 aa, Entamoeba histolytica
LQAQPLPPSIN

SEQ ID NO: 2638937 - protein, 7 aa, Entamoeba histolytica
LQDASNL

SEQ ID NO: 2638938 - protein, 14 aa, Entamoeba histolytica
LQDEEQCTKDYYDN

SEQ ID NO: 2638939 - protein, 7 aa, Entamoeba histolytica
LQDENNP

SEQ ID NO: 2638940 - protein, 8 aa, Entamoeba histolytica
LQDERGEV

SEQ ID NO: 2638941 - protein, 6 aa, Entamoeba histolytica
LQDGLE

SEQ ID NO: 2638942 - protein, 7 aa, Entamoeba histolytica
LQDKNQE

SEQ ID NO: 2638943 - protein, 9 aa, Entamoeba histolytica
LQDKSKDEI

SEQ ID NO: 2638944 - protein, 6 aa, Entamoeba histolytica
LQDPES

SEQ ID NO: 2638945 - protein, 7 aa, Entamoeba histolytica
LQDPSKR

SEQ ID NO: 2638946 - protein, 14 aa, Entamoeba histolytica
LQDPTEGVNRNQMG

SEQ ID NO: 2638947 - protein, 5 aa, Entamoeba histolytica
LQDQN

SEQ ID NO: 2638948 - protein, 10 aa, Entamoeba histolytica
LQDQTEKSNR

SEQ ID NO: 2638949 - protein, 18 aa, Entamoeba histolytica
LQDRNESKNETKTEQSFE

SEQ ID NO: 2638950 - protein, 9 aa, Entamoeba histolytica
LQEDDKKKL

SEQ ID NO: 2638951 - protein, 10 aa, Entamoeba histolytica
LQEDKNGKYP

SEQ ID NO: 2638952 - protein, 5 aa, Entamoeba histolytica
LQEEE

SEQ ID NO: 2638953 - protein, 9 aa, Entamoeba histolytica
LQEEKTPSL

SEQ ID NO: 2638954 - protein, 12 aa, Entamoeba histolytica
LQEERKKEIEDL

SEQ ID NO: 2638955 - protein, 8 aa, Entamoeba histolytica
LQEETQQI

SEQ ID NO: 2638956 - protein, 20 aa, Entamoeba histolytica
LQEKQVTSFPSLKNNDNQKE

SEQ ID NO: 2638957 - protein, 4 aa, Entamoeba histolytica
LQEM

SEQ ID NO: 2638958 - protein, 11 aa, Entamoeba histolytica
LQENENSITYG

SEQ ID NO: 2638959 - protein, 8 aa, Entamoeba histolytica
LQENKPPL

SEQ ID NO: 2638960 - protein, 8 aa, Entamoeba histolytica
LQENNDCS

SEQ ID NO: 2638961 - protein, 6 aa, Entamoeba histolytica
LQENRP

SEQ ID NO: 2638962 - protein, 10 aa, Entamoeba histolytica
LQEPSPSSQE

SEQ ID NO: 2638963 - protein, 6 aa, Entamoeba histolytica
LQEQRY

SEQ ID NO: 2638964 - protein, 15 aa, Entamoeba histolytica
LQESGLSASLIKSII

SEQ ID NO: 2638965 - protein, 10 aa, Entamoeba histolytica
LQETKGKEGV

SEQ ID NO: 2638966 - protein, 14 aa, Entamoeba histolytica
LQEVKDKNNMEEVG

SEQ ID NO: 2638967 - protein, 11 aa, Entamoeba histolytica
LQEYKNKNSNA

SEQ ID NO: 2638968 - protein, 12 aa, Entamoeba histolytica
LQGAQGVSEVPY

SEQ ID NO: 2638969 - protein, 6 aa, Entamoeba histolytica
LQGDES

SEQ ID NO: 2638970 - protein, 20 aa, Entamoeba histolytica
LQGDSTVAIGSDGKNLPPNE

SEQ ID NO: 2638971 - protein, 4 aa, Entamoeba histolytica
LQGF

SEQ ID NO: 2638972 - protein, 7 aa, Entamoeba histolytica
LQGHKKK

SEQ ID NO: 2638973 - protein, 6 aa, Entamoeba histolytica
LQGKDI

SEQ ID NO: 2638974 - protein, 9 aa, Entamoeba histolytica
LQGKPGKKV

SEQ ID NO: 2638975 - protein, 6 aa, Entamoeba histolytica
LQGNEK

SEQ ID NO: 2638976 - protein, 11 aa, Entamoeba histolytica
LQGTQNDPFTH

SEQ ID NO: 2638977 - protein, 17 aa, Entamoeba histolytica
LQGTTEFNNEIDKQPSL

SEQ ID NO: 2638978 - protein, 15 aa, Entamoeba histolytica
LQGTTQDKRLSSSIQ

SEQ ID NO: 2638979 - protein, 12 aa, Entamoeba histolytica
LQIQKSKSLHNS

SEQ ID NO: 2638980 - protein, 22 aa, Entamoeba histolytica
LQKANKKKDKLARLTGRRNSLE

SEQ ID NO: 2638981 - protein, 8 aa, Entamoeba histolytica
LQKDAGVS

SEQ ID NO: 2638982 - protein, 5 aa, Entamoeba histolytica
LQKDL

SEQ ID NO: 2638983 - protein, 12 aa, Entamoeba histolytica
LQKDTNTIQEEE

SEQ ID NO: 2638984 - protein, 4 aa, Entamoeba histolytica
LQKE

SEQ ID NO: 2638985 - protein, 8 aa, Entamoeba histolytica
LQKEDKEL

SEQ ID NO: 2638986 - protein, 14 aa, Entamoeba histolytica
LQKEEERRKEEQRV

SEQ ID NO: 2638987 - protein, 5 aa, Entamoeba histolytica
LQKEP

SEQ ID NO: 2638988 - protein, 17 aa, Entamoeba histolytica
LQKEPIRESRSRRIEQK

SEQ ID NO: 2638989 - protein, 21 aa, Entamoeba histolytica
LQKGNNDLETPSSGRTSHYGE

SEQ ID NO: 2638990 - protein, 7 aa, Entamoeba histolytica
LQKKINE

SEQ ID NO: 2638991 - protein, 33 aa, Entamoeba histolytica
LQKPSPPQNLQTTSNPSDDRKQNESNPQPTYNP

SEQ ID NO: 2638992 - protein, 8 aa, Entamoeba histolytica
LQKPTEFQ

SEQ ID NO: 2638993 - protein, 10 aa, Entamoeba histolytica
LQKQENGILS

SEQ ID NO: 2638994 - protein, 6 aa, Entamoeba histolytica
LQKQNP

SEQ ID NO: 2638995 - protein, 17 aa, Entamoeba histolytica
LQKQQEEDWENSRQQRF

SEQ ID NO: 2638996 - protein, 5 aa, Entamoeba histolytica
LQKRE

SEQ ID NO: 2638997 - protein, 12 aa, Entamoeba histolytica
LQKSQEGSIHHK

SEQ ID NO: 2638998 - protein, 7 aa, Entamoeba histolytica
LQKTNEQ

SEQ ID NO: 2638999 - protein, 9 aa, Entamoeba histolytica
LQKTPGNEG

SEQ ID NO: 2639000 - protein, 10 aa, Entamoeba histolytica
LQLNETSNER

SEQ ID NO: 2639001 - protein, 5 aa, Entamoeba histolytica
LQLNP

SEQ ID NO: 2639002 - protein, 5 aa, Entamoeba histolytica
LQNAG

SEQ ID NO: 2639003 - protein, 11 aa, Entamoeba histolytica
LQNANEQTEES

SEQ ID NO: 2639004 - protein, 5 aa, Entamoeba histolytica
LQNDL

SEQ ID NO: 2639005 - protein, 6 aa, Entamoeba histolytica
LQNDQE

SEQ ID NO: 2639006 - protein, 17 aa, Entamoeba histolytica
LQNEGMKKQVEEAHNRM

SEQ ID NO: 2639007 - protein, 6 aa, Entamoeba histolytica
LQNEKK

SEQ ID NO: 2639008 - protein, 7 aa, Entamoeba histolytica
LQNEQDQ

SEQ ID NO: 2639009 - protein, 5 aa, Entamoeba histolytica
LQNET

SEQ ID NO: 2639010 - protein, 5 aa, Entamoeba histolytica
LQNGA

SEQ ID NO: 2639011 - protein, 9 aa, Entamoeba histolytica
LQNGTTTAS

SEQ ID NO: 2639012 - protein, 12 aa, Entamoeba histolytica
LQNKKTKRSYKE

SEQ ID NO: 2639013 - protein, 33 aa, Entamoeba histolytica
LQNMDAKTKEMSEEYTKKEQKMNEESNQKITEL

SEQ ID NO: 2639014 - protein, 16 aa, Entamoeba histolytica
LQNNKVNEFDKRSPVH

SEQ ID NO: 2639015 - protein, 8 aa, Entamoeba histolytica
LQNNNQGV

SEQ ID NO: 2639016 - protein, 9 aa, Entamoeba histolytica
LQNNPEKSL

SEQ ID NO: 2639017 - protein, 9 aa, Entamoeba histolytica
LQNNSTAIN

SEQ ID NO: 2639018 - protein, 9 aa, Entamoeba histolytica
LQNPQTTLG

SEQ ID NO: 2639019 - protein, 8 aa, Entamoeba histolytica
LQNPTEPK

SEQ ID NO: 2639020 - protein, 31 aa, Entamoeba histolytica
LQNQLKNTTESLTQQKKISSLEEEVKEKETL

SEQ ID NO: 2639021 - protein, 9 aa, Entamoeba histolytica
LQNQTQNTQ

SEQ ID NO: 2639022 - protein, 6 aa, Entamoeba histolytica
LQNSEN

SEQ ID NO: 2639023 - protein, 6 aa, Entamoeba histolytica
LQNTKN

SEQ ID NO: 2639024 - protein, 18 aa, Entamoeba histolytica
LQNTTSNTLSEKTEENTL

SEQ ID NO: 2639025 - protein, 6 aa, Entamoeba histolytica
LQNYDA

SEQ ID NO: 2639026 - protein, 12 aa, Entamoeba histolytica
LQPEETKQSGYM

SEQ ID NO: 2639027 - protein, 8 aa, Entamoeba histolytica
LQPGQEKL

SEQ ID NO: 2639028 - protein, 6 aa, Entamoeba histolytica
LQPITN

SEQ ID NO: 2639029 - protein, 5 aa, Entamoeba histolytica
LQPKG

SEQ ID NO: 2639030 - protein, 5 aa, Entamoeba histolytica
LQPNL

SEQ ID NO: 2639031 - protein, 6 aa, Entamoeba histolytica
LQPPIQ

SEQ ID NO: 2639032 - protein, 8 aa, Entamoeba histolytica
LQPPPDLK

SEQ ID NO: 2639033 - protein, 19 aa, Entamoeba histolytica
LQPPPSKLMSSKQRKVKTP

SEQ ID NO: 2639034 - protein, 7 aa, Entamoeba histolytica
LQPPPSQ

SEQ ID NO: 2639035 - protein, 22 aa, Entamoeba histolytica
LQPQQIQNQIPNQSTQPATSSQ

SEQ ID NO: 2639036 - protein, 9 aa, Entamoeba histolytica
LQPSDLGKK

SEQ ID NO: 2639037 - protein, 7 aa, Entamoeba histolytica
LQPSNFE

SEQ ID NO: 2639038 - protein, 8 aa, Entamoeba histolytica
LQPSPQQL

SEQ ID NO: 2639039 - protein, 13 aa, Entamoeba histolytica
LQPSQQKIKKEKI

SEQ ID NO: 2639040 - protein, 5 aa, Entamoeba histolytica
LQPVS

SEQ ID NO: 2639041 - protein, 13 aa, Entamoeba histolytica
LQQEKEQKKETIC

SEQ ID NO: 2639042 - protein, 10 aa, Entamoeba histolytica
LQQGKKKKID

SEQ ID NO: 2639043 - protein, 16 aa, Entamoeba histolytica
LQQKDDQQNVSDGSEL

SEQ ID NO: 2639044 - protein, 19 aa, Entamoeba histolytica
LQQKENKSILDEENNNIPQ

SEQ ID NO: 2639045 - protein, 9 aa, Entamoeba histolytica
LQQKEPGRV

SEQ ID NO: 2639046 - protein, 10 aa, Entamoeba histolytica
LQQKPTITPS

SEQ ID NO: 2639047 - protein, 9 aa, Entamoeba histolytica
LQQKTTSRQ

SEQ ID NO: 2639048 - protein, 11 aa, Entamoeba histolytica
LQQLERKKNIT

SEQ ID NO: 2639049 - protein, 5 aa, Entamoeba histolytica
LQQNE

SEQ ID NO: 2639050 - protein, 20 aa, Entamoeba histolytica
LQQNQKPDDEYITPESFDKE

SEQ ID NO: 2639051 - protein, 6 aa, Entamoeba histolytica
LQQNTY

SEQ ID NO: 2639052 - protein, 4 aa, Entamoeba histolytica
LQQP

SEQ ID NO: 2639053 - protein, 17 aa, Entamoeba histolytica
LQQPETKDSIPQNIPSD

SEQ ID NO: 2639054 - protein, 8 aa, Entamoeba histolytica
LQQPSNNI

SEQ ID NO: 2639055 - protein, 11 aa, Entamoeba histolytica
LQQQAAIQPEP

SEQ ID NO: 2639056 - protein, 11 aa, Entamoeba histolytica
LQQQPSYVDQE

SEQ ID NO: 2639057 - protein, 14 aa, Entamoeba histolytica
LQQRESEEKSLKNE

SEQ ID NO: 2639058 - protein, 10 aa, Entamoeba histolytica
LQQSTDEQLE

SEQ ID NO: 2639059 - protein, 18 aa, Entamoeba histolytica
LQQTNSDGNLAPSSSLSS

SEQ ID NO: 2639060 - protein, 7 aa, Entamoeba histolytica
LQQYDSH

SEQ ID NO: 2639061 - protein, 14 aa, Entamoeba histolytica
LQRDDKCLQCILSL

SEQ ID NO: 2639062 - protein, 28 aa, Entamoeba histolytica
LQREKDRSIKSKSEPYEETSDEHQQINE

SEQ ID NO: 2639063 - protein, 26 aa, Entamoeba histolytica
LQREPNEEDGTELEEGIKEQKRVESN

SEQ ID NO: 2639064 - protein, 6 aa, Entamoeba histolytica
LQRKGI

SEQ ID NO: 2639065 - protein, 9 aa, Entamoeba histolytica
LQRNKDQKE

SEQ ID NO: 2639066 - protein, 9 aa, Entamoeba histolytica
LQRQDAASG

SEQ ID NO: 2639067 - protein, 12 aa, Entamoeba histolytica
LQSINPSDNKSI

SEQ ID NO: 2639068 - protein, 8 aa, Entamoeba histolytica
LQSKPITI

SEQ ID NO: 2639069 - protein, 10 aa, Entamoeba histolytica
LQSKSQDSNI

SEQ ID NO: 2639070 - protein, 22 aa, Entamoeba histolytica
LQSLENEPKQSTGDSISQTELK

SEQ ID NO: 2639071 - protein, 8 aa, Entamoeba histolytica
LQSPNEEK

SEQ ID NO: 2639072 - protein, 7 aa, Entamoeba histolytica
LQSPTAI

SEQ ID NO: 2639073 - protein, 7 aa, Entamoeba histolytica
LQSQNGL

SEQ ID NO: 2639074 - protein, 9 aa, Entamoeba histolytica
LQSSTKTDE

SEQ ID NO: 2639075 - protein, 10 aa, Entamoeba histolytica
LQSTNPVDFK

SEQ ID NO: 2639076 - protein, 10 aa, Entamoeba histolytica
LQSTSPPSIP

SEQ ID NO: 2639077 - protein, 9 aa, Entamoeba histolytica
LQSTTGPSF

SEQ ID NO: 2639078 - protein, 4 aa, Entamoeba histolytica
LQTE

SEQ ID NO: 2639079 - protein, 7 aa, Entamoeba histolytica
LQTEEMN

SEQ ID NO: 2639080 - protein, 8 aa, Entamoeba histolytica
LQTENFNQ

SEQ ID NO: 2639081 - protein, 5 aa, Entamoeba histolytica
LQTES

SEQ ID NO: 2639082 - protein, 7 aa, Entamoeba histolytica
LQTGFDE

SEQ ID NO: 2639083 - protein, 4 aa, Entamoeba histolytica
LQTI

SEQ ID NO: 2639084 - protein, 9 aa, Entamoeba histolytica
LQTKDDSPA

SEQ ID NO: 2639085 - protein, 6 aa, Entamoeba histolytica
LQTNHE

SEQ ID NO: 2639086 - protein, 10 aa, Entamoeba histolytica
LQTPGEERTL

SEQ ID NO: 2639087 - protein, 6 aa, Entamoeba histolytica
LQTQPD

SEQ ID NO: 2639088 - protein, 7 aa, Entamoeba histolytica
LQTQSKK

SEQ ID NO: 2639089 - protein, 15 aa, Entamoeba histolytica
LQTQYPKEFGEGTSL

SEQ ID NO: 2639090 - protein, 5 aa, Entamoeba histolytica
LQTVN

SEQ ID NO: 2639091 - protein, 8 aa, Entamoeba histolytica
LQWDPSKI

SEQ ID NO: 2639092 - protein, 11 aa, Entamoeba histolytica
LQYERAQTVED

SEQ ID NO: 2639093 - protein, 4 aa, Entamoeba histolytica
LRAT

SEQ ID NO: 2639094 - protein, 10 aa, Entamoeba histolytica
LRATGTAREI

SEQ ID NO: 2639095 - protein, 5 aa, Entamoeba histolytica
LRCPN

SEQ ID NO: 2639096 - protein, 28 aa, Entamoeba histolytica
LRDDPKEVKNLQDNGEAPYTKEDGDKLA

SEQ ID NO: 2639097 - protein, 4 aa, Entamoeba histolytica
LRDE

SEQ ID NO: 2639098 - protein, 13 aa, Entamoeba histolytica
LRDGDKKRYGGKG

SEQ ID NO: 2639099 - protein, 6 aa, Entamoeba histolytica
LRDGDS

SEQ ID NO: 2639100 - protein, 5 aa, Entamoeba histolytica
LRDKR

SEQ ID NO: 2639101 - protein, 34 aa, Entamoeba histolytica
LRDMKEKEEVEKKDNETKKQENTELKEYSNEGQR

SEQ ID NO: 2639102 - protein, 15 aa, Entamoeba histolytica
LRDNAAEVKKITDQG

SEQ ID NO: 2639103 - protein, 8 aa, Entamoeba histolytica
LRDNKQRK

SEQ ID NO: 2639104 - protein, 7 aa, Entamoeba histolytica
LRDTTTT

SEQ ID NO: 2639105 - protein, 45 aa, Entamoeba histolytica
LRDVSNDDFRSRLKDKSKDKPKDKSKDKSKDKSKDKPKDKPKELD

SEQ ID NO: 2639106 - protein, 7 aa, Entamoeba histolytica
LREDGDK

SEQ ID NO: 2639107 - protein, 57 aa, Entamoeba histolytica
LREEKLKNKQKTKSAVGLTKEEDPSKQSLSESKQEIRTSISKPKPKILTKPEEKTNI

SEQ ID NO: 2639108 - protein, 7 aa, Entamoeba histolytica
LREESMN

SEQ ID NO: 2639109 - protein, 6 aa, Entamoeba histolytica
LREGDS

SEQ ID NO: 2639110 - protein, 9 aa, Entamoeba histolytica
LREKKKDVH

SEQ ID NO: 2639111 - protein, 36 aa, Entamoeba histolytica
LREKPEEQFERPKEVTKRKVEEAIPKTEDKTTKKVV

SEQ ID NO: 2639112 - protein, 11 aa, Entamoeba histolytica
LREKTKDDEVI

SEQ ID NO: 2639113 - protein, 67 aa, Entamoeba histolytica
LREPRQPAGPSEADTADSWRRKEGEAFVPRKAPTEFREHEQREPRQPAGPSEADTADSWRRKEGEAF

SEQ ID NO: 2639114 - protein, 11 aa, Entamoeba histolytica
LREQTKQELEQ

SEQ ID NO: 2639115 - protein, 13 aa, Entamoeba histolytica
LRERVKKERGINN

SEQ ID NO: 2639116 - protein, 11 aa, Entamoeba histolytica
LRGDEEVRKSY

SEQ ID NO: 2639117 - protein, 12 aa, Entamoeba histolytica
LRGEDDAKMKER

SEQ ID NO: 2639118 - protein, 4 aa, Entamoeba histolytica
LRGF

SEQ ID NO: 2639119 - protein, 10 aa, Entamoeba histolytica
LRGGNGEEAL

SEQ ID NO: 2639120 - protein, 16 aa, Entamoeba histolytica
LRGGYDNTIEQYPDAF

SEQ ID NO: 2639121 - protein, 4 aa, Entamoeba histolytica
LRGK

SEQ ID NO: 2639122 - protein, 7 aa, Entamoeba histolytica
LRGKERE

SEQ ID NO: 2639123 - protein, 16 aa, Entamoeba histolytica
LRGNQNESHYLGGTTK

SEQ ID NO: 2639124 - protein, 7 aa, Entamoeba histolytica
LRGSGNE

SEQ ID NO: 2639125 - protein, 6 aa, Entamoeba histolytica
LRHKAP

SEQ ID NO: 2639126 - protein, 11 aa, Entamoeba histolytica
LRIQPTDKSKF

SEQ ID NO: 2639127 - protein, 7 aa, Entamoeba histolytica
LRKDEPH

SEQ ID NO: 2639128 - protein, 6 aa, Entamoeba histolytica
LRKDSE

SEQ ID NO: 2639129 - protein, 13 aa, Entamoeba histolytica
LRKEDPAKEGKDI

SEQ ID NO: 2639130 - protein, 24 aa, Entamoeba histolytica
LRKGNNFSETTSCISPPRKSPDVH

SEQ ID NO: 2639131 - protein, 11 aa, Entamoeba histolytica
LRKGSQERAIE

SEQ ID NO: 2639132 - protein, 6 aa, Entamoeba histolytica
LRKIQT

SEQ ID NO: 2639133 - protein, 38 aa, Entamoeba histolytica
LRKKEAKKEKAKQYKKHEKKQKDKEEQQENKPERKNLT

SEQ ID NO: 2639134 - protein, 8 aa, Entamoeba histolytica
LRKKTKQA

SEQ ID NO: 2639135 - protein, 5 aa, Entamoeba histolytica
LRKNT

SEQ ID NO: 2639136 - protein, 7 aa, Entamoeba histolytica
LRKPLSG

SEQ ID NO: 2639137 - protein, 26 aa, Entamoeba histolytica
LRKQKEEEEKKKREEEEADQQKKLER

SEQ ID NO: 2639138 - protein, 11 aa, Entamoeba histolytica
LRKRDEKINSL

SEQ ID NO: 2639139 - protein, 18 aa, Entamoeba histolytica
LRKRKEEVGIKKRTNDTK

SEQ ID NO: 2639140 - protein, 6 aa, Entamoeba histolytica
LRKRNK

SEQ ID NO: 2639141 - protein, 41 aa, Entamoeba histolytica
LRKTNYPKEEKESSIQNSESNPPPRSISENTSRPGVPGGQP

SEQ ID NO: 2639142 - protein, 15 aa, Entamoeba histolytica
LRKTRQGDRNQRRHL

SEQ ID NO: 2639143 - protein, 9 aa, Entamoeba histolytica
LRLGKKSKA

SEQ ID NO: 2639144 - protein, 22 aa, Entamoeba histolytica
LRNENSRKEAEIEGKKEGLETI

SEQ ID NO: 2639145 - protein, 13 aa, Entamoeba histolytica
LRNEQKLSSRSDE

SEQ ID NO: 2639146 - protein, 9 aa, Entamoeba histolytica
LRNERNEKV

SEQ ID NO: 2639147 - protein, 4 aa, Entamoeba histolytica
LRNL

SEQ ID NO: 2639148 - protein, 9 aa, Entamoeba histolytica
LRNNKENQD

SEQ ID NO: 2639149 - protein, 10 aa, Entamoeba histolytica
LRNNSQPLPI

SEQ ID NO: 2639150 - protein, 9 aa, Entamoeba histolytica
LRNQKNTSV

SEQ ID NO: 2639151 - protein, 4 aa, Entamoeba histolytica
LRNR

SEQ ID NO: 2639152 - protein, 11 aa, Entamoeba histolytica
LRNRGKDKKTI

SEQ ID NO: 2639153 - protein, 11 aa, Entamoeba histolytica
LRNSLQPSQPN

SEQ ID NO: 2639154 - protein, 7 aa, Entamoeba histolytica
LRNTESK

SEQ ID NO: 2639155 - protein, 6 aa, Entamoeba histolytica
LRPDEI

SEQ ID NO: 2639156 - protein, 6 aa, Entamoeba histolytica
LRPKPI

SEQ ID NO: 2639157 - protein, 6 aa, Entamoeba histolytica
LRPPND

SEQ ID NO: 2639158 - protein, 11 aa, Entamoeba histolytica
LRPPPNDPRRL

SEQ ID NO: 2639159 - protein, 13 aa, Entamoeba histolytica
LRPSIDTCAKLIL

SEQ ID NO: 2639160 - protein, 21 aa, Entamoeba histolytica
LRPTPKEDKEERKQGKEGKKE

SEQ ID NO: 2639161 - protein, 7 aa, Entamoeba histolytica
LRPTQGK

SEQ ID NO: 2639162 - protein, 6 aa, Entamoeba histolytica
LRPTSE

SEQ ID NO: 2639163 - protein, 7 aa, Entamoeba histolytica
LRPTYED

SEQ ID NO: 2639164 - protein, 9 aa, Entamoeba histolytica
LRPYGNAGV

SEQ ID NO: 2639165 - protein, 9 aa, Entamoeba histolytica
LRQANYEKK

SEQ ID NO: 2639166 - protein, 22 aa, Entamoeba histolytica
LRQEQAKSKSTVEMPMMEDNYF

SEQ ID NO: 2639167 - protein, 7 aa, Entamoeba histolytica
LRQNKRR

SEQ ID NO: 2639168 - protein, 6 aa, Entamoeba histolytica
LRQQSE

SEQ ID NO: 2639169 - protein, 6 aa, Entamoeba histolytica
LRQTKK

SEQ ID NO: 2639170 - protein, 4 aa, Entamoeba histolytica
LRRE

SEQ ID NO: 2639171 - protein, 16 aa, Entamoeba histolytica
LRRENDSLKSAGEEAF

SEQ ID NO: 2639172 - protein, 16 aa, Entamoeba histolytica
LRRESSSTLSSSSLIN

SEQ ID NO: 2639173 - protein, 8 aa, Entamoeba histolytica
LRRETSEM

SEQ ID NO: 2639174 - protein, 31 aa, Entamoeba histolytica
LRRGLDSARRDLKQAKRVAHKANKELAATKK

SEQ ID NO: 2639175 - protein, 9 aa, Entamoeba histolytica
LRRGNDSIK

SEQ ID NO: 2639176 - protein, 8 aa, Entamoeba histolytica
LRRKSAKV

SEQ ID NO: 2639177 - protein, 6 aa, Entamoeba histolytica
LRRNTH

SEQ ID NO: 2639178 - protein, 9 aa, Entamoeba histolytica
LRRSGGNEF

SEQ ID NO: 2639179 - protein, 8 aa, Entamoeba histolytica
LRSDKLQE

SEQ ID NO: 2639180 - protein, 8 aa, Entamoeba histolytica
LRSEEITN

SEQ ID NO: 2639181 - protein, 5 aa, Entamoeba histolytica
LRSEG

SEQ ID NO: 2639182 - protein, 11 aa, Entamoeba histolytica
LRSEKTDGTSV

SEQ ID NO: 2639183 - protein, 6 aa, Entamoeba histolytica
LRSKEE

SEQ ID NO: 2639184 - protein, 9 aa, Entamoeba histolytica
LRSKKGTGK

SEQ ID NO: 2639185 - protein, 6 aa, Entamoeba histolytica
LRSKTG

SEQ ID NO: 2639186 - protein, 5 aa, Entamoeba histolytica
LRSPG

SEQ ID NO: 2639187 - protein, 7 aa, Entamoeba histolytica
LRSPISL

SEQ ID NO: 2639188 - protein, 6 aa, Entamoeba histolytica
LRSQIS

SEQ ID NO: 2639189 - protein, 7 aa, Entamoeba histolytica
LRSRGTS

SEQ ID NO: 2639190 - protein, 4 aa, Entamoeba histolytica
LRSS

SEQ ID NO: 2639191 - protein, 10 aa, Entamoeba histolytica
LRSSYERSSI

SEQ ID NO: 2639192 - protein, 11 aa, Entamoeba histolytica
LRSTDEVEKEI

SEQ ID NO: 2639193 - protein, 8 aa, Entamoeba histolytica
LRSTENVE

SEQ ID NO: 2639194 - protein, 11 aa, Entamoeba histolytica
LRSTTSQQEFS

SEQ ID NO: 2639195 - protein, 11 aa, Entamoeba histolytica
LRSVNDKSQGL

SEQ ID NO: 2639196 - protein, 13 aa, Entamoeba histolytica
LRTERRKKFQNEK

SEQ ID NO: 2639197 - protein, 6 aa, Entamoeba histolytica
LRTPGQ

SEQ ID NO: 2639198 - protein, 8 aa, Entamoeba histolytica
LRTQSETN

SEQ ID NO: 2639199 - protein, 8 aa, Entamoeba histolytica
LRTSEADA

SEQ ID NO: 2639200 - protein, 5 aa, Entamoeba histolytica
LRTSK

SEQ ID NO: 2639201 - protein, 17 aa, Entamoeba histolytica
LRTTQTRKWSERGKSVA

SEQ ID NO: 2639202 - protein, 8 aa, Entamoeba histolytica
LSAEKEKF

SEQ ID NO: 2639203 - protein, 9 aa, Entamoeba histolytica
LSAGATPIG

SEQ ID NO: 2639204 - protein, 9 aa, Entamoeba histolytica
LSAGSAGQG

SEQ ID NO: 2639205 - protein, 43 aa, Entamoeba histolytica
LSAMSGNSLQSSQEGIQSNSNNNLTQNLGDGNTNSHSSEPHKV

SEQ ID NO: 2639206 - protein, 10 aa, Entamoeba histolytica
LSAPKKKSVV

SEQ ID NO: 2639207 - protein, 24 aa, Entamoeba histolytica
LSAPQTTSDYQTLTQSLQDNDRLN

SEQ ID NO: 2639208 - protein, 8 aa, Entamoeba histolytica
LSASAGIQ

SEQ ID NO: 2639209 - protein, 5 aa, Entamoeba histolytica
LSASS

SEQ ID NO: 2639210 - protein, 7 aa, Entamoeba histolytica
LSATPER

SEQ ID NO: 2639211 - protein, 28 aa, Entamoeba histolytica
LSDEEKEEIKKQIAKRKRRSSLTPLDRE

SEQ ID NO: 2639212 - protein, 7 aa, Entamoeba histolytica
LSDEELT

SEQ ID NO: 2639213 - protein, 5 aa, Entamoeba histolytica
LSDEI

SEQ ID NO: 2639214 - protein, 9 aa, Entamoeba histolytica
LSDEKKTKV

SEQ ID NO: 2639215 - protein, 14 aa, Entamoeba histolytica
LSDENGYLKGEVKE

SEQ ID NO: 2639216 - protein, 7 aa, Entamoeba histolytica
LSDEPSL

SEQ ID NO: 2639217 - protein, 4 aa, Entamoeba histolytica
LSDF

SEQ ID NO: 2639218 - protein, 5 aa, Entamoeba histolytica
LSDGI

SEQ ID NO: 2639219 - protein, 14 aa, Entamoeba histolytica
LSDGNDKTKQEIED

SEQ ID NO: 2639220 - protein, 12 aa, Entamoeba histolytica
LSDGTTKRPVKT

SEQ ID NO: 2639221 - protein, 6 aa, Entamoeba histolytica
LSDITS

SEQ ID NO: 2639222 - protein, 7 aa, Entamoeba histolytica
LSDKELN

SEQ ID NO: 2639223 - protein, 8 aa, Entamoeba histolytica
LSDKKDEV

SEQ ID NO: 2639224 - protein, 11 aa, Entamoeba histolytica
LSDKKEIINEK

SEQ ID NO: 2639225 - protein, 11 aa, Entamoeba histolytica
LSDKKYITKEE

SEQ ID NO: 2639226 - protein, 9 aa, Entamoeba histolytica
LSDKQLDNK

SEQ ID NO: 2639227 - protein, 14 aa, Entamoeba histolytica
LSDKVSKGLTSTKR

SEQ ID NO: 2639228 - protein, 13 aa, Entamoeba histolytica
LSDLPDKSSNFSS

SEQ ID NO: 2639229 - protein, 7 aa, Entamoeba histolytica
LSDMSNE

SEQ ID NO: 2639230 - protein, 7 aa, Entamoeba histolytica
LSDNKFT

SEQ ID NO: 2639231 - protein, 12 aa, Entamoeba histolytica
LSDNPLNKKPFE

SEQ ID NO: 2639232 - protein, 6 aa, Entamoeba histolytica
LSDNQI

SEQ ID NO: 2639233 - protein, 47 aa, Entamoeba histolytica
LSDPKKKEIYDRYGEDGLKSGMGGNGFAREGGFPGGTYTFTSNGDFN

SEQ ID NO: 2639234 - protein, 32 aa, Entamoeba histolytica
LSDPKKKEIYDRYGEEGLKNGMGGAGGFPGGG

SEQ ID NO: 2639235 - protein, 21 aa, Entamoeba histolytica
LSDPRYEHDPFPHDNVEQGMS

SEQ ID NO: 2639236 - protein, 86 aa, Entamoeba histolytica
LSDPRYERDPFSRDPRYMGDPRAPFERNPLERDPRMDPRAPLDRPPMDRPPLDPRASIDRPPIDARAPIDRPPLERTPLDRDPRIP

SEQ ID NO: 2639237 - protein, 13 aa, Entamoeba histolytica
LSDPSSYKKSVSP

SEQ ID NO: 2639238 - protein, 19 aa, Entamoeba histolytica
LSDQSSEKSIYGKSKQRQK

SEQ ID NO: 2639239 - protein, 8 aa, Entamoeba histolytica
LSDSSELV

SEQ ID NO: 2639240 - protein, 6 aa, Entamoeba histolytica
LSDTED

SEQ ID NO: 2639241 - protein, 11 aa, Entamoeba histolytica
LSDTKTGDNKR

SEQ ID NO: 2639242 - protein, 24 aa, Entamoeba histolytica
LSDTSKTPDPYSTTPSQGTYRYSS

SEQ ID NO: 2639243 - protein, 4 aa, Entamoeba histolytica
LSDW

SEQ ID NO: 2639244 - protein, 12 aa, Entamoeba histolytica
LSEASNSASFDI

SEQ ID NO: 2639245 - protein, 5 aa, Entamoeba histolytica
LSEDD

SEQ ID NO: 2639246 - protein, 19 aa, Entamoeba histolytica
LSEDDDSTSTFSSSELDSG

SEQ ID NO: 2639247 - protein, 9 aa, Entamoeba histolytica
LSEDPSSDL

SEQ ID NO: 2639248 - protein, 27 aa, Entamoeba histolytica
LSEDQQRRKRKSVPNGLDDSSPISSPD

SEQ ID NO: 2639249 - protein, 4 aa, Entamoeba histolytica
LSEE

SEQ ID NO: 2639250 - protein, 5 aa, Entamoeba histolytica
LSEEE

SEQ ID NO: 2639251 - protein, 9 aa, Entamoeba histolytica
LSEEEIDGN

SEQ ID NO: 2639252 - protein, 32 aa, Entamoeba histolytica
LSEEKEKIEKEYLEEQNKRNDEETNRTKEIEE

SEQ ID NO: 2639253 - protein, 8 aa, Entamoeba histolytica
LSEEPVSV

SEQ ID NO: 2639254 - protein, 34 aa, Entamoeba histolytica
LSEEQKKKIQGAINERTMKEKKGEKKEENKKRLE

SEQ ID NO: 2639255 - protein, 4 aa, Entamoeba histolytica
LSEF

SEQ ID NO: 2639256 - protein, 16 aa, Entamoeba histolytica
LSEFDPSTCEFANIVF

SEQ ID NO: 2639257 - protein, 15 aa, Entamoeba histolytica
LSEGDMQKKHGCSTL

SEQ ID NO: 2639258 - protein, 12 aa, Entamoeba histolytica
LSEGKDKNESVE

SEQ ID NO: 2639259 - protein, 9 aa, Entamoeba histolytica
LSEGSPDVS

SEQ ID NO: 2639260 - protein, 4 aa, Entamoeba histolytica
LSEK

SEQ ID NO: 2639261 - protein, 12 aa, Entamoeba histolytica
LSEKCTENPDIP

SEQ ID NO: 2639262 - protein, 10 aa, Entamoeba histolytica
LSEKDEDEMK

SEQ ID NO: 2639263 - protein, 9 aa, Entamoeba histolytica
LSEKDQTLY

SEQ ID NO: 2639264 - protein, 6 aa, Entamoeba histolytica
LSENDY

SEQ ID NO: 2639265 - protein, 8 aa, Entamoeba histolytica
LSENEDVV

SEQ ID NO: 2639266 - protein, 15 aa, Entamoeba histolytica
LSENGNSSNNEITEK

SEQ ID NO: 2639267 - protein, 7 aa, Entamoeba histolytica
LSENIPE

SEQ ID NO: 2639268 - protein, 10 aa, Entamoeba histolytica
LSEPKQEDID

SEQ ID NO: 2639269 - protein, 5 aa, Entamoeba histolytica
LSEPY

SEQ ID NO: 2639270 - protein, 10 aa, Entamoeba histolytica
LSEQDPGAQR

SEQ ID NO: 2639271 - protein, 12 aa, Entamoeba histolytica
LSEQKKTLTAEI

SEQ ID NO: 2639272 - protein, 7 aa, Entamoeba histolytica
LSEQQKQ

SEQ ID NO: 2639273 - protein, 13 aa, Entamoeba histolytica
LSEQQQNKKEVSS

SEQ ID NO: 2639274 - protein, 8 aa, Entamoeba histolytica
LSEQTARN

SEQ ID NO: 2639275 - protein, 7 aa, Entamoeba histolytica
LSERDAE

SEQ ID NO: 2639276 - protein, 7 aa, Entamoeba histolytica
LSESGSL

SEQ ID NO: 2639277 - protein, 9 aa, Entamoeba histolytica
LSESSATQL

SEQ ID NO: 2639278 - protein, 8 aa, Entamoeba histolytica
LSESSLTT

SEQ ID NO: 2639279 - protein, 15 aa, Entamoeba histolytica
LSESTKTSLKKSQDI

SEQ ID NO: 2639280 - protein, 5 aa, Entamoeba histolytica
LSETS

SEQ ID NO: 2639281 - protein, 18 aa, Entamoeba histolytica
LSETTQQELDEIDDEMRS

SEQ ID NO: 2639282 - protein, 6 aa, Entamoeba histolytica
LSETVE

SEQ ID NO: 2639283 - protein, 5 aa, Entamoeba histolytica
LSFDS

SEQ ID NO: 2639284 - protein, 11 aa, Entamoeba histolytica
LSFSPNQSCGY

SEQ ID NO: 2639285 - protein, 6 aa, Entamoeba histolytica
LSGCSS

SEQ ID NO: 2639286 - protein, 39 aa, Entamoeba histolytica
LSGDKKNNTSNPIPTQPTYAPPPNVTSVSEPMAPPPMTQ

SEQ ID NO: 2639287 - protein, 4 aa, Entamoeba histolytica
LSGE

SEQ ID NO: 2639288 - protein, 4 aa, Entamoeba histolytica
LSGF

SEQ ID NO: 2639289 - protein, 11 aa, Entamoeba histolytica
LSGGKPFEEAI

SEQ ID NO: 2639290 - protein, 5 aa, Entamoeba histolytica
LSGGQ

SEQ ID NO: 2639291 - protein, 10 aa, Entamoeba histolytica
LSGGSISKEL

SEQ ID NO: 2639292 - protein, 8 aa, Entamoeba histolytica
LSGKAPHH

SEQ ID NO: 2639293 - protein, 9 aa, Entamoeba histolytica
LSGKEKDNY

SEQ ID NO: 2639294 - protein, 12 aa, Entamoeba histolytica
LSGKKAPRYFPN

SEQ ID NO: 2639295 - protein, 12 aa, Entamoeba histolytica
LSGKKDESHELK

SEQ ID NO: 2639296 - protein, 8 aa, Entamoeba histolytica
LSGKQDAE

SEQ ID NO: 2639297 - protein, 9 aa, Entamoeba histolytica
LSGKTDAEL

SEQ ID NO: 2639298 - protein, 8 aa, Entamoeba histolytica
LSGKTKRV

SEQ ID NO: 2639299 - protein, 8 aa, Entamoeba histolytica
LSGNEEDS

SEQ ID NO: 2639300 - protein, 11 aa, Entamoeba histolytica
LSGNNNSLTQA

SEQ ID NO: 2639301 - protein, 11 aa, Entamoeba histolytica
LSGNNRQSESS

SEQ ID NO: 2639302 - protein, 12 aa, Entamoeba histolytica
LSGNTTPRSKKE

SEQ ID NO: 2639303 - protein, 6 aa, Entamoeba histolytica
LSGPAL

SEQ ID NO: 2639304 - protein, 7 aa, Entamoeba histolytica
LSGPTNF

SEQ ID NO: 2639305 - protein, 4 aa, Entamoeba histolytica
LSGQ

SEQ ID NO: 2639306 - protein, 6 aa, Entamoeba histolytica
LSGQEV

SEQ ID NO: 2639307 - protein, 4 aa, Entamoeba histolytica
LSGS

SEQ ID NO: 2639308 - protein, 5 aa, Entamoeba histolytica
LSGSI

SEQ ID NO: 2639309 - protein, 9 aa, Entamoeba histolytica
LSGSKSSTC

SEQ ID NO: 2639310 - protein, 20 aa, Entamoeba histolytica
LSGSSNNERDELKKKIKKDI

SEQ ID NO: 2639311 - protein, 5 aa, Entamoeba histolytica
LSGTC

SEQ ID NO: 2639312 - protein, 7 aa, Entamoeba histolytica
LSGTNYK

SEQ ID NO: 2639313 - protein, 7 aa, Entamoeba histolytica
LSGTTLT

SEQ ID NO: 2639314 - protein, 7 aa, Entamoeba histolytica
LSHPQAN

SEQ ID NO: 2639315 - protein, 10 aa, Entamoeba histolytica
LSHSENSIHE

SEQ ID NO: 2639316 - protein, 16 aa, Entamoeba histolytica
LSIDEKTFNEMEIEKF

SEQ ID NO: 2639317 - protein, 6 aa, Entamoeba histolytica
LSIDST

SEQ ID NO: 2639318 - protein, 9 aa, Entamoeba histolytica
LSIPDGTLG

SEQ ID NO: 2639319 - protein, 7 aa, Entamoeba histolytica
LSIPPTK

SEQ ID NO: 2639320 - protein, 5 aa, Entamoeba histolytica
LSIPQ

SEQ ID NO: 2639321 - protein, 7 aa, Entamoeba histolytica
LSIPSNL

SEQ ID NO: 2639322 - protein, 9 aa, Entamoeba histolytica
LSISSQPFS

SEQ ID NO: 2639323 - protein, 6 aa, Entamoeba histolytica
LSITQN

SEQ ID NO: 2639324 - protein, 25 aa, Entamoeba histolytica
LSITSEKKKGKLAQTTINQLKILSL

SEQ ID NO: 2639325 - protein, 9 aa, Entamoeba histolytica
LSKDGSGLG

SEQ ID NO: 2639326 - protein, 12 aa, Entamoeba histolytica
LSKDNSDGNTAM

SEQ ID NO: 2639327 - protein, 77 aa, Entamoeba histolytica
LSKDNSTTHGIEEKHSKNTVNQEESDKEEYNKEENPENKEEENKEENPEKKEEENKDSANTKENKEEEKDKEEEKRK

SEQ ID NO: 2639328 - protein, 11 aa, Entamoeba histolytica
LSKDTKKSIAE

SEQ ID NO: 2639329 - protein, 9 aa, Entamoeba histolytica
LSKEANKTQ

SEQ ID NO: 2639330 - protein, 11 aa, Entamoeba histolytica
LSKEDYAGKQA

SEQ ID NO: 2639331 - protein, 10 aa, Entamoeba histolytica
LSKEEQKELQ

SEQ ID NO: 2639332 - protein, 7 aa, Entamoeba histolytica
LSKEPVV

SEQ ID NO: 2639333 - protein, 12 aa, Entamoeba histolytica
LSKEQEKKEGDK

SEQ ID NO: 2639334 - protein, 5 aa, Entamoeba histolytica
LSKET

SEQ ID NO: 2639335 - protein, 4 aa, Entamoeba histolytica
LSKG

SEQ ID NO: 2639336 - protein, 7 aa, Entamoeba histolytica
LSKGEET

SEQ ID NO: 2639337 - protein, 24 aa, Entamoeba histolytica
LSKGKWEKRAEKSSTKEGKKPKLP

SEQ ID NO: 2639338 - protein, 7 aa, Entamoeba histolytica
LSKGQTY

SEQ ID NO: 2639339 - protein, 17 aa, Entamoeba histolytica
LSKKAKNIEGKKQWPYS

SEQ ID NO: 2639340 - protein, 5 aa, Entamoeba histolytica
LSKKG

SEQ ID NO: 2639341 - protein, 9 aa, Entamoeba histolytica
LSKKKEGRT

SEQ ID NO: 2639342 - protein, 5 aa, Entamoeba histolytica
LSKKN

SEQ ID NO: 2639343 - protein, 9 aa, Entamoeba histolytica
LSKKSNDPE

SEQ ID NO: 2639344 - protein, 47 aa, Entamoeba histolytica; identical to SEQ ID NO: 2444134

SEQ ID NO: 2639345 - protein, 8 aa, Entamoeba histolytica
LSKKSVDK

SEQ ID NO: 2639346 - protein, 4 aa, Entamoeba histolytica
LSKL

SEQ ID NO: 2639347 - protein, 14 aa, Entamoeba histolytica
LSKLSKNGIAKQVR

SEQ ID NO: 2639348 - protein, 5 aa, Entamoeba histolytica
LSKND

SEQ ID NO: 2639349 - protein, 21 aa, Entamoeba histolytica
LSKNQEQNQENTTEPTQPTVS

SEQ ID NO: 2639350 - protein, 12 aa, Entamoeba histolytica
LSKQSVDEQQQE

SEQ ID NO: 2639351 - protein, 9 aa, Entamoeba histolytica
LSKRNKQTF

SEQ ID NO: 2639352 - protein, 4 aa, Entamoeba histolytica
LSKS

SEQ ID NO: 2639353 - protein, 8 aa, Entamoeba histolytica
LSKSEATK

SEQ ID NO: 2639354 - protein, 12 aa, Entamoeba histolytica
LSKSFTNSEQTN

SEQ ID NO: 2639355 - protein, 11 aa, Entamoeba histolytica
LSKSKDEIDPK

SEQ ID NO: 2639356 - protein, 11 aa, Entamoeba histolytica
LSKSSKLYEAQ

SEQ ID NO: 2639357 - protein, 4 aa, Entamoeba histolytica
LSKT

SEQ ID NO: 2639358 - protein, 8 aa, Entamoeba histolytica
LSKTHAGA

SEQ ID NO: 2639359 - protein, 10 aa, Entamoeba histolytica
LSKTPVKAPH

SEQ ID NO: 2639360 - protein, 7 aa, Entamoeba histolytica
LSKTQLS

SEQ ID NO: 2639361 - protein, 7 aa, Entamoeba histolytica
LSKTTYK

SEQ ID NO: 2639362 - protein, 10 aa, Entamoeba histolytica
LSLDGNNFDD

SEQ ID NO: 2639363 - protein, 10 aa, Entamoeba histolytica
LSLPSNLPKL

SEQ ID NO: 2639364 - protein, 11 aa, Entamoeba histolytica
LSLPSTPIADK

SEQ ID NO: 2639365 - protein, 10 aa, Entamoeba histolytica
LSLSPSTSHW

SEQ ID NO: 2639366 - protein, 13 aa, Entamoeba histolytica
LSLTQSQDTSYQS

SEQ ID NO: 2639367 - protein, 4 aa, Entamoeba histolytica
LSMN

SEQ ID NO: 2639368 - protein, 13 aa, Entamoeba histolytica
LSNAVDKAENVDY

SEQ ID NO: 2639369 - protein, 8 aa, Entamoeba histolytica
LSNDPDIS

SEQ ID NO: 2639370 - protein, 7 aa, Entamoeba histolytica
LSNEAQK

SEQ ID NO: 2639371 - protein, 14 aa, Entamoeba histolytica
LSNEDARKRRKNSL

SEQ ID NO: 2639372 - protein, 8 aa, Entamoeba histolytica
LSNEDEGV

SEQ ID NO: 2639373 - protein, 26 aa, Entamoeba histolytica
LSNEDKQKRESAPKKRLTAKEKRANK

SEQ ID NO: 2639374 - protein, 16 aa, Entamoeba histolytica
LSNEEPSIRDAGWKEA

SEQ ID NO: 2639375 - protein, 7 aa, Entamoeba histolytica
LSNEEVN

SEQ ID NO: 2639376 - protein, 10 aa, Entamoeba histolytica
LSNEKSGEII

SEQ ID NO: 2639377 - protein, 8 aa, Entamoeba histolytica
LSNERKKE

SEQ ID NO: 2639378 - protein, 32 aa, Entamoeba histolytica
LSNERNSPNKENKKVIETKPIKSINKSIKNNK

SEQ ID NO: 2639379 - protein, 16 aa, Entamoeba histolytica
LSNETSNKSKQNQSYK

SEQ ID NO: 2639380 - protein, 17 aa, Entamoeba histolytica
LSNEVKGDLAKTAKRQR

SEQ ID NO: 2639381 - protein, 8 aa, Entamoeba histolytica
LSNGDNKT

SEQ ID NO: 2639382 - protein, 7 aa, Entamoeba histolytica
LSNGEFE

SEQ ID NO: 2639383 - protein, 14 aa, Entamoeba histolytica
LSNGGNQNLGGNDF

SEQ ID NO: 2639384 - protein, 11 aa, Entamoeba histolytica
LSNGTAQSIQQ

SEQ ID NO: 2639385 - protein, 8 aa, Entamoeba histolytica
LSNKNIPS

SEQ ID NO: 2639386 - protein, 14 aa, Entamoeba histolytica
LSNKVKDAFRENGV

SEQ ID NO: 2639387 - protein, 4 aa, Entamoeba histolytica
LSNN

SEQ ID NO: 2639388 - protein, 19 aa, Entamoeba histolytica
LSNNESPNLIQSPNKPNKV

SEQ ID NO: 2639389 - protein, 8 aa, Entamoeba histolytica
LSNNHKTF

SEQ ID NO: 2639390 - protein, 8 aa, Entamoeba histolytica
LSNNKDSL

SEQ ID NO: 2639391 - protein, 12 aa, Entamoeba histolytica
LSNNKINDFPTE

SEQ ID NO: 2639392 - protein, 7 aa, Entamoeba histolytica
LSNPASL

SEQ ID NO: 2639393 - protein, 8 aa, Entamoeba histolytica
LSNPDNDE

SEQ ID NO: 2639394 - protein, 7 aa, Entamoeba histolytica
LSNPKVV

SEQ ID NO: 2639395 - protein, 13 aa, Entamoeba histolytica
LSNPLDESNDSDK

SEQ ID NO: 2639396 - protein, 13 aa, Entamoeba histolytica
LSNPPNTDISSQL

SEQ ID NO: 2639397 - protein, 7 aa, Entamoeba histolytica
LSNPTTN

SEQ ID NO: 2639398 - protein, 10 aa, Entamoeba histolytica
LSNQEQKDKR

SEQ ID NO: 2639399 - protein, 5 aa, Entamoeba histolytica
LSNQF

SEQ ID NO: 2639400 - protein, 5 aa, Entamoeba histolytica
LSNSI

SEQ ID NO: 2639401 - protein, 18 aa, Entamoeba histolytica
LSNSQPQPTQETKSNTSL

SEQ ID NO: 2639402 - protein, 23 aa, Entamoeba histolytica
LSNSSIPEKVTTQSNSSSDEGME

SEQ ID NO: 2639403 - protein, 7 aa, Entamoeba histolytica
LSNSTPL

SEQ ID NO: 2639404 - protein, 23 aa, Entamoeba histolytica
LSNTERKETQKEENKENKKTDST

SEQ ID NO: 2639405 - protein, 36 aa, Entamoeba histolytica
LSNTSPKQSFIENGSEEEEEDTQKSDTENVSTKVQT

SEQ ID NO: 2639406 - protein, 4 aa, Entamoeba histolytica
LSNV

SEQ ID NO: 2639407 - protein, 14 aa, Entamoeba histolytica
LSNYDDDEDDYAKY

SEQ ID NO: 2639408 - protein, 7 aa, Entamoeba histolytica
LSPATRA

SEQ ID NO: 2639409 - protein, 6 aa, Entamoeba histolytica
LSPDGD

SEQ ID NO: 2639410 - protein, 5 aa, Entamoeba histolytica
LSPDS

SEQ ID NO: 2639411 - protein, 7 aa, Entamoeba histolytica
LSPEARD

SEQ ID NO: 2639412 - protein, 5 aa, Entamoeba histolytica
LSPEG

SEQ ID NO: 2639413 - protein, 6 aa, Entamoeba histolytica
LSPEIK

SEQ ID NO: 2639414 - protein, 6 aa, Entamoeba histolytica
LSPEME

SEQ ID NO: 2639415 - protein, 8 aa, Entamoeba histolytica
LSPENKPF

SEQ ID NO: 2639416 - protein, 14 aa, Entamoeba histolytica
LSPEPLNTQQGQTL

SEQ ID NO: 2639417 - protein, 8 aa, Entamoeba histolytica
LSPESKPF

SEQ ID NO: 2639418 - protein, 5 aa, Entamoeba histolytica
LSPGV

SEQ ID NO: 2639419 - protein, 5 aa, Entamoeba histolytica
LSPKQ

SEQ ID NO: 2639420 - protein, 6 aa, Entamoeba histolytica
LSPKVR

SEQ ID NO: 2639421 - protein, 8 aa, Entamoeba histolytica
LSPLNQTK

SEQ ID NO: 2639422 - protein, 6 aa, Entamoeba histolytica
LSPLPS

SEQ ID NO: 2639423 - protein, 9 aa, Entamoeba histolytica
LSPNGRQIK

SEQ ID NO: 2639424 - protein, 9 aa, Entamoeba histolytica
LSPNPNGVE

SEQ ID NO: 2639425 - protein, 7 aa, Entamoeba histolytica
LSPPPNC

SEQ ID NO: 2639426 - protein, 8 aa, Entamoeba histolytica
LSPPSTIS

SEQ ID NO: 2639427 - protein, 7 aa, Entamoeba histolytica
LSPQENA

SEQ ID NO: 2639428 - protein, 10 aa, Entamoeba histolytica
LSPQLSQQQQ

SEQ ID NO: 2639429 - protein, 7 aa, Entamoeba histolytica
LSPQPNL

SEQ ID NO: 2639430 - protein, 5 aa, Entamoeba histolytica
LSPQT

SEQ ID NO: 2639431 - protein, 4 aa, Entamoeba histolytica
LSPR

SEQ ID NO: 2639432 - protein, 17 aa, Entamoeba histolytica
LSPRRRGNSSGEYEKLK

SEQ ID NO: 2639433 - protein, 13 aa, Entamoeba histolytica
LSPRVNDKSKYYS

SEQ ID NO: 2639434 - protein, 13 aa, Entamoeba histolytica
LSPSAPLNSCGSP

SEQ ID NO: 2639435 - protein, 9 aa, Entamoeba histolytica
LSPSEQRHY

SEQ ID NO: 2639436 - protein, 7 aa, Entamoeba histolytica
LSPSLKK

SEQ ID NO: 2639437 - protein, 7 aa, Entamoeba histolytica
LSPSPSD

SEQ ID NO: 2639438 - protein, 5 aa, Entamoeba histolytica
LSPSS

SEQ ID NO: 2639439 - protein, 5 aa, Entamoeba histolytica
LSPST

SEQ ID NO: 2639440 - protein, 6 aa, Entamoeba histolytica
LSPSTL

SEQ ID NO: 2639441 - protein, 5 aa, Entamoeba histolytica
LSPSV

SEQ ID NO: 2639442 - protein, 9 aa, Entamoeba histolytica
LSPTNPGVT

SEQ ID NO: 2639443 - protein, 22 aa, Entamoeba histolytica
LSPTTSFNQPKKSSNAVTSKLF

SEQ ID NO: 2639444 - protein, 9 aa, Entamoeba histolytica
LSPTTSSQI

SEQ ID NO: 2639445 - protein, 15 aa, Entamoeba histolytica
LSPVERKKKAAKKRK

SEQ ID NO: 2639446 - protein, 4 aa, Entamoeba histolytica
LSQE

SEQ ID NO: 2639447 - protein, 6 aa, Entamoeba histolytica
LSQEKL

SEQ ID NO: 2639448 - protein, 10 aa, Entamoeba histolytica
LSQESDVTGI

SEQ ID NO: 2639449 - protein, 15 aa, Entamoeba histolytica
LSQFGNTINSSNSAF

SEQ ID NO: 2639450 - protein, 5 aa, Entamoeba histolytica
LSQFS

SEQ ID NO: 2639451 - protein, 16 aa, Entamoeba histolytica
LSQIPAKSVKDRHEKI

SEQ ID NO: 2639452 - protein, 10 aa, Entamoeba histolytica
LSQKNRNDED

SEQ ID NO: 2639453 - protein, 5 aa, Entamoeba histolytica
LSQKQ

SEQ ID NO: 2639454 - protein, 6 aa, Entamoeba histolytica
LSQKSI

SEQ ID NO: 2639455 - protein, 5 aa, Entamoeba histolytica
LSQKT

SEQ ID NO: 2639456 - protein, 7 aa, Entamoeba histolytica
LSQKYSQ

SEQ ID NO: 2639457 - protein, 5 aa, Entamoeba histolytica
LSQLR

SEQ ID NO: 2639458 - protein, 29 aa, Entamoeba histolytica
LSQNKPTQLQPSSSNTDQLQETTTPAQVT

SEQ ID NO: 2639459 - protein, 5 aa, Entamoeba histolytica
LSQNY

SEQ ID NO: 2639460 - protein, 4 aa, Entamoeba histolytica
LSQP

SEQ ID NO: 2639461 - protein, 16 aa, Entamoeba histolytica
LSQPNFKDSIQTSPEE

SEQ ID NO: 2639462 - protein, 6 aa, Entamoeba histolytica
LSQPQS

SEQ ID NO: 2639463 - protein, 20 aa, Entamoeba histolytica
LSQPTFEEDTKKGINIKEEN

SEQ ID NO: 2639464 - protein, 6 aa, Entamoeba histolytica
LSQQQE

SEQ ID NO: 2639465 - protein, 14 aa, Entamoeba histolytica
LSQQTKPSQVSQNM

SEQ ID NO: 2639466 - protein, 6 aa, Entamoeba histolytica
LSQQTM

SEQ ID NO: 2639467 - protein, 9 aa, Entamoeba histolytica
LSQREGYQQ

SEQ ID NO: 2639468 - protein, 5 aa, Entamoeba histolytica
LSQSG

SEQ ID NO: 2639469 - protein, 8 aa, Entamoeba histolytica
LSQSKTKL

SEQ ID NO: 2639470 - protein, 8 aa, Entamoeba histolytica
LSQSMKEK

SEQ ID NO: 2639471 - protein, 16 aa, Entamoeba histolytica
LSQSPPEGISACPDED

SEQ ID NO: 2639472 - protein, 7 aa, Entamoeba histolytica
LSQSSQI

SEQ ID NO: 2639473 - protein, 4 aa, Entamoeba histolytica
LSQT

SEQ ID NO: 2639474 - protein, 9 aa, Entamoeba histolytica
LSQTATALD

SEQ ID NO: 2639475 - protein, 21 aa, Entamoeba histolytica
LSQTDSKSKIFKGKKSSSKLL

SEQ ID NO: 2639476 - protein, 18 aa, Entamoeba histolytica
LSQTDYSGDIGYTPLSTY

SEQ ID NO: 2639477 - protein, 9 aa, Entamoeba histolytica
LSQTEGPCC

SEQ ID NO: 2639478 - protein, 7 aa, Entamoeba histolytica
LSQTKDV

SEQ ID NO: 2639479 - protein, 8 aa, Entamoeba histolytica
LSQTPPAR

SEQ ID NO: 2639480 - protein, 8 aa, Entamoeba histolytica
LSQTSDPI

SEQ ID NO: 2639481 - protein, 13 aa, Entamoeba histolytica
LSQTTQNWIVQHW

SEQ ID NO: 2639482 - protein, 6 aa, Entamoeba histolytica
LSQYNE

SEQ ID NO: 2639483 - protein, 13 aa, Entamoeba histolytica
LSRDDAKATLTDK

SEQ ID NO: 2639484 - protein, 7 aa, Entamoeba histolytica
LSREKSR

SEQ ID NO: 2639485 - protein, 4 aa, Entamoeba histolytica
LSRF

SEQ ID NO: 2639486 - protein, 4 aa, Entamoeba histolytica
LSRK

SEQ ID NO: 2639487 - protein, 6 aa, Entamoeba histolytica
LSRNDT

SEQ ID NO: 2639488 - protein, 8 aa, Entamoeba histolytica
LSRPSELY

SEQ ID NO: 2639489 - protein, 19 aa, Entamoeba histolytica
LSRPTLKRTIPGAFSSTRN

SEQ ID NO: 2639490 - protein, 14 aa, Entamoeba histolytica
LSRQTADGNYTTQS

SEQ ID NO: 2639491 - protein, 4 aa, Entamoeba histolytica
LSRR

SEQ ID NO: 2639492 - protein, 10 aa, Entamoeba histolytica
LSRRSGKAMQ

SEQ ID NO: 2639493 - protein, 12 aa, Entamoeba histolytica
LSRTSTYESITN

SEQ ID NO: 2639494 - protein, 4 aa, Entamoeba histolytica
LSSD

SEQ ID NO: 2639495 - protein, 6 aa, Entamoeba histolytica
LSSDAG

SEQ ID NO: 2639496 - protein, 7 aa, Entamoeba histolytica
LSSDDPL

SEQ ID NO: 2639497 - protein, 7 aa, Entamoeba histolytica
LSSDEPL

SEQ ID NO: 2639498 - protein, 9 aa, Entamoeba histolytica
LSSDGSITS

SEQ ID NO: 2639499 - protein, 13 aa, Entamoeba histolytica
LSSDHDKKEYPMT

SEQ ID NO: 2639500 - protein, 10 aa, Entamoeba histolytica
LSSDKKPDEC

SEQ ID NO: 2639501 - protein, 13 aa, Entamoeba histolytica
LSSDNSVIELLNP

SEQ ID NO: 2639502 - protein, 8 aa, Entamoeba histolytica
LSSDSNSN

SEQ ID NO: 2639503 - protein, 9 aa, Entamoeba histolytica
LSSECNSEL

SEQ ID NO: 2639504 - protein, 12 aa, Entamoeba histolytica
LSSEEEQSPRFS

SEQ ID NO: 2639505 - protein, 11 aa, Entamoeba histolytica
LSSEGKNNKED

SEQ ID NO: 2639506 - protein, 6 aa, Entamoeba histolytica
LSSEKA

SEQ ID NO: 2639507 - protein, 11 aa, Entamoeba histolytica
LSSENEPSPFP

SEQ ID NO: 2639508 - protein, 31 aa, Entamoeba histolytica
LSSETDESEESSTDSYSNEEFEEGKENAEII

SEQ ID NO: 2639509 - protein, 11 aa, Entamoeba histolytica
LSSETKKPTYV

SEQ ID NO: 2639510 - protein, 4 aa, Entamoeba histolytica
LSSF

SEQ ID NO: 2639511 - protein, 11 aa, Entamoeba histolytica
LSSFQSDNQKE

SEQ ID NO: 2639512 - protein, 4 aa, Entamoeba histolytica
LSSG

SEQ ID NO: 2639513 - protein, 7 aa, Entamoeba histolytica
LSSGDEK

SEQ ID NO: 2639514 - protein, 6 aa, Entamoeba histolytica
LSSGTF

SEQ ID NO: 2639515 - protein, 10 aa, Entamoeba histolytica
LSSIKNGNLR

SEQ ID NO: 2639516 - protein, 5 aa, Entamoeba histolytica
LSSIQ

SEQ ID NO: 2639517 - protein, 5 aa, Entamoeba histolytica
LSSIS

SEQ ID NO: 2639518 - protein, 18 aa, Entamoeba histolytica
LSSISKQSFTRSTTYQSQ

SEQ ID NO: 2639519 - protein, 8 aa, Entamoeba histolytica
LSSKEQVE

SEQ ID NO: 2639520 - protein, 7 aa, Entamoeba histolytica
LSSKKKE

SEQ ID NO: 2639521 - protein, 10 aa, Entamoeba histolytica
LSSKNSTVRK

SEQ ID NO: 2639522 - protein, 8 aa, Entamoeba histolytica
LSSKNTSI

SEQ ID NO: 2639523 - protein, 9 aa, Entamoeba histolytica
LSSKPVDSD

SEQ ID NO: 2639524 - protein, 7 aa, Entamoeba histolytica
LSSKSEL

SEQ ID NO: 2639525 - protein, 12 aa, Entamoeba histolytica
LSSNEKNESNGF

SEQ ID NO: 2639526 - protein, 6 aa, Entamoeba histolytica
LSSNEM

SEQ ID NO: 2639527 - protein, 7 aa, Entamoeba histolytica
LSSNESH

SEQ ID NO: 2639528 - protein, 7 aa, Entamoeba histolytica
LSSNNDP

SEQ ID NO: 2639529 - protein, 11 aa, Entamoeba histolytica
LSSNSSVITPS

SEQ ID NO: 2639530 - protein, 9 aa, Entamoeba histolytica
LSSNTSPLN

SEQ ID NO: 2639531 - protein, 11 aa, Entamoeba histolytica
LSSPDRSTQRI

SEQ ID NO: 2639532 - protein, 8 aa, Entamoeba histolytica
LSSPEQVK

SEQ ID NO: 2639533 - protein, 5 aa, Entamoeba histolytica
LSSPI

SEQ ID NO: 2639534 - protein, 7 aa, Entamoeba histolytica
LSSPNRI

SEQ ID NO: 2639535 - protein, 10 aa, Entamoeba histolytica
LSSPQFEENS

SEQ ID NO: 2639536 - protein, 9 aa, Entamoeba histolytica
LSSPSPSIK

SEQ ID NO: 2639537 - protein, 10 aa, Entamoeba histolytica
LSSPSQQNIE

SEQ ID NO: 2639538 - protein, 6 aa, Entamoeba histolytica
LSSPTD

SEQ ID NO: 2639539 - protein, 6 aa, Entamoeba histolytica
LSSPVK

SEQ ID NO: 2639540 - protein, 9 aa, Entamoeba histolytica
LSSQDEHRH

SEQ ID NO: 2639541 - protein, 12 aa, Entamoeba histolytica
LSSQNKKENNQI

SEQ ID NO: 2639542 - protein, 4 aa, Entamoeba histolytica
LSSS

SEQ ID NO: 2639543 - protein, 10 aa, Entamoeba histolytica
LSSSDASGFL

SEQ ID NO: 2639544 - protein, 20 aa, Entamoeba histolytica
LSSSDDSSDFIETNSNEESL

SEQ ID NO: 2639545 - protein, 8 aa, Entamoeba histolytica
LSSSGRRK

SEQ ID NO: 2639546 - protein, 10 aa, Entamoeba histolytica
LSSSHESYTP

SEQ ID NO: 2639547 - protein, 6 aa, Entamoeba histolytica
LSSSLA

SEQ ID NO: 2639548 - protein, 5 aa, Entamoeba histolytica
LSSSN

SEQ ID NO: 2639549 - protein, 13 aa, Entamoeba histolytica
LSSSPDGKYTGIG

SEQ ID NO: 2639550 - protein, 8 aa, Entamoeba histolytica
LSSSPKAF

SEQ ID NO: 2639551 - protein, 15 aa, Entamoeba histolytica
LSSSQPISTKEESQE

SEQ ID NO: 2639552 - protein, 7 aa, Entamoeba histolytica
LSSSQSV

SEQ ID NO: 2639553 - protein, 10 aa, Entamoeba histolytica
LSSSRATSKV

SEQ ID NO: 2639554 - protein, 14 aa, Entamoeba histolytica
LSSSSGSRRQEAQR

SEQ ID NO: 2639555 - protein, 8 aa, Entamoeba histolytica
LSSSSIPP

SEQ ID NO: 2639556 - protein, 4 aa, Entamoeba histolytica
LSST

SEQ ID NO: 2639557 - protein, 8 aa, Entamoeba histolytica
LSSTNKDN

SEQ ID NO: 2639558 - protein, 13 aa, Entamoeba histolytica
LSSTNTSQPEDFT

SEQ ID NO: 2639559 - protein, 9 aa, Entamoeba histolytica
LSSTPNNSC

SEQ ID NO: 2639560 - protein, 24 aa, Entamoeba histolytica
LSSTPRAQPGLGLGGGLGTQPAGL

SEQ ID NO: 2639561 - protein, 18 aa, Entamoeba histolytica
LSSTSSKNLLNSQQTKRT

SEQ ID NO: 2639562 - protein, 14 aa, Entamoeba histolytica
LSSVDDSNEINSSL

SEQ ID NO: 2639563 - protein, 14 aa, Entamoeba histolytica
LSSVNSPLQTDLNP

SEQ ID NO: 2639564 - protein, 4 aa, Entamoeba histolytica
LSSY

SEQ ID NO: 2639565 - protein, 9 aa, Entamoeba histolytica
LSTAQTAAF

SEQ ID NO: 2639566 - protein, 6 aa, Entamoeba histolytica
LSTASS

SEQ ID NO: 2639567 - protein, 11 aa, Entamoeba histolytica
LSTDDNSQEEI

SEQ ID NO: 2639568 - protein, 8 aa, Entamoeba histolytica
LSTDEPHQ

SEQ ID NO: 2639569 - protein, 11 aa, Entamoeba histolytica
LSTDNQNSTEN

SEQ ID NO: 2639570 - protein, 13 aa, Entamoeba histolytica
LSTDNSKNNIHSG

SEQ ID NO: 2639571 - protein, 7 aa, Entamoeba histolytica
LSTDQTE

SEQ ID NO: 2639572 - protein, 9 aa, Entamoeba histolytica
LSTDSFSMN

SEQ ID NO: 2639573 - protein, 5 aa, Entamoeba histolytica
LSTDT

SEQ ID NO: 2639574 - protein, 5 aa, Entamoeba histolytica
LSTDV

SEQ ID NO: 2639575 - protein, 7 aa, Entamoeba histolytica
LSTEPKE

SEQ ID NO: 2639576 - protein, 7 aa, Entamoeba histolytica
LSTEQQK

SEQ ID NO: 2639577 - protein, 7 aa, Entamoeba histolytica
LSTGDEK

SEQ ID NO: 2639578 - protein, 12 aa, Entamoeba histolytica
LSTGKKGTLKAE

SEQ ID NO: 2639579 - protein, 8 aa, Entamoeba histolytica
LSTGKRDL

SEQ ID NO: 2639580 - protein, 8 aa, Entamoeba histolytica
LSTKDITT

SEQ ID NO: 2639581 - protein, 4 aa, Entamoeba histolytica
LSTN

SEQ ID NO: 2639582 - protein, 12 aa, Entamoeba histolytica
LSTNAKALPKIS

SEQ ID NO: 2639583 - protein, 12 aa, Entamoeba histolytica
LSTNEKNESNGF

SEQ ID NO: 2639584 - protein, 6 aa, Entamoeba histolytica
LSTNKD

SEQ ID NO: 2639585 - protein, 10 aa, Entamoeba histolytica
LSTNNDLPDV

SEQ ID NO: 2639586 - protein, 10 aa, Entamoeba histolytica
LSTNQIEKCP

SEQ ID NO: 2639587 - protein, 11 aa, Entamoeba histolytica
LSTNTKKEKSD

SEQ ID NO: 2639588 - protein, 8 aa, Entamoeba histolytica
LSTPEGEK

SEQ ID NO: 2639589 - protein, 8 aa, Entamoeba histolytica
LSTPEKIK

SEQ ID NO: 2639590 - protein, 14 aa, Entamoeba histolytica
LSTPEKPKRKARKS

SEQ ID NO: 2639591 - protein, 12 aa, Entamoeba histolytica
LSTPGNSNAKPI

SEQ ID NO: 2639592 - protein, 6 aa, Entamoeba histolytica
LSTPLK

SEQ ID NO: 2639593 - protein, 26 aa, Entamoeba histolytica
LSTPPPTTKPIKSITKKEKVREPPPV

SEQ ID NO: 2639594 - protein, 6 aa, Entamoeba histolytica
LSTQNA

SEQ ID NO: 2639595 - protein, 10 aa, Entamoeba histolytica
LSTQQNKRIT

SEQ ID NO: 2639596 - protein, 5 aa, Entamoeba histolytica
LSTRG

SEQ ID NO: 2639597 - protein, 8 aa, Entamoeba histolytica
LSTRNEKK

SEQ ID NO: 2639598 - protein, 16 aa, Entamoeba histolytica
LSTSESANKKRKSVSI

SEQ ID NO: 2639599 - protein, 5 aa, Entamoeba histolytica
LSTST

SEQ ID NO: 2639600 - protein, 6 aa, Entamoeba histolytica
LSTTKE

SEQ ID NO: 2639601 - protein, 8 aa, Entamoeba histolytica
LSTTTDDI

SEQ ID NO: 2639602 - protein, 13 aa, Entamoeba histolytica
LSVGTEKSITESV

SEQ ID NO: 2639603 - protein, 25 aa, Entamoeba histolytica
LSVSETTLQYNQKKQAQSVGDSEIP

SEQ ID NO: 2639604 - protein, 11 aa, Entamoeba histolytica
LSVSTKPEKVA

SEQ ID NO: 2639605 - protein, 9 aa, Entamoeba histolytica
LSYDASKSD

SEQ ID NO: 2639606 - protein, 7 aa, Entamoeba histolytica
LSYDGDK

SEQ ID NO: 2639607 - protein, 7 aa, Entamoeba histolytica
LSYNNPE

SEQ ID NO: 2639608 - protein, 5 aa, Entamoeba histolytica
LSYPG

SEQ ID NO: 2639609 - protein, 6 aa, Entamoeba histolytica
LSYPGT

SEQ ID NO: 2639610 - protein, 5 aa, Entamoeba histolytica
LSYPS

SEQ ID NO: 2639611 - protein, 4 aa, Entamoeba histolytica
LSYS

SEQ ID NO: 2639612 - protein, 7 aa, Entamoeba histolytica
LSYSYQE

SEQ ID NO: 2639613 - protein, 7 aa, Entamoeba histolytica
LSYTTTT

SEQ ID NO: 2639614 - protein, 12 aa, Entamoeba histolytica
LTANKKETDSVP

SEQ ID NO: 2639615 - protein, 9 aa, Entamoeba histolytica
LTANSTKDS

SEQ ID NO: 2639616 - protein, 7 aa, Entamoeba histolytica
LTAQTLN

SEQ ID NO: 2639617 - protein, 14 aa, Entamoeba histolytica
LTDCQDSGTTTEKH

SEQ ID NO: 2639618 - protein, 42 aa, Entamoeba histolytica
LTDDDEYEKKVEEPSTPPNQNVKRNTKVQQKEEKAENSPLQG

SEQ ID NO: 2639619 - protein, 9 aa, Entamoeba histolytica
LTDDKTIQG

SEQ ID NO: 2639620 - protein, 5 aa, Entamoeba histolytica
LTDDN

SEQ ID NO: 2639621 - protein, 5 aa, Entamoeba histolytica
LTDED

SEQ ID NO: 2639622 - protein, 28 aa, Entamoeba histolytica
LTDEETNNEFTSVENSTPSKSHCSEETL

SEQ ID NO: 2639623 - protein, 9 aa, Entamoeba histolytica
LTDEKRNAV

SEQ ID NO: 2639624 - protein, 10 aa, Entamoeba histolytica
LTDGEEEGEY

SEQ ID NO: 2639625 - protein, 14 aa, Entamoeba histolytica
LTDGKKTSKFMESC

SEQ ID NO: 2639626 - protein, 5 aa, Entamoeba histolytica
LTDIT

SEQ ID NO: 2639627 - protein, 10 aa, Entamoeba histolytica
LTDKDKSITI

SEQ ID NO: 2639628 - protein, 5 aa, Entamoeba histolytica
LTDKE

SEQ ID NO: 2639629 - protein, 11 aa, Entamoeba histolytica
LTDKKKSQIER

SEQ ID NO: 2639630 - protein, 4 aa, Entamoeba histolytica
LTDL

SEQ ID NO: 2639631 - protein, 4 aa, Entamoeba histolytica
LTDN

SEQ ID NO: 2639632 - protein, 11 aa, Entamoeba histolytica
LTDNNTVNNGS

SEQ ID NO: 2639633 - protein, 5 aa, Entamoeba histolytica
LTDNP

SEQ ID NO: 2639634 - protein, 9 aa, Entamoeba histolytica
LTDPSLDNN

SEQ ID NO: 2639635 - protein, 8 aa, Entamoeba histolytica
LTDPTTGM

SEQ ID NO: 2639636 - protein, 6 aa, Entamoeba histolytica
LTDSAK

SEQ ID NO: 2639637 - protein, 5 aa, Entamoeba histolytica
LTDSG

SEQ ID NO: 2639638 - protein, 10 aa, Entamoeba histolytica
LTDSTKECYQ

SEQ ID NO: 2639639 - protein, 15 aa, Entamoeba histolytica
LTEAEINTNEDSAKL

SEQ ID NO: 2639640 - protein, 7 aa, Entamoeba histolytica
LTEDESN

SEQ ID NO: 2639641 - protein, 20 aa, Entamoeba histolytica
LTEDPTIPSIEEKKKRINDF

SEQ ID NO: 2639642 - protein, 6 aa, Entamoeba histolytica
LTEDSL

SEQ ID NO: 2639643 - protein, 7 aa, Entamoeba histolytica
LTEEEID

SEQ ID NO: 2639644 - protein, 41 aa, Entamoeba histolytica
LTEEELKKEEEKKEKRRIQARQYREEKKRKEDSMSNASQTI

SEQ ID NO: 2639645 - protein, 11 aa, Entamoeba histolytica
LTEEEREKNSQ

SEQ ID NO: 2639646 - protein, 7 aa, Entamoeba histolytica
LTEEERN

SEQ ID NO: 2639647 - protein, 11 aa, Entamoeba histolytica
LTEEKPDIFKT

SEQ ID NO: 2639648 - protein, 12 aa, Entamoeba histolytica
LTEEQQEETEDV

SEQ ID NO: 2639649 - protein, 83 aa, Entamoeba histolytica
LTEEQTPAQQQEEENKQTISEEQAPAQQQEEENQITNEEQAPAQQEIENKQTISEEQTPAQQQEEENQITNEEQRWNKKEYDI

SEQ ID NO: 2639650 - protein, 11 aa, Entamoeba histolytica
LTEETSASGPY

SEQ ID NO: 2639651 - protein, 12 aa, Entamoeba histolytica
LTEFPQEEVKKE

SEQ ID NO: 2639652 - protein, 4 aa, Entamoeba histolytica
LTEG

SEQ ID NO: 2639653 - protein, 10 aa, Entamoeba histolytica
LTEGKSGTIK

SEQ ID NO: 2639654 - protein, 5 aa, Entamoeba histolytica
LTEGN

SEQ ID NO: 2639655 - protein, 8 aa, Entamoeba histolytica
LTEGRQNR

SEQ ID NO: 2639656 - protein, 7 aa, Entamoeba histolytica
LTEIGEK

SEQ ID NO: 2639657 - protein, 11 aa, Entamoeba histolytica
LTEKEEDSLTE

SEQ ID NO: 2639658 - protein, 4 aa, Entamoeba histolytica
LTEN

SEQ ID NO: 2639659 - protein, 7 aa, Entamoeba histolytica
LTENGTT

SEQ ID NO: 2639660 - protein, 10 aa, Entamoeba histolytica
LTENNKKDPM

SEQ ID NO: 2639661 - protein, 8 aa, Entamoeba histolytica
LTENNPRG

SEQ ID NO: 2639662 - protein, 9 aa, Entamoeba histolytica
LTENPPETK

SEQ ID NO: 2639663 - protein, 6 aa, Entamoeba histolytica
LTEQNS

SEQ ID NO: 2639664 - protein, 10 aa, Entamoeba histolytica
LTERDDMGGI

SEQ ID NO: 2639665 - protein, 16 aa, Entamoeba histolytica
LTERKERANKKEEPID

SEQ ID NO: 2639666 - protein, 15 aa, Entamoeba histolytica
LTESNPNIINSNQNK

SEQ ID NO: 2639667 - protein, 11 aa, Entamoeba histolytica
LTESQKQPKVR

SEQ ID NO: 2639668 - protein, 5 aa, Entamoeba histolytica
LTESS

SEQ ID NO: 2639669 - protein, 5 aa, Entamoeba histolytica
LTESV

SEQ ID NO: 2639670 - protein, 10 aa, Entamoeba histolytica
LTESYRNNYY

SEQ ID NO: 2639671 - protein, 8 aa, Entamoeba histolytica
LTETEEKL

SEQ ID NO: 2639672 - protein, 5 aa, Entamoeba histolytica
LTETK

SEQ ID NO: 2639673 - protein, 14 aa, Entamoeba histolytica
LTETRKKFILSFFD

SEQ ID NO: 2639674 - protein, 5 aa, Entamoeba histolytica
LTFGN

SEQ ID NO: 2639675 - protein, 7 aa, Entamoeba histolytica
LTFSGQG

SEQ ID NO: 2639676 - protein, 37 aa, Entamoeba histolytica
LTGAPPLPKHPQKNFPSSTKHLQQPPKENKLTQNDNK

SEQ ID NO: 2639677 - protein, 12 aa, Entamoeba histolytica
LTGAQNKKRFNS

SEQ ID NO: 2639678 - protein, 11 aa, Entamoeba histolytica
LTGEETSKSIP

SEQ ID NO: 2639679 - protein, 7 aa, Entamoeba histolytica
LTGENGF

SEQ ID NO: 2639680 - protein, 8 aa, Entamoeba histolytica
LTGHSGKV

SEQ ID NO: 2639681 - protein, 12 aa, Entamoeba histolytica
LTGHSNRITGGK

SEQ ID NO: 2639682 - protein, 6 aa, Entamoeba histolytica
LTGKKE

SEQ ID NO: 2639683 - protein, 24 aa, Entamoeba histolytica
LTGKKKSRLRQDVSSKSGDDDDSK

SEQ ID NO: 2639684 - protein, 5 aa, Entamoeba histolytica
LTGLN

SEQ ID NO: 2639685 - protein, 4 aa, Entamoeba histolytica
LTGN

SEQ ID NO: 2639686 - protein, 10 aa, Entamoeba histolytica
LTGNDSQAKL

SEQ ID NO: 2639687 - protein, 8 aa, Entamoeba histolytica
LTGNGKEV

SEQ ID NO: 2639688 - protein, 5 aa, Entamoeba histolytica
LTGNP

SEQ ID NO: 2639689 - protein, 9 aa, Entamoeba histolytica
LTGNQWNKQ

SEQ ID NO: 2639690 - protein, 8 aa, Entamoeba histolytica
LTGQPEIN

SEQ ID NO: 2639691 - protein, 6 aa, Entamoeba histolytica
LTGRTS

SEQ ID NO: 2639692 - protein, 10 aa, Entamoeba histolytica
LTGSKSKKVK

SEQ ID NO: 2639693 - protein, 4 aa, Entamoeba histolytica
LTGT

SEQ ID NO: 2639694 - protein, 5 aa, Entamoeba histolytica
LTGTA

SEQ ID NO: 2639695 - protein, 10 aa, Entamoeba histolytica
LTGTKKTISP

SEQ ID NO: 2639696 - protein, 7 aa, Entamoeba histolytica
LTGTNLN

SEQ ID NO: 2639697 - protein, 4 aa, Entamoeba histolytica
LTGV

SEQ ID NO: 2639698 - protein, 5 aa, Entamoeba histolytica
LTIDD

SEQ ID NO: 2639699 - protein, 8 aa, Entamoeba histolytica
LTIEPSKT

SEQ ID NO: 2639700 - protein, 12 aa, Entamoeba histolytica
LTIGKRGKKSVT

SEQ ID NO: 2639701 - protein, 9 aa, Entamoeba histolytica
LTIKEEKRG

SEQ ID NO: 2639702 - protein, 37 aa, Entamoeba histolytica
LTINQQKSLSQTLPKSIEVKDTKEVPQTEIQQEVPKE

SEQ ID NO: 2639703 - protein, 5 aa, Entamoeba histolytica
LTINT

SEQ ID NO: 2639704 - protein, 16 aa, Entamoeba histolytica
LTKAQKEENDIDNYHR

SEQ ID NO: 2639705 - protein, 4 aa, Entamoeba histolytica
LTKE

SEQ ID NO: 2639706 - protein, 5 aa, Entamoeba histolytica
LTKEG

SEQ ID NO: 2639707 - protein, 10 aa, Entamoeba histolytica
LTKEKRDPAR

SEQ ID NO: 2639708 - protein, 6 aa, Entamoeba histolytica
LTKERI

SEQ ID NO: 2639709 - protein, 8 aa, Entamoeba histolytica
LTKGTKPH

SEQ ID NO: 2639710 - protein, 7 aa, Entamoeba histolytica
LTKGYGK

SEQ ID NO: 2639711 - protein, 9 aa, Entamoeba histolytica
LTKKEKINE

SEQ ID NO: 2639712 - protein, 7 aa, Entamoeba histolytica
LTKKSEK

SEQ ID NO: 2639713 - protein, 9 aa, Entamoeba histolytica
LTKNTKHTL

SEQ ID NO: 2639714 - protein, 8 aa, Entamoeba histolytica
LTKPSEDL

SEQ ID NO: 2639715 - protein, 15 aa, Entamoeba histolytica
LTKQEKASKELEGKA

SEQ ID NO: 2639716 - protein, 12 aa, Entamoeba histolytica
LTKQKSNRTSIV

SEQ ID NO: 2639717 - protein, 5 aa, Entamoeba histolytica
LTKRG

SEQ ID NO: 2639718 - protein, 6 aa, Entamoeba histolytica
LTKRQR

SEQ ID NO: 2639719 - protein, 8 aa, Entamoeba histolytica
LTKSPNEA

SEQ ID NO: 2639720 - protein, 6 aa, Entamoeba histolytica
LTKSSL

SEQ ID NO: 2639721 - protein, 11 aa, Entamoeba histolytica
LTLPETKEEVA

SEQ ID NO: 2639722 - protein, 5 aa, Entamoeba histolytica
LTLPT

SEQ ID NO: 2639723 - protein, 27 aa, Entamoeba histolytica
LTLTDERYKPSKKNTPISDTRSDSLSL

SEQ ID NO: 2639724 - protein, 8 aa, Entamoeba histolytica
LTNDEKTH

SEQ ID NO: 2639725 - protein, 7 aa, Entamoeba histolytica
LTNDMSE

SEQ ID NO: 2639726 - protein, 6 aa, Entamoeba histolytica
LTNDTE

SEQ ID NO: 2639727 - protein, 25 aa, Entamoeba histolytica
LTNDYQSKIGRMTTNSIPISKEEVN

SEQ ID NO: 2639728 - protein, 4 aa, Entamoeba histolytica
LTNE

SEQ ID NO: 2639729 - protein, 17 aa, Entamoeba histolytica
LTNEAQQSLRRTMETGS

SEQ ID NO: 2639730 - protein, 5 aa, Entamoeba histolytica
LTNEE

SEQ ID NO: 2639731 - protein, 10 aa, Entamoeba histolytica
LTNEEKGKVC

SEQ ID NO: 2639732 - protein, 6 aa, Entamoeba histolytica
LTNEQQ

SEQ ID NO: 2639733 - protein, 6 aa, Entamoeba histolytica
LTNERV

SEQ ID NO: 2639734 - protein, 10 aa, Entamoeba histolytica
LTNESLRNYE

SEQ ID NO: 2639735 - protein, 4 aa, Entamoeba histolytica
LTNG

SEQ ID NO: 2639736 - protein, 10 aa, Entamoeba histolytica
LTNGKPGTKV

SEQ ID NO: 2639737 - protein, 9 aa, Entamoeba histolytica
LTNGTNDIE

SEQ ID NO: 2639738 - protein, 14 aa, Entamoeba histolytica
LTNHHGLDSKSQFL

SEQ ID NO: 2639739 - protein, 6 aa, Entamoeba histolytica
LTNKKR

SEQ ID NO: 2639740 - protein, 17 aa, Entamoeba histolytica
LTNKQNASDFKKEKSGT

SEQ ID NO: 2639741 - protein, 13 aa, Entamoeba histolytica
LTNPKTNPDKTGR

SEQ ID NO: 2639742 - protein, 8 aa, Entamoeba histolytica
LTNPPSGI

SEQ ID NO: 2639743 - protein, 7 aa, Entamoeba histolytica
LTNQTEE

SEQ ID NO: 2639744 - protein, 11 aa, Entamoeba histolytica
LTNRNTQNPIE

SEQ ID NO: 2639745 - protein, 5 aa, Entamoeba histolytica
LTNSE

SEQ ID NO: 2639746 - protein, 20 aa, Entamoeba histolytica
LTNSNSQEIKHPREKNVAPV

SEQ ID NO: 2639747 - protein, 6 aa, Entamoeba histolytica
LTNSTI

SEQ ID NO: 2639748 - protein, 10 aa, Entamoeba histolytica
LTNTGTVSCP

SEQ ID NO: 2639749 - protein, 21 aa, Entamoeba histolytica
LTNTKPSKKKTQQKRNTQSAQ

SEQ ID NO: 2639750 - protein, 5 aa, Entamoeba histolytica
LTNTQ

SEQ ID NO: 2639751 - protein, 7 aa, Entamoeba histolytica
LTPDESN

SEQ ID NO: 2639752 - protein, 6 aa, Entamoeba histolytica
LTPEDI

SEQ ID NO: 2639753 - protein, 5 aa, Entamoeba histolytica
LTPEE

SEQ ID NO: 2639754 - protein, 6 aa, Entamoeba histolytica
LTPEEL

SEQ ID NO: 2639755 - protein, 7 aa, Entamoeba histolytica
LTPEQKR

SEQ ID NO: 2639756 - protein, 5 aa, Entamoeba histolytica
LTPFA

SEQ ID NO: 2639757 - protein, 19 aa, Entamoeba histolytica
LTPGTIGKDGYMNKKDAQK

SEQ ID NO: 2639758 - protein, 6 aa, Entamoeba histolytica
LTPKDV

SEQ ID NO: 2639759 - protein, 6 aa, Entamoeba histolytica
LTPKGL

SEQ ID NO: 2639760 - protein, 18 aa, Entamoeba histolytica
LTPKSKDKNEKPVSKKVD

SEQ ID NO: 2639761 - protein, 5 aa, Entamoeba histolytica
LTPNE

SEQ ID NO: 2639762 - protein, 5 aa, Entamoeba histolytica
LTPNK

SEQ ID NO: 2639763 - protein, 7 aa, Entamoeba histolytica
LTPNKEN

SEQ ID NO: 2639764 - protein, 8 aa, Entamoeba histolytica
LTPNVGNI

SEQ ID NO: 2639765 - protein, 4 aa, Entamoeba histolytica
LTPP

SEQ ID NO: 2639766 - protein, 6 aa, Entamoeba histolytica
LTPPIH

SEQ ID NO: 2639767 - protein, 19 aa, Entamoeba histolytica
LTPQLAPQHQNKRESSEQE

SEQ ID NO: 2639768 - protein, 12 aa, Entamoeba histolytica
LTPQSAPSKTLI

SEQ ID NO: 2639769 - protein, 5 aa, Entamoeba histolytica
LTPQT

SEQ ID NO: 2639770 - protein, 7 aa, Entamoeba histolytica
LTPSEAK

SEQ ID NO: 2639771 - protein, 6 aa, Entamoeba histolytica
LTPSLK

SEQ ID NO: 2639772 - protein, 7 aa, Entamoeba histolytica
LTPSQSY

SEQ ID NO: 2639773 - protein, 15 aa, Entamoeba histolytica
LTPSVEASERKRLET

SEQ ID NO: 2639774 - protein, 6 aa, Entamoeba histolytica
LTPSYN

SEQ ID NO: 2639775 - protein, 9 aa, Entamoeba histolytica
LTPTEQGKK

SEQ ID NO: 2639776 - protein, 34 aa, Entamoeba histolytica
LTPTPQDRSEDIGTNENNKTNNKKEYTPSSSLKT

SEQ ID NO: 2639777 - protein, 6 aa, Entamoeba histolytica
LTPTQA

SEQ ID NO: 2639778 - protein, 9 aa, Entamoeba histolytica
LTPVQSYPD

SEQ ID NO: 2639779 - protein, 6 aa, Entamoeba histolytica
LTQDPE

SEQ ID NO: 2639780 - protein, 8 aa, Entamoeba histolytica
LTQEKSSH

SEQ ID NO: 2639781 - protein, 8 aa, Entamoeba histolytica
LTQESTIG

SEQ ID NO: 2639782 - protein, 24 aa, Entamoeba histolytica
LTQGSGSAPPPVPPLSPRRQAEQK

SEQ ID NO: 2639783 - protein, 6 aa, Entamoeba histolytica
LTQHED

SEQ ID NO: 2639784 - protein, 4 aa, Entamoeba histolytica
LTQK

SEQ ID NO: 2639785 - protein, 5 aa, Entamoeba histolytica
LTQKC

SEQ ID NO: 2639786 - protein, 10 aa, Entamoeba histolytica
LTQLNTREKD

SEQ ID NO: 2639787 - protein, 8 aa, Entamoeba histolytica
LTQQAGHN

SEQ ID NO: 2639788 - protein, 6 aa, Entamoeba histolytica
LTQQEF

SEQ ID NO: 2639789 - protein, 4 aa, Entamoeba histolytica
LTQS

SEQ ID NO: 2639790 - protein, 5 aa, Entamoeba histolytica
LTQSL

SEQ ID NO: 2639791 - protein, 18 aa, Entamoeba histolytica
LTQSPSTETPIQAPNSNT

SEQ ID NO: 2639792 - protein, 8 aa, Entamoeba histolytica
LTQTQHNI

SEQ ID NO: 2639793 - protein, 15 aa, Entamoeba histolytica
LTRASAAQCLTHSWF

SEQ ID NO: 2639794 - protein, 5 aa, Entamoeba histolytica
LTRDD

SEQ ID NO: 2639795 - protein, 32 aa, Entamoeba histolytica; identical to SEQ ID NO: 2444625

SEQ ID NO: 2639796 - protein, 6 aa, Entamoeba histolytica
LTREDI

SEQ ID NO: 2639797 - protein, 5 aa, Entamoeba histolytica
LTRNQ

SEQ ID NO: 2639798 - protein, 6 aa, Entamoeba histolytica
LTRPGR

SEQ ID NO: 2639799 - protein, 32 aa, Entamoeba histolytica
LTRPKKGVNTNDSEQQDPPTQQPVEKVQQRKG

SEQ ID NO: 2639800 - protein, 12 aa, Entamoeba histolytica
LTRREETKITTI

SEQ ID NO: 2639801 - protein, 17 aa, Entamoeba histolytica
LTRSASGKLNQDKPFTF

SEQ ID NO: 2639802 - protein, 9 aa, Entamoeba histolytica
LTRSASRIL

SEQ ID NO: 2639803 - protein, 15 aa, Entamoeba histolytica
LTRSRSSLITKPGQL

SEQ ID NO: 2639804 - protein, 8 aa, Entamoeba histolytica
LTSDDEKT

SEQ ID NO: 2639805 - protein, 14 aa, Entamoeba histolytica
LTSDDLTQPKKDVY

SEQ ID NO: 2639806 - protein, 8 aa, Entamoeba histolytica
LTSEVSNQ

SEQ ID NO: 2639807 - protein, 13 aa, Entamoeba histolytica
LTSGSTTISSQRS

SEQ ID NO: 2639808 - protein, 5 aa, Entamoeba histolytica
LTSIP

SEQ ID NO: 2639809 - protein, 20 aa, Entamoeba histolytica
LTSKEDKISTITQPPSKNIR

SEQ ID NO: 2639810 - protein, 8 aa, Entamoeba histolytica
LTSKKQIE

SEQ ID NO: 2639811 - protein, 11 aa, Entamoeba histolytica
LTSKQSPVSSP

SEQ ID NO: 2639812 - protein, 8 aa, Entamoeba histolytica
LTSKSAKK

SEQ ID NO: 2639813 - protein, 4 aa, Entamoeba histolytica
LTSL

SEQ ID NO: 2639814 - protein, 6 aa, Entamoeba histolytica
LTSLPK

SEQ ID NO: 2639815 - protein, 9 aa, Entamoeba histolytica
LTSNDSEQI

SEQ ID NO: 2639816 - protein, 10 aa, Entamoeba histolytica
LTSNKDLNKE

SEQ ID NO: 2639817 - protein, 5 aa, Entamoeba histolytica
LTSNP

SEQ ID NO: 2639818 - protein, 4 aa, Entamoeba histolytica
LTSQ

SEQ ID NO: 2639819 - protein, 12 aa, Entamoeba histolytica
LTSQRDKRNSIV

SEQ ID NO: 2639820 - protein, 5 aa, Entamoeba histolytica
LTSRR

SEQ ID NO: 2639821 - protein, 19 aa, Entamoeba histolytica
LTSSAVERLNDKSTPVRKN

SEQ ID NO: 2639822 - protein, 8 aa, Entamoeba histolytica
LTSSGDST

SEQ ID NO: 2639823 - protein, 12 aa, Entamoeba histolytica
LTSSGTVSNELK

SEQ ID NO: 2639824 - protein, 10 aa, Entamoeba histolytica
LTSSLQQDNL

SEQ ID NO: 2639825 - protein, 7 aa, Entamoeba histolytica
LTSSLSS

SEQ ID NO: 2639826 - protein, 12 aa, Entamoeba histolytica
LTSTDHPMNNSQ

SEQ ID NO: 2639827 - protein, 6 aa, Entamoeba histolytica
LTSTNE

SEQ ID NO: 2639828 - protein, 7 aa, Entamoeba histolytica
LTSTNKM

SEQ ID NO: 2639829 - protein, 10 aa, Entamoeba histolytica
LTSVPGSSAV

SEQ ID NO: 2639830 - protein, 7 aa, Entamoeba histolytica
LTSVSNN

SEQ ID NO: 2639831 - protein, 13 aa, Entamoeba histolytica
LTTDTIKDDEYRR

SEQ ID NO: 2639832 - protein, 4 aa, Entamoeba histolytica
LTTE

SEQ ID NO: 2639833 - protein, 10 aa, Entamoeba histolytica
LTTEDEEKEG

SEQ ID NO: 2639834 - protein, 8 aa, Entamoeba histolytica
LTTEEEIR

SEQ ID NO: 2639835 - protein, 9 aa, Entamoeba histolytica
LTTEEGYQS

SEQ ID NO: 2639836 - protein, 7 aa, Entamoeba histolytica
LTTEPTQ

SEQ ID NO: 2639837 - protein, 5 aa, Entamoeba histolytica
LTTEY

SEQ ID NO: 2639838 - protein, 13 aa, Entamoeba histolytica
LTTEYQKNVPYDI

SEQ ID NO: 2639839 - protein, 5 aa, Entamoeba histolytica
LTTGN

SEQ ID NO: 2639840 - protein, 7 aa, Entamoeba histolytica
LTTKDYK

SEQ ID NO: 2639841 - protein, 8 aa, Entamoeba histolytica
LTTKGTNI

SEQ ID NO: 2639842 - protein, 15 aa, Entamoeba histolytica
LTTKNDSEPSPSPQI

SEQ ID NO: 2639843 - protein, 11 aa, Entamoeba histolytica
LTTKPDTNTHW

SEQ ID NO: 2639844 - protein, 10 aa, Entamoeba histolytica
LTTKPENAEV

SEQ ID NO: 2639845 - protein, 10 aa, Entamoeba histolytica
LTTKPGQPTH

SEQ ID NO: 2639846 - protein, 6 aa, Entamoeba histolytica
LTTKQE

SEQ ID NO: 2639847 - protein, 4 aa, Entamoeba histolytica
LTTN

SEQ ID NO: 2639848 - protein, 8 aa, Entamoeba histolytica
LTTNKSSD

SEQ ID NO: 2639849 - protein, 7 aa, Entamoeba histolytica
LTTNTYR

SEQ ID NO: 2639850 - protein, 49 aa, Entamoeba histolytica
LTTPPIQPTTNTFNEPEKKINDQTKKKNQSHHQEKSFTNKNDNPKTNGI

SEQ ID NO: 2639851 - protein, 10 aa, Entamoeba histolytica
LTTPQIPTKE

SEQ ID NO: 2639852 - protein, 6 aa, Entamoeba histolytica
LTTQGI

SEQ ID NO: 2639853 - protein, 7 aa, Entamoeba histolytica
LTTQKLQ

SEQ ID NO: 2639854 - protein, 6 aa, Entamoeba histolytica
LTTQNT

SEQ ID NO: 2639855 - protein, 6 aa, Entamoeba histolytica
LTTQPQ

SEQ ID NO: 2639856 - protein, 13 aa, Entamoeba histolytica
LTTSKNLKNELSK

SEQ ID NO: 2639857 - protein, 5 aa, Entamoeba histolytica
LTTSL

SEQ ID NO: 2639858 - protein, 9 aa, Entamoeba histolytica
LTTSPTYET

SEQ ID NO: 2639859 - protein, 5 aa, Entamoeba histolytica
LTTSR

SEQ ID NO: 2639860 - protein, 8 aa, Entamoeba histolytica
LTTSSTQI

SEQ ID NO: 2639861 - protein, 7 aa, Entamoeba histolytica
LTTTADQ

SEQ ID NO: 2639862 - protein, 19 aa, Entamoeba histolytica
LTTTKTDKINTSNKPTTIS

SEQ ID NO: 2639863 - protein, 6 aa, Entamoeba histolytica
LTTTST

SEQ ID NO: 2639864 - protein, 18 aa, Entamoeba histolytica
LTTTTTNDSSQDQNSASY

SEQ ID NO: 2639865 - protein, 9 aa, Entamoeba histolytica
LTTYRGDYG

SEQ ID NO: 2639866 - protein, 6 aa, Entamoeba histolytica
LTTYSQ

SEQ ID NO: 2639867 - protein, 7 aa, Entamoeba histolytica
LTVEGGD

SEQ ID NO: 2639868 - protein, 4 aa, Entamoeba histolytica
LTYG

SEQ ID NO: 2639869 - protein, 11 aa, Entamoeba histolytica
LVAQEGSQFNK

SEQ ID NO: 2639870 - protein, 8 aa, Entamoeba histolytica
LVDPSNGN

SEQ ID NO: 2639871 - protein, 12 aa, Entamoeba histolytica
LVEKTDKETIQL

SEQ ID NO: 2639872 - protein, 10 aa, Entamoeba histolytica
LVENDSPSHL

SEQ ID NO: 2639873 - protein, 8 aa, Entamoeba histolytica
LVETSNSL

SEQ ID NO: 2639874 - protein, 17 aa, Entamoeba histolytica
LVETSQSVSIGKLEGNT

SEQ ID NO: 2639875 - protein, 5 aa, Entamoeba histolytica
LVGAK

SEQ ID NO: 2639876 - protein, 4 aa, Entamoeba histolytica
LVGD

SEQ ID NO: 2639877 - protein, 19 aa, Entamoeba histolytica
LVGSNDSTFTVQRIIVLEF

SEQ ID NO: 2639878 - protein, 20 aa, Entamoeba histolytica
LVNNQNKNKGKTKESESKKF

SEQ ID NO: 2639879 - protein, 9 aa, Entamoeba histolytica
LVPGGGASE

SEQ ID NO: 2639880 - protein, 12 aa, Entamoeba histolytica
LVPTPEDPESTK

SEQ ID NO: 2639881 - protein, 5 aa, Entamoeba histolytica
LVQGG

SEQ ID NO: 2639882 - protein, 8 aa, Entamoeba histolytica
LVQSEGIS

SEQ ID NO: 2639883 - protein, 9 aa, Entamoeba histolytica
LVSDETLTK

SEQ ID NO: 2639884 - protein, 5 aa, Entamoeba histolytica
LVSDR

SEQ ID NO: 2639885 - protein, 9 aa, Entamoeba histolytica
LVSKEDGYK

SEQ ID NO: 2639886 - protein, 20 aa, Entamoeba histolytica
LVSQPQPNQSFKKEEPKKDD

SEQ ID NO: 2639887 - protein, 6 aa, Entamoeba histolytica
LVSTRA

SEQ ID NO: 2639888 - protein, 64 aa, Entamoeba histolytica
LVSTSSRHCNKQQSSSENSPQLSSSVTKEQTSDNNLPQEGHETISQDVSSHTTTYGQQETTHTL

SEQ ID NO: 2639889 - protein, 4 aa, Entamoeba histolytica
LVTE

SEQ ID NO: 2639890 - protein, 9 aa, Entamoeba histolytica
LVTTTKEQL

SEQ ID NO: 2639891 - protein, 9 aa, Entamoeba histolytica
LYAGKGDLE

SEQ ID NO: 2639892 - protein, 5 aa, Entamoeba histolytica
LYDGN

SEQ ID NO: 2639893 - protein, 10 aa, Entamoeba histolytica
LYDKNGKLKE

SEQ ID NO: 2639894 - protein, 5 aa, Entamoeba histolytica
LYDSP

SEQ ID NO: 2639895 - protein, 63 aa, Entamoeba histolytica
LYEDGKKPRLNNKHSSHGSTTKFEKKSEKKVNKKENKFNDKQTRKGDKFSKKKFKENKKVRKE

SEQ ID NO: 2639896 - protein, 10 aa, Entamoeba histolytica
LYEKEDPRYT

SEQ ID NO: 2639897 - protein, 10 aa, Entamoeba histolytica
LYEKGQSKRI

SEQ ID NO: 2639898 - protein, 4 aa, Entamoeba histolytica
LYER

SEQ ID NO: 2639899 - protein, 5 aa, Entamoeba histolytica
LYESY

SEQ ID NO: 2639900 - protein, 14 aa, Entamoeba histolytica
LYGNGEKDRGDPRI

SEQ ID NO: 2639901 - protein, 8 aa, Entamoeba histolytica
LYGSKTAK

SEQ ID NO: 2639902 - protein, 9 aa, Entamoeba histolytica
LYKEKSKQY

SEQ ID NO: 2639903 - protein, 9 aa, Entamoeba histolytica
LYKKDDKAF

SEQ ID NO: 2639904 - protein, 9 aa, Entamoeba histolytica
LYKPQPTSL

SEQ ID NO: 2639905 - protein, 8 aa, Entamoeba histolytica
LYNQDAKS

SEQ ID NO: 2639906 - protein, 25 aa, Entamoeba histolytica
LYNSTSGNEEGNEMSEEEIENDDLS

SEQ ID NO: 2639907 - protein, 6 aa, Entamoeba histolytica
LYPDSP

SEQ ID NO: 2639908 - protein, 5 aa, Entamoeba histolytica
LYPHN

SEQ ID NO: 2639909 - protein, 6 aa, Entamoeba histolytica
LYPNGY

SEQ ID NO: 2639910 - protein, 5 aa, Entamoeba histolytica
LYPPQ

SEQ ID NO: 2639911 - protein, 6 aa, Entamoeba histolytica
LYPQNM

SEQ ID NO: 2639912 - protein, 21 aa, Entamoeba histolytica
LYPSPRRVPDFQSDDGRHREQ

SEQ ID NO: 2639913 - protein, 6 aa, Entamoeba histolytica
LYPSTE

SEQ ID NO: 2639914 - protein, 12 aa, Entamoeba histolytica
LYPTASLDSPNF

SEQ ID NO: 2639915 - protein, 6 aa, Entamoeba histolytica
LYPTNK

SEQ ID NO: 2639916 - protein, 5 aa, Entamoeba histolytica
LYPVG

SEQ ID NO: 2639917 - protein, 15 aa, Entamoeba histolytica
LYTEDDSKTQGKYTI

SEQ ID NO: 2639918 - protein, 11 aa, Entamoeba histolytica
LYTQQNQTWKT

SEQ ID NO: 2639919 - protein, 12 aa, Entamoeba histolytica
MAATRSKAAEVT

SEQ ID NO: 2639920 - protein, 9 aa, Entamoeba histolytica
MADDDEDIH

SEQ ID NO: 2639921 - protein, 5 aa, Entamoeba histolytica
MADDV

SEQ ID NO: 2639922 - protein, 32 aa, Entamoeba histolytica
MADSSDFKPFEGEGSRLGRSRDMEQNDYTDTE

SEQ ID NO: 2639923 - protein, 7 aa, Entamoeba histolytica
MADTGDL

SEQ ID NO: 2639924 - protein, 30 aa, Entamoeba histolytica
MAEEKGKKKSTKKKVSKKTNSKKKKTQQKV

SEQ ID NO: 2639925 - protein, 7 aa, Entamoeba histolytica
MAEEYST

SEQ ID NO: 2639926 - protein, 42 aa, Entamoeba histolytica
MAEGKGINDVSKEIKDQEQLTGLKGEKQQEQNKDEKQDMDKG

SEQ ID NO: 2639927 - protein, 56 aa, Entamoeba histolytica
MAEPDDEDMDDEDMDDDCDDDCDCEGHDDDDDEEEDKPHGNTSNTTAPPVPQECPQ

SEQ ID NO: 2639928 - protein, 10 aa, Entamoeba histolytica
MAESLSPDPL

SEQ ID NO: 2639929 - protein, 8 aa, Entamoeba histolytica
MAGGDKKV

SEQ ID NO: 2639930 - protein, 5 aa, Entamoeba histolytica
MAKEI

SEQ ID NO: 2639931 - protein, 8 aa, Entamoeba histolytica
MAKKGKKY

SEQ ID NO: 2639932 - protein, 9 aa, Entamoeba histolytica
MAKTQDSYY

SEQ ID NO: 2639933 - protein, 9 aa, Entamoeba histolytica
MAKTSNDSF

SEQ ID NO: 2639934 - protein, 13 aa, Entamoeba histolytica
MAKTTNGSFLGSS

SEQ ID NO: 2639935 - protein, 6 aa, Entamoeba histolytica
MANIEE

SEQ ID NO: 2639936 - protein, 7 aa, Entamoeba histolytica
MANTQGN

SEQ ID NO: 2639937 - protein, 14 aa, Entamoeba histolytica
MAPEATGSTKDAAV

SEQ ID NO: 2639938 - protein, 7 aa, Entamoeba histolytica
MAPECNT

SEQ ID NO: 2639939 - protein, 5 aa, Entamoeba histolytica
MAQDR

SEQ ID NO: 2639940 - protein, 12 aa, Entamoeba histolytica
MAQPNKKEEVSM

SEQ ID NO: 2639941 - protein, 30 aa, Entamoeba histolytica; identical to SEQ ID NO: 2444761

SEQ ID NO: 2639942 - protein, 13 aa, Entamoeba histolytica
MASENKKKKPIVP

SEQ ID NO: 2639943 - protein, 5 aa, Entamoeba histolytica
MDAEK

SEQ ID NO: 2639944 - protein, 9 aa, Entamoeba histolytica
MDDSDTSEE

SEQ ID NO: 2639945 - protein, 18 aa, Entamoeba histolytica
MDDTSTEKAPKINAPKTV

SEQ ID NO: 2639946 - protein, 8 aa, Entamoeba histolytica
MDEDPSKH

SEQ ID NO: 2639947 - protein, 30 aa, Entamoeba histolytica
MDEESGDNDEDDVNVQETISTKKEKGLKVQ

SEQ ID NO: 2639948 - protein, 6 aa, Entamoeba histolytica
MDEQSV

SEQ ID NO: 2639949 - protein, 11 aa, Entamoeba histolytica
MDESDEETQIS

SEQ ID NO: 2639950 - protein, 12 aa, Entamoeba histolytica
MDESEDSEENLR

SEQ ID NO: 2639951 - protein, 8 aa, Entamoeba histolytica
MDESYTPS

SEQ ID NO: 2639952 - protein, 17 aa, Entamoeba histolytica
MDEVPKEESSQKINSQD

SEQ ID NO: 2639953 - protein, 4 aa, Entamoeba histolytica
MDGD

SEQ ID NO: 2639954 - protein, 4 aa, Entamoeba histolytica
MDID

SEQ ID NO: 2639955 - protein, 8 aa, Entamoeba histolytica
MDKGSELR

SEQ ID NO: 2639956 - protein, 22 aa, Entamoeba histolytica
MDKNSTSSDIYDQNKNSPTTKG

SEQ ID NO: 2639957 - protein, 5 aa, Entamoeba histolytica
MDKQK

SEQ ID NO: 2639958 - protein, 14 aa, Entamoeba histolytica
MDKQNTNDSFVQSP

SEQ ID NO: 2639959 - protein, 29 aa, Entamoeba histolytica
MDKRENKELKNSVLENTEKIKEKEDQINK

SEQ ID NO: 2639960 - protein, 15 aa, Entamoeba histolytica
MDKYNEKASSIDPQK

SEQ ID NO: 2639961 - protein, 11 aa, Entamoeba histolytica
MDPKKTKIYEN

SEQ ID NO: 2639962 - protein, 9 aa, Entamoeba histolytica
MDPPAYEDD

SEQ ID NO: 2639963 - protein, 8 aa, Entamoeba histolytica
MDPSGKAP

SEQ ID NO: 2639964 - protein, 7 aa, Entamoeba histolytica
MDPSTFG

SEQ ID NO: 2639965 - protein, 5 aa, Entamoeba histolytica
MDQPQ

SEQ ID NO: 2639966 - protein, 12 aa, Entamoeba histolytica
MDRQSSKLSNNQ

SEQ ID NO: 2639967 - protein, 17 aa, Entamoeba histolytica
MDSEDEIEGENEALKTL

SEQ ID NO: 2639968 - protein, 11 aa, Entamoeba histolytica
MDSESKRSAGV

SEQ ID NO: 2639969 - protein, 19 aa, Entamoeba histolytica
MDSSSDDYDEDYDEDYEDD

SEQ ID NO: 2639970 - protein, 4 aa, Entamoeba histolytica
MDST

SEQ ID NO: 2639971 - protein, 6 aa, Entamoeba histolytica
MDSTNT

SEQ ID NO: 2639972 - protein, 10 aa, Entamoeba histolytica
MDTKERTTVQ

SEQ ID NO: 2639973 - protein, 11 aa, Entamoeba histolytica
MDTQTGNYGAA

SEQ ID NO: 2639974 - protein, 7 aa, Entamoeba histolytica
MDTSNPE

SEQ ID NO: 2639975 - protein, 5 aa, Entamoeba histolytica
MEARS

SEQ ID NO: 2639976 - protein, 4 aa, Entamoeba histolytica
MEDD

SEQ ID NO: 2639977 - protein, 83 aa, Entamoeba histolytica
MEDDEEEEESPKKEVIKKEEKKPQPPKQEKKPQPPKQEKKPQQPQKKESKQQQPQKKESKQQQPQKKQFQENKKKNKNHGKKQ

SEQ ID NO: 2639978 - protein, 14 aa, Entamoeba histolytica
MEDEIKKYSDAISS

SEQ ID NO: 2639979 - protein, 35 aa, Entamoeba histolytica
MEDETGDKKDKKDKKDKKDKEKRKHNGSIFKKIFG

SEQ ID NO: 2639980 - protein, 10 aa, Entamoeba histolytica
MEDHPNNAVP

SEQ ID NO: 2639981 - protein, 8 aa, Entamoeba histolytica
MEDNENNR

SEQ ID NO: 2639982 - protein, 4 aa, Entamoeba histolytica
MEEA

SEQ ID NO: 2639983 - protein, 13 aa, Entamoeba histolytica
MEEADSGEEEISN

SEQ ID NO: 2639984 - protein, 25 aa, Entamoeba histolytica
MEEEDDDQEVYDENEDDALEEDEDI

SEQ ID NO: 2639985 - protein, 9 aa, Entamoeba histolytica
MEEEESDFN

SEQ ID NO: 2639986 - protein, 32 aa, Entamoeba histolytica
MEEEETNNSLQNNQINEQNKKEEESPKKEEKK

SEQ ID NO: 2639987 - protein, 32 aa, Entamoeba histolytica
MEEEKTGEGEKKNMIEKKERKEEDMKENQQVD

SEQ ID NO: 2639988 - protein, 19 aa, Entamoeba histolytica
MEEEPKANNDQKEMETDEV

SEQ ID NO: 2639989 - protein, 7 aa, Entamoeba histolytica
MEEGGKH

SEQ ID NO: 2639990 - protein, 4 aa, Entamoeba histolytica
MEEL

SEQ ID NO: 2639991 - protein, 15 aa, Entamoeba histolytica
MEEQQPNQNKITTKR

SEQ ID NO: 2639992 - protein, 8 aa, Entamoeba histolytica
MEEQTRNE

SEQ ID NO: 2639993 - protein, 4 aa, Entamoeba histolytica
MEER

SEQ ID NO: 2639994 - protein, 5 aa, Entamoeba histolytica
MEERN

SEQ ID NO: 2639995 - protein, 13 aa, Entamoeba histolytica
MEERNKTNRVTTE

SEQ ID NO: 2639996 - protein, 29 aa, Entamoeba histolytica
MEERRKKRKEIREKKEQEEYEKKHPTISQ

SEQ ID NO: 2639997 - protein, 11 aa, Entamoeba histolytica
MEETKNEEGDL

SEQ ID NO: 2639998 - protein, 6 aa, Entamoeba histolytica
MEETND

SEQ ID NO: 2639999 - protein, 10 aa, Entamoeba histolytica
MEETNQFSQD

SEQ ID NO: 2640000 - protein, 38 aa, Entamoeba histolytica
MEETSEVLGQEGKDIKDGETIREKRVKEKESKNQERKK

SEQ ID NO: 2640001 - protein, 4 aa, Entamoeba histolytica
MEEV

SEQ ID NO: 2640002 - protein, 4 aa, Entamoeba histolytica
MEEY

SEQ ID NO: 2640003 - protein, 4 aa, Entamoeba histolytica
MEFP

SEQ ID NO: 2640004 - protein, 7 aa, Entamoeba histolytica
MEGEEGK

SEQ ID NO: 2640005 - protein, 5 aa, Entamoeba histolytica
MEGNE

SEQ ID NO: 2640006 - protein, 13 aa, Entamoeba histolytica
MEGNKEESIKNEN

SEQ ID NO: 2640007 - protein, 11 aa, Entamoeba histolytica
MEGSEVKETGF

SEQ ID NO: 2640008 - protein, 17 aa, Entamoeba histolytica
MEGSTARYGYKDNTTVE

SEQ ID NO: 2640009 - protein, 8 aa, Entamoeba histolytica
MEKERNEL

SEQ ID NO: 2640010 - protein, 18 aa, Entamoeba histolytica
MEKEYPNLSPKEREHTVA

SEQ ID NO: 2640011 - protein, 8 aa, Entamoeba histolytica
MEKGDGKS

SEQ ID NO: 2640012 - protein, 6 aa, Entamoeba histolytica
MEKGEI

SEQ ID NO: 2640013 - protein, 12 aa, Entamoeba histolytica
MEKNSKKVKSLI

SEQ ID NO: 2640014 - protein, 21 aa, Entamoeba histolytica
MEKTELTQKTYTITPPDQSCV

SEQ ID NO: 2640015 - protein, 4 aa, Entamoeba histolytica
MELE

SEQ ID NO: 2640016 - protein, 10 aa, Entamoeba histolytica
MENNEKEISG

SEQ ID NO: 2640017 - protein, 4 aa, Entamoeba histolytica
MENQ

SEQ ID NO: 2640018 - protein, 4 aa, Entamoeba histolytica
MEPE

SEQ ID NO: 2640019 - protein, 11 aa, Entamoeba histolytica
MEPGTTNPRES

SEQ ID NO: 2640020 - protein, 11 aa, Entamoeba histolytica
MEPPWKSHEEY

SEQ ID NO: 2640021 - protein, 15 aa, Entamoeba histolytica
MEPYSDDDEDDFSSE

SEQ ID NO: 2640022 - protein, 7 aa, Entamoeba histolytica
MEQAQNK

SEQ ID NO: 2640023 - protein, 17 aa, Entamoeba histolytica
MEQDDPDVVEKRSFETM

SEQ ID NO: 2640024 - protein, 4 aa, Entamoeba histolytica
MEQL

SEQ ID NO: 2640025 - protein, 9 aa, Entamoeba histolytica
MEQPDNKNK

SEQ ID NO: 2640026 - protein, 15 aa, Entamoeba histolytica
MEREEGPSQNILNPN

SEQ ID NO: 2640027 - protein, 13 aa, Entamoeba histolytica
MERESTENRADNL

SEQ ID NO: 2640028 - protein, 7 aa, Entamoeba histolytica
MESEEKL

SEQ ID NO: 2640029 - protein, 4 aa, Entamoeba histolytica
MESK

SEQ ID NO: 2640030 - protein, 5 aa, Entamoeba histolytica
MESKE

SEQ ID NO: 2640031 - protein, 15 aa, Entamoeba histolytica
MESNPIDLNQPSQIE

SEQ ID NO: 2640032 - protein, 6 aa, Entamoeba histolytica
MESPTK

SEQ ID NO: 2640033 - protein, 6 aa, Entamoeba histolytica
MESTQN

SEQ ID NO: 2640034 - protein, 5 aa, Entamoeba histolytica
MESTS

SEQ ID NO: 2640035 - protein, 10 aa, Entamoeba histolytica
METETQEIRE

SEQ ID NO: 2640036 - protein, 5 aa, Entamoeba histolytica
METNP

SEQ ID NO: 2640037 - protein, 7 aa, Entamoeba histolytica
METPAEC

SEQ ID NO: 2640038 - protein, 8 aa, Entamoeba histolytica
METPDELS

SEQ ID NO: 2640039 - protein, 6 aa, Entamoeba histolytica
METSQK

SEQ ID NO: 2640040 - protein, 11 aa, Entamoeba histolytica
METTGQKNPYF

SEQ ID NO: 2640041 - protein, 6 aa, Entamoeba histolytica
MGATPR

SEQ ID NO: 2640042 - protein, 10 aa, Entamoeba histolytica
MGDNNKSVRE

SEQ ID NO: 2640043 - protein, 9 aa, Entamoeba histolytica
MGDQPPYNT

SEQ ID NO: 2640044 - protein, 7 aa, Entamoeba histolytica
MGDRTEM

SEQ ID NO: 2640045 - protein, 12 aa, Entamoeba histolytica
MGDVNGGTEFYD

SEQ ID NO: 2640046 - protein, 5 aa, Entamoeba histolytica
MGEEG

SEQ ID NO: 2640047 - protein, 7 aa, Entamoeba histolytica
MGEEIKN

SEQ ID NO: 2640048 - protein, 4 aa, Entamoeba histolytica
MGGD

SEQ ID NO: 2640049 - protein, 9 aa, Entamoeba histolytica
MGGNGLGTN

SEQ ID NO: 2640050 - protein, 10 aa, Entamoeba histolytica
MGKDKQEVQR

SEQ ID NO: 2640051 - protein, 9 aa, Entamoeba histolytica
MGKEGTVQT

SEQ ID NO: 2640052 - protein, 7 aa, Entamoeba histolytica
MGKGKIA

SEQ ID NO: 2640053 - protein, 19 aa, Entamoeba histolytica
MGKNPASATKYLQDPEVRS

SEQ ID NO: 2640054 - protein, 9 aa, Entamoeba histolytica
MGKSAEYAN

SEQ ID NO: 2640055 - protein, 10 aa, Entamoeba histolytica
MGLNGEEKKV

SEQ ID NO: 2640056 - protein, 8 aa, Entamoeba histolytica
MGNDSATG

SEQ ID NO: 2640057 - protein, 7 aa, Entamoeba histolytica
MGNEEAT

SEQ ID NO: 2640058 - protein, 8 aa, Entamoeba histolytica
MGNEINNT

SEQ ID NO: 2640059 - protein, 7 aa, Entamoeba histolytica
MGNQKAQ

SEQ ID NO: 2640060 - protein, 5 aa, Entamoeba histolytica
MGNSQ

SEQ ID NO: 2640061 - protein, 5 aa, Entamoeba histolytica
MGPRA

SEQ ID NO: 2640062 - protein, 8 aa, Entamoeba histolytica
MGQQETNI

SEQ ID NO: 2640063 - protein, 6 aa, Entamoeba histolytica
MGSGGR

SEQ ID NO: 2640064 - protein, 6 aa, Entamoeba histolytica
MGSQDN

SEQ ID NO: 2640065 - protein, 4 aa, Entamoeba histolytica
MGSS

SEQ ID NO: 2640066 - protein, 23 aa, Entamoeba histolytica
MGSSQRGGNMGHPGSSRDGGDVE

SEQ ID NO: 2640067 - protein, 5 aa, Entamoeba histolytica
MGTGK

SEQ ID NO: 2640068 - protein, 6 aa, Entamoeba histolytica
MGTGSA

SEQ ID NO: 2640069 - protein, 7 aa, Entamoeba histolytica
MGTSASD

SEQ ID NO: 2640070 - protein, 6 aa, Entamoeba histolytica
MGVEQS

SEQ ID NO: 2640071 - protein, 8 aa, Entamoeba histolytica
MHKTNQTP

SEQ ID NO: 2640072 - protein, 10 aa, Entamoeba histolytica
MHNQPSGSVS

SEQ ID NO: 2640073 - protein, 19 aa, Entamoeba histolytica
MHPDNEDLGIKESDLQQSD

SEQ ID NO: 2640074 - protein, 27 aa, Entamoeba histolytica
MHSDKKDSSKNKSKDSSLNTQKTLEDR

SEQ ID NO: 2640075 - protein, 8 aa, Entamoeba histolytica
MIDEKTKK

SEQ ID NO: 2640076 - protein, 12 aa, Entamoeba histolytica
MIDSSKKDISGY

SEQ ID NO: 2640077 - protein, 15 aa, Entamoeba histolytica
MINPTAKPSIIRETS

SEQ ID NO: 2640078 - protein, 11 aa, Entamoeba histolytica
MIPSEKDYASN

SEQ ID NO: 2640079 - protein, 7 aa, Entamoeba histolytica
MKAEGND

SEQ ID NO: 2640080 - protein, 13 aa, Entamoeba histolytica
MKAKEGASEEYDD

SEQ ID NO: 2640081 - protein, 9 aa, Entamoeba histolytica
MKDDDEEIT

SEQ ID NO: 2640082 - protein, 7 aa, Entamoeba histolytica
MKDEDFD

SEQ ID NO: 2640083 - protein, 5 aa, Entamoeba histolytica
MKDET

SEQ ID NO: 2640084 - protein, 9 aa, Entamoeba histolytica
MKDETGLKD

SEQ ID NO: 2640085 - protein, 19 aa, Entamoeba histolytica
MKDNENKTKKGLSGTKQMR

SEQ ID NO: 2640086 - protein, 5 aa, Entamoeba histolytica
MKDQS

SEQ ID NO: 2640087 - protein, 5 aa, Entamoeba histolytica
MKDSD

SEQ ID NO: 2640088 - protein, 5 aa, Entamoeba histolytica
MKDSQ

SEQ ID NO: 2640089 - protein, 35 aa, Entamoeba histolytica
MKDVEKSAKAVRQDAENKIKDVEKCKDATKKERDK

SEQ ID NO: 2640090 - protein, 9 aa, Entamoeba histolytica
MKDYSKKND

SEQ ID NO: 2640091 - protein, 12 aa, Entamoeba histolytica
MKEDGKKLEEKL

SEQ ID NO: 2640092 - protein, 12 aa, Entamoeba histolytica
MKEDPDVYLSPS

SEQ ID NO: 2640093 - protein, 10 aa, Entamoeba histolytica
MKEEGKEDGY

SEQ ID NO: 2640094 - protein, 19 aa, Entamoeba histolytica
MKEEKERNHEKLSDINQSE

SEQ ID NO: 2640095 - protein, 6 aa, Entamoeba histolytica
MKEKCS

SEQ ID NO: 2640096 - protein, 10 aa, Entamoeba histolytica
MKEKKKKSLS

SEQ ID NO: 2640097 - protein, 13 aa, Entamoeba histolytica
MKEKQGTTTNKRR

SEQ ID NO: 2640098 - protein, 7 aa, Entamoeba histolytica
MKENQEG

SEQ ID NO: 2640099 - protein, 17 aa, Entamoeba histolytica
MKENQKNYRDNDNNEQH

SEQ ID NO: 2640100 - protein, 9 aa, Entamoeba histolytica
MKENTSEHH

SEQ ID NO: 2640101 - protein, 6 aa, Entamoeba histolytica
MKESDE

SEQ ID NO: 2640102 - protein, 9 aa, Entamoeba histolytica
MKESETNAV

SEQ ID NO: 2640103 - protein, 8 aa, Entamoeba histolytica
MKETKKNE

SEQ ID NO: 2640104 - protein, 6 aa, Entamoeba histolytica
MKETQS

SEQ ID NO: 2640105 - protein, 4 aa, Entamoeba histolytica
MKGD

SEQ ID NO: 2640106 - protein, 8 aa, Entamoeba histolytica
MKGDEECK

SEQ ID NO: 2640107 - protein, 6 aa, Entamoeba histolytica
MKGDFD

SEQ ID NO: 2640108 - protein, 11 aa, Entamoeba histolytica
MKGGKPIEDPK

SEQ ID NO: 2640109 - protein, 9 aa, Entamoeba histolytica
MKGKSETKK

SEQ ID NO: 2640110 - protein, 10 aa, Entamoeba histolytica
MKGRRPSMQD

SEQ ID NO: 2640111 - protein, 8 aa, Entamoeba histolytica
MKHPRKPT

SEQ ID NO: 2640112 - protein, 8 aa, Entamoeba histolytica
MKHRSKGR

SEQ ID NO: 2640113 - protein, 12 aa, Entamoeba histolytica
MKIDETQNRSFG

SEQ ID NO: 2640114 - protein, 9 aa, Entamoeba histolytica
MKKADKFKP

SEQ ID NO: 2640115 - protein, 10 aa, Entamoeba histolytica
MKKEDNHPVP

SEQ ID NO: 2640116 - protein, 8 aa, Entamoeba histolytica
MKKEERSK

SEQ ID NO: 2640117 - protein, 9 aa, Entamoeba histolytica
MKKEKDPNE

SEQ ID NO: 2640118 - protein, 5 aa, Entamoeba histolytica
MKKEL

SEQ ID NO: 2640119 - protein, 7 aa, Entamoeba histolytica
MKKEPNN

SEQ ID NO: 2640120 - protein, 11 aa, Entamoeba histolytica
MKKEQEKDDEF

SEQ ID NO: 2640121 - protein, 10 aa, Entamoeba histolytica
MKKERKRVYK

SEQ ID NO: 2640122 - protein, 10 aa, Entamoeba histolytica
MKKIGRRKEA

SEQ ID NO: 2640123 - protein, 5 aa, Entamoeba histolytica
MKKIK

SEQ ID NO: 2640124 - protein, 11 aa, Entamoeba histolytica
MKKITEEWSNE

SEQ ID NO: 2640125 - protein, 8 aa, Entamoeba histolytica
MKKNEKKI

SEQ ID NO: 2640126 - protein, 9 aa, Entamoeba histolytica
MKKNKDPNE

SEQ ID NO: 2640127 - protein, 14 aa, Entamoeba histolytica
MKKQEKPKSNGSTL

SEQ ID NO: 2640128 - protein, 10 aa, Entamoeba histolytica
MKKQKEDEYL

SEQ ID NO: 2640129 - protein, 9 aa, Entamoeba histolytica
MKKQTQEIE

SEQ ID NO: 2640130 - protein, 12 aa, Entamoeba histolytica
MKKRNKSRKIYD

SEQ ID NO: 2640131 - protein, 7 aa, Entamoeba histolytica
MKNEGIE

SEQ ID NO: 2640132 - protein, 17 aa, Entamoeba histolytica
MKNEITESSNQGEMSQN

SEQ ID NO: 2640133 - protein, 7 aa, Entamoeba histolytica
MKNERED

SEQ ID NO: 2640134 - protein, 19 aa, Entamoeba histolytica
MKNEVQENENNEESKEINI

SEQ ID NO: 2640135 - protein, 34 aa, Entamoeba histolytica
MKNPRNGKATDKSHPPIHPTRNANLNDLSEKERK

SEQ ID NO: 2640136 - protein, 12 aa, Entamoeba histolytica
MKNPSKEGKKLC

SEQ ID NO: 2640137 - protein, 7 aa, Entamoeba histolytica
MKNPSSY

SEQ ID NO: 2640138 - protein, 7 aa, Entamoeba histolytica
MKNQNLK

SEQ ID NO: 2640139 - protein, 4 aa, Entamoeba histolytica
MKNS

SEQ ID NO: 2640140 - protein, 8 aa, Entamoeba histolytica
MKPDSKIR

SEQ ID NO: 2640141 - protein, 9 aa, Entamoeba histolytica
MKPEDLTDE

SEQ ID NO: 2640142 - protein, 9 aa, Entamoeba histolytica
MKPETFESN

SEQ ID NO: 2640143 - protein, 6 aa, Entamoeba histolytica
MKPGET

SEQ ID NO: 2640144 - protein, 16 aa, Entamoeba histolytica
MKPNGRNISPKKEVPP

SEQ ID NO: 2640145 - protein, 6 aa, Entamoeba histolytica
MKPNTF

SEQ ID NO: 2640146 - protein, 8 aa, Entamoeba histolytica
MKPTTHSS

SEQ ID NO: 2640147 - protein, 7 aa, Entamoeba histolytica
MKQASDK

SEQ ID NO: 2640148 - protein, 30 aa, Entamoeba histolytica
MKQEERMSQVEKTYKRGLSKSNTTKPHSSH

SEQ ID NO: 2640149 - protein, 6 aa, Entamoeba histolytica
MKQENE

SEQ ID NO: 2640150 - protein, 9 aa, Entamoeba histolytica
MKQGKKPVL

SEQ ID NO: 2640151 - protein, 4 aa, Entamoeba histolytica
MKQP

SEQ ID NO: 2640152 - protein, 7 aa, Entamoeba histolytica
MKQSEME

SEQ ID NO: 2640153 - protein, 8 aa, Entamoeba histolytica
MKQSHDPA

SEQ ID NO: 2640154 - protein, 23 aa, Entamoeba histolytica
MKQTKSSKKEEKETQKNDEEHKS

SEQ ID NO: 2640155 - protein, 25 aa, Entamoeba histolytica
MKRDEEEREQREVRYKEKKQTEQKE

SEQ ID NO: 2640156 - protein, 29 aa, Entamoeba histolytica
MKRHTKKRSIFGRKDKEEKDKKEETKNEK

SEQ ID NO: 2640157 - protein, 14 aa, Entamoeba histolytica
MKRKDDDPSTYEYV

SEQ ID NO: 2640158 - protein, 7 aa, Entamoeba histolytica
MKRKRKV

SEQ ID NO: 2640159 - protein, 8 aa, Entamoeba histolytica
MKRQEEKI

SEQ ID NO: 2640160 - protein, 13 aa, Entamoeba histolytica
MKRRDEREERIDK

SEQ ID NO: 2640161 - protein, 7 aa, Entamoeba histolytica
MKRRKSI

SEQ ID NO: 2640162 - protein, 10 aa, Entamoeba histolytica
MKSEKGKIQR

SEQ ID NO: 2640163 - protein, 8 aa, Entamoeba histolytica
MKSEMEAK

SEQ ID NO: 2640164 - protein, 7 aa, Entamoeba histolytica
MKSGVTE

SEQ ID NO: 2640165 - protein, 10 aa, Entamoeba histolytica
MKSKKGKSFD

SEQ ID NO: 2640166 - protein, 4 aa, Entamoeba histolytica
MKSN

SEQ ID NO: 2640167 - protein, 6 aa, Entamoeba histolytica
MKSNPE

SEQ ID NO: 2640168 - protein, 15 aa, Entamoeba histolytica
MKSPDIVSKQNKADL

SEQ ID NO: 2640169 - protein, 7 aa, Entamoeba histolytica
MKSPSQL

SEQ ID NO: 2640170 - protein, 11 aa, Entamoeba histolytica
MKTAKKSNNIL

SEQ ID NO: 2640171 - protein, 11 aa, Entamoeba histolytica
MKTASTEQKLT

SEQ ID NO: 2640172 - protein, 4 aa, Entamoeba histolytica
MKTE

SEQ ID NO: 2640173 - protein, 9 aa, Entamoeba histolytica
MKTEAGRNG

SEQ ID NO: 2640174 - protein, 10 aa, Entamoeba histolytica
MKTESDPTKM

SEQ ID NO: 2640175 - protein, 7 aa, Entamoeba histolytica
MKTESGT

SEQ ID NO: 2640176 - protein, 6 aa, Entamoeba histolytica
MKTKPI

SEQ ID NO: 2640177 - protein, 6 aa, Entamoeba histolytica
MKTPEY

SEQ ID NO: 2640178 - protein, 13 aa, Entamoeba histolytica
MKTPSQTTDSSSI

SEQ ID NO: 2640179 - protein, 10 aa, Entamoeba histolytica
MKTRRGSAQP

SEQ ID NO: 2640180 - protein, 10 aa, Entamoeba histolytica
MLGEKKQENI

SEQ ID NO: 2640181 - protein, 8 aa, Entamoeba histolytica
MLKGGKRK

SEQ ID NO: 2640182 - protein, 16 aa, Entamoeba histolytica
MLSKDSTKKKRAHPGA

SEQ ID NO: 2640183 - protein, 17 aa, Entamoeba histolytica
MMPPPGAYPPPGYPPMQ

SEQ ID NO: 2640184 - protein, 5 aa, Entamoeba histolytica
MNAEN

SEQ ID NO: 2640185 - protein, 9 aa, Entamoeba histolytica
MNATGKYKE

SEQ ID NO: 2640186 - protein, 15 aa, Entamoeba histolytica
MNATNKKEVQPQQNI

SEQ ID NO: 2640187 - protein, 7 aa, Entamoeba histolytica
MNDEEVY

SEQ ID NO: 2640188 - protein, 10 aa, Entamoeba histolytica
MNDIGTPSKN

SEQ ID NO: 2640189 - protein, 37 aa, Entamoeba histolytica
MNDPDDGTPNSVSPFSNESFSDSEQSGGNKLKRSRNT

SEQ ID NO: 2640190 - protein, 37 aa, Entamoeba histolytica
MNDPDDGTPNSVSPFSNESFSDSEQSGGNKLSKGQEM

SEQ ID NO: 2640191 - protein, 4 aa, Entamoeba histolytica
MNEE

SEQ ID NO: 2640192 - protein, 5 aa, Entamoeba histolytica
MNEEE

SEQ ID NO: 2640193 - protein, 7 aa, Entamoeba histolytica
MNEEEEI

SEQ ID NO: 2640194 - protein, 15 aa, Entamoeba histolytica
MNEEKMRQESTYQQK

SEQ ID NO: 2640195 - protein, 6 aa, Entamoeba histolytica
MNEERR

SEQ ID NO: 2640196 - protein, 8 aa, Entamoeba histolytica
MNEETYQE

SEQ ID NO: 2640197 - protein, 9 aa, Entamoeba histolytica
MNEGNEEKI

SEQ ID NO: 2640198 - protein, 7 aa, Entamoeba histolytica
MNENPKQ

SEQ ID NO: 2640199 - protein, 7 aa, Entamoeba histolytica
MNETELT

SEQ ID NO: 2640200 - protein, 10 aa, Entamoeba histolytica
MNETQEKEKE

SEQ ID NO: 2640201 - protein, 9 aa, Entamoeba histolytica
MNETSEKIK

SEQ ID NO: 2640202 - protein, 4 aa, Entamoeba histolytica
MNGE

SEQ ID NO: 2640203 - protein, 8 aa, Entamoeba histolytica
MNGEPDER

SEQ ID NO: 2640204 - protein, 20 aa, Entamoeba histolytica
MNGNEKQEGGSDEDPIGTPN

SEQ ID NO: 2640205 - protein, 7 aa, Entamoeba histolytica
MNGQEVE

SEQ ID NO: 2640206 - protein, 7 aa, Entamoeba histolytica
MNKEDRR

SEQ ID NO: 2640207 - protein, 16 aa, Entamoeba histolytica
MNKEENRKYTRFLMTF

SEQ ID NO: 2640208 - protein, 10 aa, Entamoeba histolytica
MNKEKNQLEN

SEQ ID NO: 2640209 - protein, 11 aa, Entamoeba histolytica
MNKEKRPDINK

SEQ ID NO: 2640210 - protein, 29 aa, Entamoeba histolytica
MNKETEINNKTQQELNKIKEENNEYKNQI

SEQ ID NO: 2640211 - protein, 8 aa, Entamoeba histolytica
MNKGNSEK

SEQ ID NO: 2640212 - protein, 17 aa, Entamoeba histolytica
MNKNPPRSKSRTTNQKR

SEQ ID NO: 2640213 - protein, 17 aa, Entamoeba histolytica
MNKNQQQRSDLDCTDPN

SEQ ID NO: 2640214 - protein, 10 aa, Entamoeba histolytica
MNKQLSKEDI

SEQ ID NO: 2640215 - protein, 12 aa, Entamoeba histolytica
MNKRNKEKETNL

SEQ ID NO: 2640216 - protein, 9 aa, Entamoeba histolytica
MNNEPHENI

SEQ ID NO: 2640217 - protein, 23 aa, Entamoeba histolytica
MNNGCDASKISLNEKQPTKGREE

SEQ ID NO: 2640218 - protein, 7 aa, Entamoeba histolytica
MNNGETT

SEQ ID NO: 2640219 - protein, 5 aa, Entamoeba histolytica
MNNKG

SEQ ID NO: 2640220 - protein, 10 aa, Entamoeba histolytica
MNNPSNTPPV

SEQ ID NO: 2640221 - protein, 11 aa, Entamoeba histolytica
MNNSPLKPEPI

SEQ ID NO: 2640222 - protein, 19 aa, Entamoeba histolytica
MNPEITVGDKEEQVDDEDW

SEQ ID NO: 2640223 - protein, 11 aa, Entamoeba histolytica
MNPSTNKDSPF

SEQ ID NO: 2640224 - protein, 9 aa, Entamoeba histolytica
MNPTTNPES

SEQ ID NO: 2640225 - protein, 11 aa, Entamoeba histolytica
MNQDNNRFPTF

SEQ ID NO: 2640226 - protein, 5 aa, Entamoeba histolytica
MNQPH

SEQ ID NO: 2640227 - protein, 9 aa, Entamoeba histolytica
MNQQNIQGL

SEQ ID NO: 2640228 - protein, 5 aa, Entamoeba histolytica
MNQSL

SEQ ID NO: 2640229 - protein, 15 aa, Entamoeba histolytica
MNQTKPKKKSGGCSL

SEQ ID NO: 2640230 - protein, 11 aa, Entamoeba histolytica
MNRAPGPTDRW

SEQ ID NO: 2640231 - protein, 9 aa, Entamoeba histolytica
MNRNESMGI

SEQ ID NO: 2640232 - protein, 54 aa, Entamoeba histolytica
MNRQPKPGNKQPRNVSASQNAKKKSKVDNNIKKQPKSIEKAPTVTEEMKNNLGD

SEQ ID NO: 2640233 - protein, 10 aa, Entamoeba histolytica
MNSDQSVKKS

SEQ ID NO: 2640234 - protein, 6 aa, Entamoeba histolytica
MNSERT

SEQ ID NO: 2640235 - protein, 5 aa, Entamoeba histolytica
MNSGD

SEQ ID NO: 2640236 - protein, 18 aa, Entamoeba histolytica
MNSGEKPRVVGHKSSDVN

SEQ ID NO: 2640237 - protein, 8 aa, Entamoeba histolytica
MNSKGENE

SEQ ID NO: 2640238 - protein, 10 aa, Entamoeba histolytica
MNTNTSSSEI

SEQ ID NO: 2640239 - protein, 11 aa, Entamoeba histolytica
MNTPPDVTDSP

SEQ ID NO: 2640240 - protein, 18 aa, Entamoeba histolytica
MNVNEDPIEENEEEENEL

SEQ ID NO: 2640241 - protein, 24 aa, Entamoeba histolytica
MNVNEDSIKEGEEENNNDNDNSTN

SEQ ID NO: 2640242 - protein, 7 aa, Entamoeba histolytica
MPAPKQV

SEQ ID NO: 2640243 - protein, 11 aa, Entamoeba histolytica
MPESAPTGQMP

SEQ ID NO: 2640244 - protein, 14 aa, Entamoeba histolytica
MPGMAPSVQPQTAM

SEQ ID NO: 2640245 - protein, 15 aa, Entamoeba histolytica
MPGTESLKKQQYYGH

SEQ ID NO: 2640246 - protein, 6 aa, Entamoeba histolytica
MPKAVD

SEQ ID NO: 2640247 - protein, 10 aa, Entamoeba histolytica
MPKDTYKEGV

SEQ ID NO: 2640248 - protein, 4 aa, Entamoeba histolytica
MPKE

SEQ ID NO: 2640249 - protein, 15 aa, Entamoeba histolytica
MPKENNKMDHTSEMV

SEQ ID NO: 2640250 - protein, 13 aa, Entamoeba histolytica
MPKKRDDIARPAV

SEQ ID NO: 2640251 - protein, 4 aa, Entamoeba histolytica
MPKN

SEQ ID NO: 2640252 - protein, 6 aa, Entamoeba histolytica
MPKSSI

SEQ ID NO: 2640253 - protein, 7 aa, Entamoeba histolytica
MPNDPKN

SEQ ID NO: 2640254 - protein, 6 aa, Entamoeba histolytica
MPNDSD

SEQ ID NO: 2640255 - protein, 5 aa, Entamoeba histolytica
MPNMG

SEQ ID NO: 2640256 - protein, 6 aa, Entamoeba histolytica
MPNPSS

SEQ ID NO: 2640257 - protein, 6 aa, Entamoeba histolytica
MPNSPI

SEQ ID NO: 2640258 - protein, 10 aa, Entamoeba histolytica
MPNTYSPKYV

SEQ ID NO: 2640259 - protein, 5 aa, Entamoeba histolytica
MPPED

SEQ ID NO: 2640260 - protein, 5 aa, Entamoeba histolytica
MPPEE

SEQ ID NO: 2640261 - protein, 7 aa, Entamoeba histolytica
MPPNPKV

SEQ ID NO: 2640262 - protein, 25 aa, Entamoeba histolytica
MPPPGAYPPPGYPPMQPGMMPPPGF

SEQ ID NO: 2640263 - protein, 10 aa, Entamoeba histolytica
MPPPGYPPMQ

SEQ ID NO: 2640264 - protein, 28 aa, Entamoeba histolytica
MPPPPPSNNLPPPGPANVPPPSSAGRGD

SEQ ID NO: 2640265 - protein, 10 aa, Entamoeba histolytica
MPPTSQNSDL

SEQ ID NO: 2640266 - protein, 10 aa, Entamoeba histolytica
MPQGKGQPTI

SEQ ID NO: 2640267 - protein, 4 aa, Entamoeba histolytica
MPQL

SEQ ID NO: 2640268 - protein, 8 aa, Entamoeba histolytica
MPQNDSKI

SEQ ID NO: 2640269 - protein, 15 aa, Entamoeba histolytica
MPQNSYKREQSERYL

SEQ ID NO: 2640270 - protein, 19 aa, Entamoeba histolytica
MPRPRSRESVSQRERSESR

SEQ ID NO: 2640271 - protein, 8 aa, Entamoeba histolytica
MPRTNGGT

SEQ ID NO: 2640272 - protein, 15 aa, Entamoeba histolytica
MPSDQDNVDVGNFEP

SEQ ID NO: 2640273 - protein, 46 aa, Entamoeba histolytica
MPSPNDTPTYPPFPSQNNNQGMNEDATPGANETNVGNHESPNPSPN

SEQ ID NO: 2640274 - protein, 5 aa, Entamoeba histolytica
MPSTL

SEQ ID NO: 2640275 - protein, 5 aa, Entamoeba histolytica
MPTED

SEQ ID NO: 2640276 - protein, 15 aa, Entamoeba histolytica
MPTIPQNNNMPAIPQ

SEQ ID NO: 2640277 - protein, 7 aa, Entamoeba histolytica
MPVPSNN

SEQ ID NO: 2640278 - protein, 10 aa, Entamoeba histolytica
MQAQPGQNPP

SEQ ID NO: 2640279 - protein, 16 aa, Entamoeba histolytica
MQDATEGKNKNSFKLP

SEQ ID NO: 2640280 - protein, 45 aa, Entamoeba histolytica
MQEEEEIKKEEAIEKRTTESMQEEEIKKKEEELKKKERNEHRNYP

SEQ ID NO: 2640281 - protein, 26 aa, Entamoeba histolytica
MQEEEIKKKEEEELKKKERNEHRNYP

SEQ ID NO: 2640282 - protein, 8 aa, Entamoeba histolytica
MQGMQGKQ

SEQ ID NO: 2640283 - protein, 6 aa, Entamoeba histolytica
MQKDAR

SEQ ID NO: 2640284 - protein, 8 aa, Entamoeba histolytica
MQKSGSFK

SEQ ID NO: 2640285 - protein, 17 aa, Entamoeba histolytica
MQKSSTVTKETEDKDPL

SEQ ID NO: 2640286 - protein, 14 aa, Entamoeba histolytica
MQNENKENEQEISN

SEQ ID NO: 2640287 - protein, 18 aa, Entamoeba histolytica
MQNSTKDDKKDKKRLKKQ

SEQ ID NO: 2640288 - protein, 5 aa, Entamoeba histolytica
MQNTE

SEQ ID NO: 2640289 - protein, 9 aa, Entamoeba histolytica
MQPNNNPII

SEQ ID NO: 2640290 - protein, 7 aa, Entamoeba histolytica
MQPSEIN

SEQ ID NO: 2640291 - protein, 9 aa, Entamoeba histolytica
MQPSQPKQS

SEQ ID NO: 2640292 - protein, 10 aa, Entamoeba histolytica
MQQPGMPPMG

SEQ ID NO: 2640293 - protein, 8 aa, Entamoeba histolytica
MQQPTQPM

SEQ ID NO: 2640294 - protein, 30 aa, Entamoeba histolytica
MQQQNQQKIQKSTTDNTISSTNQLKQTSAT

SEQ ID NO: 2640295 - protein, 9 aa, Entamoeba histolytica
MQSAPNVSE

SEQ ID NO: 2640296 - protein, 4 aa, Entamoeba histolytica
MQYT

SEQ ID NO: 2640297 - protein, 5 aa, Entamoeba histolytica
MRDED

SEQ ID NO: 2640298 - protein, 8 aa, Entamoeba histolytica
MRDEVKNS

SEQ ID NO: 2640299 - protein, 17 aa, Entamoeba histolytica
MREKEEKQRKKQELEEK

SEQ ID NO: 2640300 - protein, 9 aa, Entamoeba histolytica
MREKIRPKN

SEQ ID NO: 2640301 - protein, 9 aa, Entamoeba histolytica
MRENAKNVD

SEQ ID NO: 2640302 - protein, 9 aa, Entamoeba histolytica
MRENGKNIG

SEQ ID NO: 2640303 - protein, 11 aa, Entamoeba histolytica
MRGESSNSIVQ

SEQ ID NO: 2640304 - protein, 6 aa, Entamoeba histolytica
MRGGEK

SEQ ID NO: 2640305 - protein, 13 aa, Entamoeba histolytica
MRIPKDKNSLGDD

SEQ ID NO: 2640306 - protein, 16 aa, Entamoeba histolytica
MRKKDLNGIGISPDWK

SEQ ID NO: 2640307 - protein, 4 aa, Entamoeba histolytica
MRKN

SEQ ID NO: 2640308 - protein, 4 aa, Entamoeba histolytica
MRKP

SEQ ID NO: 2640309 - protein, 8 aa, Entamoeba histolytica
MRNEETKR

SEQ ID NO: 2640310 - protein, 6 aa, Entamoeba histolytica
MRNEKT

SEQ ID NO: 2640311 - protein, 21 aa, Entamoeba histolytica
MRNEQRKKEQLERKKAEFEEM

SEQ ID NO: 2640312 - protein, 8 aa, Entamoeba histolytica
MRNPDPDL

SEQ ID NO: 2640313 - protein, 5 aa, Entamoeba histolytica
MRNRE

SEQ ID NO: 2640314 - protein, 8 aa, Entamoeba histolytica
MRNTSISE

SEQ ID NO: 2640315 - protein, 6 aa, Entamoeba histolytica
MRPADF

SEQ ID NO: 2640316 - protein, 5 aa, Entamoeba histolytica
MRPDQ

SEQ ID NO: 2640317 - protein, 7 aa, Entamoeba histolytica
MRSSKRV

SEQ ID NO: 2640318 - protein, 7 aa, Entamoeba histolytica
MRSSNAE

SEQ ID NO: 2640319 - protein, 5 aa, Entamoeba histolytica
MRSTD

SEQ ID NO: 2640320 - protein, 19 aa, Entamoeba histolytica
MRTQADGEAVPSDKAEMQE

SEQ ID NO: 2640321 - protein, 15 aa, Entamoeba histolytica
MSDAYEKKLSTMKFS

SEQ ID NO: 2640322 - protein, 5 aa, Entamoeba histolytica
MSDGV

SEQ ID NO: 2640323 - protein, 15 aa, Entamoeba histolytica
MSDKQYNRSKEAQIN

SEQ ID NO: 2640324 - protein, 7 aa, Entamoeba histolytica
MSDPGGG

SEQ ID NO: 2640325 - protein, 7 aa, Entamoeba histolytica
MSDPTRF

SEQ ID NO: 2640326 - protein, 6 aa, Entamoeba histolytica
MSDQGN

SEQ ID NO: 2640327 - protein, 66 aa, Entamoeba histolytica
MSDSSTGTYFNNNKEQHTYQTKDKESSSTSSSSSNSNEKEEKGTDKENKEETSESQRDVEVYEISD

SEQ ID NO: 2640328 - protein, 9 aa, Entamoeba histolytica
MSDTQAGIE

SEQ ID NO: 2640329 - protein, 18 aa, Entamoeba histolytica
MSDTSNVKQDTLEQILAE

SEQ ID NO: 2640330 - protein, 5 aa, Entamoeba histolytica
MSEDG

SEQ ID NO: 2640331 - protein, 4 aa, Entamoeba histolytica
MSEE

SEQ ID NO: 2640332 - protein, 13 aa, Entamoeba histolytica
MSEEEEECSVSDK

SEQ ID NO: 2640333 - protein, 23 aa, Entamoeba histolytica
MSEEEKMKEEKEIQYSNTPINQE

SEQ ID NO: 2640334 - protein, 6 aa, Entamoeba histolytica
MSEEGI

SEQ ID NO: 2640335 - protein, 12 aa, Entamoeba histolytica
MSEENKNEEEDI

SEQ ID NO: 2640336 - protein, 17 aa, Entamoeba histolytica
MSEGKQPNDRTTNESIN

SEQ ID NO: 2640337 - protein, 33 aa, Entamoeba histolytica
MSEKKKQEAIKESGISKEKEEIATKKTEEVQKK

SEQ ID NO: 2640338 - protein, 17 aa, Entamoeba histolytica
MSENAKKFAEKRSPGSY

SEQ ID NO: 2640339 - protein, 16 aa, Entamoeba histolytica
MSENSSRSKNSAPASD

SEQ ID NO: 2640340 - protein, 4 aa, Entamoeba histolytica
MSES

SEQ ID NO: 2640341 - protein, 32 aa, Entamoeba histolytica
MSETSPNECSSGWSSSYSSNQSSPKPPQESSF

SEQ ID NO: 2640342 - protein, 7 aa, Entamoeba histolytica
MSGEDPL

SEQ ID NO: 2640343 - protein, 7 aa, Entamoeba histolytica
MSGETFG

SEQ ID NO: 2640344 - protein, 8 aa, Entamoeba histolytica
MSGQGSMS

SEQ ID NO: 2640345 - protein, 7 aa, Entamoeba histolytica
MSGSSPI

SEQ ID NO: 2640346 - protein, 5 aa, Entamoeba histolytica
MSGTT

SEQ ID NO: 2640347 - protein, 7 aa, Entamoeba histolytica
MSHDEDQ

SEQ ID NO: 2640348 - protein, 6 aa, Entamoeba histolytica
MSHDQK

SEQ ID NO: 2640349 - protein, 12 aa, Entamoeba histolytica
MSIEDEESNDER

SEQ ID NO: 2640350 - protein, 7 aa, Entamoeba histolytica
MSKDEQK

SEQ ID NO: 2640351 - protein, 9 aa, Entamoeba histolytica
MSKEERKVK

SEQ ID NO: 2640352 - protein, 9 aa, Entamoeba histolytica
MSKRSKRGF

SEQ ID NO: 2640353 - protein, 30 aa, Entamoeba histolytica
MSKSHKKKEKEVNDQLPSKAKERVSRSSIY

SEQ ID NO: 2640354 - protein, 8 aa, Entamoeba histolytica
MSKYSDSS

SEQ ID NO: 2640355 - protein, 10 aa, Entamoeba histolytica
MSMTKNENDY

SEQ ID NO: 2640356 - protein, 6 aa, Entamoeba histolytica
MSNATK

SEQ ID NO: 2640357 - protein, 4 aa, Entamoeba histolytica
MSNE

SEQ ID NO: 2640358 - protein, 9 aa, Entamoeba histolytica
MSNEELEEI

SEQ ID NO: 2640359 - protein, 6 aa, Entamoeba histolytica
MSNEKS

SEQ ID NO: 2640360 - protein, 5 aa, Entamoeba histolytica
MSNEQ

SEQ ID NO: 2640361 - protein, 15 aa, Entamoeba histolytica
MSNERTKKYLKDESF

SEQ ID NO: 2640362 - protein, 11 aa, Entamoeba histolytica
MSNGGPAPIEV

SEQ ID NO: 2640363 - protein, 5 aa, Entamoeba histolytica
MSNIG

SEQ ID NO: 2640364 - protein, 64 aa, Entamoeba histolytica
MSNPYGIDNPYATVTTPTESSPYSGDSTNNTKNYSQPYSSTNQADPFQQINSSTKEDTNNDDGI

SEQ ID NO: 2640365 - protein, 4 aa, Entamoeba histolytica
MSNS

SEQ ID NO: 2640366 - protein, 14 aa, Entamoeba histolytica
MSNTNPKSSSETEK

SEQ ID NO: 2640367 - protein, 11 aa, Entamoeba histolytica
MSPAAIERRER

SEQ ID NO: 2640368 - protein, 14 aa, Entamoeba histolytica
MSPLNSPKTYDKAG

SEQ ID NO: 2640369 - protein, 5 aa, Entamoeba histolytica
MSQAD

SEQ ID NO: 2640370 - protein, 6 aa, Entamoeba histolytica
MSQDKE

SEQ ID NO: 2640371 - protein, 53 aa, Entamoeba histolytica
MSQNVSKSTEPAKTNTTVKGIQKQSNIPVKETESSTVQETIKSPKTQQPNIEK

SEQ ID NO: 2640372 - protein, 23 aa, Entamoeba histolytica
MSQPKKPEEEILQNESRKMEEEN

SEQ ID NO: 2640373 - protein, 5 aa, Entamoeba histolytica
MSQQK

SEQ ID NO: 2640374 - protein, 4 aa, Entamoeba histolytica
MSQR

SEQ ID NO: 2640375 - protein, 5 aa, Entamoeba histolytica
MSQRG

SEQ ID NO: 2640376 - protein, 12 aa, Entamoeba histolytica
MSQSPSETTRLN

SEQ ID NO: 2640377 - protein, 6 aa, Entamoeba histolytica
MSQSSY

SEQ ID NO: 2640378 - protein, 11 aa, Entamoeba histolytica
MSRDPKEYETE

SEQ ID NO: 2640379 - protein, 12 aa, Entamoeba histolytica
MSRDQMGEKYDG

SEQ ID NO: 2640380 - protein, 5 aa, Entamoeba histolytica
MSSDD

SEQ ID NO: 2640381 - protein, 9 aa, Entamoeba histolytica
MSSDNQLRG

SEQ ID NO: 2640382 - protein, 4 aa, Entamoeba histolytica
MSSF

SEQ ID NO: 2640383 - protein, 11 aa, Entamoeba histolytica
MSSISSEKSHE

SEQ ID NO: 2640384 - protein, 16 aa, Entamoeba histolytica
MSSNHDSDSNSNSNTN

SEQ ID NO: 2640385 - protein, 19 aa, Entamoeba histolytica
MSSNKVKKDHQRKTSSFGK

SEQ ID NO: 2640386 - protein, 4 aa, Entamoeba histolytica
MSSR

SEQ ID NO: 2640387 - protein, 10 aa, Entamoeba histolytica
MSSSQNENKC

SEQ ID NO: 2640388 - protein, 5 aa, Entamoeba histolytica
MSSTQ

SEQ ID NO: 2640389 - protein, 4 aa, Entamoeba histolytica
MSSV

SEQ ID NO: 2640390 - protein, 15 aa, Entamoeba histolytica
MSTKEVEKGYTKHEG

SEQ ID NO: 2640391 - protein, 10 aa, Entamoeba histolytica
MSTNGLGGIG

SEQ ID NO: 2640392 - protein, 7 aa, Entamoeba histolytica
MSTPETA

SEQ ID NO: 2640393 - protein, 8 aa, Entamoeba histolytica
MSTQSQQA

SEQ ID NO: 2640394 - protein, 9 aa, Entamoeba histolytica
MSTRNPSEL

SEQ ID NO: 2640395 - protein, 10 aa, Entamoeba histolytica
MSTSGLGGIG

SEQ ID NO: 2640396 - protein, 10 aa, Entamoeba histolytica
MSTSSTILQS

SEQ ID NO: 2640397 - protein, 4 aa, Entamoeba histolytica
MSTT

SEQ ID NO: 2640398 - protein, 15 aa, Entamoeba histolytica
MSTTAGIPDFRSPRT

SEQ ID NO: 2640399 - protein, 24 aa, Entamoeba histolytica
MSVQNNNSIQIEKEQQDLIDSQKK

SEQ ID NO: 2640400 - protein, 5 aa, Entamoeba histolytica
MSYEE

SEQ ID NO: 2640401 - protein, 5 aa, Entamoeba histolytica
MSYPD

SEQ ID NO: 2640402 - protein, 4 aa, Entamoeba histolytica
MTDE

SEQ ID NO: 2640403 - protein, 14 aa, Entamoeba histolytica
MTDPDMAMAMVMSL

SEQ ID NO: 2640404 - protein, 10 aa, Entamoeba histolytica
MTEDENEDLE

SEQ ID NO: 2640405 - protein, 20 aa, Entamoeba histolytica
MTEEQKVVDGQKSGDDKDEY

SEQ ID NO: 2640406 - protein, 6 aa, Entamoeba histolytica
MTEPEA

SEQ ID NO: 2640407 - protein, 4 aa, Entamoeba histolytica
MTEQ

SEQ ID NO: 2640408 - protein, 6 aa, Entamoeba histolytica
MTESNF

SEQ ID NO: 2640409 - protein, 5 aa, Entamoeba histolytica
MTETS

SEQ ID NO: 2640410 - protein, 11 aa, Entamoeba histolytica
MTFGSDKDKIQ

SEQ ID NO: 2640411 - protein, 5 aa, Entamoeba histolytica
MTGDA

SEQ ID NO: 2640412 - protein, 14 aa, Entamoeba histolytica
MTGDKEIKKQQQKL

SEQ ID NO: 2640413 - protein, 4 aa, Entamoeba histolytica
MTGE

SEQ ID NO: 2640414 - protein, 10 aa, Entamoeba histolytica
MTGESNKNFK

SEQ ID NO: 2640415 - protein, 9 aa, Entamoeba histolytica
MTGSHDRTL

SEQ ID NO: 2640416 - protein, 15 aa, Entamoeba histolytica
MTIDDSDKEEQPLTE

SEQ ID NO: 2640417 - protein, 7 aa, Entamoeba histolytica
MTKDGNT

SEQ ID NO: 2640418 - protein, 10 aa, Entamoeba histolytica
MTKKSKTEEV

SEQ ID NO: 2640419 - protein, 9 aa, Entamoeba histolytica
MTKPTKEIA

SEQ ID NO: 2640420 - protein, 5 aa, Entamoeba histolytica
MTNDE

SEQ ID NO: 2640421 - protein, 9 aa, Entamoeba histolytica
MTNESEEYS

SEQ ID NO: 2640422 - protein, 5 aa, Entamoeba histolytica
MTNNP

SEQ ID NO: 2640423 - protein, 35 aa, Entamoeba histolytica
MTNTATGIGNNGGLGSGLGTPFGNGFGNNSNGGFN

SEQ ID NO: 2640424 - protein, 8 aa, Entamoeba histolytica
MTNVPPRY

SEQ ID NO: 2640425 - protein, 5 aa, Entamoeba histolytica
MTPEE

SEQ ID NO: 2640426 - protein, 10 aa, Entamoeba histolytica
MTPEERAQQV

SEQ ID NO: 2640427 - protein, 7 aa, Entamoeba histolytica
MTPEESR

SEQ ID NO: 2640428 - protein, 5 aa, Entamoeba histolytica
MTPEG

SEQ ID NO: 2640429 - protein, 5 aa, Entamoeba histolytica
MTPEP

SEQ ID NO: 2640430 - protein, 8 aa, Entamoeba histolytica
MTPSKTIT

SEQ ID NO: 2640431 - protein, 7 aa, Entamoeba histolytica
MTPTESK

SEQ ID NO: 2640432 - protein, 13 aa, Entamoeba histolytica
MTQPQSKNAMEVE

SEQ ID NO: 2640433 - protein, 5 aa, Entamoeba histolytica
MTRPE

SEQ ID NO: 2640434 - protein, 9 aa, Entamoeba histolytica
MTSKPEESL

SEQ ID NO: 2640435 - protein, 7 aa, Entamoeba histolytica
MTSKSDL

SEQ ID NO: 2640436 - protein, 7 aa, Entamoeba histolytica
MTSNSES

SEQ ID NO: 2640437 - protein, 7 aa, Entamoeba histolytica
MTSPNMK

SEQ ID NO: 2640438 - protein, 7 aa, Entamoeba histolytica
MTSQSNQ

SEQ ID NO: 2640439 - protein, 6 aa, Entamoeba histolytica
MTSSAV

SEQ ID NO: 2640440 - protein, 6 aa, Entamoeba histolytica
MTSSSG

SEQ ID NO: 2640441 - protein, 8 aa, Entamoeba histolytica
MTSTPSPL

SEQ ID NO: 2640442 - protein, 7 aa, Entamoeba histolytica
MTSTQST

SEQ ID NO: 2640443 - protein, 4 aa, Entamoeba histolytica
MTTA

SEQ ID NO: 2640444 - protein, 5 aa, Entamoeba histolytica
MTTER

SEQ ID NO: 2640445 - protein, 6 aa, Entamoeba histolytica
MTTPKG

SEQ ID NO: 2640446 - protein, 5 aa, Entamoeba histolytica
MTTSD

SEQ ID NO: 2640447 - protein, 9 aa, Entamoeba histolytica
MTTSPLSGT

SEQ ID NO: 2640448 - protein, 14 aa, Entamoeba histolytica
MTTSPSWNSFVHPS

SEQ ID NO: 2640449 - protein, 4 aa, Entamoeba histolytica
MTVN

SEQ ID NO: 2640450 - protein, 10 aa, Entamoeba histolytica
MVKTKQEKHP

SEQ ID NO: 2640451 - protein, 14 aa, Entamoeba histolytica
MVRGDDGKILPSGY

SEQ ID NO: 2640452 - protein, 12 aa, Entamoeba histolytica
MYPPNSPEMTTS

SEQ ID NO: 2640453 - protein, 4 aa, Entamoeba histolytica
MYPS

SEQ ID NO: 2640454 - protein, 10 aa, Entamoeba histolytica
MYPSQYDKIP

SEQ ID NO: 2640455 - protein, 5 aa, Entamoeba histolytica
MYQRT

SEQ ID NO: 2640456 - protein, 17 aa, Entamoeba histolytica
NAAAPPPEKKDRKKCVL

SEQ ID NO: 2640457 - protein, 28 aa, Entamoeba histolytica
NAAATLKKGSASVTSRSGNSGTNAKKAS

SEQ ID NO: 2640458 - protein, 6 aa, Entamoeba histolytica
NAAEHY

SEQ ID NO: 2640459 - protein, 7 aa, Entamoeba histolytica
NAAKAAV

SEQ ID NO: 2640460 - protein, 9 aa, Entamoeba histolytica
NAAKDSISE

SEQ ID NO: 2640461 - protein, 4 aa, Entamoeba histolytica
NAAN

SEQ ID NO: 2640462 - protein, 13 aa, Entamoeba histolytica
NAANTRKSVEQSS

SEQ ID NO: 2640463 - protein, 7 aa, Entamoeba histolytica
NAAPGDI

SEQ ID NO: 2640464 - protein, 9 aa, Entamoeba histolytica
NAAQDERSR

SEQ ID NO: 2640465 - protein, 9 aa, Entamoeba histolytica
NAARNNTQQ

SEQ ID NO: 2640466 - protein, 4 aa, Entamoeba histolytica
NAAT

SEQ ID NO: 2640467 - protein, 10 aa, Entamoeba histolytica
NAATNRQSTA

SEQ ID NO: 2640468 - protein, 15 aa, Entamoeba histolytica
NADAELEQQAASEEL

SEQ ID NO: 2640469 - protein, 7 aa, Entamoeba histolytica
NADDGNY

SEQ ID NO: 2640470 - protein, 9 aa, Entamoeba histolytica
NADDLDTTH

SEQ ID NO: 2640471 - protein, 7 aa, Entamoeba histolytica
NADEGIS

SEQ ID NO: 2640472 - protein, 5 aa, Entamoeba histolytica
NADEY

SEQ ID NO: 2640473 - protein, 4 aa, Entamoeba histolytica
NADG

SEQ ID NO: 2640474 - protein, 25 aa, Entamoeba histolytica
NADGENERKILGTDKVDGLNEDNER

SEQ ID NO: 2640475 - protein, 7 aa, Entamoeba histolytica
NADGKKK

SEQ ID NO: 2640476 - protein, 23 aa, Entamoeba histolytica
NADIQDSYTDATTTNLTQQAGHN

SEQ ID NO: 2640477 - protein, 18 aa, Entamoeba histolytica
NADIQDSYTDATTTSEGL

SEQ ID NO: 2640478 - protein, 11 aa, Entamoeba histolytica
NADKYAISDSY

SEQ ID NO: 2640479 - protein, 6 aa, Entamoeba histolytica
NADPTN

SEQ ID NO: 2640480 - protein, 5 aa, Entamoeba histolytica
NADRY

SEQ ID NO: 2640481 - protein, 14 aa, Entamoeba histolytica
NADSESEDAKWKPE

SEQ ID NO: 2640482 - protein, 6 aa, Entamoeba histolytica
NADSGE

SEQ ID NO: 2640483 - protein, 6 aa, Entamoeba histolytica
NADSIQ

SEQ ID NO: 2640484 - protein, 5 aa, Entamoeba histolytica
NADTQ

SEQ ID NO: 2640485 - protein, 13 aa, Entamoeba histolytica
NADTTLVDSNGQN

SEQ ID NO: 2640486 - protein, 9 aa, Entamoeba histolytica
NAEDGKKII

SEQ ID NO: 2640487 - protein, 7 aa, Entamoeba histolytica
NAEDIST

SEQ ID NO: 2640488 - protein, 10 aa, Entamoeba histolytica
NAEEDKEKKE

SEQ ID NO: 2640489 - protein, 40 aa, Entamoeba histolytica
NAEEEEKRRIEEEEAQQFKYKTKTNELAIDEDKEEEEYRE

SEQ ID NO: 2640490 - protein, 28 aa, Entamoeba histolytica
NAEEIEEEKQEKQETKEVKEEEKTQREI

SEQ ID NO: 2640491 - protein, 11 aa, Entamoeba histolytica
NAEGKRTTPSY

SEQ ID NO: 2640492 - protein, 7 aa, Entamoeba histolytica
NAEHSGV

SEQ ID NO: 2640493 - protein, 6 aa, Entamoeba histolytica
NAEING

SEQ ID NO: 2640494 - protein, 14 aa, Entamoeba histolytica
NAEKVQRLTAKRQA

SEQ ID NO: 2640495 - protein, 6 aa, Entamoeba histolytica
NAEMEQ

SEQ ID NO: 2640496 - protein, 5 aa, Entamoeba histolytica
NAEPE

SEQ ID NO: 2640497 - protein, 15 aa, Entamoeba histolytica
NAESDIEKGKANNLI

SEQ ID NO: 2640498 - protein, 8 aa, Entamoeba histolytica
NAEYNPKR

SEQ ID NO: 2640499 - protein, 6 aa, Entamoeba histolytica
NAFPNE

SEQ ID NO: 2640500 - protein, 6 aa, Entamoeba histolytica
NAFPTE

SEQ ID NO: 2640501 - protein, 4 aa, Entamoeba histolytica
NAFS

SEQ ID NO: 2640502 - protein, 8 aa, Entamoeba histolytica
NAFSNTPL

SEQ ID NO: 2640503 - protein, 13 aa, Entamoeba histolytica
NAGGKYSMSLQRS

SEQ ID NO: 2640504 - protein, 9 aa, Entamoeba histolytica
NAGISAEDF

SEQ ID NO: 2640505 - protein, 5 aa, Entamoeba histolytica
NAGKD

SEQ ID NO: 2640506 - protein, 10 aa, Entamoeba histolytica
NAGKKITGIG

SEQ ID NO: 2640507 - protein, 10 aa, Entamoeba histolytica
NAGKRGMANA

SEQ ID NO: 2640508 - protein, 7 aa, Entamoeba histolytica
NAGLESS

SEQ ID NO: 2640509 - protein, 9 aa, Entamoeba histolytica
NAGPNTNGS

SEQ ID NO: 2640510 - protein, 7 aa, Entamoeba histolytica
NAGPQID

SEQ ID NO: 2640511 - protein, 5 aa, Entamoeba histolytica
NAGQI

SEQ ID NO: 2640512 - protein, 8 aa, Entamoeba histolytica
NAGSQESL

SEQ ID NO: 2640513 - protein, 7 aa, Entamoeba histolytica
NAGYDSA

SEQ ID NO: 2640514 - protein, 7 aa, Entamoeba histolytica
NAHDKNE

SEQ ID NO: 2640515 - protein, 4 aa, Entamoeba histolytica
NAHE

SEQ ID NO: 2640516 - protein, 23 aa, Entamoeba histolytica
NAHNLSKSIRDSTIQNLNDDEDV

SEQ ID NO: 2640517 - protein, 13 aa, Entamoeba histolytica
NAIAQSKSSQSLV

SEQ ID NO: 2640518 - protein, 10 aa, Entamoeba histolytica
NAIERENGRD

SEQ ID NO: 2640519 - protein, 10 aa, Entamoeba histolytica
NAIKEERDEL

SEQ ID NO: 2640520 - protein, 6 aa, Entamoeba histolytica
NAIKNN

SEQ ID NO: 2640521 - protein, 11 aa, Entamoeba histolytica
NAIKNPPQSAM

SEQ ID NO: 2640522 - protein, 8 aa, Entamoeba histolytica
NAINGNHQ

SEQ ID NO: 2640523 - protein, 5 aa, Entamoeba histolytica
NAINQ

SEQ ID NO: 2640524 - protein, 14 aa, Entamoeba histolytica
NAISDEITNNLQGD

SEQ ID NO: 2640525 - protein, 7 aa, Entamoeba histolytica
NAISKEA

SEQ ID NO: 2640526 - protein, 4 aa, Entamoeba histolytica
NAIT

SEQ ID NO: 2640527 - protein, 8 aa, Entamoeba histolytica
NAITPGTE

SEQ ID NO: 2640528 - protein, 4 aa, Entamoeba histolytica
NAIY

SEQ ID NO: 2640529 - protein, 9 aa, Entamoeba histolytica
NAKDEGKKL

SEQ ID NO: 2640530 - protein, 7 aa, Entamoeba histolytica
NAKDIDR

SEQ ID NO: 2640531 - protein, 12 aa, Entamoeba histolytica
NAKEKNIGKELI

SEQ ID NO: 2640532 - protein, 13 aa, Entamoeba histolytica
NAKEPRQIFIPVF

SEQ ID NO: 2640533 - protein, 4 aa, Entamoeba histolytica
NAKG

SEQ ID NO: 2640534 - protein, 7 aa, Entamoeba histolytica
NAKIENL

SEQ ID NO: 2640535 - protein, 5 aa, Entamoeba histolytica
NAKPE

SEQ ID NO: 2640536 - protein, 6 aa, Entamoeba histolytica
NAKQAT

SEQ ID NO: 2640537 - protein, 8 aa, Entamoeba histolytica
NAKQVERK

SEQ ID NO: 2640538 - protein, 10 aa, Entamoeba histolytica
NAKRKKYRYY

SEQ ID NO: 2640539 - protein, 8 aa, Entamoeba histolytica
NAKRTDDK

SEQ ID NO: 2640540 - protein, 8 aa, Entamoeba histolytica
NAKSGLTS

SEQ ID NO: 2640541 - protein, 9 aa, Entamoeba histolytica
NAKSKDIKT

SEQ ID NO: 2640542 - protein, 11 aa, Entamoeba histolytica
NAKSKGDNREF

SEQ ID NO: 2640543 - protein, 26 aa, Entamoeba histolytica
NAKSKGGSKEFNIENEYKQAKEVGRK

SEQ ID NO: 2640544 - protein, 8 aa, Entamoeba histolytica
NAKTETAK

SEQ ID NO: 2640545 - protein, 23 aa, Entamoeba histolytica
NAKTKKELYGDEAKQALSKKGVT

SEQ ID NO: 2640546 - protein, 12 aa, Entamoeba histolytica
NAKTQEDKDKAA

SEQ ID NO: 2640547 - protein, 10 aa, Entamoeba histolytica
NAKTRVDSRT

SEQ ID NO: 2640548 - protein, 13 aa, Entamoeba histolytica
NAKTVKNNNSSRF

SEQ ID NO: 2640549 - protein, 10 aa, Entamoeba histolytica
NALEKDSKDN

SEQ ID NO: 2640550 - protein, 7 aa, Entamoeba histolytica
NALGESP

SEQ ID NO: 2640551 - protein, 8 aa, Entamoeba histolytica
NALPDNGL

SEQ ID NO: 2640552 - protein, 13 aa, Entamoeba histolytica
NALPPQNSIDEQT

SEQ ID NO: 2640553 - protein, 7 aa, Entamoeba histolytica
NALPPVP

SEQ ID NO: 2640554 - protein, 11 aa, Entamoeba histolytica
NALSNNTQPID

SEQ ID NO: 2640555 - protein, 8 aa, Entamoeba histolytica
NALTQEQR

SEQ ID NO: 2640556 - protein, 20 aa, Entamoeba histolytica
NANAEELSTEHTNNEEASTC

SEQ ID NO: 2640557 - protein, 4 aa, Entamoeba histolytica
NANC

SEQ ID NO: 2640558 - protein, 7 aa, Entamoeba histolytica
NANDRDK

SEQ ID NO: 2640559 - protein, 7 aa, Entamoeba histolytica
NANDSPI

SEQ ID NO: 2640560 - protein, 5 aa, Entamoeba histolytica
NANEI

SEQ ID NO: 2640561 - protein, 16 aa, Entamoeba histolytica
NANGEQGTVPLNYLRK

SEQ ID NO: 2640562 - protein, 5 aa, Entamoeba histolytica
NANGM

SEQ ID NO: 2640563 - protein, 9 aa, Entamoeba histolytica
NANGSERYN

SEQ ID NO: 2640564 - protein, 9 aa, Entamoeba histolytica
NANGTPGFI

SEQ ID NO: 2640565 - protein, 8 aa, Entamoeba histolytica
NANIPSDL

SEQ ID NO: 2640566 - protein, 53 aa, Entamoeba histolytica
NANNTNPTLQQSQKQNVPKEIKQQTNISSNPSSQKKSQKTSKKVKKSRKNKKI

SEQ ID NO: 2640567 - protein, 4 aa, Entamoeba histolytica
NANS

SEQ ID NO: 2640568 - protein, 8 aa, Entamoeba histolytica
NANSQIET

SEQ ID NO: 2640569 - protein, 8 aa, Entamoeba histolytica
NANTNAHT

SEQ ID NO: 2640570 - protein, 4 aa, Entamoeba histolytica
NANV

SEQ ID NO: 2640571 - protein, 4 aa, Entamoeba histolytica
NAPD

SEQ ID NO: 2640572 - protein, 6 aa, Entamoeba histolytica
NAPIGS

SEQ ID NO: 2640573 - protein, 10 aa, Entamoeba histolytica
NAPKDLSVND

SEQ ID NO: 2640574 - protein, 7 aa, Entamoeba histolytica
NAPKSGE

SEQ ID NO: 2640575 - protein, 14 aa, Entamoeba histolytica
NAPLKGSPLDAKDR

SEQ ID NO: 2640576 - protein, 16 aa, Entamoeba histolytica
NAPLRPPKSNPRHGSF

SEQ ID NO: 2640577 - protein, 5 aa, Entamoeba histolytica
NAPLS

SEQ ID NO: 2640578 - protein, 32 aa, Entamoeba histolytica
NAPPTLDEGFEPEGELKTEVQQEETLPTKIES

SEQ ID NO: 2640579 - protein, 4 aa, Entamoeba histolytica
NAPQ

SEQ ID NO: 2640580 - protein, 14 aa, Entamoeba histolytica
NAPQGANGAEVEKA

SEQ ID NO: 2640581 - protein, 16 aa, Entamoeba histolytica
NAPQGAQSAEMQKAQE

SEQ ID NO: 2640582 - protein, 13 aa, Entamoeba histolytica
NAPQGGNVEGIEK

SEQ ID NO: 2640583 - protein, 16 aa, Entamoeba histolytica
NAPRDCPKKEANPDRA

SEQ ID NO: 2640584 - protein, 14 aa, Entamoeba histolytica
NAPSFKKQKRVEQP

SEQ ID NO: 2640585 - protein, 8 aa, Entamoeba histolytica
NAPSGNDI

SEQ ID NO: 2640586 - protein, 9 aa, Entamoeba histolytica
NAPSGTDLS

SEQ ID NO: 2640587 - protein, 13 aa, Entamoeba histolytica
NAPSNGLFSVVSL

SEQ ID NO: 2640588 - protein, 18 aa, Entamoeba histolytica
NAPSSVAQEEEKQRLESD

SEQ ID NO: 2640589 - protein, 6 aa, Entamoeba histolytica
NAPTQQ

SEQ ID NO: 2640590 - protein, 7 aa, Entamoeba histolytica
NAPVEEE

SEQ ID NO: 2640591 - protein, 19 aa, Entamoeba histolytica
NAQASKMLEEDKSEQRLRR

SEQ ID NO: 2640592 - protein, 7 aa, Entamoeba histolytica
NAQGEDV

SEQ ID NO: 2640593 - protein, 28 aa, Entamoeba histolytica
NAQIEEENKRLQNENEELKKKCDAQDSL

SEQ ID NO: 2640594 - protein, 5 aa, Entamoeba histolytica
NAQIQ

SEQ ID NO: 2640595 - protein, 5 aa, Entamoeba histolytica
NAQKD

SEQ ID NO: 2640596 - protein, 28 aa, Entamoeba histolytica
NAQNEEENGDEEEGDDDEYEYEEVEEDE

SEQ ID NO: 2640597 - protein, 12 aa, Entamoeba histolytica
NAQPEDAIKASE

SEQ ID NO: 2640598 - protein, 19 aa, Entamoeba histolytica
NAQQTAKPASGSKSMGSET

SEQ ID NO: 2640599 - protein, 7 aa, Entamoeba histolytica
NAQQTMD

SEQ ID NO: 2640600 - protein, 6 aa, Entamoeba histolytica
NAQRTF

SEQ ID NO: 2640601 - protein, 4 aa, Entamoeba histolytica
NAQS

SEQ ID NO: 2640602 - protein, 8 aa, Entamoeba histolytica
NAQSGTKY

SEQ ID NO: 2640603 - protein, 5 aa, Entamoeba histolytica
NAQSK

SEQ ID NO: 2640604 - protein, 10 aa, Entamoeba histolytica
NAQSKKVKTM

SEQ ID NO: 2640605 - protein, 8 aa, Entamoeba histolytica
NAQSKNRG

SEQ ID NO: 2640606 - protein, 15 aa, Entamoeba histolytica
NAQTNVKPSTGGPET

SEQ ID NO: 2640607 - protein, 17 aa, Entamoeba histolytica
NAQTSSQYDNELPPMPI

SEQ ID NO: 2640608 - protein, 6 aa, Entamoeba histolytica
NAQTTE

SEQ ID NO: 2640609 - protein, 7 aa, Entamoeba histolytica
NARETAI

SEQ ID NO: 2640610 - protein, 6 aa, Entamoeba histolytica
NARGGT

SEQ ID NO: 2640611 - protein, 42 aa, Entamoeba histolytica
NARKDNAKAKEQEEKERKKAEEAKKKAQLAAARKAGGKVDAL

SEQ ID NO: 2640612 - protein, 8 aa, Entamoeba histolytica
NARKDYAK

SEQ ID NO: 2640613 - protein, 8 aa, Entamoeba histolytica
NARNLNEV

SEQ ID NO: 2640614 - protein, 16 aa, Entamoeba histolytica
NARNTRKQQLVQLAEL

SEQ ID NO: 2640615 - protein, 5 aa, Entamoeba histolytica
NARPS

SEQ ID NO: 2640616 - protein, 11 aa, Entamoeba histolytica
NARPSKSEQIK

SEQ ID NO: 2640617 - protein, 14 aa, Entamoeba histolytica
NARTYDKKGVTIPS

SEQ ID NO: 2640618 - protein, 6 aa, Entamoeba histolytica
NASAQT

SEQ ID NO: 2640619 - protein, 7 aa, Entamoeba histolytica
NASASLN

SEQ ID NO: 2640620 - protein, 14 aa, Entamoeba histolytica
NASDEVKNKPIESI

SEQ ID NO: 2640621 - protein, 10 aa, Entamoeba histolytica
NASESKQNKC

SEQ ID NO: 2640622 - protein, 7 aa, Entamoeba histolytica
NASEYPR

SEQ ID NO: 2640623 - protein, 12 aa, Entamoeba histolytica
NASKSLVNKYGQ

SEQ ID NO: 2640624 - protein, 9 aa, Entamoeba histolytica
NASKSPAIQ

SEQ ID NO: 2640625 - protein, 14 aa, Entamoeba histolytica
NASNDLNGKEIEYT

SEQ ID NO: 2640626 - protein, 4 aa, Entamoeba histolytica
NASP

SEQ ID NO: 2640627 - protein, 13 aa, Entamoeba histolytica
NASPIQEQQKAKL

SEQ ID NO: 2640628 - protein, 5 aa, Entamoeba histolytica
NASQQ

SEQ ID NO: 2640629 - protein, 28 aa, Entamoeba histolytica
NASQRNKEDTQNESKEKKELAKDIAGDV

SEQ ID NO: 2640630 - protein, 25 aa, Entamoeba histolytica
NASQSISSSYTPQLSKNKSNRINQP

SEQ ID NO: 2640631 - protein, 4 aa, Entamoeba histolytica
NASS

SEQ ID NO: 2640632 - protein, 14 aa, Entamoeba histolytica
NASSKEEDYDAFEK

SEQ ID NO: 2640633 - protein, 10 aa, Entamoeba histolytica
NASSSNPAPL

SEQ ID NO: 2640634 - protein, 7 aa, Entamoeba histolytica
NASSTFH

SEQ ID NO: 2640635 - protein, 4 aa, Entamoeba histolytica
NAST

SEQ ID NO: 2640636 - protein, 4 aa, Entamoeba histolytica
NASY

SEQ ID NO: 2640637 - protein, 5 aa, Entamoeba histolytica
NASYP

SEQ ID NO: 2640638 - protein, 8 aa, Entamoeba histolytica
NATAEDGI

SEQ ID NO: 2640639 - protein, 13 aa, Entamoeba histolytica
NATDAAKCYQDKD

SEQ ID NO: 2640640 - protein, 8 aa, Entamoeba histolytica
NATDAQRT

SEQ ID NO: 2640641 - protein, 10 aa, Entamoeba histolytica
NATDDQRRAM

SEQ ID NO: 2640642 - protein, 9 aa, Entamoeba histolytica
NATEGFSGA

SEQ ID NO: 2640643 - protein, 8 aa, Entamoeba histolytica
NATEKGDM

SEQ ID NO: 2640644 - protein, 10 aa, Entamoeba histolytica
NATENTKQNS

SEQ ID NO: 2640645 - protein, 6 aa, Entamoeba histolytica
NATEQC

SEQ ID NO: 2640646 - protein, 4 aa, Entamoeba histolytica
NATH

SEQ ID NO: 2640647 - protein, 11 aa, Entamoeba histolytica
NATKKSKPNLL

SEQ ID NO: 2640648 - protein, 15 aa, Entamoeba histolytica
NATKRIRDQITSKDL

SEQ ID NO: 2640649 - protein, 4 aa, Entamoeba histolytica
NATL

SEQ ID NO: 2640650 - protein, 8 aa, Entamoeba histolytica
NATNSGGI

SEQ ID NO: 2640651 - protein, 6 aa, Entamoeba histolytica
NATNSL

SEQ ID NO: 2640652 - protein, 7 aa, Entamoeba histolytica
NATPEQL

SEQ ID NO: 2640653 - protein, 5 aa, Entamoeba histolytica
NATQR

SEQ ID NO: 2640654 - protein, 14 aa, Entamoeba histolytica
NATRYANGYTKDTP

SEQ ID NO: 2640655 - protein, 6 aa, Entamoeba histolytica
NATTMV

SEQ ID NO: 2640656 - protein, 28 aa, Entamoeba histolytica
NATVAQKNITKEETIKEKKDVYNRDANW

SEQ ID NO: 2640657 - protein, 13 aa, Entamoeba histolytica
NAVESNGNKVKKN

SEQ ID NO: 2640658 - protein, 10 aa, Entamoeba histolytica
NAVKNAGNRR

SEQ ID NO: 2640659 - protein, 25 aa, Entamoeba histolytica
NAVPPQTTPQQAKTQPSGPQYPGYN

SEQ ID NO: 2640660 - protein, 12 aa, Entamoeba histolytica
NAWTKSGAYTGE

SEQ ID NO: 2640661 - protein, 7 aa, Entamoeba histolytica
NAYEPKT

SEQ ID NO: 2640662 - protein, 6 aa, Entamoeba histolytica
NAYETS

SEQ ID NO: 2640663 - protein, 5 aa, Entamoeba histolytica
NCEDS

SEQ ID NO: 2640664 - protein, 4 aa, Entamoeba histolytica
NCEN

SEQ ID NO: 2640665 - protein, 25 aa, Entamoeba histolytica
NCGENEESRLSGNFKREYEDNGQTI

SEQ ID NO: 2640666 - protein, 6 aa, Entamoeba histolytica
NCGGSL

SEQ ID NO: 2640667 - protein, 7 aa, Entamoeba histolytica
NCGKDDP

SEQ ID NO: 2640668 - protein, 8 aa, Entamoeba histolytica
NCGTPVNG

SEQ ID NO: 2640669 - protein, 7 aa, Entamoeba histolytica
NCKEQDI

SEQ ID NO: 2640670 - protein, 8 aa, Entamoeba histolytica
NCKNSERN

SEQ ID NO: 2640671 - protein, 11 aa, Entamoeba histolytica
NCKPPDFPCST

SEQ ID NO: 2640672 - protein, 8 aa, Entamoeba histolytica
NCKPPEIR

SEQ ID NO: 2640673 - protein, 5 aa, Entamoeba histolytica
NCNKV

SEQ ID NO: 2640674 - protein, 6 aa, Entamoeba histolytica
NCNSDL

SEQ ID NO: 2640675 - protein, 12 aa, Entamoeba histolytica
NCNSQGVDLSGS

SEQ ID NO: 2640676 - protein, 9 aa, Entamoeba histolytica
NCPESKMDN

SEQ ID NO: 2640677 - protein, 19 aa, Entamoeba histolytica
NCPKNKGASFSAVFKRISL

SEQ ID NO: 2640678 - protein, 139 aa, Entamoeba histolytica
NCPKQSGRRYERNRPRRRRSRSRSPNIRNRNRSPNSRSRSPNSRSRSPNSRSRSPNSRSRSPNSRSRSPNSRSSSPGIRNRNRSPNSRSRSPSRRRYRKSTSFKRRYSSRSRSRSNSRRRSYSRSRSNSRSYSQRSQHN

SEQ ID NO: 2640679 - protein, 109 aa, Entamoeba histolytica
NCPKQSGRRYERNRPRRRRSRSRSPNIRNRNRSPNSRSRSPNSRSRSPNSRSRSPNSRSRSPSRRRYRKSTSFKRRYSSRSRSRSNSRRRSYSRSRSNSRSYSQRSQHN

SEQ ID NO: 2640680 - protein, 8 aa, Entamoeba histolytica
NCPRNDPW

SEQ ID NO: 2640681 - protein, 4 aa, Entamoeba histolytica
NCQG

SEQ ID NO: 2640682 - protein, 8 aa, Entamoeba histolytica
NCQPPLSS

SEQ ID NO: 2640683 - protein, 4 aa, Entamoeba histolytica
NCQY

SEQ ID NO: 2640684 - protein, 4 aa, Entamoeba histolytica
NCSD

SEQ ID NO: 2640685 - protein, 12 aa, Entamoeba histolytica
NCSNKQKKENSM

SEQ ID NO: 2640686 - protein, 12 aa, Entamoeba histolytica
NCTEGKKPTKAH

SEQ ID NO: 2640687 - protein, 4 aa, Entamoeba histolytica
NCTI

SEQ ID NO: 2640688 - protein, 8 aa, Entamoeba histolytica
NCTNEERV

SEQ ID NO: 2640689 - protein, 4 aa, Entamoeba histolytica
NCYQ

SEQ ID NO: 2640690 - protein, 7 aa, Entamoeba histolytica
NDAERQK

SEQ ID NO: 2640691 - protein, 6 aa, Entamoeba histolytica
NDAKTA

SEQ ID NO: 2640692 - protein, 14 aa, Entamoeba histolytica
NDAKVKSNKDNKYP

SEQ ID NO: 2640693 - protein, 7 aa, Entamoeba histolytica
NDAPSRE

SEQ ID NO: 2640694 - protein, 5 aa, Entamoeba histolytica
NDARG

SEQ ID NO: 2640695 - protein, 8 aa, Entamoeba histolytica
NDASDETI

SEQ ID NO: 2640696 - protein, 8 aa, Entamoeba histolytica
NDASNTYK

SEQ ID NO: 2640697 - protein, 8 aa, Entamoeba histolytica
NDAYNGTK

SEQ ID NO: 2640698 - protein, 12 aa, Entamoeba histolytica
NDCKKNSSIEND

SEQ ID NO: 2640699 - protein, 13 aa, Entamoeba histolytica
NDCTNKNERTGKE

SEQ ID NO: 2640700 - protein, 29 aa, Entamoeba histolytica
NDDANEAYRTAEKTASTNNGNSSHDPRKK

SEQ ID NO: 2640701 - protein, 6 aa, Entamoeba histolytica
NDDATS

SEQ ID NO: 2640702 - protein, 4 aa, Entamoeba histolytica
NDDD

SEQ ID NO: 2640703 - protein, 7 aa, Entamoeba histolytica
NDDDIYD

SEQ ID NO: 2640704 - protein, 7 aa, Entamoeba histolytica
NDDDLTN

SEQ ID NO: 2640705 - protein, 6 aa, Entamoeba histolytica
NDDDVE

SEQ ID NO: 2640706 - protein, 8 aa, Entamoeba histolytica
NDDEAKEA

SEQ ID NO: 2640707 - protein, 20 aa, Entamoeba histolytica
NDDEDSEIKTKKINTQKKKV

SEQ ID NO: 2640708 - protein, 7 aa, Entamoeba histolytica
NDDEIES

SEQ ID NO: 2640709 - protein, 12 aa, Entamoeba histolytica
NDDFNDKKKEGV

SEQ ID NO: 2640710 - protein, 11 aa, Entamoeba histolytica
NDDGDSIEITK

SEQ ID NO: 2640711 - protein, 6 aa, Entamoeba histolytica
NDDGEI

SEQ ID NO: 2640712 - protein, 9 aa, Entamoeba histolytica
NDDNGMNKR

SEQ ID NO: 2640713 - protein, 6 aa, Entamoeba histolytica
NDDNRK

SEQ ID NO: 2640714 - protein, 4 aa, Entamoeba histolytica
NDDQ

SEQ ID NO: 2640715 - protein, 7 aa, Entamoeba histolytica
NDDQVEK

SEQ ID NO: 2640716 - protein, 4 aa, Entamoeba histolytica
NDDS

SEQ ID NO: 2640717 - protein, 16 aa, Entamoeba histolytica
NDDSASDSEKEEIQRK

SEQ ID NO: 2640718 - protein, 19 aa, Entamoeba histolytica
NDDSQKENVLEQPETEMKI

SEQ ID NO: 2640719 - protein, 7 aa, Entamoeba histolytica
NDDSQVS

SEQ ID NO: 2640720 - protein, 6 aa, Entamoeba histolytica
NDDTIG

SEQ ID NO: 2640721 - protein, 7 aa, Entamoeba histolytica
NDDTPYV

SEQ ID NO: 2640722 - protein, 5 aa, Entamoeba histolytica
NDDTV

SEQ ID NO: 2640723 - protein, 7 aa, Entamoeba histolytica
NDDVEDV

SEQ ID NO: 2640724 - protein, 6 aa, Entamoeba histolytica
NDDVTS

SEQ ID NO: 2640725 - protein, 7 aa, Entamoeba histolytica
NDEATPN

SEQ ID NO: 2640726 - protein, 8 aa, Entamoeba histolytica
NDECRNAC

SEQ ID NO: 2640727 - protein, 27 aa, Entamoeba histolytica
NDEDEPIKDDLSDGLEFEEQKDDDIPL

SEQ ID NO: 2640728 - protein, 5 aa, Entamoeba histolytica
NDEDL

SEQ ID NO: 2640729 - protein, 14 aa, Entamoeba histolytica
NDEDLDKKIGDLQK

SEQ ID NO: 2640730 - protein, 6 aa, Entamoeba histolytica
NDEDPH

SEQ ID NO: 2640731 - protein, 34 aa, Entamoeba histolytica
NDEDQKQMDIASTEKKGKTTSSAPLVDNKGSEEM

SEQ ID NO: 2640732 - protein, 6 aa, Entamoeba histolytica
NDEDVQ

SEQ ID NO: 2640733 - protein, 24 aa, Entamoeba histolytica
NDEEAVEEIKNDEYSAYYKGREPK

SEQ ID NO: 2640734 - protein, 10 aa, Entamoeba histolytica
NDEEFEDAEG

SEQ ID NO: 2640735 - protein, 10 aa, Entamoeba histolytica
NDEEFNDETI

SEQ ID NO: 2640736 - protein, 15 aa, Entamoeba histolytica
NDEELEEVKKEVQSE

SEQ ID NO: 2640737 - protein, 7 aa, Entamoeba histolytica
NDEENDI

SEQ ID NO: 2640738 - protein, 6 aa, Entamoeba histolytica
NDEERG

SEQ ID NO: 2640739 - protein, 7 aa, Entamoeba histolytica
NDEETHD

SEQ ID NO: 2640740 - protein, 17 aa, Entamoeba histolytica
NDEEVTEKRKRVKKSDD

SEQ ID NO: 2640741 - protein, 8 aa, Entamoeba histolytica
NDEGELKE

SEQ ID NO: 2640742 - protein, 8 aa, Entamoeba histolytica
NDEGQNEI

SEQ ID NO: 2640743 - protein, 4 aa, Entamoeba histolytica
NDEH

SEQ ID NO: 2640744 - protein, 7 aa, Entamoeba histolytica
NDEIEKY

SEQ ID NO: 2640745 - protein, 22 aa, Entamoeba histolytica
NDEIKKTSGTTETKEKVEVKKE

SEQ ID NO: 2640746 - protein, 10 aa, Entamoeba histolytica
NDEKDKKLSM

SEQ ID NO: 2640747 - protein, 5 aa, Entamoeba histolytica
NDEKE

SEQ ID NO: 2640748 - protein, 25 aa, Entamoeba histolytica
NDEKKRRIPPQTPIRQKDINQRKRV

SEQ ID NO: 2640749 - protein, 13 aa, Entamoeba histolytica
NDEKREPNQLPKA

SEQ ID NO: 2640750 - protein, 6 aa, Entamoeba histolytica
NDEKSK

SEQ ID NO: 2640751 - protein, 7 aa, Entamoeba histolytica
NDEKYTK

SEQ ID NO: 2640752 - protein, 7 aa, Entamoeba histolytica
NDELGKR

SEQ ID NO: 2640753 - protein, 8 aa, Entamoeba histolytica
NDELKDKI

SEQ ID NO: 2640754 - protein, 7 aa, Entamoeba histolytica
NDELKKA

SEQ ID NO: 2640755 - protein, 4 aa, Entamoeba histolytica
NDEM

SEQ ID NO: 2640756 - protein, 5 aa, Entamoeba histolytica
NDEMI

SEQ ID NO: 2640757 - protein, 4 aa, Entamoeba histolytica
NDEN

SEQ ID NO: 2640758 - protein, 9 aa, Entamoeba histolytica
NDENDEVRS

SEQ ID NO: 2640759 - protein, 8 aa, Entamoeba histolytica
NDENEEKV

SEQ ID NO: 2640760 - protein, 6 aa, Entamoeba histolytica
NDENHS

SEQ ID NO: 2640761 - protein, 14 aa, Entamoeba histolytica
NDENKKPTTTHRNS

SEQ ID NO: 2640762 - protein, 6 aa, Entamoeba histolytica
NDENLK

SEQ ID NO: 2640763 - protein, 7 aa, Entamoeba histolytica
NDENNVK

SEQ ID NO: 2640764 - protein, 10 aa, Entamoeba histolytica
NDENPQRDDM

SEQ ID NO: 2640765 - protein, 10 aa, Entamoeba histolytica
NDEPPTPLPL

SEQ ID NO: 2640766 - protein, 7 aa, Entamoeba histolytica
NDEPTTQ

SEQ ID NO: 2640767 - protein, 4 aa, Entamoeba histolytica
NDEQ

SEQ ID NO: 2640768 - protein, 12 aa, Entamoeba histolytica
NDEQIPSQKPYT

SEQ ID NO: 2640769 - protein, 6 aa, Entamoeba histolytica
NDEQSL

SEQ ID NO: 2640770 - protein, 8 aa, Entamoeba histolytica
NDERETGH

SEQ ID NO: 2640771 - protein, 6 aa, Entamoeba histolytica
NDERKN

SEQ ID NO: 2640772 - protein, 7 aa, Entamoeba histolytica
NDESELD

SEQ ID NO: 2640773 - protein, 11 aa, Entamoeba histolytica
NDESSEDEIPH

SEQ ID NO: 2640774 - protein, 33 aa, Entamoeba histolytica
NDESTVSNDSPTHLTPRTPKTPKSSLAKSSGQS

SEQ ID NO: 2640775 - protein, 24 aa, Entamoeba histolytica
NDETNNEEEKEKRIENKEKEEEEL

SEQ ID NO: 2640776 - protein, 7 aa, Entamoeba histolytica
NDETRLP

SEQ ID NO: 2640777 - protein, 9 aa, Entamoeba histolytica
NDEVHEKTN

SEQ ID NO: 2640778 - protein, 7 aa, Entamoeba histolytica
NDEYTNK

SEQ ID NO: 2640779 - protein, 20 aa, Entamoeba histolytica
NDFAENAPTQQDNSSDEEED

SEQ ID NO: 2640780 - protein, 24 aa, Entamoeba histolytica
NDFAQPSEALENKISEKLKGVEGR

SEQ ID NO: 2640781 - protein, 4 aa, Entamoeba histolytica
NDFD

SEQ ID NO: 2640782 - protein, 11 aa, Entamoeba histolytica
NDFENKTFEEI

SEQ ID NO: 2640783 - protein, 12 aa, Entamoeba histolytica
NDFKKTKAKSIA

SEQ ID NO: 2640784 - protein, 12 aa, Entamoeba histolytica
NDFNEARQSGEY

SEQ ID NO: 2640785 - protein, 7 aa, Entamoeba histolytica
NDFNEAT

SEQ ID NO: 2640786 - protein, 7 aa, Entamoeba histolytica
NDFPSDY

SEQ ID NO: 2640787 - protein, 7 aa, Entamoeba histolytica
NDFRDKN

SEQ ID NO: 2640788 - protein, 5 aa, Entamoeba histolytica
NDFRP

SEQ ID NO: 2640789 - protein, 13 aa, Entamoeba histolytica
NDFTDSTTSGFKD

SEQ ID NO: 2640790 - protein, 5 aa, Entamoeba histolytica
NDGAK

SEQ ID NO: 2640791 - protein, 4 aa, Entamoeba histolytica
NDGF

SEQ ID NO: 2640792 - protein, 8 aa, Entamoeba histolytica
NDGKIPTD

SEQ ID NO: 2640793 - protein, 15 aa, Entamoeba histolytica
NDGLSSPSLINPNNT

SEQ ID NO: 2640794 - protein, 8 aa, Entamoeba histolytica
NDGNAKTS

SEQ ID NO: 2640795 - protein, 7 aa, Entamoeba histolytica
NDGNKSI

SEQ ID NO: 2640796 - protein, 6 aa, Entamoeba histolytica
NDGNPY

SEQ ID NO: 2640797 - protein, 6 aa, Entamoeba histolytica
NDGQTS

SEQ ID NO: 2640798 - protein, 10 aa, Entamoeba histolytica
NDGQVKRIRG

SEQ ID NO: 2640799 - protein, 21 aa, Entamoeba histolytica
NDGRTHENPSKNYGKGGLDHG

SEQ ID NO: 2640800 - protein, 5 aa, Entamoeba histolytica
NDGSF

SEQ ID NO: 2640801 - protein, 8 aa, Entamoeba histolytica
NDGTYKKD

SEQ ID NO: 2640802 - protein, 7 aa, Entamoeba histolytica
NDGVKGR

SEQ ID NO: 2640803 - protein, 8 aa, Entamoeba histolytica
NDGWEGFG

SEQ ID NO: 2640804 - protein, 4 aa, Entamoeba histolytica
NDGY

SEQ ID NO: 2640805 - protein, 8 aa, Entamoeba histolytica
NDGYNPNV

SEQ ID NO: 2640806 - protein, 8 aa, Entamoeba histolytica
NDHDREIT

SEQ ID NO: 2640807 - protein, 6 aa, Entamoeba histolytica
NDHEEK

SEQ ID NO: 2640808 - protein, 6 aa, Entamoeba histolytica
NDHESD

SEQ ID NO: 2640809 - protein, 7 aa, Entamoeba histolytica
NDHLSPE

SEQ ID NO: 2640810 - protein, 6 aa, Entamoeba histolytica
NDHPRI

SEQ ID NO: 2640811 - protein, 18 aa, Entamoeba histolytica
NDIADDEDDDDDDDDEWS

SEQ ID NO: 2640812 - protein, 12 aa, Entamoeba histolytica
NDIDEDEEEEMI

SEQ ID NO: 2640813 - protein, 10 aa, Entamoeba histolytica
NDIDEDENIP

SEQ ID NO: 2640814 - protein, 8 aa, Entamoeba histolytica
NDIDNDGM

SEQ ID NO: 2640815 - protein, 4 aa, Entamoeba histolytica
NDIE

SEQ ID NO: 2640816 - protein, 6 aa, Entamoeba histolytica
NDIEDY

SEQ ID NO: 2640817 - protein, 5 aa, Entamoeba histolytica
NDIEG

SEQ ID NO: 2640818 - protein, 5 aa, Entamoeba histolytica
NDIEH

SEQ ID NO: 2640819 - protein, 7 aa, Entamoeba histolytica
NDIGPAR

SEQ ID NO: 2640820 - protein, 5 aa, Entamoeba histolytica
NDIGR

SEQ ID NO: 2640821 - protein, 4 aa, Entamoeba histolytica
NDIH

SEQ ID NO: 2640822 - protein, 11 aa, Entamoeba histolytica
NDIKENEERVE

SEQ ID NO: 2640823 - protein, 11 aa, Entamoeba histolytica
NDIMEEESREK

SEQ ID NO: 2640824 - protein, 4 aa, Entamoeba histolytica
NDIN

SEQ ID NO: 2640825 - protein, 8 aa, Entamoeba histolytica
NDIPEDKM

SEQ ID NO: 2640826 - protein, 6 aa, Entamoeba histolytica
NDIPPK

SEQ ID NO: 2640827 - protein, 13 aa, Entamoeba histolytica
NDIPQKSKTLRLD

SEQ ID NO: 2640828 - protein, 7 aa, Entamoeba histolytica
NDIPSSF

SEQ ID NO: 2640829 - protein, 15 aa, Entamoeba histolytica
NDIQSQQDAKKIYEE

SEQ ID NO: 2640830 - protein, 8 aa, Entamoeba histolytica
NDIQTRQY

SEQ ID NO: 2640831 - protein, 7 aa, Entamoeba histolytica
NDIRKSP

SEQ ID NO: 2640832 - protein, 13 aa, Entamoeba histolytica
NDISRNIQQVSSN

SEQ ID NO: 2640833 - protein, 6 aa, Entamoeba histolytica
NDITGE

SEQ ID NO: 2640834 - protein, 31 aa, Entamoeba histolytica
NDIVERKKEKKNLSQDNNPPKRVSLFKQRMG

SEQ ID NO: 2640835 - protein, 4 aa, Entamoeba histolytica
NDKA

SEQ ID NO: 2640836 - protein, 13 aa, Entamoeba histolytica
NDKANSPTGYEGY

SEQ ID NO: 2640837 - protein, 9 aa, Entamoeba histolytica
NDKDSSIDL

SEQ ID NO: 2640838 - protein, 6 aa, Entamoeba histolytica
NDKDYE

SEQ ID NO: 2640839 - protein, 20 aa, Entamoeba histolytica
NDKEANTTRHRGTESIKPPE

SEQ ID NO: 2640840 - protein, 6 aa, Entamoeba histolytica
NDKEFN

SEQ ID NO: 2640841 - protein, 6 aa, Entamoeba histolytica
NDKEKA

SEQ ID NO: 2640842 - protein, 8 aa, Entamoeba histolytica
NDKEKEIN

SEQ ID NO: 2640843 - protein, 7 aa, Entamoeba histolytica
NDKELHN

SEQ ID NO: 2640844 - protein, 8 aa, Entamoeba histolytica
NDKELPSQ

SEQ ID NO: 2640845 - protein, 18 aa, Entamoeba histolytica
NDKELRTSHDLNGFEVLD

SEQ ID NO: 2640846 - protein, 5 aa, Entamoeba histolytica
NDKES

SEQ ID NO: 2640847 - protein, 7 aa, Entamoeba histolytica
NDKGKFE

SEQ ID NO: 2640848 - protein, 10 aa, Entamoeba histolytica
NDKGKLKTQE

SEQ ID NO: 2640849 - protein, 4 aa, Entamoeba histolytica
NDKI

SEQ ID NO: 2640850 - protein, 9 aa, Entamoeba histolytica
NDKITNSSN

SEQ ID NO: 2640851 - protein, 6 aa, Entamoeba histolytica
NDKKEC

SEQ ID NO: 2640852 - protein, 8 aa, Entamoeba histolytica
NDKKEKMK

SEQ ID NO: 2640853 - protein, 7 aa, Entamoeba histolytica
NDKKIKG

SEQ ID NO: 2640854 - protein, 4 aa, Entamoeba histolytica
NDKL

SEQ ID NO: 2640855 - protein, 20 aa, Entamoeba histolytica
NDKLEDKIDLNDDKKVSNSL

SEQ ID NO: 2640856 - protein, 5 aa, Entamoeba histolytica
NDKMN

SEQ ID NO: 2640857 - protein, 5 aa, Entamoeba histolytica
NDKNE

SEQ ID NO: 2640858 - protein, 10 aa, Entamoeba histolytica
NDKNESGSTA

SEQ ID NO: 2640859 - protein, 14 aa, Entamoeba histolytica
NDKNESSYDSENET

SEQ ID NO: 2640860 - protein, 8 aa, Entamoeba histolytica
NDKNGTFE

SEQ ID NO: 2640861 - protein, 7 aa, Entamoeba histolytica
NDKNSEQ

SEQ ID NO: 2640862 - protein, 5 aa, Entamoeba histolytica
NDKNV

SEQ ID NO: 2640863 - protein, 5 aa, Entamoeba histolytica
NDKQG

SEQ ID NO: 2640864 - protein, 11 aa, Entamoeba histolytica
NDKQGESSSSL

SEQ ID NO: 2640865 - protein, 6 aa, Entamoeba histolytica
NDKQIN

SEQ ID NO: 2640866 - protein, 8 aa, Entamoeba histolytica
NDKQKTHL

SEQ ID NO: 2640867 - protein, 11 aa, Entamoeba histolytica
NDKQLKLKGGN

SEQ ID NO: 2640868 - protein, 9 aa, Entamoeba histolytica
NDKQSKQCS

SEQ ID NO: 2640869 - protein, 14 aa, Entamoeba histolytica
NDKQYNRSKEAQIN

SEQ ID NO: 2640870 - protein, 8 aa, Entamoeba histolytica
NDKRIKGV

SEQ ID NO: 2640871 - protein, 7 aa, Entamoeba histolytica
NDKRNEK

SEQ ID NO: 2640872 - protein, 9 aa, Entamoeba histolytica
NDKRNETLK

SEQ ID NO: 2640873 - protein, 4 aa, Entamoeba histolytica
NDKS

SEQ ID NO: 2640874 - protein, 7 aa, Entamoeba histolytica
NDKSESN

SEQ ID NO: 2640875 - protein, 6 aa, Entamoeba histolytica
NDKSIS

SEQ ID NO: 2640876 - protein, 7 aa, Entamoeba histolytica
NDKSSNY

SEQ ID NO: 2640877 - protein, 4 aa, Entamoeba histolytica
NDKT

SEQ ID NO: 2640878 - protein, 9 aa, Entamoeba histolytica
NDKTREKGQ

SEQ ID NO: 2640879 - protein, 13 aa, Entamoeba histolytica
NDKTTIENHGDKE

SEQ ID NO: 2640880 - protein, 5 aa, Entamoeba histolytica
NDKTV

SEQ ID NO: 2640881 - protein, 12 aa, Entamoeba histolytica
NDKYNLDSTKKQ

SEQ ID NO: 2640882 - protein, 4 aa, Entamoeba histolytica
NDLE

SEQ ID NO: 2640883 - protein, 18 aa, Entamoeba histolytica
NDLEKQTSEVKEKTLPVK

SEQ ID NO: 2640884 - protein, 4 aa, Entamoeba histolytica
NDLH

SEQ ID NO: 2640885 - protein, 22 aa, Entamoeba histolytica
NDLNNTESFKTKTKNEQDKEIR

SEQ ID NO: 2640886 - protein, 6 aa, Entamoeba histolytica
NDLPHQ

SEQ ID NO: 2640887 - protein, 4 aa, Entamoeba histolytica
NDLS

SEQ ID NO: 2640888 - protein, 4 aa, Entamoeba histolytica
NDLT

SEQ ID NO: 2640889 - protein, 51 aa, Entamoeba histolytica
NDLTKKKNEEENNNDEQNMISSTEDDNESNEERDKSEGVDKEVILEPDDFI

SEQ ID NO: 2640890 - protein, 7 aa, Entamoeba histolytica
NDLTQSS

SEQ ID NO: 2640891 - protein, 6 aa, Entamoeba histolytica
NDLTSF

SEQ ID NO: 2640892 - protein, 6 aa, Entamoeba histolytica
NDMNEA

SEQ ID NO: 2640893 - protein, 13 aa, Entamoeba histolytica
NDMNSYKKRGQII

SEQ ID NO: 2640894 - protein, 5 aa, Entamoeba histolytica
NDMQR

SEQ ID NO: 2640895 - protein, 5 aa, Entamoeba histolytica
NDNDH

SEQ ID NO: 2640896 - protein, 8 aa, Entamoeba histolytica
NDNDKRDV

SEQ ID NO: 2640897 - protein, 13 aa, Entamoeba histolytica
NDNEEESQESEEK

SEQ ID NO: 2640898 - protein, 8 aa, Entamoeba histolytica
NDNEINEE

SEQ ID NO: 2640899 - protein, 42 aa, Entamoeba histolytica
NDNEKERKNNEIEQKKKNEEFNQKEEELNNDIEKKKKEIEKL

SEQ ID NO: 2640900 - protein, 9 aa, Entamoeba histolytica
NDNERDEAA

SEQ ID NO: 2640901 - protein, 8 aa, Entamoeba histolytica
NDNETKPC

SEQ ID NO: 2640902 - protein, 16 aa, Entamoeba histolytica
NDNFENKKMRKEDDNN

SEQ ID NO: 2640903 - protein, 4 aa, Entamoeba histolytica
NDNG

SEQ ID NO: 2640904 - protein, 7 aa, Entamoeba histolytica
NDNGEML

SEQ ID NO: 2640905 - protein, 7 aa, Entamoeba histolytica
NDNGIDV

SEQ ID NO: 2640906 - protein, 9 aa, Entamoeba histolytica
NDNGSKTIK

SEQ ID NO: 2640907 - protein, 6 aa, Entamoeba histolytica
NDNGVF

SEQ ID NO: 2640908 - protein, 9 aa, Entamoeba histolytica
NDNIEKSNL

SEQ ID NO: 2640909 - protein, 7 aa, Entamoeba histolytica
NDNKEKI

SEQ ID NO: 2640910 - protein, 7 aa, Entamoeba histolytica
NDNKLNQ

SEQ ID NO: 2640911 - protein, 12 aa, Entamoeba histolytica
NDNKTKDLEEVK

SEQ ID NO: 2640912 - protein, 13 aa, Entamoeba histolytica
NDNKTQESNKERI

SEQ ID NO: 2640913 - protein, 7 aa, Entamoeba histolytica
NDNLNNN

SEQ ID NO: 2640914 - protein, 11 aa, Entamoeba histolytica
NDNLSNNCQDL

SEQ ID NO: 2640915 - protein, 4 aa, Entamoeba histolytica
NDNN

SEQ ID NO: 2640916 - protein, 7 aa, Entamoeba histolytica
NDNNDEL

SEQ ID NO: 2640917 - protein, 6 aa, Entamoeba histolytica
NDNTKQ

SEQ ID NO: 2640918 - protein, 7 aa, Entamoeba histolytica
NDNTKTM

SEQ ID NO: 2640919 - protein, 8 aa, Entamoeba histolytica
NDNTSVED

SEQ ID NO: 2640920 - protein, 4 aa, Entamoeba histolytica
NDNY

SEQ ID NO: 2640921 - protein, 5 aa, Entamoeba histolytica
NDPAN

SEQ ID NO: 2640922 - protein, 8 aa, Entamoeba histolytica
NDPDADRL

SEQ ID NO: 2640923 - protein, 9 aa, Entamoeba histolytica
NDPDPDVIR

SEQ ID NO: 2640924 - protein, 11 aa, Entamoeba histolytica
NDPDTNQRTLE

SEQ ID NO: 2640925 - protein, 18 aa, Entamoeba histolytica
NDPEDKENSPTNSSVDDS

SEQ ID NO: 2640926 - protein, 7 aa, Entamoeba histolytica
NDPEQLG

SEQ ID NO: 2640927 - protein, 8 aa, Entamoeba histolytica
NDPFEPEN

SEQ ID NO: 2640928 - protein, 5 aa, Entamoeba histolytica
NDPFK

SEQ ID NO: 2640929 - protein, 6 aa, Entamoeba histolytica
NDPKEL

SEQ ID NO: 2640930 - protein, 6 aa, Entamoeba histolytica
NDPKSI

SEQ ID NO: 2640931 - protein, 6 aa, Entamoeba histolytica
NDPKTL

SEQ ID NO: 2640932 - protein, 14 aa, Entamoeba histolytica
NDPNVVDDDAREDI

SEQ ID NO: 2640933 - protein, 7 aa, Entamoeba histolytica
NDPQQLG

SEQ ID NO: 2640934 - protein, 14 aa, Entamoeba histolytica
NDPRSSSSLTGLKK

SEQ ID NO: 2640935 - protein, 7 aa, Entamoeba histolytica
NDPRTKE

SEQ ID NO: 2640936 - protein, 23 aa, Entamoeba histolytica
NDPSPLSHDDKTPNSSLDTPRNE

SEQ ID NO: 2640937 - protein, 10 aa, Entamoeba histolytica
NDPSRTHQGK

SEQ ID NO: 2640938 - protein, 8 aa, Entamoeba histolytica
NDPSTDKT

SEQ ID NO: 2640939 - protein, 8 aa, Entamoeba histolytica
NDPTEIGS

SEQ ID NO: 2640940 - protein, 5 aa, Entamoeba histolytica
NDPTI

SEQ ID NO: 2640941 - protein, 6 aa, Entamoeba histolytica
NDPTKQ

SEQ ID NO: 2640942 - protein, 10 aa, Entamoeba histolytica
NDPYAQDSMK

SEQ ID NO: 2640943 - protein, 13 aa, Entamoeba histolytica
NDQANKDAFTEDG

SEQ ID NO: 2640944 - protein, 6 aa, Entamoeba histolytica
NDQARK

SEQ ID NO: 2640945 - protein, 16 aa, Entamoeba histolytica
NDQCNNKYCKSSSSFV

SEQ ID NO: 2640946 - protein, 5 aa, Entamoeba histolytica
NDQED

SEQ ID NO: 2640947 - protein, 11 aa, Entamoeba histolytica
NDQEEQFQPTF

SEQ ID NO: 2640948 - protein, 6 aa, Entamoeba histolytica
NDQEFN

SEQ ID NO: 2640949 - protein, 7 aa, Entamoeba histolytica
NDQEIGN

SEQ ID NO: 2640950 - protein, 4 aa, Entamoeba histolytica
NDQH

SEQ ID NO: 2640951 - protein, 6 aa, Entamoeba histolytica
NDQKTM

SEQ ID NO: 2640952 - protein, 4 aa, Entamoeba histolytica
NDQN

SEQ ID NO: 2640953 - protein, 8 aa, Entamoeba histolytica
NDQNKIED

SEQ ID NO: 2640954 - protein, 7 aa, Entamoeba histolytica
NDQNPLG

SEQ ID NO: 2640955 - protein, 22 aa, Entamoeba histolytica
NDQPIAEPPLDTSNDTVGCLIL

SEQ ID NO: 2640956 - protein, 4 aa, Entamoeba histolytica
NDQQ

SEQ ID NO: 2640957 - protein, 7 aa, Entamoeba histolytica
NDQRRYD

SEQ ID NO: 2640958 - protein, 9 aa, Entamoeba histolytica
NDQSKETQA

SEQ ID NO: 2640959 - protein, 7 aa, Entamoeba histolytica
NDQTNER

SEQ ID NO: 2640960 - protein, 4 aa, Entamoeba histolytica
NDQV

SEQ ID NO: 2640961 - protein, 8 aa, Entamoeba histolytica
NDQVAKKL

SEQ ID NO: 2640962 - protein, 12 aa, Entamoeba histolytica
NDRENQSASTSN

SEQ ID NO: 2640963 - protein, 8 aa, Entamoeba histolytica
NDRKYTSE

SEQ ID NO: 2640964 - protein, 11 aa, Entamoeba histolytica
NDRLQEELPPI

SEQ ID NO: 2640965 - protein, 6 aa, Entamoeba histolytica
NDRPSL

SEQ ID NO: 2640966 - protein, 4 aa, Entamoeba histolytica
NDRS

SEQ ID NO: 2640967 - protein, 8 aa, Entamoeba histolytica
NDRSIKNI

SEQ ID NO: 2640968 - protein, 11 aa, Entamoeba histolytica
NDRTVRKGGLR

SEQ ID NO: 2640969 - protein, 8 aa, Entamoeba histolytica
NDSAQRVV

SEQ ID NO: 2640970 - protein, 8 aa, Entamoeba histolytica
NDSCSSLK

SEQ ID NO: 2640971 - protein, 19 aa, Entamoeba histolytica
NDSDDEEQNSIDEDKQQPF

SEQ ID NO: 2640972 - protein, 10 aa, Entamoeba histolytica
NDSDEETIGR

SEQ ID NO: 2640973 - protein, 6 aa, Entamoeba histolytica
NDSDKE

SEQ ID NO: 2640974 - protein, 6 aa, Entamoeba histolytica
NDSDKV

SEQ ID NO: 2640975 - protein, 37 aa, Entamoeba histolytica
NDSDSDGEKSKKKVKVDTSSNDKKKKREEKEKKDKKK

SEQ ID NO: 2640976 - protein, 42 aa, Entamoeba histolytica
NDSDSDVEKISPKKPSDKFERTQRSQKIATQSKKGDLTPEET

SEQ ID NO: 2640977 - protein, 8 aa, Entamoeba histolytica
NDSDTTMT

SEQ ID NO: 2640978 - protein, 7 aa, Entamoeba histolytica
NDSEREQ

SEQ ID NO: 2640979 - protein, 8 aa, Entamoeba histolytica
NDSFPTPT

SEQ ID NO: 2640980 - protein, 11 aa, Entamoeba histolytica
NDSGNLTNTDQ

SEQ ID NO: 2640981 - protein, 15 aa, Entamoeba histolytica
NDSHQIEEQQNGGVC

SEQ ID NO: 2640982 - protein, 7 aa, Entamoeba histolytica
NDSIAQQ

SEQ ID NO: 2640983 - protein, 28 aa, Entamoeba histolytica
NDSITVNSQPSRITKQKSQNQSHAIPHS

SEQ ID NO: 2640984 - protein, 10 aa, Entamoeba histolytica
NDSKKKQKQM

SEQ ID NO: 2640985 - protein, 10 aa, Entamoeba histolytica
NDSKKPHPTI

SEQ ID NO: 2640986 - protein, 11 aa, Entamoeba histolytica
NDSKLKGIDDE

SEQ ID NO: 2640987 - protein, 13 aa, Entamoeba histolytica
NDSLNKSDTNGNY

SEQ ID NO: 2640988 - protein, 12 aa, Entamoeba histolytica
NDSLSVKERNQL

SEQ ID NO: 2640989 - protein, 7 aa, Entamoeba histolytica
NDSNLKE

SEQ ID NO: 2640990 - protein, 16 aa, Entamoeba histolytica
NDSNNKGNTDKLNELN

SEQ ID NO: 2640991 - protein, 4 aa, Entamoeba histolytica
NDSQ

SEQ ID NO: 2640992 - protein, 7 aa, Entamoeba histolytica
NDSQNKF

SEQ ID NO: 2640993 - protein, 7 aa, Entamoeba histolytica
NDSRFEN

SEQ ID NO: 2640994 - protein, 4 aa, Entamoeba histolytica
NDSS

SEQ ID NO: 2640995 - protein, 6 aa, Entamoeba histolytica
NDSSDY

SEQ ID NO: 2640996 - protein, 17 aa, Entamoeba histolytica
NDSSIPSKNEIPKGSDD

SEQ ID NO: 2640997 - protein, 8 aa, Entamoeba histolytica
NDSSKIQK

SEQ ID NO: 2640998 - protein, 10 aa, Entamoeba histolytica
NDSSKPLDQI

SEQ ID NO: 2640999 - protein, 7 aa, Entamoeba histolytica
NDSSNSL

SEQ ID NO: 2641000 - protein, 42 aa, Entamoeba histolytica
NDSTETEDNPPNFTTYTRTESNPTAFANGHPSTDGAQIGFIN

SEQ ID NO: 2641001 - protein, 30 aa, Entamoeba histolytica
NDSTNLPKELDRAQDEAKKNISKANDEWKK

SEQ ID NO: 2641002 - protein, 5 aa, Entamoeba histolytica
NDSTP

SEQ ID NO: 2641003 - protein, 17 aa, Entamoeba histolytica
NDSTTSKIEGTKENIVS

SEQ ID NO: 2641004 - protein, 9 aa, Entamoeba histolytica
NDSVGQGSS

SEQ ID NO: 2641005 - protein, 6 aa, Entamoeba histolytica
NDSVNE

SEQ ID NO: 2641006 - protein, 5 aa, Entamoeba histolytica
NDSVT

SEQ ID NO: 2641007 - protein, 9 aa, Entamoeba histolytica
NDSVTKSKF

SEQ ID NO: 2641008 - protein, 6 aa, Entamoeba histolytica
NDSVTT

SEQ ID NO: 2641009 - protein, 10 aa, Entamoeba histolytica
NDSYGGLSGR

SEQ ID NO: 2641010 - protein, 7 aa, Entamoeba histolytica
NDSYNDY

SEQ ID NO: 2641011 - protein, 8 aa, Entamoeba histolytica
NDTAGQER

SEQ ID NO: 2641012 - protein, 20 aa, Entamoeba histolytica
NDTAIIPPKEPDVELTQQAR

SEQ ID NO: 2641013 - protein, 24 aa, Entamoeba histolytica
NDTDKKIIEEKKPKSPLPLPKQPQ

SEQ ID NO: 2641014 - protein, 7 aa, Entamoeba histolytica
NDTDKSI

SEQ ID NO: 2641015 - protein, 5 aa, Entamoeba histolytica
NDTDN

SEQ ID NO: 2641016 - protein, 7 aa, Entamoeba histolytica
NDTEDIQ

SEQ ID NO: 2641017 - protein, 6 aa, Entamoeba histolytica
NDTELQ

SEQ ID NO: 2641018 - protein, 5 aa, Entamoeba histolytica
NDTEQ

SEQ ID NO: 2641019 - protein, 5 aa, Entamoeba histolytica
NDTFK

SEQ ID NO: 2641020 - protein, 18 aa, Entamoeba histolytica
NDTFSVGSSEMCGNRDQM

SEQ ID NO: 2641021 - protein, 4 aa, Entamoeba histolytica
NDTH

SEQ ID NO: 2641022 - protein, 8 aa, Entamoeba histolytica
NDTKFQDG

SEQ ID NO: 2641023 - protein, 40 aa, Entamoeba histolytica
NDTKKSDTQPTIGTTLSTEEKKIETNFSGLTEKPLSSPFS

SEQ ID NO: 2641024 - protein, 16 aa, Entamoeba histolytica
NDTNNGLFSKSSSSCI

SEQ ID NO: 2641025 - protein, 7 aa, Entamoeba histolytica
NDTNYGS

SEQ ID NO: 2641026 - protein, 16 aa, Entamoeba histolytica
NDTPATNQQNTQQDEL

SEQ ID NO: 2641027 - protein, 20 aa, Entamoeba histolytica
NDTPLVPPKEPDVELTQQAR

SEQ ID NO: 2641028 - protein, 7 aa, Entamoeba histolytica
NDTQRNA

SEQ ID NO: 2641029 - protein, 7 aa, Entamoeba histolytica
NDTRESM

SEQ ID NO: 2641030 - protein, 7 aa, Entamoeba histolytica
NDTSAGH

SEQ ID NO: 2641031 - protein, 8 aa, Entamoeba histolytica
NDTSLQGL

SEQ ID NO: 2641032 - protein, 7 aa, Entamoeba histolytica
NDTSPIQ

SEQ ID NO: 2641033 - protein, 8 aa, Entamoeba histolytica
NDTSQTSE

SEQ ID NO: 2641034 - protein, 15 aa, Entamoeba histolytica
NDTSVNSELTSQGRN

SEQ ID NO: 2641035 - protein, 9 aa, Entamoeba histolytica
NDTTSNETI

SEQ ID NO: 2641036 - protein, 6 aa, Entamoeba histolytica
NDVDKV

SEQ ID NO: 2641037 - protein, 4 aa, Entamoeba histolytica
NDVE

SEQ ID NO: 2641038 - protein, 11 aa, Entamoeba histolytica
NDVETTTNGKI

SEQ ID NO: 2641039 - protein, 7 aa, Entamoeba histolytica
NDVGKSS

SEQ ID NO: 2641040 - protein, 12 aa, Entamoeba histolytica
NDVNDEDNSIEE

SEQ ID NO: 2641041 - protein, 6 aa, Entamoeba histolytica
NDVPVD

SEQ ID NO: 2641042 - protein, 6 aa, Entamoeba histolytica
NDVQRK

SEQ ID NO: 2641043 - protein, 4 aa, Entamoeba histolytica
NDVR

SEQ ID NO: 2641044 - protein, 14 aa, Entamoeba histolytica
NDVTSENIRKGASY

SEQ ID NO: 2641045 - protein, 4 aa, Entamoeba histolytica
NDWP

SEQ ID NO: 2641046 - protein, 4 aa, Entamoeba histolytica
NDYA

SEQ ID NO: 2641047 - protein, 6 aa, Entamoeba histolytica
NDYESE

SEQ ID NO: 2641048 - protein, 21 aa, Entamoeba histolytica
NDYIPQDTYKISDDKDFSGQV

SEQ ID NO: 2641049 - protein, 6 aa, Entamoeba histolytica
NDYKIR

SEQ ID NO: 2641050 - protein, 16 aa, Entamoeba histolytica
NDYPNEENEKEENELP

SEQ ID NO: 2641051 - protein, 9 aa, Entamoeba histolytica
NDYSAEGYE

SEQ ID NO: 2641052 - protein, 10 aa, Entamoeba histolytica
NDYSNGMNKK

SEQ ID NO: 2641053 - protein, 7 aa, Entamoeba histolytica
NDYSSLT

SEQ ID NO: 2641054 - protein, 6 aa, Entamoeba histolytica
NDYYSS

SEQ ID NO: 2641055 - protein, 6 aa, Entamoeba histolytica
NEAEIQ

SEQ ID NO: 2641056 - protein, 21 aa, Entamoeba histolytica
NEAEKTITSIADSRKTKYRKR

SEQ ID NO: 2641057 - protein, 6 aa, Entamoeba histolytica
NEAESK

SEQ ID NO: 2641058 - protein, 12 aa, Entamoeba histolytica
NEAFKQKSKDNI

SEQ ID NO: 2641059 - protein, 9 aa, Entamoeba histolytica
NEAGRSYRT

SEQ ID NO: 2641060 - protein, 41 aa, Entamoeba histolytica
NEAKKEFEKANEEEKKKEDEGQKNEENKEENNASKRFKENI

SEQ ID NO: 2641061 - protein, 7 aa, Entamoeba histolytica
NEAKKVS

SEQ ID NO: 2641062 - protein, 12 aa, Entamoeba histolytica
NEAKPQNPTISQ

SEQ ID NO: 2641063 - protein, 7 aa, Entamoeba histolytica
NEAKSKA

SEQ ID NO: 2641064 - protein, 18 aa, Entamoeba histolytica
NEALEEQERLATNYGEAC

SEQ ID NO: 2641065 - protein, 11 aa, Entamoeba histolytica
NEALKKGSSEI

SEQ ID NO: 2641066 - protein, 7 aa, Entamoeba histolytica
NEANDAY

SEQ ID NO: 2641067 - protein, 6 aa, Entamoeba histolytica
NEANGC

SEQ ID NO: 2641068 - protein, 7 aa, Entamoeba histolytica
NEAPRPV

SEQ ID NO: 2641069 - protein, 5 aa, Entamoeba histolytica
NEAQN

SEQ ID NO: 2641070 - protein, 9 aa, Entamoeba histolytica
NEAQPHKSD

SEQ ID NO: 2641071 - protein, 7 aa, Entamoeba histolytica
NEAQPRI

SEQ ID NO: 2641072 - protein, 5 aa, Entamoeba histolytica
NEASF

SEQ ID NO: 2641073 - protein, 9 aa, Entamoeba histolytica
NEASHEVSD

SEQ ID NO: 2641074 - protein, 8 aa, Entamoeba histolytica
NEASKTQY

SEQ ID NO: 2641075 - protein, 12 aa, Entamoeba histolytica
NEASSGVTAEQM

SEQ ID NO: 2641076 - protein, 8 aa, Entamoeba histolytica
NEATNGEF

SEQ ID NO: 2641077 - protein, 14 aa, Entamoeba histolytica
NEATQLNETRKEQI

SEQ ID NO: 2641078 - protein, 6 aa, Entamoeba histolytica
NEATSV

SEQ ID NO: 2641079 - protein, 10 aa, Entamoeba histolytica
NEAYGESQEL

SEQ ID NO: 2641080 - protein, 4 aa, Entamoeba histolytica
NECD

SEQ ID NO: 2641081 - protein, 16 aa, Entamoeba histolytica
NECDSITTKSLKKDNN

SEQ ID NO: 2641082 - protein, 8 aa, Entamoeba histolytica
NECSNERL

SEQ ID NO: 2641083 - protein, 9 aa, Entamoeba histolytica
NECTTTEDA

SEQ ID NO: 2641084 - protein, 6 aa, Entamoeba histolytica
NEDAQE

SEQ ID NO: 2641085 - protein, 4 aa, Entamoeba histolytica
NEDD

SEQ ID NO: 2641086 - protein, 6 aa, Entamoeba histolytica
NEDDAR

SEQ ID NO: 2641087 - protein, 11 aa, Entamoeba histolytica
NEDDKKLKQKH

SEQ ID NO: 2641088 - protein, 7 aa, Entamoeba histolytica
NEDDTLS

SEQ ID NO: 2641089 - protein, 10 aa, Entamoeba histolytica
NEDDTSLSNW

SEQ ID NO: 2641090 - protein, 4 aa, Entamoeba histolytica
NEDE

SEQ ID NO: 2641091 - protein, 14 aa, Entamoeba histolytica
NEDEFSSHYRRKRG

SEQ ID NO: 2641092 - protein, 4 aa, Entamoeba histolytica
NEDG

SEQ ID NO: 2641093 - protein, 5 aa, Entamoeba histolytica
NEDGA

SEQ ID NO: 2641094 - protein, 7 aa, Entamoeba histolytica
NEDGEIQ

SEQ ID NO: 2641095 - protein, 11 aa, Entamoeba histolytica
NEDGEKEWNEY

SEQ ID NO: 2641096 - protein, 17 aa, Entamoeba histolytica
NEDGSFEVSAQEDIRKS

SEQ ID NO: 2641097 - protein, 5 aa, Entamoeba histolytica
NEDHP

SEQ ID NO: 2641098 - protein, 41 aa, Entamoeba histolytica
NEDINDITEENDMSEISNEENEENEENEENEEENKEKKEFR

SEQ ID NO: 2641099 - protein, 6 aa, Entamoeba histolytica
NEDIRK

SEQ ID NO: 2641100 - protein, 7 aa, Entamoeba histolytica
NEDKEER

SEQ ID NO: 2641101 - protein, 5 aa, Entamoeba histolytica
NEDKI

SEQ ID NO: 2641102 - protein, 5 aa, Entamoeba histolytica
NEDKK

SEQ ID NO: 2641103 - protein, 15 aa, Entamoeba histolytica
NEDKRPFKNPVSKPC

SEQ ID NO: 2641104 - protein, 20 aa, Entamoeba histolytica
NEDKVTTENRDELKSQNDRN

SEQ ID NO: 2641105 - protein, 12 aa, Entamoeba histolytica
NEDLKKKQKEIL

SEQ ID NO: 2641106 - protein, 7 aa, Entamoeba histolytica
NEDNDDV

SEQ ID NO: 2641107 - protein, 24 aa, Entamoeba histolytica
NEDNETTNSKNNFNSESKASTKLR

SEQ ID NO: 2641108 - protein, 8 aa, Entamoeba histolytica
NEDPEGDP

SEQ ID NO: 2641109 - protein, 9 aa, Entamoeba histolytica
NEDPESKKK

SEQ ID NO: 2641110 - protein, 10 aa, Entamoeba histolytica
NEDQAQTAIT

SEQ ID NO: 2641111 - protein, 10 aa, Entamoeba histolytica
NEDRDINKEP

SEQ ID NO: 2641112 - protein, 18 aa, Entamoeba histolytica
NEDRKNDIKETTASERLK

SEQ ID NO: 2641113 - protein, 13 aa, Entamoeba histolytica
NEDRLRSTKHRPL

SEQ ID NO: 2641114 - protein, 11 aa, Entamoeba histolytica
NEDRMKAEEEV

SEQ ID NO: 2641115 - protein, 7 aa, Entamoeba histolytica
NEDRSMI

SEQ ID NO: 2641116 - protein, 14 aa, Entamoeba histolytica
NEDSESSNDESYES

SEQ ID NO: 2641117 - protein, 5 aa, Entamoeba histolytica
NEDTI

SEQ ID NO: 2641118 - protein, 7 aa, Entamoeba histolytica
NEDTKYR

SEQ ID NO: 2641119 - protein, 8 aa, Entamoeba histolytica
NEDVRTDE

SEQ ID NO: 2641120 - protein, 5 aa, Entamoeba histolytica
NEDWA

SEQ ID NO: 2641121 - protein, 8 aa, Entamoeba histolytica
NEDYSDQK

SEQ ID NO: 2641122 - protein, 12 aa, Entamoeba histolytica
NEEATKAAINDD

SEQ ID NO: 2641123 - protein, 5 aa, Entamoeba histolytica
NEECD

SEQ ID NO: 2641124 - protein, 6 aa, Entamoeba histolytica
NEEDAF

SEQ ID NO: 2641125 - protein, 9 aa, Entamoeba histolytica
NEEDEKNVD

SEQ ID NO: 2641126 - protein, 7 aa, Entamoeba histolytica
NEEDKEY

SEQ ID NO: 2641127 - protein, 8 aa, Entamoeba histolytica
NEEDSQSF

SEQ ID NO: 2641128 - protein, 6 aa, Entamoeba histolytica
NEEDTQ

SEQ ID NO: 2641129 - protein, 5 aa, Entamoeba histolytica
NEEEA

SEQ ID NO: 2641130 - protein, 18 aa, Entamoeba histolytica
NEEEDDEYCSRCSNPGIF

SEQ ID NO: 2641131 - protein, 14 aa, Entamoeba histolytica
NEEEDDKDEGINKA

SEQ ID NO: 2641132 - protein, 37 aa, Entamoeba histolytica
NEEEDDSMEEEYEDFSDDAPPEHQPFGGKDNDMNIIY

SEQ ID NO: 2641133 - protein, 13 aa, Entamoeba histolytica
NEEEEEEDDDDWS

SEQ ID NO: 2641134 - protein, 28 aa, Entamoeba histolytica
NEEEGKKEKIKESEESTTSESESGSTSE

SEQ ID NO: 2641135 - protein, 7 aa, Entamoeba histolytica
NEEEHTC

SEQ ID NO: 2641136 - protein, 46 aa, Entamoeba histolytica
NEEEKAKFKPKPRVGPKGKLAKKEEEPPKEEVKEEKKEEVTKEEKE

SEQ ID NO: 2641137 - protein, 6 aa, Entamoeba histolytica
NEEEKD

SEQ ID NO: 2641138 - protein, 7 aa, Entamoeba histolytica
NEEEKGD

SEQ ID NO: 2641139 - protein, 7 aa, Entamoeba histolytica
NEEEKKL

SEQ ID NO: 2641140 - protein, 7 aa, Entamoeba histolytica
NEEEKRD

SEQ ID NO: 2641141 - protein, 30 aa, Entamoeba histolytica
NEEEKRRNNTVIKTRKDSNTEIRSGGDEKV

SEQ ID NO: 2641142 - protein, 10 aa, Entamoeba histolytica
NEEEKTRKQF

SEQ ID NO: 2641143 - protein, 5 aa, Entamoeba histolytica
NEEEL

SEQ ID NO: 2641144 - protein, 6 aa, Entamoeba histolytica
NEEELN

SEQ ID NO: 2641145 - protein, 12 aa, Entamoeba histolytica
NEEEPECCSREN

SEQ ID NO: 2641146 - protein, 7 aa, Entamoeba histolytica
NEEEPKK

SEQ ID NO: 2641147 - protein, 38 aa, Entamoeba histolytica
NEEEQNESEEGVEEEQNEDGMEKEKKVVEQKTPKTRTF

SEQ ID NO: 2641148 - protein, 7 aa, Entamoeba histolytica
NEEESGL

SEQ ID NO: 2641149 - protein, 6 aa, Entamoeba histolytica
NEEETP

SEQ ID NO: 2641150 - protein, 9 aa, Entamoeba histolytica
NEEETSGNI

SEQ ID NO: 2641151 - protein, 12 aa, Entamoeba histolytica
NEEEVKERFKQR

SEQ ID NO: 2641152 - protein, 6 aa, Entamoeba histolytica
NEEEVL

SEQ ID NO: 2641153 - protein, 7 aa, Entamoeba histolytica
NEEGCDL

SEQ ID NO: 2641154 - protein, 9 aa, Entamoeba histolytica
NEEGDFEMK

SEQ ID NO: 2641155 - protein, 7 aa, Entamoeba histolytica
NEEGEEG

SEQ ID NO: 2641156 - protein, 17 aa, Entamoeba histolytica
NEEGEVKYNTRSKDSAI

SEQ ID NO: 2641157 - protein, 5 aa, Entamoeba histolytica
NEEGI

SEQ ID NO: 2641158 - protein, 6 aa, Entamoeba histolytica
NEEGKV

SEQ ID NO: 2641159 - protein, 8 aa, Entamoeba histolytica
NEEGTRLE

SEQ ID NO: 2641160 - protein, 9 aa, Entamoeba histolytica
NEEGVQQAE

SEQ ID NO: 2641161 - protein, 14 aa, Entamoeba histolytica
NEEGYHKGFSLQID

SEQ ID NO: 2641162 - protein, 4 aa, Entamoeba histolytica
NEEI

SEQ ID NO: 2641163 - protein, 6 aa, Entamoeba histolytica
NEEIET

SEQ ID NO: 2641164 - protein, 6 aa, Entamoeba histolytica
NEEIKQ

SEQ ID NO: 2641165 - protein, 15 aa, Entamoeba histolytica
NEEIKQGEFKGDEKL

SEQ ID NO: 2641166 - protein, 14 aa, Entamoeba histolytica
NEEKAKADKENEKK

SEQ ID NO: 2641167 - protein, 21 aa, Entamoeba histolytica
NEEKAKKAFDEYKAKYDGKYK

SEQ ID NO: 2641168 - protein, 8 aa, Entamoeba histolytica
NEEKCEEQ

SEQ ID NO: 2641169 - protein, 8 aa, Entamoeba histolytica
NEEKDTQL

SEQ ID NO: 2641170 - protein, 28 aa, Entamoeba histolytica
NEEKEDEEEISHSSSTSSSDKIDKDNAE

SEQ ID NO: 2641171 - protein, 7 aa, Entamoeba histolytica
NEEKHQL

SEQ ID NO: 2641172 - protein, 13 aa, Entamoeba histolytica
NEEKKKLKNKKRK

SEQ ID NO: 2641173 - protein, 66 aa, Entamoeba histolytica
NEEKLDIEPKKDIKEEVKPEEEHKEEEHKEEKPEEVKPEEVKPEEVKPEEVKPEEEKKNESNEQQK

SEQ ID NO: 2641174 - protein, 5 aa, Entamoeba histolytica
NEEKN

SEQ ID NO: 2641175 - protein, 7 aa, Entamoeba histolytica
NEEKRKK

SEQ ID NO: 2641176 - protein, 26 aa, Entamoeba histolytica
NEELETTEGEIENTEVQKKESNSDGM

SEQ ID NO: 2641177 - protein, 7 aa, Entamoeba histolytica
NEELKGE

SEQ ID NO: 2641178 - protein, 17 aa, Entamoeba histolytica
NEELTQTKQEKEEINNE

SEQ ID NO: 2641179 - protein, 29 aa, Entamoeba histolytica
NEELTQTKQEKEEIQKALEEEKEKLERIE

SEQ ID NO: 2641180 - protein, 14 aa, Entamoeba histolytica
NEELTQTKQEKENV

SEQ ID NO: 2641181 - protein, 5 aa, Entamoeba histolytica
NEELY

SEQ ID NO: 2641182 - protein, 5 aa, Entamoeba histolytica
NEEMK

SEQ ID NO: 2641183 - protein, 22 aa, Entamoeba histolytica
NEENAKKAVEEMNGRGVEGGEL

SEQ ID NO: 2641184 - protein, 6 aa, Entamoeba histolytica
NEENEY

SEQ ID NO: 2641185 - protein, 10 aa, Entamoeba histolytica
NEENGEPELI

SEQ ID NO: 2641186 - protein, 22 aa, Entamoeba histolytica
NEENGEPELINDKNESTSTSED

SEQ ID NO: 2641187 - protein, 7 aa, Entamoeba histolytica
NEENGID

SEQ ID NO: 2641188 - protein, 9 aa, Entamoeba histolytica
NEENIKNPF

SEQ ID NO: 2641189 - protein, 14 aa, Entamoeba histolytica
NEENKGRTEEEEFQ

SEQ ID NO: 2641190 - protein, 6 aa, Entamoeba histolytica
NEENNS

SEQ ID NO: 2641191 - protein, 12 aa, Entamoeba histolytica
NEENQEEKRYEK

SEQ ID NO: 2641192 - protein, 8 aa, Entamoeba histolytica
NEENQKKR

SEQ ID NO: 2641193 - protein, 9 aa, Entamoeba histolytica
NEENRTSEN

SEQ ID NO: 2641194 - protein, 5 aa, Entamoeba histolytica
NEENS

SEQ ID NO: 2641195 - protein, 17 aa, Entamoeba histolytica
NEENSKDKNKEIKEITD

SEQ ID NO: 2641196 - protein, 7 aa, Entamoeba histolytica
NEENSNI

SEQ ID NO: 2641197 - protein, 9 aa, Entamoeba histolytica
NEENTQDGN

SEQ ID NO: 2641198 - protein, 6 aa, Entamoeba histolytica
NEEPKA

SEQ ID NO: 2641199 - protein, 15 aa, Entamoeba histolytica
NEEPSVPYSSMFEGI

SEQ ID NO: 2641200 - protein, 5 aa, Entamoeba histolytica
NEEQE

SEQ ID NO: 2641201 - protein, 10 aa, Entamoeba histolytica
NEEQKKEINR

SEQ ID NO: 2641202 - protein, 19 aa, Entamoeba histolytica
NEEQNSQLPPATTQNDISQ

SEQ ID NO: 2641203 - protein, 5 aa, Entamoeba histolytica
NEEQR

SEQ ID NO: 2641204 - protein, 10 aa, Entamoeba histolytica
NEEQSKKELI

SEQ ID NO: 2641205 - protein, 7 aa, Entamoeba histolytica
NEEQTKF

SEQ ID NO: 2641206 - protein, 4 aa, Entamoeba histolytica
NEER

SEQ ID NO: 2641207 - protein, 6 aa, Entamoeba histolytica
NEERIT

SEQ ID NO: 2641208 - protein, 6 aa, Entamoeba histolytica
NEERTN

SEQ ID NO: 2641209 - protein, 10 aa, Entamoeba histolytica
NEERVSKGIE

SEQ ID NO: 2641210 - protein, 9 aa, Entamoeba histolytica
NEESDRDSW

SEQ ID NO: 2641211 - protein, 6 aa, Entamoeba histolytica
NEESEL

SEQ ID NO: 2641212 - protein, 10 aa, Entamoeba histolytica
NEESENNTKN

SEQ ID NO: 2641213 - protein, 7 aa, Entamoeba histolytica
NEESNIH

SEQ ID NO: 2641214 - protein, 10 aa, Entamoeba histolytica
NEESQIKGKK

SEQ ID NO: 2641215 - protein, 11 aa, Entamoeba histolytica
NEESSNDPLNA

SEQ ID NO: 2641216 - protein, 12 aa, Entamoeba histolytica
NEESSSSNLGGL

SEQ ID NO: 2641217 - protein, 11 aa, Entamoeba histolytica
NEESTYKFPSP

SEQ ID NO: 2641218 - protein, 9 aa, Entamoeba histolytica
NEETGSVTV

SEQ ID NO: 2641219 - protein, 9 aa, Entamoeba histolytica
NEETKIGEP

SEQ ID NO: 2641220 - protein, 9 aa, Entamoeba histolytica
NEETKMERN

SEQ ID NO: 2641221 - protein, 6 aa, Entamoeba histolytica
NEETKN

SEQ ID NO: 2641222 - protein, 14 aa, Entamoeba histolytica
NEETKNAFNENGKQ

SEQ ID NO: 2641223 - protein, 8 aa, Entamoeba histolytica
NEETNDVE

SEQ ID NO: 2641224 - protein, 16 aa, Entamoeba histolytica
NEETPIDDNNETKTSV

SEQ ID NO: 2641225 - protein, 11 aa, Entamoeba histolytica
NEETQNENDNS

SEQ ID NO: 2641226 - protein, 9 aa, Entamoeba histolytica
NEEVEERQR

SEQ ID NO: 2641227 - protein, 16 aa, Entamoeba histolytica
NEEVNEDNTSPKQEVR

SEQ ID NO: 2641228 - protein, 5 aa, Entamoeba histolytica
NEEYK

SEQ ID NO: 2641229 - protein, 6 aa, Entamoeba histolytica
NEEYKR

SEQ ID NO: 2641230 - protein, 11 aa, Entamoeba histolytica
NEEYNQKKNEV

SEQ ID NO: 2641231 - protein, 5 aa, Entamoeba histolytica
NEEYR

SEQ ID NO: 2641232 - protein, 13 aa, Entamoeba histolytica
NEFDGEKVNNELD

SEQ ID NO: 2641233 - protein, 7 aa, Entamoeba histolytica
NEFEKEN

SEQ ID NO: 2641234 - protein, 7 aa, Entamoeba histolytica
NEFEPEK

SEQ ID NO: 2641235 - protein, 9 aa, Entamoeba histolytica
NEFEQQESI

SEQ ID NO: 2641236 - protein, 17 aa, Entamoeba histolytica
NEFFGEGSDLQESEGTQ

SEQ ID NO: 2641237 - protein, 8 aa, Entamoeba histolytica
NEFGNEEG

SEQ ID NO: 2641238 - protein, 7 aa, Entamoeba histolytica
NEFKGKP

SEQ ID NO: 2641239 - protein, 13 aa, Entamoeba histolytica
NEFKGRMKKKNVE

SEQ ID NO: 2641240 - protein, 6 aa, Entamoeba histolytica
NEFKPE

SEQ ID NO: 2641241 - protein, 7 aa, Entamoeba histolytica
NEFKSKK

SEQ ID NO: 2641242 - protein, 9 aa, Entamoeba histolytica
NEFPSSQYY

SEQ ID NO: 2641243 - protein, 11 aa, Entamoeba histolytica
NEFQKCQTKKL

SEQ ID NO: 2641244 - protein, 10 aa, Entamoeba histolytica
NEFSNPKITA

SEQ ID NO: 2641245 - protein, 14 aa, Entamoeba histolytica
NEGAKTSVVFRMGS

SEQ ID NO: 2641246 - protein, 5 aa, Entamoeba histolytica
NEGDR

SEQ ID NO: 2641247 - protein, 5 aa, Entamoeba histolytica
NEGEC

SEQ ID NO: 2641248 - protein, 8 aa, Entamoeba histolytica
NEGEETEE

SEQ ID NO: 2641249 - protein, 8 aa, Entamoeba histolytica
NEGEGNPI

SEQ ID NO: 2641250 - protein, 5 aa, Entamoeba histolytica
NEGEI

SEQ ID NO: 2641251 - protein, 14 aa, Entamoeba histolytica
NEGEVQQNSPQIEL

SEQ ID NO: 2641252 - protein, 11 aa, Entamoeba histolytica
NEGINNNITNV

SEQ ID NO: 2641253 - protein, 9 aa, Entamoeba histolytica
NEGKASEYG

SEQ ID NO: 2641254 - protein, 8 aa, Entamoeba histolytica
NEGKGTKI

SEQ ID NO: 2641255 - protein, 5 aa, Entamoeba histolytica
NEGKN

SEQ ID NO: 2641256 - protein, 4 aa, Entamoeba histolytica
NEGN

SEQ ID NO: 2641257 - protein, 12 aa, Entamoeba histolytica
NEGNEGSRLSHD

SEQ ID NO: 2641258 - protein, 5 aa, Entamoeba histolytica
NEGNI

SEQ ID NO: 2641259 - protein, 10 aa, Entamoeba histolytica
NEGRNGSAVD

SEQ ID NO: 2641260 - protein, 6 aa, Entamoeba histolytica
NEGSHQ

SEQ ID NO: 2641261 - protein, 8 aa, Entamoeba histolytica
NEGSIEEL

SEQ ID NO: 2641262 - protein, 5 aa, Entamoeba histolytica
NEGSQ

SEQ ID NO: 2641263 - protein, 6 aa, Entamoeba histolytica
NEGTSH

SEQ ID NO: 2641264 - protein, 5 aa, Entamoeba histolytica
NEGTT

SEQ ID NO: 2641265 - protein, 5 aa, Entamoeba histolytica
NEGVE

SEQ ID NO: 2641266 - protein, 10 aa, Entamoeba histolytica
NEGYDEAQER

SEQ ID NO: 2641267 - protein, 15 aa, Entamoeba histolytica
NEGYEGDDIEEETEL

SEQ ID NO: 2641268 - protein, 8 aa, Entamoeba histolytica
NEHDPKRK

SEQ ID NO: 2641269 - protein, 17 aa, Entamoeba histolytica
NEHEGGDKKKKKKEQTI

SEQ ID NO: 2641270 - protein, 7 aa, Entamoeba histolytica
NEHEREI

SEQ ID NO: 2641271 - protein, 7 aa, Entamoeba histolytica
NEHETQR

SEQ ID NO: 2641272 - protein, 8 aa, Entamoeba histolytica
NEHGKVSV

SEQ ID NO: 2641273 - protein, 9 aa, Entamoeba histolytica
NEHGWSGEQ

SEQ ID NO: 2641274 - protein, 17 aa, Entamoeba histolytica
NEHKENIEKQMNETKDA

SEQ ID NO: 2641275 - protein, 19 aa, Entamoeba histolytica
NEHKSVSSWRGIPNQGISK

SEQ ID NO: 2641276 - protein, 8 aa, Entamoeba histolytica
NEHNSDVK

SEQ ID NO: 2641277 - protein, 6 aa, Entamoeba histolytica
NEHPDK

SEQ ID NO: 2641278 - protein, 14 aa, Entamoeba histolytica
NEHPNEKCSSNDIS

SEQ ID NO: 2641279 - protein, 7 aa, Entamoeba histolytica
NEHRYEK

SEQ ID NO: 2641280 - protein, 5 aa, Entamoeba histolytica
NEHSA

SEQ ID NO: 2641281 - protein, 8 aa, Entamoeba histolytica
NEIDDEPD

SEQ ID NO: 2641282 - protein, 6 aa, Entamoeba histolytica
NEIDGK

SEQ ID NO: 2641283 - protein, 8 aa, Entamoeba histolytica
NEIDSSEI

SEQ ID NO: 2641284 - protein, 6 aa, Entamoeba histolytica
NEIEDQ

SEQ ID NO: 2641285 - protein, 11 aa, Entamoeba histolytica
NEIEKEGNEYT

SEQ ID NO: 2641286 - protein, 6 aa, Entamoeba histolytica
NEIEPN

SEQ ID NO: 2641287 - protein, 8 aa, Entamoeba histolytica
NEIEPSSG

SEQ ID NO: 2641288 - protein, 24 aa, Entamoeba histolytica
NEIEQTSKQLDENREKVKNNENYT

SEQ ID NO: 2641289 - protein, 6 aa, Entamoeba histolytica
NEIERI

SEQ ID NO: 2641290 - protein, 18 aa, Entamoeba histolytica
NEIETEKKKEKVQETKSI

SEQ ID NO: 2641291 - protein, 4 aa, Entamoeba histolytica
NEIG

SEQ ID NO: 2641292 - protein, 6 aa, Entamoeba histolytica
NEIGEE

SEQ ID NO: 2641293 - protein, 12 aa, Entamoeba histolytica
NEIGGEVQGEEY

SEQ ID NO: 2641294 - protein, 11 aa, Entamoeba histolytica
NEIHPSPSIKA

SEQ ID NO: 2641295 - protein, 21 aa, Entamoeba histolytica
NEIINEKPQGQQQKEEDTISE

SEQ ID NO: 2641296 - protein, 9 aa, Entamoeba histolytica
NEIKDGNIE

SEQ ID NO: 2641297 - protein, 13 aa, Entamoeba histolytica
NEIKEEKEQINKY

SEQ ID NO: 2641298 - protein, 22 aa, Entamoeba histolytica
NEIKEGQKKLNELKEQKEHQQV

SEQ ID NO: 2641299 - protein, 6 aa, Entamoeba histolytica
NEIKHQ

SEQ ID NO: 2641300 - protein, 20 aa, Entamoeba histolytica
NEIKKEVDKDTHKQEGSGIP

SEQ ID NO: 2641301 - protein, 12 aa, Entamoeba histolytica
NEIKPIDTNGIR

SEQ ID NO: 2641302 - protein, 28 aa, Entamoeba histolytica
NEIKRQEEQKASLEKENNIQKSTIEQNS

SEQ ID NO: 2641303 - protein, 6 aa, Entamoeba histolytica
NEINEH

SEQ ID NO: 2641304 - protein, 9 aa, Entamoeba histolytica
NEINEKGGI

SEQ ID NO: 2641305 - protein, 14 aa, Entamoeba histolytica
NEINENKRKFENKT

SEQ ID NO: 2641306 - protein, 5 aa, Entamoeba histolytica
NEINP

SEQ ID NO: 2641307 - protein, 13 aa, Entamoeba histolytica
NEINSLKEKVSSL

SEQ ID NO: 2641308 - protein, 10 aa, Entamoeba histolytica
NEINSPQMEE

SEQ ID NO: 2641309 - protein, 4 aa, Entamoeba histolytica
NEIP

SEQ ID NO: 2641310 - protein, 8 aa, Entamoeba histolytica
NEIPKDHR

SEQ ID NO: 2641311 - protein, 7 aa, Entamoeba histolytica
NEIPPPI

SEQ ID NO: 2641312 - protein, 5 aa, Entamoeba histolytica
NEIPS

SEQ ID NO: 2641313 - protein, 4 aa, Entamoeba histolytica
NEIQ

SEQ ID NO: 2641314 - protein, 5 aa, Entamoeba histolytica
NEIQE

SEQ ID NO: 2641315 - protein, 8 aa, Entamoeba histolytica
NEIQEKNK

SEQ ID NO: 2641316 - protein, 5 aa, Entamoeba histolytica
NEIQS

SEQ ID NO: 2641317 - protein, 12 aa, Entamoeba histolytica
NEISGSNEEKIR

SEQ ID NO: 2641318 - protein, 19 aa, Entamoeba histolytica
NEISSTPFSSQNIKSTPEF

SEQ ID NO: 2641319 - protein, 5 aa, Entamoeba histolytica
NEITN

SEQ ID NO: 2641320 - protein, 6 aa, Entamoeba histolytica
NEITQL

SEQ ID NO: 2641321 - protein, 4 aa, Entamoeba histolytica
NEKA

SEQ ID NO: 2641322 - protein, 8 aa, Entamoeba histolytica
NEKANRKN

SEQ ID NO: 2641323 - protein, 15 aa, Entamoeba histolytica
NEKAPEPNKKKKNEE

SEQ ID NO: 2641324 - protein, 4 aa, Entamoeba histolytica
NEKC

SEQ ID NO: 2641325 - protein, 7 aa, Entamoeba histolytica
NEKDGCE

SEQ ID NO: 2641326 - protein, 9 aa, Entamoeba histolytica
NEKDGDDKI

SEQ ID NO: 2641327 - protein, 14 aa, Entamoeba histolytica
NEKDIENTKELQKL

SEQ ID NO: 2641328 - protein, 10 aa, Entamoeba histolytica
NEKDKREKEI

SEQ ID NO: 2641329 - protein, 9 aa, Entamoeba histolytica
NEKDNKNII

SEQ ID NO: 2641330 - protein, 9 aa, Entamoeba histolytica
NEKDPKTYI

SEQ ID NO: 2641331 - protein, 8 aa, Entamoeba histolytica
NEKDPNIL

SEQ ID NO: 2641332 - protein, 7 aa, Entamoeba histolytica
NEKDQDV

SEQ ID NO: 2641333 - protein, 8 aa, Entamoeba histolytica
NEKDTQEF

SEQ ID NO: 2641334 - protein, 4 aa, Entamoeba histolytica
NEKE

SEQ ID NO: 2641335 - protein, 5 aa, Entamoeba histolytica
NEKEE

SEQ ID NO: 2641336 - protein, 7 aa, Entamoeba histolytica
NEKEEEL

SEQ ID NO: 2641337 - protein, 6 aa, Entamoeba histolytica
NEKEEI

SEQ ID NO: 2641338 - protein, 7 aa, Entamoeba histolytica
NEKEENT

SEQ ID NO: 2641339 - protein, 6 aa, Entamoeba histolytica
NEKEEW

SEQ ID NO: 2641340 - protein, 6 aa, Entamoeba histolytica
NEKEIE

SEQ ID NO: 2641341 - protein, 7 aa, Entamoeba histolytica
NEKEIGE

SEQ ID NO: 2641342 - protein, 6 aa, Entamoeba histolytica
NEKEIK

SEQ ID NO: 2641343 - protein, 40 aa, Entamoeba histolytica
NEKEINSPFKSSENLSETSKQIKNDENNTKSTKELKESEE

SEQ ID NO: 2641344 - protein, 10 aa, Entamoeba histolytica
NEKEKAEEVA

SEQ ID NO: 2641345 - protein, 7 aa, Entamoeba histolytica
NEKEKDI

SEQ ID NO: 2641346 - protein, 9 aa, Entamoeba histolytica
NEKEKHNTY

SEQ ID NO: 2641347 - protein, 7 aa, Entamoeba histolytica
NEKEKKN

SEQ ID NO: 2641348 - protein, 6 aa, Entamoeba histolytica
NEKEKR

SEQ ID NO: 2641349 - protein, 5 aa, Entamoeba histolytica
NEKEM

SEQ ID NO: 2641350 - protein, 29 aa, Entamoeba histolytica
NEKEPENIHPCGSKTDPIKIDDFDIENHE

SEQ ID NO: 2641351 - protein, 11 aa, Entamoeba histolytica
NEKEQSQFENY

SEQ ID NO: 2641352 - protein, 20 aa, Entamoeba histolytica
NEKERKKLEKKKKREEEEKA

SEQ ID NO: 2641353 - protein, 8 aa, Entamoeba histolytica
NEKESNQL

SEQ ID NO: 2641354 - protein, 9 aa, Entamoeba histolytica
NEKESREEN

SEQ ID NO: 2641355 - protein, 16 aa, Entamoeba histolytica
NEKEVQNIEETTQLTK

SEQ ID NO: 2641356 - protein, 8 aa, Entamoeba histolytica
NEKGVIGE

SEQ ID NO: 2641357 - protein, 6 aa, Entamoeba histolytica
NEKGYI

SEQ ID NO: 2641358 - protein, 7 aa, Entamoeba histolytica
NEKHENG

SEQ ID NO: 2641359 - protein, 10 aa, Entamoeba histolytica
NEKINSMGSK

SEQ ID NO: 2641360 - protein, 8 aa, Entamoeba histolytica
NEKIPSYN

SEQ ID NO: 2641361 - protein, 5 aa, Entamoeba histolytica
NEKIT

SEQ ID NO: 2641362 - protein, 7 aa, Entamoeba histolytica
NEKITDQ

SEQ ID NO: 2641363 - protein, 4 aa, Entamoeba histolytica
NEKK

SEQ ID NO: 2641364 - protein, 6 aa, Entamoeba histolytica
NEKKDL

SEQ ID NO: 2641365 - protein, 8 aa, Entamoeba histolytica
NEKKDSNH

SEQ ID NO: 2641366 - protein, 10 aa, Entamoeba histolytica
NEKKESNIKT

SEQ ID NO: 2641367 - protein, 8 aa, Entamoeba histolytica
NEKKEYND

SEQ ID NO: 2641368 - protein, 21 aa, Entamoeba histolytica
NEKKIESIRNEINSKERELGT

SEQ ID NO: 2641369 - protein, 5 aa, Entamoeba histolytica
NEKKK

SEQ ID NO: 2641370 - protein, 11 aa, Entamoeba histolytica
NEKKKAERVKT

SEQ ID NO: 2641371 - protein, 7 aa, Entamoeba histolytica
NEKKKER

SEQ ID NO: 2641372 - protein, 9 aa, Entamoeba histolytica
NEKKSNDAM

SEQ ID NO: 2641373 - protein, 14 aa, Entamoeba histolytica
NEKKSQKKRKEEGL

SEQ ID NO: 2641374 - protein, 4 aa, Entamoeba histolytica
NEKL

SEQ ID NO: 2641375 - protein, 8 aa, Entamoeba histolytica
NEKLDSIS

SEQ ID NO: 2641376 - protein, 9 aa, Entamoeba histolytica
NEKLGTTLE

SEQ ID NO: 2641377 - protein, 7 aa, Entamoeba histolytica
NEKLQER

SEQ ID NO: 2641378 - protein, 7 aa, Entamoeba histolytica
NEKNETM

SEQ ID NO: 2641379 - protein, 20 aa, Entamoeba histolytica
NEKNRAAKSPVIVIDVDEPK

SEQ ID NO: 2641380 - protein, 8 aa, Entamoeba histolytica
NEKPEDRC

SEQ ID NO: 2641381 - protein, 13 aa, Entamoeba histolytica
NEKPIKSKNNIKL

SEQ ID NO: 2641382 - protein, 7 aa, Entamoeba histolytica
NEKPIQS

SEQ ID NO: 2641383 - protein, 8 aa, Entamoeba histolytica
NEKPKKEV

SEQ ID NO: 2641384 - protein, 17 aa, Entamoeba histolytica
NEKPKVDLRVEDTDYDD

SEQ ID NO: 2641385 - protein, 7 aa, Entamoeba histolytica
NEKPNIP

SEQ ID NO: 2641386 - protein, 9 aa, Entamoeba histolytica
NEKQINDSH

SEQ ID NO: 2641387 - protein, 8 aa, Entamoeba histolytica
NEKQMEQN

SEQ ID NO: 2641388 - protein, 5 aa, Entamoeba histolytica
NEKQQ

SEQ ID NO: 2641389 - protein, 27 aa, Entamoeba histolytica
NEKQQIKKEESMMRKSGNFENISEQTK

SEQ ID NO: 2641390 - protein, 13 aa, Entamoeba histolytica
NEKQQTKIPTPIT

SEQ ID NO: 2641391 - protein, 21 aa, Entamoeba histolytica
NEKSAMEQSRSNGMNEMSDDD

SEQ ID NO: 2641392 - protein, 7 aa, Entamoeba histolytica
NEKSKDH

SEQ ID NO: 2641393 - protein, 7 aa, Entamoeba histolytica
NEKTEKK

SEQ ID NO: 2641394 - protein, 8 aa, Entamoeba histolytica
NEKTENIE

SEQ ID NO: 2641395 - protein, 7 aa, Entamoeba histolytica
NEKTIGE

SEQ ID NO: 2641396 - protein, 5 aa, Entamoeba histolytica
NEKTK

SEQ ID NO: 2641397 - protein, 8 aa, Entamoeba histolytica
NEKTKGQL

SEQ ID NO: 2641398 - protein, 8 aa, Entamoeba histolytica
NEKTNKKW

SEQ ID NO: 2641399 - protein, 14 aa, Entamoeba histolytica
NEKTPSVESIEKGL

SEQ ID NO: 2641400 - protein, 15 aa, Entamoeba histolytica
NEKTRLKEEEERYEI

SEQ ID NO: 2641401 - protein, 13 aa, Entamoeba histolytica
NEKTTGATKQIDK

SEQ ID NO: 2641402 - protein, 5 aa, Entamoeba histolytica
NEKVT

SEQ ID NO: 2641403 - protein, 6 aa, Entamoeba histolytica
NEKVTI

SEQ ID NO: 2641404 - protein, 4 aa, Entamoeba histolytica
NEKY

SEQ ID NO: 2641405 - protein, 23 aa, Entamoeba histolytica
NEKYEDIKDDDTEKYQDENENSL

SEQ ID NO: 2641406 - protein, 9 aa, Entamoeba histolytica
NEKYPRTNA

SEQ ID NO: 2641407 - protein, 6 aa, Entamoeba histolytica
NEKYQP

SEQ ID NO: 2641408 - protein, 12 aa, Entamoeba histolytica
NELAQMKSEDQL

SEQ ID NO: 2641409 - protein, 9 aa, Entamoeba histolytica
NELAQSEAY

SEQ ID NO: 2641410 - protein, 5 aa, Entamoeba histolytica
NELAT

SEQ ID NO: 2641411 - protein, 7 aa, Entamoeba histolytica
NELDEFP

SEQ ID NO: 2641412 - protein, 10 aa, Entamoeba histolytica
NELDNNKKST

SEQ ID NO: 2641413 - protein, 7 aa, Entamoeba histolytica
NELDPNL

SEQ ID NO: 2641414 - protein, 10 aa, Entamoeba histolytica
NELGNASGEL

SEQ ID NO: 2641415 - protein, 11 aa, Entamoeba histolytica
NELGNEKNEMS

SEQ ID NO: 2641416 - protein, 4 aa, Entamoeba histolytica
NELK

SEQ ID NO: 2641417 - protein, 6 aa, Entamoeba histolytica
NELKEE

SEQ ID NO: 2641418 - protein, 23 aa, Entamoeba histolytica
NELKEEKMKNENSIEASKQQNEL

SEQ ID NO: 2641419 - protein, 14 aa, Entamoeba histolytica
NELKENNDNNKENI

SEQ ID NO: 2641420 - protein, 12 aa, Entamoeba histolytica
NELKNNSQSSIR

SEQ ID NO: 2641421 - protein, 17 aa, Entamoeba histolytica
NELKSKDIQTKTVLIES

SEQ ID NO: 2641422 - protein, 9 aa, Entamoeba histolytica
NELNAQNEE

SEQ ID NO: 2641423 - protein, 13 aa, Entamoeba histolytica
NELNESGKMSIQD

SEQ ID NO: 2641424 - protein, 16 aa, Entamoeba histolytica
NELNETESSDDEGEDL

SEQ ID NO: 2641425 - protein, 8 aa, Entamoeba histolytica
NELNNGVE

SEQ ID NO: 2641426 - protein, 5 aa, Entamoeba histolytica
NELNT

SEQ ID NO: 2641427 - protein, 5 aa, Entamoeba histolytica
NELPP

SEQ ID NO: 2641428 - protein, 4 aa, Entamoeba histolytica
NELQ

SEQ ID NO: 2641429 - protein, 16 aa, Entamoeba histolytica
NELQEKEFRKGKSNIG

SEQ ID NO: 2641430 - protein, 24 aa, Entamoeba histolytica
NELSAQNEEIKQKFEESKNDIKSY

SEQ ID NO: 2641431 - protein, 5 aa, Entamoeba histolytica
NELSE

SEQ ID NO: 2641432 - protein, 11 aa, Entamoeba histolytica
NELSEAPNRTV

SEQ ID NO: 2641433 - protein, 10 aa, Entamoeba histolytica
NELSEKTSYD

SEQ ID NO: 2641434 - protein, 13 aa, Entamoeba histolytica
NELSPNNINKEYT

SEQ ID NO: 2641435 - protein, 11 aa, Entamoeba histolytica
NELSSNKTVLN

SEQ ID NO: 2641436 - protein, 8 aa, Entamoeba histolytica
NELTDNED

SEQ ID NO: 2641437 - protein, 9 aa, Entamoeba histolytica
NELTQKQQT

SEQ ID NO: 2641438 - protein, 14 aa, Entamoeba histolytica
NELTQTKDDQSELI

SEQ ID NO: 2641439 - protein, 58 aa, Entamoeba histolytica
NELTSSTPSTLSIQKTTTKPMPIAPPKPKSKIPSSSLGSSLSMSPVTSSYSFKKGSSM

SEQ ID NO: 2641440 - protein, 6 aa, Entamoeba histolytica
NEMENQ

SEQ ID NO: 2641441 - protein, 6 aa, Entamoeba histolytica
NEMGES

SEQ ID NO: 2641442 - protein, 15 aa, Entamoeba histolytica
NEMKEEQSQERQQQK

SEQ ID NO: 2641443 - protein, 5 aa, Entamoeba histolytica
NEMKG

SEQ ID NO: 2641444 - protein, 5 aa, Entamoeba histolytica
NEMKN

SEQ ID NO: 2641445 - protein, 23 aa, Entamoeba histolytica
NEMNKQKVDCKKPKFPKNESTDS

SEQ ID NO: 2641446 - protein, 24 aa, Entamoeba histolytica
NEMNKQKVDCKKPKFTKNESTDSW

SEQ ID NO: 2641447 - protein, 7 aa, Entamoeba histolytica
NEMPKDE

SEQ ID NO: 2641448 - protein, 8 aa, Entamoeba histolytica
NEMPPVGK

SEQ ID NO: 2641449 - protein, 7 aa, Entamoeba histolytica
NEMSQED

SEQ ID NO: 2641450 - protein, 14 aa, Entamoeba histolytica
NEMTPEELKKVPTA

SEQ ID NO: 2641451 - protein, 15 aa, Entamoeba histolytica
NENAKLKNELQTKED

SEQ ID NO: 2641452 - protein, 8 aa, Entamoeba histolytica
NENAQPSD

SEQ ID NO: 2641453 - protein, 19 aa, Entamoeba histolytica
NENDASKAKDAENGKEWNG

SEQ ID NO: 2641454 - protein, 17 aa, Entamoeba histolytica
NENDDKSKFQRASTSID

SEQ ID NO: 2641455 - protein, 6 aa, Entamoeba histolytica
NENDFP

SEQ ID NO: 2641456 - protein, 6 aa, Entamoeba histolytica
NENDIK

SEQ ID NO: 2641457 - protein, 9 aa, Entamoeba histolytica
NENDKQKLC

SEQ ID NO: 2641458 - protein, 20 aa, Entamoeba histolytica
NENDNKNNICSNDDKTIEME

SEQ ID NO: 2641459 - protein, 9 aa, Entamoeba histolytica
NENDTSDSF

SEQ ID NO: 2641460 - protein, 10 aa, Entamoeba histolytica
NENDVQGELR

SEQ ID NO: 2641461 - protein, 15 aa, Entamoeba histolytica
NENEEDNSDTVIDDR

SEQ ID NO: 2641462 - protein, 17 aa, Entamoeba histolytica
NENEELRRKLKELKIAF

SEQ ID NO: 2641463 - protein, 7 aa, Entamoeba histolytica
NENEELT

SEQ ID NO: 2641464 - protein, 5 aa, Entamoeba histolytica
NENEG

SEQ ID NO: 2641465 - protein, 7 aa, Entamoeba histolytica
NENEIKE

SEQ ID NO: 2641466 - protein, 8 aa, Entamoeba histolytica
NENEIPPV

SEQ ID NO: 2641467 - protein, 4 aa, Entamoeba histolytica
NENF

SEQ ID NO: 2641468 - protein, 14 aa, Entamoeba histolytica
NENFKPEDYQGITN

SEQ ID NO: 2641469 - protein, 11 aa, Entamoeba histolytica
NENGERIGSTG

SEQ ID NO: 2641470 - protein, 7 aa, Entamoeba histolytica
NENGIGE

SEQ ID NO: 2641471 - protein, 6 aa, Entamoeba histolytica
NENGLK

SEQ ID NO: 2641472 - protein, 8 aa, Entamoeba histolytica
NENGRGME

SEQ ID NO: 2641473 - protein, 5 aa, Entamoeba histolytica
NENGS

SEQ ID NO: 2641474 - protein, 7 aa, Entamoeba histolytica
NENGTYD

SEQ ID NO: 2641475 - protein, 15 aa, Entamoeba histolytica
NENGVISQKGKMKSI

SEQ ID NO: 2641476 - protein, 14 aa, Entamoeba histolytica
NENIQQITQKSKKV

SEQ ID NO: 2641477 - protein, 8 aa, Entamoeba histolytica
NENKGKFV

SEQ ID NO: 2641478 - protein, 15 aa, Entamoeba histolytica
NENKISSSSAKSSLC

SEQ ID NO: 2641479 - protein, 20 aa, Entamoeba histolytica
NENKKKTVNKEDIENGQNQI

SEQ ID NO: 2641480 - protein, 10 aa, Entamoeba histolytica
NENKLEEKQF

SEQ ID NO: 2641481 - protein, 33 aa, Entamoeba histolytica
NENKQNVTEKGKQEKEDNKTVESESVNKEFDTI

SEQ ID NO: 2641482 - protein, 7 aa, Entamoeba histolytica
NENKTEL

SEQ ID NO: 2641483 - protein, 9 aa, Entamoeba histolytica
NENNDKLPI

SEQ ID NO: 2641484 - protein, 5 aa, Entamoeba histolytica
NENNH

SEQ ID NO: 2641485 - protein, 5 aa, Entamoeba histolytica
NENNI

SEQ ID NO: 2641486 - protein, 10 aa, Entamoeba histolytica
NENNKLKKEI

SEQ ID NO: 2641487 - protein, 13 aa, Entamoeba histolytica
NENNKNDSDNKEN

SEQ ID NO: 2641488 - protein, 8 aa, Entamoeba histolytica
NENNKQKM

SEQ ID NO: 2641489 - protein, 9 aa, Entamoeba histolytica
NENNNSNEF

SEQ ID NO: 2641490 - protein, 6 aa, Entamoeba histolytica
NENNQR

SEQ ID NO: 2641491 - protein, 9 aa, Entamoeba histolytica
NENNRWDDE

SEQ ID NO: 2641492 - protein, 15 aa, Entamoeba histolytica
NENNSYGAYTQAKPD

SEQ ID NO: 2641493 - protein, 6 aa, Entamoeba histolytica
NENNTK

SEQ ID NO: 2641494 - protein, 7 aa, Entamoeba histolytica
NENQENV

SEQ ID NO: 2641495 - protein, 7 aa, Entamoeba histolytica
NENQKTI

SEQ ID NO: 2641496 - protein, 5 aa, Entamoeba histolytica
NENQT

SEQ ID NO: 2641497 - protein, 4 aa, Entamoeba histolytica
NENR

SEQ ID NO: 2641498 - protein, 42 aa, Entamoeba histolytica
NENREKKMKRTLGEDEEDKEIKTRKERRKEGKKKSKKEKMDK

SEQ ID NO: 2641499 - protein, 14 aa, Entamoeba histolytica
NENRPQTELENEDD

SEQ ID NO: 2641500 - protein, 8 aa, Entamoeba histolytica
NENRPSNC

SEQ ID NO: 2641501 - protein, 4 aa, Entamoeba histolytica
NENS

SEQ ID NO: 2641502 - protein, 5 aa, Entamoeba histolytica
NENSD

SEQ ID NO: 2641503 - protein, 7 aa, Entamoeba histolytica
NENSKKA

SEQ ID NO: 2641504 - protein, 4 aa, Entamoeba histolytica
NENT

SEQ ID NO: 2641505 - protein, 7 aa, Entamoeba histolytica
NENTDDT

SEQ ID NO: 2641506 - protein, 5 aa, Entamoeba histolytica
NENTE

SEQ ID NO: 2641507 - protein, 5 aa, Entamoeba histolytica
NENTI

SEQ ID NO: 2641508 - protein, 9 aa, Entamoeba histolytica
NENTIEDKT

SEQ ID NO: 2641509 - protein, 7 aa, Entamoeba histolytica
NENTLGN

SEQ ID NO: 2641510 - protein, 8 aa, Entamoeba histolytica
NENTNNEY

SEQ ID NO: 2641511 - protein, 8 aa, Entamoeba histolytica
NENTQHNV

SEQ ID NO: 2641512 - protein, 10 aa, Entamoeba histolytica
NENTTSQKIE

SEQ ID NO: 2641513 - protein, 4 aa, Entamoeba histolytica
NENV

SEQ ID NO: 2641514 - protein, 7 aa, Entamoeba histolytica
NENYPTN

SEQ ID NO: 2641515 - protein, 8 aa, Entamoeba histolytica
NENYQIQS

SEQ ID NO: 2641516 - protein, 8 aa, Entamoeba histolytica
NEPAPGYN

SEQ ID NO: 2641517 - protein, 6 aa, Entamoeba histolytica
NEPCQT

SEQ ID NO: 2641518 - protein, 8 aa, Entamoeba histolytica
NEPDSQVT

SEQ ID NO: 2641519 - protein, 6 aa, Entamoeba histolytica
NEPFKD

SEQ ID NO: 2641520 - protein, 4 aa, Entamoeba histolytica
NEPI

SEQ ID NO: 2641521 - protein, 8 aa, Entamoeba histolytica
NEPIDEND

SEQ ID NO: 2641522 - protein, 9 aa, Entamoeba histolytica
NEPIEQSDN

SEQ ID NO: 2641523 - protein, 6 aa, Entamoeba histolytica
NEPIKP

SEQ ID NO: 2641524 - protein, 7 aa, Entamoeba histolytica
NEPITKQ

SEQ ID NO: 2641525 - protein, 10 aa, Entamoeba histolytica
NEPKATPHPY

SEQ ID NO: 2641526 - protein, 21 aa, Entamoeba histolytica
NEPKINGGVSDYSSEEKSIPQ

SEQ ID NO: 2641527 - protein, 10 aa, Entamoeba histolytica
NEPKKSATDR

SEQ ID NO: 2641528 - protein, 11 aa, Entamoeba histolytica
NEPKQKKVEGV

SEQ ID NO: 2641529 - protein, 36 aa, Entamoeba histolytica
NEPKTPRLTPRKTGDTRSVSTITPKKKRMSGDTPRI

SEQ ID NO: 2641530 - protein, 4 aa, Entamoeba histolytica
NEPL

SEQ ID NO: 2641531 - protein, 15 aa, Entamoeba histolytica
NEPLKTPCGTQDYAA

SEQ ID NO: 2641532 - protein, 6 aa, Entamoeba histolytica
NEPLTV

SEQ ID NO: 2641533 - protein, 12 aa, Entamoeba histolytica
NEPNHTLNGDKA

SEQ ID NO: 2641534 - protein, 7 aa, Entamoeba histolytica
NEPPIQD

SEQ ID NO: 2641535 - protein, 8 aa, Entamoeba histolytica
NEPQDKNN

SEQ ID NO: 2641536 - protein, 15 aa, Entamoeba histolytica
NEPQYNIPKAGSVIE

SEQ ID NO: 2641537 - protein, 4 aa, Entamoeba histolytica
NEPR

SEQ ID NO: 2641538 - protein, 4 aa, Entamoeba histolytica
NEPS

SEQ ID NO: 2641539 - protein, 5 aa, Entamoeba histolytica
NEPSC

SEQ ID NO: 2641540 - protein, 7 aa, Entamoeba histolytica
NEPTEME

SEQ ID NO: 2641541 - protein, 5 aa, Entamoeba histolytica
NEPTQ

SEQ ID NO: 2641542 - protein, 8 aa, Entamoeba histolytica
NEPTTLSQ

SEQ ID NO: 2641543 - protein, 7 aa, Entamoeba histolytica
NEPVNGD

SEQ ID NO: 2641544 - protein, 12 aa, Entamoeba histolytica
NEPYESPLKPFG

SEQ ID NO: 2641545 - protein, 8 aa, Entamoeba histolytica
NEPYHGGL

SEQ ID NO: 2641546 - protein, 18 aa, Entamoeba histolytica
NEQAKAELKKEQLKKSQR

SEQ ID NO: 2641547 - protein, 6 aa, Entamoeba histolytica
NEQCKK

SEQ ID NO: 2641548 - protein, 5 aa, Entamoeba histolytica
NEQCT

SEQ ID NO: 2641549 - protein, 8 aa, Entamoeba histolytica
NEQEGEGD

SEQ ID NO: 2641550 - protein, 11 aa, Entamoeba histolytica
NEQEHQKSMDE

SEQ ID NO: 2641551 - protein, 21 aa, Entamoeba histolytica
NEQEKEGVELDGQKKQKKGGC

SEQ ID NO: 2641552 - protein, 8 aa, Entamoeba histolytica
NEQEKSDW

SEQ ID NO: 2641553 - protein, 5 aa, Entamoeba histolytica
NEQEQ

SEQ ID NO: 2641554 - protein, 5 aa, Entamoeba histolytica
NEQET

SEQ ID NO: 2641555 - protein, 13 aa, Entamoeba histolytica
NEQGVSENQISSS

SEQ ID NO: 2641556 - protein, 5 aa, Entamoeba histolytica
NEQHK

SEQ ID NO: 2641557 - protein, 5 aa, Entamoeba histolytica
NEQIE

SEQ ID NO: 2641558 - protein, 5 aa, Entamoeba histolytica
NEQKI

SEQ ID NO: 2641559 - protein, 10 aa, Entamoeba histolytica
NEQKPKEKQY

SEQ ID NO: 2641560 - protein, 4 aa, Entamoeba histolytica
NEQL

SEQ ID NO: 2641561 - protein, 153 aa, Entamoeba histolytica
NEQLEEEKKKSVDYEQLKQKQEDSEKQYSQSLTEKEKEIERQKAEIESQKAEIESQKAEIERQRNEIESQKAEIESQKAEIESQKAEIESQKAEIERQKAEIERQRNEIESQRNEIERQKAEIERQRKKIEEKEKEIKGKESTIEDKENEIEK

SEQ ID NO: 2641562 - protein, 4 aa, Entamoeba histolytica
NEQP

SEQ ID NO: 2641563 - protein, 8 aa, Entamoeba histolytica
NEQPGASF

SEQ ID NO: 2641564 - protein, 6 aa, Entamoeba histolytica
NEQPSQ

SEQ ID NO: 2641565 - protein, 4 aa, Entamoeba histolytica
NEQQ

SEQ ID NO: 2641566 - protein, 41 aa, Entamoeba histolytica
NEQQKDDKKENTNPPKPETNSKENKEIIQSSNTNKQINSLP

SEQ ID NO: 2641567 - protein, 38 aa, Entamoeba histolytica
NEQQPHESTETSSNQQENQVEDIKDDDNMKIKESKEIL

SEQ ID NO: 2641568 - protein, 5 aa, Entamoeba histolytica
NEQQS

SEQ ID NO: 2641569 - protein, 45 aa, Entamoeba histolytica
NEQQTTNTHSEEKTNNEQEITTSQIKEEEKQEQTQKETKEEISLQ

SEQ ID NO: 2641570 - protein, 4 aa, Entamoeba histolytica
NEQS

SEQ ID NO: 2641571 - protein, 7 aa, Entamoeba histolytica
NEQSFQS

SEQ ID NO: 2641572 - protein, 7 aa, Entamoeba histolytica
NEQSTID

SEQ ID NO: 2641573 - protein, 8 aa, Entamoeba histolytica
NEQTPKQW

SEQ ID NO: 2641574 - protein, 8 aa, Entamoeba histolytica
NEQTTQQS

SEQ ID NO: 2641575 - protein, 51 aa, Entamoeba histolytica
NEQVGESAECIESSGTTTTEGISSEENESEGLSCRDQSTERLSSSELKIEE

SEQ ID NO: 2641576 - protein, 4 aa, Entamoeba histolytica
NEQY

SEQ ID NO: 2641577 - protein, 5 aa, Entamoeba histolytica
NERAK

SEQ ID NO: 2641578 - protein, 4 aa, Entamoeba histolytica
NERC

SEQ ID NO: 2641579 - protein, 6 aa, Entamoeba histolytica
NERDEH

SEQ ID NO: 2641580 - protein, 6 aa, Entamoeba histolytica
NEREKI

SEQ ID NO: 2641581 - protein, 7 aa, Entamoeba histolytica
NERELNR

SEQ ID NO: 2641582 - protein, 5 aa, Entamoeba histolytica
NEREM

SEQ ID NO: 2641583 - protein, 7 aa, Entamoeba histolytica
NERGYRE

SEQ ID NO: 2641584 - protein, 8 aa, Entamoeba histolytica
NERHSNSS

SEQ ID NO: 2641585 - protein, 6 aa, Entamoeba histolytica
NERIDS

SEQ ID NO: 2641586 - protein, 8 aa, Entamoeba histolytica
NERKEEIK

SEQ ID NO: 2641587 - protein, 7 aa, Entamoeba histolytica
NERKEIV

SEQ ID NO: 2641588 - protein, 12 aa, Entamoeba histolytica
NERKGIVQSEEQ

SEQ ID NO: 2641589 - protein, 25 aa, Entamoeba histolytica
NERKIEEKPHKEEKKMKKQRYKKEE

SEQ ID NO: 2641590 - protein, 19 aa, Entamoeba histolytica
NERKRKQEEIKEPIIPPFT

SEQ ID NO: 2641591 - protein, 11 aa, Entamoeba histolytica
NERKVAAEKIN

SEQ ID NO: 2641592 - protein, 9 aa, Entamoeba histolytica
NERKYADDQ

SEQ ID NO: 2641593 - protein, 16 aa, Entamoeba histolytica
NERLKEENQKCEGVSE

SEQ ID NO: 2641594 - protein, 8 aa, Entamoeba histolytica
NERLRKEL

SEQ ID NO: 2641595 - protein, 8 aa, Entamoeba histolytica
NERMTPTE

SEQ ID NO: 2641596 - protein, 7 aa, Entamoeba histolytica
NERNGIY

SEQ ID NO: 2641597 - protein, 5 aa, Entamoeba histolytica
NERNL

SEQ ID NO: 2641598 - protein, 8 aa, Entamoeba histolytica
NERNQPQM

SEQ ID NO: 2641599 - protein, 7 aa, Entamoeba histolytica
NERNWPG

SEQ ID NO: 2641600 - protein, 6 aa, Entamoeba histolytica
NERPSF

SEQ ID NO: 2641601 - protein, 7 aa, Entamoeba histolytica
NERRNGI

SEQ ID NO: 2641602 - protein, 8 aa, Entamoeba histolytica
NERSDEKK

SEQ ID NO: 2641603 - protein, 12 aa, Entamoeba histolytica
NERSKMVQTKEQ

SEQ ID NO: 2641604 - protein, 10 aa, Entamoeba histolytica
NERTKDIDRR

SEQ ID NO: 2641605 - protein, 6 aa, Entamoeba histolytica
NERTKQ

SEQ ID NO: 2641606 - protein, 9 aa, Entamoeba histolytica
NERTNQTKV

SEQ ID NO: 2641607 - protein, 7 aa, Entamoeba histolytica
NESAQPL

SEQ ID NO: 2641608 - protein, 7 aa, Entamoeba histolytica
NESATQR

SEQ ID NO: 2641609 - protein, 38 aa, Entamoeba histolytica
NESAVKALSTKPILPPNWKQTPKGNNLFSDEKEALKRV

SEQ ID NO: 2641610 - protein, 8 aa, Entamoeba histolytica
NESCPTPE

SEQ ID NO: 2641611 - protein, 4 aa, Entamoeba histolytica
NESD

SEQ ID NO: 2641612 - protein, 14 aa, Entamoeba histolytica
NESDEQHKHYTEQG

SEQ ID NO: 2641613 - protein, 5 aa, Entamoeba histolytica
NESDL

SEQ ID NO: 2641614 - protein, 8 aa, Entamoeba histolytica
NESDYSNV

SEQ ID NO: 2641615 - protein, 7 aa, Entamoeba histolytica
NESEKIE

SEQ ID NO: 2641616 - protein, 12 aa, Entamoeba histolytica
NESERQGDSEQK

SEQ ID NO: 2641617 - protein, 6 aa, Entamoeba histolytica
NESETD

SEQ ID NO: 2641618 - protein, 24 aa, Entamoeba histolytica
NESFKEDDKKEFIKKSEKKKKLSF

SEQ ID NO: 2641619 - protein, 13 aa, Entamoeba histolytica
NESFPNKLPPATS

SEQ ID NO: 2641620 - protein, 17 aa, Entamoeba histolytica
NESGIKASTEDKRKKAI

SEQ ID NO: 2641621 - protein, 4 aa, Entamoeba histolytica
NESH

SEQ ID NO: 2641622 - protein, 9 aa, Entamoeba histolytica
NESHEQKQT

SEQ ID NO: 2641623 - protein, 20 aa, Entamoeba histolytica
NESIDIGKNGISQLKQQNQH

SEQ ID NO: 2641624 - protein, 6 aa, Entamoeba histolytica
NESIKN

SEQ ID NO: 2641625 - protein, 6 aa, Entamoeba histolytica
NESIPQ

SEQ ID NO: 2641626 - protein, 5 aa, Entamoeba histolytica
NESIQ

SEQ ID NO: 2641627 - protein, 7 aa, Entamoeba histolytica
NESKAKM

SEQ ID NO: 2641628 - protein, 9 aa, Entamoeba histolytica
NESKKTGSF

SEQ ID NO: 2641629 - protein, 7 aa, Entamoeba histolytica
NESKNDI

SEQ ID NO: 2641630 - protein, 8 aa, Entamoeba histolytica
NESKPTFN

SEQ ID NO: 2641631 - protein, 44 aa, Entamoeba histolytica
NESKPTSSEEKNTTQKNPTKPERRKRATTLANSNNPMKKEIMQL

SEQ ID NO: 2641632 - protein, 6 aa, Entamoeba histolytica
NESKQK

SEQ ID NO: 2641633 - protein, 15 aa, Entamoeba histolytica
NESKSIKNEKRLQEI

SEQ ID NO: 2641634 - protein, 4 aa, Entamoeba histolytica
NESL

SEQ ID NO: 2641635 - protein, 11 aa, Entamoeba histolytica
NESNGLNTEEC

SEQ ID NO: 2641636 - protein, 5 aa, Entamoeba histolytica
NESNV

SEQ ID NO: 2641637 - protein, 8 aa, Entamoeba histolytica
NESPEITD

SEQ ID NO: 2641638 - protein, 23 aa, Entamoeba histolytica
NESPPSQKSPLLPQNVSPPTPLS

SEQ ID NO: 2641639 - protein, 6 aa, Entamoeba histolytica
NESPVE

SEQ ID NO: 2641640 - protein, 10 aa, Entamoeba histolytica
NESQEDNTSM

SEQ ID NO: 2641641 - protein, 10 aa, Entamoeba histolytica
NESQENNESL

SEQ ID NO: 2641642 - protein, 11 aa, Entamoeba histolytica
NESQHQENEET

SEQ ID NO: 2641643 - protein, 6 aa, Entamoeba histolytica
NESQIQ

SEQ ID NO: 2641644 - protein, 12 aa, Entamoeba histolytica
NESQLNSNSLDA

SEQ ID NO: 2641645 - protein, 11 aa, Entamoeba histolytica
NESRKHSLDQP

SEQ ID NO: 2641646 - protein, 10 aa, Entamoeba histolytica
NESRSDDDKT

SEQ ID NO: 2641647 - protein, 5 aa, Entamoeba histolytica
NESSF

SEQ ID NO: 2641648 - protein, 19 aa, Entamoeba histolytica
NESSQENISSLRSSDNVQD

SEQ ID NO: 2641649 - protein, 10 aa, Entamoeba histolytica
NESSSESTEI

SEQ ID NO: 2641650 - protein, 9 aa, Entamoeba histolytica
NESSTSEKK

SEQ ID NO: 2641651 - protein, 20 aa, Entamoeba histolytica
NESTDSLEKSAEIDQPYPPT

SEQ ID NO: 2641652 - protein, 11 aa, Entamoeba histolytica
NESTEITKESV

SEQ ID NO: 2641653 - protein, 10 aa, Entamoeba histolytica
NESTERTENV

SEQ ID NO: 2641654 - protein, 5 aa, Entamoeba histolytica
NESTF

SEQ ID NO: 2641655 - protein, 11 aa, Entamoeba histolytica
NESTKKESNQW

SEQ ID NO: 2641656 - protein, 12 aa, Entamoeba histolytica
NESTKKSIKKSI

SEQ ID NO: 2641657 - protein, 41 aa, Entamoeba histolytica
NESTPTQSDTSSTTIKTKTSQLPSSYEKHQNYQSHSQEKTI

SEQ ID NO: 2641658 - protein, 11 aa, Entamoeba histolytica
NESTSKKVDFE

SEQ ID NO: 2641659 - protein, 5 aa, Entamoeba histolytica
NESVD

SEQ ID NO: 2641660 - protein, 6 aa, Entamoeba histolytica
NETAKS

SEQ ID NO: 2641661 - protein, 5 aa, Entamoeba histolytica
NETDK

SEQ ID NO: 2641662 - protein, 6 aa, Entamoeba histolytica
NETDPA

SEQ ID NO: 2641663 - protein, 14 aa, Entamoeba histolytica
NETDVQFASVMELM

SEQ ID NO: 2641664 - protein, 6 aa, Entamoeba histolytica
NETENI

SEQ ID NO: 2641665 - protein, 14 aa, Entamoeba histolytica
NETESDDSSSDSYF

SEQ ID NO: 2641666 - protein, 10 aa, Entamoeba histolytica
NETESYASDL

SEQ ID NO: 2641667 - protein, 5 aa, Entamoeba histolytica
NETGE

SEQ ID NO: 2641668 - protein, 11 aa, Entamoeba histolytica
NETHNPFTQPI

SEQ ID NO: 2641669 - protein, 5 aa, Entamoeba histolytica
NETIR

SEQ ID NO: 2641670 - protein, 5 aa, Entamoeba histolytica
NETIS

SEQ ID NO: 2641671 - protein, 12 aa, Entamoeba histolytica
NETISGKSVDDK

SEQ ID NO: 2641672 - protein, 5 aa, Entamoeba histolytica
NETKA

SEQ ID NO: 2641673 - protein, 5 aa, Entamoeba histolytica
NETKH

SEQ ID NO: 2641674 - protein, 8 aa, Entamoeba histolytica
NETKKIGN

SEQ ID NO: 2641675 - protein, 11 aa, Entamoeba histolytica
NETKQENQPTL

SEQ ID NO: 2641676 - protein, 4 aa, Entamoeba histolytica
NETM

SEQ ID NO: 2641677 - protein, 5 aa, Entamoeba histolytica
NETNE

SEQ ID NO: 2641678 - protein, 11 aa, Entamoeba histolytica
NETNENKSKLD

SEQ ID NO: 2641679 - protein, 7 aa, Entamoeba histolytica
NETNGNE

SEQ ID NO: 2641680 - protein, 7 aa, Entamoeba histolytica
NETNQMS

SEQ ID NO: 2641681 - protein, 6 aa, Entamoeba histolytica
NETNTH

SEQ ID NO: 2641682 - protein, 4 aa, Entamoeba histolytica
NETP

SEQ ID NO: 2641683 - protein, 10 aa, Entamoeba histolytica
NETPKWEESK

SEQ ID NO: 2641684 - protein, 4 aa, Entamoeba histolytica
NETQ

SEQ ID NO: 2641685 - protein, 6 aa, Entamoeba histolytica
NETQDY

SEQ ID NO: 2641686 - protein, 11 aa, Entamoeba histolytica
NETQEQLESEF

SEQ ID NO: 2641687 - protein, 10 aa, Entamoeba histolytica
NETQSHQSNH

SEQ ID NO: 2641688 - protein, 4 aa, Entamoeba histolytica
NETR

SEQ ID NO: 2641689 - protein, 6 aa, Entamoeba histolytica
NETSIR

SEQ ID NO: 2641690 - protein, 5 aa, Entamoeba histolytica
NETSK

SEQ ID NO: 2641691 - protein, 8 aa, Entamoeba histolytica
NETSPQKD

SEQ ID NO: 2641692 - protein, 6 aa, Entamoeba histolytica
NETSSQ

SEQ ID NO: 2641693 - protein, 27 aa, Entamoeba histolytica
NETSTKQEYIKTENKTTEKESPKQSSV

SEQ ID NO: 2641694 - protein, 6 aa, Entamoeba histolytica
NETTKE

SEQ ID NO: 2641695 - protein, 8 aa, Entamoeba histolytica
NETTKKQL

SEQ ID NO: 2641696 - protein, 6 aa, Entamoeba histolytica
NETTKR

SEQ ID NO: 2641697 - protein, 8 aa, Entamoeba histolytica
NETTNKYN

SEQ ID NO: 2641698 - protein, 23 aa, Entamoeba histolytica
NETTQKKEEIPSNTDNFSKVEPL

SEQ ID NO: 2641699 - protein, 10 aa, Entamoeba histolytica
NETTTSSSIP

SEQ ID NO: 2641700 - protein, 19 aa, Entamoeba histolytica
NETTYIPPSLRKQQEDNSI

SEQ ID NO: 2641701 - protein, 6 aa, Entamoeba histolytica
NETVPI

SEQ ID NO: 2641702 - protein, 4 aa, Entamoeba histolytica
NETY

SEQ ID NO: 2641703 - protein, 13 aa, Entamoeba histolytica
NETYQGKITEYRN

SEQ ID NO: 2641704 - protein, 6 aa, Entamoeba histolytica
NEVAKV

SEQ ID NO: 2641705 - protein, 9 aa, Entamoeba histolytica
NEVDTKQSL

SEQ ID NO: 2641706 - protein, 6 aa, Entamoeba histolytica
NEVDVK

SEQ ID NO: 2641707 - protein, 6 aa, Entamoeba histolytica
NEVEEI

SEQ ID NO: 2641708 - protein, 11 aa, Entamoeba histolytica
NEVEKQPEGHL

SEQ ID NO: 2641709 - protein, 7 aa, Entamoeba histolytica
NEVESIS

SEQ ID NO: 2641710 - protein, 4 aa, Entamoeba histolytica
NEVG

SEQ ID NO: 2641711 - protein, 7 aa, Entamoeba histolytica
NEVGHKT

SEQ ID NO: 2641712 - protein, 5 aa, Entamoeba histolytica
NEVIS

SEQ ID NO: 2641713 - protein, 7 aa, Entamoeba histolytica
NEVKNNN

SEQ ID NO: 2641714 - protein, 5 aa, Entamoeba histolytica
NEVKR

SEQ ID NO: 2641715 - protein, 25 aa, Entamoeba histolytica
NEVKSQEQAKEDKRKALQKKIETAG

SEQ ID NO: 2641716 - protein, 6 aa, Entamoeba histolytica
NEVQNT

SEQ ID NO: 2641717 - protein, 10 aa, Entamoeba histolytica
NEVQSSPPCD

SEQ ID NO: 2641718 - protein, 6 aa, Entamoeba histolytica
NEVSKL

SEQ ID NO: 2641719 - protein, 9 aa, Entamoeba histolytica
NEVSKQSYP

SEQ ID NO: 2641720 - protein, 15 aa, Entamoeba histolytica
NEVSKSLDESTDGKY

SEQ ID NO: 2641721 - protein, 11 aa, Entamoeba histolytica
NEVSPNITTSG

SEQ ID NO: 2641722 - protein, 22 aa, Entamoeba histolytica
NEVSTTNNLVSTNETTPTQNGI

SEQ ID NO: 2641723 - protein, 11 aa, Entamoeba histolytica
NEVTQKPLNPI

SEQ ID NO: 2641724 - protein, 23 aa, Entamoeba histolytica
NEVTTSENDRESNNNTDSDSQIS

SEQ ID NO: 2641725 - protein, 11 aa, Entamoeba histolytica
NEWDPDDPEWE

SEQ ID NO: 2641726 - protein, 8 aa, Entamoeba histolytica
NEWEEHGT

SEQ ID NO: 2641727 - protein, 6 aa, Entamoeba histolytica
NEWNAQ

SEQ ID NO: 2641728 - protein, 4 aa, Entamoeba histolytica
NEYC

SEQ ID NO: 2641729 - protein, 4 aa, Entamoeba histolytica
NEYD

SEQ ID NO: 2641730 - protein, 8 aa, Entamoeba histolytica
NEYDNQKA

SEQ ID NO: 2641731 - protein, 9 aa, Entamoeba histolytica
NEYDPFSKS

SEQ ID NO: 2641732 - protein, 4 aa, Entamoeba histolytica
NEYE

SEQ ID NO: 2641733 - protein, 5 aa, Entamoeba histolytica
NEYEE

SEQ ID NO: 2641734 - protein, 5 aa, Entamoeba histolytica
NEYEL

SEQ ID NO: 2641735 - protein, 7 aa, Entamoeba histolytica
NEYENEV

SEQ ID NO: 2641736 - protein, 5 aa, Entamoeba histolytica
NEYEQ

SEQ ID NO: 2641737 - protein, 4 aa, Entamoeba histolytica
NEYG

SEQ ID NO: 2641738 - protein, 10 aa, Entamoeba histolytica
NEYGISPQKV

SEQ ID NO: 2641739 - protein, 6 aa, Entamoeba histolytica
NEYGNS

SEQ ID NO: 2641740 - protein, 5 aa, Entamoeba histolytica
NEYHE

SEQ ID NO: 2641741 - protein, 6 aa, Entamoeba histolytica
NEYHSQ

SEQ ID NO: 2641742 - protein, 12 aa, Entamoeba histolytica
NEYKQAKEVGRK

SEQ ID NO: 2641743 - protein, 6 aa, Entamoeba histolytica
NEYKRN

SEQ ID NO: 2641744 - protein, 6 aa, Entamoeba histolytica
NEYNKQ

SEQ ID NO: 2641745 - protein, 10 aa, Entamoeba histolytica
NEYPPELSQD

SEQ ID NO: 2641746 - protein, 4 aa, Entamoeba histolytica
NEYQ

SEQ ID NO: 2641747 - protein, 7 aa, Entamoeba histolytica
NEYQKPS

SEQ ID NO: 2641748 - protein, 5 aa, Entamoeba histolytica
NEYQS

SEQ ID NO: 2641749 - protein, 4 aa, Entamoeba histolytica
NEYR

SEQ ID NO: 2641750 - protein, 38 aa, Entamoeba histolytica
NEYREEYEDDEDDDIGEEEIDKEIKERLSNIKGENQIK

SEQ ID NO: 2641751 - protein, 15 aa, Entamoeba histolytica
NEYSEKQKATSYDEA

SEQ ID NO: 2641752 - protein, 10 aa, Entamoeba histolytica
NEYSTTRLPE

SEQ ID NO: 2641753 - protein, 6 aa, Entamoeba histolytica
NEYSYE

SEQ ID NO: 2641754 - protein, 8 aa, Entamoeba histolytica
NEYTKTAP

SEQ ID NO: 2641755 - protein, 6 aa, Entamoeba histolytica
NEYTNQ

SEQ ID NO: 2641756 - protein, 4 aa, Entamoeba histolytica
NFDG

SEQ ID NO: 2641757 - protein, 4 aa, Entamoeba histolytica
NFDK

SEQ ID NO: 2641758 - protein, 6 aa, Entamoeba histolytica
NFDPSP

SEQ ID NO: 2641759 - protein, 9 aa, Entamoeba histolytica
NFEDDEKET

SEQ ID NO: 2641760 - protein, 16 aa, Entamoeba histolytica
NFEEEGKKKDKEIEDL

SEQ ID NO: 2641761 - protein, 9 aa, Entamoeba histolytica
NFENNKNDI

SEQ ID NO: 2641762 - protein, 17 aa, Entamoeba histolytica
NFEQQAKDKAAGDDEAQ

SEQ ID NO: 2641763 - protein, 10 aa, Entamoeba histolytica
NFGAKSCESL

SEQ ID NO: 2641764 - protein, 5 aa, Entamoeba histolytica
NFGGS

SEQ ID NO: 2641765 - protein, 8 aa, Entamoeba histolytica
NFGGTSDG

SEQ ID NO: 2641766 - protein, 11 aa, Entamoeba histolytica
NFGKNDNLGST

SEQ ID NO: 2641767 - protein, 12 aa, Entamoeba histolytica
NFGSQQYPGYNM

SEQ ID NO: 2641768 - protein, 7 aa, Entamoeba histolytica
NFIDPKN

SEQ ID NO: 2641769 - protein, 12 aa, Entamoeba histolytica
NFKNKKLQNDTS

SEQ ID NO: 2641770 - protein, 8 aa, Entamoeba histolytica
NFKPKSKD

SEQ ID NO: 2641771 - protein, 13 aa, Entamoeba histolytica
NFKRRESLAFYLP

SEQ ID NO: 2641772 - protein, 5 aa, Entamoeba histolytica
NFKTK

SEQ ID NO: 2641773 - protein, 10 aa, Entamoeba histolytica
NFNENKLNEQ

SEQ ID NO: 2641774 - protein, 6 aa, Entamoeba histolytica
NFNEPY

SEQ ID NO: 2641775 - protein, 4 aa, Entamoeba histolytica
NFNP

SEQ ID NO: 2641776 - protein, 8 aa, Entamoeba histolytica
NFNSNDEV

SEQ ID NO: 2641777 - protein, 10 aa, Entamoeba histolytica
NFPEQRNTAR

SEQ ID NO: 2641778 - protein, 8 aa, Entamoeba histolytica
NFPESNGR

SEQ ID NO: 2641779 - protein, 13 aa, Entamoeba histolytica
NFPPIDKEKVNEE

SEQ ID NO: 2641780 - protein, 9 aa, Entamoeba histolytica
NFQEEGVSQ

SEQ ID NO: 2641781 - protein, 4 aa, Entamoeba histolytica
NFQQ

SEQ ID NO: 2641782 - protein, 4 aa, Entamoeba histolytica
NFRN

SEQ ID NO: 2641783 - protein, 12 aa, Entamoeba histolytica
NFSDESPQLPNE

SEQ ID NO: 2641784 - protein, 5 aa, Entamoeba histolytica
NFSEE

SEQ ID NO: 2641785 - protein, 5 aa, Entamoeba histolytica
NFSGN

SEQ ID NO: 2641786 - protein, 14 aa, Entamoeba histolytica
NFSKTKQNKSSTIL

SEQ ID NO: 2641787 - protein, 33 aa, Entamoeba histolytica
NFSNEIDSSSDNDEEDIRKKPSKHRSSPVKAKS

SEQ ID NO: 2641788 - protein, 10 aa, Entamoeba histolytica
NFSPEKCKSI

SEQ ID NO: 2641789 - protein, 6 aa, Entamoeba histolytica
NFSQNS

SEQ ID NO: 2641790 - protein, 18 aa, Entamoeba histolytica
NFSSKSKERKSEEEVDER

SEQ ID NO: 2641791 - protein, 11 aa, Entamoeba histolytica
NFSSQQEQTPI

SEQ ID NO: 2641792 - protein, 10 aa, Entamoeba histolytica
NFSTRSKITQ

SEQ ID NO: 2641793 - protein, 5 aa, Entamoeba histolytica
NFTDS

SEQ ID NO: 2641794 - protein, 6 aa, Entamoeba histolytica
NFTESE

SEQ ID NO: 2641795 - protein, 12 aa, Entamoeba histolytica
NFTEYSKEGNTI

SEQ ID NO: 2641796 - protein, 6 aa, Entamoeba histolytica
NFTKEQ

SEQ ID NO: 2641797 - protein, 5 aa, Entamoeba histolytica
NFTKT

SEQ ID NO: 2641798 - protein, 19 aa, Entamoeba histolytica
NFTNNPEDPYWTEPEVPGT

SEQ ID NO: 2641799 - protein, 5 aa, Entamoeba histolytica
NFTPD

SEQ ID NO: 2641800 - protein, 17 aa, Entamoeba histolytica
NFTPEMSKEADLLLRQI

SEQ ID NO: 2641801 - protein, 13 aa, Entamoeba histolytica
NFTPREERDKPDN

SEQ ID NO: 2641802 - protein, 10 aa, Entamoeba histolytica
NFTSNTHGSL

SEQ ID NO: 2641803 - protein, 63 aa, Entamoeba histolytica
NFTSTSKQSLSSTFTQSNNKHDTINPGLTKTEEETDAEEEEEEYDEDDEESYEEDNSDDSGSC

SEQ ID NO: 2641804 - protein, 14 aa, Entamoeba histolytica
NFTTSYDDNSYYEP

SEQ ID NO: 2641805 - protein, 5 aa, Entamoeba histolytica
NFYGT

SEQ ID NO: 2641806 - protein, 5 aa, Entamoeba histolytica
NGAEK

SEQ ID NO: 2641807 - protein, 5 aa, Entamoeba histolytica
NGAER

SEQ ID NO: 2641808 - protein, 4 aa, Entamoeba histolytica
NGAG

SEQ ID NO: 2641809 - protein, 8 aa, Entamoeba histolytica
NGAGKTSI

SEQ ID NO: 2641810 - protein, 9 aa, Entamoeba histolytica
NGAIDTDHQ

SEQ ID NO: 2641811 - protein, 16 aa, Entamoeba histolytica
NGAKQWKKRHPSNCES

SEQ ID NO: 2641812 - protein, 9 aa, Entamoeba histolytica
NGALDKPEK

SEQ ID NO: 2641813 - protein, 7 aa, Entamoeba histolytica
NGANSQS

SEQ ID NO: 2641814 - protein, 18 aa, Entamoeba histolytica
NGASRIGASAGIAILNGI

SEQ ID NO: 2641815 - protein, 4 aa, Entamoeba histolytica
NGAT

SEQ ID NO: 2641816 - protein, 6 aa, Entamoeba histolytica
NGATFK

SEQ ID NO: 2641817 - protein, 4 aa, Entamoeba histolytica
NGAY

SEQ ID NO: 2641818 - protein, 5 aa, Entamoeba histolytica
NGCDS

SEQ ID NO: 2641819 - protein, 4 aa, Entamoeba histolytica
NGCL

SEQ ID NO: 2641820 - protein, 13 aa, Entamoeba histolytica
NGCNEKATYRKGQ

SEQ ID NO: 2641821 - protein, 9 aa, Entamoeba histolytica
NGDDNPFEQ

SEQ ID NO: 2641822 - protein, 9 aa, Entamoeba histolytica
NGDEDLIPN

SEQ ID NO: 2641823 - protein, 8 aa, Entamoeba histolytica
NGDGAVSY

SEQ ID NO: 2641824 - protein, 9 aa, Entamoeba histolytica
NGDGSVSYE

SEQ ID NO: 2641825 - protein, 7 aa, Entamoeba histolytica
NGDGTFT

SEQ ID NO: 2641826 - protein, 5 aa, Entamoeba histolytica
NGDHH

SEQ ID NO: 2641827 - protein, 9 aa, Entamoeba histolytica
NGDKSIENE

SEQ ID NO: 2641828 - protein, 10 aa, Entamoeba histolytica
NGDKVGKAPY

SEQ ID NO: 2641829 - protein, 9 aa, Entamoeba histolytica
NGDNEQRQT

SEQ ID NO: 2641830 - protein, 4 aa, Entamoeba histolytica
NGDQ

SEQ ID NO: 2641831 - protein, 4 aa, Entamoeba histolytica
NGDS

SEQ ID NO: 2641832 - protein, 10 aa, Entamoeba histolytica
NGDSANDKFT

SEQ ID NO: 2641833 - protein, 6 aa, Entamoeba histolytica
NGDTET

SEQ ID NO: 2641834 - protein, 5 aa, Entamoeba histolytica
NGDVR

SEQ ID NO: 2641835 - protein, 6 aa, Entamoeba histolytica
NGDWKV

SEQ ID NO: 2641836 - protein, 9 aa, Entamoeba histolytica
NGDYKGAFE

SEQ ID NO: 2641837 - protein, 8 aa, Entamoeba histolytica
NGEAEAEN

SEQ ID NO: 2641838 - protein, 4 aa, Entamoeba histolytica
NGEE

SEQ ID NO: 2641839 - protein, 5 aa, Entamoeba histolytica
NGEED

SEQ ID NO: 2641840 - protein, 5 aa, Entamoeba histolytica
NGEEI

SEQ ID NO: 2641841 - protein, 13 aa, Entamoeba histolytica
NGEEIEEEEEIKT

SEQ ID NO: 2641842 - protein, 5 aa, Entamoeba histolytica
NGEGS

SEQ ID NO: 2641843 - protein, 5 aa, Entamoeba histolytica
NGEHI

SEQ ID NO: 2641844 - protein, 6 aa, Entamoeba histolytica
NGEHNG

SEQ ID NO: 2641845 - protein, 6 aa, Entamoeba histolytica
NGEHSL

SEQ ID NO: 2641846 - protein, 13 aa, Entamoeba histolytica
NGEIKTSLNGVSS

SEQ ID NO: 2641847 - protein, 6 aa, Entamoeba histolytica
NGEKTR

SEQ ID NO: 2641848 - protein, 5 aa, Entamoeba histolytica
NGEKV

SEQ ID NO: 2641849 - protein, 4 aa, Entamoeba histolytica
NGEL

SEQ ID NO: 2641850 - protein, 6 aa, Entamoeba histolytica
NGEMKD

SEQ ID NO: 2641851 - protein, 5 aa, Entamoeba histolytica
NGENE

SEQ ID NO: 2641852 - protein, 10 aa, Entamoeba histolytica
NGENEEESRS

SEQ ID NO: 2641853 - protein, 10 aa, Entamoeba histolytica
NGENGSNIKR

SEQ ID NO: 2641854 - protein, 5 aa, Entamoeba histolytica
NGENI

SEQ ID NO: 2641855 - protein, 12 aa, Entamoeba histolytica
NGENIRNSHERV

SEQ ID NO: 2641856 - protein, 9 aa, Entamoeba histolytica
NGENTLKNT

SEQ ID NO: 2641857 - protein, 6 aa, Entamoeba histolytica
NGEPKP

SEQ ID NO: 2641858 - protein, 7 aa, Entamoeba histolytica
NGEQPKE

SEQ ID NO: 2641859 - protein, 5 aa, Entamoeba histolytica
NGEQS

SEQ ID NO: 2641860 - protein, 5 aa, Entamoeba histolytica
NGEQV

SEQ ID NO: 2641861 - protein, 4 aa, Entamoeba histolytica
NGER

SEQ ID NO: 2641862 - protein, 5 aa, Entamoeba histolytica
NGERA

SEQ ID NO: 2641863 - protein, 11 aa, Entamoeba histolytica
NGERASLESPQ

SEQ ID NO: 2641864 - protein, 5 aa, Entamoeba histolytica
NGERS

SEQ ID NO: 2641865 - protein, 5 aa, Entamoeba histolytica
NGERT

SEQ ID NO: 2641866 - protein, 7 aa, Entamoeba histolytica
NGESEIG

SEQ ID NO: 2641867 - protein, 10 aa, Entamoeba histolytica
NGESIKDRSP

SEQ ID NO: 2641868 - protein, 6 aa, Entamoeba histolytica
NGETDN

SEQ ID NO: 2641869 - protein, 7 aa, Entamoeba histolytica
NGETGRA

SEQ ID NO: 2641870 - protein, 12 aa, Entamoeba histolytica
NGEVDNDGQESE

SEQ ID NO: 2641871 - protein, 11 aa, Entamoeba histolytica
NGEVVNQEEDI

SEQ ID NO: 2641872 - protein, 6 aa, Entamoeba histolytica
NGFEEM

SEQ ID NO: 2641873 - protein, 5 aa, Entamoeba histolytica
NGFNA

SEQ ID NO: 2641874 - protein, 36 aa, Entamoeba histolytica
NGFNKQGIRSNRDKRAKQVKNANLDTVTDEGIEETS

SEQ ID NO: 2641875 - protein, 11 aa, Entamoeba histolytica
NGFSMTEGKLG

SEQ ID NO: 2641876 - protein, 23 aa, Entamoeba histolytica
NGFTAQRSDFPTKEKIQREPQRE

SEQ ID NO: 2641877 - protein, 6 aa, Entamoeba histolytica
NGFTPQ

SEQ ID NO: 2641878 - protein, 8 aa, Entamoeba histolytica
NGFTSRRE

SEQ ID NO: 2641879 - protein, 4 aa, Entamoeba histolytica
NGGA

SEQ ID NO: 2641880 - protein, 19 aa, Entamoeba histolytica
NGGAGNNWGKGHYSEGSSL

SEQ ID NO: 2641881 - protein, 5 aa, Entamoeba histolytica
NGGAY

SEQ ID NO: 2641882 - protein, 4 aa, Entamoeba histolytica
NGGE

SEQ ID NO: 2641883 - protein, 10 aa, Entamoeba histolytica
NGGEKTTTLY

SEQ ID NO: 2641884 - protein, 5 aa, Entamoeba histolytica
NGGFD

SEQ ID NO: 2641885 - protein, 4 aa, Entamoeba histolytica
NGGH

SEQ ID NO: 2641886 - protein, 7 aa, Entamoeba histolytica
NGGHSGV

SEQ ID NO: 2641887 - protein, 8 aa, Entamoeba histolytica
NGGIMDSG

SEQ ID NO: 2641888 - protein, 9 aa, Entamoeba histolytica
NGGKDNANY

SEQ ID NO: 2641889 - protein, 5 aa, Entamoeba histolytica
NGGKN

SEQ ID NO: 2641890 - protein, 8 aa, Entamoeba histolytica
NGGKYTVK

SEQ ID NO: 2641891 - protein, 4 aa, Entamoeba histolytica
NGGL

SEQ ID NO: 2641892 - protein, 6 aa, Entamoeba histolytica
NGGNIN

SEQ ID NO: 2641893 - protein, 12 aa, Entamoeba histolytica
NGGNKIRSENPR

SEQ ID NO: 2641894 - protein, 6 aa, Entamoeba histolytica
NGGTGL

SEQ ID NO: 2641895 - protein, 7 aa, Entamoeba histolytica
NGGTGNV

SEQ ID NO: 2641896 - protein, 5 aa, Entamoeba histolytica
NGGYA

SEQ ID NO: 2641897 - protein, 8 aa, Entamoeba histolytica
NGGYEKEQ

SEQ ID NO: 2641898 - protein, 12 aa, Entamoeba histolytica
NGHEICDDKSNK

SEQ ID NO: 2641899 - protein, 7 aa, Entamoeba histolytica
NGHPNAI

SEQ ID NO: 2641900 - protein, 4 aa, Entamoeba histolytica
NGHQ

SEQ ID NO: 2641901 - protein, 6 aa, Entamoeba histolytica
NGHTGD

SEQ ID NO: 2641902 - protein, 31 aa, Entamoeba histolytica
NGHTKTSTPTPDKDKLKKKSKSSKERKCCVL

SEQ ID NO: 2641903 - protein, 4 aa, Entamoeba histolytica
NGID

SEQ ID NO: 2641904 - protein, 5 aa, Entamoeba histolytica
NGIDT

SEQ ID NO: 2641905 - protein, 12 aa, Entamoeba histolytica
NGIEAFDREEIV

SEQ ID NO: 2641906 - protein, 5 aa, Entamoeba histolytica
NGIEN

SEQ ID NO: 2641907 - protein, 5 aa, Entamoeba histolytica
NGIES

SEQ ID NO: 2641908 - protein, 7 aa, Entamoeba histolytica
NGIESNE

SEQ ID NO: 2641909 - protein, 4 aa, Entamoeba histolytica
NGIG

SEQ ID NO: 2641910 - protein, 8 aa, Entamoeba histolytica
NGIGTDAS

SEQ ID NO: 2641911 - protein, 8 aa, Entamoeba histolytica
NGIGTDAT

SEQ ID NO: 2641912 - protein, 14 aa, Entamoeba histolytica
NGIITSKDEEVNKV

SEQ ID NO: 2641913 - protein, 11 aa, Entamoeba histolytica
NGIKGGYVNEK

SEQ ID NO: 2641914 - protein, 9 aa, Entamoeba histolytica
NGIKNEDEF

SEQ ID NO: 2641915 - protein, 17 aa, Entamoeba histolytica
NGINDTNTIEAISILRF

SEQ ID NO: 2641916 - protein, 6 aa, Entamoeba histolytica
NGINNG

SEQ ID NO: 2641917 - protein, 4 aa, Entamoeba histolytica
NGIP

SEQ ID NO: 2641918 - protein, 8 aa, Entamoeba histolytica
NGIPESEI

SEQ ID NO: 2641919 - protein, 6 aa, Entamoeba histolytica
NGIPPD

SEQ ID NO: 2641920 - protein, 7 aa, Entamoeba histolytica
NGIPQGG

SEQ ID NO: 2641921 - protein, 12 aa, Entamoeba histolytica
NGIPSGKRGEQK

SEQ ID NO: 2641922 - protein, 12 aa, Entamoeba histolytica
NGIPTSDNTKDY

SEQ ID NO: 2641923 - protein, 7 aa, Entamoeba histolytica
NGIQKDQ

SEQ ID NO: 2641924 - protein, 6 aa, Entamoeba histolytica
NGIQNP

SEQ ID NO: 2641925 - protein, 7 aa, Entamoeba histolytica
NGIQSSD

SEQ ID NO: 2641926 - protein, 17 aa, Entamoeba histolytica
NGISEKTARRRSESNKR

SEQ ID NO: 2641927 - protein, 11 aa, Entamoeba histolytica
NGISEKTAYRR

SEQ ID NO: 2641928 - protein, 19 aa, Entamoeba histolytica
NGISFGKRKTKQAKKTVQL

SEQ ID NO: 2641929 - protein, 6 aa, Entamoeba histolytica
NGISNS

SEQ ID NO: 2641930 - protein, 7 aa, Entamoeba histolytica
NGITNEE

SEQ ID NO: 2641931 - protein, 6 aa, Entamoeba histolytica
NGITTD

SEQ ID NO: 2641932 - protein, 6 aa, Entamoeba histolytica
NGKDNT

SEQ ID NO: 2641933 - protein, 8 aa, Entamoeba histolytica
NGKDVSDV

SEQ ID NO: 2641934 - protein, 24 aa, Entamoeba histolytica
NGKEELRKSVEREKNEINKSIGEV

SEQ ID NO: 2641935 - protein, 5 aa, Entamoeba histolytica
NGKEF

SEQ ID NO: 2641936 - protein, 9 aa, Entamoeba histolytica
NGKEGKRSD

SEQ ID NO: 2641937 - protein, 5 aa, Entamoeba histolytica
NGKEI

SEQ ID NO: 2641938 - protein, 19 aa, Entamoeba histolytica
NGKEPNKSINPDEAVAYGA

SEQ ID NO: 2641939 - protein, 10 aa, Entamoeba histolytica
NGKESEDQLS

SEQ ID NO: 2641940 - protein, 19 aa, Entamoeba histolytica
NGKEYKTKHDNNTSEPKWE

SEQ ID NO: 2641941 - protein, 4 aa, Entamoeba histolytica
NGKF

SEQ ID NO: 2641942 - protein, 7 aa, Entamoeba histolytica
NGKFEQG

SEQ ID NO: 2641943 - protein, 7 aa, Entamoeba histolytica
NGKFNTK

SEQ ID NO: 2641944 - protein, 8 aa, Entamoeba histolytica
NGKGIGCG

SEQ ID NO: 2641945 - protein, 16 aa, Entamoeba histolytica
NGKGIKEIEEEFGNDT

SEQ ID NO: 2641946 - protein, 12 aa, Entamoeba histolytica
NGKGSSQNTHPH

SEQ ID NO: 2641947 - protein, 10 aa, Entamoeba histolytica
NGKISGGGAI

SEQ ID NO: 2641948 - protein, 9 aa, Entamoeba histolytica
NGKKIKNSI

SEQ ID NO: 2641949 - protein, 8 aa, Entamoeba histolytica
NGKKKTNY

SEQ ID NO: 2641950 - protein, 9 aa, Entamoeba histolytica
NGKKTPKQV

SEQ ID NO: 2641951 - protein, 4 aa, Entamoeba histolytica
NGKL

SEQ ID NO: 2641952 - protein, 7 aa, Entamoeba histolytica
NGKLEKD

SEQ ID NO: 2641953 - protein, 12 aa, Entamoeba histolytica
NGKMNATATVRT

SEQ ID NO: 2641954 - protein, 7 aa, Entamoeba histolytica
NGKNENE

SEQ ID NO: 2641955 - protein, 5 aa, Entamoeba histolytica
NGKNI

SEQ ID NO: 2641956 - protein, 6 aa, Entamoeba histolytica
NGKNTG

SEQ ID NO: 2641957 - protein, 5 aa, Entamoeba histolytica
NGKNV

SEQ ID NO: 2641958 - protein, 6 aa, Entamoeba histolytica
NGKPAE

SEQ ID NO: 2641959 - protein, 16 aa, Entamoeba histolytica
NGKPNIQSSEKRRKEL

SEQ ID NO: 2641960 - protein, 7 aa, Entamoeba histolytica
NGKPVFS

SEQ ID NO: 2641961 - protein, 8 aa, Entamoeba histolytica
NGKQAPNE

SEQ ID NO: 2641962 - protein, 15 aa, Entamoeba histolytica
NGKQIGKYEGHASTI

SEQ ID NO: 2641963 - protein, 12 aa, Entamoeba histolytica
NGKREGNSGNLF

SEQ ID NO: 2641964 - protein, 14 aa, Entamoeba histolytica
NGKRGFVPSNFLQP

SEQ ID NO: 2641965 - protein, 8 aa, Entamoeba histolytica
NGKRIPLK

SEQ ID NO: 2641966 - protein, 8 aa, Entamoeba histolytica
NGKRTNEC

SEQ ID NO: 2641967 - protein, 5 aa, Entamoeba histolytica
NGKRV

SEQ ID NO: 2641968 - protein, 7 aa, Entamoeba histolytica
NGKSLKE

SEQ ID NO: 2641969 - protein, 8 aa, Entamoeba histolytica
NGKSPSWC

SEQ ID NO: 2641970 - protein, 8 aa, Entamoeba histolytica
NGKSQKQL

SEQ ID NO: 2641971 - protein, 5 aa, Entamoeba histolytica
NGKTF

SEQ ID NO: 2641972 - protein, 5 aa, Entamoeba histolytica
NGKYP

SEQ ID NO: 2641973 - protein, 4 aa, Entamoeba histolytica
NGLE

SEQ ID NO: 2641974 - protein, 5 aa, Entamoeba histolytica
NGLEA

SEQ ID NO: 2641975 - protein, 5 aa, Entamoeba histolytica
NGLEN

SEQ ID NO: 2641976 - protein, 9 aa, Entamoeba histolytica
NGLEQKETI

SEQ ID NO: 2641977 - protein, 9 aa, Entamoeba histolytica
NGLKAKEND

SEQ ID NO: 2641978 - protein, 24 aa, Entamoeba histolytica
NGLKPVPETRQRNTRLKERRQVQM

SEQ ID NO: 2641979 - protein, 10 aa, Entamoeba histolytica
NGLKRTVATK

SEQ ID NO: 2641980 - protein, 21 aa, Entamoeba histolytica
NGLKTSDIKKAMDDHPTIHFV

SEQ ID NO: 2641981 - protein, 4 aa, Entamoeba histolytica
NGLN

SEQ ID NO: 2641982 - protein, 9 aa, Entamoeba histolytica
NGLNGQEKE

SEQ ID NO: 2641983 - protein, 7 aa, Entamoeba histolytica
NGLPPPL

SEQ ID NO: 2641984 - protein, 6 aa, Entamoeba histolytica
NGLPTQ

SEQ ID NO: 2641985 - protein, 4 aa, Entamoeba histolytica
NGLR

SEQ ID NO: 2641986 - protein, 12 aa, Entamoeba histolytica
NGLREKKRDEML

SEQ ID NO: 2641987 - protein, 7 aa, Entamoeba histolytica
NGLSDNE

SEQ ID NO: 2641988 - protein, 5 aa, Entamoeba histolytica
NGLSE

SEQ ID NO: 2641989 - protein, 6 aa, Entamoeba histolytica
NGLSEE

SEQ ID NO: 2641990 - protein, 6 aa, Entamoeba histolytica
NGLSEG

SEQ ID NO: 2641991 - protein, 9 aa, Entamoeba histolytica
NGLSQSEDV

SEQ ID NO: 2641992 - protein, 6 aa, Entamoeba histolytica
NGMEGV

SEQ ID NO: 2641993 - protein, 4 aa, Entamoeba histolytica
NGMK

SEQ ID NO: 2641994 - protein, 20 aa, Entamoeba histolytica
NGMKSSDTSLEETEVDENMT

SEQ ID NO: 2641995 - protein, 13 aa, Entamoeba histolytica
NGMNNGDTSTKDF

SEQ ID NO: 2641996 - protein, 13 aa, Entamoeba histolytica
NGNCADDFEQGND

SEQ ID NO: 2641997 - protein, 6 aa, Entamoeba histolytica
NGNCEQ

SEQ ID NO: 2641998 - protein, 12 aa, Entamoeba histolytica
NGNDENFTDEDG

SEQ ID NO: 2641999 - protein, 9 aa, Entamoeba histolytica
NGNDETSFR

SEQ ID NO: 2642000 - protein, 6 aa, Entamoeba histolytica
NGNDGL

SEQ ID NO: 2642001 - protein, 12 aa, Entamoeba histolytica
NGNDTQLKTQAS

SEQ ID NO: 2642002 - protein, 7 aa, Entamoeba histolytica
NGNELAN

SEQ ID NO: 2642003 - protein, 11 aa, Entamoeba histolytica
NGNELQKRKPA

SEQ ID NO: 2642004 - protein, 8 aa, Entamoeba histolytica
NGNENTTV

SEQ ID NO: 2642005 - protein, 14 aa, Entamoeba histolytica
NGNESKLSSNGITG

SEQ ID NO: 2642006 - protein, 9 aa, Entamoeba histolytica
NGNHEGHDY

SEQ ID NO: 2642007 - protein, 7 aa, Entamoeba histolytica
NGNIESQ

SEQ ID NO: 2642008 - protein, 7 aa, Entamoeba histolytica
NGNISNE

SEQ ID NO: 2642009 - protein, 7 aa, Entamoeba histolytica
NGNITTE

SEQ ID NO: 2642010 - protein, 5 aa, Entamoeba histolytica
NGNKD

SEQ ID NO: 2642011 - protein, 6 aa, Entamoeba histolytica
NGNKEI

SEQ ID NO: 2642012 - protein, 8 aa, Entamoeba histolytica
NGNKNHIR

SEQ ID NO: 2642013 - protein, 11 aa, Entamoeba histolytica
NGNKNIEIDGT

SEQ ID NO: 2642014 - protein, 5 aa, Entamoeba histolytica
NGNKT

SEQ ID NO: 2642015 - protein, 9 aa, Entamoeba histolytica
NGNLSTQKI

SEQ ID NO: 2642016 - protein, 4 aa, Entamoeba histolytica
NGNM

SEQ ID NO: 2642017 - protein, 13 aa, Entamoeba histolytica
NGNNELGGNNFDE

SEQ ID NO: 2642018 - protein, 9 aa, Entamoeba histolytica
NGNNYSQYN

SEQ ID NO: 2642019 - protein, 5 aa, Entamoeba histolytica
NGNPL

SEQ ID NO: 2642020 - protein, 5 aa, Entamoeba histolytica
NGNPV

SEQ ID NO: 2642021 - protein, 8 aa, Entamoeba histolytica
NGNQPTYE

SEQ ID NO: 2642022 - protein, 7 aa, Entamoeba histolytica
NGNQQQH

SEQ ID NO: 2642023 - protein, 6 aa, Entamoeba histolytica
NGNQSI

SEQ ID NO: 2642024 - protein, 6 aa, Entamoeba histolytica
NGNRDP

SEQ ID NO: 2642025 - protein, 12 aa, Entamoeba histolytica
NGNRVSRTATWT

SEQ ID NO: 2642026 - protein, 4 aa, Entamoeba histolytica
NGNT

SEQ ID NO: 2642027 - protein, 4 aa, Entamoeba histolytica
NGNY

SEQ ID NO: 2642028 - protein, 13 aa, Entamoeba histolytica
NGNYSGQPNVFGT

SEQ ID NO: 2642029 - protein, 7 aa, Entamoeba histolytica
NGPAVAD

SEQ ID NO: 2642030 - protein, 5 aa, Entamoeba histolytica
NGPIT

SEQ ID NO: 2642031 - protein, 10 aa, Entamoeba histolytica
NGPQHNENDI

SEQ ID NO: 2642032 - protein, 7 aa, Entamoeba histolytica
NGPQLDK

SEQ ID NO: 2642033 - protein, 7 aa, Entamoeba histolytica
NGPSCSH

SEQ ID NO: 2642034 - protein, 4 aa, Entamoeba histolytica
NGPT

SEQ ID NO: 2642035 - protein, 5 aa, Entamoeba histolytica
NGQCS

SEQ ID NO: 2642036 - protein, 5 aa, Entamoeba histolytica
NGQEE

SEQ ID NO: 2642037 - protein, 7 aa, Entamoeba histolytica
NGQEGNG

SEQ ID NO: 2642038 - protein, 8 aa, Entamoeba histolytica
NGQESNLD

SEQ ID NO: 2642039 - protein, 8 aa, Entamoeba histolytica
NGQEYPEN

SEQ ID NO: 2642040 - protein, 17 aa, Entamoeba histolytica
NGQGFKPTISKNEMSEE

SEQ ID NO: 2642041 - protein, 5 aa, Entamoeba histolytica
NGQNY

SEQ ID NO: 2642042 - protein, 20 aa, Entamoeba histolytica
NGQQKRRTRKVDDITPELSE

SEQ ID NO: 2642043 - protein, 5 aa, Entamoeba histolytica
NGQRV

SEQ ID NO: 2642044 - protein, 6 aa, Entamoeba histolytica
NGQSIR

SEQ ID NO: 2642045 - protein, 6 aa, Entamoeba histolytica
NGQTAE

SEQ ID NO: 2642046 - protein, 14 aa, Entamoeba histolytica
NGQTGQFPSNYVTL

SEQ ID NO: 2642047 - protein, 6 aa, Entamoeba histolytica
NGQTVT

SEQ ID NO: 2642048 - protein, 4 aa, Entamoeba histolytica
NGRF

SEQ ID NO: 2642049 - protein, 7 aa, Entamoeba histolytica
NGRGDEV

SEQ ID NO: 2642050 - protein, 6 aa, Entamoeba histolytica
NGRGDR

SEQ ID NO: 2642051 - protein, 10 aa, Entamoeba histolytica
NGRHNSNYSR

SEQ ID NO: 2642052 - protein, 4 aa, Entamoeba histolytica
NGRI

SEQ ID NO: 2642053 - protein, 8 aa, Entamoeba histolytica
NGRIQDPQ

SEQ ID NO: 2642054 - protein, 5 aa, Entamoeba histolytica
NGRIT

SEQ ID NO: 2642055 - protein, 6 aa, Entamoeba histolytica
NGRNGV

SEQ ID NO: 2642056 - protein, 6 aa, Entamoeba histolytica
NGRPER

SEQ ID NO: 2642057 - protein, 9 aa, Entamoeba histolytica
NGRSPNAVK

SEQ ID NO: 2642058 - protein, 14 aa, Entamoeba histolytica
NGRSQGSNIRSTQR

SEQ ID NO: 2642059 - protein, 6 aa, Entamoeba histolytica
NGRSRR

SEQ ID NO: 2642060 - protein, 6 aa, Entamoeba histolytica
NGRTNK

SEQ ID NO: 2642061 - protein, 4 aa, Entamoeba histolytica
NGRV

SEQ ID NO: 2642062 - protein, 60 aa, Entamoeba histolytica
NGRVNENTPLNKETTNQKPVQQQNENQTYQGVENKTTTTTETVPNNKQDIKPTEPPTEKK

SEQ ID NO: 2642063 - protein, 7 aa, Entamoeba histolytica
NGRVNGN

SEQ ID NO: 2642064 - protein, 8 aa, Entamoeba histolytica
NGRYGTDM

SEQ ID NO: 2642065 - protein, 18 aa, Entamoeba histolytica
NGRYPQPTEEQRERDNRS

SEQ ID NO: 2642066 - protein, 4 aa, Entamoeba histolytica
NGSC

SEQ ID NO: 2642067 - protein, 7 aa, Entamoeba histolytica
NGSCQYD

SEQ ID NO: 2642068 - protein, 11 aa, Entamoeba histolytica
NGSDDAKKAVK

SEQ ID NO: 2642069 - protein, 8 aa, Entamoeba histolytica
NGSDESQS

SEQ ID NO: 2642070 - protein, 6 aa, Entamoeba histolytica
NGSDKT

SEQ ID NO: 2642071 - protein, 5 aa, Entamoeba histolytica
NGSDY

SEQ ID NO: 2642072 - protein, 6 aa, Entamoeba histolytica
NGSERM

SEQ ID NO: 2642073 - protein, 11 aa, Entamoeba histolytica
NGSESDENDDL

SEQ ID NO: 2642074 - protein, 8 aa, Entamoeba histolytica
NGSEVNEQ

SEQ ID NO: 2642075 - protein, 7 aa, Entamoeba histolytica
NGSGSSE

SEQ ID NO: 2642076 - protein, 9 aa, Entamoeba histolytica
NGSIDQSRG

SEQ ID NO: 2642077 - protein, 4 aa, Entamoeba histolytica
NGSL

SEQ ID NO: 2642078 - protein, 5 aa, Entamoeba histolytica
NGSLG

SEQ ID NO: 2642079 - protein, 4 aa, Entamoeba histolytica
NGSN

SEQ ID NO: 2642080 - protein, 7 aa, Entamoeba histolytica
NGSNDSI

SEQ ID NO: 2642081 - protein, 6 aa, Entamoeba histolytica
NGSNQN

SEQ ID NO: 2642082 - protein, 6 aa, Entamoeba histolytica
NGSNVD

SEQ ID NO: 2642083 - protein, 7 aa, Entamoeba histolytica
NGSPFTA

SEQ ID NO: 2642084 - protein, 8 aa, Entamoeba histolytica
NGSPQNTL

SEQ ID NO: 2642085 - protein, 10 aa, Entamoeba histolytica
NGSQSISETS

SEQ ID NO: 2642086 - protein, 8 aa, Entamoeba histolytica
NGSRVTPR

SEQ ID NO: 2642087 - protein, 6 aa, Entamoeba histolytica
NGSSDY

SEQ ID NO: 2642088 - protein, 21 aa, Entamoeba histolytica
NGSSGTQTKECPSNYLQVTLS

SEQ ID NO: 2642089 - protein, 5 aa, Entamoeba histolytica
NGSSI

SEQ ID NO: 2642090 - protein, 6 aa, Entamoeba histolytica
NGSSQC

SEQ ID NO: 2642091 - protein, 9 aa, Entamoeba histolytica
NGSSSVEDK

SEQ ID NO: 2642092 - protein, 5 aa, Entamoeba histolytica
NGSTI

SEQ ID NO: 2642093 - protein, 13 aa, Entamoeba histolytica
NGSTLRCSWGRES

SEQ ID NO: 2642094 - protein, 8 aa, Entamoeba histolytica
NGSTSLTS

SEQ ID NO: 2642095 - protein, 6 aa, Entamoeba histolytica
NGSTWN

SEQ ID NO: 2642096 - protein, 17 aa, Entamoeba histolytica
NGSVEIGSSGRGDNFDG

SEQ ID NO: 2642097 - protein, 9 aa, Entamoeba histolytica
NGSVTPNNW

SEQ ID NO: 2642098 - protein, 5 aa, Entamoeba histolytica
NGSYD

SEQ ID NO: 2642099 - protein, 5 aa, Entamoeba histolytica
NGTAT

SEQ ID NO: 2642100 - protein, 6 aa, Entamoeba histolytica
NGTCNS

SEQ ID NO: 2642101 - protein, 5 aa, Entamoeba histolytica
NGTDL

SEQ ID NO: 2642102 - protein, 5 aa, Entamoeba histolytica
NGTDY

SEQ ID NO: 2642103 - protein, 9 aa, Entamoeba histolytica
NGTEIPQEN

SEQ ID NO: 2642104 - protein, 15 aa, Entamoeba histolytica
NGTEKIPEKRSRAAT

SEQ ID NO: 2642105 - protein, 13 aa, Entamoeba histolytica
NGTESNIIIFEPN

SEQ ID NO: 2642106 - protein, 12 aa, Entamoeba histolytica
NGTESSFTKQKY

SEQ ID NO: 2642107 - protein, 7 aa, Entamoeba histolytica
NGTETSD

SEQ ID NO: 2642108 - protein, 5 aa, Entamoeba histolytica
NGTEV

SEQ ID NO: 2642109 - protein, 7 aa, Entamoeba histolytica
NGTGKVV

SEQ ID NO: 2642110 - protein, 8 aa, Entamoeba histolytica
NGTGNGKV

SEQ ID NO: 2642111 - protein, 14 aa, Entamoeba histolytica
NGTGQVTIKKNNKS

SEQ ID NO: 2642112 - protein, 6 aa, Entamoeba histolytica
NGTGYS

SEQ ID NO: 2642113 - protein, 7 aa, Entamoeba histolytica
NGTIGSQ

SEQ ID NO: 2642114 - protein, 5 aa, Entamoeba histolytica
NGTIK

SEQ ID NO: 2642115 - protein, 8 aa, Entamoeba histolytica
NGTKAVGH

SEQ ID NO: 2642116 - protein, 7 aa, Entamoeba histolytica
NGTKRVN

SEQ ID NO: 2642117 - protein, 9 aa, Entamoeba histolytica
NGTKSQNEH

SEQ ID NO: 2642118 - protein, 4 aa, Entamoeba histolytica
NGTL

SEQ ID NO: 2642119 - protein, 7 aa, Entamoeba histolytica
NGTLPHE

SEQ ID NO: 2642120 - protein, 7 aa, Entamoeba histolytica
NGTMSNT

SEQ ID NO: 2642121 - protein, 7 aa, Entamoeba histolytica
NGTNETI

SEQ ID NO: 2642122 - protein, 10 aa, Entamoeba histolytica
NGTNETQEQL

SEQ ID NO: 2642123 - protein, 14 aa, Entamoeba histolytica
NGTPRQGLLSPTTR

SEQ ID NO: 2642124 - protein, 9 aa, Entamoeba histolytica
NGTPYDGSK

SEQ ID NO: 2642125 - protein, 7 aa, Entamoeba histolytica
NGTRPDV

SEQ ID NO: 2642126 - protein, 8 aa, Entamoeba histolytica
NGTSPILP

SEQ ID NO: 2642127 - protein, 16 aa, Entamoeba histolytica
NGTSQPPKVSFPNGSI

SEQ ID NO: 2642128 - protein, 5 aa, Entamoeba histolytica
NGTSV

SEQ ID NO: 2642129 - protein, 6 aa, Entamoeba histolytica
NGTTIR

SEQ ID NO: 2642130 - protein, 7 aa, Entamoeba histolytica
NGTTPSQ

SEQ ID NO: 2642131 - protein, 6 aa, Entamoeba histolytica
NGTVER

SEQ ID NO: 2642132 - protein, 5 aa, Entamoeba histolytica
NGTYN

SEQ ID NO: 2642133 - protein, 17 aa, Entamoeba histolytica
NGTYNLKPEYQTEGAIL

SEQ ID NO: 2642134 - protein, 7 aa, Entamoeba histolytica
NGVAHTK

SEQ ID NO: 2642135 - protein, 4 aa, Entamoeba histolytica
NGVD

SEQ ID NO: 2642136 - protein, 4 aa, Entamoeba histolytica
NGVE

SEQ ID NO: 2642137 - protein, 6 aa, Entamoeba histolytica
NGVEEK

SEQ ID NO: 2642138 - protein, 11 aa, Entamoeba histolytica
NGVEPSDEYHQ

SEQ ID NO: 2642139 - protein, 10 aa, Entamoeba histolytica
NGVESGTTIT

SEQ ID NO: 2642140 - protein, 5 aa, Entamoeba histolytica
NGVGK

SEQ ID NO: 2642141 - protein, 4 aa, Entamoeba histolytica
NGVI

SEQ ID NO: 2642142 - protein, 7 aa, Entamoeba histolytica
NGVPKEL

SEQ ID NO: 2642143 - protein, 8 aa, Entamoeba histolytica
NGVPTVSR

SEQ ID NO: 2642144 - protein, 5 aa, Entamoeba histolytica
NGVQP

SEQ ID NO: 2642145 - protein, 4 aa, Entamoeba histolytica
NGVS

SEQ ID NO: 2642146 - protein, 4 aa, Entamoeba histolytica
NGVT

SEQ ID NO: 2642147 - protein, 5 aa, Entamoeba histolytica
NGVTK

SEQ ID NO: 2642148 - protein, 5 aa, Entamoeba histolytica
NGVTP

SEQ ID NO: 2642149 - protein, 6 aa, Entamoeba histolytica
NGVTPR

SEQ ID NO: 2642150 - protein, 18 aa, Entamoeba histolytica
NGVTSKTAIRRGQNNRKI

SEQ ID NO: 2642151 - protein, 5 aa, Entamoeba histolytica
NGVYE

SEQ ID NO: 2642152 - protein, 5 aa, Entamoeba histolytica
NGWEQ

SEQ ID NO: 2642153 - protein, 4 aa, Entamoeba histolytica
NGWN

SEQ ID NO: 2642154 - protein, 7 aa, Entamoeba histolytica
NGYDEKG

SEQ ID NO: 2642155 - protein, 7 aa, Entamoeba histolytica
NGYEEEE

SEQ ID NO: 2642156 - protein, 8 aa, Entamoeba histolytica
NGYEEKGL

SEQ ID NO: 2642157 - protein, 8 aa, Entamoeba histolytica
NGYESKEC

SEQ ID NO: 2642158 - protein, 6 aa, Entamoeba histolytica
NGYLQK

SEQ ID NO: 2642159 - protein, 4 aa, Entamoeba histolytica
NGYN

SEQ ID NO: 2642160 - protein, 7 aa, Entamoeba histolytica
NGYPNET

SEQ ID NO: 2642161 - protein, 7 aa, Entamoeba histolytica
NGYPSFP

SEQ ID NO: 2642162 - protein, 6 aa, Entamoeba histolytica
NGYQSE

SEQ ID NO: 2642163 - protein, 7 aa, Entamoeba histolytica
NGYRGGL

SEQ ID NO: 2642164 - protein, 65 aa, Entamoeba histolytica
NGYSPRRGVRRDDPYLSPRRDIRREEPYLSPRREMRRDDPYLSPRREIRRDDPYLSPRRDIRRED

SEQ ID NO: 2642165 - protein, 9 aa, Entamoeba histolytica
NHAKNNEIN

SEQ ID NO: 2642166 - protein, 7 aa, Entamoeba histolytica
NHAPKNR

SEQ ID NO: 2642167 - protein, 5 aa, Entamoeba histolytica
NHCPE

SEQ ID NO: 2642168 - protein, 10 aa, Entamoeba histolytica
NHEDADPAQC

SEQ ID NO: 2642169 - protein, 5 aa, Entamoeba histolytica
NHEDE

SEQ ID NO: 2642170 - protein, 6 aa, Entamoeba histolytica
NHEDEK

SEQ ID NO: 2642171 - protein, 9 aa, Entamoeba histolytica
NHEDKDNPL

SEQ ID NO: 2642172 - protein, 13 aa, Entamoeba histolytica
NHEGSQVNGSTQV

SEQ ID NO: 2642173 - protein, 10 aa, Entamoeba histolytica
NHEKKQQIKT

SEQ ID NO: 2642174 - protein, 5 aa, Entamoeba histolytica
NHERG

SEQ ID NO: 2642175 - protein, 6 aa, Entamoeba histolytica
NHESRA

SEQ ID NO: 2642176 - protein, 8 aa, Entamoeba histolytica
NHESRNMT

SEQ ID NO: 2642177 - protein, 8 aa, Entamoeba histolytica
NHESRSMT

SEQ ID NO: 2642178 - protein, 5 aa, Entamoeba histolytica
NHESS

SEQ ID NO: 2642179 - protein, 7 aa, Entamoeba histolytica
NHESSSM

SEQ ID NO: 2642180 - protein, 10 aa, Entamoeba histolytica
NHESSTGETI

SEQ ID NO: 2642181 - protein, 8 aa, Entamoeba histolytica
NHETRQIS

SEQ ID NO: 2642182 - protein, 15 aa, Entamoeba histolytica
NHGIERDSGEVELAG

SEQ ID NO: 2642183 - protein, 4 aa, Entamoeba histolytica
NHGY

SEQ ID NO: 2642184 - protein, 11 aa, Entamoeba histolytica
NHHGSEHSNNA

SEQ ID NO: 2642185 - protein, 10 aa, Entamoeba histolytica
NHHKERQELT

SEQ ID NO: 2642186 - protein, 4 aa, Entamoeba histolytica
NHHN

SEQ ID NO: 2642187 - protein, 9 aa, Entamoeba histolytica
NHKDIEAAK

SEQ ID NO: 2642188 - protein, 11 aa, Entamoeba histolytica
NHKKSHSKGDA

SEQ ID NO: 2642189 - protein, 12 aa, Entamoeba histolytica
NHKKTTKKLPNG

SEQ ID NO: 2642190 - protein, 15 aa, Entamoeba histolytica
NHKPSQMSGGEQQRV

SEQ ID NO: 2642191 - protein, 31 aa, Entamoeba histolytica
NHKTNTPTKDRRKRATTLTNSTPMKKEIMQL

SEQ ID NO: 2642192 - protein, 13 aa, Entamoeba histolytica
NHKYGRNSDAFQY

SEQ ID NO: 2642193 - protein, 4 aa, Entamoeba histolytica
NHLG

SEQ ID NO: 2642194 - protein, 5 aa, Entamoeba histolytica
NHLPT

SEQ ID NO: 2642195 - protein, 9 aa, Entamoeba histolytica
NHLTDENEE

SEQ ID NO: 2642196 - protein, 7 aa, Entamoeba histolytica
NHNDSDN

SEQ ID NO: 2642197 - protein, 14 aa, Entamoeba histolytica
NHNDTSEESSESMD

SEQ ID NO: 2642198 - protein, 6 aa, Entamoeba histolytica
NHNNTT

SEQ ID NO: 2642199 - protein, 5 aa, Entamoeba histolytica
NHNPL

SEQ ID NO: 2642200 - protein, 15 aa, Entamoeba histolytica
NHNQIKQSSSRDEMI

SEQ ID NO: 2642201 - protein, 8 aa, Entamoeba histolytica
NHNSDIET

SEQ ID NO: 2642202 - protein, 7 aa, Entamoeba histolytica
NHNVTTN

SEQ ID NO: 2642203 - protein, 9 aa, Entamoeba histolytica
NHPAIKTKG

SEQ ID NO: 2642204 - protein, 40 aa, Entamoeba histolytica
NHPDDRRLSKVSSSKKLVKEKEKKNENSEMSEAKGCTKEE

SEQ ID NO: 2642205 - protein, 5 aa, Entamoeba histolytica
NHPED

SEQ ID NO: 2642206 - protein, 8 aa, Entamoeba histolytica
NHPKGSSI

SEQ ID NO: 2642207 - protein, 12 aa, Entamoeba histolytica
NHPMNDKMGTNT

SEQ ID NO: 2642208 - protein, 11 aa, Entamoeba histolytica
NHPNDEIRESA

SEQ ID NO: 2642209 - protein, 5 aa, Entamoeba histolytica
NHPNH

SEQ ID NO: 2642210 - protein, 5 aa, Entamoeba histolytica
NHPNI

SEQ ID NO: 2642211 - protein, 6 aa, Entamoeba histolytica
NHPNNP

SEQ ID NO: 2642212 - protein, 8 aa, Entamoeba histolytica
NHPNTSLR

SEQ ID NO: 2642213 - protein, 7 aa, Entamoeba histolytica
NHPPTSF

SEQ ID NO: 2642214 - protein, 10 aa, Entamoeba histolytica
NHPSLTKDKE

SEQ ID NO: 2642215 - protein, 31 aa, Entamoeba histolytica
NHPTTTMSVETNTNPFNEDNETLDKNSKTAV

SEQ ID NO: 2642216 - protein, 11 aa, Entamoeba histolytica
NHQNDKIRDAG

SEQ ID NO: 2642217 - protein, 5 aa, Entamoeba histolytica
NHQNR

SEQ ID NO: 2642218 - protein, 11 aa, Entamoeba histolytica
NHQNYREEFEK

SEQ ID NO: 2642219 - protein, 18 aa, Entamoeba histolytica
NHRNYREEFNKRNTNERI

SEQ ID NO: 2642220 - protein, 7 aa, Entamoeba histolytica
NHRPATC

SEQ ID NO: 2642221 - protein, 8 aa, Entamoeba histolytica
NHSDGTKQ

SEQ ID NO: 2642222 - protein, 5 aa, Entamoeba histolytica
NHSEE

SEQ ID NO: 2642223 - protein, 5 aa, Entamoeba histolytica
NHSFT

SEQ ID NO: 2642224 - protein, 6 aa, Entamoeba histolytica
NHSKKT

SEQ ID NO: 2642225 - protein, 6 aa, Entamoeba histolytica
NHSPKQ

SEQ ID NO: 2642226 - protein, 6 aa, Entamoeba histolytica
NHSQDV

SEQ ID NO: 2642227 - protein, 6 aa, Entamoeba histolytica
NHSQSI

SEQ ID NO: 2642228 - protein, 10 aa, Entamoeba histolytica
NHSSLNTSIQ

SEQ ID NO: 2642229 - protein, 26 aa, Entamoeba histolytica
NHSSQKSKDSQEQKQFVEKDDESIEK

SEQ ID NO: 2642230 - protein, 7 aa, Entamoeba histolytica
NHTITEM

SEQ ID NO: 2642231 - protein, 7 aa, Entamoeba histolytica
NHTNTEK

SEQ ID NO: 2642232 - protein, 5 aa, Entamoeba histolytica
NHTQF

SEQ ID NO: 2642233 - protein, 12 aa, Entamoeba histolytica
NHVDGKSLDTHL

SEQ ID NO: 2642234 - protein, 7 aa, Entamoeba histolytica
NHVNGTN

SEQ ID NO: 2642235 - protein, 9 aa, Entamoeba histolytica
NIADGDEKV

SEQ ID NO: 2642236 - protein, 4 aa, Entamoeba histolytica
NIAT

SEQ ID NO: 2642237 - protein, 9 aa, Entamoeba histolytica
NIATNTRDG

SEQ ID NO: 2642238 - protein, 10 aa, Entamoeba histolytica
NIDAKKEAKD

SEQ ID NO: 2642239 - protein, 6 aa, Entamoeba histolytica
NIDEKF

SEQ ID NO: 2642240 - protein, 4 aa, Entamoeba histolytica
NIDK

SEQ ID NO: 2642241 - protein, 19 aa, Entamoeba histolytica
NIDKQEKYYSSQVTSPELS

SEQ ID NO: 2642242 - protein, 8 aa, Entamoeba histolytica
NIDPETSL

SEQ ID NO: 2642243 - protein, 12 aa, Entamoeba histolytica
NIDPNTGKEVGY

SEQ ID NO: 2642244 - protein, 8 aa, Entamoeba histolytica
NIDVKESD

SEQ ID NO: 2642245 - protein, 12 aa, Entamoeba histolytica
NIEDDTGDEDEY

SEQ ID NO: 2642246 - protein, 7 aa, Entamoeba histolytica
NIEDTET

SEQ ID NO: 2642247 - protein, 48 aa, Entamoeba histolytica
NIEEDSDDDENTCYGDNESNDEEENDDQLFEPDTSDIINSTDRHNTLQ

SEQ ID NO: 2642248 - protein, 7 aa, Entamoeba histolytica
NIEENRK

SEQ ID NO: 2642249 - protein, 5 aa, Entamoeba histolytica
NIEEQ

SEQ ID NO: 2642250 - protein, 7 aa, Entamoeba histolytica
NIEESTD

SEQ ID NO: 2642251 - protein, 16 aa, Entamoeba histolytica
NIEKEQSVVTKPQPTV

SEQ ID NO: 2642252 - protein, 8 aa, Entamoeba histolytica
NIEKKNIN

SEQ ID NO: 2642253 - protein, 7 aa, Entamoeba histolytica
NIEKKQF

SEQ ID NO: 2642254 - protein, 5 aa, Entamoeba histolytica
NIEKY

SEQ ID NO: 2642255 - protein, 15 aa, Entamoeba histolytica
NIEKYEQEFNWLNQT

SEQ ID NO: 2642256 - protein, 4 aa, Entamoeba histolytica
NIEL

SEQ ID NO: 2642257 - protein, 4 aa, Entamoeba histolytica
NIEN

SEQ ID NO: 2642258 - protein, 7 aa, Entamoeba histolytica
NIENEIH

SEQ ID NO: 2642259 - protein, 10 aa, Entamoeba histolytica
NIENNKENEL

SEQ ID NO: 2642260 - protein, 10 aa, Entamoeba histolytica
NIENNSLDEV

SEQ ID NO: 2642261 - protein, 5 aa, Entamoeba histolytica
NIEPG

SEQ ID NO: 2642262 - protein, 7 aa, Entamoeba histolytica
NIEPSRG

SEQ ID NO: 2642263 - protein, 6 aa, Entamoeba histolytica
NIEQGA

SEQ ID NO: 2642264 - protein, 8 aa, Entamoeba histolytica
NIEQKKPT

SEQ ID NO: 2642265 - protein, 5 aa, Entamoeba histolytica
NIEQL

SEQ ID NO: 2642266 - protein, 11 aa, Entamoeba histolytica
NIEQQVQTTGK

SEQ ID NO: 2642267 - protein, 7 aa, Entamoeba histolytica
NIESGDG

SEQ ID NO: 2642268 - protein, 7 aa, Entamoeba histolytica
NIETDDI

SEQ ID NO: 2642269 - protein, 8 aa, Entamoeba histolytica
NIETEKSQ

SEQ ID NO: 2642270 - protein, 7 aa, Entamoeba histolytica
NIETGKN

SEQ ID NO: 2642271 - protein, 7 aa, Entamoeba histolytica
NIETKNN

SEQ ID NO: 2642272 - protein, 7 aa, Entamoeba histolytica
NIETKSD

SEQ ID NO: 2642273 - protein, 7 aa, Entamoeba histolytica
NIETNGI

SEQ ID NO: 2642274 - protein, 5 aa, Entamoeba histolytica
NIEVN

SEQ ID NO: 2642275 - protein, 5 aa, Entamoeba histolytica
NIEVR

SEQ ID NO: 2642276 - protein, 9 aa, Entamoeba histolytica
NIGAGGAEL

SEQ ID NO: 2642277 - protein, 8 aa, Entamoeba histolytica
NIGDNELP

SEQ ID NO: 2642278 - protein, 4 aa, Entamoeba histolytica
NIGG

SEQ ID NO: 2642279 - protein, 4 aa, Entamoeba histolytica
NIGN

SEQ ID NO: 2642280 - protein, 7 aa, Entamoeba histolytica
NIGQSQK

SEQ ID NO: 2642281 - protein, 11 aa, Entamoeba histolytica
NIGSAFSKEGE

SEQ ID NO: 2642282 - protein, 11 aa, Entamoeba histolytica
NIGSEKSNANF

SEQ ID NO: 2642283 - protein, 9 aa, Entamoeba histolytica
NIGSNSLSK

SEQ ID NO: 2642284 - protein, 5 aa, Entamoeba histolytica
NIGTS

SEQ ID NO: 2642285 - protein, 22 aa, Entamoeba histolytica
NIGTTVKNYRSKQKKMKEDKNA

SEQ ID NO: 2642286 - protein, 14 aa, Entamoeba histolytica
NIHTDGANNSFKNE

SEQ ID NO: 2642287 - protein, 17 aa, Entamoeba histolytica
NIIRPTTKEDGVSQRKM

SEQ ID NO: 2642288 - protein, 6 aa, Entamoeba histolytica
NIKEKS

SEQ ID NO: 2642289 - protein, 8 aa, Entamoeba histolytica
NIKEKSKA

SEQ ID NO: 2642290 - protein, 8 aa, Entamoeba histolytica
NIKKEGDK

SEQ ID NO: 2642291 - protein, 7 aa, Entamoeba histolytica
NIKKGSP

SEQ ID NO: 2642292 - protein, 11 aa, Entamoeba histolytica
NIKNSSNEEKF

SEQ ID NO: 2642293 - protein, 7 aa, Entamoeba histolytica
NIKNSYD

SEQ ID NO: 2642294 - protein, 11 aa, Entamoeba histolytica
NIKPNNKYLEE

SEQ ID NO: 2642295 - protein, 12 aa, Entamoeba histolytica
NIKQPINQQEKS

SEQ ID NO: 2642296 - protein, 7 aa, Entamoeba histolytica
NIKQQQR

SEQ ID NO: 2642297 - protein, 15 aa, Entamoeba histolytica
NIKREQKREDSEYKK

SEQ ID NO: 2642298 - protein, 10 aa, Entamoeba histolytica
NIKSLSKETT

SEQ ID NO: 2642299 - protein, 19 aa, Entamoeba histolytica
NIKSPNGVDSFGGKKIEMT

SEQ ID NO: 2642300 - protein, 14 aa, Entamoeba histolytica
NIKTPTKITKKDKV

SEQ ID NO: 2642301 - protein, 8 aa, Entamoeba histolytica
NIKTTNQL

SEQ ID NO: 2642302 - protein, 8 aa, Entamoeba histolytica
NIKTTQDH

SEQ ID NO: 2642303 - protein, 8 aa, Entamoeba histolytica
NIKYTQRG

SEQ ID NO: 2642304 - protein, 7 aa, Entamoeba histolytica
NILEQGS

SEQ ID NO: 2642305 - protein, 6 aa, Entamoeba histolytica
NILPEN

SEQ ID NO: 2642306 - protein, 7 aa, Entamoeba histolytica
NILPPSS

SEQ ID NO: 2642307 - protein, 5 aa, Entamoeba histolytica
NINDR

SEQ ID NO: 2642308 - protein, 16 aa, Entamoeba histolytica
NINEVNKKNEELNEKI

SEQ ID NO: 2642309 - protein, 7 aa, Entamoeba histolytica
NINKEEY

SEQ ID NO: 2642310 - protein, 8 aa, Entamoeba histolytica
NINKETHD

SEQ ID NO: 2642311 - protein, 6 aa, Entamoeba histolytica
NINPSR

SEQ ID NO: 2642312 - protein, 13 aa, Entamoeba histolytica
NINQSKSKVASEA

SEQ ID NO: 2642313 - protein, 5 aa, Entamoeba histolytica
NINRA

SEQ ID NO: 2642314 - protein, 9 aa, Entamoeba histolytica
NINSDEAQT

SEQ ID NO: 2642315 - protein, 10 aa, Entamoeba histolytica
NINSNKCNEQ

SEQ ID NO: 2642316 - protein, 13 aa, Entamoeba histolytica
NINSSSSKVSSIN

SEQ ID NO: 2642317 - protein, 4 aa, Entamoeba histolytica
NINT

SEQ ID NO: 2642318 - protein, 22 aa, Entamoeba histolytica
NINTNGCSIETQQQQPSTSKSF

SEQ ID NO: 2642319 - protein, 6 aa, Entamoeba histolytica
NINTSE

SEQ ID NO: 2642320 - protein, 7 aa, Entamoeba histolytica
NINYPDG

SEQ ID NO: 2642321 - protein, 19 aa, Entamoeba histolytica
NIPDQPAGSYEEYPQEPGS

SEQ ID NO: 2642322 - protein, 4 aa, Entamoeba histolytica
NIPF

SEQ ID NO: 2642323 - protein, 17 aa, Entamoeba histolytica
NIPGDKKVKRRNIDATT

SEQ ID NO: 2642324 - protein, 6 aa, Entamoeba histolytica
NIPIDS

SEQ ID NO: 2642325 - protein, 4 aa, Entamoeba histolytica
NIPK

SEQ ID NO: 2642326 - protein, 6 aa, Entamoeba histolytica
NIPKEN

SEQ ID NO: 2642327 - protein, 10 aa, Entamoeba histolytica
NIPKGVKEVG

SEQ ID NO: 2642328 - protein, 21 aa, Entamoeba histolytica
NIPKIDDSGRLKSGLTPPTNR

SEQ ID NO: 2642329 - protein, 7 aa, Entamoeba histolytica
NIPKNSN

SEQ ID NO: 2642330 - protein, 17 aa, Entamoeba histolytica
NIPKPQKKINDDTIEDV

SEQ ID NO: 2642331 - protein, 11 aa, Entamoeba histolytica
NIPNKQGETPL

SEQ ID NO: 2642332 - protein, 7 aa, Entamoeba histolytica
NIPNNKR

SEQ ID NO: 2642333 - protein, 22 aa, Entamoeba histolytica
NIPNNTQPIQQQPQQIHNTQNA

SEQ ID NO: 2642334 - protein, 11 aa, Entamoeba histolytica
NIPPKENYSSF

SEQ ID NO: 2642335 - protein, 6 aa, Entamoeba histolytica
NIPPPV

SEQ ID NO: 2642336 - protein, 14 aa, Entamoeba histolytica
NIPPSVSKIKSEAF

SEQ ID NO: 2642337 - protein, 4 aa, Entamoeba histolytica
NIPQ

SEQ ID NO: 2642338 - protein, 11 aa, Entamoeba histolytica
NIPSGKSYTPY

SEQ ID NO: 2642339 - protein, 5 aa, Entamoeba histolytica
NIPSL

SEQ ID NO: 2642340 - protein, 6 aa, Entamoeba histolytica
NIPSLS

SEQ ID NO: 2642341 - protein, 11 aa, Entamoeba histolytica
NIPSNETKDSD

SEQ ID NO: 2642342 - protein, 5 aa, Entamoeba histolytica
NIPSS

SEQ ID NO: 2642343 - protein, 6 aa, Entamoeba histolytica
NIPSSE

SEQ ID NO: 2642344 - protein, 7 aa, Entamoeba histolytica
NIPSSVS

SEQ ID NO: 2642345 - protein, 8 aa, Entamoeba histolytica
NIPSSVSK

SEQ ID NO: 2642346 - protein, 8 aa, Entamoeba histolytica
NIPSSVSQ

SEQ ID NO: 2642347 - protein, 7 aa, Entamoeba histolytica
NIPTFNS

SEQ ID NO: 2642348 - protein, 11 aa, Entamoeba histolytica
NIPTNVSEIGE

SEQ ID NO: 2642349 - protein, 8 aa, Entamoeba histolytica
NIPTNVSK

SEQ ID NO: 2642350 - protein, 5 aa, Entamoeba histolytica
NIPTS

SEQ ID NO: 2642351 - protein, 6 aa, Entamoeba histolytica
NIPTSI

SEQ ID NO: 2642352 - protein, 7 aa, Entamoeba histolytica
NIPTSVS

SEQ ID NO: 2642353 - protein, 12 aa, Entamoeba histolytica
NIPTSVSKIGDS

SEQ ID NO: 2642354 - protein, 13 aa, Entamoeba histolytica
NIPTSVVKSSNSN

SEQ ID NO: 2642355 - protein, 13 aa, Entamoeba histolytica
NIPYAGKNWRNST

SEQ ID NO: 2642356 - protein, 6 aa, Entamoeba histolytica
NIQAAQ

SEQ ID NO: 2642357 - protein, 7 aa, Entamoeba histolytica
NIQDDYQ

SEQ ID NO: 2642358 - protein, 26 aa, Entamoeba histolytica
NIQEEGSDSEESNSIPIAPTPPESRL

SEQ ID NO: 2642359 - protein, 6 aa, Entamoeba histolytica
NIQEEI

SEQ ID NO: 2642360 - protein, 6 aa, Entamoeba histolytica
NIQEPN

SEQ ID NO: 2642361 - protein, 18 aa, Entamoeba histolytica
NIQGGVEQRRNLQATDTL

SEQ ID NO: 2642362 - protein, 5 aa, Entamoeba histolytica
NIQLS

SEQ ID NO: 2642363 - protein, 8 aa, Entamoeba histolytica
NIQNNQQT

SEQ ID NO: 2642364 - protein, 6 aa, Entamoeba histolytica
NIQPTL

SEQ ID NO: 2642365 - protein, 4 aa, Entamoeba histolytica
NIQQ

SEQ ID NO: 2642366 - protein, 11 aa, Entamoeba histolytica
NIQQSAREREV

SEQ ID NO: 2642367 - protein, 12 aa, Entamoeba histolytica
NIQRRKTGQCDH

SEQ ID NO: 2642368 - protein, 8 aa, Entamoeba histolytica
NIQSWKSD

SEQ ID NO: 2642369 - protein, 4 aa, Entamoeba histolytica
NIRG

SEQ ID NO: 2642370 - protein, 9 aa, Entamoeba histolytica
NIRSKESND

SEQ ID NO: 2642371 - protein, 8 aa, Entamoeba histolytica
NIRTNGDS

SEQ ID NO: 2642372 - protein, 14 aa, Entamoeba histolytica
NISDENVSESTTSE

SEQ ID NO: 2642373 - protein, 5 aa, Entamoeba histolytica
NISEE

SEQ ID NO: 2642374 - protein, 6 aa, Entamoeba histolytica
NISEHQ

SEQ ID NO: 2642375 - protein, 14 aa, Entamoeba histolytica
NISESVSTPEKNYS

SEQ ID NO: 2642376 - protein, 5 aa, Entamoeba histolytica
NISGE

SEQ ID NO: 2642377 - protein, 5 aa, Entamoeba histolytica
NISGG

SEQ ID NO: 2642378 - protein, 8 aa, Entamoeba histolytica
NISINDKE

SEQ ID NO: 2642379 - protein, 13 aa, Entamoeba histolytica
NISKQKSKNLESF

SEQ ID NO: 2642380 - protein, 11 aa, Entamoeba histolytica
NISKSVEVTKT

SEQ ID NO: 2642381 - protein, 4 aa, Entamoeba histolytica
NISL

SEQ ID NO: 2642382 - protein, 8 aa, Entamoeba histolytica
NISNDPTF

SEQ ID NO: 2642383 - protein, 7 aa, Entamoeba histolytica
NISNDTK

SEQ ID NO: 2642384 - protein, 6 aa, Entamoeba histolytica
NISNEQ

SEQ ID NO: 2642385 - protein, 7 aa, Entamoeba histolytica
NISNNPH

SEQ ID NO: 2642386 - protein, 5 aa, Entamoeba histolytica
NISNT

SEQ ID NO: 2642387 - protein, 5 aa, Entamoeba histolytica
NISNV

SEQ ID NO: 2642388 - protein, 4 aa, Entamoeba histolytica
NISP

SEQ ID NO: 2642389 - protein, 10 aa, Entamoeba histolytica
NISPRSQPAM

SEQ ID NO: 2642390 - protein, 18 aa, Entamoeba histolytica
NISPTKPIETQATQLSQD

SEQ ID NO: 2642391 - protein, 4 aa, Entamoeba histolytica
NISQ

SEQ ID NO: 2642392 - protein, 8 aa, Entamoeba histolytica
NISQEDFD

SEQ ID NO: 2642393 - protein, 9 aa, Entamoeba histolytica
NISSDGGRV

SEQ ID NO: 2642394 - protein, 10 aa, Entamoeba histolytica
NISSDSVVEE

SEQ ID NO: 2642395 - protein, 6 aa, Entamoeba histolytica
NISSIT

SEQ ID NO: 2642396 - protein, 5 aa, Entamoeba histolytica
NISSK

SEQ ID NO: 2642397 - protein, 8 aa, Entamoeba histolytica
NISSTTKE

SEQ ID NO: 2642398 - protein, 6 aa, Entamoeba histolytica
NISTET

SEQ ID NO: 2642399 - protein, 11 aa, Entamoeba histolytica
NISTGGNSEVK

SEQ ID NO: 2642400 - protein, 5 aa, Entamoeba histolytica
NISTK

SEQ ID NO: 2642401 - protein, 8 aa, Entamoeba histolytica
NISTTSTL

SEQ ID NO: 2642402 - protein, 8 aa, Entamoeba histolytica
NITDKTNK

SEQ ID NO: 2642403 - protein, 17 aa, Entamoeba histolytica
NITDNDPEVRAAASNAI

SEQ ID NO: 2642404 - protein, 6 aa, Entamoeba histolytica
NITERP

SEQ ID NO: 2642405 - protein, 5 aa, Entamoeba histolytica
NITGI

SEQ ID NO: 2642406 - protein, 4 aa, Entamoeba histolytica
NITK

SEQ ID NO: 2642407 - protein, 19 aa, Entamoeba histolytica
NITKEKKVTKEKKPRKRIT

SEQ ID NO: 2642408 - protein, 15 aa, Entamoeba histolytica
NITKELEKKGIKDAT

SEQ ID NO: 2642409 - protein, 15 aa, Entamoeba histolytica
NITKPTKDFNLSPSA

SEQ ID NO: 2642410 - protein, 12 aa, Entamoeba histolytica
NITNDGYLQKEN

SEQ ID NO: 2642411 - protein, 11 aa, Entamoeba histolytica
NITNKENKLPI

SEQ ID NO: 2642412 - protein, 10 aa, Entamoeba histolytica
NITPSNQSQP

SEQ ID NO: 2642413 - protein, 9 aa, Entamoeba histolytica
NITREEVEE

SEQ ID NO: 2642414 - protein, 19 aa, Entamoeba histolytica
NITSSIKSGAEKVKQAAIS

SEQ ID NO: 2642415 - protein, 6 aa, Entamoeba histolytica
NITTEG

SEQ ID NO: 2642416 - protein, 13 aa, Entamoeba histolytica
NITTNGGVKLPTK

SEQ ID NO: 2642417 - protein, 4 aa, Entamoeba histolytica
NIVE

SEQ ID NO: 2642418 - protein, 9 aa, Entamoeba histolytica
NIVEEEDYE

SEQ ID NO: 2642419 - protein, 10 aa, Entamoeba histolytica
NIVQSDNKHL

SEQ ID NO: 2642420 - protein, 5 aa, Entamoeba histolytica
NIVSS

SEQ ID NO: 2642421 - protein, 5 aa, Entamoeba histolytica
NIYPP

SEQ ID NO: 2642422 - protein, 5 aa, Entamoeba histolytica
NIYRP

SEQ ID NO: 2642423 - protein, 8 aa, Entamoeba histolytica
NIYTEPNR

SEQ ID NO: 2642424 - protein, 7 aa, Entamoeba histolytica
NKADELE

SEQ ID NO: 2642425 - protein, 23 aa, Entamoeba histolytica
NKADKDATKAVSTEQAAEFAKQE

SEQ ID NO: 2642426 - protein, 9 aa, Entamoeba histolytica
NKADKLQPI

SEQ ID NO: 2642427 - protein, 6 aa, Entamoeba histolytica
NKAEQT

SEQ ID NO: 2642428 - protein, 24 aa, Entamoeba histolytica
NKAESEQIPPSQPEKKEEQKIIEE

SEQ ID NO: 2642429 - protein, 7 aa, Entamoeba histolytica
NKAGEVS

SEQ ID NO: 2642430 - protein, 4 aa, Entamoeba histolytica
NKAK

SEQ ID NO: 2642431 - protein, 13 aa, Entamoeba histolytica
NKAKDSNSTTSSI

SEQ ID NO: 2642432 - protein, 14 aa, Entamoeba histolytica
NKAKDSNSTTSSVE

SEQ ID NO: 2642433 - protein, 9 aa, Entamoeba histolytica
NKAKDVRKQ

SEQ ID NO: 2642434 - protein, 5 aa, Entamoeba histolytica
NKAKE

SEQ ID NO: 2642435 - protein, 8 aa, Entamoeba histolytica
NKAKIHND

SEQ ID NO: 2642436 - protein, 7 aa, Entamoeba histolytica
NKAKSLS

SEQ ID NO: 2642437 - protein, 7 aa, Entamoeba histolytica
NKAKYKC

SEQ ID NO: 2642438 - protein, 18 aa, Entamoeba histolytica
NKALDNAESALKIDGKNV

SEQ ID NO: 2642439 - protein, 7 aa, Entamoeba histolytica
NKALRDP

SEQ ID NO: 2642440 - protein, 7 aa, Entamoeba histolytica
NKANDIR

SEQ ID NO: 2642441 - protein, 8 aa, Entamoeba histolytica
NKANFNQN

SEQ ID NO: 2642442 - protein, 8 aa, Entamoeba histolytica
NKAPSSIK

SEQ ID NO: 2642443 - protein, 7 aa, Entamoeba histolytica
NKAQFPD

SEQ ID NO: 2642444 - protein, 5 aa, Entamoeba histolytica
NKAQI

SEQ ID NO: 2642445 - protein, 9 aa, Entamoeba histolytica
NKASKKPIT

SEQ ID NO: 2642446 - protein, 6 aa, Entamoeba histolytica
NKASRD

SEQ ID NO: 2642447 - protein, 5 aa, Entamoeba histolytica
NKASS

SEQ ID NO: 2642448 - protein, 9 aa, Entamoeba histolytica
NKASSLNIS

SEQ ID NO: 2642449 - protein, 7 aa, Entamoeba histolytica
NKASYEA

SEQ ID NO: 2642450 - protein, 10 aa, Entamoeba histolytica
NKATDSVIST

SEQ ID NO: 2642451 - protein, 7 aa, Entamoeba histolytica
NKATNKS

SEQ ID NO: 2642452 - protein, 10 aa, Entamoeba histolytica
NKCKNREYTR

SEQ ID NO: 2642453 - protein, 15 aa, Entamoeba histolytica
NKCNDKKKSVSSKEV

SEQ ID NO: 2642454 - protein, 12 aa, Entamoeba histolytica
NKDEEDRKGIND

SEQ ID NO: 2642455 - protein, 18 aa, Entamoeba histolytica
NKDEEEVERKEKEERSEG

SEQ ID NO: 2642456 - protein, 8 aa, Entamoeba histolytica
NKDEENVG

SEQ ID NO: 2642457 - protein, 13 aa, Entamoeba histolytica
NKDEKEKLDSTIE

SEQ ID NO: 2642458 - protein, 5 aa, Entamoeba histolytica
NKDEL

SEQ ID NO: 2642459 - protein, 8 aa, Entamoeba histolytica
NKDGSYNL

SEQ ID NO: 2642460 - protein, 4 aa, Entamoeba histolytica
NKDK

SEQ ID NO: 2642461 - protein, 6 aa, Entamoeba histolytica
NKDKAK

SEQ ID NO: 2642462 - protein, 5 aa, Entamoeba histolytica
NKDKG

SEQ ID NO: 2642463 - protein, 10 aa, Entamoeba histolytica
NKDKKSLSLT

SEQ ID NO: 2642464 - protein, 9 aa, Entamoeba histolytica
NKDKSISEI

SEQ ID NO: 2642465 - protein, 7 aa, Entamoeba histolytica
NKDKTDY

SEQ ID NO: 2642466 - protein, 8 aa, Entamoeba histolytica
NKDKTQEI

SEQ ID NO: 2642467 - protein, 7 aa, Entamoeba histolytica
NKDLQNE

SEQ ID NO: 2642468 - protein, 11 aa, Entamoeba histolytica
NKDLSNKNDKL

SEQ ID NO: 2642469 - protein, 4 aa, Entamoeba histolytica
NKDN

SEQ ID NO: 2642470 - protein, 6 aa, Entamoeba histolytica
NKDNEI

SEQ ID NO: 2642471 - protein, 8 aa, Entamoeba histolytica
NKDNELKV

SEQ ID NO: 2642472 - protein, 10 aa, Entamoeba histolytica
NKDNGERKEV

SEQ ID NO: 2642473 - protein, 22 aa, Entamoeba histolytica
NKDNNNEKEINHQSTNETIQDN

SEQ ID NO: 2642474 - protein, 21 aa, Entamoeba histolytica
NKDNQTSTSNDCKEDITNEKL

SEQ ID NO: 2642475 - protein, 6 aa, Entamoeba histolytica
NKDNTL

SEQ ID NO: 2642476 - protein, 9 aa, Entamoeba histolytica
NKDPSSIDK

SEQ ID NO: 2642477 - protein, 4 aa, Entamoeba histolytica
NKDQ

SEQ ID NO: 2642478 - protein, 4 aa, Entamoeba histolytica
NKDR

SEQ ID NO: 2642479 - protein, 6 aa, Entamoeba histolytica
NKDSDI

SEQ ID NO: 2642480 - protein, 7 aa, Entamoeba histolytica
NKDSLQN

SEQ ID NO: 2642481 - protein, 9 aa, Entamoeba histolytica
NKDSQTKVE

SEQ ID NO: 2642482 - protein, 6 aa, Entamoeba histolytica
NKDSVI

SEQ ID NO: 2642483 - protein, 6 aa, Entamoeba histolytica
NKDTEL

SEQ ID NO: 2642484 - protein, 9 aa, Entamoeba histolytica
NKDTERTEQ

SEQ ID NO: 2642485 - protein, 7 aa, Entamoeba histolytica
NKDTKIA

SEQ ID NO: 2642486 - protein, 8 aa, Entamoeba histolytica
NKDTVTEL

SEQ ID NO: 2642487 - protein, 5 aa, Entamoeba histolytica
NKEAL

SEQ ID NO: 2642488 - protein, 19 aa, Entamoeba histolytica
NKEARQKERSQLRTSRRVQ

SEQ ID NO: 2642489 - protein, 5 aa, Entamoeba histolytica
NKEAV

SEQ ID NO: 2642490 - protein, 8 aa, Entamoeba histolytica
NKECKEKL

SEQ ID NO: 2642491 - protein, 4 aa, Entamoeba histolytica
NKED

SEQ ID NO: 2642492 - protein, 12 aa, Entamoeba histolytica
NKEDDNGDDLNP

SEQ ID NO: 2642493 - protein, 7 aa, Entamoeba histolytica
NKEDKVK

SEQ ID NO: 2642494 - protein, 7 aa, Entamoeba histolytica
NKEDNEK

SEQ ID NO: 2642495 - protein, 7 aa, Entamoeba histolytica
NKEDNIT

SEQ ID NO: 2642496 - protein, 8 aa, Entamoeba histolytica
NKEDVQKG

SEQ ID NO: 2642497 - protein, 4 aa, Entamoeba histolytica
NKEE

SEQ ID NO: 2642498 - protein, 7 aa, Entamoeba histolytica
NKEEEFK

SEQ ID NO: 2642499 - protein, 7 aa, Entamoeba histolytica
NKEEEKM

SEQ ID NO: 2642500 - protein, 16 aa, Entamoeba histolytica
NKEEEKRAEENNQTED

SEQ ID NO: 2642501 - protein, 5 aa, Entamoeba histolytica
NKEEF

SEQ ID NO: 2642502 - protein, 13 aa, Entamoeba histolytica
NKEEGRTITPQRR

SEQ ID NO: 2642503 - protein, 7 aa, Entamoeba histolytica
NKEEIDS

SEQ ID NO: 2642504 - protein, 9 aa, Entamoeba histolytica
NKEENDKEL

SEQ ID NO: 2642505 - protein, 7 aa, Entamoeba histolytica
NKEENEN

SEQ ID NO: 2642506 - protein, 8 aa, Entamoeba histolytica
NKEEPVDS

SEQ ID NO: 2642507 - protein, 7 aa, Entamoeba histolytica
NKEEQDL

SEQ ID NO: 2642508 - protein, 8 aa, Entamoeba histolytica
NKEERDST

SEQ ID NO: 2642509 - protein, 8 aa, Entamoeba histolytica
NKEESEKL

SEQ ID NO: 2642510 - protein, 7 aa, Entamoeba histolytica
NKEESIK

SEQ ID NO: 2642511 - protein, 34 aa, Entamoeba histolytica
NKEESTEEEEDDDEQLESQSNEIENIEKDSNTNI

SEQ ID NO: 2642512 - protein, 6 aa, Entamoeba histolytica
NKEETF

SEQ ID NO: 2642513 - protein, 6 aa, Entamoeba histolytica
NKEEVA

SEQ ID NO: 2642514 - protein, 5 aa, Entamoeba histolytica
NKEGI

SEQ ID NO: 2642515 - protein, 7 aa, Entamoeba histolytica
NKEGIKE

SEQ ID NO: 2642516 - protein, 8 aa, Entamoeba histolytica
NKEGKQIM

SEQ ID NO: 2642517 - protein, 8 aa, Entamoeba histolytica
NKEGNDKE

SEQ ID NO: 2642518 - protein, 7 aa, Entamoeba histolytica
NKEGPYS

SEQ ID NO: 2642519 - protein, 5 aa, Entamoeba histolytica
NKEID

SEQ ID NO: 2642520 - protein, 23 aa, Entamoeba histolytica
NKEIEEKIEKQQKEVEESNKRCN

SEQ ID NO: 2642521 - protein, 17 aa, Entamoeba histolytica
NKEIEEQKKSIKNIKEE

SEQ ID NO: 2642522 - protein, 8 aa, Entamoeba histolytica
NKEIEQQQ

SEQ ID NO: 2642523 - protein, 14 aa, Entamoeba histolytica
NKEIKQVYSGENDI

SEQ ID NO: 2642524 - protein, 6 aa, Entamoeba histolytica
NKEIKR

SEQ ID NO: 2642525 - protein, 7 aa, Entamoeba histolytica
NKEIPSN

SEQ ID NO: 2642526 - protein, 13 aa, Entamoeba histolytica
NKEKAQKSKGDIV

SEQ ID NO: 2642527 - protein, 7 aa, Entamoeba histolytica
NKEKDNE

SEQ ID NO: 2642528 - protein, 7 aa, Entamoeba histolytica
NKEKENH

SEQ ID NO: 2642529 - protein, 10 aa, Entamoeba histolytica
NKEKENKIQQ

SEQ ID NO: 2642530 - protein, 23 aa, Entamoeba histolytica
NKEKKAQKQEEFTKKKKKYEKDI

SEQ ID NO: 2642531 - protein, 15 aa, Entamoeba histolytica
NKEKKEQTVNVSQPH

SEQ ID NO: 2642532 - protein, 7 aa, Entamoeba histolytica
NKEKMEK

SEQ ID NO: 2642533 - protein, 10 aa, Entamoeba histolytica
NKEKPKEVEK

SEQ ID NO: 2642534 - protein, 92 aa, Entamoeba histolytica
NKEKQPKTKKEKKDKSSTKKQLTEETKEEKEQGEEEMKKEEEDINGDSPTTKMEEDDSSEDFSSKDIQKEIKKEIKQKRQEELKEKHTNEDD

SEQ ID NO: 2642535 - protein, 37 aa, Entamoeba histolytica
NKEKRNTISSISQTPITQQPTEKIKRKEGEKKRKKSF

SEQ ID NO: 2642536 - protein, 7 aa, Entamoeba histolytica
NKEKSEY

SEQ ID NO: 2642537 - protein, 6 aa, Entamoeba histolytica
NKEKVK

SEQ ID NO: 2642538 - protein, 4 aa, Entamoeba histolytica
NKEL

SEQ ID NO: 2642539 - protein, 6 aa, Entamoeba histolytica
NKEMEG

SEQ ID NO: 2642540 - protein, 6 aa, Entamoeba histolytica
NKEMTR

SEQ ID NO: 2642541 - protein, 5 aa, Entamoeba histolytica
NKENK

SEQ ID NO: 2642542 - protein, 12 aa, Entamoeba histolytica
NKENKQKKIKQS

SEQ ID NO: 2642543 - protein, 9 aa, Entamoeba histolytica
NKENLDKNT

SEQ ID NO: 2642544 - protein, 9 aa, Entamoeba histolytica
NKENPPTKE

SEQ ID NO: 2642545 - protein, 13 aa, Entamoeba histolytica
NKENPVDKTESTL

SEQ ID NO: 2642546 - protein, 9 aa, Entamoeba histolytica
NKENPYLQP

SEQ ID NO: 2642547 - protein, 8 aa, Entamoeba histolytica
NKENSQAM

SEQ ID NO: 2642548 - protein, 10 aa, Entamoeba histolytica
NKENSSNGSS

SEQ ID NO: 2642549 - protein, 5 aa, Entamoeba histolytica
NKEPI

SEQ ID NO: 2642550 - protein, 7 aa, Entamoeba histolytica
NKEPPRI

SEQ ID NO: 2642551 - protein, 24 aa, Entamoeba histolytica
NKEQAQDRSNSKKKKKEGIKDNRN

SEQ ID NO: 2642552 - protein, 14 aa, Entamoeba histolytica
NKEQIDGETSEERE

SEQ ID NO: 2642553 - protein, 19 aa, Entamoeba histolytica
NKERKRQKERKKKKIKETA

SEQ ID NO: 2642554 - protein, 11 aa, Entamoeba histolytica
NKERNKPNKIY

SEQ ID NO: 2642555 - protein, 4 aa, Entamoeba histolytica
NKES

SEQ ID NO: 2642556 - protein, 7 aa, Entamoeba histolytica
NKESFEN

SEQ ID NO: 2642557 - protein, 7 aa, Entamoeba histolytica
NKESFNT

SEQ ID NO: 2642558 - protein, 9 aa, Entamoeba histolytica
NKESKNSED

SEQ ID NO: 2642559 - protein, 9 aa, Entamoeba histolytica
NKESNGDPI

SEQ ID NO: 2642560 - protein, 12 aa, Entamoeba histolytica
NKESNVSKPVGF

SEQ ID NO: 2642561 - protein, 7 aa, Entamoeba histolytica
NKESPYY

SEQ ID NO: 2642562 - protein, 7 aa, Entamoeba histolytica
NKESQIK

SEQ ID NO: 2642563 - protein, 8 aa, Entamoeba histolytica
NKESSEEE

SEQ ID NO: 2642564 - protein, 11 aa, Entamoeba histolytica
NKESSSSSSQI

SEQ ID NO: 2642565 - protein, 8 aa, Entamoeba histolytica
NKESTEQP

SEQ ID NO: 2642566 - protein, 7 aa, Entamoeba histolytica
NKETAKA

SEQ ID NO: 2642567 - protein, 6 aa, Entamoeba histolytica
NKETAY

SEQ ID NO: 2642568 - protein, 7 aa, Entamoeba histolytica
NKETDIV

SEQ ID NO: 2642569 - protein, 6 aa, Entamoeba histolytica
NKETEI

SEQ ID NO: 2642570 - protein, 6 aa, Entamoeba histolytica
NKETIK

SEQ ID NO: 2642571 - protein, 8 aa, Entamoeba histolytica
NKETKMRD

SEQ ID NO: 2642572 - protein, 5 aa, Entamoeba histolytica
NKETL

SEQ ID NO: 2642573 - protein, 6 aa, Entamoeba histolytica
NKETLT

SEQ ID NO: 2642574 - protein, 7 aa, Entamoeba histolytica
NKETPKI

SEQ ID NO: 2642575 - protein, 10 aa, Entamoeba histolytica
NKETPTQNDI

SEQ ID NO: 2642576 - protein, 7 aa, Entamoeba histolytica
NKETQDI

SEQ ID NO: 2642577 - protein, 6 aa, Entamoeba histolytica
NKETQT

SEQ ID NO: 2642578 - protein, 9 aa, Entamoeba histolytica
NKETREALR

SEQ ID NO: 2642579 - protein, 4 aa, Entamoeba histolytica
NKEV

SEQ ID NO: 2642580 - protein, 11 aa, Entamoeba histolytica
NKEVESNEDVT

SEQ ID NO: 2642581 - protein, 5 aa, Entamoeba histolytica
NKEYS

SEQ ID NO: 2642582 - protein, 4 aa, Entamoeba histolytica
NKFD

SEQ ID NO: 2642583 - protein, 5 aa, Entamoeba histolytica
NKFEP

SEQ ID NO: 2642584 - protein, 6 aa, Entamoeba histolytica
NKFERT

SEQ ID NO: 2642585 - protein, 11 aa, Entamoeba histolytica
NKFGSKPSLSD

SEQ ID NO: 2642586 - protein, 4 aa, Entamoeba histolytica
NKFP

SEQ ID NO: 2642587 - protein, 8 aa, Entamoeba histolytica
NKFPQSNT

SEQ ID NO: 2642588 - protein, 8 aa, Entamoeba histolytica
NKFSKYGQ

SEQ ID NO: 2642589 - protein, 14 aa, Entamoeba histolytica
NKFSNSSTNLGEEG

SEQ ID NO: 2642590 - protein, 6 aa, Entamoeba histolytica
NKFTEA

SEQ ID NO: 2642591 - protein, 5 aa, Entamoeba histolytica
NKGAI

SEQ ID NO: 2642592 - protein, 6 aa, Entamoeba histolytica
NKGDIG

SEQ ID NO: 2642593 - protein, 4 aa, Entamoeba histolytica
NKGE

SEQ ID NO: 2642594 - protein, 5 aa, Entamoeba histolytica
NKGEE

SEQ ID NO: 2642595 - protein, 5 aa, Entamoeba histolytica
NKGEM

SEQ ID NO: 2642596 - protein, 4 aa, Entamoeba histolytica
NKGG

SEQ ID NO: 2642597 - protein, 9 aa, Entamoeba histolytica
NKGGDEHPQ

SEQ ID NO: 2642598 - protein, 12 aa, Entamoeba histolytica
NKGGKYPESKTM

SEQ ID NO: 2642599 - protein, 5 aa, Entamoeba histolytica
NKGGL

SEQ ID NO: 2642600 - protein, 7 aa, Entamoeba histolytica
NKGIEYR

SEQ ID NO: 2642601 - protein, 4 aa, Entamoeba histolytica
NKGK

SEQ ID NO: 2642602 - protein, 8 aa, Entamoeba histolytica
NKGKGGES

SEQ ID NO: 2642603 - protein, 7 aa, Entamoeba histolytica
NKGKPEI

SEQ ID NO: 2642604 - protein, 14 aa, Entamoeba histolytica
NKGKRASEKDHDIE

SEQ ID NO: 2642605 - protein, 4 aa, Entamoeba histolytica
NKGM

SEQ ID NO: 2642606 - protein, 11 aa, Entamoeba histolytica
NKGMETLSPRA

SEQ ID NO: 2642607 - protein, 9 aa, Entamoeba histolytica
NKGNGDRVQ

SEQ ID NO: 2642608 - protein, 22 aa, Entamoeba histolytica
NKGNIAKPAELSKAFPGKSGDE

SEQ ID NO: 2642609 - protein, 18 aa, Entamoeba histolytica
NKGNQSRYKQDNRRAEEW

SEQ ID NO: 2642610 - protein, 5 aa, Entamoeba histolytica
NKGSI

SEQ ID NO: 2642611 - protein, 7 aa, Entamoeba histolytica
NKGSKYY

SEQ ID NO: 2642612 - protein, 11 aa, Entamoeba histolytica
NKGVNKNSPSF

SEQ ID NO: 2642613 - protein, 7 aa, Entamoeba histolytica
NKGVPGY

SEQ ID NO: 2642614 - protein, 4 aa, Entamoeba histolytica
NKHC

SEQ ID NO: 2642615 - protein, 7 aa, Entamoeba histolytica
NKHGGAV

SEQ ID NO: 2642616 - protein, 8 aa, Entamoeba histolytica
NKHKRAYK

SEQ ID NO: 2642617 - protein, 9 aa, Entamoeba histolytica
NKHKSDTEI

SEQ ID NO: 2642618 - protein, 18 aa, Entamoeba histolytica
NKHQNETMNEKDESVEKD

SEQ ID NO: 2642619 - protein, 19 aa, Entamoeba histolytica
NKHQNETMNEKDESVEKDN

SEQ ID NO: 2642620 - protein, 4 aa, Entamoeba histolytica
NKHT

SEQ ID NO: 2642621 - protein, 5 aa, Entamoeba histolytica
NKHTE

SEQ ID NO: 2642622 - protein, 7 aa, Entamoeba histolytica
NKIATGQ

SEQ ID NO: 2642623 - protein, 8 aa, Entamoeba histolytica
NKIDKITP

SEQ ID NO: 2642624 - protein, 8 aa, Entamoeba histolytica
NKIDKSYP

SEQ ID NO: 2642625 - protein, 5 aa, Entamoeba histolytica
NKIDQ

SEQ ID NO: 2642626 - protein, 7 aa, Entamoeba histolytica
NKIDTLT

SEQ ID NO: 2642627 - protein, 4 aa, Entamoeba histolytica
NKIE

SEQ ID NO: 2642628 - protein, 6 aa, Entamoeba histolytica
NKIEDK

SEQ ID NO: 2642629 - protein, 5 aa, Entamoeba histolytica
NKIEE

SEQ ID NO: 2642630 - protein, 7 aa, Entamoeba histolytica
NKIEEEI

SEQ ID NO: 2642631 - protein, 10 aa, Entamoeba histolytica
NKIEETSFGN

SEQ ID NO: 2642632 - protein, 6 aa, Entamoeba histolytica
NKIEEV

SEQ ID NO: 2642633 - protein, 14 aa, Entamoeba histolytica
NKIEKVKKSSKQDE

SEQ ID NO: 2642634 - protein, 5 aa, Entamoeba histolytica
NKIEN

SEQ ID NO: 2642635 - protein, 16 aa, Entamoeba histolytica
NKIEQTPKQDNYNDEI

SEQ ID NO: 2642636 - protein, 21 aa, Entamoeba histolytica
NKIESEDKKVNDTKTICDKNE

SEQ ID NO: 2642637 - protein, 9 aa, Entamoeba histolytica
NKIESIPKN

SEQ ID NO: 2642638 - protein, 11 aa, Entamoeba histolytica
NKIGDPKRGLA

SEQ ID NO: 2642639 - protein, 8 aa, Entamoeba histolytica
NKIGKEEL

SEQ ID NO: 2642640 - protein, 7 aa, Entamoeba histolytica
NKIGQIG

SEQ ID NO: 2642641 - protein, 6 aa, Entamoeba histolytica
NKIGTE

SEQ ID NO: 2642642 - protein, 8 aa, Entamoeba histolytica
NKIHTNED

SEQ ID NO: 2642643 - protein, 31 aa, Entamoeba histolytica
NKIKKDSKTRKESTTNENTSLEKDTNQPEIQ

SEQ ID NO: 2642644 - protein, 7 aa, Entamoeba histolytica
NKIKLNG

SEQ ID NO: 2642645 - protein, 5 aa, Entamoeba histolytica
NKIKT

SEQ ID NO: 2642646 - protein, 4 aa, Entamoeba histolytica
NKIL

SEQ ID NO: 2642647 - protein, 24 aa, Entamoeba histolytica
NKINETRKHSIDLSSDDVLRLFNI

SEQ ID NO: 2642648 - protein, 9 aa, Entamoeba histolytica
NKINGLTPN

SEQ ID NO: 2642649 - protein, 7 aa, Entamoeba histolytica
NKINKPM

SEQ ID NO: 2642650 - protein, 6 aa, Entamoeba histolytica
NKINNL

SEQ ID NO: 2642651 - protein, 6 aa, Entamoeba histolytica
NKINPK

SEQ ID NO: 2642652 - protein, 9 aa, Entamoeba histolytica
NKINTSTFN

SEQ ID NO: 2642653 - protein, 4 aa, Entamoeba histolytica
NKIP

SEQ ID NO: 2642654 - protein, 8 aa, Entamoeba histolytica
NKIPSKKL

SEQ ID NO: 2642655 - protein, 8 aa, Entamoeba histolytica
NKIPSNPQ

SEQ ID NO: 2642656 - protein, 7 aa, Entamoeba histolytica
NKIPTSI

SEQ ID NO: 2642657 - protein, 28 aa, Entamoeba histolytica
NKIQGKSPRIPSTPRKEVEKKEPTEKTK

SEQ ID NO: 2642658 - protein, 8 aa, Entamoeba histolytica
NKIQNENL

SEQ ID NO: 2642659 - protein, 5 aa, Entamoeba histolytica
NKIQQ

SEQ ID NO: 2642660 - protein, 8 aa, Entamoeba histolytica
NKIQQTGT

SEQ ID NO: 2642661 - protein, 4 aa, Entamoeba histolytica
NKIR

SEQ ID NO: 2642662 - protein, 5 aa, Entamoeba histolytica
NKISE

SEQ ID NO: 2642663 - protein, 20 aa, Entamoeba histolytica
NKISEGEEAQQDDDEGWEEV

SEQ ID NO: 2642664 - protein, 8 aa, Entamoeba histolytica
NKISGEMA

SEQ ID NO: 2642665 - protein, 7 aa, Entamoeba histolytica
NKISGSP

SEQ ID NO: 2642666 - protein, 12 aa, Entamoeba histolytica
NKISPSENRDQN

SEQ ID NO: 2642667 - protein, 6 aa, Entamoeba histolytica
NKISQE

SEQ ID NO: 2642668 - protein, 5 aa, Entamoeba histolytica
NKITK

SEQ ID NO: 2642669 - protein, 8 aa, Entamoeba histolytica
NKITKDDI

SEQ ID NO: 2642670 - protein, 13 aa, Entamoeba histolytica
NKITPQENEELPP

SEQ ID NO: 2642671 - protein, 8 aa, Entamoeba histolytica
NKITSDEA

SEQ ID NO: 2642672 - protein, 13 aa, Entamoeba histolytica
NKITSLPNKPDMS

SEQ ID NO: 2642673 - protein, 17 aa, Entamoeba histolytica
NKITSTVKESADDITTS

SEQ ID NO: 2642674 - protein, 6 aa, Entamoeba histolytica
NKITTI

SEQ ID NO: 2642675 - protein, 10 aa, Entamoeba histolytica
NKITTIPNGM

SEQ ID NO: 2642676 - protein, 8 aa, Entamoeba histolytica
NKKASNEV

SEQ ID NO: 2642677 - protein, 5 aa, Entamoeba histolytica
NKKDE

SEQ ID NO: 2642678 - protein, 15 aa, Entamoeba histolytica
NKKDEKKTEEEKGQL

SEQ ID NO: 2642679 - protein, 8 aa, Entamoeba histolytica
NKKDENTL

SEQ ID NO: 2642680 - protein, 8 aa, Entamoeba histolytica
NKKDKNEI

SEQ ID NO: 2642681 - protein, 20 aa, Entamoeba histolytica
NKKDNKTLLSSSKHNQKCCI

SEQ ID NO: 2642682 - protein, 37 aa, Entamoeba histolytica
NKKEEKPKQDIINTPQTKNEDKEKLTIPTRKSKRNNL

SEQ ID NO: 2642683 - protein, 5 aa, Entamoeba histolytica
NKKEF

SEQ ID NO: 2642684 - protein, 8 aa, Entamoeba histolytica
NKKEKKEL

SEQ ID NO: 2642685 - protein, 6 aa, Entamoeba histolytica
NKKELK

SEQ ID NO: 2642686 - protein, 31 aa, Entamoeba histolytica
NKKENKEQKKSIQQKSLPSLKEKSKQQPEQL

SEQ ID NO: 2642687 - protein, 6 aa, Entamoeba histolytica
NKKEPI

SEQ ID NO: 2642688 - protein, 9 aa, Entamoeba histolytica
NKKEPKFDD

SEQ ID NO: 2642689 - protein, 9 aa, Entamoeba histolytica
NKKERTPQD

SEQ ID NO: 2642690 - protein, 17 aa, Entamoeba histolytica
NKKESQIQTIQNETEKI

SEQ ID NO: 2642691 - protein, 8 aa, Entamoeba histolytica
NKKESREE

SEQ ID NO: 2642692 - protein, 7 aa, Entamoeba histolytica
NKKESTC

SEQ ID NO: 2642693 - protein, 5 aa, Entamoeba histolytica
NKKEY

SEQ ID NO: 2642694 - protein, 4 aa, Entamoeba histolytica
NKKG

SEQ ID NO: 2642695 - protein, 9 aa, Entamoeba histolytica
NKKGEITTE

SEQ ID NO: 2642696 - protein, 8 aa, Entamoeba histolytica
NKKGEQIA

SEQ ID NO: 2642697 - protein, 8 aa, Entamoeba histolytica
NKKGEQLP

SEQ ID NO: 2642698 - protein, 10 aa, Entamoeba histolytica
NKKGFEASDD

SEQ ID NO: 2642699 - protein, 10 aa, Entamoeba histolytica
NKKGQQGYLK

SEQ ID NO: 2642700 - protein, 10 aa, Entamoeba histolytica
NKKGQYPDNV

SEQ ID NO: 2642701 - protein, 7 aa, Entamoeba histolytica
NKKHPTK

SEQ ID NO: 2642702 - protein, 4 aa, Entamoeba histolytica
NKKI

SEQ ID NO: 2642703 - protein, 8 aa, Entamoeba histolytica
NKKIAKDE

SEQ ID NO: 2642704 - protein, 8 aa, Entamoeba histolytica
NKKIKKSV

SEQ ID NO: 2642705 - protein, 15 aa, Entamoeba histolytica
NKKINANDVERNSME

SEQ ID NO: 2642706 - protein, 8 aa, Entamoeba histolytica
NKKIPKES

SEQ ID NO: 2642707 - protein, 5 aa, Entamoeba histolytica
NKKIQ

SEQ ID NO: 2642708 - protein, 15 aa, Entamoeba histolytica
NKKIQREYKTNLTSK

SEQ ID NO: 2642709 - protein, 16 aa, Entamoeba histolytica
NKKIQREYKTNPTSKY

SEQ ID NO: 2642710 - protein, 9 aa, Entamoeba histolytica
NKKKDEQRL

SEQ ID NO: 2642711 - protein, 9 aa, Entamoeba histolytica
NKKKIGELT

SEQ ID NO: 2642712 - protein, 9 aa, Entamoeba histolytica
NKKKKAIAI

SEQ ID NO: 2642713 - protein, 35 aa, Entamoeba histolytica
NKKKKKSTINKKEQQSDFQKTEDNSFDLPSSIGGI

SEQ ID NO: 2642714 - protein, 18 aa, Entamoeba histolytica
NKKKNNTPKQSSIADFQT

SEQ ID NO: 2642715 - protein, 14 aa, Entamoeba histolytica
NKKKQDLKNSKEQL

SEQ ID NO: 2642716 - protein, 9 aa, Entamoeba histolytica
NKKKQQKLK

SEQ ID NO: 2642717 - protein, 16 aa, Entamoeba histolytica
NKKKRSMSESNNPEIK

SEQ ID NO: 2642718 - protein, 8 aa, Entamoeba histolytica
NKKKSIKK

SEQ ID NO: 2642719 - protein, 8 aa, Entamoeba histolytica
NKKKSNPL

SEQ ID NO: 2642720 - protein, 6 aa, Entamoeba histolytica
NKKKTR

SEQ ID NO: 2642721 - protein, 9 aa, Entamoeba histolytica
NKKKYQIQE

SEQ ID NO: 2642722 - protein, 8 aa, Entamoeba histolytica
NKKKYYEE

SEQ ID NO: 2642723 - protein, 35 aa, Entamoeba histolytica
NKKLENEQNEIQKKYEYSEKEKREIEKRNEENEEK

SEQ ID NO: 2642724 - protein, 5 aa, Entamoeba histolytica
NKKMG

SEQ ID NO: 2642725 - protein, 6 aa, Entamoeba histolytica
NKKNKI

SEQ ID NO: 2642726 - protein, 6 aa, Entamoeba histolytica
NKKNKK

SEQ ID NO: 2642727 - protein, 9 aa, Entamoeba histolytica
NKKPETKIH

SEQ ID NO: 2642728 - protein, 10 aa, Entamoeba histolytica
NKKPQPLKHS

SEQ ID NO: 2642729 - protein, 19 aa, Entamoeba histolytica
NKKPSQLKNDTTTSKTTNI

SEQ ID NO: 2642730 - protein, 9 aa, Entamoeba histolytica
NKKQNIVDS

SEQ ID NO: 2642731 - protein, 7 aa, Entamoeba histolytica
NKKQSYV

SEQ ID NO: 2642732 - protein, 4 aa, Entamoeba histolytica
NKKR

SEQ ID NO: 2642733 - protein, 8 aa, Entamoeba histolytica
NKKRTEDI

SEQ ID NO: 2642734 - protein, 4 aa, Entamoeba histolytica
NKKS

SEQ ID NO: 2642735 - protein, 7 aa, Entamoeba histolytica
NKKSEEG

SEQ ID NO: 2642736 - protein, 9 aa, Entamoeba histolytica
NKKSKETKI

SEQ ID NO: 2642737 - protein, 7 aa, Entamoeba histolytica
NKKSKIN

SEQ ID NO: 2642738 - protein, 8 aa, Entamoeba histolytica
NKKSPQEL

SEQ ID NO: 2642739 - protein, 13 aa, Entamoeba histolytica
NKKSSPSDKSDSL

SEQ ID NO: 2642740 - protein, 10 aa, Entamoeba histolytica
NKKSTGSSIV

SEQ ID NO: 2642741 - protein, 9 aa, Entamoeba histolytica
NKKSTYTEK

SEQ ID NO: 2642742 - protein, 9 aa, Entamoeba histolytica
NKKTASENL

SEQ ID NO: 2642743 - protein, 8 aa, Entamoeba histolytica
NKKTDTVA

SEQ ID NO: 2642744 - protein, 8 aa, Entamoeba histolytica
NKKTETDR

SEQ ID NO: 2642745 - protein, 8 aa, Entamoeba histolytica
NKKTKTKP

SEQ ID NO: 2642746 - protein, 9 aa, Entamoeba histolytica
NKKTLSSME

SEQ ID NO: 2642747 - protein, 6 aa, Entamoeba histolytica
NKKTNQ

SEQ ID NO: 2642748 - protein, 29 aa, Entamoeba histolytica
NKKTPSGSSLSNDQKEEPITNINESNQEN

SEQ ID NO: 2642749 - protein, 12 aa, Entamoeba histolytica
NKKTREEKEIER

SEQ ID NO: 2642750 - protein, 7 aa, Entamoeba histolytica
NKKWSKR

SEQ ID NO: 2642751 - protein, 10 aa, Entamoeba histolytica
NKKYHAEKKI

SEQ ID NO: 2642752 - protein, 8 aa, Entamoeba histolytica
NKKYHTKV

SEQ ID NO: 2642753 - protein, 7 aa, Entamoeba histolytica
NKKYITK

SEQ ID NO: 2642754 - protein, 9 aa, Entamoeba histolytica
NKKYSDTRE

SEQ ID NO: 2642755 - protein, 10 aa, Entamoeba histolytica
NKLAESTVKE

SEQ ID NO: 2642756 - protein, 6 aa, Entamoeba histolytica
NKLAYD

SEQ ID NO: 2642757 - protein, 8 aa, Entamoeba histolytica
NKLDGIPS

SEQ ID NO: 2642758 - protein, 20 aa, Entamoeba histolytica
NKLEDLSTSIEDFKNKDTNI

SEQ ID NO: 2642759 - protein, 18 aa, Entamoeba histolytica
NKLEEATNNKVDNTIDSL

SEQ ID NO: 2642760 - protein, 21 aa, Entamoeba histolytica
NKLENEKKGIENKISKSEVEA

SEQ ID NO: 2642761 - protein, 13 aa, Entamoeba histolytica
NKLEQSKALTKEA

SEQ ID NO: 2642762 - protein, 11 aa, Entamoeba histolytica
NKLKDKTYKNV

SEQ ID NO: 2642763 - protein, 8 aa, Entamoeba histolytica
NKLKNAPQ

SEQ ID NO: 2642764 - protein, 10 aa, Entamoeba histolytica
NKLKNGEELN

SEQ ID NO: 2642765 - protein, 8 aa, Entamoeba histolytica
NKLKNGKS

SEQ ID NO: 2642766 - protein, 9 aa, Entamoeba histolytica
NKLKNTDKY

SEQ ID NO: 2642767 - protein, 7 aa, Entamoeba histolytica
NKLKQEY

SEQ ID NO: 2642768 - protein, 17 aa, Entamoeba histolytica
NKLNKEEEERKKAERGM

SEQ ID NO: 2642769 - protein, 11 aa, Entamoeba histolytica
NKLNKQKKQLC

SEQ ID NO: 2642770 - protein, 11 aa, Entamoeba histolytica
NKLNPDEYDDE

SEQ ID NO: 2642771 - protein, 13 aa, Entamoeba histolytica
NKLNQEKEQVENE

SEQ ID NO: 2642772 - protein, 7 aa, Entamoeba histolytica
NKLPEKE

SEQ ID NO: 2642773 - protein, 7 aa, Entamoeba histolytica
NKLPELQ

SEQ ID NO: 2642774 - protein, 8 aa, Entamoeba histolytica
NKLPSTSF

SEQ ID NO: 2642775 - protein, 29 aa, Entamoeba histolytica
NKLQDKTVTNNNSIGSTDNSAKDSNTTVV

SEQ ID NO: 2642776 - protein, 6 aa, Entamoeba histolytica
NKLQEL

SEQ ID NO: 2642777 - protein, 5 aa, Entamoeba histolytica
NKLQK

SEQ ID NO: 2642778 - protein, 5 aa, Entamoeba histolytica
NKLSD

SEQ ID NO: 2642779 - protein, 6 aa, Entamoeba histolytica
NKLSEE

SEQ ID NO: 2642780 - protein, 5 aa, Entamoeba histolytica
NKLSN

SEQ ID NO: 2642781 - protein, 8 aa, Entamoeba histolytica
NKLSQSNP

SEQ ID NO: 2642782 - protein, 4 aa, Entamoeba histolytica
NKLT

SEQ ID NO: 2642783 - protein, 13 aa, Entamoeba histolytica
NKLTESVKSDTYQ

SEQ ID NO: 2642784 - protein, 7 aa, Entamoeba histolytica
NKLTETQ

SEQ ID NO: 2642785 - protein, 11 aa, Entamoeba histolytica
NKLTTNSISTQ

SEQ ID NO: 2642786 - protein, 7 aa, Entamoeba histolytica
NKMNPRD

SEQ ID NO: 2642787 - protein, 11 aa, Entamoeba histolytica
NKMNQEEKEIN

SEQ ID NO: 2642788 - protein, 4 aa, Entamoeba histolytica
NKMT

SEQ ID NO: 2642789 - protein, 15 aa, Entamoeba histolytica
NKMTKTPIHETKIPE

SEQ ID NO: 2642790 - protein, 7 aa, Entamoeba histolytica
NKNDDKG

SEQ ID NO: 2642791 - protein, 7 aa, Entamoeba histolytica
NKNDDNL

SEQ ID NO: 2642792 - protein, 9 aa, Entamoeba histolytica
NKNDPDEIY

SEQ ID NO: 2642793 - protein, 7 aa, Entamoeba histolytica
NKNDSDN

SEQ ID NO: 2642794 - protein, 7 aa, Entamoeba histolytica
NKNEDEI

SEQ ID NO: 2642795 - protein, 22 aa, Entamoeba histolytica
NKNEDKTESEKRQWKTKYDDST

SEQ ID NO: 2642796 - protein, 9 aa, Entamoeba histolytica
NKNEDVSRN

SEQ ID NO: 2642797 - protein, 13 aa, Entamoeba histolytica
NKNEKQKTEEIEK

SEQ ID NO: 2642798 - protein, 6 aa, Entamoeba histolytica
NKNENG

SEQ ID NO: 2642799 - protein, 8 aa, Entamoeba histolytica
NKNENGIN

SEQ ID NO: 2642800 - protein, 7 aa, Entamoeba histolytica
NKNEQAL

SEQ ID NO: 2642801 - protein, 7 aa, Entamoeba histolytica
NKNESIP

SEQ ID NO: 2642802 - protein, 6 aa, Entamoeba histolytica
NKNESL

SEQ ID NO: 2642803 - protein, 7 aa, Entamoeba histolytica
NKNESTK

SEQ ID NO: 2642804 - protein, 5 aa, Entamoeba histolytica
NKNFQ

SEQ ID NO: 2642805 - protein, 9 aa, Entamoeba histolytica
NKNGVGDPT

SEQ ID NO: 2642806 - protein, 9 aa, Entamoeba histolytica
NKNHPDYQP

SEQ ID NO: 2642807 - protein, 8 aa, Entamoeba histolytica
NKNHPIKG

SEQ ID NO: 2642808 - protein, 8 aa, Entamoeba histolytica
NKNISHDS

SEQ ID NO: 2642809 - protein, 7 aa, Entamoeba histolytica
NKNITKE

SEQ ID NO: 2642810 - protein, 17 aa, Entamoeba histolytica
NKNKDEEQEKPQQLNEK

SEQ ID NO: 2642811 - protein, 9 aa, Entamoeba histolytica
NKNKEDEKY

SEQ ID NO: 2642812 - protein, 9 aa, Entamoeba histolytica
NKNKEEWQT

SEQ ID NO: 2642813 - protein, 18 aa, Entamoeba histolytica
NKNKEINEIKEKNEKEIN

SEQ ID NO: 2642814 - protein, 15 aa, Entamoeba histolytica
NKNKEVAANYLFERG

SEQ ID NO: 2642815 - protein, 8 aa, Entamoeba histolytica
NKNKFTRH

SEQ ID NO: 2642816 - protein, 8 aa, Entamoeba histolytica
NKNKGFSI

SEQ ID NO: 2642817 - protein, 6 aa, Entamoeba histolytica
NKNKGS

SEQ ID NO: 2642818 - protein, 10 aa, Entamoeba histolytica
NKNKQSNGYG

SEQ ID NO: 2642819 - protein, 10 aa, Entamoeba histolytica
NKNKSKEFPI

SEQ ID NO: 2642820 - protein, 8 aa, Entamoeba histolytica
NKNKTLKD

SEQ ID NO: 2642821 - protein, 4 aa, Entamoeba histolytica
NKNL

SEQ ID NO: 2642822 - protein, 8 aa, Entamoeba histolytica
NKNLNGEY

SEQ ID NO: 2642823 - protein, 12 aa, Entamoeba histolytica
NKNLSLKNEVDD

SEQ ID NO: 2642824 - protein, 7 aa, Entamoeba histolytica
NKNNDEF

SEQ ID NO: 2642825 - protein, 6 aa, Entamoeba histolytica
NKNNNQ

SEQ ID NO: 2642826 - protein, 6 aa, Entamoeba histolytica
NKNNQC

SEQ ID NO: 2642827 - protein, 7 aa, Entamoeba histolytica
NKNNSIP

SEQ ID NO: 2642828 - protein, 6 aa, Entamoeba histolytica
NKNPVD

SEQ ID NO: 2642829 - protein, 20 aa, Entamoeba histolytica
NKNQAKPQQQHVPKESITTS

SEQ ID NO: 2642830 - protein, 7 aa, Entamoeba histolytica
NKNQPNI

SEQ ID NO: 2642831 - protein, 9 aa, Entamoeba histolytica
NKNQSTQEL

SEQ ID NO: 2642832 - protein, 5 aa, Entamoeba histolytica
NKNRI

SEQ ID NO: 2642833 - protein, 7 aa, Entamoeba histolytica
NKNSDEI

SEQ ID NO: 2642834 - protein, 7 aa, Entamoeba histolytica
NKNSELN

SEQ ID NO: 2642835 - protein, 12 aa, Entamoeba histolytica
NKNSENKEVKSQ

SEQ ID NO: 2642836 - protein, 5 aa, Entamoeba histolytica
NKNSF

SEQ ID NO: 2642837 - protein, 7 aa, Entamoeba histolytica
NKNSHVK

SEQ ID NO: 2642838 - protein, 8 aa, Entamoeba histolytica
NKNSIEGA

SEQ ID NO: 2642839 - protein, 17 aa, Entamoeba histolytica
NKNTNQPSKSNGSLQPL

SEQ ID NO: 2642840 - protein, 6 aa, Entamoeba histolytica
NKNVPS

SEQ ID NO: 2642841 - protein, 5 aa, Entamoeba histolytica
NKNYI

SEQ ID NO: 2642842 - protein, 7 aa, Entamoeba histolytica
NKNYNQR

SEQ ID NO: 2642843 - protein, 6 aa, Entamoeba histolytica
NKNYQI

SEQ ID NO: 2642844 - protein, 7 aa, Entamoeba histolytica
NKNYSTK

SEQ ID NO: 2642845 - protein, 5 aa, Entamoeba histolytica
NKPAG

SEQ ID NO: 2642846 - protein, 12 aa, Entamoeba histolytica
NKPCPQPQTSEH

SEQ ID NO: 2642847 - protein, 8 aa, Entamoeba histolytica
NKPEEDSD

SEQ ID NO: 2642848 - protein, 5 aa, Entamoeba histolytica
NKPEM

SEQ ID NO: 2642849 - protein, 9 aa, Entamoeba histolytica
NKPENKPLV

SEQ ID NO: 2642850 - protein, 10 aa, Entamoeba histolytica
NKPENTSSIE

SEQ ID NO: 2642851 - protein, 8 aa, Entamoeba histolytica
NKPEYRKK

SEQ ID NO: 2642852 - protein, 7 aa, Entamoeba histolytica
NKPFDDE

SEQ ID NO: 2642853 - protein, 10 aa, Entamoeba histolytica
NKPFNRSRKR

SEQ ID NO: 2642854 - protein, 8 aa, Entamoeba histolytica
NKPGTLPQ

SEQ ID NO: 2642855 - protein, 6 aa, Entamoeba histolytica
NKPIIE

SEQ ID NO: 2642856 - protein, 20 aa, Entamoeba histolytica
NKPIRQENIASSAPPSNNPI

SEQ ID NO: 2642857 - protein, 25 aa, Entamoeba histolytica
NKPISSPQQNKQMPTLSSTLKTTPL

SEQ ID NO: 2642858 - protein, 7 aa, Entamoeba histolytica
NKPKEYS

SEQ ID NO: 2642859 - protein, 12 aa, Entamoeba histolytica
NKPKKERENSQM

SEQ ID NO: 2642860 - protein, 8 aa, Entamoeba histolytica
NKPKQVEK

SEQ ID NO: 2642861 - protein, 5 aa, Entamoeba histolytica
NKPKT

SEQ ID NO: 2642862 - protein, 7 aa, Entamoeba histolytica
NKPKVSK

SEQ ID NO: 2642863 - protein, 4 aa, Entamoeba histolytica
NKPL

SEQ ID NO: 2642864 - protein, 8 aa, Entamoeba histolytica
NKPLPSDR

SEQ ID NO: 2642865 - protein, 7 aa, Entamoeba histolytica
NKPLSKT

SEQ ID NO: 2642866 - protein, 10 aa, Entamoeba histolytica
NKPLTPNQEE

SEQ ID NO: 2642867 - protein, 9 aa, Entamoeba histolytica
NKPNEDISR

SEQ ID NO: 2642868 - protein, 8 aa, Entamoeba histolytica
NKPNGSLT

SEQ ID NO: 2642869 - protein, 12 aa, Entamoeba histolytica
NKPNKKYKENEI

SEQ ID NO: 2642870 - protein, 7 aa, Entamoeba histolytica
NKPNKPA

SEQ ID NO: 2642871 - protein, 6 aa, Entamoeba histolytica
NKPNQK

SEQ ID NO: 2642872 - protein, 8 aa, Entamoeba histolytica
NKPNSYSF

SEQ ID NO: 2642873 - protein, 7 aa, Entamoeba histolytica
NKPPISV

SEQ ID NO: 2642874 - protein, 7 aa, Entamoeba histolytica
NKPPPIN

SEQ ID NO: 2642875 - protein, 6 aa, Entamoeba histolytica
NKPQHI

SEQ ID NO: 2642876 - protein, 7 aa, Entamoeba histolytica
NKPQKAI

SEQ ID NO: 2642877 - protein, 8 aa, Entamoeba histolytica
NKPQSFKS

SEQ ID NO: 2642878 - protein, 6 aa, Entamoeba histolytica
NKPRTE

SEQ ID NO: 2642879 - protein, 5 aa, Entamoeba histolytica
NKPRV

SEQ ID NO: 2642880 - protein, 6 aa, Entamoeba histolytica
NKPSDA

SEQ ID NO: 2642881 - protein, 7 aa, Entamoeba histolytica
NKPSKEI

SEQ ID NO: 2642882 - protein, 6 aa, Entamoeba histolytica
NKPSKK

SEQ ID NO: 2642883 - protein, 12 aa, Entamoeba histolytica
NKPTHCVKVVIQ

SEQ ID NO: 2642884 - protein, 11 aa, Entamoeba histolytica
NKPTIKPSKYS

SEQ ID NO: 2642885 - protein, 6 aa, Entamoeba histolytica
NKPTKA

SEQ ID NO: 2642886 - protein, 12 aa, Entamoeba histolytica
NKPTLTKSSNLR

SEQ ID NO: 2642887 - protein, 9 aa, Entamoeba histolytica
NKPTPLSNE

SEQ ID NO: 2642888 - protein, 9 aa, Entamoeba histolytica
NKPTQSSNV

SEQ ID NO: 2642889 - protein, 7 aa, Entamoeba histolytica
NKPTSFA

SEQ ID NO: 2642890 - protein, 12 aa, Entamoeba histolytica
NKPVEVGKTGEE

SEQ ID NO: 2642891 - protein, 19 aa, Entamoeba histolytica
NKPYKHNENKEEKKGSEAI

SEQ ID NO: 2642892 - protein, 6 aa, Entamoeba histolytica
NKPYPT

SEQ ID NO: 2642893 - protein, 10 aa, Entamoeba histolytica
NKPYSGKPSF

SEQ ID NO: 2642894 - protein, 5 aa, Entamoeba histolytica
NKQAM

SEQ ID NO: 2642895 - protein, 8 aa, Entamoeba histolytica
NKQDDKKH

SEQ ID NO: 2642896 - protein, 10 aa, Entamoeba histolytica
NKQDEQLQSF

SEQ ID NO: 2642897 - protein, 6 aa, Entamoeba histolytica
NKQDTM

SEQ ID NO: 2642898 - protein, 12 aa, Entamoeba histolytica
NKQEESIGKYST

SEQ ID NO: 2642899 - protein, 36 aa, Entamoeba histolytica
NKQEFSSSTESPNSGSKSSSPQLDNEKEKRKSKVGK

SEQ ID NO: 2642900 - protein, 7 aa, Entamoeba histolytica
NKQENLR

SEQ ID NO: 2642901 - protein, 6 aa, Entamoeba histolytica
NKQERF

SEQ ID NO: 2642902 - protein, 13 aa, Entamoeba histolytica
NKQETSESEEMGE

SEQ ID NO: 2642903 - protein, 98 aa, Entamoeba histolytica
NKQGLDEKTLKAKKEAEEKAKKEAEEKAKKEAEEKAKKEAEEKAKKEAEEKAKKEAEEKAKKEAEEKAKKEAEEKAKKEAEEKARKEKSEKEKQERLK

SEQ ID NO: 2642904 - protein, 6 aa, Entamoeba histolytica
NKQHYN

SEQ ID NO: 2642905 - protein, 4 aa, Entamoeba histolytica
NKQI

SEQ ID NO: 2642906 - protein, 32 aa, Entamoeba histolytica
NKQISKDSISKTNNGGYKRPQRELPLIEPRHI

SEQ ID NO: 2642907 - protein, 8 aa, Entamoeba histolytica
NKQKNDSI

SEQ ID NO: 2642908 - protein, 15 aa, Entamoeba histolytica
NKQKPVSKKMKHFWL

SEQ ID NO: 2642909 - protein, 7 aa, Entamoeba histolytica
NKQKTEI

SEQ ID NO: 2642910 - protein, 6 aa, Entamoeba histolytica
NKQKTK

SEQ ID NO: 2642911 - protein, 4 aa, Entamoeba histolytica
NKQL

SEQ ID NO: 2642912 - protein, 6 aa, Entamoeba histolytica
NKQLKQ

SEQ ID NO: 2642913 - protein, 8 aa, Entamoeba histolytica
NKQLKTET

SEQ ID NO: 2642914 - protein, 26 aa, Entamoeba histolytica
NKQLTPKVQEQQKPDTTLKKQSSKRL

SEQ ID NO: 2642915 - protein, 15 aa, Entamoeba histolytica
NKQMPRSQDEKNTEM

SEQ ID NO: 2642916 - protein, 4 aa, Entamoeba histolytica
NKQN

SEQ ID NO: 2642917 - protein, 7 aa, Entamoeba histolytica
NKQNGKI

SEQ ID NO: 2642918 - protein, 7 aa, Entamoeba histolytica
NKQNGYK

SEQ ID NO: 2642919 - protein, 13 aa, Entamoeba histolytica
NKQNNKEEYSAEL

SEQ ID NO: 2642920 - protein, 9 aa, Entamoeba histolytica
NKQNSKQCH

SEQ ID NO: 2642921 - protein, 8 aa, Entamoeba histolytica
NKQPPYKS

SEQ ID NO: 2642922 - protein, 6 aa, Entamoeba histolytica
NKQPTE

SEQ ID NO: 2642923 - protein, 7 aa, Entamoeba histolytica
NKQPTQI

SEQ ID NO: 2642924 - protein, 5 aa, Entamoeba histolytica
NKQQH

SEQ ID NO: 2642925 - protein, 11 aa, Entamoeba histolytica
NKQREGSINEV

SEQ ID NO: 2642926 - protein, 11 aa, Entamoeba histolytica
NKQRPADQQAA

SEQ ID NO: 2642927 - protein, 13 aa, Entamoeba histolytica
NKQSLDNKTPSSN

SEQ ID NO: 2642928 - protein, 8 aa, Entamoeba histolytica
NKQTGKDM

SEQ ID NO: 2642929 - protein, 5 aa, Entamoeba histolytica
NKQTL

SEQ ID NO: 2642930 - protein, 7 aa, Entamoeba histolytica
NKQTLQD

SEQ ID NO: 2642931 - protein, 13 aa, Entamoeba histolytica
NKQTTEDNPVKGK

SEQ ID NO: 2642932 - protein, 8 aa, Entamoeba histolytica
NKQVNSNK

SEQ ID NO: 2642933 - protein, 12 aa, Entamoeba histolytica
NKQVSDEHNTKT

SEQ ID NO: 2642934 - protein, 24 aa, Entamoeba histolytica
NKQYEKLKKQYKRLAAAKDSDDDS

SEQ ID NO: 2642935 - protein, 12 aa, Entamoeba histolytica
NKQYKEWPPLPQ

SEQ ID NO: 2642936 - protein, 8 aa, Entamoeba histolytica
NKQYQEQL

SEQ ID NO: 2642937 - protein, 6 aa, Entamoeba histolytica
NKRATM

SEQ ID NO: 2642938 - protein, 6 aa, Entamoeba histolytica
NKRCTE

SEQ ID NO: 2642939 - protein, 9 aa, Entamoeba histolytica
NKRDELDSP

SEQ ID NO: 2642940 - protein, 7 aa, Entamoeba histolytica
NKREEAT

SEQ ID NO: 2642941 - protein, 8 aa, Entamoeba histolytica
NKREIYDR

SEQ ID NO: 2642942 - protein, 90 aa, Entamoeba histolytica
NKREYENNTEGNNNGNNLETKNEDKPLTEESEIEEITQKQIEEKQIEKESNNVESKQLDVENNNTIQLKEEEKNKTELKDNNNEKEEDNF

SEQ ID NO: 2642943 - protein, 10 aa, Entamoeba histolytica
NKRGEEVEGC

SEQ ID NO: 2642944 - protein, 10 aa, Entamoeba histolytica
NKRGEYPEGV

SEQ ID NO: 2642945 - protein, 5 aa, Entamoeba histolytica
NKRGN

SEQ ID NO: 2642946 - protein, 8 aa, Entamoeba histolytica
NKRGSQTK

SEQ ID NO: 2642947 - protein, 6 aa, Entamoeba histolytica
NKRGTL

SEQ ID NO: 2642948 - protein, 7 aa, Entamoeba histolytica
NKRHPTI

SEQ ID NO: 2642949 - protein, 5 aa, Entamoeba histolytica
NKRID

SEQ ID NO: 2642950 - protein, 8 aa, Entamoeba histolytica
NKRIEGDR

SEQ ID NO: 2642951 - protein, 15 aa, Entamoeba histolytica
NKRIEKHNKYGKTIE

SEQ ID NO: 2642952 - protein, 5 aa, Entamoeba histolytica
NKRIQ

SEQ ID NO: 2642953 - protein, 17 aa, Entamoeba histolytica
NKRITDEKLKSQPQTVT

SEQ ID NO: 2642954 - protein, 6 aa, Entamoeba histolytica
NKRKDV

SEQ ID NO: 2642955 - protein, 6 aa, Entamoeba histolytica
NKRKGC

SEQ ID NO: 2642956 - protein, 8 aa, Entamoeba histolytica
NKRKKEIN

SEQ ID NO: 2642957 - protein, 9 aa, Entamoeba histolytica
NKRKPQPAV

SEQ ID NO: 2642958 - protein, 25 aa, Entamoeba histolytica
NKRKYSPPRSTSRHSNRNRSQYSFS

SEQ ID NO: 2642959 - protein, 13 aa, Entamoeba histolytica
NKRMNEENKGIRE

SEQ ID NO: 2642960 - protein, 12 aa, Entamoeba histolytica
NKRNKREPTKNA

SEQ ID NO: 2642961 - protein, 11 aa, Entamoeba histolytica
NKRNSISPYPL

SEQ ID NO: 2642962 - protein, 35 aa, Entamoeba histolytica
NKRNYYDNLESSDDELSSDDEMSSSAFEEEYENNN

SEQ ID NO: 2642963 - protein, 6 aa, Entamoeba histolytica
NKRPNI

SEQ ID NO: 2642964 - protein, 4 aa, Entamoeba histolytica
NKRQ

SEQ ID NO: 2642965 - protein, 8 aa, Entamoeba histolytica
NKRQNGDR

SEQ ID NO: 2642966 - protein, 6 aa, Entamoeba histolytica
NKRQPF

SEQ ID NO: 2642967 - protein, 18 aa, Entamoeba histolytica
NKRRSNYKKVQDKKIKNR

SEQ ID NO: 2642968 - protein, 10 aa, Entamoeba histolytica
NKRRYPTESC

SEQ ID NO: 2642969 - protein, 4 aa, Entamoeba histolytica
NKRT

SEQ ID NO: 2642970 - protein, 5 aa, Entamoeba histolytica
NKRTD

SEQ ID NO: 2642971 - protein, 14 aa, Entamoeba histolytica
NKRTFQKKNTTKLS

SEQ ID NO: 2642972 - protein, 8 aa, Entamoeba histolytica
NKRTKKEF

SEQ ID NO: 2642973 - protein, 4 aa, Entamoeba histolytica
NKRY

SEQ ID NO: 2642974 - protein, 7 aa, Entamoeba histolytica
NKSDCDG

SEQ ID NO: 2642975 - protein, 24 aa, Entamoeba histolytica
NKSDEEAKSVEEEKADGENEDMVE

SEQ ID NO: 2642976 - protein, 13 aa, Entamoeba histolytica
NKSDGKEFTEEEC

SEQ ID NO: 2642977 - protein, 8 aa, Entamoeba histolytica
NKSDGSVV

SEQ ID NO: 2642978 - protein, 9 aa, Entamoeba histolytica
NKSDINDQR

SEQ ID NO: 2642979 - protein, 7 aa, Entamoeba histolytica
NKSDLDP

SEQ ID NO: 2642980 - protein, 10 aa, Entamoeba histolytica
NKSDLSNART

SEQ ID NO: 2642981 - protein, 12 aa, Entamoeba histolytica
NKSDSPNPTVSK

SEQ ID NO: 2642982 - protein, 8 aa, Entamoeba histolytica
NKSDSYKL

SEQ ID NO: 2642983 - protein, 11 aa, Entamoeba histolytica
NKSDYTNPEIE

SEQ ID NO: 2642984 - protein, 4 aa, Entamoeba histolytica
NKSE

SEQ ID NO: 2642985 - protein, 11 aa, Entamoeba histolytica
NKSEFGKNRSG

SEQ ID NO: 2642986 - protein, 6 aa, Entamoeba histolytica
NKSFNQ

SEQ ID NO: 2642987 - protein, 7 aa, Entamoeba histolytica
NKSGKVP

SEQ ID NO: 2642988 - protein, 7 aa, Entamoeba histolytica
NKSGYFD

SEQ ID NO: 2642989 - protein, 7 aa, Entamoeba histolytica
NKSHNIK

SEQ ID NO: 2642990 - protein, 4 aa, Entamoeba histolytica
NKSI

SEQ ID NO: 2642991 - protein, 7 aa, Entamoeba histolytica
NKSIENS

SEQ ID NO: 2642992 - protein, 5 aa, Entamoeba histolytica
NKSII

SEQ ID NO: 2642993 - protein, 13 aa, Entamoeba histolytica
NKSIKETLKRDSD

SEQ ID NO: 2642994 - protein, 6 aa, Entamoeba histolytica
NKSINK

SEQ ID NO: 2642995 - protein, 6 aa, Entamoeba histolytica
NKSISS

SEQ ID NO: 2642996 - protein, 9 aa, Entamoeba histolytica
NKSKALEGK

SEQ ID NO: 2642997 - protein, 8 aa, Entamoeba histolytica
NKSKITKR

SEQ ID NO: 2642998 - protein, 11 aa, Entamoeba histolytica
NKSKPSPPLKE

SEQ ID NO: 2642999 - protein, 7 aa, Entamoeba histolytica
NKSKQLE

SEQ ID NO: 2643000 - protein, 7 aa, Entamoeba histolytica
NKSKTSL

SEQ ID NO: 2643001 - protein, 5 aa, Entamoeba histolytica
NKSKV

SEQ ID NO: 2643002 - protein, 26 aa, Entamoeba histolytica
NKSLPSKDQISDSKVKRKRSEPDAVS

SEQ ID NO: 2643003 - protein, 8 aa, Entamoeba histolytica
NKSLSKEQ

SEQ ID NO: 2643004 - protein, 9 aa, Entamoeba histolytica
NKSMTTKQM

SEQ ID NO: 2643005 - protein, 8 aa, Entamoeba histolytica
NKSNDVRI

SEQ ID NO: 2643006 - protein, 13 aa, Entamoeba histolytica
NKSNEMDREEANY

SEQ ID NO: 2643007 - protein, 8 aa, Entamoeba histolytica
NKSNINVS

SEQ ID NO: 2643008 - protein, 8 aa, Entamoeba histolytica
NKSNMTQT

SEQ ID NO: 2643009 - protein, 7 aa, Entamoeba histolytica
NKSNYPK

SEQ ID NO: 2643010 - protein, 7 aa, Entamoeba histolytica
NKSQTFK

SEQ ID NO: 2643011 - protein, 8 aa, Entamoeba histolytica
NKSRKEEG

SEQ ID NO: 2643012 - protein, 6 aa, Entamoeba histolytica
NKSSIL

SEQ ID NO: 2643013 - protein, 7 aa, Entamoeba histolytica
NKSSLNQ

SEQ ID NO: 2643014 - protein, 10 aa, Entamoeba histolytica
NKSSRKSYQN

SEQ ID NO: 2643015 - protein, 8 aa, Entamoeba histolytica
NKSSSDLD

SEQ ID NO: 2643016 - protein, 9 aa, Entamoeba histolytica
NKSSSESIQ

SEQ ID NO: 2643017 - protein, 8 aa, Entamoeba histolytica
NKSSSQLN

SEQ ID NO: 2643018 - protein, 10 aa, Entamoeba histolytica
NKSSTEPSLS

SEQ ID NO: 2643019 - protein, 5 aa, Entamoeba histolytica
NKSSV

SEQ ID NO: 2643020 - protein, 5 aa, Entamoeba histolytica
NKSTF

SEQ ID NO: 2643021 - protein, 9 aa, Entamoeba histolytica
NKSTGELDI

SEQ ID NO: 2643022 - protein, 9 aa, Entamoeba histolytica
NKSTGTQNF

SEQ ID NO: 2643023 - protein, 10 aa, Entamoeba histolytica
NKSTQSFTGC

SEQ ID NO: 2643024 - protein, 8 aa, Entamoeba histolytica
NKSTQTEI

SEQ ID NO: 2643025 - protein, 5 aa, Entamoeba histolytica
NKSVN

SEQ ID NO: 2643026 - protein, 9 aa, Entamoeba histolytica
NKSVPEEGL

SEQ ID NO: 2643027 - protein, 7 aa, Entamoeba histolytica
NKSYEEL

SEQ ID NO: 2643028 - protein, 6 aa, Entamoeba histolytica
NKSYQD

SEQ ID NO: 2643029 - protein, 9 aa, Entamoeba histolytica
NKTAEQQFP

SEQ ID NO: 2643030 - protein, 8 aa, Entamoeba histolytica
NKTAGEVR

SEQ ID NO: 2643031 - protein, 7 aa, Entamoeba histolytica
NKTAPLG

SEQ ID NO: 2643032 - protein, 8 aa, Entamoeba histolytica
NKTDESLK

SEQ ID NO: 2643033 - protein, 10 aa, Entamoeba histolytica
NKTDEYGGID

SEQ ID NO: 2643034 - protein, 7 aa, Entamoeba histolytica
NKTDKEF

SEQ ID NO: 2643035 - protein, 7 aa, Entamoeba histolytica
NKTDLDE

SEQ ID NO: 2643036 - protein, 9 aa, Entamoeba histolytica
NKTDTEPTE

SEQ ID NO: 2643037 - protein, 4 aa, Entamoeba histolytica
NKTE

SEQ ID NO: 2643038 - protein, 8 aa, Entamoeba histolytica
NKTEPFAR

SEQ ID NO: 2643039 - protein, 7 aa, Entamoeba histolytica
NKTEPVS

SEQ ID NO: 2643040 - protein, 8 aa, Entamoeba histolytica
NKTFSESI

SEQ ID NO: 2643041 - protein, 10 aa, Entamoeba histolytica
NKTGEFDGHD

SEQ ID NO: 2643042 - protein, 12 aa, Entamoeba histolytica
NKTGIDSQNNLG

SEQ ID NO: 2643043 - protein, 4 aa, Entamoeba histolytica
NKTH

SEQ ID NO: 2643044 - protein, 5 aa, Entamoeba histolytica
NKTHQ

SEQ ID NO: 2643045 - protein, 12 aa, Entamoeba histolytica
NKTHRDQQQQYR

SEQ ID NO: 2643046 - protein, 7 aa, Entamoeba histolytica
NKTIEGG

SEQ ID NO: 2643047 - protein, 6 aa, Entamoeba histolytica
NKTIPY

SEQ ID NO: 2643048 - protein, 17 aa, Entamoeba histolytica
NKTIQDAKDQEKDLRDE

SEQ ID NO: 2643049 - protein, 7 aa, Entamoeba histolytica
NKTKDTY

SEQ ID NO: 2643050 - protein, 9 aa, Entamoeba histolytica
NKTKEAAKQ

SEQ ID NO: 2643051 - protein, 8 aa, Entamoeba histolytica
NKTKEIQS

SEQ ID NO: 2643052 - protein, 16 aa, Entamoeba histolytica
NKTKTILEGEKGIKEL

SEQ ID NO: 2643053 - protein, 19 aa, Entamoeba histolytica
NKTKTSSISEKEANKHMDE

SEQ ID NO: 2643054 - protein, 6 aa, Entamoeba histolytica
NKTLHS

SEQ ID NO: 2643055 - protein, 12 aa, Entamoeba histolytica
NKTLKEQVSKLS

SEQ ID NO: 2643056 - protein, 5 aa, Entamoeba histolytica
NKTMT

SEQ ID NO: 2643057 - protein, 7 aa, Entamoeba histolytica
NKTNENI

SEQ ID NO: 2643058 - protein, 11 aa, Entamoeba histolytica
NKTNKEITPNA

SEQ ID NO: 2643059 - protein, 7 aa, Entamoeba histolytica
NKTNKHN

SEQ ID NO: 2643060 - protein, 7 aa, Entamoeba histolytica
NKTNNSY

SEQ ID NO: 2643061 - protein, 6 aa, Entamoeba histolytica
NKTPAL

SEQ ID NO: 2643062 - protein, 5 aa, Entamoeba histolytica
NKTPG

SEQ ID NO: 2643063 - protein, 5 aa, Entamoeba histolytica
NKTPL

SEQ ID NO: 2643064 - protein, 7 aa, Entamoeba histolytica
NKTPLSN

SEQ ID NO: 2643065 - protein, 18 aa, Entamoeba histolytica
NKTPTQIRDKVNNTRSSY

SEQ ID NO: 2643066 - protein, 8 aa, Entamoeba histolytica
NKTQSSQV

SEQ ID NO: 2643067 - protein, 10 aa, Entamoeba histolytica
NKTSQNGFSR

SEQ ID NO: 2643068 - protein, 8 aa, Entamoeba histolytica
NKTTEKAE

SEQ ID NO: 2643069 - protein, 36 aa, Entamoeba histolytica
NKTTHKNKESIIRNSENQVPINTNNALSSSPQNDDQ

SEQ ID NO: 2643070 - protein, 12 aa, Entamoeba histolytica
NKTTSDKELIGP

SEQ ID NO: 2643071 - protein, 8 aa, Entamoeba histolytica
NKTVEEHD

SEQ ID NO: 2643072 - protein, 20 aa, Entamoeba histolytica
NKTVEIKEEEEEVEEEVEEP

SEQ ID NO: 2643073 - protein, 14 aa, Entamoeba histolytica
NKTYATTISPSSQW

SEQ ID NO: 2643074 - protein, 4 aa, Entamoeba histolytica
NKVD

SEQ ID NO: 2643075 - protein, 4 aa, Entamoeba histolytica
NKVE

SEQ ID NO: 2643076 - protein, 7 aa, Entamoeba histolytica
NKVEEKN

SEQ ID NO: 2643077 - protein, 14 aa, Entamoeba histolytica
NKVENENEKRFKEK

SEQ ID NO: 2643078 - protein, 7 aa, Entamoeba histolytica
NKVETDS

SEQ ID NO: 2643079 - protein, 9 aa, Entamoeba histolytica
NKVHGDIKP

SEQ ID NO: 2643080 - protein, 9 aa, Entamoeba histolytica
NKVKAERDY

SEQ ID NO: 2643081 - protein, 6 aa, Entamoeba histolytica
NKVKKG

SEQ ID NO: 2643082 - protein, 5 aa, Entamoeba histolytica
NKVNE

SEQ ID NO: 2643083 - protein, 19 aa, Entamoeba histolytica
NKVNETSKINELTEETQKY

SEQ ID NO: 2643084 - protein, 9 aa, Entamoeba histolytica
NKVNKKNAW

SEQ ID NO: 2643085 - protein, 9 aa, Entamoeba histolytica
NKVNNQTEQ

SEQ ID NO: 2643086 - protein, 4 aa, Entamoeba histolytica
NKVQ

SEQ ID NO: 2643087 - protein, 8 aa, Entamoeba histolytica
NKVSCQKE

SEQ ID NO: 2643088 - protein, 9 aa, Entamoeba histolytica
NKVSGEEKR

SEQ ID NO: 2643089 - protein, 8 aa, Entamoeba histolytica
NKVTSSNE

SEQ ID NO: 2643090 - protein, 12 aa, Entamoeba histolytica
NKYDNNASEKVE

SEQ ID NO: 2643091 - protein, 15 aa, Entamoeba histolytica
NKYEQSPYHTDYLND

SEQ ID NO: 2643092 - protein, 8 aa, Entamoeba histolytica
NKYESKEL

SEQ ID NO: 2643093 - protein, 13 aa, Entamoeba histolytica
NKYESQSRDNLSS

SEQ ID NO: 2643094 - protein, 4 aa, Entamoeba histolytica
NKYG

SEQ ID NO: 2643095 - protein, 8 aa, Entamoeba histolytica
NKYGCASQ

SEQ ID NO: 2643096 - protein, 5 aa, Entamoeba histolytica
NKYGI

SEQ ID NO: 2643097 - protein, 5 aa, Entamoeba histolytica
NKYHG

SEQ ID NO: 2643098 - protein, 8 aa, Entamoeba histolytica
NKYKNYGG

SEQ ID NO: 2643099 - protein, 6 aa, Entamoeba histolytica
NKYKSN

SEQ ID NO: 2643100 - protein, 4 aa, Entamoeba histolytica
NKYN

SEQ ID NO: 2643101 - protein, 6 aa, Entamoeba histolytica
NKYPYP

SEQ ID NO: 2643102 - protein, 12 aa, Entamoeba histolytica
NKYSDDGRSVNT

SEQ ID NO: 2643103 - protein, 5 aa, Entamoeba histolytica
NKYTD

SEQ ID NO: 2643104 - protein, 6 aa, Entamoeba histolytica
NKYTDA

SEQ ID NO: 2643105 - protein, 5 aa, Entamoeba histolytica
NKYYD

SEQ ID NO: 2643106 - protein, 7 aa, Entamoeba histolytica
NLADSQY

SEQ ID NO: 2643107 - protein, 6 aa, Entamoeba histolytica
NLAQNI

SEQ ID NO: 2643108 - protein, 7 aa, Entamoeba histolytica
NLATKDD

SEQ ID NO: 2643109 - protein, 4 aa, Entamoeba histolytica
NLDD

SEQ ID NO: 2643110 - protein, 7 aa, Entamoeba histolytica
NLDIDPK

SEQ ID NO: 2643111 - protein, 7 aa, Entamoeba histolytica
NLDKEAP

SEQ ID NO: 2643112 - protein, 8 aa, Entamoeba histolytica
NLDNTTLS

SEQ ID NO: 2643113 - protein, 12 aa, Entamoeba histolytica
NLDPSDDNIEGN

SEQ ID NO: 2643114 - protein, 13 aa, Entamoeba histolytica
NLDPTFQKSDEEM

SEQ ID NO: 2643115 - protein, 14 aa, Entamoeba histolytica
NLDTQQMEMVQAEV

SEQ ID NO: 2643116 - protein, 7 aa, Entamoeba histolytica
NLEDESL

SEQ ID NO: 2643117 - protein, 5 aa, Entamoeba histolytica
NLEEA

SEQ ID NO: 2643118 - protein, 13 aa, Entamoeba histolytica
NLEEDKEELKETI

SEQ ID NO: 2643119 - protein, 25 aa, Entamoeba histolytica
NLEEDSDDESTYHDDNESSDEENDE

SEQ ID NO: 2643120 - protein, 18 aa, Entamoeba histolytica
NLEESIKQTEKAEKEMYK

SEQ ID NO: 2643121 - protein, 5 aa, Entamoeba histolytica
NLENS

SEQ ID NO: 2643122 - protein, 5 aa, Entamoeba histolytica
NLEPF

SEQ ID NO: 2643123 - protein, 6 aa, Entamoeba histolytica
NLEPKY

SEQ ID NO: 2643124 - protein, 16 aa, Entamoeba histolytica
NLEQHKDQSQSQTSQV

SEQ ID NO: 2643125 - protein, 9 aa, Entamoeba histolytica
NLEQLNKDD

SEQ ID NO: 2643126 - protein, 16 aa, Entamoeba histolytica
NLEQRKDQSKSQTSEV

SEQ ID NO: 2643127 - protein, 7 aa, Entamoeba histolytica
NLEQSSS

SEQ ID NO: 2643128 - protein, 9 aa, Entamoeba histolytica
NLESQPQNE

SEQ ID NO: 2643129 - protein, 8 aa, Entamoeba histolytica
NLETEERM

SEQ ID NO: 2643130 - protein, 5 aa, Entamoeba histolytica
NLETV

SEQ ID NO: 2643131 - protein, 4 aa, Entamoeba histolytica
NLGE

SEQ ID NO: 2643132 - protein, 8 aa, Entamoeba histolytica
NLGEGTYG

SEQ ID NO: 2643133 - protein, 6 aa, Entamoeba histolytica
NLGETL

SEQ ID NO: 2643134 - protein, 6 aa, Entamoeba histolytica
NLGKDR

SEQ ID NO: 2643135 - protein, 10 aa, Entamoeba histolytica
NLGPKVTEED

SEQ ID NO: 2643136 - protein, 5 aa, Entamoeba histolytica
NLGQN

SEQ ID NO: 2643137 - protein, 5 aa, Entamoeba histolytica
NLGYP

SEQ ID NO: 2643138 - protein, 10 aa, Entamoeba histolytica
NLGYTPNELP

SEQ ID NO: 2643139 - protein, 9 aa, Entamoeba histolytica
NLHSSKEHF

SEQ ID NO: 2643140 - protein, 29 aa, Entamoeba histolytica
NLKDEEIQALKKENEKLKQESEKSHKPKV

SEQ ID NO: 2643141 - protein, 24 aa, Entamoeba histolytica
NLKEEFEKKKIQNQKKEEGTQTKN

SEQ ID NO: 2643142 - protein, 13 aa, Entamoeba histolytica
NLKEEKENIPEVE

SEQ ID NO: 2643143 - protein, 13 aa, Entamoeba histolytica
NLKEEKENTPEIN

SEQ ID NO: 2643144 - protein, 14 aa, Entamoeba histolytica
NLKEEKENTPERND

SEQ ID NO: 2643145 - protein, 8 aa, Entamoeba histolytica
NLKELSKG

SEQ ID NO: 2643146 - protein, 20 aa, Entamoeba histolytica
NLKEVPKTCSPFTEFDLETL

SEQ ID NO: 2643147 - protein, 14 aa, Entamoeba histolytica
NLKGADFGGLSSDP

SEQ ID NO: 2643148 - protein, 6 aa, Entamoeba histolytica
NLKGSD

SEQ ID NO: 2643149 - protein, 6 aa, Entamoeba histolytica
NLKKQP

SEQ ID NO: 2643150 - protein, 6 aa, Entamoeba histolytica
NLKNEN

SEQ ID NO: 2643151 - protein, 8 aa, Entamoeba histolytica
NLKNGANV

SEQ ID NO: 2643152 - protein, 12 aa, Entamoeba histolytica
NLKQSKESYSDI

SEQ ID NO: 2643153 - protein, 6 aa, Entamoeba histolytica
NLKRKE

SEQ ID NO: 2643154 - protein, 6 aa, Entamoeba histolytica
NLKSKR

SEQ ID NO: 2643155 - protein, 9 aa, Entamoeba histolytica
NLKTEFSST

SEQ ID NO: 2643156 - protein, 5 aa, Entamoeba histolytica
NLMNE

SEQ ID NO: 2643157 - protein, 9 aa, Entamoeba histolytica
NLNDSHSEL

SEQ ID NO: 2643158 - protein, 9 aa, Entamoeba histolytica
NLNENEKSI

SEQ ID NO: 2643159 - protein, 12 aa, Entamoeba histolytica
NLNEQLGERDHT

SEQ ID NO: 2643160 - protein, 8 aa, Entamoeba histolytica
NLNGEIKT

SEQ ID NO: 2643161 - protein, 9 aa, Entamoeba histolytica
NLNGSEQGI

SEQ ID NO: 2643162 - protein, 9 aa, Entamoeba histolytica
NLNKEFEDS

SEQ ID NO: 2643163 - protein, 10 aa, Entamoeba histolytica
NLNLDNDQDL

SEQ ID NO: 2643164 - protein, 8 aa, Entamoeba histolytica
NLNNTYSQ

SEQ ID NO: 2643165 - protein, 13 aa, Entamoeba histolytica
NLNQKNEGDNGEV

SEQ ID NO: 2643166 - protein, 7 aa, Entamoeba histolytica
NLNSQNL

SEQ ID NO: 2643167 - protein, 7 aa, Entamoeba histolytica
NLPADEE

SEQ ID NO: 2643168 - protein, 6 aa, Entamoeba histolytica
NLPDQQ

SEQ ID NO: 2643169 - protein, 5 aa, Entamoeba histolytica
NLPEE

SEQ ID NO: 2643170 - protein, 5 aa, Entamoeba histolytica
NLPEN

SEQ ID NO: 2643171 - protein, 4 aa, Entamoeba histolytica
NLPF

SEQ ID NO: 2643172 - protein, 4 aa, Entamoeba histolytica
NLPG

SEQ ID NO: 2643173 - protein, 6 aa, Entamoeba histolytica
NLPGNS

SEQ ID NO: 2643174 - protein, 12 aa, Entamoeba histolytica
NLPKADPTGLSD

SEQ ID NO: 2643175 - protein, 9 aa, Entamoeba histolytica
NLPKEDGNF

SEQ ID NO: 2643176 - protein, 8 aa, Entamoeba histolytica
NLPKGEAD

SEQ ID NO: 2643177 - protein, 12 aa, Entamoeba histolytica
NLPLSAADSLRT

SEQ ID NO: 2643178 - protein, 6 aa, Entamoeba histolytica
NLPNPY

SEQ ID NO: 2643179 - protein, 8 aa, Entamoeba histolytica
NLPPNSRL

SEQ ID NO: 2643180 - protein, 6 aa, Entamoeba histolytica
NLPPQC

SEQ ID NO: 2643181 - protein, 15 aa, Entamoeba histolytica
NLPPQDPSVRPPQQY

SEQ ID NO: 2643182 - protein, 9 aa, Entamoeba histolytica
NLPPSVSKI

SEQ ID NO: 2643183 - protein, 4 aa, Entamoeba histolytica
NLPQ

SEQ ID NO: 2643184 - protein, 17 aa, Entamoeba histolytica
NLPQKGDGYDYAAWVKT

SEQ ID NO: 2643185 - protein, 10 aa, Entamoeba histolytica
NLPQKSIDEI

SEQ ID NO: 2643186 - protein, 11 aa, Entamoeba histolytica
NLPQPPKQRIE

SEQ ID NO: 2643187 - protein, 11 aa, Entamoeba histolytica
NLPRMEGGKDL

SEQ ID NO: 2643188 - protein, 5 aa, Entamoeba histolytica
NLPRT

SEQ ID NO: 2643189 - protein, 4 aa, Entamoeba histolytica
NLPS

SEQ ID NO: 2643190 - protein, 7 aa, Entamoeba histolytica
NLPSTFD

SEQ ID NO: 2643191 - protein, 21 aa, Entamoeba histolytica
NLPTGNIPRQNYSQSSNLSSN

SEQ ID NO: 2643192 - protein, 13 aa, Entamoeba histolytica
NLPTKTSKQPLLK

SEQ ID NO: 2643193 - protein, 16 aa, Entamoeba histolytica
NLPTPSLSESASETIA

SEQ ID NO: 2643194 - protein, 11 aa, Entamoeba histolytica
NLQDKTGETPL

SEQ ID NO: 2643195 - protein, 11 aa, Entamoeba histolytica
NLQEKKEENAR

SEQ ID NO: 2643196 - protein, 4 aa, Entamoeba histolytica
NLQG

SEQ ID NO: 2643197 - protein, 9 aa, Entamoeba histolytica
NLQGQQKEF

SEQ ID NO: 2643198 - protein, 10 aa, Entamoeba histolytica
NLQIKTGRAE

SEQ ID NO: 2643199 - protein, 4 aa, Entamoeba histolytica
NLQK

SEQ ID NO: 2643200 - protein, 6 aa, Entamoeba histolytica
NLQNKY

SEQ ID NO: 2643201 - protein, 23 aa, Entamoeba histolytica
NLQNPEKRFNSKKTISKEQLSDI

SEQ ID NO: 2643202 - protein, 14 aa, Entamoeba histolytica
NLQNQENSSNEEED

SEQ ID NO: 2643203 - protein, 10 aa, Entamoeba histolytica
NLQPGEYATN

SEQ ID NO: 2643204 - protein, 10 aa, Entamoeba histolytica
NLQPSTSNTR

SEQ ID NO: 2643205 - protein, 8 aa, Entamoeba histolytica
NLQTPRTG

SEQ ID NO: 2643206 - protein, 16 aa, Entamoeba histolytica
NLQTTKPIDYDNSSEL

SEQ ID NO: 2643207 - protein, 6 aa, Entamoeba histolytica
NLRAGD

SEQ ID NO: 2643208 - protein, 21 aa, Entamoeba histolytica
NLREAERNTRLVESKKKETEN

SEQ ID NO: 2643209 - protein, 11 aa, Entamoeba histolytica
NLRNEKSPFAK

SEQ ID NO: 2643210 - protein, 27 aa, Entamoeba histolytica
NLRNTAKSITTTEDKQSKEEKKEEDHI

SEQ ID NO: 2643211 - protein, 5 aa, Entamoeba histolytica
NLRPE

SEQ ID NO: 2643212 - protein, 5 aa, Entamoeba histolytica
NLRQN

SEQ ID NO: 2643213 - protein, 5 aa, Entamoeba histolytica
NLSDG

SEQ ID NO: 2643214 - protein, 22 aa, Entamoeba histolytica
NLSDKKPLSTLENGKKRRNSLS

SEQ ID NO: 2643215 - protein, 10 aa, Entamoeba histolytica
NLSEGTTKDV

SEQ ID NO: 2643216 - protein, 6 aa, Entamoeba histolytica
NLSEQD

SEQ ID NO: 2643217 - protein, 8 aa, Entamoeba histolytica
NLSGESDL

SEQ ID NO: 2643218 - protein, 10 aa, Entamoeba histolytica
NLSGGEKTLS

SEQ ID NO: 2643219 - protein, 13 aa, Entamoeba histolytica
NLSGTSPKPKSSR

SEQ ID NO: 2643220 - protein, 9 aa, Entamoeba histolytica
NLSKETQVS

SEQ ID NO: 2643221 - protein, 10 aa, Entamoeba histolytica
NLSNNGISQL

SEQ ID NO: 2643222 - protein, 10 aa, Entamoeba histolytica
NLSNPDASSD

SEQ ID NO: 2643223 - protein, 8 aa, Entamoeba histolytica
NLSPNEPV

SEQ ID NO: 2643224 - protein, 4 aa, Entamoeba histolytica
NLSQ

SEQ ID NO: 2643225 - protein, 5 aa, Entamoeba histolytica
NLSQK

SEQ ID NO: 2643226 - protein, 7 aa, Entamoeba histolytica
NLSTREE

SEQ ID NO: 2643227 - protein, 5 aa, Entamoeba histolytica
NLTEE

SEQ ID NO: 2643228 - protein, 8 aa, Entamoeba histolytica
NLTESELG

SEQ ID NO: 2643229 - protein, 4 aa, Entamoeba histolytica
NLTI

SEQ ID NO: 2643230 - protein, 15 aa, Entamoeba histolytica
NLTKARGAMTGARVD

SEQ ID NO: 2643231 - protein, 4 aa, Entamoeba histolytica
NLTN

SEQ ID NO: 2643232 - protein, 11 aa, Entamoeba histolytica
NLTNEMENSIQ

SEQ ID NO: 2643233 - protein, 10 aa, Entamoeba histolytica
NLTNKENELN

SEQ ID NO: 2643234 - protein, 12 aa, Entamoeba histolytica
NLTNNKSKTNCV

SEQ ID NO: 2643235 - protein, 10 aa, Entamoeba histolytica
NLTNQKSIDT

SEQ ID NO: 2643236 - protein, 27 aa, Entamoeba histolytica
NLTPEQKARAIHPTESYSKFNKKSVKK

SEQ ID NO: 2643237 - protein, 7 aa, Entamoeba histolytica
NLTPQQL

SEQ ID NO: 2643238 - protein, 16 aa, Entamoeba histolytica
NLTTKEAKEINKIKEK

SEQ ID NO: 2643239 - protein, 12 aa, Entamoeba histolytica
NLTTLSEKGAQQ

SEQ ID NO: 2643240 - protein, 5 aa, Entamoeba histolytica
NLTTN

SEQ ID NO: 2643241 - protein, 8 aa, Entamoeba histolytica
NLTTQTIE

SEQ ID NO: 2643242 - protein, 6 aa, Entamoeba histolytica
NLYPEE

SEQ ID NO: 2643243 - protein, 8 aa, Entamoeba histolytica
NLYSAKQH

SEQ ID NO: 2643244 - protein, 10 aa, Entamoeba histolytica
NMEKTGRMGS

SEQ ID NO: 2643245 - protein, 7 aa, Entamoeba histolytica
NMGFGDK

SEQ ID NO: 2643246 - protein, 4 aa, Entamoeba histolytica
NMGY

SEQ ID NO: 2643247 - protein, 39 aa, Entamoeba histolytica
NMKEQQANNEEKKEEPTAETEAPAATEAVEDNGYVPAEE

SEQ ID NO: 2643248 - protein, 36 aa, Entamoeba histolytica
NMKEQQNTTEEKKEEQVNESSAPATTEAVEDDGYVP

SEQ ID NO: 2643249 - protein, 8 aa, Entamoeba histolytica
NMKQEHAG

SEQ ID NO: 2643250 - protein, 10 aa, Entamoeba histolytica
NMKSETRSIP

SEQ ID NO: 2643251 - protein, 6 aa, Entamoeba histolytica
NMLGEN

SEQ ID NO: 2643252 - protein, 14 aa, Entamoeba histolytica
NMNDRSLRGDRDTE

SEQ ID NO: 2643253 - protein, 6 aa, Entamoeba histolytica
NMNEKC

SEQ ID NO: 2643254 - protein, 6 aa, Entamoeba histolytica
NMPEAS

SEQ ID NO: 2643255 - protein, 4 aa, Entamoeba histolytica
NMPN

SEQ ID NO: 2643256 - protein, 14 aa, Entamoeba histolytica
NMPPSGPQFAEASR

SEQ ID NO: 2643257 - protein, 21 aa, Entamoeba histolytica
NMPSMGSEPQEHPNVQEKSGM

SEQ ID NO: 2643258 - protein, 10 aa, Entamoeba histolytica
NMSDDDMTKY

SEQ ID NO: 2643259 - protein, 74 aa, Entamoeba histolytica
NMSDESGLEKSKNSNSELKISSDSETNRIPSNEVKSTSPTQKQVIEQNSRGSPLSKSPDTHSTNQSNNSLNSNH

SEQ ID NO: 2643260 - protein, 11 aa, Entamoeba histolytica
NMSQSTNDAFP

SEQ ID NO: 2643261 - protein, 4 aa, Entamoeba histolytica
NMST

SEQ ID NO: 2643262 - protein, 4 aa, Entamoeba histolytica
NMTN

SEQ ID NO: 2643263 - protein, 8 aa, Entamoeba histolytica
NNAEIKNS

SEQ ID NO: 2643264 - protein, 12 aa, Entamoeba histolytica
NNAERQRAQSDP

SEQ ID NO: 2643265 - protein, 8 aa, Entamoeba histolytica
NNAQTDHH

SEQ ID NO: 2643266 - protein, 13 aa, Entamoeba histolytica
NNCLSRKERREAF

SEQ ID NO: 2643267 - protein, 12 aa, Entamoeba histolytica
NNCSQPTGGSNL

SEQ ID NO: 2643268 - protein, 7 aa, Entamoeba histolytica
NNDDCSE

SEQ ID NO: 2643269 - protein, 8 aa, Entamoeba histolytica
NNDDLSQE

SEQ ID NO: 2643270 - protein, 27 aa, Entamoeba histolytica
NNDEDKKRNKEIKVQKEQPKKRKKSVK

SEQ ID NO: 2643271 - protein, 6 aa, Entamoeba histolytica
NNDEEV

SEQ ID NO: 2643272 - protein, 9 aa, Entamoeba histolytica
NNDENIKEI

SEQ ID NO: 2643273 - protein, 7 aa, Entamoeba histolytica
NNDESNS

SEQ ID NO: 2643274 - protein, 32 aa, Entamoeba histolytica
NNDESSKSRLRDVRKRNKLNEERRKDIEKITQ

SEQ ID NO: 2643275 - protein, 8 aa, Entamoeba histolytica
NNDEVKEI

SEQ ID NO: 2643276 - protein, 5 aa, Entamoeba histolytica
NNDFS

SEQ ID NO: 2643277 - protein, 13 aa, Entamoeba histolytica
NNDGLRTKETNFG

SEQ ID NO: 2643278 - protein, 5 aa, Entamoeba histolytica
NNDGS

SEQ ID NO: 2643279 - protein, 9 aa, Entamoeba histolytica
NNDGTYTGS

SEQ ID NO: 2643280 - protein, 9 aa, Entamoeba histolytica
NNDHEEEKD

SEQ ID NO: 2643281 - protein, 6 aa, Entamoeba histolytica
NNDIRD

SEQ ID NO: 2643282 - protein, 8 aa, Entamoeba histolytica
NNDKADQL

SEQ ID NO: 2643283 - protein, 7 aa, Entamoeba histolytica
NNDKTID

SEQ ID NO: 2643284 - protein, 5 aa, Entamoeba histolytica
NNDLK

SEQ ID NO: 2643285 - protein, 5 aa, Entamoeba histolytica
NNDLQ

SEQ ID NO: 2643286 - protein, 8 aa, Entamoeba histolytica
NNDNDGLK

SEQ ID NO: 2643287 - protein, 7 aa, Entamoeba histolytica
NNDNKIT

SEQ ID NO: 2643288 - protein, 9 aa, Entamoeba histolytica
NNDNPNKDL

SEQ ID NO: 2643289 - protein, 4 aa, Entamoeba histolytica
NNDP

SEQ ID NO: 2643290 - protein, 6 aa, Entamoeba histolytica
NNDPED

SEQ ID NO: 2643291 - protein, 9 aa, Entamoeba histolytica
NNDPNVESK

SEQ ID NO: 2643292 - protein, 9 aa, Entamoeba histolytica
NNDPPITEV

SEQ ID NO: 2643293 - protein, 7 aa, Entamoeba histolytica
NNDPQIA

SEQ ID NO: 2643294 - protein, 20 aa, Entamoeba histolytica
NNDPQKKHGRKEKKEDEFTV

SEQ ID NO: 2643295 - protein, 6 aa, Entamoeba histolytica
NNDPSL

SEQ ID NO: 2643296 - protein, 7 aa, Entamoeba histolytica
NNDRPTL

SEQ ID NO: 2643297 - protein, 5 aa, Entamoeba histolytica
NNDSM

SEQ ID NO: 2643298 - protein, 7 aa, Entamoeba histolytica
NNDSRDK

SEQ ID NO: 2643299 - protein, 7 aa, Entamoeba histolytica
NNDSSIE

SEQ ID NO: 2643300 - protein, 10 aa, Entamoeba histolytica
NNDTNVNGRQ

SEQ ID NO: 2643301 - protein, 5 aa, Entamoeba histolytica
NNDYQ

SEQ ID NO: 2643302 - protein, 11 aa, Entamoeba histolytica
NNEASKKVEKI

SEQ ID NO: 2643303 - protein, 9 aa, Entamoeba histolytica
NNEDEMSAT

SEQ ID NO: 2643304 - protein, 7 aa, Entamoeba histolytica
NNEDIRI

SEQ ID NO: 2643305 - protein, 14 aa, Entamoeba histolytica
NNEDKNGLISKTTV

SEQ ID NO: 2643306 - protein, 5 aa, Entamoeba histolytica
NNEDN

SEQ ID NO: 2643307 - protein, 5 aa, Entamoeba histolytica
NNEDP

SEQ ID NO: 2643308 - protein, 8 aa, Entamoeba histolytica
NNEEEESF

SEQ ID NO: 2643309 - protein, 20 aa, Entamoeba histolytica
NNEEENQVKVEEQNNGNISS

SEQ ID NO: 2643310 - protein, 10 aa, Entamoeba histolytica
NNEENNSIER

SEQ ID NO: 2643311 - protein, 20 aa, Entamoeba histolytica
NNEEQNQVKVEEQNNGNISS

SEQ ID NO: 2643312 - protein, 9 aa, Entamoeba histolytica
NNEERQQKW

SEQ ID NO: 2643313 - protein, 8 aa, Entamoeba histolytica
NNEESNDV

SEQ ID NO: 2643314 - protein, 15 aa, Entamoeba histolytica
NNEEVNESYGLKETK

SEQ ID NO: 2643315 - protein, 8 aa, Entamoeba histolytica
NNEEYLNG

SEQ ID NO: 2643316 - protein, 6 aa, Entamoeba histolytica
NNEGNS

SEQ ID NO: 2643317 - protein, 9 aa, Entamoeba histolytica
NNEGNTLTL

SEQ ID NO: 2643318 - protein, 8 aa, Entamoeba histolytica
NNEGYNED

SEQ ID NO: 2643319 - protein, 11 aa, Entamoeba histolytica
NNEIDQGIKDE

SEQ ID NO: 2643320 - protein, 10 aa, Entamoeba histolytica
NNEIQAKNRP

SEQ ID NO: 2643321 - protein, 7 aa, Entamoeba histolytica
NNEIQTP

SEQ ID NO: 2643322 - protein, 7 aa, Entamoeba histolytica
NNEITSD

SEQ ID NO: 2643323 - protein, 13 aa, Entamoeba histolytica
NNEKANKESYTED

SEQ ID NO: 2643324 - protein, 9 aa, Entamoeba histolytica
NNEKSKKLR

SEQ ID NO: 2643325 - protein, 5 aa, Entamoeba histolytica
NNEKY

SEQ ID NO: 2643326 - protein, 11 aa, Entamoeba histolytica
NNELPKEKKNF

SEQ ID NO: 2643327 - protein, 7 aa, Entamoeba histolytica
NNENDPN

SEQ ID NO: 2643328 - protein, 6 aa, Entamoeba histolytica
NNENMD

SEQ ID NO: 2643329 - protein, 6 aa, Entamoeba histolytica
NNENST

SEQ ID NO: 2643330 - protein, 4 aa, Entamoeba histolytica
NNEQ

SEQ ID NO: 2643331 - protein, 7 aa, Entamoeba histolytica
NNEQARM

SEQ ID NO: 2643332 - protein, 8 aa, Entamoeba histolytica
NNEQEGKE

SEQ ID NO: 2643333 - protein, 6 aa, Entamoeba histolytica
NNEQEI

SEQ ID NO: 2643334 - protein, 24 aa, Entamoeba histolytica
NNEQKQKESIKKSFTQERKNRINK

SEQ ID NO: 2643335 - protein, 8 aa, Entamoeba histolytica
NNERDKAF

SEQ ID NO: 2643336 - protein, 5 aa, Entamoeba histolytica
NNERI

SEQ ID NO: 2643337 - protein, 5 aa, Entamoeba histolytica
NNERN

SEQ ID NO: 2643338 - protein, 7 aa, Entamoeba histolytica
NNERSGI

SEQ ID NO: 2643339 - protein, 6 aa, Entamoeba histolytica
NNESFK

SEQ ID NO: 2643340 - protein, 6 aa, Entamoeba histolytica
NNESFR

SEQ ID NO: 2643341 - protein, 6 aa, Entamoeba histolytica
NNESKK

SEQ ID NO: 2643342 - protein, 8 aa, Entamoeba histolytica
NNESNNMV

SEQ ID NO: 2643343 - protein, 13 aa, Entamoeba histolytica
NNESVQPKITARP

SEQ ID NO: 2643344 - protein, 19 aa, Entamoeba histolytica
NNETCEAPKTLTPPTETEK

SEQ ID NO: 2643345 - protein, 10 aa, Entamoeba histolytica
NNETINKREE

SEQ ID NO: 2643346 - protein, 11 aa, Entamoeba histolytica
NNETMEKTANA

SEQ ID NO: 2643347 - protein, 9 aa, Entamoeba histolytica
NNETNNSFG

SEQ ID NO: 2643348 - protein, 8 aa, Entamoeba histolytica
NNETNSLQ

SEQ ID NO: 2643349 - protein, 9 aa, Entamoeba histolytica
NNETTQVTS

SEQ ID NO: 2643350 - protein, 9 aa, Entamoeba histolytica
NNETVNSGA

SEQ ID NO: 2643351 - protein, 4 aa, Entamoeba histolytica
NNEV

SEQ ID NO: 2643352 - protein, 6 aa, Entamoeba histolytica
NNEVNK

SEQ ID NO: 2643353 - protein, 5 aa, Entamoeba histolytica
NNEYP

SEQ ID NO: 2643354 - protein, 4 aa, Entamoeba histolytica
NNFD

SEQ ID NO: 2643355 - protein, 8 aa, Entamoeba histolytica
NNFEGAGA

SEQ ID NO: 2643356 - protein, 5 aa, Entamoeba histolytica
NNFEK

SEQ ID NO: 2643357 - protein, 11 aa, Entamoeba histolytica
NNFKPPPKVES

SEQ ID NO: 2643358 - protein, 4 aa, Entamoeba histolytica
NNFS

SEQ ID NO: 2643359 - protein, 9 aa, Entamoeba histolytica
NNFTSSHPF

SEQ ID NO: 2643360 - protein, 9 aa, Entamoeba histolytica
NNFTSTTTT

SEQ ID NO: 2643361 - protein, 5 aa, Entamoeba histolytica
NNGAA

SEQ ID NO: 2643362 - protein, 5 aa, Entamoeba histolytica
NNGCK

SEQ ID NO: 2643363 - protein, 4 aa, Entamoeba histolytica
NNGD

SEQ ID NO: 2643364 - protein, 8 aa, Entamoeba histolytica
NNGDEKEL

SEQ ID NO: 2643365 - protein, 4 aa, Entamoeba histolytica
NNGE

SEQ ID NO: 2643366 - protein, 21 aa, Entamoeba histolytica
NNGEDSRESLSRSVSRSSSNI

SEQ ID NO: 2643367 - protein, 6 aa, Entamoeba histolytica
NNGEHS

SEQ ID NO: 2643368 - protein, 5 aa, Entamoeba histolytica
NNGEI

SEQ ID NO: 2643369 - protein, 8 aa, Entamoeba histolytica
NNGEPMDD

SEQ ID NO: 2643370 - protein, 7 aa, Entamoeba histolytica
NNGEVDK

SEQ ID NO: 2643371 - protein, 6 aa, Entamoeba histolytica
NNGFGH

SEQ ID NO: 2643372 - protein, 13 aa, Entamoeba histolytica
NNGFGKFGKGTFY

SEQ ID NO: 2643373 - protein, 18 aa, Entamoeba histolytica
NNGFGTNTTTGLGSTNSL

SEQ ID NO: 2643374 - protein, 7 aa, Entamoeba histolytica
NNGFGVD

SEQ ID NO: 2643375 - protein, 5 aa, Entamoeba histolytica
NNGGE

SEQ ID NO: 2643376 - protein, 8 aa, Entamoeba histolytica
NNGGSDID

SEQ ID NO: 2643377 - protein, 5 aa, Entamoeba histolytica
NNGIN

SEQ ID NO: 2643378 - protein, 11 aa, Entamoeba histolytica
NNGINENQRKT

SEQ ID NO: 2643379 - protein, 7 aa, Entamoeba histolytica
NNGKGIP

SEQ ID NO: 2643380 - protein, 14 aa, Entamoeba histolytica
NNGKKVNGGDRLSQ

SEQ ID NO: 2643381 - protein, 8 aa, Entamoeba histolytica
NNGKPVKS

SEQ ID NO: 2643382 - protein, 4 aa, Entamoeba histolytica
NNGL

SEQ ID NO: 2643383 - protein, 8 aa, Entamoeba histolytica
NNGMTPYD

SEQ ID NO: 2643384 - protein, 9 aa, Entamoeba histolytica
NNGNRSAAI

SEQ ID NO: 2643385 - protein, 14 aa, Entamoeba histolytica
NNGNSSTKQPTTWS

SEQ ID NO: 2643386 - protein, 7 aa, Entamoeba histolytica
NNGNTSQ

SEQ ID NO: 2643387 - protein, 7 aa, Entamoeba histolytica
NNGRSEQ

SEQ ID NO: 2643388 - protein, 8 aa, Entamoeba histolytica
NNGSIKGN

SEQ ID NO: 2643389 - protein, 6 aa, Entamoeba histolytica
NNGTFT

SEQ ID NO: 2643390 - protein, 7 aa, Entamoeba histolytica
NNGTIPS

SEQ ID NO: 2643391 - protein, 13 aa, Entamoeba histolytica
NNGTNKENKFKVD

SEQ ID NO: 2643392 - protein, 8 aa, Entamoeba histolytica
NNGTSGDV

SEQ ID NO: 2643393 - protein, 4 aa, Entamoeba histolytica
NNHD

SEQ ID NO: 2643394 - protein, 8 aa, Entamoeba histolytica
NNHIKGQE

SEQ ID NO: 2643395 - protein, 15 aa, Entamoeba histolytica
NNHKGYEQSRRDDLE

SEQ ID NO: 2643396 - protein, 6 aa, Entamoeba histolytica
NNHKTK

SEQ ID NO: 2643397 - protein, 5 aa, Entamoeba histolytica
NNHQN

SEQ ID NO: 2643398 - protein, 17 aa, Entamoeba histolytica
NNHQPEPQIARKKETGY

SEQ ID NO: 2643399 - protein, 14 aa, Entamoeba histolytica
NNHRGREQSRRDDL

SEQ ID NO: 2643400 - protein, 5 aa, Entamoeba histolytica
NNHSI

SEQ ID NO: 2643401 - protein, 4 aa, Entamoeba histolytica
NNIE

SEQ ID NO: 2643402 - protein, 24 aa, Entamoeba histolytica
NNIENKQNLSDSTQSERKSIDNDC

SEQ ID NO: 2643403 - protein, 5 aa, Entamoeba histolytica
NNIES

SEQ ID NO: 2643404 - protein, 4 aa, Entamoeba histolytica
NNIL

SEQ ID NO: 2643405 - protein, 7 aa, Entamoeba histolytica
NNINPTR

SEQ ID NO: 2643406 - protein, 13 aa, Entamoeba histolytica
NNINREENGSSQD

SEQ ID NO: 2643407 - protein, 13 aa, Entamoeba histolytica
NNINRQPEQTQRV

SEQ ID NO: 2643408 - protein, 4 aa, Entamoeba histolytica
NNIP

SEQ ID NO: 2643409 - protein, 12 aa, Entamoeba histolytica
NNIPDKNEKEKI

SEQ ID NO: 2643410 - protein, 20 aa, Entamoeba histolytica
NNIPGGGKRPRIDPKTEKEN

SEQ ID NO: 2643411 - protein, 9 aa, Entamoeba histolytica
NNIPSSSKI

SEQ ID NO: 2643412 - protein, 4 aa, Entamoeba histolytica
NNIQ

SEQ ID NO: 2643413 - protein, 17 aa, Entamoeba histolytica
NNIQQNPSSIKEELQNE

SEQ ID NO: 2643414 - protein, 4 aa, Entamoeba histolytica
NNIR

SEQ ID NO: 2643415 - protein, 12 aa, Entamoeba histolytica
NNISNEQNEKAP

SEQ ID NO: 2643416 - protein, 6 aa, Entamoeba histolytica
NNISNP

SEQ ID NO: 2643417 - protein, 41 aa, Entamoeba histolytica
NNISRTASPGLNKNSSCLSQQPKVISSTPIPPTTKETQPNV

SEQ ID NO: 2643418 - protein, 6 aa, Entamoeba histolytica
NNITQT

SEQ ID NO: 2643419 - protein, 22 aa, Entamoeba histolytica
NNKAILPPKESDVELTQKAREL

SEQ ID NO: 2643420 - protein, 15 aa, Entamoeba histolytica
NNKCQENSRCTKINN

SEQ ID NO: 2643421 - protein, 13 aa, Entamoeba histolytica
NNKCVKDKEECYY

SEQ ID NO: 2643422 - protein, 7 aa, Entamoeba histolytica
NNKDDTI

SEQ ID NO: 2643423 - protein, 7 aa, Entamoeba histolytica
NNKDLSK

SEQ ID NO: 2643424 - protein, 8 aa, Entamoeba histolytica
NNKDSSEY

SEQ ID NO: 2643425 - protein, 10 aa, Entamoeba histolytica
NNKEGQLNEM

SEQ ID NO: 2643426 - protein, 8 aa, Entamoeba histolytica
NNKEGSHV

SEQ ID NO: 2643427 - protein, 8 aa, Entamoeba histolytica
NNKEKKDV

SEQ ID NO: 2643428 - protein, 6 aa, Entamoeba histolytica
NNKETM

SEQ ID NO: 2643429 - protein, 4 aa, Entamoeba histolytica
NNKF

SEQ ID NO: 2643430 - protein, 15 aa, Entamoeba histolytica
NNKFKNQENTQRTNA

SEQ ID NO: 2643431 - protein, 4 aa, Entamoeba histolytica
NNKG

SEQ ID NO: 2643432 - protein, 49 aa, Entamoeba histolytica
NNKGKKEKGKRKNEKIKDETNEKEAIEEPTPNEEKEPCTDTKPNEDNQI

SEQ ID NO: 2643433 - protein, 8 aa, Entamoeba histolytica
NNKHPTGG

SEQ ID NO: 2643434 - protein, 6 aa, Entamoeba histolytica
NNKIEK

SEQ ID NO: 2643435 - protein, 15 aa, Entamoeba histolytica
NNKIEQENNNVEDTT

SEQ ID NO: 2643436 - protein, 14 aa, Entamoeba histolytica
NNKIEQQNKNYEDL

SEQ ID NO: 2643437 - protein, 5 aa, Entamoeba histolytica
NNKIS

SEQ ID NO: 2643438 - protein, 10 aa, Entamoeba histolytica
NNKKDGDPVC

SEQ ID NO: 2643439 - protein, 6 aa, Entamoeba histolytica
NNKKGV

SEQ ID NO: 2643440 - protein, 5 aa, Entamoeba histolytica
NNKLF

SEQ ID NO: 2643441 - protein, 12 aa, Entamoeba histolytica
NNKLNKTTSDMI

SEQ ID NO: 2643442 - protein, 10 aa, Entamoeba histolytica
NNKNDSISSQ

SEQ ID NO: 2643443 - protein, 6 aa, Entamoeba histolytica
NNKNKY

SEQ ID NO: 2643444 - protein, 9 aa, Entamoeba histolytica
NNKNQGNIE

SEQ ID NO: 2643445 - protein, 7 aa, Entamoeba histolytica
NNKNTEN

SEQ ID NO: 2643446 - protein, 15 aa, Entamoeba histolytica
NNKPFTTDRIIILQL

SEQ ID NO: 2643447 - protein, 7 aa, Entamoeba histolytica
NNKPIKH

SEQ ID NO: 2643448 - protein, 6 aa, Entamoeba histolytica
NNKQFE

SEQ ID NO: 2643449 - protein, 6 aa, Entamoeba histolytica
NNKQGM

SEQ ID NO: 2643450 - protein, 7 aa, Entamoeba histolytica
NNKRNDI

SEQ ID NO: 2643451 - protein, 6 aa, Entamoeba histolytica
NNKSEC

SEQ ID NO: 2643452 - protein, 6 aa, Entamoeba histolytica
NNKSLQ

SEQ ID NO: 2643453 - protein, 10 aa, Entamoeba histolytica
NNKSQESNYL

SEQ ID NO: 2643454 - protein, 8 aa, Entamoeba histolytica
NNKSTQLK

SEQ ID NO: 2643455 - protein, 8 aa, Entamoeba histolytica
NNKTGGLR

SEQ ID NO: 2643456 - protein, 5 aa, Entamoeba histolytica
NNKTL

SEQ ID NO: 2643457 - protein, 8 aa, Entamoeba histolytica
NNKTQNIL

SEQ ID NO: 2643458 - protein, 7 aa, Entamoeba histolytica
NNKTTIE

SEQ ID NO: 2643459 - protein, 10 aa, Entamoeba histolytica
NNKVSKNGSY

SEQ ID NO: 2643460 - protein, 4 aa, Entamoeba histolytica
NNKY

SEQ ID NO: 2643461 - protein, 18 aa, Entamoeba histolytica
NNKYPDEEKKPKKAETKD

SEQ ID NO: 2643462 - protein, 7 aa, Entamoeba histolytica
NNLAEEA

SEQ ID NO: 2643463 - protein, 4 aa, Entamoeba histolytica
NNLD

SEQ ID NO: 2643464 - protein, 7 aa, Entamoeba histolytica
NNLEEKE

SEQ ID NO: 2643465 - protein, 41 aa, Entamoeba histolytica
NNLEKKIEETKESITKKSLEEIKKDNKDPLSGEISSEASTM

SEQ ID NO: 2643466 - protein, 6 aa, Entamoeba histolytica
NNLGDA

SEQ ID NO: 2643467 - protein, 6 aa, Entamoeba histolytica
NNLGNN

SEQ ID NO: 2643468 - protein, 13 aa, Entamoeba histolytica
NNLKSKERELTKR

SEQ ID NO: 2643469 - protein, 10 aa, Entamoeba histolytica
NNLKSLPPEI

SEQ ID NO: 2643470 - protein, 16 aa, Entamoeba histolytica
NNLPNSKLYNSYDTSK

SEQ ID NO: 2643471 - protein, 5 aa, Entamoeba histolytica
NNLQQ

SEQ ID NO: 2643472 - protein, 6 aa, Entamoeba histolytica
NNLQTE

SEQ ID NO: 2643473 - protein, 6 aa, Entamoeba histolytica
NNLRTD

SEQ ID NO: 2643474 - protein, 10 aa, Entamoeba histolytica
NNLSSIPKSI

SEQ ID NO: 2643475 - protein, 8 aa, Entamoeba histolytica
NNLSTLPK

SEQ ID NO: 2643476 - protein, 8 aa, Entamoeba histolytica
NNLTNNTL

SEQ ID NO: 2643477 - protein, 6 aa, Entamoeba histolytica
NNMENE

SEQ ID NO: 2643478 - protein, 7 aa, Entamoeba histolytica
NNMKGGM

SEQ ID NO: 2643479 - protein, 4 aa, Entamoeba histolytica
NNMN

SEQ ID NO: 2643480 - protein, 8 aa, Entamoeba histolytica
NNMTDGAT

SEQ ID NO: 2643481 - protein, 4 aa, Entamoeba histolytica
NNNA

SEQ ID NO: 2643482 - protein, 11 aa, Entamoeba histolytica
NNNDEKNAQCS

SEQ ID NO: 2643483 - protein, 6 aa, Entamoeba histolytica
NNNDFS

SEQ ID NO: 2643484 - protein, 9 aa, Entamoeba histolytica
NNNDGDNNL

SEQ ID NO: 2643485 - protein, 13 aa, Entamoeba histolytica
NNNDGNLEKNQST

SEQ ID NO: 2643486 - protein, 7 aa, Entamoeba histolytica
NNNDNIK

SEQ ID NO: 2643487 - protein, 10 aa, Entamoeba histolytica
NNNDSPSTVT

SEQ ID NO: 2643488 - protein, 4 aa, Entamoeba histolytica
NNNE

SEQ ID NO: 2643489 - protein, 20 aa, Entamoeba histolytica
NNNEEYDKNGEIDEEIDEDE

SEQ ID NO: 2643490 - protein, 26 aa, Entamoeba histolytica
NNNEEYDKNGEIDEEIDEDEKIAGIG

SEQ ID NO: 2643491 - protein, 24 aa, Entamoeba histolytica
NNNEEYDKNGEIDEEIDEDEVDDY

SEQ ID NO: 2643492 - protein, 5 aa, Entamoeba histolytica
NNNEI

SEQ ID NO: 2643493 - protein, 7 aa, Entamoeba histolytica
NNNEKKK

SEQ ID NO: 2643494 - protein, 8 aa, Entamoeba histolytica
NNNESTYN

SEQ ID NO: 2643495 - protein, 6 aa, Entamoeba histolytica
NNNGHY

SEQ ID NO: 2643496 - protein, 4 aa, Entamoeba histolytica
NNNI

SEQ ID NO: 2643497 - protein, 9 aa, Entamoeba histolytica
NNNIQTNNK

SEQ ID NO: 2643498 - protein, 16 aa, Entamoeba histolytica
NNNKLEQENDNVEDTT

SEQ ID NO: 2643499 - protein, 9 aa, Entamoeba histolytica
NNNKPSQMV

SEQ ID NO: 2643500 - protein, 8 aa, Entamoeba histolytica
NNNKQNQT

SEQ ID NO: 2643501 - protein, 4 aa, Entamoeba histolytica
NNNL

SEQ ID NO: 2643502 - protein, 16 aa, Entamoeba histolytica
NNNLNEQNESNQNNIP

SEQ ID NO: 2643503 - protein, 5 aa, Entamoeba histolytica
NNNLT

SEQ ID NO: 2643504 - protein, 12 aa, Entamoeba histolytica
NNNNAQAQTGDN

SEQ ID NO: 2643505 - protein, 9 aa, Entamoeba histolytica
NNNNEIKNM

SEQ ID NO: 2643506 - protein, 7 aa, Entamoeba histolytica
NNNNEKV

SEQ ID NO: 2643507 - protein, 5 aa, Entamoeba histolytica
NNNNI

SEQ ID NO: 2643508 - protein, 7 aa, Entamoeba histolytica
NNNNKSC

SEQ ID NO: 2643509 - protein, 6 aa, Entamoeba histolytica
NNNNLQ

SEQ ID NO: 2643510 - protein, 11 aa, Entamoeba histolytica
NNNNNNGSLDD

SEQ ID NO: 2643511 - protein, 11 aa, Entamoeba histolytica
NNNNNNNTTNK

SEQ ID NO: 2643512 - protein, 17 aa, Entamoeba histolytica
NNNNYNNNNNASKTIIF

SEQ ID NO: 2643513 - protein, 9 aa, Entamoeba histolytica
NNNPPSASR

SEQ ID NO: 2643514 - protein, 8 aa, Entamoeba histolytica
NNNPTIRK

SEQ ID NO: 2643515 - protein, 5 aa, Entamoeba histolytica
NNNPY

SEQ ID NO: 2643516 - protein, 5 aa, Entamoeba histolytica
NNNQF

SEQ ID NO: 2643517 - protein, 12 aa, Entamoeba histolytica
NNNQIKELPKQV

SEQ ID NO: 2643518 - protein, 8 aa, Entamoeba histolytica
NNNQNEYN

SEQ ID NO: 2643519 - protein, 12 aa, Entamoeba histolytica
NNNSASTTKNER

SEQ ID NO: 2643520 - protein, 14 aa, Entamoeba histolytica
NNNSINNKVSSGTI

SEQ ID NO: 2643521 - protein, 5 aa, Entamoeba histolytica
NNNSS

SEQ ID NO: 2643522 - protein, 10 aa, Entamoeba histolytica
NNNSSTLPPG

SEQ ID NO: 2643523 - protein, 7 aa, Entamoeba histolytica
NNNSVGG

SEQ ID NO: 2643524 - protein, 6 aa, Entamoeba histolytica
NNNTIT

SEQ ID NO: 2643525 - protein, 5 aa, Entamoeba histolytica
NNNTL

SEQ ID NO: 2643526 - protein, 7 aa, Entamoeba histolytica
NNNTPHE

SEQ ID NO: 2643527 - protein, 35 aa, Entamoeba histolytica
NNNTSTTTNNTSTINTSVKQTKPRKISDEINKKYS

SEQ ID NO: 2643528 - protein, 34 aa, Entamoeba histolytica
NNNTSTTTNTSTINTSVKQTKPRKISDEINKKYS

SEQ ID NO: 2643529 - protein, 20 aa, Entamoeba histolytica
NNNVLSSQEIKSKGKKNEIP

SEQ ID NO: 2643530 - protein, 4 aa, Entamoeba histolytica
NNNW

SEQ ID NO: 2643531 - protein, 4 aa, Entamoeba histolytica
NNNY

SEQ ID NO: 2643532 - protein, 7 aa, Entamoeba histolytica
NNNYQQT

SEQ ID NO: 2643533 - protein, 9 aa, Entamoeba histolytica
NNPDIEPSQ

SEQ ID NO: 2643534 - protein, 5 aa, Entamoeba histolytica
NNPDS

SEQ ID NO: 2643535 - protein, 5 aa, Entamoeba histolytica
NNPDV

SEQ ID NO: 2643536 - protein, 4 aa, Entamoeba histolytica
NNPE

SEQ ID NO: 2643537 - protein, 11 aa, Entamoeba histolytica
NNPEANKQAFT

SEQ ID NO: 2643538 - protein, 12 aa, Entamoeba histolytica
NNPEANKQAFTK

SEQ ID NO: 2643539 - protein, 5 aa, Entamoeba histolytica
NNPEG

SEQ ID NO: 2643540 - protein, 6 aa, Entamoeba histolytica
NNPETQ

SEQ ID NO: 2643541 - protein, 10 aa, Entamoeba histolytica
NNPFEEDKNE

SEQ ID NO: 2643542 - protein, 8 aa, Entamoeba histolytica
NNPGPTAL

SEQ ID NO: 2643543 - protein, 4 aa, Entamoeba histolytica
NNPI

SEQ ID NO: 2643544 - protein, 7 aa, Entamoeba histolytica
NNPIGQR

SEQ ID NO: 2643545 - protein, 5 aa, Entamoeba histolytica
NNPIK

SEQ ID NO: 2643546 - protein, 12 aa, Entamoeba histolytica
NNPIKGRNIEEE

SEQ ID NO: 2643547 - protein, 8 aa, Entamoeba histolytica
NNPIKKEI

SEQ ID NO: 2643548 - protein, 5 aa, Entamoeba histolytica
NNPIT

SEQ ID NO: 2643549 - protein, 25 aa, Entamoeba histolytica
NNPITRGYQPNPYEQQNPSSYPSVY

SEQ ID NO: 2643550 - protein, 4 aa, Entamoeba histolytica
NNPK

SEQ ID NO: 2643551 - protein, 5 aa, Entamoeba histolytica
NNPKR

SEQ ID NO: 2643552 - protein, 9 aa, Entamoeba histolytica
NNPLGTSGK

SEQ ID NO: 2643553 - protein, 7 aa, Entamoeba histolytica
NNPLPKD

SEQ ID NO: 2643554 - protein, 8 aa, Entamoeba histolytica
NNPMSGKE

SEQ ID NO: 2643555 - protein, 4 aa, Entamoeba histolytica
NNPN

SEQ ID NO: 2643556 - protein, 9 aa, Entamoeba histolytica
NNPNASESD

SEQ ID NO: 2643557 - protein, 8 aa, Entamoeba histolytica
NNPNLNQN

SEQ ID NO: 2643558 - protein, 9 aa, Entamoeba histolytica
NNPPEGMTQ

SEQ ID NO: 2643559 - protein, 5 aa, Entamoeba histolytica
NNPPL

SEQ ID NO: 2643560 - protein, 8 aa, Entamoeba histolytica
NNPPPQYI

SEQ ID NO: 2643561 - protein, 7 aa, Entamoeba histolytica
NNPPVPD

SEQ ID NO: 2643562 - protein, 6 aa, Entamoeba histolytica
NNPQDL

SEQ ID NO: 2643563 - protein, 8 aa, Entamoeba histolytica
NNPQGEDI

SEQ ID NO: 2643564 - protein, 5 aa, Entamoeba histolytica
NNPQM

SEQ ID NO: 2643565 - protein, 5 aa, Entamoeba histolytica
NNPQV

SEQ ID NO: 2643566 - protein, 45 aa, Entamoeba histolytica
NNPQYKQSLKKGFNNKKSSEKTKKTSLSITSSQSNKKEKQGCCTL

SEQ ID NO: 2643567 - protein, 9 aa, Entamoeba histolytica
NNPRLDEER

SEQ ID NO: 2643568 - protein, 6 aa, Entamoeba histolytica
NNPTAV

SEQ ID NO: 2643569 - protein, 7 aa, Entamoeba histolytica
NNPTDCS

SEQ ID NO: 2643570 - protein, 8 aa, Entamoeba histolytica
NNPTDIEG

SEQ ID NO: 2643571 - protein, 7 aa, Entamoeba histolytica
NNPTEDC

SEQ ID NO: 2643572 - protein, 8 aa, Entamoeba histolytica
NNPTEEKI

SEQ ID NO: 2643573 - protein, 21 aa, Entamoeba histolytica
NNPTGAQDKPKKAVVIADCGQ

SEQ ID NO: 2643574 - protein, 6 aa, Entamoeba histolytica
NNPTIT

SEQ ID NO: 2643575 - protein, 8 aa, Entamoeba histolytica
NNPVKGKH

SEQ ID NO: 2643576 - protein, 8 aa, Entamoeba histolytica
NNPVSGYN

SEQ ID NO: 2643577 - protein, 5 aa, Entamoeba histolytica
NNPYK

SEQ ID NO: 2643578 - protein, 9 aa, Entamoeba histolytica
NNQDFEGAE

SEQ ID NO: 2643579 - protein, 7 aa, Entamoeba histolytica
NNQESIK

SEQ ID NO: 2643580 - protein, 11 aa, Entamoeba histolytica
NNQETNSWRKT

SEQ ID NO: 2643581 - protein, 9 aa, Entamoeba histolytica
NNQETQREE

SEQ ID NO: 2643582 - protein, 6 aa, Entamoeba histolytica
NNQIEG

SEQ ID NO: 2643583 - protein, 6 aa, Entamoeba histolytica
NNQINS

SEQ ID NO: 2643584 - protein, 11 aa, Entamoeba histolytica
NNQINSSKQKS

SEQ ID NO: 2643585 - protein, 7 aa, Entamoeba histolytica
NNQINTS

SEQ ID NO: 2643586 - protein, 11 aa, Entamoeba histolytica
NNQITQKKPHL

SEQ ID NO: 2643587 - protein, 6 aa, Entamoeba histolytica
NNQKYD

SEQ ID NO: 2643588 - protein, 13 aa, Entamoeba histolytica
NNQLDTSKNKESL

SEQ ID NO: 2643589 - protein, 6 aa, Entamoeba histolytica
NNQLGT

SEQ ID NO: 2643590 - protein, 26 aa, Entamoeba histolytica
NNQLNSQIKTNQQQRKSIPSIDSSTT

SEQ ID NO: 2643591 - protein, 14 aa, Entamoeba histolytica
NNQLQQETKSEEQM

SEQ ID NO: 2643592 - protein, 13 aa, Entamoeba histolytica
NNQMKEIPSSPSD

SEQ ID NO: 2643593 - protein, 20 aa, Entamoeba histolytica
NNQNASTEEYDNKMKEVEGK

SEQ ID NO: 2643594 - protein, 8 aa, Entamoeba histolytica
NNQNEKST

SEQ ID NO: 2643595 - protein, 67 aa, Entamoeba histolytica
NNQNPQNEYEQSHQLTNKYKAEHNRYKQETPKPISYGGNTTKKPNTLSSTSKPKIVPVQGTKPYHKR

SEQ ID NO: 2643596 - protein, 27 aa, Entamoeba histolytica
NNQNRNSTSELAVSDSPSPRISKTPDL

SEQ ID NO: 2643597 - protein, 6 aa, Entamoeba histolytica
NNQNVI

SEQ ID NO: 2643598 - protein, 10 aa, Entamoeba histolytica
NNQPKTISTG

SEQ ID NO: 2643599 - protein, 6 aa, Entamoeba histolytica
NNQPSA

SEQ ID NO: 2643600 - protein, 10 aa, Entamoeba histolytica
NNQPTNPQPN

SEQ ID NO: 2643601 - protein, 7 aa, Entamoeba histolytica
NNQQQSF

SEQ ID NO: 2643602 - protein, 5 aa, Entamoeba histolytica
NNQQS

SEQ ID NO: 2643603 - protein, 12 aa, Entamoeba histolytica
NNQQTKAIPNEP

SEQ ID NO: 2643604 - protein, 7 aa, Entamoeba histolytica
NNQQTSY

SEQ ID NO: 2643605 - protein, 6 aa, Entamoeba histolytica
NNQRQA

SEQ ID NO: 2643606 - protein, 16 aa, Entamoeba histolytica
NNQRSEEEAYENNECS

SEQ ID NO: 2643607 - protein, 4 aa, Entamoeba histolytica
NNQS

SEQ ID NO: 2643608 - protein, 9 aa, Entamoeba histolytica
NNQSRIREE

SEQ ID NO: 2643609 - protein, 9 aa, Entamoeba histolytica
NNQSTNNEL

SEQ ID NO: 2643610 - protein, 5 aa, Entamoeba histolytica
NNQSY

SEQ ID NO: 2643611 - protein, 7 aa, Entamoeba histolytica
NNQTLQD

SEQ ID NO: 2643612 - protein, 25 aa, Entamoeba histolytica
NNQTNTPQFESQIDDYNKDVHTDND

SEQ ID NO: 2643613 - protein, 16 aa, Entamoeba histolytica
NNQTQIKLSTNKSTDI

SEQ ID NO: 2643614 - protein, 5 aa, Entamoeba histolytica
NNQTY

SEQ ID NO: 2643615 - protein, 8 aa, Entamoeba histolytica
NNQVNKAR

SEQ ID NO: 2643616 - protein, 5 aa, Entamoeba histolytica
NNQVS

SEQ ID NO: 2643617 - protein, 4 aa, Entamoeba histolytica
NNQY

SEQ ID NO: 2643618 - protein, 6 aa, Entamoeba histolytica
NNQYNR

SEQ ID NO: 2643619 - protein, 6 aa, Entamoeba histolytica
NNQYYT

SEQ ID NO: 2643620 - protein, 5 aa, Entamoeba histolytica
NNRCA

SEQ ID NO: 2643621 - protein, 8 aa, Entamoeba histolytica
NNREEFKK

SEQ ID NO: 2643622 - protein, 7 aa, Entamoeba histolytica
NNREGSI

SEQ ID NO: 2643623 - protein, 7 aa, Entamoeba histolytica
NNREYDN

SEQ ID NO: 2643624 - protein, 4 aa, Entamoeba histolytica
NNRG

SEQ ID NO: 2643625 - protein, 6 aa, Entamoeba histolytica
NNRGYT

SEQ ID NO: 2643626 - protein, 10 aa, Entamoeba histolytica
NNRKKIVNKR

SEQ ID NO: 2643627 - protein, 6 aa, Entamoeba histolytica
NNRKNS

SEQ ID NO: 2643628 - protein, 5 aa, Entamoeba histolytica
NNRLI

SEQ ID NO: 2643629 - protein, 13 aa, Entamoeba histolytica
NNRMEQRGRYHGK

SEQ ID NO: 2643630 - protein, 4 aa, Entamoeba histolytica
NNRN

SEQ ID NO: 2643631 - protein, 9 aa, Entamoeba histolytica
NNRQREITG

SEQ ID NO: 2643632 - protein, 5 aa, Entamoeba histolytica
NNRRE

SEQ ID NO: 2643633 - protein, 14 aa, Entamoeba histolytica
NNRRYSKKRLNDIQ

SEQ ID NO: 2643634 - protein, 5 aa, Entamoeba histolytica
NNRTI

SEQ ID NO: 2643635 - protein, 7 aa, Entamoeba histolytica
NNRTPAI

SEQ ID NO: 2643636 - protein, 4 aa, Entamoeba histolytica
NNRV

SEQ ID NO: 2643637 - protein, 17 aa, Entamoeba histolytica
NNRYRKDTKLGEGTYGE

SEQ ID NO: 2643638 - protein, 4 aa, Entamoeba histolytica
NNSA

SEQ ID NO: 2643639 - protein, 5 aa, Entamoeba histolytica
NNSDF

SEQ ID NO: 2643640 - protein, 7 aa, Entamoeba histolytica
NNSDTNF

SEQ ID NO: 2643641 - protein, 4 aa, Entamoeba histolytica
NNSE

SEQ ID NO: 2643642 - protein, 10 aa, Entamoeba histolytica
NNSELSGSAL

SEQ ID NO: 2643643 - protein, 8 aa, Entamoeba histolytica
NNSENQLK

SEQ ID NO: 2643644 - protein, 9 aa, Entamoeba histolytica
NNSETNPEI

SEQ ID NO: 2643645 - protein, 7 aa, Entamoeba histolytica
NNSFDNK

SEQ ID NO: 2643646 - protein, 6 aa, Entamoeba histolytica
NNSFNK

SEQ ID NO: 2643647 - protein, 6 aa, Entamoeba histolytica
NNSGAY

SEQ ID NO: 2643648 - protein, 6 aa, Entamoeba histolytica
NNSGNI

SEQ ID NO: 2643649 - protein, 16 aa, Entamoeba histolytica
NNSIEIRKKASDAISS

SEQ ID NO: 2643650 - protein, 5 aa, Entamoeba histolytica
NNSIM

SEQ ID NO: 2643651 - protein, 51 aa, Entamoeba histolytica
NNSIPRRGQLKQRPQSRVADNRPQSRVGDTKLQSSMRNTSTAYRLGNSQPY

SEQ ID NO: 2643652 - protein, 11 aa, Entamoeba histolytica
NNSISDKTDLN

SEQ ID NO: 2643653 - protein, 7 aa, Entamoeba histolytica
NNSISEV

SEQ ID NO: 2643654 - protein, 9 aa, Entamoeba histolytica
NNSISNEQR

SEQ ID NO: 2643655 - protein, 7 aa, Entamoeba histolytica
NNSKSIY

SEQ ID NO: 2643656 - protein, 7 aa, Entamoeba histolytica
NNSKSQY

SEQ ID NO: 2643657 - protein, 6 aa, Entamoeba histolytica
NNSLLT

SEQ ID NO: 2643658 - protein, 4 aa, Entamoeba histolytica
NNSN

SEQ ID NO: 2643659 - protein, 5 aa, Entamoeba histolytica
NNSNA

SEQ ID NO: 2643660 - protein, 10 aa, Entamoeba histolytica
NNSNGELDGE

SEQ ID NO: 2643661 - protein, 5 aa, Entamoeba histolytica
NNSNK

SEQ ID NO: 2643662 - protein, 9 aa, Entamoeba histolytica
NNSNKSELI

SEQ ID NO: 2643663 - protein, 11 aa, Entamoeba histolytica
NNSNRENTASN

SEQ ID NO: 2643664 - protein, 7 aa, Entamoeba histolytica
NNSNSGM

SEQ ID NO: 2643665 - protein, 15 aa, Entamoeba histolytica
NNSNTMTSKQIENTI

SEQ ID NO: 2643666 - protein, 6 aa, Entamoeba histolytica
NNSPGL

SEQ ID NO: 2643667 - protein, 6 aa, Entamoeba histolytica
NNSPLQ

SEQ ID NO: 2643668 - protein, 8 aa, Entamoeba histolytica
NNSPQEIK

SEQ ID NO: 2643669 - protein, 8 aa, Entamoeba histolytica
NNSQKPLT

SEQ ID NO: 2643670 - protein, 19 aa, Entamoeba histolytica
NNSQQEKQIKQQSESTKNF

SEQ ID NO: 2643671 - protein, 31 aa, Entamoeba histolytica
NNSQTEHSLKNAQMKEKRKTSQLDQVNNEDE

SEQ ID NO: 2643672 - protein, 7 aa, Entamoeba histolytica
NNSRTEI

SEQ ID NO: 2643673 - protein, 5 aa, Entamoeba histolytica
NNSSF

SEQ ID NO: 2643674 - protein, 10 aa, Entamoeba histolytica
NNSSNLSDSV

SEQ ID NO: 2643675 - protein, 10 aa, Entamoeba histolytica
NNSSPSLKSD

SEQ ID NO: 2643676 - protein, 10 aa, Entamoeba histolytica
NNSSRQNHPP

SEQ ID NO: 2643677 - protein, 6 aa, Entamoeba histolytica
NNSTEE

SEQ ID NO: 2643678 - protein, 10 aa, Entamoeba histolytica
NNSTKQSTVE

SEQ ID NO: 2643679 - protein, 6 aa, Entamoeba histolytica
NNSTPL

SEQ ID NO: 2643680 - protein, 7 aa, Entamoeba histolytica
NNSTSLT

SEQ ID NO: 2643681 - protein, 7 aa, Entamoeba histolytica
NNSTSSL

SEQ ID NO: 2643682 - protein, 8 aa, Entamoeba histolytica
NNSVPAFS

SEQ ID NO: 2643683 - protein, 11 aa, Entamoeba histolytica
NNSVSQNTSSL

SEQ ID NO: 2643684 - protein, 4 aa, Entamoeba histolytica
NNSW

SEQ ID NO: 2643685 - protein, 8 aa, Entamoeba histolytica
NNSYAKVE

SEQ ID NO: 2643686 - protein, 11 aa, Entamoeba histolytica
NNSYLPKESQY

SEQ ID NO: 2643687 - protein, 5 aa, Entamoeba histolytica
NNSYQ

SEQ ID NO: 2643688 - protein, 7 aa, Entamoeba histolytica
NNTDNTY

SEQ ID NO: 2643689 - protein, 14 aa, Entamoeba histolytica
NNTDPDTNINQDDV

SEQ ID NO: 2643690 - protein, 8 aa, Entamoeba histolytica
NNTDSTYK

SEQ ID NO: 2643691 - protein, 19 aa, Entamoeba histolytica
NNTEESILENNQSDNINNN

SEQ ID NO: 2643692 - protein, 6 aa, Entamoeba histolytica
NNTEKV

SEQ ID NO: 2643693 - protein, 14 aa, Entamoeba histolytica
NNTETIGDDHPKIK

SEQ ID NO: 2643694 - protein, 7 aa, Entamoeba histolytica
NNTFEDS

SEQ ID NO: 2643695 - protein, 6 aa, Entamoeba histolytica
NNTFTE

SEQ ID NO: 2643696 - protein, 10 aa, Entamoeba histolytica
NNTGAGQPVS

SEQ ID NO: 2643697 - protein, 7 aa, Entamoeba histolytica
NNTGETP

SEQ ID NO: 2643698 - protein, 14 aa, Entamoeba histolytica
NNTIEKKNEESIKQ

SEQ ID NO: 2643699 - protein, 4 aa, Entamoeba histolytica
NNTK

SEQ ID NO: 2643700 - protein, 70 aa, Entamoeba histolytica
NNTKKEDQQPTSQNQNTTNEEIKQTLPSTQVEDKEQLTSKNEEVNENMKDENNINTEENTDDNSEEEDNY

SEQ ID NO: 2643701 - protein, 6 aa, Entamoeba histolytica
NNTKME

SEQ ID NO: 2643702 - protein, 11 aa, Entamoeba histolytica
NNTKNLNTGTN

SEQ ID NO: 2643703 - protein, 10 aa, Entamoeba histolytica
NNTLETNPSL

SEQ ID NO: 2643704 - protein, 32 aa, Entamoeba histolytica
NNTLPTNTNFTNANNNKTIEIKTNQTNPDIKK

SEQ ID NO: 2643705 - protein, 7 aa, Entamoeba histolytica
NNTNASN

SEQ ID NO: 2643706 - protein, 6 aa, Entamoeba histolytica
NNTNEE

SEQ ID NO: 2643707 - protein, 8 aa, Entamoeba histolytica
NNTNKIEE

SEQ ID NO: 2643708 - protein, 10 aa, Entamoeba histolytica
NNTNKRKEDP

SEQ ID NO: 2643709 - protein, 7 aa, Entamoeba histolytica
NNTNPET

SEQ ID NO: 2643710 - protein, 9 aa, Entamoeba histolytica
NNTNPEVSL

SEQ ID NO: 2643711 - protein, 5 aa, Entamoeba histolytica
NNTNT

SEQ ID NO: 2643712 - protein, 15 aa, Entamoeba histolytica
NNTPAPLLELMEQLE

SEQ ID NO: 2643713 - protein, 6 aa, Entamoeba histolytica
NNTPGE

SEQ ID NO: 2643714 - protein, 6 aa, Entamoeba histolytica
NNTPID

SEQ ID NO: 2643715 - protein, 6 aa, Entamoeba histolytica
NNTPIH

SEQ ID NO: 2643716 - protein, 5 aa, Entamoeba histolytica
NNTPQ

SEQ ID NO: 2643717 - protein, 6 aa, Entamoeba histolytica
NNTPRD

SEQ ID NO: 2643718 - protein, 7 aa, Entamoeba histolytica
NNTQDNA

SEQ ID NO: 2643719 - protein, 7 aa, Entamoeba histolytica
NNTQEKG

SEQ ID NO: 2643720 - protein, 10 aa, Entamoeba histolytica
NNTQKSERHY

SEQ ID NO: 2643721 - protein, 6 aa, Entamoeba histolytica
NNTQNI

SEQ ID NO: 2643722 - protein, 5 aa, Entamoeba histolytica
NNTQQ

SEQ ID NO: 2643723 - protein, 8 aa, Entamoeba histolytica
NNTQSYSQ

SEQ ID NO: 2643724 - protein, 9 aa, Entamoeba histolytica
NNTSDCDTE

SEQ ID NO: 2643725 - protein, 8 aa, Entamoeba histolytica
NNTSGTSW

SEQ ID NO: 2643726 - protein, 8 aa, Entamoeba histolytica
NNTSIEGV

SEQ ID NO: 2643727 - protein, 11 aa, Entamoeba histolytica
NNTSQYKKSGF

SEQ ID NO: 2643728 - protein, 29 aa, Entamoeba histolytica
NNTSSQEVKKADNTSSSINTNQPKQPQNT

SEQ ID NO: 2643729 - protein, 4 aa, Entamoeba histolytica
NNTT

SEQ ID NO: 2643730 - protein, 11 aa, Entamoeba histolytica
NNTTEYIDSDG

SEQ ID NO: 2643731 - protein, 5 aa, Entamoeba histolytica
NNTTK

SEQ ID NO: 2643732 - protein, 7 aa, Entamoeba histolytica
NNTTNIQ

SEQ ID NO: 2643733 - protein, 12 aa, Entamoeba histolytica
NNTTQPKLNQTL

SEQ ID NO: 2643734 - protein, 4 aa, Entamoeba histolytica
NNTV

SEQ ID NO: 2643735 - protein, 7 aa, Entamoeba histolytica
NNTWSGE

SEQ ID NO: 2643736 - protein, 9 aa, Entamoeba histolytica
NNVGNKKNE

SEQ ID NO: 2643737 - protein, 6 aa, Entamoeba histolytica
NNVGRT

SEQ ID NO: 2643738 - protein, 7 aa, Entamoeba histolytica
NNVGVSG

SEQ ID NO: 2643739 - protein, 4 aa, Entamoeba histolytica
NNVK

SEQ ID NO: 2643740 - protein, 6 aa, Entamoeba histolytica
NNVKDD

SEQ ID NO: 2643741 - protein, 22 aa, Entamoeba histolytica
NNVKSGYKKDKKALRSSPHSDT

SEQ ID NO: 2643742 - protein, 10 aa, Entamoeba histolytica
NNVNESYSIP

SEQ ID NO: 2643743 - protein, 5 aa, Entamoeba histolytica
NNVNP

SEQ ID NO: 2643744 - protein, 20 aa, Entamoeba histolytica
NNVNSMKKRRATLISGKEKH

SEQ ID NO: 2643745 - protein, 5 aa, Entamoeba histolytica
NNVSH

SEQ ID NO: 2643746 - protein, 5 aa, Entamoeba histolytica
NNVTD

SEQ ID NO: 2643747 - protein, 14 aa, Entamoeba histolytica
NNVTPGCEKNEDAL

SEQ ID NO: 2643748 - protein, 11 aa, Entamoeba histolytica
NNVTSTKEPYF

SEQ ID NO: 2643749 - protein, 18 aa, Entamoeba histolytica
NNYDKTKSQSKEEDTIKR

SEQ ID NO: 2643750 - protein, 6 aa, Entamoeba histolytica
NNYENL

SEQ ID NO: 2643751 - protein, 10 aa, Entamoeba histolytica
NNYEPLNDPT

SEQ ID NO: 2643752 - protein, 6 aa, Entamoeba histolytica
NNYGDK

SEQ ID NO: 2643753 - protein, 21 aa, Entamoeba histolytica
NNYKKEGDSEFTKSSDTDSVQ

SEQ ID NO: 2643754 - protein, 8 aa, Entamoeba histolytica
NNYLNSSQ

SEQ ID NO: 2643755 - protein, 9 aa, Entamoeba histolytica
NNYPQPSRD

SEQ ID NO: 2643756 - protein, 5 aa, Entamoeba histolytica
NNYQE

SEQ ID NO: 2643757 - protein, 10 aa, Entamoeba histolytica
NNYQTKNGNV

SEQ ID NO: 2643758 - protein, 6 aa, Entamoeba histolytica
NNYRRD

SEQ ID NO: 2643759 - protein, 6 aa, Entamoeba histolytica
NNYSDG

SEQ ID NO: 2643760 - protein, 12 aa, Entamoeba histolytica
NNYSTSTTGLSS

SEQ ID NO: 2643761 - protein, 9 aa, Entamoeba histolytica
NNYTSPQLY

SEQ ID NO: 2643762 - protein, 8 aa, Entamoeba histolytica
NPAEKTTR

SEQ ID NO: 2643763 - protein, 15 aa, Entamoeba histolytica
NPAFDSQTKETLKTQ

SEQ ID NO: 2643764 - protein, 9 aa, Entamoeba histolytica
NPAKRTPKF

SEQ ID NO: 2643765 - protein, 11 aa, Entamoeba histolytica
NPAPLQDHYRP

SEQ ID NO: 2643766 - protein, 19 aa, Entamoeba histolytica
NPAQAKSNARDYTQKYAHA

SEQ ID NO: 2643767 - protein, 10 aa, Entamoeba histolytica
NPATGKDEGE

SEQ ID NO: 2643768 - protein, 11 aa, Entamoeba histolytica
NPDAEADKELS

SEQ ID NO: 2643769 - protein, 13 aa, Entamoeba histolytica
NPDASKRASAEEL

SEQ ID NO: 2643770 - protein, 8 aa, Entamoeba histolytica
NPDDPNHT

SEQ ID NO: 2643771 - protein, 5 aa, Entamoeba histolytica
NPDDT

SEQ ID NO: 2643772 - protein, 4 aa, Entamoeba histolytica
NPDE

SEQ ID NO: 2643773 - protein, 4 aa, Entamoeba histolytica
NPDI

SEQ ID NO: 2643774 - protein, 8 aa, Entamoeba histolytica
NPDLSTTG

SEQ ID NO: 2643775 - protein, 6 aa, Entamoeba histolytica
NPDPCN

SEQ ID NO: 2643776 - protein, 23 aa, Entamoeba histolytica
NPDQTDSKGRRKQRIDDELNSFD

SEQ ID NO: 2643777 - protein, 10 aa, Entamoeba histolytica
NPDTFAATDR

SEQ ID NO: 2643778 - protein, 5 aa, Entamoeba histolytica
NPDVK

SEQ ID NO: 2643779 - protein, 10 aa, Entamoeba histolytica
NPDYADTSYS

SEQ ID NO: 2643780 - protein, 8 aa, Entamoeba histolytica
NPEAINDQ

SEQ ID NO: 2643781 - protein, 4 aa, Entamoeba histolytica
NPEC

SEQ ID NO: 2643782 - protein, 7 aa, Entamoeba histolytica
NPEEEEQ

SEQ ID NO: 2643783 - protein, 16 aa, Entamoeba histolytica
NPEEPQINPDEPPNFN

SEQ ID NO: 2643784 - protein, 6 aa, Entamoeba histolytica
NPEEVE

SEQ ID NO: 2643785 - protein, 13 aa, Entamoeba histolytica
NPEFKGTRSARKT

SEQ ID NO: 2643786 - protein, 13 aa, Entamoeba histolytica
NPEIKSDSDNIQP

SEQ ID NO: 2643787 - protein, 10 aa, Entamoeba histolytica
NPEKESSHQE

SEQ ID NO: 2643788 - protein, 6 aa, Entamoeba histolytica
NPEKHL

SEQ ID NO: 2643789 - protein, 5 aa, Entamoeba histolytica
NPELS

SEQ ID NO: 2643790 - protein, 4 aa, Entamoeba histolytica
NPEM

SEQ ID NO: 2643791 - protein, 4 aa, Entamoeba histolytica
NPEN

SEQ ID NO: 2643792 - protein, 9 aa, Entamoeba histolytica
NPENPEEFK

SEQ ID NO: 2643793 - protein, 4 aa, Entamoeba histolytica
NPEP

SEQ ID NO: 2643794 - protein, 5 aa, Entamoeba histolytica
NPEPQ

SEQ ID NO: 2643795 - protein, 6 aa, Entamoeba histolytica
NPETGM

SEQ ID NO: 2643796 - protein, 7 aa, Entamoeba histolytica
NPETGNY

SEQ ID NO: 2643797 - protein, 10 aa, Entamoeba histolytica
NPETKSWGQA

SEQ ID NO: 2643798 - protein, 5 aa, Entamoeba histolytica
NPETQ

SEQ ID NO: 2643799 - protein, 5 aa, Entamoeba histolytica
NPETT

SEQ ID NO: 2643800 - protein, 5 aa, Entamoeba histolytica
NPEVY

SEQ ID NO: 2643801 - protein, 8 aa, Entamoeba histolytica
NPEWDKEK

SEQ ID NO: 2643802 - protein, 5 aa, Entamoeba histolytica
NPEYK

SEQ ID NO: 2643803 - protein, 6 aa, Entamoeba histolytica
NPEYKE

SEQ ID NO: 2643804 - protein, 6 aa, Entamoeba histolytica
NPEYYS

SEQ ID NO: 2643805 - protein, 7 aa, Entamoeba histolytica
NPFDPVT

SEQ ID NO: 2643806 - protein, 5 aa, Entamoeba histolytica
NPFGE

SEQ ID NO: 2643807 - protein, 26 aa, Entamoeba histolytica
NPFIDESDEKVEEQVEEHRNPFGDES

SEQ ID NO: 2643808 - protein, 10 aa, Entamoeba histolytica
NPFKSKVSNT

SEQ ID NO: 2643809 - protein, 4 aa, Entamoeba histolytica
NPFN

SEQ ID NO: 2643810 - protein, 5 aa, Entamoeba histolytica
NPFPQ

SEQ ID NO: 2643811 - protein, 14 aa, Entamoeba histolytica
NPFQNLSSTDNSGY

SEQ ID NO: 2643812 - protein, 20 aa, Entamoeba histolytica
NPFQYQSDKKRHQKERERNE

SEQ ID NO: 2643813 - protein, 4 aa, Entamoeba histolytica
NPFS

SEQ ID NO: 2643814 - protein, 21 aa, Entamoeba histolytica
NPFSNQTTQTSSIKPNEPTQI

SEQ ID NO: 2643815 - protein, 8 aa, Entamoeba histolytica
NPFSTSNN

SEQ ID NO: 2643816 - protein, 7 aa, Entamoeba histolytica
NPFYGKN

SEQ ID NO: 2643817 - protein, 6 aa, Entamoeba histolytica
NPFYSG

SEQ ID NO: 2643818 - protein, 8 aa, Entamoeba histolytica
NPGADSFS

SEQ ID NO: 2643819 - protein, 8 aa, Entamoeba histolytica
NPGCSAED

SEQ ID NO: 2643820 - protein, 15 aa, Entamoeba histolytica
NPGGDFGKRELSPAM

SEQ ID NO: 2643821 - protein, 7 aa, Entamoeba histolytica
NPGGNDQ

SEQ ID NO: 2643822 - protein, 19 aa, Entamoeba histolytica
NPGKRISAREAMKDPFFIK

SEQ ID NO: 2643823 - protein, 10 aa, Entamoeba histolytica
NPGPTGDSKV

SEQ ID NO: 2643824 - protein, 9 aa, Entamoeba histolytica
NPGQTNDFK

SEQ ID NO: 2643825 - protein, 11 aa, Entamoeba histolytica
NPGSATGAYSP

SEQ ID NO: 2643826 - protein, 11 aa, Entamoeba histolytica
NPGSKTMTEEA

SEQ ID NO: 2643827 - protein, 15 aa, Entamoeba histolytica
NPHDKVSSTNQKAEI

SEQ ID NO: 2643828 - protein, 5 aa, Entamoeba histolytica
NPHLP

SEQ ID NO: 2643829 - protein, 22 aa, Entamoeba histolytica
NPHPKLNSDAQHDFNGNTNTRS

SEQ ID NO: 2643830 - protein, 4 aa, Entamoeba histolytica
NPHT

SEQ ID NO: 2643831 - protein, 13 aa, Entamoeba histolytica
NPIDPKSSDSQTN

SEQ ID NO: 2643832 - protein, 6 aa, Entamoeba histolytica
NPIKAR

SEQ ID NO: 2643833 - protein, 5 aa, Entamoeba histolytica
NPIKE

SEQ ID NO: 2643834 - protein, 5 aa, Entamoeba histolytica
NPIKR

SEQ ID NO: 2643835 - protein, 5 aa, Entamoeba histolytica
NPING

SEQ ID NO: 2643836 - protein, 7 aa, Entamoeba histolytica
NPINGEI

SEQ ID NO: 2643837 - protein, 7 aa, Entamoeba histolytica
NPINNNN

SEQ ID NO: 2643838 - protein, 8 aa, Entamoeba histolytica
NPINNVPP

SEQ ID NO: 2643839 - protein, 25 aa, Entamoeba histolytica
NPINSPSEEQIQQSDAMSEQPVIED

SEQ ID NO: 2643840 - protein, 8 aa, Entamoeba histolytica
NPINSPTI

SEQ ID NO: 2643841 - protein, 8 aa, Entamoeba histolytica
NPIPEGTT

SEQ ID NO: 2643842 - protein, 7 aa, Entamoeba histolytica
NPIPLND

SEQ ID NO: 2643843 - protein, 23 aa, Entamoeba histolytica
NPIQVNQTSPSPMGSSASSLRNS

SEQ ID NO: 2643844 - protein, 4 aa, Entamoeba histolytica
NPIS

SEQ ID NO: 2643845 - protein, 8 aa, Entamoeba histolytica
NPISRPNA

SEQ ID NO: 2643846 - protein, 4 aa, Entamoeba histolytica
NPIT

SEQ ID NO: 2643847 - protein, 6 aa, Entamoeba histolytica
NPITNE

SEQ ID NO: 2643848 - protein, 6 aa, Entamoeba histolytica
NPITTI

SEQ ID NO: 2643849 - protein, 6 aa, Entamoeba histolytica
NPKAQS

SEQ ID NO: 2643850 - protein, 8 aa, Entamoeba histolytica
NPKDLAPY

SEQ ID NO: 2643851 - protein, 9 aa, Entamoeba histolytica
NPKDNKSLQ

SEQ ID NO: 2643852 - protein, 32 aa, Entamoeba histolytica
NPKEDSTKSSNKKSGKKQSEKNREKKKGGCVL

SEQ ID NO: 2643853 - protein, 8 aa, Entamoeba histolytica
NPKESSGK

SEQ ID NO: 2643854 - protein, 5 aa, Entamoeba histolytica
NPKFG

SEQ ID NO: 2643855 - protein, 9 aa, Entamoeba histolytica
NPKFKKSTL

SEQ ID NO: 2643856 - protein, 8 aa, Entamoeba histolytica
NPKGKAQD

SEQ ID NO: 2643857 - protein, 12 aa, Entamoeba histolytica
NPKHQKEYEYPL

SEQ ID NO: 2643858 - protein, 4 aa, Entamoeba histolytica
NPKI

SEQ ID NO: 2643859 - protein, 6 aa, Entamoeba histolytica
NPKIPN

SEQ ID NO: 2643860 - protein, 18 aa, Entamoeba histolytica
NPKKKSTGLLSKAKKQCS

SEQ ID NO: 2643861 - protein, 17 aa, Entamoeba histolytica
NPKKRIDDGEALERDEK

SEQ ID NO: 2643862 - protein, 6 aa, Entamoeba histolytica
NPKKRV

SEQ ID NO: 2643863 - protein, 8 aa, Entamoeba histolytica
NPKKTSPI

SEQ ID NO: 2643864 - protein, 9 aa, Entamoeba histolytica
NPKNEEARE

SEQ ID NO: 2643865 - protein, 6 aa, Entamoeba histolytica
NPKNIR

SEQ ID NO: 2643866 - protein, 10 aa, Entamoeba histolytica
NPKNTKAREL

SEQ ID NO: 2643867 - protein, 4 aa, Entamoeba histolytica
NPKP

SEQ ID NO: 2643868 - protein, 8 aa, Entamoeba histolytica
NPKQKKVT

SEQ ID NO: 2643869 - protein, 6 aa, Entamoeba histolytica
NPKSFE

SEQ ID NO: 2643870 - protein, 10 aa, Entamoeba histolytica
NPKSSKTELE

SEQ ID NO: 2643871 - protein, 28 aa, Entamoeba histolytica
NPKSVPNKLNGKSQGLAAPENIKQPDEQ

SEQ ID NO: 2643872 - protein, 8 aa, Entamoeba histolytica
NPKTIEGE

SEQ ID NO: 2643873 - protein, 14 aa, Entamoeba histolytica
NPKTQDVEEFEPEE

SEQ ID NO: 2643874 - protein, 14 aa, Entamoeba histolytica
NPKTQGIEEFEPEE

SEQ ID NO: 2643875 - protein, 5 aa, Entamoeba histolytica
NPKTR

SEQ ID NO: 2643876 - protein, 7 aa, Entamoeba histolytica
NPKTSDI

SEQ ID NO: 2643877 - protein, 24 aa, Entamoeba histolytica
NPKTSKKDNVNKEIDYPTDLDDED

SEQ ID NO: 2643878 - protein, 5 aa, Entamoeba histolytica
NPKTT

SEQ ID NO: 2643879 - protein, 5 aa, Entamoeba histolytica
NPKVT

SEQ ID NO: 2643880 - protein, 4 aa, Entamoeba histolytica
NPKY

SEQ ID NO: 2643881 - protein, 10 aa, Entamoeba histolytica
NPKYEDTKYT

SEQ ID NO: 2643882 - protein, 13 aa, Entamoeba histolytica
NPLDPTDEESPHR

SEQ ID NO: 2643883 - protein, 4 aa, Entamoeba histolytica
NPLE

SEQ ID NO: 2643884 - protein, 7 aa, Entamoeba histolytica
NPLGMSK

SEQ ID NO: 2643885 - protein, 20 aa, Entamoeba histolytica
NPLGSRHHGELEKTSTNSHD

SEQ ID NO: 2643886 - protein, 17 aa, Entamoeba histolytica
NPLINNDQEQKKVDEIK

SEQ ID NO: 2643887 - protein, 9 aa, Entamoeba histolytica
NPLKKGKSV

SEQ ID NO: 2643888 - protein, 5 aa, Entamoeba histolytica
NPLNN

SEQ ID NO: 2643889 - protein, 5 aa, Entamoeba histolytica
NPLPG

SEQ ID NO: 2643890 - protein, 15 aa, Entamoeba histolytica
NPLPSEGNSFSATNR

SEQ ID NO: 2643891 - protein, 11 aa, Entamoeba histolytica
NPLPSTGPLSS

SEQ ID NO: 2643892 - protein, 7 aa, Entamoeba histolytica
NPLSTED

SEQ ID NO: 2643893 - protein, 5 aa, Entamoeba histolytica
NPLTN

SEQ ID NO: 2643894 - protein, 7 aa, Entamoeba histolytica
NPMNTPK

SEQ ID NO: 2643895 - protein, 5 aa, Entamoeba histolytica
NPMQN

SEQ ID NO: 2643896 - protein, 8 aa, Entamoeba histolytica
NPNAPFEE

SEQ ID NO: 2643897 - protein, 6 aa, Entamoeba histolytica
NPNATL

SEQ ID NO: 2643898 - protein, 16 aa, Entamoeba histolytica
NPNAYPALKTNQHPDL

SEQ ID NO: 2643899 - protein, 5 aa, Entamoeba histolytica
NPNCE

SEQ ID NO: 2643900 - protein, 6 aa, Entamoeba histolytica
NPNCPK

SEQ ID NO: 2643901 - protein, 15 aa, Entamoeba histolytica
NPNDERHSKESDNQI

SEQ ID NO: 2643902 - protein, 8 aa, Entamoeba histolytica
NPNDSIRK

SEQ ID NO: 2643903 - protein, 5 aa, Entamoeba histolytica
NPNEH

SEQ ID NO: 2643904 - protein, 6 aa, Entamoeba histolytica
NPNEPD

SEQ ID NO: 2643905 - protein, 8 aa, Entamoeba histolytica
NPNGEPCT

SEQ ID NO: 2643906 - protein, 9 aa, Entamoeba histolytica
NPNGPHGTR

SEQ ID NO: 2643907 - protein, 9 aa, Entamoeba histolytica
NPNGTNLGS

SEQ ID NO: 2643908 - protein, 16 aa, Entamoeba histolytica
NPNGVTKQLSLIIDED

SEQ ID NO: 2643909 - protein, 17 aa, Entamoeba histolytica
NPNIKPSHQNASNSSCQ

SEQ ID NO: 2643910 - protein, 5 aa, Entamoeba histolytica
NPNKI

SEQ ID NO: 2643911 - protein, 16 aa, Entamoeba histolytica
NPNKINQEKGESYNGL

SEQ ID NO: 2643912 - protein, 9 aa, Entamoeba histolytica
NPNKKEREP

SEQ ID NO: 2643913 - protein, 19 aa, Entamoeba histolytica
NPNKKSKKKGEKKNGSEFS

SEQ ID NO: 2643914 - protein, 10 aa, Entamoeba histolytica
NPNKSLKPIR

SEQ ID NO: 2643915 - protein, 7 aa, Entamoeba histolytica
NPNLEDP

SEQ ID NO: 2643916 - protein, 4 aa, Entamoeba histolytica
NPNN

SEQ ID NO: 2643917 - protein, 7 aa, Entamoeba histolytica
NPNNEQA

SEQ ID NO: 2643918 - protein, 6 aa, Entamoeba histolytica
NPNNPH

SEQ ID NO: 2643919 - protein, 9 aa, Entamoeba histolytica
NPNNQQFNQ

SEQ ID NO: 2643920 - protein, 8 aa, Entamoeba histolytica
NPNNSSIQ

SEQ ID NO: 2643921 - protein, 11 aa, Entamoeba histolytica
NPNNTDEQKEI

SEQ ID NO: 2643922 - protein, 23 aa, Entamoeba histolytica
NPNPRPKTEIGENGMEKEQDYDE

SEQ ID NO: 2643923 - protein, 7 aa, Entamoeba histolytica
NPNSNEI

SEQ ID NO: 2643924 - protein, 22 aa, Entamoeba histolytica
NPNSNISKGVNSPIKDANSPII

SEQ ID NO: 2643925 - protein, 17 aa, Entamoeba histolytica
NPNSPYTKIPRVNGKGM

SEQ ID NO: 2643926 - protein, 6 aa, Entamoeba histolytica
NPNTGE

SEQ ID NO: 2643927 - protein, 16 aa, Entamoeba histolytica
NPNTISSVREKVESTL

SEQ ID NO: 2643928 - protein, 16 aa, Entamoeba histolytica
NPNTISSVRERVESTL

SEQ ID NO: 2643929 - protein, 12 aa, Entamoeba histolytica
NPNTPCPRDSSR

SEQ ID NO: 2643930 - protein, 12 aa, Entamoeba histolytica
NPNTTSENSVTL

SEQ ID NO: 2643931 - protein, 7 aa, Entamoeba histolytica
NPNVGKS

SEQ ID NO: 2643932 - protein, 7 aa, Entamoeba histolytica
NPNYLQK

SEQ ID NO: 2643933 - protein, 6 aa, Entamoeba histolytica
NPPEFN

SEQ ID NO: 2643934 - protein, 5 aa, Entamoeba histolytica
NPPEP

SEQ ID NO: 2643935 - protein, 14 aa, Entamoeba histolytica
NPPEPIIQPPPQQY

SEQ ID NO: 2643936 - protein, 5 aa, Entamoeba histolytica
NPPEY

SEQ ID NO: 2643937 - protein, 9 aa, Entamoeba histolytica
NPPFPNDNE

SEQ ID NO: 2643938 - protein, 6 aa, Entamoeba histolytica
NPPIID

SEQ ID NO: 2643939 - protein, 9 aa, Entamoeba histolytica
NPPKEGTVN

SEQ ID NO: 2643940 - protein, 7 aa, Entamoeba histolytica
NPPKIPE

SEQ ID NO: 2643941 - protein, 6 aa, Entamoeba histolytica
NPPKLV

SEQ ID NO: 2643942 - protein, 16 aa, Entamoeba histolytica
NPPKPLPPKAPYQKGD

SEQ ID NO: 2643943 - protein, 4 aa, Entamoeba histolytica
NPPL

SEQ ID NO: 2643944 - protein, 8 aa, Entamoeba histolytica
NPPLQQPS

SEQ ID NO: 2643945 - protein, 13 aa, Entamoeba histolytica
NPPLSDAPGTRNQ

SEQ ID NO: 2643946 - protein, 9 aa, Entamoeba histolytica
NPPMPRQSN

SEQ ID NO: 2643947 - protein, 6 aa, Entamoeba histolytica
NPPNNE

SEQ ID NO: 2643948 - protein, 14 aa, Entamoeba histolytica
NPPPKLKNESEHSY

SEQ ID NO: 2643949 - protein, 5 aa, Entamoeba histolytica
NPPPL

SEQ ID NO: 2643950 - protein, 6 aa, Entamoeba histolytica
NPPPLS

SEQ ID NO: 2643951 - protein, 6 aa, Entamoeba histolytica
NPPPTL

SEQ ID NO: 2643952 - protein, 13 aa, Entamoeba histolytica
NPPQQMGIPPNGI

SEQ ID NO: 2643953 - protein, 18 aa, Entamoeba histolytica
NPPQSQTNNTQESSTIKD

SEQ ID NO: 2643954 - protein, 6 aa, Entamoeba histolytica
NPPRID

SEQ ID NO: 2643955 - protein, 7 aa, Entamoeba histolytica
NPPRSLQ

SEQ ID NO: 2643956 - protein, 6 aa, Entamoeba histolytica
NPPSAQ

SEQ ID NO: 2643957 - protein, 7 aa, Entamoeba histolytica
NPPSEIK

SEQ ID NO: 2643958 - protein, 6 aa, Entamoeba histolytica
NPPSFR

SEQ ID NO: 2643959 - protein, 6 aa, Entamoeba histolytica
NPPSIY

SEQ ID NO: 2643960 - protein, 6 aa, Entamoeba histolytica
NPPSLG

SEQ ID NO: 2643961 - protein, 10 aa, Entamoeba histolytica
NPPSQEIKEK

SEQ ID NO: 2643962 - protein, 7 aa, Entamoeba histolytica
NPPSSLP

SEQ ID NO: 2643963 - protein, 16 aa, Entamoeba histolytica
NPPTDVGKKDLAPGIK

SEQ ID NO: 2643964 - protein, 7 aa, Entamoeba histolytica
NPPTPDF

SEQ ID NO: 2643965 - protein, 6 aa, Entamoeba histolytica
NPQEHV

SEQ ID NO: 2643966 - protein, 5 aa, Entamoeba histolytica
NPQEN

SEQ ID NO: 2643967 - protein, 4 aa, Entamoeba histolytica
NPQG

SEQ ID NO: 2643968 - protein, 12 aa, Entamoeba histolytica
NPQIEKYPKPQK

SEQ ID NO: 2643969 - protein, 5 aa, Entamoeba histolytica
NPQKR

SEQ ID NO: 2643970 - protein, 9 aa, Entamoeba histolytica
NPQLPPPNA

SEQ ID NO: 2643971 - protein, 9 aa, Entamoeba histolytica
NPQNTDQSK

SEQ ID NO: 2643972 - protein, 5 aa, Entamoeba histolytica
NPQPL

SEQ ID NO: 2643973 - protein, 4 aa, Entamoeba histolytica
NPQQ

SEQ ID NO: 2643974 - protein, 5 aa, Entamoeba histolytica
NPQQA

SEQ ID NO: 2643975 - protein, 6 aa, Entamoeba histolytica
NPQQFQ

SEQ ID NO: 2643976 - protein, 8 aa, Entamoeba histolytica
NPQRPEGM

SEQ ID NO: 2643977 - protein, 17 aa, Entamoeba histolytica
NPQSMSPLSYEKKNPKN

SEQ ID NO: 2643978 - protein, 28 aa, Entamoeba histolytica
NPQSPEPTQTQNQNTNTNTLGYGEAPGT

SEQ ID NO: 2643979 - protein, 7 aa, Entamoeba histolytica
NPQTIAE

SEQ ID NO: 2643980 - protein, 6 aa, Entamoeba histolytica
NPQTNE

SEQ ID NO: 2643981 - protein, 8 aa, Entamoeba histolytica
NPQTNKNE

SEQ ID NO: 2643982 - protein, 11 aa, Entamoeba histolytica
NPQTNPKRTNE

SEQ ID NO: 2643983 - protein, 14 aa, Entamoeba histolytica
NPQTQGIEEFEPEE

SEQ ID NO: 2643984 - protein, 8 aa, Entamoeba histolytica
NPQTQPKT

SEQ ID NO: 2643985 - protein, 14 aa, Entamoeba histolytica
NPQTQSAEEFEPEE

SEQ ID NO: 2643986 - protein, 14 aa, Entamoeba histolytica
NPQTQSTEEFEPEE

SEQ ID NO: 2643987 - protein, 6 aa, Entamoeba histolytica
NPQTSG

SEQ ID NO: 2643988 - protein, 5 aa, Entamoeba histolytica
NPQVG

SEQ ID NO: 2643989 - protein, 6 aa, Entamoeba histolytica
NPQYDA

SEQ ID NO: 2643990 - protein, 6 aa, Entamoeba histolytica
NPQYMS

SEQ ID NO: 2643991 - protein, 4 aa, Entamoeba histolytica
NPRA

SEQ ID NO: 2643992 - protein, 6 aa, Entamoeba histolytica
NPRAQP

SEQ ID NO: 2643993 - protein, 7 aa, Entamoeba histolytica
NPRKGVK

SEQ ID NO: 2643994 - protein, 5 aa, Entamoeba histolytica
NPRKR

SEQ ID NO: 2643995 - protein, 11 aa, Entamoeba histolytica
NPRSTSSKYTS

SEQ ID NO: 2643996 - protein, 11 aa, Entamoeba histolytica
NPRTKSERKTH

SEQ ID NO: 2643997 - protein, 16 aa, Entamoeba histolytica
NPRTPNRPNKKELKKN

SEQ ID NO: 2643998 - protein, 5 aa, Entamoeba histolytica
NPSAI

SEQ ID NO: 2643999 - protein, 6 aa, Entamoeba histolytica
NPSCSE

SEQ ID NO: 2644000 - protein, 5 aa, Entamoeba histolytica
NPSDL

SEQ ID NO: 2644001 - protein, 11 aa, Entamoeba histolytica
NPSEKDKRKQL

SEQ ID NO: 2644002 - protein, 5 aa, Entamoeba histolytica
NPSEL

SEQ ID NO: 2644003 - protein, 11 aa, Entamoeba histolytica
NPSEVKNTINS

SEQ ID NO: 2644004 - protein, 5 aa, Entamoeba histolytica
NPSKA

SEQ ID NO: 2644005 - protein, 7 aa, Entamoeba histolytica
NPSKKNC

SEQ ID NO: 2644006 - protein, 5 aa, Entamoeba histolytica
NPSKL

SEQ ID NO: 2644007 - protein, 8 aa, Entamoeba histolytica
NPSKMSQI

SEQ ID NO: 2644008 - protein, 8 aa, Entamoeba histolytica
NPSKNQRF

SEQ ID NO: 2644009 - protein, 7 aa, Entamoeba histolytica
NPSKNYL

SEQ ID NO: 2644010 - protein, 14 aa, Entamoeba histolytica
NPSKTKIITGGGDG

SEQ ID NO: 2644011 - protein, 20 aa, Entamoeba histolytica
NPSLGKEGNETQEEKLTKSI

SEQ ID NO: 2644012 - protein, 5 aa, Entamoeba histolytica
NPSLS

SEQ ID NO: 2644013 - protein, 9 aa, Entamoeba histolytica
NPSNEEGRE

SEQ ID NO: 2644014 - protein, 8 aa, Entamoeba histolytica
NPSNKRGF

SEQ ID NO: 2644015 - protein, 7 aa, Entamoeba histolytica
NPSNVSQ

SEQ ID NO: 2644016 - protein, 15 aa, Entamoeba histolytica
NPSQKEPPPLSESAT

SEQ ID NO: 2644017 - protein, 6 aa, Entamoeba histolytica
NPSQSD

SEQ ID NO: 2644018 - protein, 8 aa, Entamoeba histolytica
NPSQSRSG

SEQ ID NO: 2644019 - protein, 7 aa, Entamoeba histolytica
NPSQWTP

SEQ ID NO: 2644020 - protein, 4 aa, Entamoeba histolytica
NPSR

SEQ ID NO: 2644021 - protein, 9 aa, Entamoeba histolytica
NPSSECENE

SEQ ID NO: 2644022 - protein, 8 aa, Entamoeba histolytica
NPSSISDN

SEQ ID NO: 2644023 - protein, 57 aa, Entamoeba histolytica
NPSSKNISEESNEDISENETEESSTREESDGELSISSGEGNEENPNESSITITEGKN

SEQ ID NO: 2644024 - protein, 13 aa, Entamoeba histolytica
NPSSLAKAKQFAA

SEQ ID NO: 2644025 - protein, 107 aa, Entamoeba histolytica
NPSSNNGSQQFNTMGSTGNSIPNMGTNSFGGNGLGTNTMGGNTFGTNPLGGNGLSTNAFGGNTFGTNSLGGNGLSTNTMGGNGLGTNTFGGNGLGTNTFGGNGLGTN

SEQ ID NO: 2644026 - protein, 10 aa, Entamoeba histolytica
NPSSPFPQAK

SEQ ID NO: 2644027 - protein, 10 aa, Entamoeba histolytica
NPSSQEQKSY

SEQ ID NO: 2644028 - protein, 12 aa, Entamoeba histolytica
NPSSTTQKTSED

SEQ ID NO: 2644029 - protein, 4 aa, Entamoeba histolytica
NPST

SEQ ID NO: 2644030 - protein, 8 aa, Entamoeba histolytica
NPSTHITP

SEQ ID NO: 2644031 - protein, 7 aa, Entamoeba histolytica
NPSTLQT

SEQ ID NO: 2644032 - protein, 8 aa, Entamoeba histolytica
NPSTSGID

SEQ ID NO: 2644033 - protein, 6 aa, Entamoeba histolytica
NPSVES

SEQ ID NO: 2644034 - protein, 4 aa, Entamoeba histolytica
NPSY

SEQ ID NO: 2644035 - protein, 4 aa, Entamoeba histolytica
NPTD

SEQ ID NO: 2644036 - protein, 7 aa, Entamoeba histolytica
NPTDENI

SEQ ID NO: 2644037 - protein, 4 aa, Entamoeba histolytica
NPTE

SEQ ID NO: 2644038 - protein, 4 aa, Entamoeba histolytica
NPTF

SEQ ID NO: 2644039 - protein, 7 aa, Entamoeba histolytica
NPTFEHP

SEQ ID NO: 2644040 - protein, 10 aa, Entamoeba histolytica
NPTGYGGITQ

SEQ ID NO: 2644041 - protein, 7 aa, Entamoeba histolytica
NPTISDE

SEQ ID NO: 2644042 - protein, 5 aa, Entamoeba histolytica
NPTKQ

SEQ ID NO: 2644043 - protein, 6 aa, Entamoeba histolytica
NPTLPR

SEQ ID NO: 2644044 - protein, 5 aa, Entamoeba histolytica
NPTLS

SEQ ID NO: 2644045 - protein, 5 aa, Entamoeba histolytica
NPTNG

SEQ ID NO: 2644046 - protein, 7 aa, Entamoeba histolytica
NPTNKAP

SEQ ID NO: 2644047 - protein, 4 aa, Entamoeba histolytica
NPTP

SEQ ID NO: 2644048 - protein, 6 aa, Entamoeba histolytica
NPTPDD

SEQ ID NO: 2644049 - protein, 7 aa, Entamoeba histolytica
NPTPIKE

SEQ ID NO: 2644050 - protein, 23 aa, Entamoeba histolytica
NPTPKNSSPVPRLGGATPAPIAS

SEQ ID NO: 2644051 - protein, 14 aa, Entamoeba histolytica
NPTPTKTDSTGISE

SEQ ID NO: 2644052 - protein, 13 aa, Entamoeba histolytica
NPTQLPSSFSTEE

SEQ ID NO: 2644053 - protein, 6 aa, Entamoeba histolytica
NPTSEE

SEQ ID NO: 2644054 - protein, 6 aa, Entamoeba histolytica
NPTSKM

SEQ ID NO: 2644055 - protein, 8 aa, Entamoeba histolytica
NPTSSKKL

SEQ ID NO: 2644056 - protein, 14 aa, Entamoeba histolytica
NPTTTPATQPSTNL

SEQ ID NO: 2644057 - protein, 4 aa, Entamoeba histolytica
NPTV

SEQ ID NO: 2644058 - protein, 5 aa, Entamoeba histolytica
NPTVP

SEQ ID NO: 2644059 - protein, 24 aa, Entamoeba histolytica
NPVDDQGGEILPTQEPDQSGNPDL

SEQ ID NO: 2644060 - protein, 4 aa, Entamoeba histolytica
NPVP

SEQ ID NO: 2644061 - protein, 36 aa, Entamoeba histolytica
NPVQPQNKTSQTGQNTQTQQNPVQQQNTQTQPQKDI

SEQ ID NO: 2644062 - protein, 22 aa, Entamoeba histolytica
NPVQPQNKTSQTGQNTQTQQSL

SEQ ID NO: 2644063 - protein, 6 aa, Entamoeba histolytica
NPVRPD

SEQ ID NO: 2644064 - protein, 8 aa, Entamoeba histolytica
NPVSSIPD

SEQ ID NO: 2644065 - protein, 7 aa, Entamoeba histolytica
NPVYDDS

SEQ ID NO: 2644066 - protein, 5 aa, Entamoeba histolytica
NPWLD

SEQ ID NO: 2644067 - protein, 20 aa, Entamoeba histolytica
NPYAQIQQQRRQQRGDRSRL

SEQ ID NO: 2644068 - protein, 11 aa, Entamoeba histolytica
NPYDKDEGSRF

SEQ ID NO: 2644069 - protein, 5 aa, Entamoeba histolytica
NPYEK

SEQ ID NO: 2644070 - protein, 6 aa, Entamoeba histolytica
NPYEPN

SEQ ID NO: 2644071 - protein, 5 aa, Entamoeba histolytica
NPYGH

SEQ ID NO: 2644072 - protein, 12 aa, Entamoeba histolytica
NPYQDKESSEMM

SEQ ID NO: 2644073 - protein, 8 aa, Entamoeba histolytica
NPYQRPTG

SEQ ID NO: 2644074 - protein, 9 aa, Entamoeba histolytica
NPYYPEKDP

SEQ ID NO: 2644075 - protein, 9 aa, Entamoeba histolytica
NQAEDETDR

SEQ ID NO: 2644076 - protein, 11 aa, Entamoeba histolytica
NQAFKNYGKSE

SEQ ID NO: 2644077 - protein, 11 aa, Entamoeba histolytica
NQAIEGRTEDW

SEQ ID NO: 2644078 - protein, 17 aa, Entamoeba histolytica
NQAKASADPNKPTDEMC

SEQ ID NO: 2644079 - protein, 13 aa, Entamoeba histolytica
NQAKEPPKQAKYI

SEQ ID NO: 2644080 - protein, 7 aa, Entamoeba histolytica
NQAKRSM

SEQ ID NO: 2644081 - protein, 8 aa, Entamoeba histolytica
NQANESSV

SEQ ID NO: 2644082 - protein, 9 aa, Entamoeba histolytica
NQANPNFGS

SEQ ID NO: 2644083 - protein, 9 aa, Entamoeba histolytica
NQAQEAERL

SEQ ID NO: 2644084 - protein, 7 aa, Entamoeba histolytica
NQASHLK

SEQ ID NO: 2644085 - protein, 7 aa, Entamoeba histolytica
NQASIPT

SEQ ID NO: 2644086 - protein, 4 aa, Entamoeba histolytica
NQCK

SEQ ID NO: 2644087 - protein, 60 aa, Entamoeba histolytica
NQCTSGNSSSKKEIKDQPKSITKQNYSKQSQPIQKPVSYETGKKKPEPKQTNTTTPVRGK

SEQ ID NO: 2644088 - protein, 8 aa, Entamoeba histolytica
NQDDEDEY

SEQ ID NO: 2644089 - protein, 13 aa, Entamoeba histolytica
NQDEQNNENKQNN

SEQ ID NO: 2644090 - protein, 8 aa, Entamoeba histolytica
NQDERKFG

SEQ ID NO: 2644091 - protein, 4 aa, Entamoeba histolytica
NQDK

SEQ ID NO: 2644092 - protein, 8 aa, Entamoeba histolytica
NQDKPDIV

SEQ ID NO: 2644093 - protein, 6 aa, Entamoeba histolytica
NQDKYR

SEQ ID NO: 2644094 - protein, 6 aa, Entamoeba histolytica
NQDNPD

SEQ ID NO: 2644095 - protein, 42 aa, Entamoeba histolytica
NQDPNDPSKRKAATPRAESSPRLGSQKEFKKDLNEVKSLRRK

SEQ ID NO: 2644096 - protein, 10 aa, Entamoeba histolytica
NQDPNKAEFD

SEQ ID NO: 2644097 - protein, 6 aa, Entamoeba histolytica
NQDTIK

SEQ ID NO: 2644098 - protein, 31 aa, Entamoeba histolytica
NQDVQRDEAIQEEQQNEQQDSSVITETKQPD

SEQ ID NO: 2644099 - protein, 4 aa, Entamoeba histolytica
NQEA

SEQ ID NO: 2644100 - protein, 12 aa, Entamoeba histolytica
NQEDFKKAKEKV

SEQ ID NO: 2644101 - protein, 5 aa, Entamoeba histolytica
NQEDI

SEQ ID NO: 2644102 - protein, 8 aa, Entamoeba histolytica
NQEDIEGA

SEQ ID NO: 2644103 - protein, 40 aa, Entamoeba histolytica
NQEDKELNKEFENESDSSSSKEERDNEEILEEEDKQELSD

SEQ ID NO: 2644104 - protein, 7 aa, Entamoeba histolytica
NQEDKKE

SEQ ID NO: 2644105 - protein, 8 aa, Entamoeba histolytica
NQEDYQPN

SEQ ID NO: 2644106 - protein, 4 aa, Entamoeba histolytica
NQEE

SEQ ID NO: 2644107 - protein, 7 aa, Entamoeba histolytica
NQEEKDT

SEQ ID NO: 2644108 - protein, 6 aa, Entamoeba histolytica
NQEESL

SEQ ID NO: 2644109 - protein, 13 aa, Entamoeba histolytica
NQEEVIGEEKGEI

SEQ ID NO: 2644110 - protein, 9 aa, Entamoeba histolytica
NQEGSPAYK

SEQ ID NO: 2644111 - protein, 15 aa, Entamoeba histolytica
NQEIPSTTSRPSTLS

SEQ ID NO: 2644112 - protein, 14 aa, Entamoeba histolytica
NQEKQQNKETIYKT

SEQ ID NO: 2644113 - protein, 33 aa, Entamoeba histolytica
NQEKQQTKKTIQQAREERKEIIKEKKKELEEQK

SEQ ID NO: 2644114 - protein, 17 aa, Entamoeba histolytica
NQEKRKTITRYQSNETQ

SEQ ID NO: 2644115 - protein, 14 aa, Entamoeba histolytica
NQEKRTIKGNKRGV

SEQ ID NO: 2644116 - protein, 10 aa, Entamoeba histolytica
NQEKTQVENE

SEQ ID NO: 2644117 - protein, 22 aa, Entamoeba histolytica
NQELNNTTQQPSIQKNKIETNP

SEQ ID NO: 2644118 - protein, 6 aa, Entamoeba histolytica
NQEMKE

SEQ ID NO: 2644119 - protein, 7 aa, Entamoeba histolytica
NQENAQH

SEQ ID NO: 2644120 - protein, 12 aa, Entamoeba histolytica
NQENDSSKFSTI

SEQ ID NO: 2644121 - protein, 8 aa, Entamoeba histolytica
NQENHSQK

SEQ ID NO: 2644122 - protein, 28 aa, Entamoeba histolytica
NQEQIKPKEELEKDSRQKVEELRGSPLE

SEQ ID NO: 2644123 - protein, 4 aa, Entamoeba histolytica
NQER

SEQ ID NO: 2644124 - protein, 10 aa, Entamoeba histolytica
NQESEPFKTE

SEQ ID NO: 2644125 - protein, 5 aa, Entamoeba histolytica
NQETQ

SEQ ID NO: 2644126 - protein, 6 aa, Entamoeba histolytica
NQETSE

SEQ ID NO: 2644127 - protein, 20 aa, Entamoeba histolytica
NQETTTAIQNGWSSISVIEL

SEQ ID NO: 2644128 - protein, 6 aa, Entamoeba histolytica
NQETVL

SEQ ID NO: 2644129 - protein, 15 aa, Entamoeba histolytica
NQEYFTTQSNNDNGV

SEQ ID NO: 2644130 - protein, 12 aa, Entamoeba histolytica
NQFDSPNQSPRL

SEQ ID NO: 2644131 - protein, 24 aa, Entamoeba histolytica
NQFEEEKKELENKLQREEKEREKL

SEQ ID NO: 2644132 - protein, 8 aa, Entamoeba histolytica
NQFKTSAD

SEQ ID NO: 2644133 - protein, 5 aa, Entamoeba histolytica
NQFNE

SEQ ID NO: 2644134 - protein, 6 aa, Entamoeba histolytica
NQFNES

SEQ ID NO: 2644135 - protein, 8 aa, Entamoeba histolytica
NQFNSEEL

SEQ ID NO: 2644136 - protein, 4 aa, Entamoeba histolytica
NQFP

SEQ ID NO: 2644137 - protein, 6 aa, Entamoeba histolytica
NQGAKK

SEQ ID NO: 2644138 - protein, 6 aa, Entamoeba histolytica
NQGEFP

SEQ ID NO: 2644139 - protein, 7 aa, Entamoeba histolytica
NQGGEQL

SEQ ID NO: 2644140 - protein, 8 aa, Entamoeba histolytica
NQGKEDEE

SEQ ID NO: 2644141 - protein, 9 aa, Entamoeba histolytica
NQGKIANNP

SEQ ID NO: 2644142 - protein, 8 aa, Entamoeba histolytica
NQGNKDNI

SEQ ID NO: 2644143 - protein, 11 aa, Entamoeba histolytica
NQGNNSILSNS

SEQ ID NO: 2644144 - protein, 18 aa, Entamoeba histolytica
NQGRQNPIDPDLPNPNDT

SEQ ID NO: 2644145 - protein, 9 aa, Entamoeba histolytica
NQGRSHPQI

SEQ ID NO: 2644146 - protein, 16 aa, Entamoeba histolytica
NQGSDQFGNEKVGGGA

SEQ ID NO: 2644147 - protein, 33 aa, Entamoeba histolytica
NQGSEQLPDDISSSFDKQAEIRRSFSSSSPNKN

SEQ ID NO: 2644148 - protein, 7 aa, Entamoeba histolytica
NQGTARA

SEQ ID NO: 2644149 - protein, 8 aa, Entamoeba histolytica
NQGYDEEH

SEQ ID NO: 2644150 - protein, 18 aa, Entamoeba histolytica
NQHKEEAANILTAIVLNV

SEQ ID NO: 2644151 - protein, 7 aa, Entamoeba histolytica
NQIDESD

SEQ ID NO: 2644152 - protein, 8 aa, Entamoeba histolytica
NQIERDND

SEQ ID NO: 2644153 - protein, 5 aa, Entamoeba histolytica
NQIES

SEQ ID NO: 2644154 - protein, 6 aa, Entamoeba histolytica
NQIGGI

SEQ ID NO: 2644155 - protein, 4 aa, Entamoeba histolytica
NQIK

SEQ ID NO: 2644156 - protein, 17 aa, Entamoeba histolytica
NQIKEEKQKTENEKNEL

SEQ ID NO: 2644157 - protein, 10 aa, Entamoeba histolytica
NQIKEEKSKL

SEQ ID NO: 2644158 - protein, 14 aa, Entamoeba histolytica
NQIKNDKEELTEKN

SEQ ID NO: 2644159 - protein, 12 aa, Entamoeba histolytica
NQIKSDDQPFKE

SEQ ID NO: 2644160 - protein, 8 aa, Entamoeba histolytica
NQIKSSSL

SEQ ID NO: 2644161 - protein, 4 aa, Entamoeba histolytica
NQIM

SEQ ID NO: 2644162 - protein, 4 aa, Entamoeba histolytica
NQIN

SEQ ID NO: 2644163 - protein, 6 aa, Entamoeba histolytica
NQINKY

SEQ ID NO: 2644164 - protein, 5 aa, Entamoeba histolytica
NQIPS

SEQ ID NO: 2644165 - protein, 14 aa, Entamoeba histolytica
NQIPSKEQLQSASA

SEQ ID NO: 2644166 - protein, 12 aa, Entamoeba histolytica
NQISNLQKEKED

SEQ ID NO: 2644167 - protein, 8 aa, Entamoeba histolytica
NQISQTYH

SEQ ID NO: 2644168 - protein, 7 aa, Entamoeba histolytica
NQISSFP

SEQ ID NO: 2644169 - protein, 4 aa, Entamoeba histolytica
NQIT

SEQ ID NO: 2644170 - protein, 5 aa, Entamoeba histolytica
NQITS

SEQ ID NO: 2644171 - protein, 15 aa, Entamoeba histolytica
NQITTISPIQENSSC

SEQ ID NO: 2644172 - protein, 11 aa, Entamoeba histolytica
NQKAEITNTSI

SEQ ID NO: 2644173 - protein, 12 aa, Entamoeba histolytica
NQKDLSSSSPLN

SEQ ID NO: 2644174 - protein, 7 aa, Entamoeba histolytica
NQKDPKV

SEQ ID NO: 2644175 - protein, 9 aa, Entamoeba histolytica
NQKESYPTI

SEQ ID NO: 2644176 - protein, 12 aa, Entamoeba histolytica
NQKGELTQRGQK

SEQ ID NO: 2644177 - protein, 11 aa, Entamoeba histolytica
NQKKDIEIETD

SEQ ID NO: 2644178 - protein, 8 aa, Entamoeba histolytica
NQKKGSMT

SEQ ID NO: 2644179 - protein, 6 aa, Entamoeba histolytica
NQKMEI

SEQ ID NO: 2644180 - protein, 8 aa, Entamoeba histolytica
NQKNEFPS

SEQ ID NO: 2644181 - protein, 8 aa, Entamoeba histolytica
NQKNENDC

SEQ ID NO: 2644182 - protein, 7 aa, Entamoeba histolytica
NQKNQSQ

SEQ ID NO: 2644183 - protein, 6 aa, Entamoeba histolytica
NQKNTP

SEQ ID NO: 2644184 - protein, 6 aa, Entamoeba histolytica
NQKNYS

SEQ ID NO: 2644185 - protein, 6 aa, Entamoeba histolytica
NQKPSK

SEQ ID NO: 2644186 - protein, 9 aa, Entamoeba histolytica
NQKPVTTTH

SEQ ID NO: 2644187 - protein, 7 aa, Entamoeba histolytica
NQKQTIE

SEQ ID NO: 2644188 - protein, 7 aa, Entamoeba histolytica
NQKRVEE

SEQ ID NO: 2644189 - protein, 8 aa, Entamoeba histolytica
NQKSELTY

SEQ ID NO: 2644190 - protein, 7 aa, Entamoeba histolytica
NQKSINE

SEQ ID NO: 2644191 - protein, 7 aa, Entamoeba histolytica
NQKSLSI

SEQ ID NO: 2644192 - protein, 10 aa, Entamoeba histolytica
NQKSQNVQAD

SEQ ID NO: 2644193 - protein, 4 aa, Entamoeba histolytica
NQKT

SEQ ID NO: 2644194 - protein, 7 aa, Entamoeba histolytica
NQKTISQ

SEQ ID NO: 2644195 - protein, 5 aa, Entamoeba histolytica
NQKVP

SEQ ID NO: 2644196 - protein, 8 aa, Entamoeba histolytica
NQKYDIKK

SEQ ID NO: 2644197 - protein, 5 aa, Entamoeba histolytica
NQKYP

SEQ ID NO: 2644198 - protein, 5 aa, Entamoeba histolytica
NQKYS

SEQ ID NO: 2644199 - protein, 18 aa, Entamoeba histolytica
NQLDKEVNVQSQQTEYKD

SEQ ID NO: 2644200 - protein, 10 aa, Entamoeba histolytica
NQLEDDNESL

SEQ ID NO: 2644201 - protein, 14 aa, Entamoeba histolytica
NQLEEEIKKKDQLI

SEQ ID NO: 2644202 - protein, 14 aa, Entamoeba histolytica
NQLENDKQLNDKEK

SEQ ID NO: 2644203 - protein, 15 aa, Entamoeba histolytica
NQLEREKRKKEKLKE

SEQ ID NO: 2644204 - protein, 4 aa, Entamoeba histolytica
NQLL

SEQ ID NO: 2644205 - protein, 17 aa, Entamoeba histolytica
NQLNEDNEALKEQVRTL

SEQ ID NO: 2644206 - protein, 5 aa, Entamoeba histolytica
NQLNQ

SEQ ID NO: 2644207 - protein, 13 aa, Entamoeba histolytica
NQLPEDQDIDEED

SEQ ID NO: 2644208 - protein, 7 aa, Entamoeba histolytica
NQLPQQD

SEQ ID NO: 2644209 - protein, 11 aa, Entamoeba histolytica
NQLQRSESQEK

SEQ ID NO: 2644210 - protein, 12 aa, Entamoeba histolytica
NQLRDKQANKLE

SEQ ID NO: 2644211 - protein, 4 aa, Entamoeba histolytica
NQLS

SEQ ID NO: 2644212 - protein, 7 aa, Entamoeba histolytica
NQLSENT

SEQ ID NO: 2644213 - protein, 13 aa, Entamoeba histolytica
NQLSPKTSGITKQ

SEQ ID NO: 2644214 - protein, 17 aa, Entamoeba histolytica
NQLTESKKTLKSPSQVQ

SEQ ID NO: 2644215 - protein, 8 aa, Entamoeba histolytica
NQMKPKRL

SEQ ID NO: 2644216 - protein, 6 aa, Entamoeba histolytica
NQMSEE

SEQ ID NO: 2644217 - protein, 59 aa, Entamoeba histolytica
NQMSEEGSMSLNSEDEMSEEEGQLSTTDSKPPKAPKSDQQKSNLPKKENLSSEDQKNIT

SEQ ID NO: 2644218 - protein, 10 aa, Entamoeba histolytica
NQMSQDNESI

SEQ ID NO: 2644219 - protein, 10 aa, Entamoeba histolytica
NQMTNSDTSL

SEQ ID NO: 2644220 - protein, 4 aa, Entamoeba histolytica
NQNC

SEQ ID NO: 2644221 - protein, 10 aa, Entamoeba histolytica
NQNEDTYNTS

SEQ ID NO: 2644222 - protein, 8 aa, Entamoeba histolytica
NQNEENKK

SEQ ID NO: 2644223 - protein, 10 aa, Entamoeba histolytica
NQNETISEQL

SEQ ID NO: 2644224 - protein, 8 aa, Entamoeba histolytica
NQNETSEL

SEQ ID NO: 2644225 - protein, 8 aa, Entamoeba histolytica
NQNGIETT

SEQ ID NO: 2644226 - protein, 6 aa, Entamoeba histolytica
NQNGII

SEQ ID NO: 2644227 - protein, 10 aa, Entamoeba histolytica
NQNHSSVERS

SEQ ID NO: 2644228 - protein, 13 aa, Entamoeba histolytica
NQNIQDEALDPKL

SEQ ID NO: 2644229 - protein, 29 aa, Entamoeba histolytica
NQNKKHGSESTFDEIGKEEAIKGKVGNNL

SEQ ID NO: 2644230 - protein, 6 aa, Entamoeba histolytica
NQNKKL

SEQ ID NO: 2644231 - protein, 16 aa, Entamoeba histolytica
NQNKTVQRRSNPMSRG

SEQ ID NO: 2644232 - protein, 22 aa, Entamoeba histolytica
NQNNEHISYSEDKSLTGTARYA

SEQ ID NO: 2644233 - protein, 7 aa, Entamoeba histolytica
NQNNPQL

SEQ ID NO: 2644234 - protein, 10 aa, Entamoeba histolytica
NQNPSIPTNV

SEQ ID NO: 2644235 - protein, 7 aa, Entamoeba histolytica
NQNRSIS

SEQ ID NO: 2644236 - protein, 5 aa, Entamoeba histolytica
NQNSP

SEQ ID NO: 2644237 - protein, 4 aa, Entamoeba histolytica
NQNT

SEQ ID NO: 2644238 - protein, 6 aa, Entamoeba histolytica
NQNTKF

SEQ ID NO: 2644239 - protein, 6 aa, Entamoeba histolytica
NQNTNS

SEQ ID NO: 2644240 - protein, 7 aa, Entamoeba histolytica
NQNTYNS

SEQ ID NO: 2644241 - protein, 4 aa, Entamoeba histolytica
NQNY

SEQ ID NO: 2644242 - protein, 6 aa, Entamoeba histolytica
NQNYNP

SEQ ID NO: 2644243 - protein, 6 aa, Entamoeba histolytica
NQPDEY

SEQ ID NO: 2644244 - protein, 8 aa, Entamoeba histolytica
NQPDKNSQ

SEQ ID NO: 2644245 - protein, 6 aa, Entamoeba histolytica
NQPDTI

SEQ ID NO: 2644246 - protein, 15 aa, Entamoeba histolytica
NQPELNDSNDSSRDT

SEQ ID NO: 2644247 - protein, 9 aa, Entamoeba histolytica
NQPENEIPK

SEQ ID NO: 2644248 - protein, 6 aa, Entamoeba histolytica
NQPESK

SEQ ID NO: 2644249 - protein, 12 aa, Entamoeba histolytica
NQPESPAFNTPV

SEQ ID NO: 2644250 - protein, 6 aa, Entamoeba histolytica
NQPIDN

SEQ ID NO: 2644251 - protein, 9 aa, Entamoeba histolytica
NQPKEEYNE

SEQ ID NO: 2644252 - protein, 29 aa, Entamoeba histolytica
NQPKETKRQKTPKPTDQISYTPPKQINKP

SEQ ID NO: 2644253 - protein, 8 aa, Entamoeba histolytica
NQPKYRND

SEQ ID NO: 2644254 - protein, 5 aa, Entamoeba histolytica
NQPLQ

SEQ ID NO: 2644255 - protein, 15 aa, Entamoeba histolytica
NQPLSQNTVVDKSKI

SEQ ID NO: 2644256 - protein, 9 aa, Entamoeba histolytica
NQPNENDIK

SEQ ID NO: 2644257 - protein, 7 aa, Entamoeba histolytica
NQPNEYH

SEQ ID NO: 2644258 - protein, 18 aa, Entamoeba histolytica
NQPQYPVDAANQQYPGYP

SEQ ID NO: 2644259 - protein, 19 aa, Entamoeba histolytica
NQPSNTTVSQSPKPSSSAS

SEQ ID NO: 2644260 - protein, 7 aa, Entamoeba histolytica
NQPSNVQ

SEQ ID NO: 2644261 - protein, 5 aa, Entamoeba histolytica
NQPSQ

SEQ ID NO: 2644262 - protein, 5 aa, Entamoeba histolytica
NQPTD

SEQ ID NO: 2644263 - protein, 9 aa, Entamoeba histolytica
NQPTDENEL

SEQ ID NO: 2644264 - protein, 7 aa, Entamoeba histolytica
NQPTKAE

SEQ ID NO: 2644265 - protein, 17 aa, Entamoeba histolytica
NQPTNELISPSQNQNSL

SEQ ID NO: 2644266 - protein, 7 aa, Entamoeba histolytica
NQPTSLT

SEQ ID NO: 2644267 - protein, 9 aa, Entamoeba histolytica
NQQDKDGNT

SEQ ID NO: 2644268 - protein, 13 aa, Entamoeba histolytica
NQQEEEQSENQSI

SEQ ID NO: 2644269 - protein, 6 aa, Entamoeba histolytica
NQQETI

SEQ ID NO: 2644270 - protein, 8 aa, Entamoeba histolytica
NQQETTFT

SEQ ID NO: 2644271 - protein, 4 aa, Entamoeba histolytica
NQQI

SEQ ID NO: 2644272 - protein, 10 aa, Entamoeba histolytica
NQQKLSKTTP

SEQ ID NO: 2644273 - protein, 6 aa, Entamoeba histolytica
NQQKNQ

SEQ ID NO: 2644274 - protein, 36 aa, Entamoeba histolytica
NQQLVNQDDNKIDDFDQSEKDKSEKSTEKLNSNDKQ

SEQ ID NO: 2644275 - protein, 6 aa, Entamoeba histolytica
NQQNEL

SEQ ID NO: 2644276 - protein, 7 aa, Entamoeba histolytica
NQQNGIS

SEQ ID NO: 2644277 - protein, 13 aa, Entamoeba histolytica
NQQNISDKTNGNI

SEQ ID NO: 2644278 - protein, 5 aa, Entamoeba histolytica
NQQNL

SEQ ID NO: 2644279 - protein, 19 aa, Entamoeba histolytica
NQQNTSSTTMSNGNDAAMS

SEQ ID NO: 2644280 - protein, 8 aa, Entamoeba histolytica
NQQPFGFG

SEQ ID NO: 2644281 - protein, 9 aa, Entamoeba histolytica
NQQPPLSGI

SEQ ID NO: 2644282 - protein, 56 aa, Entamoeba histolytica
NQQPPVSSSNQQQEQKEQQPKEDNIPKNTEEKKDSHETHSNEQEHSQNTRHEEPNP

SEQ ID NO: 2644283 - protein, 6 aa, Entamoeba histolytica
NQQQSF

SEQ ID NO: 2644284 - protein, 6 aa, Entamoeba histolytica
NQQQTG

SEQ ID NO: 2644285 - protein, 18 aa, Entamoeba histolytica
NQQSISSKPKRSFFSFGK

SEQ ID NO: 2644286 - protein, 6 aa, Entamoeba histolytica
NQQSSQ

SEQ ID NO: 2644287 - protein, 8 aa, Entamoeba histolytica
NQQTFNST

SEQ ID NO: 2644288 - protein, 5 aa, Entamoeba histolytica
NQQTT

SEQ ID NO: 2644289 - protein, 23 aa, Entamoeba histolytica
NQRCYDSKRSVSNSESSSIDPQE

SEQ ID NO: 2644290 - protein, 4 aa, Entamoeba histolytica
NQRD

SEQ ID NO: 2644291 - protein, 15 aa, Entamoeba histolytica
NQREKHSTSLPKVAD

SEQ ID NO: 2644292 - protein, 8 aa, Entamoeba histolytica
NQRENKEI

SEQ ID NO: 2644293 - protein, 20 aa, Entamoeba histolytica
NQRHEMKEEKNLKYKTAYTN

SEQ ID NO: 2644294 - protein, 10 aa, Entamoeba histolytica
NQRHNTQTLQ

SEQ ID NO: 2644295 - protein, 11 aa, Entamoeba histolytica
NQRISSSKTIE

SEQ ID NO: 2644296 - protein, 41 aa, Entamoeba histolytica
NQRKNQKECTNSPETTPPQSSPHENWKQPINKTKKSFTTTQ

SEQ ID NO: 2644297 - protein, 7 aa, Entamoeba histolytica
NQRNEEL

SEQ ID NO: 2644298 - protein, 9 aa, Entamoeba histolytica
NQRNEQNEI

SEQ ID NO: 2644299 - protein, 9 aa, Entamoeba histolytica
NQRNQISSE

SEQ ID NO: 2644300 - protein, 8 aa, Entamoeba histolytica
NQRQKIDD

SEQ ID NO: 2644301 - protein, 7 aa, Entamoeba histolytica
NQRQQEA

SEQ ID NO: 2644302 - protein, 8 aa, Entamoeba histolytica
NQSDSLKK

SEQ ID NO: 2644303 - protein, 12 aa, Entamoeba histolytica
NQSEAEKQQNIS

SEQ ID NO: 2644304 - protein, 28 aa, Entamoeba histolytica
NQSEKSEKKEDEEPKSIQTSYELPTNPV

SEQ ID NO: 2644305 - protein, 7 aa, Entamoeba histolytica
NQSENDY

SEQ ID NO: 2644306 - protein, 7 aa, Entamoeba histolytica
NQSERSR

SEQ ID NO: 2644307 - protein, 7 aa, Entamoeba histolytica
NQSERVK

SEQ ID NO: 2644308 - protein, 5 aa, Entamoeba histolytica
NQSES

SEQ ID NO: 2644309 - protein, 4 aa, Entamoeba histolytica
NQSF

SEQ ID NO: 2644310 - protein, 13 aa, Entamoeba histolytica
NQSFDDESIDQND

SEQ ID NO: 2644311 - protein, 10 aa, Entamoeba histolytica
NQSFNDYSQP

SEQ ID NO: 2644312 - protein, 6 aa, Entamoeba histolytica
NQSGFD

SEQ ID NO: 2644313 - protein, 10 aa, Entamoeba histolytica
NQSGKEKGRI

SEQ ID NO: 2644314 - protein, 7 aa, Entamoeba histolytica
NQSGRRK

SEQ ID NO: 2644315 - protein, 4 aa, Entamoeba histolytica
NQSI

SEQ ID NO: 2644316 - protein, 7 aa, Entamoeba histolytica
NQSIGRT

SEQ ID NO: 2644317 - protein, 12 aa, Entamoeba histolytica
NQSISANNESGI

SEQ ID NO: 2644318 - protein, 5 aa, Entamoeba histolytica
NQSKI

SEQ ID NO: 2644319 - protein, 4 aa, Entamoeba histolytica
NQSL

SEQ ID NO: 2644320 - protein, 4 aa, Entamoeba histolytica
NQSN

SEQ ID NO: 2644321 - protein, 8 aa, Entamoeba histolytica
NQSNERCG

SEQ ID NO: 2644322 - protein, 65 aa, Entamoeba histolytica
NQSPPLQKKSKEGTSSLENSKDDDNSEHTEEDSFVSSQTESYSSQSSYSSQSSQNSETSNDSMEQ

SEQ ID NO: 2644323 - protein, 6 aa, Entamoeba histolytica
NQSPSP

SEQ ID NO: 2644324 - protein, 10 aa, Entamoeba histolytica
NQSQEEAKKT

SEQ ID NO: 2644325 - protein, 10 aa, Entamoeba histolytica
NQSQKEKREI

SEQ ID NO: 2644326 - protein, 29 aa, Entamoeba histolytica
NQSSDNLTPRSKKDHELKEKEEELKQREE

SEQ ID NO: 2644327 - protein, 8 aa, Entamoeba histolytica
NQSSEENG

SEQ ID NO: 2644328 - protein, 11 aa, Entamoeba histolytica
NQSSEFLPTSS

SEQ ID NO: 2644329 - protein, 13 aa, Entamoeba histolytica
NQSSKKSSKKCAL

SEQ ID NO: 2644330 - protein, 8 aa, Entamoeba histolytica
NQSSPDSI

SEQ ID NO: 2644331 - protein, 7 aa, Entamoeba histolytica
NQSSSFK

SEQ ID NO: 2644332 - protein, 27 aa, Entamoeba histolytica
NQSSSQEKRIESKPIKEQSNKTKRVKK

SEQ ID NO: 2644333 - protein, 18 aa, Entamoeba histolytica
NQSSTNSIIKERTSSSHI

SEQ ID NO: 2644334 - protein, 19 aa, Entamoeba histolytica
NQSTDEGVKITSKRAPKRI

SEQ ID NO: 2644335 - protein, 46 aa, Entamoeba histolytica; identical to SEQ ID NO: 2449299

SEQ ID NO: 2644336 - protein, 17 aa, Entamoeba histolytica
NQTAARKTGDAQLPVDQ

SEQ ID NO: 2644337 - protein, 49 aa, Entamoeba histolytica
NQTAQLNQTQINPQQPTQITQTQQRIPAPIQPNFKQRNQQEFQTSQNIS

SEQ ID NO: 2644338 - protein, 5 aa, Entamoeba histolytica
NQTDP

SEQ ID NO: 2644339 - protein, 6 aa, Entamoeba histolytica
NQTEDI

SEQ ID NO: 2644340 - protein, 52 aa, Entamoeba histolytica
NQTEITPADIDYDDKTSRQLVPEHKNAAATRTGLPDAIDQSTIPSSNNDIAE

SEQ ID NO: 2644341 - protein, 5 aa, Entamoeba histolytica
NQTES

SEQ ID NO: 2644342 - protein, 5 aa, Entamoeba histolytica
NQTGK

SEQ ID NO: 2644343 - protein, 7 aa, Entamoeba histolytica
NQTIGSS

SEQ ID NO: 2644344 - protein, 19 aa, Entamoeba histolytica
NQTIKKAYNATRKQHTNSE

SEQ ID NO: 2644345 - protein, 5 aa, Entamoeba histolytica
NQTIN

SEQ ID NO: 2644346 - protein, 31 aa, Entamoeba histolytica
NQTKDINDTPLTDSLQQDTTATASTLFSNSV

SEQ ID NO: 2644347 - protein, 12 aa, Entamoeba histolytica
NQTKGRGRENRV

SEQ ID NO: 2644348 - protein, 5 aa, Entamoeba histolytica
NQTLG

SEQ ID NO: 2644349 - protein, 8 aa, Entamoeba histolytica
NQTLSELE

SEQ ID NO: 2644350 - protein, 6 aa, Entamoeba histolytica
NQTNEK

SEQ ID NO: 2644351 - protein, 12 aa, Entamoeba histolytica
NQTNIDNEQYDY

SEQ ID NO: 2644352 - protein, 6 aa, Entamoeba histolytica
NQTNNL

SEQ ID NO: 2644353 - protein, 15 aa, Entamoeba histolytica
NQTNPQTENAMEEEN

SEQ ID NO: 2644354 - protein, 7 aa, Entamoeba histolytica
NQTNQSL

SEQ ID NO: 2644355 - protein, 12 aa, Entamoeba histolytica
NQTNTINELQPN

SEQ ID NO: 2644356 - protein, 5 aa, Entamoeba histolytica
NQTNV

SEQ ID NO: 2644357 - protein, 169 aa, Entamoeba histolytica
NQTPSSNTITPGNNTTTTTGSNPFGNFTTTNNTTSSTTSTGTTITTGSNPFGNFTPSNSAPTTGNNTTGTTTTTGNNTTSTGSNPFGNFTTSNSTTTTGTTTTTGNNTTTGTTTTTGSNPFGNFNTNNTTSNASTTPTTGSNPFGNFTTSNTTPTTGTTTTTGSNPFGN

SEQ ID NO: 2644358 - protein, 16 aa, Entamoeba histolytica
NQTPSTTNSKKDSKCD

SEQ ID NO: 2644359 - protein, 5 aa, Entamoeba histolytica
NQTQS

SEQ ID NO: 2644360 - protein, 7 aa, Entamoeba histolytica
NQTRYSD

SEQ ID NO: 2644361 - protein, 38 aa, Entamoeba histolytica; identical to SEQ ID NO: 2449322

SEQ ID NO: 2644362 - protein, 14 aa, Entamoeba histolytica
NQTTPFKTTCSGTS

SEQ ID NO: 2644363 - protein, 5 aa, Entamoeba histolytica
NQTVN

SEQ ID NO: 2644364 - protein, 8 aa, Entamoeba histolytica
NQTVPQGL

SEQ ID NO: 2644365 - protein, 14 aa, Entamoeba histolytica
NQVEEIKGELSESK

SEQ ID NO: 2644366 - protein, 14 aa, Entamoeba histolytica
NQVNDTEKDINKEG

SEQ ID NO: 2644367 - protein, 8 aa, Entamoeba histolytica
NQVNNDNH

SEQ ID NO: 2644368 - protein, 12 aa, Entamoeba histolytica
NQVRTTNSNIAS

SEQ ID NO: 2644369 - protein, 4 aa, Entamoeba histolytica
NQVT

SEQ ID NO: 2644370 - protein, 15 aa, Entamoeba histolytica
NQVTSEARGRPNSEM

SEQ ID NO: 2644371 - protein, 10 aa, Entamoeba histolytica
NQVTTAKEKY

SEQ ID NO: 2644372 - protein, 6 aa, Entamoeba histolytica
NQYDEK

SEQ ID NO: 2644373 - protein, 21 aa, Entamoeba histolytica
NQYEEIKNNTLKKYKKPPLSA

SEQ ID NO: 2644374 - protein, 6 aa, Entamoeba histolytica
NQYGEQ

SEQ ID NO: 2644375 - protein, 5 aa, Entamoeba histolytica
NQYGP

SEQ ID NO: 2644376 - protein, 22 aa, Entamoeba histolytica
NQYGTFKDSRELSFDQDNAQNV

SEQ ID NO: 2644377 - protein, 10 aa, Entamoeba histolytica
NQYKEKRERC

SEQ ID NO: 2644378 - protein, 7 aa, Entamoeba histolytica
NQYKELE

SEQ ID NO: 2644379 - protein, 27 aa, Entamoeba histolytica
NQYPNAYEQTASQEEGTEAPPPVPAPR

SEQ ID NO: 2644380 - protein, 23 aa, Entamoeba histolytica
NQYPPASIYSSTEEYRKQAVSNE

SEQ ID NO: 2644381 - protein, 7 aa, Entamoeba histolytica
NQYPSYQ

SEQ ID NO: 2644382 - protein, 6 aa, Entamoeba histolytica
NQYSGQ

SEQ ID NO: 2644383 - protein, 8 aa, Entamoeba histolytica
NQYSPSKT

SEQ ID NO: 2644384 - protein, 8 aa, Entamoeba histolytica
NQYSSTFA

SEQ ID NO: 2644385 - protein, 5 aa, Entamoeba histolytica
NQYSV

SEQ ID NO: 2644386 - protein, 8 aa, Entamoeba histolytica
NRADSLDP

SEQ ID NO: 2644387 - protein, 16 aa, Entamoeba histolytica
NRAIKNTTSILSVRLL

SEQ ID NO: 2644388 - protein, 10 aa, Entamoeba histolytica
NRAKGERDKL

SEQ ID NO: 2644389 - protein, 8 aa, Entamoeba histolytica
NRAKTNLT

SEQ ID NO: 2644390 - protein, 4 aa, Entamoeba histolytica
NRAS

SEQ ID NO: 2644391 - protein, 6 aa, Entamoeba histolytica
NRCEQQ

SEQ ID NO: 2644392 - protein, 6 aa, Entamoeba histolytica
NRDAFS

SEQ ID NO: 2644393 - protein, 4 aa, Entamoeba histolytica
NRDD

SEQ ID NO: 2644394 - protein, 6 aa, Entamoeba histolytica
NRDEEW

SEQ ID NO: 2644395 - protein, 10 aa, Entamoeba histolytica
NRDEKVKTYC

SEQ ID NO: 2644396 - protein, 9 aa, Entamoeba histolytica
NRDERDDDY

SEQ ID NO: 2644397 - protein, 5 aa, Entamoeba histolytica
NRDGH

SEQ ID NO: 2644398 - protein, 10 aa, Entamoeba histolytica
NRDGTNIKSM

SEQ ID NO: 2644399 - protein, 11 aa, Entamoeba histolytica
NRDINPEINDN

SEQ ID NO: 2644400 - protein, 9 aa, Entamoeba histolytica
NRDKAEELA

SEQ ID NO: 2644401 - protein, 5 aa, Entamoeba histolytica
NRDNN

SEQ ID NO: 2644402 - protein, 5 aa, Entamoeba histolytica
NRDNV

SEQ ID NO: 2644403 - protein, 14 aa, Entamoeba histolytica
NRDRVKADGHTGNE

SEQ ID NO: 2644404 - protein, 4 aa, Entamoeba histolytica
NRDS

SEQ ID NO: 2644405 - protein, 12 aa, Entamoeba histolytica
NRDSLNKGKPIK

SEQ ID NO: 2644406 - protein, 6 aa, Entamoeba histolytica
NRDSLS

SEQ ID NO: 2644407 - protein, 8 aa, Entamoeba histolytica
NREENNQF

SEQ ID NO: 2644408 - protein, 7 aa, Entamoeba histolytica
NREERKS

SEQ ID NO: 2644409 - protein, 9 aa, Entamoeba histolytica
NREESTNYL

SEQ ID NO: 2644410 - protein, 6 aa, Entamoeba histolytica
NREGMK

SEQ ID NO: 2644411 - protein, 6 aa, Entamoeba histolytica
NRELHS

SEQ ID NO: 2644412 - protein, 5 aa, Entamoeba histolytica
NRELK

SEQ ID NO: 2644413 - protein, 10 aa, Entamoeba histolytica
NRENKKEEQM

SEQ ID NO: 2644414 - protein, 24 aa, Entamoeba histolytica
NRENKKRSNKNNEEKKPKREEEKI

SEQ ID NO: 2644415 - protein, 7 aa, Entamoeba histolytica
NRENPEV

SEQ ID NO: 2644416 - protein, 6 aa, Entamoeba histolytica
NRETNQ

SEQ ID NO: 2644417 - protein, 13 aa, Entamoeba histolytica
NREVSTESNSSFY

SEQ ID NO: 2644418 - protein, 5 aa, Entamoeba histolytica
NRFNS

SEQ ID NO: 2644419 - protein, 6 aa, Entamoeba histolytica
NRFSEP

SEQ ID NO: 2644420 - protein, 7 aa, Entamoeba histolytica
NRFTPET

SEQ ID NO: 2644421 - protein, 4 aa, Entamoeba histolytica
NRFV

SEQ ID NO: 2644422 - protein, 4 aa, Entamoeba histolytica
NRGE

SEQ ID NO: 2644423 - protein, 14 aa, Entamoeba histolytica
NRGEGAMDKEKYGD

SEQ ID NO: 2644424 - protein, 5 aa, Entamoeba histolytica
NRGEK

SEQ ID NO: 2644425 - protein, 5 aa, Entamoeba histolytica
NRGHT

SEQ ID NO: 2644426 - protein, 4 aa, Entamoeba histolytica
NRGI

SEQ ID NO: 2644427 - protein, 4 aa, Entamoeba histolytica
NRGN

SEQ ID NO: 2644428 - protein, 11 aa, Entamoeba histolytica
NRGNKKYGYRD

SEQ ID NO: 2644429 - protein, 19 aa, Entamoeba histolytica
NRGNVKIRGTEEISPHGIP

SEQ ID NO: 2644430 - protein, 37 aa, Entamoeba histolytica
NRGTCKEEISEDDGYGETQEEVSKPTEIEENDDELGN

SEQ ID NO: 2644431 - protein, 7 aa, Entamoeba histolytica
NRGTREQ

SEQ ID NO: 2644432 - protein, 7 aa, Entamoeba histolytica
NRHEKQD

SEQ ID NO: 2644433 - protein, 11 aa, Entamoeba histolytica
NRHVNEESSEA

SEQ ID NO: 2644434 - protein, 4 aa, Entamoeba histolytica
NRID

SEQ ID NO: 2644435 - protein, 5 aa, Entamoeba histolytica
NRIDE

SEQ ID NO: 2644436 - protein, 33 aa, Entamoeba histolytica
NRIDEEENKIKSERKELEERIQKGEEDTEQYER

SEQ ID NO: 2644437 - protein, 5 aa, Entamoeba histolytica
NRIDK

SEQ ID NO: 2644438 - protein, 14 aa, Entamoeba histolytica
NRIDSENSSTIDKL

SEQ ID NO: 2644439 - protein, 8 aa, Entamoeba histolytica
NRIEPTEY

SEQ ID NO: 2644440 - protein, 6 aa, Entamoeba histolytica
NRINSG

SEQ ID NO: 2644441 - protein, 18 aa, Entamoeba histolytica
NRIPPSQVDKWASQCIES

SEQ ID NO: 2644442 - protein, 4 aa, Entamoeba histolytica
NRIQ

SEQ ID NO: 2644443 - protein, 21 aa, Entamoeba histolytica
NRIQTSSSFSAGKNGRIKTET

SEQ ID NO: 2644444 - protein, 8 aa, Entamoeba histolytica
NRISDEIR

SEQ ID NO: 2644445 - protein, 5 aa, Entamoeba histolytica
NRITQ

SEQ ID NO: 2644446 - protein, 6 aa, Entamoeba histolytica
NRKAAE

SEQ ID NO: 2644447 - protein, 7 aa, Entamoeba histolytica
NRKAPSI

SEQ ID NO: 2644448 - protein, 7 aa, Entamoeba histolytica
NRKEETI

SEQ ID NO: 2644449 - protein, 5 aa, Entamoeba histolytica
NRKEL

SEQ ID NO: 2644450 - protein, 9 aa, Entamoeba histolytica
NRKENEQEV

SEQ ID NO: 2644451 - protein, 7 aa, Entamoeba histolytica
NRKISEK

SEQ ID NO: 2644452 - protein, 4 aa, Entamoeba histolytica
NRKK

SEQ ID NO: 2644453 - protein, 12 aa, Entamoeba histolytica
NRKKFEEETETF

SEQ ID NO: 2644454 - protein, 6 aa, Entamoeba histolytica
NRKMQH

SEQ ID NO: 2644455 - protein, 7 aa, Entamoeba histolytica
NRKNPIT

SEQ ID NO: 2644456 - protein, 9 aa, Entamoeba histolytica
NRKNYSPGD

SEQ ID NO: 2644457 - protein, 9 aa, Entamoeba histolytica
NRKTKSTSC

SEQ ID NO: 2644458 - protein, 10 aa, Entamoeba histolytica
NRLDCPENVS

SEQ ID NO: 2644459 - protein, 5 aa, Entamoeba histolytica
NRLDP

SEQ ID NO: 2644460 - protein, 14 aa, Entamoeba histolytica
NRLDSSLRKTDSKN

SEQ ID NO: 2644461 - protein, 12 aa, Entamoeba histolytica
NRLGEEKVKSYD

SEQ ID NO: 2644462 - protein, 7 aa, Entamoeba histolytica
NRLGTET

SEQ ID NO: 2644463 - protein, 20 aa, Entamoeba histolytica
NRLKQKDISTREKRLDTEMS

SEQ ID NO: 2644464 - protein, 14 aa, Entamoeba histolytica
NRLNPNGKLETEYD

SEQ ID NO: 2644465 - protein, 6 aa, Entamoeba histolytica
NRLPES

SEQ ID NO: 2644466 - protein, 5 aa, Entamoeba histolytica
NRLSD

SEQ ID NO: 2644467 - protein, 15 aa, Entamoeba histolytica
NRLSGGGTESSGSYK

SEQ ID NO: 2644468 - protein, 14 aa, Entamoeba histolytica
NRLSGTSKPSDDGI

SEQ ID NO: 2644469 - protein, 7 aa, Entamoeba histolytica
NRMEKDE

SEQ ID NO: 2644470 - protein, 6 aa, Entamoeba histolytica
NRMQKD

SEQ ID NO: 2644471 - protein, 23 aa, Entamoeba histolytica
NRNEHTEEEEENEEDNEKIQTDG

SEQ ID NO: 2644472 - protein, 57 aa, Entamoeba histolytica
NRNEKVKDYNSYYNERRKSRSRSRSRGRSNHNDTYRDRYSRSERDYYRDRGYEDKRR

SEQ ID NO: 2644473 - protein, 10 aa, Entamoeba histolytica
NRNEQVGNDL

SEQ ID NO: 2644474 - protein, 5 aa, Entamoeba histolytica
NRNFS

SEQ ID NO: 2644475 - protein, 7 aa, Entamoeba histolytica
NRNGLID

SEQ ID NO: 2644476 - protein, 5 aa, Entamoeba histolytica
NRNLK

SEQ ID NO: 2644477 - protein, 7 aa, Entamoeba histolytica
NRNLPSM

SEQ ID NO: 2644478 - protein, 4 aa, Entamoeba histolytica
NRNN

SEQ ID NO: 2644479 - protein, 8 aa, Entamoeba histolytica
NRNNDETD

SEQ ID NO: 2644480 - protein, 22 aa, Entamoeba histolytica
NRNPHSSPKLLSSQNSKRKSII

SEQ ID NO: 2644481 - protein, 4 aa, Entamoeba histolytica
NRNY

SEQ ID NO: 2644482 - protein, 7 aa, Entamoeba histolytica
NRNYQSK

SEQ ID NO: 2644483 - protein, 6 aa, Entamoeba histolytica
NRPAYY

SEQ ID NO: 2644484 - protein, 5 aa, Entamoeba histolytica
NRPDC

SEQ ID NO: 2644485 - protein, 5 aa, Entamoeba histolytica
NRPDL

SEQ ID NO: 2644486 - protein, 10 aa, Entamoeba histolytica
NRPEETDQQL

SEQ ID NO: 2644487 - protein, 5 aa, Entamoeba histolytica
NRPEI

SEQ ID NO: 2644488 - protein, 8 aa, Entamoeba histolytica
NRPFKTPR

SEQ ID NO: 2644489 - protein, 30 aa, Entamoeba histolytica
NRPIVGGGTAINPDEIQSRRSSSCCSCCVI

SEQ ID NO: 2644490 - protein, 5 aa, Entamoeba histolytica
NRPKG

SEQ ID NO: 2644491 - protein, 5 aa, Entamoeba histolytica
NRPKR

SEQ ID NO: 2644492 - protein, 5 aa, Entamoeba histolytica
NRPME

SEQ ID NO: 2644493 - protein, 15 aa, Entamoeba histolytica
NRPPPTLSTPEEVSK

SEQ ID NO: 2644494 - protein, 6 aa, Entamoeba histolytica
NRPPTI

SEQ ID NO: 2644495 - protein, 5 aa, Entamoeba histolytica
NRPVR

SEQ ID NO: 2644496 - protein, 8 aa, Entamoeba histolytica
NRQASVDE

SEQ ID NO: 2644497 - protein, 5 aa, Entamoeba histolytica
NRQEN

SEQ ID NO: 2644498 - protein, 5 aa, Entamoeba histolytica
NRQFQ

SEQ ID NO: 2644499 - protein, 5 aa, Entamoeba histolytica
NRQNQ

SEQ ID NO: 2644500 - protein, 8 aa, Entamoeba histolytica
NRQPTLHK

SEQ ID NO: 2644501 - protein, 5 aa, Entamoeba histolytica
NRQQA

SEQ ID NO: 2644502 - protein, 10 aa, Entamoeba histolytica
NRQTDELGAY

SEQ ID NO: 2644503 - protein, 9 aa, Entamoeba histolytica
NRQWNGEIN

SEQ ID NO: 2644504 - protein, 13 aa, Entamoeba histolytica
NRRASDEKATAST

SEQ ID NO: 2644505 - protein, 8 aa, Entamoeba histolytica
NRRDERKQ

SEQ ID NO: 2644506 - protein, 18 aa, Entamoeba histolytica
NRRGKKSNDDEPTGEAES

SEQ ID NO: 2644507 - protein, 13 aa, Entamoeba histolytica
NRRNTRQKERRIQ

SEQ ID NO: 2644508 - protein, 5 aa, Entamoeba histolytica
NRRQT

SEQ ID NO: 2644509 - protein, 9 aa, Entamoeba histolytica
NRRSNTPIQ

SEQ ID NO: 2644510 - protein, 8 aa, Entamoeba histolytica
NRRTGEKK

SEQ ID NO: 2644511 - protein, 7 aa, Entamoeba histolytica
NRRTPLG

SEQ ID NO: 2644512 - protein, 9 aa, Entamoeba histolytica
NRSGEGDNI

SEQ ID NO: 2644513 - protein, 9 aa, Entamoeba histolytica
NRSGKELTV

SEQ ID NO: 2644514 - protein, 13 aa, Entamoeba histolytica
NRSKESYSRKKHE

SEQ ID NO: 2644515 - protein, 12 aa, Entamoeba histolytica
NRSLEEKRKTIR

SEQ ID NO: 2644516 - protein, 8 aa, Entamoeba histolytica
NRSNEDQA

SEQ ID NO: 2644517 - protein, 12 aa, Entamoeba histolytica
NRSQNTYEVSPQ

SEQ ID NO: 2644518 - protein, 7 aa, Entamoeba histolytica
NRSRASC

SEQ ID NO: 2644519 - protein, 10 aa, Entamoeba histolytica
NRSSINKPLP

SEQ ID NO: 2644520 - protein, 6 aa, Entamoeba histolytica
NRSYRD

SEQ ID NO: 2644521 - protein, 8 aa, Entamoeba histolytica
NRTEEIEG

SEQ ID NO: 2644522 - protein, 10 aa, Entamoeba histolytica
NRTFEKPEQI

SEQ ID NO: 2644523 - protein, 4 aa, Entamoeba histolytica
NRTH

SEQ ID NO: 2644524 - protein, 9 aa, Entamoeba histolytica
NRTITGTEN

SEQ ID NO: 2644525 - protein, 8 aa, Entamoeba histolytica
NRTKTTGI

SEQ ID NO: 2644526 - protein, 7 aa, Entamoeba histolytica
NRTNESF

SEQ ID NO: 2644527 - protein, 8 aa, Entamoeba histolytica
NRTNGGLA

SEQ ID NO: 2644528 - protein, 14 aa, Entamoeba histolytica
NRTPVPMRNPEERI

SEQ ID NO: 2644529 - protein, 5 aa, Entamoeba histolytica
NRTTF

SEQ ID NO: 2644530 - protein, 9 aa, Entamoeba histolytica
NRTTTISSQ

SEQ ID NO: 2644531 - protein, 4 aa, Entamoeba histolytica
NRTY

SEQ ID NO: 2644532 - protein, 5 aa, Entamoeba histolytica
NRTYE

SEQ ID NO: 2644533 - protein, 9 aa, Entamoeba histolytica
NRVARNNEV

SEQ ID NO: 2644534 - protein, 9 aa, Entamoeba histolytica
NRVDQSRDA

SEQ ID NO: 2644535 - protein, 4 aa, Entamoeba histolytica
NRVE

SEQ ID NO: 2644536 - protein, 17 aa, Entamoeba histolytica
NRVEDKEDKIKNLVKEW

SEQ ID NO: 2644537 - protein, 10 aa, Entamoeba histolytica
NRVEEGDVTL

SEQ ID NO: 2644538 - protein, 4 aa, Entamoeba histolytica
NRVQ

SEQ ID NO: 2644539 - protein, 6 aa, Entamoeba histolytica
NRVTTI

SEQ ID NO: 2644540 - protein, 5 aa, Entamoeba histolytica
NRYGT

SEQ ID NO: 2644541 - protein, 5 aa, Entamoeba histolytica
NRYNE

SEQ ID NO: 2644542 - protein, 5 aa, Entamoeba histolytica
NRYSP

SEQ ID NO: 2644543 - protein, 16 aa, Entamoeba histolytica
NSAASGVKKRKSWTEE

SEQ ID NO: 2644544 - protein, 9 aa, Entamoeba histolytica
NSADEHSEQ

SEQ ID NO: 2644545 - protein, 9 aa, Entamoeba histolytica
NSAEEGKSI

SEQ ID NO: 2644546 - protein, 10 aa, Entamoeba histolytica
NSAGTSHKGK

SEQ ID NO: 2644547 - protein, 6 aa, Entamoeba histolytica
NSAHQR

SEQ ID NO: 2644548 - protein, 12 aa, Entamoeba histolytica
NSAHSPRTYRSH

SEQ ID NO: 2644549 - protein, 4 aa, Entamoeba histolytica
NSAI

SEQ ID NO: 2644550 - protein, 31 aa, Entamoeba histolytica
NSAISQKTLSTNPFSDSSENDDNKQQNEESL

SEQ ID NO: 2644551 - protein, 9 aa, Entamoeba histolytica
NSAKNEANN

SEQ ID NO: 2644552 - protein, 4 aa, Entamoeba histolytica
NSAL

SEQ ID NO: 2644553 - protein, 6 aa, Entamoeba histolytica
NSALRP

SEQ ID NO: 2644554 - protein, 19 aa, Entamoeba histolytica
NSALYKGSRQNQDASGSLY

SEQ ID NO: 2644555 - protein, 6 aa, Entamoeba histolytica
NSANET

SEQ ID NO: 2644556 - protein, 12 aa, Entamoeba histolytica
NSANKTKELQQQ

SEQ ID NO: 2644557 - protein, 9 aa, Entamoeba histolytica
NSANTRGKI

SEQ ID NO: 2644558 - protein, 11 aa, Entamoeba histolytica
NSARKELAEIG

SEQ ID NO: 2644559 - protein, 5 aa, Entamoeba histolytica
NSASG

SEQ ID NO: 2644560 - protein, 25 aa, Entamoeba histolytica
NSASMTPDGSICSSKSSIGSHNTCQ

SEQ ID NO: 2644561 - protein, 9 aa, Entamoeba histolytica
NSASYGSCT

SEQ ID NO: 2644562 - protein, 7 aa, Entamoeba histolytica
NSATHLG

SEQ ID NO: 2644563 - protein, 9 aa, Entamoeba histolytica
NSATQTKEF

SEQ ID NO: 2644564 - protein, 8 aa, Entamoeba histolytica
NSCISNEQ

SEQ ID NO: 2644565 - protein, 9 aa, Entamoeba histolytica
NSCNDGIST

SEQ ID NO: 2644566 - protein, 16 aa, Entamoeba histolytica
NSCNQNKSQPETMSDE

SEQ ID NO: 2644567 - protein, 5 aa, Entamoeba histolytica
NSCPR

SEQ ID NO: 2644568 - protein, 16 aa, Entamoeba histolytica
NSCTKVTGNSLDPTSI

SEQ ID NO: 2644569 - protein, 15 aa, Entamoeba histolytica
NSDALKKAVQQQKTS

SEQ ID NO: 2644570 - protein, 6 aa, Entamoeba histolytica
NSDALQ

SEQ ID NO: 2644571 - protein, 11 aa, Entamoeba histolytica
NSDDADPATRL

SEQ ID NO: 2644572 - protein, 7 aa, Entamoeba histolytica
NSDFDED

SEQ ID NO: 2644573 - protein, 9 aa, Entamoeba histolytica
NSDGNGIPV

SEQ ID NO: 2644574 - protein, 6 aa, Entamoeba histolytica
NSDHTQ

SEQ ID NO: 2644575 - protein, 4 aa, Entamoeba histolytica
NSDI

SEQ ID NO: 2644576 - protein, 6 aa, Entamoeba histolytica
NSDITS

SEQ ID NO: 2644577 - protein, 9 aa, Entamoeba histolytica
NSDKGCSDK

SEQ ID NO: 2644578 - protein, 14 aa, Entamoeba histolytica
NSDKIKNDDERQDL

SEQ ID NO: 2644579 - protein, 11 aa, Entamoeba histolytica
NSDKSEWIEEE

SEQ ID NO: 2644580 - protein, 14 aa, Entamoeba histolytica
NSDKVKSDEDRRDL

SEQ ID NO: 2644581 - protein, 7 aa, Entamoeba histolytica
NSDLEEV

SEQ ID NO: 2644582 - protein, 4 aa, Entamoeba histolytica
NSDN

SEQ ID NO: 2644583 - protein, 5 aa, Entamoeba histolytica
NSDND

SEQ ID NO: 2644584 - protein, 10 aa, Entamoeba histolytica
NSDPDKLGGT

SEQ ID NO: 2644585 - protein, 5 aa, Entamoeba histolytica
NSDPI

SEQ ID NO: 2644586 - protein, 6 aa, Entamoeba histolytica
NSDRTM

SEQ ID NO: 2644587 - protein, 8 aa, Entamoeba histolytica
NSDSDTVI

SEQ ID NO: 2644588 - protein, 10 aa, Entamoeba histolytica
NSDTKKTKKM

SEQ ID NO: 2644589 - protein, 11 aa, Entamoeba histolytica
NSDTKKTKKMK

SEQ ID NO: 2644590 - protein, 5 aa, Entamoeba histolytica
NSDTS

SEQ ID NO: 2644591 - protein, 19 aa, Entamoeba histolytica
NSDWGRAMTSAQSAAKDKH

SEQ ID NO: 2644592 - protein, 8 aa, Entamoeba histolytica
NSEAQPVT

SEQ ID NO: 2644593 - protein, 11 aa, Entamoeba histolytica
NSEDLGSDMER

SEQ ID NO: 2644594 - protein, 20 aa, Entamoeba histolytica
NSEDPLRPYGKDLTTEDSAN

SEQ ID NO: 2644595 - protein, 6 aa, Entamoeba histolytica
NSEDRT

SEQ ID NO: 2644596 - protein, 7 aa, Entamoeba histolytica
NSEEEDP

SEQ ID NO: 2644597 - protein, 7 aa, Entamoeba histolytica
NSEEERD

SEQ ID NO: 2644598 - protein, 5 aa, Entamoeba histolytica
NSEEG

SEQ ID NO: 2644599 - protein, 10 aa, Entamoeba histolytica
NSEEGNPFRH

SEQ ID NO: 2644600 - protein, 6 aa, Entamoeba histolytica
NSEERT

SEQ ID NO: 2644601 - protein, 7 aa, Entamoeba histolytica
NSEESLE

SEQ ID NO: 2644602 - protein, 8 aa, Entamoeba histolytica
NSEESQKH

SEQ ID NO: 2644603 - protein, 4 aa, Entamoeba histolytica
NSEF

SEQ ID NO: 2644604 - protein, 9 aa, Entamoeba histolytica
NSEGHSTKE

SEQ ID NO: 2644605 - protein, 8 aa, Entamoeba histolytica
NSEGINNK

SEQ ID NO: 2644606 - protein, 12 aa, Entamoeba histolytica
NSEIEKQTTSLL

SEQ ID NO: 2644607 - protein, 6 aa, Entamoeba histolytica
NSEIKG

SEQ ID NO: 2644608 - protein, 6 aa, Entamoeba histolytica
NSEITE

SEQ ID NO: 2644609 - protein, 7 aa, Entamoeba histolytica
NSEKKIE

SEQ ID NO: 2644610 - protein, 6 aa, Entamoeba histolytica
NSEKSD

SEQ ID NO: 2644611 - protein, 14 aa, Entamoeba histolytica
NSEKVKTDEERQDL

SEQ ID NO: 2644612 - protein, 4 aa, Entamoeba histolytica
NSEL

SEQ ID NO: 2644613 - protein, 18 aa, Entamoeba histolytica
NSELNNKIKNQQKEFEEQ

SEQ ID NO: 2644614 - protein, 8 aa, Entamoeba histolytica
NSELSNID

SEQ ID NO: 2644615 - protein, 5 aa, Entamoeba histolytica
NSELY

SEQ ID NO: 2644616 - protein, 7 aa, Entamoeba histolytica
NSENAYS

SEQ ID NO: 2644617 - protein, 8 aa, Entamoeba histolytica
NSENEENL

SEQ ID NO: 2644618 - protein, 8 aa, Entamoeba histolytica
NSENGNTE

SEQ ID NO: 2644619 - protein, 10 aa, Entamoeba histolytica
NSENISGENI

SEQ ID NO: 2644620 - protein, 6 aa, Entamoeba histolytica
NSEPKM

SEQ ID NO: 2644621 - protein, 36 aa, Entamoeba histolytica
NSEPNSVDNEVNQKNIKKELTSSKSKQNKRQETYQE

SEQ ID NO: 2644622 - protein, 6 aa, Entamoeba histolytica
NSEPSQ

SEQ ID NO: 2644623 - protein, 6 aa, Entamoeba histolytica
NSEPTD

SEQ ID NO: 2644624 - protein, 15 aa, Entamoeba histolytica
NSEQNNITTKESERV

SEQ ID NO: 2644625 - protein, 16 aa, Entamoeba histolytica
NSERQQKSLGDTHSYT

SEQ ID NO: 2644626 - protein, 5 aa, Entamoeba histolytica
NSESF

SEQ ID NO: 2644627 - protein, 6 aa, Entamoeba histolytica
NSESFE

SEQ ID NO: 2644628 - protein, 6 aa, Entamoeba histolytica
NSESYQ

SEQ ID NO: 2644629 - protein, 12 aa, Entamoeba histolytica
NSETNTLEIDGN

SEQ ID NO: 2644630 - protein, 14 aa, Entamoeba histolytica
NSETTADSSTNTID

SEQ ID NO: 2644631 - protein, 8 aa, Entamoeba histolytica
NSETTDSI

SEQ ID NO: 2644632 - protein, 9 aa, Entamoeba histolytica
NSETTNTLD

SEQ ID NO: 2644633 - protein, 6 aa, Entamoeba histolytica
NSETYG

SEQ ID NO: 2644634 - protein, 8 aa, Entamoeba histolytica
NSEVSSEA

SEQ ID NO: 2644635 - protein, 4 aa, Entamoeba histolytica
NSEY

SEQ ID NO: 2644636 - protein, 37 aa, Entamoeba histolytica
NSFESKSLKKRSVNSSKEIESKPFQKQLEKNDTSDEK

SEQ ID NO: 2644637 - protein, 16 aa, Entamoeba histolytica
NSFGGEEIKPKEIRVE

SEQ ID NO: 2644638 - protein, 15 aa, Entamoeba histolytica
NSFGKEKDKIEKEQF

SEQ ID NO: 2644639 - protein, 8 aa, Entamoeba histolytica
NSFGTSRH

SEQ ID NO: 2644640 - protein, 6 aa, Entamoeba histolytica
NSFKSR

SEQ ID NO: 2644641 - protein, 5 aa, Entamoeba histolytica
NSFLS

SEQ ID NO: 2644642 - protein, 33 aa, Entamoeba histolytica
NSFNDDTTDFISEKKNNLQTQGKTFNNTNKING

SEQ ID NO: 2644643 - protein, 6 aa, Entamoeba histolytica
NSFNNL

SEQ ID NO: 2644644 - protein, 7 aa, Entamoeba histolytica
NSFPDSY

SEQ ID NO: 2644645 - protein, 6 aa, Entamoeba histolytica
NSFPDT

SEQ ID NO: 2644646 - protein, 6 aa, Entamoeba histolytica
NSFPEL

SEQ ID NO: 2644647 - protein, 6 aa, Entamoeba histolytica
NSFPNE

SEQ ID NO: 2644648 - protein, 4 aa, Entamoeba histolytica
NSFS

SEQ ID NO: 2644649 - protein, 8 aa, Entamoeba histolytica
NSFSESKS

SEQ ID NO: 2644650 - protein, 10 aa, Entamoeba histolytica
NSFSKQDEKP

SEQ ID NO: 2644651 - protein, 4 aa, Entamoeba histolytica
NSFT

SEQ ID NO: 2644652 - protein, 32 aa, Entamoeba histolytica
NSFTSESISETPKHSLKQSKIEKHKSLRSAKT

SEQ ID NO: 2644653 - protein, 18 aa, Entamoeba histolytica
NSGDKKQNIVESGAGSGM

SEQ ID NO: 2644654 - protein, 7 aa, Entamoeba histolytica
NSGDQLQ

SEQ ID NO: 2644655 - protein, 10 aa, Entamoeba histolytica
NSGDSESSFI

SEQ ID NO: 2644656 - protein, 5 aa, Entamoeba histolytica
NSGET

SEQ ID NO: 2644657 - protein, 7 aa, Entamoeba histolytica
NSGIEET

SEQ ID NO: 2644658 - protein, 13 aa, Entamoeba histolytica
NSGINNKEEEFTD

SEQ ID NO: 2644659 - protein, 14 aa, Entamoeba histolytica
NSGISQKDQQQLQK

SEQ ID NO: 2644660 - protein, 4 aa, Entamoeba histolytica
NSGL

SEQ ID NO: 2644661 - protein, 8 aa, Entamoeba histolytica
NSGLKGTN

SEQ ID NO: 2644662 - protein, 5 aa, Entamoeba histolytica
NSGLT

SEQ ID NO: 2644663 - protein, 8 aa, Entamoeba histolytica
NSGNADYI

SEQ ID NO: 2644664 - protein, 70 aa, Entamoeba histolytica
NSGNNKPKAEKKTATEMKQVDNKPKDQKVDTKTTNNNKPAEGTHVPKPKGDAPVIEDRPNGKKEVVSGDK

SEQ ID NO: 2644665 - protein, 8 aa, Entamoeba histolytica
NSGNWRKN

SEQ ID NO: 2644666 - protein, 4 aa, Entamoeba histolytica
NSGP

SEQ ID NO: 2644667 - protein, 8 aa, Entamoeba histolytica
NSGPNTNG

SEQ ID NO: 2644668 - protein, 7 aa, Entamoeba histolytica
NSGPTSL

SEQ ID NO: 2644669 - protein, 15 aa, Entamoeba histolytica
NSGQDIKDEEFGPEG

SEQ ID NO: 2644670 - protein, 8 aa, Entamoeba histolytica
NSGSELSQ

SEQ ID NO: 2644671 - protein, 11 aa, Entamoeba histolytica
NSGSITEKKET

SEQ ID NO: 2644672 - protein, 10 aa, Entamoeba histolytica
NSGTAKGNVA

SEQ ID NO: 2644673 - protein, 7 aa, Entamoeba histolytica
NSGVDSI

SEQ ID NO: 2644674 - protein, 4 aa, Entamoeba histolytica
NSGY

SEQ ID NO: 2644675 - protein, 4 aa, Entamoeba histolytica
NSHD

SEQ ID NO: 2644676 - protein, 4 aa, Entamoeba histolytica
NSHE

SEQ ID NO: 2644677 - protein, 5 aa, Entamoeba histolytica
NSHEA

SEQ ID NO: 2644678 - protein, 7 aa, Entamoeba histolytica
NSHEENQ

SEQ ID NO: 2644679 - protein, 17 aa, Entamoeba histolytica
NSHEGIVPSQYSKKLND

SEQ ID NO: 2644680 - protein, 5 aa, Entamoeba histolytica
NSHET

SEQ ID NO: 2644681 - protein, 9 aa, Entamoeba histolytica
NSHKGDLEV

SEQ ID NO: 2644682 - protein, 7 aa, Entamoeba histolytica
NSHKSSM

SEQ ID NO: 2644683 - protein, 4 aa, Entamoeba histolytica
NSHN

SEQ ID NO: 2644684 - protein, 9 aa, Entamoeba histolytica
NSHNKQEMT

SEQ ID NO: 2644685 - protein, 7 aa, Entamoeba histolytica
NSHNTSG

SEQ ID NO: 2644686 - protein, 5 aa, Entamoeba histolytica
NSHRS

SEQ ID NO: 2644687 - protein, 4 aa, Entamoeba histolytica
NSHT

SEQ ID NO: 2644688 - protein, 4 aa, Entamoeba histolytica
NSID

SEQ ID NO: 2644689 - protein, 5 aa, Entamoeba histolytica
NSIDE

SEQ ID NO: 2644690 - protein, 8 aa, Entamoeba histolytica
NSIDSGAT

SEQ ID NO: 2644691 - protein, 6 aa, Entamoeba histolytica
NSIDSI

SEQ ID NO: 2644692 - protein, 9 aa, Entamoeba histolytica
NSIDTNGKK

SEQ ID NO: 2644693 - protein, 13 aa, Entamoeba histolytica
NSIEDEDEEDEIG

SEQ ID NO: 2644694 - protein, 13 aa, Entamoeba histolytica
NSIEEEEEEDEIG

SEQ ID NO: 2644695 - protein, 9 aa, Entamoeba histolytica
NSIEKGPGI

SEQ ID NO: 2644696 - protein, 14 aa, Entamoeba histolytica
NSIEVGNCGDSPAY

SEQ ID NO: 2644697 - protein, 5 aa, Entamoeba histolytica
NSIGD

SEQ ID NO: 2644698 - protein, 7 aa, Entamoeba histolytica
NSIGGSC

SEQ ID NO: 2644699 - protein, 8 aa, Entamoeba histolytica
NSIGIKPP

SEQ ID NO: 2644700 - protein, 6 aa, Entamoeba histolytica
NSIGNA

SEQ ID NO: 2644701 - protein, 4 aa, Entamoeba histolytica
NSIK

SEQ ID NO: 2644702 - protein, 42 aa, Entamoeba histolytica
NSIKEEKKRIEEEKNQIINENKEIKEENIKSIEEKTQEINSL

SEQ ID NO: 2644703 - protein, 7 aa, Entamoeba histolytica
NSIKEGL

SEQ ID NO: 2644704 - protein, 6 aa, Entamoeba histolytica
NSIKTY

SEQ ID NO: 2644705 - protein, 10 aa, Entamoeba histolytica
NSINKNNENK

SEQ ID NO: 2644706 - protein, 10 aa, Entamoeba histolytica
NSINQDKKDY

SEQ ID NO: 2644707 - protein, 7 aa, Entamoeba histolytica
NSINSNT

SEQ ID NO: 2644708 - protein, 5 aa, Entamoeba histolytica
NSINT

SEQ ID NO: 2644709 - protein, 7 aa, Entamoeba histolytica
NSIPEQT

SEQ ID NO: 2644710 - protein, 6 aa, Entamoeba histolytica
NSIPGV

SEQ ID NO: 2644711 - protein, 5 aa, Entamoeba histolytica
NSIPN

SEQ ID NO: 2644712 - protein, 4 aa, Entamoeba histolytica
NSIQ

SEQ ID NO: 2644713 - protein, 7 aa, Entamoeba histolytica
NSIQEGY

SEQ ID NO: 2644714 - protein, 6 aa, Entamoeba histolytica
NSIQQQ

SEQ ID NO: 2644715 - protein, 12 aa, Entamoeba histolytica
NSIQTKGRGITG

SEQ ID NO: 2644716 - protein, 4 aa, Entamoeba histolytica
NSIR

SEQ ID NO: 2644717 - protein, 14 aa, Entamoeba histolytica
NSIRKSKSMAKTTY

SEQ ID NO: 2644718 - protein, 12 aa, Entamoeba histolytica
NSIRSLPDSFGT

SEQ ID NO: 2644719 - protein, 30 aa, Entamoeba histolytica
NSISTPQQPIDRSHQQQRYQQPQYQTFPNQ

SEQ ID NO: 2644720 - protein, 5 aa, Entamoeba histolytica
NSIVP

SEQ ID NO: 2644721 - protein, 5 aa, Entamoeba histolytica
NSKAE

SEQ ID NO: 2644722 - protein, 5 aa, Entamoeba histolytica
NSKCA

SEQ ID NO: 2644723 - protein, 28 aa, Entamoeba histolytica
NSKDQKKVGKKNKKGERKSGKHAKKFGK

SEQ ID NO: 2644724 - protein, 7 aa, Entamoeba histolytica
NSKEDPY

SEQ ID NO: 2644725 - protein, 7 aa, Entamoeba histolytica
NSKEEIA

SEQ ID NO: 2644726 - protein, 9 aa, Entamoeba histolytica
NSKEKKAEI

SEQ ID NO: 2644727 - protein, 7 aa, Entamoeba histolytica
NSKENSQ

SEQ ID NO: 2644728 - protein, 9 aa, Entamoeba histolytica
NSKEVNSSL

SEQ ID NO: 2644729 - protein, 9 aa, Entamoeba histolytica
NSKFKDELR

SEQ ID NO: 2644730 - protein, 5 aa, Entamoeba histolytica
NSKFS

SEQ ID NO: 2644731 - protein, 7 aa, Entamoeba histolytica
NSKGERR

SEQ ID NO: 2644732 - protein, 8 aa, Entamoeba histolytica
NSKGPKGY

SEQ ID NO: 2644733 - protein, 7 aa, Entamoeba histolytica
NSKGQER

SEQ ID NO: 2644734 - protein, 7 aa, Entamoeba histolytica
NSKIIEE

SEQ ID NO: 2644735 - protein, 7 aa, Entamoeba histolytica
NSKIRKE

SEQ ID NO: 2644736 - protein, 8 aa, Entamoeba histolytica
NSKKDSIK

SEQ ID NO: 2644737 - protein, 8 aa, Entamoeba histolytica
NSKKEKMK

SEQ ID NO: 2644738 - protein, 19 aa, Entamoeba histolytica
NSKKLNENEVPPNTDPKKD

SEQ ID NO: 2644739 - protein, 10 aa, Entamoeba histolytica
NSKKNQLKRQ

SEQ ID NO: 2644740 - protein, 6 aa, Entamoeba histolytica
NSKLNK

SEQ ID NO: 2644741 - protein, 7 aa, Entamoeba histolytica
NSKLQPH

SEQ ID NO: 2644742 - protein, 7 aa, Entamoeba histolytica
NSKLTRT

SEQ ID NO: 2644743 - protein, 8 aa, Entamoeba histolytica
NSKNENEA

SEQ ID NO: 2644744 - protein, 10 aa, Entamoeba histolytica
NSKNESEKTM

SEQ ID NO: 2644745 - protein, 5 aa, Entamoeba histolytica
NSKNI

SEQ ID NO: 2644746 - protein, 20 aa, Entamoeba histolytica
NSKNKKETLIEKEEEEKPIS

SEQ ID NO: 2644747 - protein, 9 aa, Entamoeba histolytica
NSKNSESLI

SEQ ID NO: 2644748 - protein, 5 aa, Entamoeba histolytica
NSKPS

SEQ ID NO: 2644749 - protein, 7 aa, Entamoeba histolytica
NSKPSKI

SEQ ID NO: 2644750 - protein, 79 aa, Entamoeba histolytica
NSKPSTNETKGSESSKTDLTKSCKGQKAHTKEDEKKLHSSDSESSDSESSYSDSDSESSDSEDEESSTESDSPSDREIR

SEQ ID NO: 2644751 - protein, 8 aa, Entamoeba histolytica
NSKPTQGI

SEQ ID NO: 2644752 - protein, 8 aa, Entamoeba histolytica
NSKQGTTH

SEQ ID NO: 2644753 - protein, 9 aa, Entamoeba histolytica
NSKQRDDTV

SEQ ID NO: 2644754 - protein, 7 aa, Entamoeba histolytica
NSKRKLT

SEQ ID NO: 2644755 - protein, 10 aa, Entamoeba histolytica
NSKRLTKESD

SEQ ID NO: 2644756 - protein, 11 aa, Entamoeba histolytica
NSKSGGQTGKN

SEQ ID NO: 2644757 - protein, 8 aa, Entamoeba histolytica
NSKSLNEV

SEQ ID NO: 2644758 - protein, 7 aa, Entamoeba histolytica
NSKSPIA

SEQ ID NO: 2644759 - protein, 6 aa, Entamoeba histolytica
NSKSPL

SEQ ID NO: 2644760 - protein, 8 aa, Entamoeba histolytica
NSKSQAKI

SEQ ID NO: 2644761 - protein, 7 aa, Entamoeba histolytica
NSKTDKL

SEQ ID NO: 2644762 - protein, 9 aa, Entamoeba histolytica
NSKTKTSYK

SEQ ID NO: 2644763 - protein, 13 aa, Entamoeba histolytica
NSKVGDEKAKKNI

SEQ ID NO: 2644764 - protein, 6 aa, Entamoeba histolytica
NSKVGN

SEQ ID NO: 2644765 - protein, 5 aa, Entamoeba histolytica
NSLAN

SEQ ID NO: 2644766 - protein, 9 aa, Entamoeba histolytica
NSLANKDTI

SEQ ID NO: 2644767 - protein, 11 aa, Entamoeba histolytica
NSLASNDEVRT

SEQ ID NO: 2644768 - protein, 5 aa, Entamoeba histolytica
NSLEI

SEQ ID NO: 2644769 - protein, 13 aa, Entamoeba histolytica
NSLEKGNTFGPKQ

SEQ ID NO: 2644770 - protein, 12 aa, Entamoeba histolytica
NSLEKRQKRIKG

SEQ ID NO: 2644771 - protein, 5 aa, Entamoeba histolytica
NSLEP

SEQ ID NO: 2644772 - protein, 20 aa, Entamoeba histolytica
NSLGGTFNKVKSEKQEIKQE

SEQ ID NO: 2644773 - protein, 7 aa, Entamoeba histolytica
NSLGTDG

SEQ ID NO: 2644774 - protein, 6 aa, Entamoeba histolytica
NSLKKQ

SEQ ID NO: 2644775 - protein, 19 aa, Entamoeba histolytica
NSLKNQLNDMSKPRTNEQK

SEQ ID NO: 2644776 - protein, 6 aa, Entamoeba histolytica
NSLNSE

SEQ ID NO: 2644777 - protein, 17 aa, Entamoeba histolytica
NSLPKEDINESKEITDL

SEQ ID NO: 2644778 - protein, 21 aa, Entamoeba histolytica
NSLPNEKIEEKRDEKEEKRIK

SEQ ID NO: 2644779 - protein, 18 aa, Entamoeba histolytica
NSLPPKKIEKGKINKEQF

SEQ ID NO: 2644780 - protein, 7 aa, Entamoeba histolytica
NSLPTIS

SEQ ID NO: 2644781 - protein, 14 aa, Entamoeba histolytica
NSLPVKAKPRSNTI

SEQ ID NO: 2644782 - protein, 4 aa, Entamoeba histolytica
NSLQ

SEQ ID NO: 2644783 - protein, 9 aa, Entamoeba histolytica
NSLQEQVRT

SEQ ID NO: 2644784 - protein, 6 aa, Entamoeba histolytica
NSLQQV

SEQ ID NO: 2644785 - protein, 7 aa, Entamoeba histolytica
NSLRKRK

SEQ ID NO: 2644786 - protein, 5 aa, Entamoeba histolytica
NSLSF

SEQ ID NO: 2644787 - protein, 9 aa, Entamoeba histolytica
NSLSHQEKN

SEQ ID NO: 2644788 - protein, 7 aa, Entamoeba histolytica
NSLSRTK

SEQ ID NO: 2644789 - protein, 7 aa, Entamoeba histolytica
NSLSSGS

SEQ ID NO: 2644790 - protein, 14 aa, Entamoeba histolytica
NSLSTEPPKRDSDE

SEQ ID NO: 2644791 - protein, 5 aa, Entamoeba histolytica
NSLTS

SEQ ID NO: 2644792 - protein, 4 aa, Entamoeba histolytica
NSLV

SEQ ID NO: 2644793 - protein, 7 aa, Entamoeba histolytica
NSLYKKT

SEQ ID NO: 2644794 - protein, 11 aa, Entamoeba histolytica
NSLYSSRRSYK

SEQ ID NO: 2644795 - protein, 16 aa, Entamoeba histolytica
NSLYTQRTSFDRQQMD

SEQ ID NO: 2644796 - protein, 4 aa, Entamoeba histolytica
NSMD

SEQ ID NO: 2644797 - protein, 6 aa, Entamoeba histolytica
NSMDKQ

SEQ ID NO: 2644798 - protein, 6 aa, Entamoeba histolytica
NSMEND

SEQ ID NO: 2644799 - protein, 36 aa, Entamoeba histolytica
NSMGRSTRMSTPRKSSKSSLGSRLDRSSVSAIEKEE

SEQ ID NO: 2644800 - protein, 6 aa, Entamoeba histolytica
NSMNSK

SEQ ID NO: 2644801 - protein, 11 aa, Entamoeba histolytica
NSMVNNEASKR

SEQ ID NO: 2644802 - protein, 13 aa, Entamoeba histolytica
NSNDESMVTTGNE

SEQ ID NO: 2644803 - protein, 16 aa, Entamoeba histolytica
NSNDGTKKNEYHLESE

SEQ ID NO: 2644804 - protein, 6 aa, Entamoeba histolytica
NSNDPQ

SEQ ID NO: 2644805 - protein, 17 aa, Entamoeba histolytica
NSNDTINCQPSISRGSY

SEQ ID NO: 2644806 - protein, 10 aa, Entamoeba histolytica
NSNEKKNENL

SEQ ID NO: 2644807 - protein, 7 aa, Entamoeba histolytica
NSNELNG

SEQ ID NO: 2644808 - protein, 9 aa, Entamoeba histolytica
NSNELPSSL

SEQ ID NO: 2644809 - protein, 19 aa, Entamoeba histolytica
NSNENDNNSFRKAASRSRS

SEQ ID NO: 2644810 - protein, 7 aa, Entamoeba histolytica
NSNENLS

SEQ ID NO: 2644811 - protein, 10 aa, Entamoeba histolytica
NSNESADSLE

SEQ ID NO: 2644812 - protein, 13 aa, Entamoeba histolytica
NSNESSTTVTPRS

SEQ ID NO: 2644813 - protein, 4 aa, Entamoeba histolytica
NSNF

SEQ ID NO: 2644814 - protein, 8 aa, Entamoeba histolytica
NSNFEKGT

SEQ ID NO: 2644815 - protein, 6 aa, Entamoeba histolytica
NSNGPE

SEQ ID NO: 2644816 - protein, 27 aa, Entamoeba histolytica
NSNGSTPSDGRELYTPPNRCENPDISE

SEQ ID NO: 2644817 - protein, 7 aa, Entamoeba histolytica
NSNGYEE

SEQ ID NO: 2644818 - protein, 7 aa, Entamoeba histolytica
NSNHDKI

SEQ ID NO: 2644819 - protein, 4 aa, Entamoeba histolytica
NSNI

SEQ ID NO: 2644820 - protein, 5 aa, Entamoeba histolytica
NSNIA

SEQ ID NO: 2644821 - protein, 5 aa, Entamoeba histolytica
NSNID

SEQ ID NO: 2644822 - protein, 7 aa, Entamoeba histolytica
NSNIRTQ

SEQ ID NO: 2644823 - protein, 9 aa, Entamoeba histolytica
NSNKAQISL

SEQ ID NO: 2644824 - protein, 6 aa, Entamoeba histolytica
NSNKDR

SEQ ID NO: 2644825 - protein, 40 aa, Entamoeba histolytica
NSNKQNKETRMSGGKEQEMTERKEDKSTEKGNDPETEMKE

SEQ ID NO: 2644826 - protein, 7 aa, Entamoeba histolytica
NSNKTGE

SEQ ID NO: 2644827 - protein, 10 aa, Entamoeba histolytica
NSNNATTADL

SEQ ID NO: 2644828 - protein, 20 aa, Entamoeba histolytica
NSNNETTTPNKQETEQQDDE

SEQ ID NO: 2644829 - protein, 8 aa, Entamoeba histolytica
NSNNIKKN

SEQ ID NO: 2644830 - protein, 10 aa, Entamoeba histolytica
NSNNQEYSIN

SEQ ID NO: 2644831 - protein, 12 aa, Entamoeba histolytica
NSNNVIREKADF

SEQ ID NO: 2644832 - protein, 9 aa, Entamoeba histolytica
NSNPEGKGI

SEQ ID NO: 2644833 - protein, 9 aa, Entamoeba histolytica
NSNPTIEGR

SEQ ID NO: 2644834 - protein, 4 aa, Entamoeba histolytica
NSNQ

SEQ ID NO: 2644835 - protein, 7 aa, Entamoeba histolytica
NSNQITQ

SEQ ID NO: 2644836 - protein, 7 aa, Entamoeba histolytica
NSNQTLK

SEQ ID NO: 2644837 - protein, 10 aa, Entamoeba histolytica
NSNSEAQSKY

SEQ ID NO: 2644838 - protein, 7 aa, Entamoeba histolytica
NSNSEHD

SEQ ID NO: 2644839 - protein, 12 aa, Entamoeba histolytica
NSNSHLSKRDEQ

SEQ ID NO: 2644840 - protein, 40 aa, Entamoeba histolytica
NSNSQSPREGYKENSLHSSNKTEDLNDEPLEKVKDNNQLD

SEQ ID NO: 2644841 - protein, 8 aa, Entamoeba histolytica
NSNSTFGA

SEQ ID NO: 2644842 - protein, 10 aa, Entamoeba histolytica
NSNSTSNEKE

SEQ ID NO: 2644843 - protein, 13 aa, Entamoeba histolytica
NSNSVASSSNTYY

SEQ ID NO: 2644844 - protein, 9 aa, Entamoeba histolytica
NSNTNDEKV

SEQ ID NO: 2644845 - protein, 8 aa, Entamoeba histolytica
NSNTTITQ

SEQ ID NO: 2644846 - protein, 4 aa, Entamoeba histolytica
NSNY

SEQ ID NO: 2644847 - protein, 7 aa, Entamoeba histolytica
NSPDDDS

SEQ ID NO: 2644848 - protein, 10 aa, Entamoeba histolytica
NSPDFEKNKS

SEQ ID NO: 2644849 - protein, 9 aa, Entamoeba histolytica
NSPDKRPRF

SEQ ID NO: 2644850 - protein, 6 aa, Entamoeba histolytica
NSPDPF

SEQ ID NO: 2644851 - protein, 9 aa, Entamoeba histolytica
NSPEEAKRN

SEQ ID NO: 2644852 - protein, 9 aa, Entamoeba histolytica
NSPELEEES

SEQ ID NO: 2644853 - protein, 8 aa, Entamoeba histolytica
NSPEPVEE

SEQ ID NO: 2644854 - protein, 6 aa, Entamoeba histolytica
NSPGIK

SEQ ID NO: 2644855 - protein, 9 aa, Entamoeba histolytica
NSPHTSLSN

SEQ ID NO: 2644856 - protein, 7 aa, Entamoeba histolytica
NSPIGQQ

SEQ ID NO: 2644857 - protein, 9 aa, Entamoeba histolytica
NSPIQGTAA

SEQ ID NO: 2644858 - protein, 7 aa, Entamoeba histolytica
NSPISSD

SEQ ID NO: 2644859 - protein, 18 aa, Entamoeba histolytica
NSPKGKAFAKPYGQGDTV

SEQ ID NO: 2644860 - protein, 7 aa, Entamoeba histolytica
NSPNEDD

SEQ ID NO: 2644861 - protein, 7 aa, Entamoeba histolytica
NSPNFRT

SEQ ID NO: 2644862 - protein, 5 aa, Entamoeba histolytica
NSPNP

SEQ ID NO: 2644863 - protein, 10 aa, Entamoeba histolytica
NSPNPQKSYE

SEQ ID NO: 2644864 - protein, 8 aa, Entamoeba histolytica
NSPNTTEL

SEQ ID NO: 2644865 - protein, 7 aa, Entamoeba histolytica
NSPPISH

SEQ ID NO: 2644866 - protein, 12 aa, Entamoeba histolytica
NSPPVDGKANTE

SEQ ID NO: 2644867 - protein, 5 aa, Entamoeba histolytica
NSPQY

SEQ ID NO: 2644868 - protein, 7 aa, Entamoeba histolytica
NSPRETW

SEQ ID NO: 2644869 - protein, 11 aa, Entamoeba histolytica
NSPRGRDVSEL

SEQ ID NO: 2644870 - protein, 7 aa, Entamoeba histolytica
NSPRKAT

SEQ ID NO: 2644871 - protein, 6 aa, Entamoeba histolytica
NSPRNV

SEQ ID NO: 2644872 - protein, 23 aa, Entamoeba histolytica
NSPRSSPKSNRTPKKNITSKETN

SEQ ID NO: 2644873 - protein, 10 aa, Entamoeba histolytica
NSPSAAPKKI

SEQ ID NO: 2644874 - protein, 5 aa, Entamoeba histolytica
NSPSF

SEQ ID NO: 2644875 - protein, 9 aa, Entamoeba histolytica
NSPSLPSLT

SEQ ID NO: 2644876 - protein, 17 aa, Entamoeba histolytica
NSPSLTQRKGTKQPQYI

SEQ ID NO: 2644877 - protein, 10 aa, Entamoeba histolytica
NSPSNKYNEL

SEQ ID NO: 2644878 - protein, 4 aa, Entamoeba histolytica
NSPT

SEQ ID NO: 2644879 - protein, 7 aa, Entamoeba histolytica
NSPTTSM

SEQ ID NO: 2644880 - protein, 4 aa, Entamoeba histolytica
NSPV

SEQ ID NO: 2644881 - protein, 9 aa, Entamoeba histolytica
NSPVPSTKI

SEQ ID NO: 2644882 - protein, 8 aa, Entamoeba histolytica
NSPYSSTL

SEQ ID NO: 2644883 - protein, 10 aa, Entamoeba histolytica
NSQAEEEYHE

SEQ ID NO: 2644884 - protein, 6 aa, Entamoeba histolytica
NSQAGV

SEQ ID NO: 2644885 - protein, 9 aa, Entamoeba histolytica
NSQDVTSAR

SEQ ID NO: 2644886 - protein, 7 aa, Entamoeba histolytica
NSQEQAN

SEQ ID NO: 2644887 - protein, 7 aa, Entamoeba histolytica
NSQFGQS

SEQ ID NO: 2644888 - protein, 8 aa, Entamoeba histolytica
NSQGGDDF

SEQ ID NO: 2644889 - protein, 16 aa, Entamoeba histolytica
NSQGQSGFVPENFVEV

SEQ ID NO: 2644890 - protein, 5 aa, Entamoeba histolytica
NSQGV

SEQ ID NO: 2644891 - protein, 5 aa, Entamoeba histolytica
NSQIE

SEQ ID NO: 2644892 - protein, 8 aa, Entamoeba histolytica
NSQITEIN

SEQ ID NO: 2644893 - protein, 23 aa, Entamoeba histolytica
NSQKIKDEKVEENQENKNIQKPL

SEQ ID NO: 2644894 - protein, 6 aa, Entamoeba histolytica
NSQKNI

SEQ ID NO: 2644895 - protein, 10 aa, Entamoeba histolytica
NSQKQNTELQ

SEQ ID NO: 2644896 - protein, 5 aa, Entamoeba histolytica
NSQKV

SEQ ID NO: 2644897 - protein, 7 aa, Entamoeba histolytica
NSQLSEV

SEQ ID NO: 2644898 - protein, 7 aa, Entamoeba histolytica
NSQNGSC

SEQ ID NO: 2644899 - protein, 18 aa, Entamoeba histolytica
NSQNHQPVSDDESNDEED

SEQ ID NO: 2644900 - protein, 5 aa, Entamoeba histolytica
NSQPI

SEQ ID NO: 2644901 - protein, 10 aa, Entamoeba histolytica
NSQPNISNNP

SEQ ID NO: 2644902 - protein, 4 aa, Entamoeba histolytica
NSQQ

SEQ ID NO: 2644903 - protein, 7 aa, Entamoeba histolytica
NSQQEGE

SEQ ID NO: 2644904 - protein, 7 aa, Entamoeba histolytica
NSQQPNL

SEQ ID NO: 2644905 - protein, 8 aa, Entamoeba histolytica
NSQQQYDI

SEQ ID NO: 2644906 - protein, 7 aa, Entamoeba histolytica
NSQQTKL

SEQ ID NO: 2644907 - protein, 14 aa, Entamoeba histolytica
NSQQYQSNYNSIPP

SEQ ID NO: 2644908 - protein, 6 aa, Entamoeba histolytica
NSQRLA

SEQ ID NO: 2644909 - protein, 13 aa, Entamoeba histolytica
NSQSKTPSQYGMK

SEQ ID NO: 2644910 - protein, 11 aa, Entamoeba histolytica
NSQSNASMSGN

SEQ ID NO: 2644911 - protein, 15 aa, Entamoeba histolytica
NSQSNESTHVTPSTQ

SEQ ID NO: 2644912 - protein, 7 aa, Entamoeba histolytica
NSQTDPL

SEQ ID NO: 2644913 - protein, 8 aa, Entamoeba histolytica
NSQTEVTD

SEQ ID NO: 2644914 - protein, 6 aa, Entamoeba histolytica
NSQTGK

SEQ ID NO: 2644915 - protein, 7 aa, Entamoeba histolytica
NSQYFKE

SEQ ID NO: 2644916 - protein, 5 aa, Entamoeba histolytica
NSQYS

SEQ ID NO: 2644917 - protein, 13 aa, Entamoeba histolytica
NSREGTLTSPPIK

SEQ ID NO: 2644918 - protein, 14 aa, Entamoeba histolytica
NSREVQKESIPQER

SEQ ID NO: 2644919 - protein, 4 aa, Entamoeba histolytica
NSRG

SEQ ID NO: 2644920 - protein, 6 aa, Entamoeba histolytica
NSRGAL

SEQ ID NO: 2644921 - protein, 10 aa, Entamoeba histolytica
NSRGDYDDDV

SEQ ID NO: 2644922 - protein, 4 aa, Entamoeba histolytica
NSRI

SEQ ID NO: 2644923 - protein, 6 aa, Entamoeba histolytica
NSRIQD

SEQ ID NO: 2644924 - protein, 4 aa, Entamoeba histolytica
NSRK

SEQ ID NO: 2644925 - protein, 6 aa, Entamoeba histolytica
NSRKKN

SEQ ID NO: 2644926 - protein, 6 aa, Entamoeba histolytica
NSRNGT

SEQ ID NO: 2644927 - protein, 50 aa, Entamoeba histolytica
NSRNRYHSRSISRSRKRSSRSFSRRRTSPRKYNFSERRDSYSDRRRSLSK

SEQ ID NO: 2644928 - protein, 7 aa, Entamoeba histolytica
NSRNSNQ

SEQ ID NO: 2644929 - protein, 6 aa, Entamoeba histolytica
NSRPCP

SEQ ID NO: 2644930 - protein, 7 aa, Entamoeba histolytica
NSRPCPS

SEQ ID NO: 2644931 - protein, 6 aa, Entamoeba histolytica
NSRPTM

SEQ ID NO: 2644932 - protein, 9 aa, Entamoeba histolytica
NSRRKEGLG

SEQ ID NO: 2644933 - protein, 9 aa, Entamoeba histolytica
NSRSGSLGT

SEQ ID NO: 2644934 - protein, 10 aa, Entamoeba histolytica
NSRSNSPNLQ

SEQ ID NO: 2644935 - protein, 6 aa, Entamoeba histolytica
NSRTEL

SEQ ID NO: 2644936 - protein, 21 aa, Entamoeba histolytica
NSRTETTDEKMKPNDITKNIQ

SEQ ID NO: 2644937 - protein, 8 aa, Entamoeba histolytica
NSRTPIEV

SEQ ID NO: 2644938 - protein, 20 aa, Entamoeba histolytica
NSRTSRDGYELNPESDYEKR

SEQ ID NO: 2644939 - protein, 4 aa, Entamoeba histolytica
NSRV

SEQ ID NO: 2644940 - protein, 7 aa, Entamoeba histolytica
NSSAISR

SEQ ID NO: 2644941 - protein, 8 aa, Entamoeba histolytica
NSSDSDII

SEQ ID NO: 2644942 - protein, 5 aa, Entamoeba histolytica
NSSDY

SEQ ID NO: 2644943 - protein, 8 aa, Entamoeba histolytica
NSSEDMFD

SEQ ID NO: 2644944 - protein, 8 aa, Entamoeba histolytica
NSSEEQHK

SEQ ID NO: 2644945 - protein, 11 aa, Entamoeba histolytica
NSSESFSNNSI

SEQ ID NO: 2644946 - protein, 7 aa, Entamoeba histolytica
NSSEYKK

SEQ ID NO: 2644947 - protein, 14 aa, Entamoeba histolytica
NSSGEEQKGGVSVE

SEQ ID NO: 2644948 - protein, 9 aa, Entamoeba histolytica
NSSGEIKSE

SEQ ID NO: 2644949 - protein, 6 aa, Entamoeba histolytica
NSSGIK

SEQ ID NO: 2644950 - protein, 15 aa, Entamoeba histolytica
NSSGKVEDDEERSRI

SEQ ID NO: 2644951 - protein, 10 aa, Entamoeba histolytica
NSSGSQNECS

SEQ ID NO: 2644952 - protein, 5 aa, Entamoeba histolytica
NSSGV

SEQ ID NO: 2644953 - protein, 6 aa, Entamoeba histolytica
NSSHRY

SEQ ID NO: 2644954 - protein, 11 aa, Entamoeba histolytica
NSSHSSLSQHT

SEQ ID NO: 2644955 - protein, 9 aa, Entamoeba histolytica
NSSHYKGQE

SEQ ID NO: 2644956 - protein, 6 aa, Entamoeba histolytica
NSSIDS

SEQ ID NO: 2644957 - protein, 6 aa, Entamoeba histolytica
NSSIQE

SEQ ID NO: 2644958 - protein, 8 aa, Entamoeba histolytica
NSSITPKV

SEQ ID NO: 2644959 - protein, 9 aa, Entamoeba histolytica
NSSKDGLSA

SEQ ID NO: 2644960 - protein, 8 aa, Entamoeba histolytica
NSSKGTIE

SEQ ID NO: 2644961 - protein, 7 aa, Entamoeba histolytica
NSSKHDY

SEQ ID NO: 2644962 - protein, 9 aa, Entamoeba histolytica
NSSKKEERF

SEQ ID NO: 2644963 - protein, 15 aa, Entamoeba histolytica
NSSKWNNIRKKGNQN

SEQ ID NO: 2644964 - protein, 8 aa, Entamoeba histolytica
NSSLGTTK

SEQ ID NO: 2644965 - protein, 9 aa, Entamoeba histolytica
NSSLIGEDR

SEQ ID NO: 2644966 - protein, 5 aa, Entamoeba histolytica
NSSLP

SEQ ID NO: 2644967 - protein, 6 aa, Entamoeba histolytica
NSSLPL

SEQ ID NO: 2644968 - protein, 6 aa, Entamoeba histolytica
NSSLSN

SEQ ID NO: 2644969 - protein, 17 aa, Entamoeba histolytica
NSSLSRLASNFASFYQI

SEQ ID NO: 2644970 - protein, 13 aa, Entamoeba histolytica
NSSLTTMKSLFPL

SEQ ID NO: 2644971 - protein, 5 aa, Entamoeba histolytica
NSSLV

SEQ ID NO: 2644972 - protein, 8 aa, Entamoeba histolytica
NSSNHQQQ

SEQ ID NO: 2644973 - protein, 7 aa, Entamoeba histolytica
NSSNNNV

SEQ ID NO: 2644974 - protein, 7 aa, Entamoeba histolytica
NSSNSNI

SEQ ID NO: 2644975 - protein, 10 aa, Entamoeba histolytica
NSSNSQITTI

SEQ ID NO: 2644976 - protein, 7 aa, Entamoeba histolytica
NSSNTIT

SEQ ID NO: 2644977 - protein, 4 aa, Entamoeba histolytica
NSSP

SEQ ID NO: 2644978 - protein, 5 aa, Entamoeba histolytica
NSSPQ

SEQ ID NO: 2644979 - protein, 9 aa, Entamoeba histolytica
NSSQIQQPL

SEQ ID NO: 2644980 - protein, 7 aa, Entamoeba histolytica
NSSQISS

SEQ ID NO: 2644981 - protein, 14 aa, Entamoeba histolytica
NSSQKKSSSNYLEE

SEQ ID NO: 2644982 - protein, 9 aa, Entamoeba histolytica
NSSQREDKN

SEQ ID NO: 2644983 - protein, 4 aa, Entamoeba histolytica
NSSR

SEQ ID NO: 2644984 - protein, 9 aa, Entamoeba histolytica
NSSRAKKYG

SEQ ID NO: 2644985 - protein, 5 aa, Entamoeba histolytica
NSSRE

SEQ ID NO: 2644986 - protein, 11 aa, Entamoeba histolytica
NSSRPLPSIPQ

SEQ ID NO: 2644987 - protein, 4 aa, Entamoeba histolytica
NSSS

SEQ ID NO: 2644988 - protein, 10 aa, Entamoeba histolytica
NSSSNKEKEP

SEQ ID NO: 2644989 - protein, 6 aa, Entamoeba histolytica
NSSSNL

SEQ ID NO: 2644990 - protein, 16 aa, Entamoeba histolytica
NSSSQNQNTTSYNMPS

SEQ ID NO: 2644991 - protein, 41 aa, Entamoeba histolytica
NSSSQSINSHQKKITKTIKNQQKIIRSDGNQIMNDKDKEDI

SEQ ID NO: 2644992 - protein, 13 aa, Entamoeba histolytica
NSSSSFNVSNQTM

SEQ ID NO: 2644993 - protein, 8 aa, Entamoeba histolytica
NSSSSIKN

SEQ ID NO: 2644994 - protein, 23 aa, Entamoeba histolytica
NSSSSSNEKEFETHSESKESSVQ

SEQ ID NO: 2644995 - protein, 5 aa, Entamoeba histolytica
NSSST

SEQ ID NO: 2644996 - protein, 7 aa, Entamoeba histolytica
NSSSVSA

SEQ ID NO: 2644997 - protein, 4 aa, Entamoeba histolytica
NSST

SEQ ID NO: 2644998 - protein, 9 aa, Entamoeba histolytica
NSSTNGPNV

SEQ ID NO: 2644999 - protein, 16 aa, Entamoeba histolytica
NSSTNLQQEEAINNQL

SEQ ID NO: 2645000 - protein, 7 aa, Entamoeba histolytica
NSSTQCN

SEQ ID NO: 2645001 - protein, 8 aa, Entamoeba histolytica
NSSTQIYD

SEQ ID NO: 2645002 - protein, 26 aa, Entamoeba histolytica
NSSTTGIQTNGNQPTTNDIQSSIQKE

SEQ ID NO: 2645003 - protein, 8 aa, Entamoeba histolytica
NSSVGKKG

SEQ ID NO: 2645004 - protein, 9 aa, Entamoeba histolytica
NSSVKKTTM

SEQ ID NO: 2645005 - protein, 8 aa, Entamoeba histolytica
NSSVPAAR

SEQ ID NO: 2645006 - protein, 5 aa, Entamoeba histolytica
NSSVV

SEQ ID NO: 2645007 - protein, 19 aa, Entamoeba histolytica
NSSYNKETIEGEGKALKEI

SEQ ID NO: 2645008 - protein, 6 aa, Entamoeba histolytica
NSTAIE

SEQ ID NO: 2645009 - protein, 33 aa, Entamoeba histolytica
NSTDDINEHENKLRKTNKQFESTINKTRTTHKM

SEQ ID NO: 2645010 - protein, 9 aa, Entamoeba histolytica
NSTDKDIDS

SEQ ID NO: 2645011 - protein, 8 aa, Entamoeba histolytica
NSTDNLNT

SEQ ID NO: 2645012 - protein, 7 aa, Entamoeba histolytica
NSTDQSI

SEQ ID NO: 2645013 - protein, 12 aa, Entamoeba histolytica
NSTDSNIPEQSN

SEQ ID NO: 2645014 - protein, 20 aa, Entamoeba histolytica
NSTEIEDKITTETNKNKCNS

SEQ ID NO: 2645015 - protein, 7 aa, Entamoeba histolytica
NSTEKEL

SEQ ID NO: 2645016 - protein, 6 aa, Entamoeba histolytica
NSTERN

SEQ ID NO: 2645017 - protein, 7 aa, Entamoeba histolytica
NSTFQSK

SEQ ID NO: 2645018 - protein, 10 aa, Entamoeba histolytica
NSTGNESERF

SEQ ID NO: 2645019 - protein, 4 aa, Entamoeba histolytica
NSTI

SEQ ID NO: 2645020 - protein, 12 aa, Entamoeba histolytica
NSTIPAKKSQVF

SEQ ID NO: 2645021 - protein, 7 aa, Entamoeba histolytica
NSTIPST

SEQ ID NO: 2645022 - protein, 6 aa, Entamoeba histolytica
NSTKGI

SEQ ID NO: 2645023 - protein, 7 aa, Entamoeba histolytica
NSTKKTG

SEQ ID NO: 2645024 - protein, 6 aa, Entamoeba histolytica
NSTKVK

SEQ ID NO: 2645025 - protein, 10 aa, Entamoeba histolytica
NSTLKRKTEE

SEQ ID NO: 2645026 - protein, 19 aa, Entamoeba histolytica
NSTLNVPKGKLYESYVRTG

SEQ ID NO: 2645027 - protein, 4 aa, Entamoeba histolytica
NSTN

SEQ ID NO: 2645028 - protein, 6 aa, Entamoeba histolytica
NSTNDD

SEQ ID NO: 2645029 - protein, 16 aa, Entamoeba histolytica
NSTNEDNQSIEEGEEY

SEQ ID NO: 2645030 - protein, 6 aa, Entamoeba histolytica
NSTNIE

SEQ ID NO: 2645031 - protein, 7 aa, Entamoeba histolytica
NSTNNLK

SEQ ID NO: 2645032 - protein, 7 aa, Entamoeba histolytica
NSTNSEK

SEQ ID NO: 2645033 - protein, 9 aa, Entamoeba histolytica
NSTNTPTEV

SEQ ID NO: 2645034 - protein, 16 aa, Entamoeba histolytica
NSTPKMSSQQKQTQYP

SEQ ID NO: 2645035 - protein, 18 aa, Entamoeba histolytica
NSTPSPYEPTIPSIEQAS

SEQ ID NO: 2645036 - protein, 6 aa, Entamoeba histolytica
NSTPVG

SEQ ID NO: 2645037 - protein, 11 aa, Entamoeba histolytica
NSTPVTPMKAS

SEQ ID NO: 2645038 - protein, 7 aa, Entamoeba histolytica
NSTRKKR

SEQ ID NO: 2645039 - protein, 8 aa, Entamoeba histolytica
NSTSASVS

SEQ ID NO: 2645040 - protein, 10 aa, Entamoeba histolytica
NSTSEDAEKG

SEQ ID NO: 2645041 - protein, 10 aa, Entamoeba histolytica
NSTSKESNLK

SEQ ID NO: 2645042 - protein, 10 aa, Entamoeba histolytica
NSTSPSPEGI

SEQ ID NO: 2645043 - protein, 7 aa, Entamoeba histolytica
NSTSSEW

SEQ ID NO: 2645044 - protein, 7 aa, Entamoeba histolytica
NSTTKTL

SEQ ID NO: 2645045 - protein, 7 aa, Entamoeba histolytica
NSTTSGF

SEQ ID NO: 2645046 - protein, 16 aa, Entamoeba histolytica
NSTTSGHPSYMKGGSN

SEQ ID NO: 2645047 - protein, 8 aa, Entamoeba histolytica
NSTTTELS

SEQ ID NO: 2645048 - protein, 20 aa, Entamoeba histolytica
NSTVDTKSNEKPKEENQTNN

SEQ ID NO: 2645049 - protein, 8 aa, Entamoeba histolytica
NSTYDNEN

SEQ ID NO: 2645050 - protein, 5 aa, Entamoeba histolytica
NSTYV

SEQ ID NO: 2645051 - protein, 8 aa, Entamoeba histolytica
NSVDEEKL

SEQ ID NO: 2645052 - protein, 34 aa, Entamoeba histolytica
NSVEQKVNTPLTQQITKEDITQRTRQQSSSNRKV

SEQ ID NO: 2645053 - protein, 6 aa, Entamoeba histolytica
NSVISY

SEQ ID NO: 2645054 - protein, 6 aa, Entamoeba histolytica
NSVITE

SEQ ID NO: 2645055 - protein, 9 aa, Entamoeba histolytica
NSVKLQEDL

SEQ ID NO: 2645056 - protein, 8 aa, Entamoeba histolytica
NSVKNFAE

SEQ ID NO: 2645057 - protein, 7 aa, Entamoeba histolytica
NSVKSTM

SEQ ID NO: 2645058 - protein, 11 aa, Entamoeba histolytica
NSVLPGGDTAK

SEQ ID NO: 2645059 - protein, 19 aa, Entamoeba histolytica
NSVNVESNGGDQDLGGNDF

SEQ ID NO: 2645060 - protein, 6 aa, Entamoeba histolytica
NSVPEI

SEQ ID NO: 2645061 - protein, 6 aa, Entamoeba histolytica
NSVQLT

SEQ ID NO: 2645062 - protein, 8 aa, Entamoeba histolytica
NSVRPTGD

SEQ ID NO: 2645063 - protein, 12 aa, Entamoeba histolytica
NSVRQQKKIPEG

SEQ ID NO: 2645064 - protein, 4 aa, Entamoeba histolytica
NSVS

SEQ ID NO: 2645065 - protein, 5 aa, Entamoeba histolytica
NSVSQ

SEQ ID NO: 2645066 - protein, 12 aa, Entamoeba histolytica
NSVSSTEEEPKS

SEQ ID NO: 2645067 - protein, 8 aa, Entamoeba histolytica
NSVTDLSP

SEQ ID NO: 2645068 - protein, 6 aa, Entamoeba histolytica
NSVTNR

SEQ ID NO: 2645069 - protein, 8 aa, Entamoeba histolytica
NSYDEQEK

SEQ ID NO: 2645070 - protein, 9 aa, Entamoeba histolytica
NSYDFQEQE

SEQ ID NO: 2645071 - protein, 5 aa, Entamoeba histolytica
NSYDK

SEQ ID NO: 2645072 - protein, 5 aa, Entamoeba histolytica
NSYEE

SEQ ID NO: 2645073 - protein, 9 aa, Entamoeba histolytica
NSYESVDGK

SEQ ID NO: 2645074 - protein, 7 aa, Entamoeba histolytica
NSYKEEK

SEQ ID NO: 2645075 - protein, 9 aa, Entamoeba histolytica
NSYKQHGQF

SEQ ID NO: 2645076 - protein, 13 aa, Entamoeba histolytica
NSYNATTQNNPTV

SEQ ID NO: 2645077 - protein, 4 aa, Entamoeba histolytica
NSYQ

SEQ ID NO: 2645078 - protein, 7 aa, Entamoeba histolytica
NSYSSDP

SEQ ID NO: 2645079 - protein, 5 aa, Entamoeba histolytica
NSYSV

SEQ ID NO: 2645080 - protein, 7 aa, Entamoeba histolytica
NSYTQPS

SEQ ID NO: 2645081 - protein, 21 aa, Entamoeba histolytica
NSYTQSRSPPTPTQQYDGRNT

SEQ ID NO: 2645082 - protein, 16 aa, Entamoeba histolytica
NSYYTQNNSIINSHFL

SEQ ID NO: 2645083 - protein, 6 aa, Entamoeba histolytica
NTADDI

SEQ ID NO: 2645084 - protein, 6 aa, Entamoeba histolytica
NTADSV

SEQ ID NO: 2645085 - protein, 4 aa, Entamoeba histolytica
NTAF

SEQ ID NO: 2645086 - protein, 7 aa, Entamoeba histolytica
NTAGYKD

SEQ ID NO: 2645087 - protein, 10 aa, Entamoeba histolytica
NTAKNNQEEF

SEQ ID NO: 2645088 - protein, 4 aa, Entamoeba histolytica
NTAN

SEQ ID NO: 2645089 - protein, 7 aa, Entamoeba histolytica
NTAPPQK

SEQ ID NO: 2645090 - protein, 7 aa, Entamoeba histolytica
NTDDDQL

SEQ ID NO: 2645091 - protein, 17 aa, Entamoeba histolytica
NTDDVTIETTTNGITTF

SEQ ID NO: 2645092 - protein, 20 aa, Entamoeba histolytica
NTDDVTIETTTNGTTTFTSE

SEQ ID NO: 2645093 - protein, 4 aa, Entamoeba histolytica
NTDE

SEQ ID NO: 2645094 - protein, 6 aa, Entamoeba histolytica
NTDECR

SEQ ID NO: 2645095 - protein, 14 aa, Entamoeba histolytica
NTDEKEKEATKIDE

SEQ ID NO: 2645096 - protein, 6 aa, Entamoeba histolytica
NTDELV

SEQ ID NO: 2645097 - protein, 10 aa, Entamoeba histolytica
NTDETDTDVE

SEQ ID NO: 2645098 - protein, 5 aa, Entamoeba histolytica
NTDGE

SEQ ID NO: 2645099 - protein, 5 aa, Entamoeba histolytica
NTDGP

SEQ ID NO: 2645100 - protein, 5 aa, Entamoeba histolytica
NTDGW

SEQ ID NO: 2645101 - protein, 6 aa, Entamoeba histolytica
NTDHTQ

SEQ ID NO: 2645102 - protein, 4 aa, Entamoeba histolytica
NTDI

SEQ ID NO: 2645103 - protein, 4 aa, Entamoeba histolytica
NTDN

SEQ ID NO: 2645104 - protein, 7 aa, Entamoeba histolytica
NTDNNPM

SEQ ID NO: 2645105 - protein, 17 aa, Entamoeba histolytica
NTDNTTVSSCSLSGEDE

SEQ ID NO: 2645106 - protein, 6 aa, Entamoeba histolytica
NTDPTL

SEQ ID NO: 2645107 - protein, 14 aa, Entamoeba histolytica
NTDPYYDSEINNEN

SEQ ID NO: 2645108 - protein, 4 aa, Entamoeba histolytica
NTDQ

SEQ ID NO: 2645109 - protein, 7 aa, Entamoeba histolytica
NTDQPEL

SEQ ID NO: 2645110 - protein, 7 aa, Entamoeba histolytica
NTDSDYE

SEQ ID NO: 2645111 - protein, 7 aa, Entamoeba histolytica
NTDTDNY

SEQ ID NO: 2645112 - protein, 8 aa, Entamoeba histolytica
NTDVNHSQ

SEQ ID NO: 2645113 - protein, 17 aa, Entamoeba histolytica
NTDWNTPYKPQAAVGTN

SEQ ID NO: 2645114 - protein, 7 aa, Entamoeba histolytica
NTEDNKR

SEQ ID NO: 2645115 - protein, 6 aa, Entamoeba histolytica
NTEEEI

SEQ ID NO: 2645116 - protein, 13 aa, Entamoeba histolytica
NTEEVQQFLNILC

SEQ ID NO: 2645117 - protein, 6 aa, Entamoeba histolytica
NTEGKP

SEQ ID NO: 2645118 - protein, 6 aa, Entamoeba histolytica
NTEKIE

SEQ ID NO: 2645119 - protein, 9 aa, Entamoeba histolytica
NTEKTIKSQ

SEQ ID NO: 2645120 - protein, 4 aa, Entamoeba histolytica
NTEL

SEQ ID NO: 2645121 - protein, 5 aa, Entamoeba histolytica
NTEPF

SEQ ID NO: 2645122 - protein, 7 aa, Entamoeba histolytica
NTEPQQM

SEQ ID NO: 2645123 - protein, 4 aa, Entamoeba histolytica
NTEQ

SEQ ID NO: 2645124 - protein, 7 aa, Entamoeba histolytica
NTEQAVE

SEQ ID NO: 2645125 - protein, 10 aa, Entamoeba histolytica
NTEQKLKEQL

SEQ ID NO: 2645126 - protein, 17 aa, Entamoeba histolytica
NTEQRPSFEDILNILKQ

SEQ ID NO: 2645127 - protein, 34 aa, Entamoeba histolytica; identical to SEQ ID NO: 2450052

SEQ ID NO: 2645128 - protein, 5 aa, Entamoeba histolytica
NTESI

SEQ ID NO: 2645129 - protein, 6 aa, Entamoeba histolytica
NTESKK

SEQ ID NO: 2645130 - protein, 9 aa, Entamoeba histolytica
NTESPFPNG

SEQ ID NO: 2645131 - protein, 4 aa, Entamoeba histolytica
NTET

SEQ ID NO: 2645132 - protein, 12 aa, Entamoeba histolytica
NTETAKGITGCE

SEQ ID NO: 2645133 - protein, 6 aa, Entamoeba histolytica
NTETPF

SEQ ID NO: 2645134 - protein, 8 aa, Entamoeba histolytica
NTETREID

SEQ ID NO: 2645135 - protein, 12 aa, Entamoeba histolytica
NTEVEQTSPIQD

SEQ ID NO: 2645136 - protein, 13 aa, Entamoeba histolytica
NTEVGISDDSSYG

SEQ ID NO: 2645137 - protein, 15 aa, Entamoeba histolytica
NTEVRGKQLGSTKID

SEQ ID NO: 2645138 - protein, 23 aa, Entamoeba histolytica
NTFGTNGQGTNTGIGTPTPQDFT

SEQ ID NO: 2645139 - protein, 12 aa, Entamoeba histolytica
NTFKPDSECLKD

SEQ ID NO: 2645140 - protein, 4 aa, Entamoeba histolytica
NTFP

SEQ ID NO: 2645141 - protein, 6 aa, Entamoeba histolytica
NTFSGN

SEQ ID NO: 2645142 - protein, 4 aa, Entamoeba histolytica
NTFT

SEQ ID NO: 2645143 - protein, 4 aa, Entamoeba histolytica
NTGA

SEQ ID NO: 2645144 - protein, 10 aa, Entamoeba histolytica
NTGDGKSSLG

SEQ ID NO: 2645145 - protein, 6 aa, Entamoeba histolytica
NTGDIP

SEQ ID NO: 2645146 - protein, 7 aa, Entamoeba histolytica
NTGETTN

SEQ ID NO: 2645147 - protein, 14 aa, Entamoeba histolytica
NTGFGNSTTGNNNT

SEQ ID NO: 2645148 - protein, 6 aa, Entamoeba histolytica
NTGGLV

SEQ ID NO: 2645149 - protein, 9 aa, Entamoeba histolytica
NTGIKSKKT

SEQ ID NO: 2645150 - protein, 18 aa, Entamoeba histolytica
NTGKEENVKEINEKKEIT

SEQ ID NO: 2645151 - protein, 7 aa, Entamoeba histolytica
NTGKKEI

SEQ ID NO: 2645152 - protein, 6 aa, Entamoeba histolytica
NTGKLI

SEQ ID NO: 2645153 - protein, 7 aa, Entamoeba histolytica
NTGLDTS

SEQ ID NO: 2645154 - protein, 8 aa, Entamoeba histolytica
NTGLSGTD

SEQ ID NO: 2645155 - protein, 7 aa, Entamoeba histolytica
NTGNENI

SEQ ID NO: 2645156 - protein, 10 aa, Entamoeba histolytica
NTGPRHPDQP

SEQ ID NO: 2645157 - protein, 5 aa, Entamoeba histolytica
NTGRA

SEQ ID NO: 2645158 - protein, 10 aa, Entamoeba histolytica
NTGSAQPKGV

SEQ ID NO: 2645159 - protein, 12 aa, Entamoeba histolytica
NTHDDETKNKKI

SEQ ID NO: 2645160 - protein, 4 aa, Entamoeba histolytica
NTHE

SEQ ID NO: 2645161 - protein, 16 aa, Entamoeba histolytica
NTHEGSAKKKSSNPLI

SEQ ID NO: 2645162 - protein, 15 aa, Entamoeba histolytica
NTHEGSTKKKSSNPL

SEQ ID NO: 2645163 - protein, 5 aa, Entamoeba histolytica
NTHNG

SEQ ID NO: 2645164 - protein, 7 aa, Entamoeba histolytica
NTIDETK

SEQ ID NO: 2645165 - protein, 22 aa, Entamoeba histolytica
NTIDNEECSIPETKKNTKEDTE

SEQ ID NO: 2645166 - protein, 15 aa, Entamoeba histolytica
NTIDTEKVKKVEKKV

SEQ ID NO: 2645167 - protein, 7 aa, Entamoeba histolytica
NTIDVKG

SEQ ID NO: 2645168 - protein, 6 aa, Entamoeba histolytica
NTIEDL

SEQ ID NO: 2645169 - protein, 7 aa, Entamoeba histolytica
NTIGDKA

SEQ ID NO: 2645170 - protein, 44 aa, Entamoeba histolytica
NTIGNSLTSGFGQNTTQQNSFGGFGQNNQQSNGFGSFGKTGFNA

SEQ ID NO: 2645171 - protein, 14 aa, Entamoeba histolytica
NTIGSKFDGRNEDR

SEQ ID NO: 2645172 - protein, 4 aa, Entamoeba histolytica
NTIK

SEQ ID NO: 2645173 - protein, 6 aa, Entamoeba histolytica
NTIKEP

SEQ ID NO: 2645174 - protein, 13 aa, Entamoeba histolytica
NTIKQSKTEYIKK

SEQ ID NO: 2645175 - protein, 10 aa, Entamoeba histolytica
NTINEGNKEI

SEQ ID NO: 2645176 - protein, 6 aa, Entamoeba histolytica
NTINGK

SEQ ID NO: 2645177 - protein, 5 aa, Entamoeba histolytica
NTINI

SEQ ID NO: 2645178 - protein, 6 aa, Entamoeba histolytica
NTINNQ

SEQ ID NO: 2645179 - protein, 10 aa, Entamoeba histolytica
NTINTSTKDE

SEQ ID NO: 2645180 - protein, 7 aa, Entamoeba histolytica
NTIPYND

SEQ ID NO: 2645181 - protein, 7 aa, Entamoeba histolytica
NTIQPGE

SEQ ID NO: 2645182 - protein, 7 aa, Entamoeba histolytica
NTIQTAN

SEQ ID NO: 2645183 - protein, 16 aa, Entamoeba histolytica
NTISSETPFVLQHYFT

SEQ ID NO: 2645184 - protein, 6 aa, Entamoeba histolytica
NTISSS

SEQ ID NO: 2645185 - protein, 4 aa, Entamoeba histolytica
NTIT

SEQ ID NO: 2645186 - protein, 14 aa, Entamoeba histolytica
NTITPSKVSPETPA

SEQ ID NO: 2645187 - protein, 7 aa, Entamoeba histolytica
NTKAQRK

SEQ ID NO: 2645188 - protein, 4 aa, Entamoeba histolytica
NTKD

SEQ ID NO: 2645189 - protein, 20 aa, Entamoeba histolytica
NTKDCKYNRCGRTDKGVSAF

SEQ ID NO: 2645190 - protein, 6 aa, Entamoeba histolytica
NTKDGF

SEQ ID NO: 2645191 - protein, 8 aa, Entamoeba histolytica
NTKDPDVE

SEQ ID NO: 2645192 - protein, 7 aa, Entamoeba histolytica
NTKDTPV

SEQ ID NO: 2645193 - protein, 6 aa, Entamoeba histolytica
NTKDVD

SEQ ID NO: 2645194 - protein, 6 aa, Entamoeba histolytica
NTKEEI

SEQ ID NO: 2645195 - protein, 6 aa, Entamoeba histolytica
NTKEEV

SEQ ID NO: 2645196 - protein, 8 aa, Entamoeba histolytica
NTKEPNMN

SEQ ID NO: 2645197 - protein, 7 aa, Entamoeba histolytica
NTKEQPE

SEQ ID NO: 2645198 - protein, 14 aa, Entamoeba histolytica
NTKETKADSKSNNR

SEQ ID NO: 2645199 - protein, 6 aa, Entamoeba histolytica
NTKEVK

SEQ ID NO: 2645200 - protein, 9 aa, Entamoeba histolytica
NTKFGDNAS

SEQ ID NO: 2645201 - protein, 13 aa, Entamoeba histolytica
NTKGNGDQTIPYN

SEQ ID NO: 2645202 - protein, 5 aa, Entamoeba histolytica
NTKGY

SEQ ID NO: 2645203 - protein, 6 aa, Entamoeba histolytica
NTKGYP

SEQ ID NO: 2645204 - protein, 5 aa, Entamoeba histolytica
NTKHD

SEQ ID NO: 2645205 - protein, 5 aa, Entamoeba histolytica
NTKIN

SEQ ID NO: 2645206 - protein, 5 aa, Entamoeba histolytica
NTKIQ

SEQ ID NO: 2645207 - protein, 12 aa, Entamoeba histolytica
NTKISENTKTVT

SEQ ID NO: 2645208 - protein, 11 aa, Entamoeba histolytica
NTKKDIEIETD

SEQ ID NO: 2645209 - protein, 5 aa, Entamoeba histolytica
NTKKE

SEQ ID NO: 2645210 - protein, 7 aa, Entamoeba histolytica
NTKKEQR

SEQ ID NO: 2645211 - protein, 9 aa, Entamoeba histolytica
NTKKIQKSI

SEQ ID NO: 2645212 - protein, 23 aa, Entamoeba histolytica
NTKKKGYRHGDTSTPETASLNKS

SEQ ID NO: 2645213 - protein, 14 aa, Entamoeba histolytica
NTKKSKKKEETGMS

SEQ ID NO: 2645214 - protein, 4 aa, Entamoeba histolytica
NTKL

SEQ ID NO: 2645215 - protein, 9 aa, Entamoeba histolytica
NTKLPKDGV

SEQ ID NO: 2645216 - protein, 9 aa, Entamoeba histolytica
NTKNASEIG

SEQ ID NO: 2645217 - protein, 9 aa, Entamoeba histolytica
NTKNKIEPD

SEQ ID NO: 2645218 - protein, 8 aa, Entamoeba histolytica
NTKNSSVT

SEQ ID NO: 2645219 - protein, 7 aa, Entamoeba histolytica
NTKPGVP

SEQ ID NO: 2645220 - protein, 12 aa, Entamoeba histolytica
NTKPIENNNNNK

SEQ ID NO: 2645221 - protein, 9 aa, Entamoeba histolytica
NTKQARKEV

SEQ ID NO: 2645222 - protein, 5 aa, Entamoeba histolytica
NTKQH

SEQ ID NO: 2645223 - protein, 5 aa, Entamoeba histolytica
NTKQY

SEQ ID NO: 2645224 - protein, 5 aa, Entamoeba histolytica
NTKSN

SEQ ID NO: 2645225 - protein, 8 aa, Entamoeba histolytica
NTKTESSL

SEQ ID NO: 2645226 - protein, 8 aa, Entamoeba histolytica
NTKTNGCR

SEQ ID NO: 2645227 - protein, 8 aa, Entamoeba histolytica
NTKTQRDW

SEQ ID NO: 2645228 - protein, 7 aa, Entamoeba histolytica
NTKTSQI

SEQ ID NO: 2645229 - protein, 5 aa, Entamoeba histolytica
NTKVI

SEQ ID NO: 2645230 - protein, 9 aa, Entamoeba histolytica
NTKVNIDKD

SEQ ID NO: 2645231 - protein, 7 aa, Entamoeba histolytica
NTKVSDD

SEQ ID NO: 2645232 - protein, 5 aa, Entamoeba histolytica
NTKYQ

SEQ ID NO: 2645233 - protein, 24 aa, Entamoeba histolytica
NTKYSYDMSKSKKLNNKSLEMGKK

SEQ ID NO: 2645234 - protein, 5 aa, Entamoeba histolytica
NTLCT

SEQ ID NO: 2645235 - protein, 5 aa, Entamoeba histolytica
NTLER

SEQ ID NO: 2645236 - protein, 4 aa, Entamoeba histolytica
NTLG

SEQ ID NO: 2645237 - protein, 8 aa, Entamoeba histolytica
NTLGSSQV

SEQ ID NO: 2645238 - protein, 8 aa, Entamoeba histolytica
NTLHSSST

SEQ ID NO: 2645239 - protein, 17 aa, Entamoeba histolytica
NTLKQKNEFRRGQSQAD

SEQ ID NO: 2645240 - protein, 17 aa, Entamoeba histolytica
NTLPDRYLTSSGEVSVV

SEQ ID NO: 2645241 - protein, 19 aa, Entamoeba histolytica
NTLPKSFTAGVKTKSSIRT

SEQ ID NO: 2645242 - protein, 7 aa, Entamoeba histolytica
NTLPKTI

SEQ ID NO: 2645243 - protein, 17 aa, Entamoeba histolytica
NTLQSEGPELTEIDKEN

SEQ ID NO: 2645244 - protein, 10 aa, Entamoeba histolytica
NTLRRQPPTP

SEQ ID NO: 2645245 - protein, 4 aa, Entamoeba histolytica
NTLS

SEQ ID NO: 2645246 - protein, 7 aa, Entamoeba histolytica
NTLSEGI

SEQ ID NO: 2645247 - protein, 18 aa, Entamoeba histolytica
NTLSPSEAIQTENNSDWD

SEQ ID NO: 2645248 - protein, 5 aa, Entamoeba histolytica
NTLTG

SEQ ID NO: 2645249 - protein, 4 aa, Entamoeba histolytica
NTLY

SEQ ID NO: 2645250 - protein, 4 aa, Entamoeba histolytica
NTMD

SEQ ID NO: 2645251 - protein, 9 aa, Entamoeba histolytica
NTMDESEIK

SEQ ID NO: 2645252 - protein, 4 aa, Entamoeba histolytica
NTMF

SEQ ID NO: 2645253 - protein, 7 aa, Entamoeba histolytica
NTMKNEY

SEQ ID NO: 2645254 - protein, 16 aa, Entamoeba histolytica
NTMTKEKEIKEEEKTK

SEQ ID NO: 2645255 - protein, 4 aa, Entamoeba histolytica
NTNC

SEQ ID NO: 2645256 - protein, 8 aa, Entamoeba histolytica
NTNCKSIK

SEQ ID NO: 2645257 - protein, 8 aa, Entamoeba histolytica
NTNEDNEA

SEQ ID NO: 2645258 - protein, 9 aa, Entamoeba histolytica
NTNENQENK

SEQ ID NO: 2645259 - protein, 8 aa, Entamoeba histolytica
NTNETIKP

SEQ ID NO: 2645260 - protein, 7 aa, Entamoeba histolytica
NTNETTK

SEQ ID NO: 2645261 - protein, 6 aa, Entamoeba histolytica
NTNIKQ

SEQ ID NO: 2645262 - protein, 9 aa, Entamoeba histolytica
NTNKDGIYE

SEQ ID NO: 2645263 - protein, 11 aa, Entamoeba histolytica
NTNKDQPELGH

SEQ ID NO: 2645264 - protein, 4 aa, Entamoeba histolytica
NTNL

SEQ ID NO: 2645265 - protein, 8 aa, Entamoeba histolytica
NTNNNQPI

SEQ ID NO: 2645266 - protein, 7 aa, Entamoeba histolytica
NTNNSQS

SEQ ID NO: 2645267 - protein, 5 aa, Entamoeba histolytica
NTNPE

SEQ ID NO: 2645268 - protein, 63 aa, Entamoeba histolytica
NTNPFESDTLPSTSNNPFSDPSDSITNNTNPFVTNDKPTVSKSPKVSSTNPFGESTTTHNTNP

SEQ ID NO: 2645269 - protein, 10 aa, Entamoeba histolytica
NTNPKKGIVS

SEQ ID NO: 2645270 - protein, 6 aa, Entamoeba histolytica
NTNQIT

SEQ ID NO: 2645271 - protein, 8 aa, Entamoeba histolytica
NTNQNSII

SEQ ID NO: 2645272 - protein, 14 aa, Entamoeba histolytica
NTNSRYTTKSASAM

SEQ ID NO: 2645273 - protein, 16 aa, Entamoeba histolytica
NTNTDSCSSYTNEQIS

SEQ ID NO: 2645274 - protein, 9 aa, Entamoeba histolytica
NTNTNGWKS

SEQ ID NO: 2645275 - protein, 7 aa, Entamoeba histolytica
NTNTPHL

SEQ ID NO: 2645276 - protein, 6 aa, Entamoeba histolytica
NTNTRL

SEQ ID NO: 2645277 - protein, 6 aa, Entamoeba histolytica
NTNVDK

SEQ ID NO: 2645278 - protein, 11 aa, Entamoeba histolytica
NTNYENSINND

SEQ ID NO: 2645279 - protein, 12 aa, Entamoeba histolytica
NTNYSQSTDEII

SEQ ID NO: 2645280 - protein, 5 aa, Entamoeba histolytica
NTNYV

SEQ ID NO: 2645281 - protein, 26 aa, Entamoeba histolytica
NTPEAMEKGKPSKIKVERSGKPKWSK

SEQ ID NO: 2645282 - protein, 6 aa, Entamoeba histolytica
NTPEGH

SEQ ID NO: 2645283 - protein, 6 aa, Entamoeba histolytica
NTPELD

SEQ ID NO: 2645284 - protein, 9 aa, Entamoeba histolytica
NTPEPNDFD

SEQ ID NO: 2645285 - protein, 5 aa, Entamoeba histolytica
NTPEQ

SEQ ID NO: 2645286 - protein, 7 aa, Entamoeba histolytica
NTPESCS

SEQ ID NO: 2645287 - protein, 4 aa, Entamoeba histolytica
NTPF

SEQ ID NO: 2645288 - protein, 7 aa, Entamoeba histolytica
NTPGEES

SEQ ID NO: 2645289 - protein, 5 aa, Entamoeba histolytica
NTPGM

SEQ ID NO: 2645290 - protein, 6 aa, Entamoeba histolytica
NTPKGI

SEQ ID NO: 2645291 - protein, 6 aa, Entamoeba histolytica
NTPLPE

SEQ ID NO: 2645292 - protein, 5 aa, Entamoeba histolytica
NTPLT

SEQ ID NO: 2645293 - protein, 24 aa, Entamoeba histolytica
NTPLTNPEINGRRKRKNNHAGNDA

SEQ ID NO: 2645294 - protein, 4 aa, Entamoeba histolytica
NTPN

SEQ ID NO: 2645295 - protein, 7 aa, Entamoeba histolytica
NTPNEDK

SEQ ID NO: 2645296 - protein, 6 aa, Entamoeba histolytica
NTPNFP

SEQ ID NO: 2645297 - protein, 7 aa, Entamoeba histolytica
NTPNSTP

SEQ ID NO: 2645298 - protein, 7 aa, Entamoeba histolytica
NTPNTKT

SEQ ID NO: 2645299 - protein, 14 aa, Entamoeba histolytica
NTPNTLSPAQPDAF

SEQ ID NO: 2645300 - protein, 4 aa, Entamoeba histolytica
NTPP

SEQ ID NO: 2645301 - protein, 14 aa, Entamoeba histolytica
NTPPAYKKPIPNIQ

SEQ ID NO: 2645302 - protein, 6 aa, Entamoeba histolytica
NTPPSK

SEQ ID NO: 2645303 - protein, 4 aa, Entamoeba histolytica
NTPQ

SEQ ID NO: 2645304 - protein, 6 aa, Entamoeba histolytica
NTPQQL

SEQ ID NO: 2645305 - protein, 6 aa, Entamoeba histolytica
NTPQSS

SEQ ID NO: 2645306 - protein, 6 aa, Entamoeba histolytica
NTPRIQ

SEQ ID NO: 2645307 - protein, 22 aa, Entamoeba histolytica
NTPSASPMPLDGTVTNKDKSPL

SEQ ID NO: 2645308 - protein, 23 aa, Entamoeba histolytica
NTPSASPMPLDGTVTNKDKSPLL

SEQ ID NO: 2645309 - protein, 11 aa, Entamoeba histolytica
NTPSKKRHAQG

SEQ ID NO: 2645310 - protein, 17 aa, Entamoeba histolytica
NTPSQQPSTQQTNSNTF

SEQ ID NO: 2645311 - protein, 5 aa, Entamoeba histolytica
NTPTT

SEQ ID NO: 2645312 - protein, 6 aa, Entamoeba histolytica
NTPTVE

SEQ ID NO: 2645313 - protein, 7 aa, Entamoeba histolytica
NTPYSIS

SEQ ID NO: 2645314 - protein, 10 aa, Entamoeba histolytica
NTQAEATYNK

SEQ ID NO: 2645315 - protein, 6 aa, Entamoeba histolytica
NTQAGV

SEQ ID NO: 2645316 - protein, 4 aa, Entamoeba histolytica
NTQE

SEQ ID NO: 2645317 - protein, 6 aa, Entamoeba histolytica
NTQEGE

SEQ ID NO: 2645318 - protein, 9 aa, Entamoeba histolytica
NTQEKYTKE

SEQ ID NO: 2645319 - protein, 6 aa, Entamoeba histolytica
NTQEMN

SEQ ID NO: 2645320 - protein, 5 aa, Entamoeba histolytica
NTQEP

SEQ ID NO: 2645321 - protein, 9 aa, Entamoeba histolytica
NTQGFKPQT

SEQ ID NO: 2645322 - protein, 6 aa, Entamoeba histolytica
NTQGGK

SEQ ID NO: 2645323 - protein, 6 aa, Entamoeba histolytica
NTQGSL

SEQ ID NO: 2645324 - protein, 6 aa, Entamoeba histolytica
NTQGTL

SEQ ID NO: 2645325 - protein, 12 aa, Entamoeba histolytica
NTQHTNDRNKQY

SEQ ID NO: 2645326 - protein, 4 aa, Entamoeba histolytica
NTQI

SEQ ID NO: 2645327 - protein, 7 aa, Entamoeba histolytica
NTQIKTT

SEQ ID NO: 2645328 - protein, 7 aa, Entamoeba histolytica
NTQKKQR

SEQ ID NO: 2645329 - protein, 18 aa, Entamoeba histolytica
NTQKKVASINDPSVAKDL

SEQ ID NO: 2645330 - protein, 7 aa, Entamoeba histolytica
NTQLQTN

SEQ ID NO: 2645331 - protein, 10 aa, Entamoeba histolytica
NTQNNYGETP

SEQ ID NO: 2645332 - protein, 7 aa, Entamoeba histolytica
NTQNQNI

SEQ ID NO: 2645333 - protein, 15 aa, Entamoeba histolytica
NTQPPKTEQQTQNEI

SEQ ID NO: 2645334 - protein, 31 aa, Entamoeba histolytica
NTQPQQQTNKQQPITNPNQNTFQTINSNSGQ

SEQ ID NO: 2645335 - protein, 4 aa, Entamoeba histolytica
NTQQ

SEQ ID NO: 2645336 - protein, 7 aa, Entamoeba histolytica
NTQQGRT

SEQ ID NO: 2645337 - protein, 5 aa, Entamoeba histolytica
NTQRK

SEQ ID NO: 2645338 - protein, 10 aa, Entamoeba histolytica
NTQSEKQENL

SEQ ID NO: 2645339 - protein, 5 aa, Entamoeba histolytica
NTQTN

SEQ ID NO: 2645340 - protein, 9 aa, Entamoeba histolytica
NTQTPTDDF

SEQ ID NO: 2645341 - protein, 7 aa, Entamoeba histolytica
NTQVETK

SEQ ID NO: 2645342 - protein, 6 aa, Entamoeba histolytica
NTQYSS

SEQ ID NO: 2645343 - protein, 6 aa, Entamoeba histolytica
NTRAKQ

SEQ ID NO: 2645344 - protein, 9 aa, Entamoeba histolytica
NTRDNETSE

SEQ ID NO: 2645345 - protein, 10 aa, Entamoeba histolytica
NTRGSKSYEY

SEQ ID NO: 2645346 - protein, 10 aa, Entamoeba histolytica
NTRKPNPNGV

SEQ ID NO: 2645347 - protein, 7 aa, Entamoeba histolytica
NTRKPTE

SEQ ID NO: 2645348 - protein, 5 aa, Entamoeba histolytica
NTRPI

SEQ ID NO: 2645349 - protein, 13 aa, Entamoeba histolytica
NTRPKKQQRQLPP

SEQ ID NO: 2645350 - protein, 6 aa, Entamoeba histolytica
NTRPSF

SEQ ID NO: 2645351 - protein, 5 aa, Entamoeba histolytica
NTRTM

SEQ ID NO: 2645352 - protein, 5 aa, Entamoeba histolytica
NTRVL

SEQ ID NO: 2645353 - protein, 10 aa, Entamoeba histolytica
NTSCEDESIE

SEQ ID NO: 2645354 - protein, 7 aa, Entamoeba histolytica
NTSDSIN

SEQ ID NO: 2645355 - protein, 4 aa, Entamoeba histolytica
NTSE

SEQ ID NO: 2645356 - protein, 9 aa, Entamoeba histolytica
NTSEDEDEI

SEQ ID NO: 2645357 - protein, 6 aa, Entamoeba histolytica
NTSENE

SEQ ID NO: 2645358 - protein, 12 aa, Entamoeba histolytica
NTSETQDTEEVS

SEQ ID NO: 2645359 - protein, 4 aa, Entamoeba histolytica
NTSF

SEQ ID NO: 2645360 - protein, 12 aa, Entamoeba histolytica
NTSFKEKDNNFI

SEQ ID NO: 2645361 - protein, 6 aa, Entamoeba histolytica
NTSGAV

SEQ ID NO: 2645362 - protein, 6 aa, Entamoeba histolytica
NTSGTI

SEQ ID NO: 2645363 - protein, 8 aa, Entamoeba histolytica
NTSHGGTH

SEQ ID NO: 2645364 - protein, 9 aa, Entamoeba histolytica
NTSHPDFDT

SEQ ID NO: 2645365 - protein, 4 aa, Entamoeba histolytica
NTSI

SEQ ID NO: 2645366 - protein, 9 aa, Entamoeba histolytica
NTSIDREAI

SEQ ID NO: 2645367 - protein, 18 aa, Entamoeba histolytica
NTSINGPQIADSGRSKLI

SEQ ID NO: 2645368 - protein, 6 aa, Entamoeba histolytica
NTSISR

SEQ ID NO: 2645369 - protein, 5 aa, Entamoeba histolytica
NTSKE

SEQ ID NO: 2645370 - protein, 10 aa, Entamoeba histolytica
NTSKEENEKI

SEQ ID NO: 2645371 - protein, 8 aa, Entamoeba histolytica
NTSKLQQQ

SEQ ID NO: 2645372 - protein, 19 aa, Entamoeba histolytica
NTSKQPSNSSVSLRRTKSM

SEQ ID NO: 2645373 - protein, 13 aa, Entamoeba histolytica
NTSKSAKSDSNQT

SEQ ID NO: 2645374 - protein, 16 aa, Entamoeba histolytica
NTSKSKSSSPNIQQTN

SEQ ID NO: 2645375 - protein, 6 aa, Entamoeba histolytica
NTSLPF

SEQ ID NO: 2645376 - protein, 10 aa, Entamoeba histolytica
NTSLTDEQKA

SEQ ID NO: 2645377 - protein, 9 aa, Entamoeba histolytica
NTSNKESEL

SEQ ID NO: 2645378 - protein, 10 aa, Entamoeba histolytica
NTSNLKAVSS

SEQ ID NO: 2645379 - protein, 8 aa, Entamoeba histolytica
NTSNMPVA

SEQ ID NO: 2645380 - protein, 8 aa, Entamoeba histolytica
NTSNNEIP

SEQ ID NO: 2645381 - protein, 7 aa, Entamoeba histolytica
NTSNSSN

SEQ ID NO: 2645382 - protein, 7 aa, Entamoeba histolytica
NTSPETC

SEQ ID NO: 2645383 - protein, 10 aa, Entamoeba histolytica
NTSPETKSDI

SEQ ID NO: 2645384 - protein, 6 aa, Entamoeba histolytica
NTSPNH

SEQ ID NO: 2645385 - protein, 6 aa, Entamoeba histolytica
NTSPQA

SEQ ID NO: 2645386 - protein, 28 aa, Entamoeba histolytica
NTSPSNSPSFNSSQKQSSSTSKVDSNDI

SEQ ID NO: 2645387 - protein, 8 aa, Entamoeba histolytica
NTSPTASV

SEQ ID NO: 2645388 - protein, 8 aa, Entamoeba histolytica
NTSPTMKS

SEQ ID NO: 2645389 - protein, 7 aa, Entamoeba histolytica
NTSQEFK

SEQ ID NO: 2645390 - protein, 22 aa, Entamoeba histolytica
NTSQKLEVSDTKRFKEAVEADP

SEQ ID NO: 2645391 - protein, 17 aa, Entamoeba histolytica
NTSQSTLLTTPTPLNAQ

SEQ ID NO: 2645392 - protein, 6 aa, Entamoeba histolytica
NTSREI

SEQ ID NO: 2645393 - protein, 5 aa, Entamoeba histolytica
NTSRN

SEQ ID NO: 2645394 - protein, 5 aa, Entamoeba histolytica
NTSSF

SEQ ID NO: 2645395 - protein, 8 aa, Entamoeba histolytica
NTSSFHPE

SEQ ID NO: 2645396 - protein, 9 aa, Entamoeba histolytica
NTSSKAEFA

SEQ ID NO: 2645397 - protein, 7 aa, Entamoeba histolytica
NTSSNTC

SEQ ID NO: 2645398 - protein, 16 aa, Entamoeba histolytica
NTSSQLKNAILKMKTY

SEQ ID NO: 2645399 - protein, 8 aa, Entamoeba histolytica
NTSSSNSH

SEQ ID NO: 2645400 - protein, 9 aa, Entamoeba histolytica
NTSSSSQEI

SEQ ID NO: 2645401 - protein, 7 aa, Entamoeba histolytica
NTSSSTI

SEQ ID NO: 2645402 - protein, 5 aa, Entamoeba histolytica
NTSSY

SEQ ID NO: 2645403 - protein, 9 aa, Entamoeba histolytica
NTSVNQMTS

SEQ ID NO: 2645404 - protein, 5 aa, Entamoeba histolytica
NTSYD

SEQ ID NO: 2645405 - protein, 10 aa, Entamoeba histolytica
NTTAEETLKE

SEQ ID NO: 2645406 - protein, 19 aa, Entamoeba histolytica
NTTAKQAQNELKQYQKQHK

SEQ ID NO: 2645407 - protein, 12 aa, Entamoeba histolytica
NTTENNEIPNGV

SEQ ID NO: 2645408 - protein, 17 aa, Entamoeba histolytica
NTTEPNNQKEETKPKKI

SEQ ID NO: 2645409 - protein, 4 aa, Entamoeba histolytica
NTTF

SEQ ID NO: 2645410 - protein, 7 aa, Entamoeba histolytica
NTTGGYE

SEQ ID NO: 2645411 - protein, 5 aa, Entamoeba histolytica
NTTHE

SEQ ID NO: 2645412 - protein, 4 aa, Entamoeba histolytica
NTTI

SEQ ID NO: 2645413 - protein, 11 aa, Entamoeba histolytica
NTTIDKSSITI

SEQ ID NO: 2645414 - protein, 31 aa, Entamoeba histolytica
NTTIKDNFTPELQSSKTQEKKIKNEEYERKK

SEQ ID NO: 2645415 - protein, 5 aa, Entamoeba histolytica
NTTIN

SEQ ID NO: 2645416 - protein, 7 aa, Entamoeba histolytica
NTTIPKE

SEQ ID NO: 2645417 - protein, 13 aa, Entamoeba histolytica
NTTIPSGNTENVI

SEQ ID NO: 2645418 - protein, 19 aa, Entamoeba histolytica
NTTITVSGKKLSKECLNNN

SEQ ID NO: 2645419 - protein, 7 aa, Entamoeba histolytica
NTTKEGN

SEQ ID NO: 2645420 - protein, 9 aa, Entamoeba histolytica
NTTKREELH

SEQ ID NO: 2645421 - protein, 17 aa, Entamoeba histolytica
NTTKTDIDISKRKETEL

SEQ ID NO: 2645422 - protein, 7 aa, Entamoeba histolytica
NTTKVRA

SEQ ID NO: 2645423 - protein, 8 aa, Entamoeba histolytica
NTTLPPKE

SEQ ID NO: 2645424 - protein, 6 aa, Entamoeba histolytica
NTTLTE

SEQ ID NO: 2645425 - protein, 5 aa, Entamoeba histolytica
NTTND

SEQ ID NO: 2645426 - protein, 10 aa, Entamoeba histolytica
NTTNSPQQMM

SEQ ID NO: 2645427 - protein, 4 aa, Entamoeba histolytica
NTTP

SEQ ID NO: 2645428 - protein, 21 aa, Entamoeba histolytica
NTTPTQPKQQEEKKDQPKKKI

SEQ ID NO: 2645429 - protein, 6 aa, Entamoeba histolytica
NTTQPN

SEQ ID NO: 2645430 - protein, 14 aa, Entamoeba histolytica
NTTQVPKSEDSGYG

SEQ ID NO: 2645431 - protein, 22 aa, Entamoeba histolytica
NTTSFSTKPISTLGHPRPFSAT

SEQ ID NO: 2645432 - protein, 7 aa, Entamoeba histolytica
NTTSKQH

SEQ ID NO: 2645433 - protein, 6 aa, Entamoeba histolytica
NTTTKE

SEQ ID NO: 2645434 - protein, 6 aa, Entamoeba histolytica
NTTTKP

SEQ ID NO: 2645435 - protein, 7 aa, Entamoeba histolytica
NTTTNKI

SEQ ID NO: 2645436 - protein, 6 aa, Entamoeba histolytica
NTTTPL

SEQ ID NO: 2645437 - protein, 6 aa, Entamoeba histolytica
NTTTRK

SEQ ID NO: 2645438 - protein, 5 aa, Entamoeba histolytica
NTTTS

SEQ ID NO: 2645439 - protein, 8 aa, Entamoeba histolytica
NTTVDGKQ

SEQ ID NO: 2645440 - protein, 7 aa, Entamoeba histolytica
NTVDPNQ

SEQ ID NO: 2645441 - protein, 5 aa, Entamoeba histolytica
NTVHD

SEQ ID NO: 2645442 - protein, 9 aa, Entamoeba histolytica
NTVNPSCST

SEQ ID NO: 2645443 - protein, 19 aa, Entamoeba histolytica
NTVNSQEIPEINEEDMSAL

SEQ ID NO: 2645444 - protein, 18 aa, Entamoeba histolytica
NTVQPETTPIQQVPQQQF

SEQ ID NO: 2645445 - protein, 4 aa, Entamoeba histolytica
NTVR

SEQ ID NO: 2645446 - protein, 5 aa, Entamoeba histolytica
NTVRG

SEQ ID NO: 2645447 - protein, 11 aa, Entamoeba histolytica
NTVSHKGEGID

SEQ ID NO: 2645448 - protein, 4 aa, Entamoeba histolytica
NTYC

SEQ ID NO: 2645449 - protein, 8 aa, Entamoeba histolytica
NTYDSPDR

SEQ ID NO: 2645450 - protein, 8 aa, Entamoeba histolytica
NTYEGSDE

SEQ ID NO: 2645451 - protein, 55 aa, Entamoeba histolytica
NTYLNNQSKTTTTSNLQTPNETSEDNLNTQNDGVSSMVSSNPELSPRTKPQRTLS

SEQ ID NO: 2645452 - protein, 4 aa, Entamoeba histolytica
NTYS

SEQ ID NO: 2645453 - protein, 5 aa, Entamoeba histolytica
NTYTI

SEQ ID NO: 2645454 - protein, 8 aa, Entamoeba histolytica
NVASGDAV

SEQ ID NO: 2645455 - protein, 14 aa, Entamoeba histolytica
NVCDELRDKKKELV

SEQ ID NO: 2645456 - protein, 4 aa, Entamoeba histolytica
NVDD

SEQ ID NO: 2645457 - protein, 14 aa, Entamoeba histolytica
NVDDVSGSKSFSKK

SEQ ID NO: 2645458 - protein, 7 aa, Entamoeba histolytica
NVDEQDL

SEQ ID NO: 2645459 - protein, 28 aa, Entamoeba histolytica
NVDFKTKTIEKKKEDSQKKVKEKKKKVE

SEQ ID NO: 2645460 - protein, 7 aa, Entamoeba histolytica
NVDGQNH

SEQ ID NO: 2645461 - protein, 5 aa, Entamoeba histolytica
NVDLG

SEQ ID NO: 2645462 - protein, 7 aa, Entamoeba histolytica
NVDSETI

SEQ ID NO: 2645463 - protein, 5 aa, Entamoeba histolytica
NVDSF

SEQ ID NO: 2645464 - protein, 9 aa, Entamoeba histolytica
NVDSNGLQI

SEQ ID NO: 2645465 - protein, 17 aa, Entamoeba histolytica
NVDSQPPEASEKENEEV

SEQ ID NO: 2645466 - protein, 6 aa, Entamoeba histolytica
NVDTRI

SEQ ID NO: 2645467 - protein, 11 aa, Entamoeba histolytica
NVEEKSSTLRN

SEQ ID NO: 2645468 - protein, 5 aa, Entamoeba histolytica
NVEEL

SEQ ID NO: 2645469 - protein, 9 aa, Entamoeba histolytica
NVEENADEG

SEQ ID NO: 2645470 - protein, 6 aa, Entamoeba histolytica
NVEGKA

SEQ ID NO: 2645471 - protein, 4 aa, Entamoeba histolytica
NVEM

SEQ ID NO: 2645472 - protein, 4 aa, Entamoeba histolytica
NVEP

SEQ ID NO: 2645473 - protein, 8 aa, Entamoeba histolytica
NVEPSLKK

SEQ ID NO: 2645474 - protein, 27 aa, Entamoeba histolytica
NVEPTRNKEISKEDKKKINKAKGDVEN

SEQ ID NO: 2645475 - protein, 6 aa, Entamoeba histolytica
NVEQEK

SEQ ID NO: 2645476 - protein, 8 aa, Entamoeba histolytica
NVEQSIPS

SEQ ID NO: 2645477 - protein, 16 aa, Entamoeba histolytica
NVEREDTIKPDEEKGL

SEQ ID NO: 2645478 - protein, 8 aa, Entamoeba histolytica
NVERRKNI

SEQ ID NO: 2645479 - protein, 4 aa, Entamoeba histolytica
NVET

SEQ ID NO: 2645480 - protein, 15 aa, Entamoeba histolytica
NVFGSYNSKQIPEIK

SEQ ID NO: 2645481 - protein, 36 aa, Entamoeba histolytica
NVGGSQPSSLNTTQNLNNSIQSNTSIQQSNLQQNNQ

SEQ ID NO: 2645482 - protein, 6 aa, Entamoeba histolytica
NVGKTS

SEQ ID NO: 2645483 - protein, 5 aa, Entamoeba histolytica
NVGKV

SEQ ID NO: 2645484 - protein, 15 aa, Entamoeba histolytica
NVGSASSKGEEQETV

SEQ ID NO: 2645485 - protein, 5 aa, Entamoeba histolytica
NVGSG

SEQ ID NO: 2645486 - protein, 7 aa, Entamoeba histolytica
NVHNEKP

SEQ ID NO: 2645487 - protein, 5 aa, Entamoeba histolytica
NVIST

SEQ ID NO: 2645488 - protein, 28 aa, Entamoeba histolytica
NVITENTKTQNLTKKTKKKIIKKTISLD

SEQ ID NO: 2645489 - protein, 14 aa, Entamoeba histolytica
NVITGSVDGSIRSS

SEQ ID NO: 2645490 - protein, 16 aa, Entamoeba histolytica
NVKDEKKPKEIHRDGK

SEQ ID NO: 2645491 - protein, 17 aa, Entamoeba histolytica
NVKEESKDDSEEEEQEF

SEQ ID NO: 2645492 - protein, 9 aa, Entamoeba histolytica
NVKHPNDGA

SEQ ID NO: 2645493 - protein, 6 aa, Entamoeba histolytica
NVKKRH

SEQ ID NO: 2645494 - protein, 4 aa, Entamoeba histolytica
NVKL

SEQ ID NO: 2645495 - protein, 8 aa, Entamoeba histolytica
NVKNDEEV

SEQ ID NO: 2645496 - protein, 7 aa, Entamoeba histolytica
NVKNGNV

SEQ ID NO: 2645497 - protein, 7 aa, Entamoeba histolytica
NVKNTIQ

SEQ ID NO: 2645498 - protein, 7 aa, Entamoeba histolytica
NVKPYQI

SEQ ID NO: 2645499 - protein, 4 aa, Entamoeba histolytica
NVKQ

SEQ ID NO: 2645500 - protein, 10 aa, Entamoeba histolytica
NVKQKTKIDN

SEQ ID NO: 2645501 - protein, 23 aa, Entamoeba histolytica
NVKTPTKVNSLQETLKQEEEKKR

SEQ ID NO: 2645502 - protein, 6 aa, Entamoeba histolytica
NVKTYT

SEQ ID NO: 2645503 - protein, 40 aa, Entamoeba histolytica
NVLKPKGKKPNTKQKSDKRDEAVQQNIEKAESEEITKSDT

SEQ ID NO: 2645504 - protein, 7 aa, Entamoeba histolytica
NVLPTSS

SEQ ID NO: 2645505 - protein, 21 aa, Entamoeba histolytica
NVMEEEEEEKINKDNNQFNEE

SEQ ID NO: 2645506 - protein, 8 aa, Entamoeba histolytica
NVNDTDQQ

SEQ ID NO: 2645507 - protein, 11 aa, Entamoeba histolytica
NVNENDLKKAY

SEQ ID NO: 2645508 - protein, 9 aa, Entamoeba histolytica
NVNGSPKHH

SEQ ID NO: 2645509 - protein, 9 aa, Entamoeba histolytica
NVNKQDSYR

SEQ ID NO: 2645510 - protein, 6 aa, Entamoeba histolytica
NVNPED

SEQ ID NO: 2645511 - protein, 6 aa, Entamoeba histolytica
NVNSSQ

SEQ ID NO: 2645512 - protein, 7 aa, Entamoeba histolytica
NVNTQSK

SEQ ID NO: 2645513 - protein, 6 aa, Entamoeba histolytica
NVPDNY

SEQ ID NO: 2645514 - protein, 4 aa, Entamoeba histolytica
NVPE

SEQ ID NO: 2645515 - protein, 5 aa, Entamoeba histolytica
NVPEG

SEQ ID NO: 2645516 - protein, 8 aa, Entamoeba histolytica
NVPEPING

SEQ ID NO: 2645517 - protein, 5 aa, Entamoeba histolytica
NVPHN

SEQ ID NO: 2645518 - protein, 7 aa, Entamoeba histolytica
NVPHPTP

SEQ ID NO: 2645519 - protein, 5 aa, Entamoeba histolytica
NVPIE

SEQ ID NO: 2645520 - protein, 6 aa, Entamoeba histolytica
NVPITT

SEQ ID NO: 2645521 - protein, 6 aa, Entamoeba histolytica
NVPKVA

SEQ ID NO: 2645522 - protein, 17 aa, Entamoeba histolytica
NVPNNSNGEEGTSDEEF

SEQ ID NO: 2645523 - protein, 11 aa, Entamoeba histolytica
NVPPPPPPAFD

SEQ ID NO: 2645524 - protein, 31 aa, Entamoeba histolytica
NVPPPPPPKPSNTNHSRSSGWSNTRPSENLS

SEQ ID NO: 2645525 - protein, 20 aa, Entamoeba histolytica
NVPRSSYKFTEDEINSKRSF

SEQ ID NO: 2645526 - protein, 8 aa, Entamoeba histolytica
NVPSDDGD

SEQ ID NO: 2645527 - protein, 6 aa, Entamoeba histolytica
NVPTDD

SEQ ID NO: 2645528 - protein, 4 aa, Entamoeba histolytica
NVQC

SEQ ID NO: 2645529 - protein, 26 aa, Entamoeba histolytica
NVQKLEQARHKRNQQAQQVLMAGGKI

SEQ ID NO: 2645530 - protein, 9 aa, Entamoeba histolytica
NVQQPQQQY

SEQ ID NO: 2645531 - protein, 10 aa, Entamoeba histolytica
NVQRPGETHR

SEQ ID NO: 2645532 - protein, 7 aa, Entamoeba histolytica
NVQSSIN

SEQ ID NO: 2645533 - protein, 6 aa, Entamoeba histolytica
NVRATA

SEQ ID NO: 2645534 - protein, 9 aa, Entamoeba histolytica
NVRETKEPW

SEQ ID NO: 2645535 - protein, 4 aa, Entamoeba histolytica
NVRG

SEQ ID NO: 2645536 - protein, 13 aa, Entamoeba histolytica
NVRTRENKVEGKV

SEQ ID NO: 2645537 - protein, 8 aa, Entamoeba histolytica
NVSDEDRE

SEQ ID NO: 2645538 - protein, 7 aa, Entamoeba histolytica
NVSDPKF

SEQ ID NO: 2645539 - protein, 5 aa, Entamoeba histolytica
NVSDY

SEQ ID NO: 2645540 - protein, 5 aa, Entamoeba histolytica
NVSEI

SEQ ID NO: 2645541 - protein, 7 aa, Entamoeba histolytica
NVSELGD

SEQ ID NO: 2645542 - protein, 26 aa, Entamoeba histolytica
NVSGESESSSESLDKPEVSPRYQQTH

SEQ ID NO: 2645543 - protein, 8 aa, Entamoeba histolytica
NVSGNKQK

SEQ ID NO: 2645544 - protein, 8 aa, Entamoeba histolytica
NVSHTPTP

SEQ ID NO: 2645545 - protein, 10 aa, Entamoeba histolytica
NVSNNDKNKL

SEQ ID NO: 2645546 - protein, 5 aa, Entamoeba histolytica
NVSPE

SEQ ID NO: 2645547 - protein, 7 aa, Entamoeba histolytica
NVSQERP

SEQ ID NO: 2645548 - protein, 6 aa, Entamoeba histolytica
NVSRED

SEQ ID NO: 2645549 - protein, 7 aa, Entamoeba histolytica
NVSRQDD

SEQ ID NO: 2645550 - protein, 18 aa, Entamoeba histolytica
NVSSKKEQKTEEVQGNNM

SEQ ID NO: 2645551 - protein, 6 aa, Entamoeba histolytica
NVSTTE

SEQ ID NO: 2645552 - protein, 5 aa, Entamoeba histolytica
NVSYQ

SEQ ID NO: 2645553 - protein, 10 aa, Entamoeba histolytica
NVTDETTDAD

SEQ ID NO: 2645554 - protein, 12 aa, Entamoeba histolytica
NVTDKKKEYEEV

SEQ ID NO: 2645555 - protein, 8 aa, Entamoeba histolytica
NVTEPKPI

SEQ ID NO: 2645556 - protein, 9 aa, Entamoeba histolytica
NVTFSNPPK

SEQ ID NO: 2645557 - protein, 4 aa, Entamoeba histolytica
NVTK

SEQ ID NO: 2645558 - protein, 8 aa, Entamoeba histolytica
NVTKKARV

SEQ ID NO: 2645559 - protein, 4 aa, Entamoeba histolytica
NVTN

SEQ ID NO: 2645560 - protein, 6 aa, Entamoeba histolytica
NVTPDS

SEQ ID NO: 2645561 - protein, 20 aa, Entamoeba histolytica
NVTPRVPSHVPPQKPLQQSQ

SEQ ID NO: 2645562 - protein, 6 aa, Entamoeba histolytica
NVTQPS

SEQ ID NO: 2645563 - protein, 9 aa, Entamoeba histolytica
NVTQPSIDE

SEQ ID NO: 2645564 - protein, 4 aa, Entamoeba histolytica
NVTT

SEQ ID NO: 2645565 - protein, 24 aa, Entamoeba histolytica
NVTTEIKPLSSSKLKDLSSISEDD

SEQ ID NO: 2645566 - protein, 9 aa, Entamoeba histolytica
NVTTTQKSE

SEQ ID NO: 2645567 - protein, 4 aa, Entamoeba histolytica
NVVS

SEQ ID NO: 2645568 - protein, 32 aa, Entamoeba histolytica
NVYENSTLKSTESINTLTPEQQEQLKTQEAEI

SEQ ID NO: 2645569 - protein, 8 aa, Entamoeba histolytica
NVYTRKGN

SEQ ID NO: 2645570 - protein, 9 aa, Entamoeba histolytica
NWASSPQQF

SEQ ID NO: 2645571 - protein, 6 aa, Entamoeba histolytica
NWDPND

SEQ ID NO: 2645572 - protein, 5 aa, Entamoeba histolytica
NWEQD

SEQ ID NO: 2645573 - protein, 6 aa, Entamoeba histolytica
NWNYPK

SEQ ID NO: 2645574 - protein, 13 aa, Entamoeba histolytica
NWRESVNTQQASP

SEQ ID NO: 2645575 - protein, 7 aa, Entamoeba histolytica
NWSTQTD

SEQ ID NO: 2645576 - protein, 5 aa, Entamoeba histolytica
NWTGE

SEQ ID NO: 2645577 - protein, 5 aa, Entamoeba histolytica
NYADP

SEQ ID NO: 2645578 - protein, 7 aa, Entamoeba histolytica
NYAEAVT

SEQ ID NO: 2645579 - protein, 7 aa, Entamoeba histolytica
NYAKTNS

SEQ ID NO: 2645580 - protein, 13 aa, Entamoeba histolytica
NYASDKIDKSTIL

SEQ ID NO: 2645581 - protein, 5 aa, Entamoeba histolytica
NYCPQ

SEQ ID NO: 2645582 - protein, 28 aa, Entamoeba histolytica
NYDASDKNKEEQGEEENKEENKLKKEIE

SEQ ID NO: 2645583 - protein, 10 aa, Entamoeba histolytica
NYDDNLTESK

SEQ ID NO: 2645584 - protein, 4 aa, Entamoeba histolytica
NYDG

SEQ ID NO: 2645585 - protein, 8 aa, Entamoeba histolytica
NYDSDGMS

SEQ ID NO: 2645586 - protein, 9 aa, Entamoeba histolytica
NYDTTSDSA

SEQ ID NO: 2645587 - protein, 11 aa, Entamoeba histolytica
NYEQQMSSTNQ

SEQ ID NO: 2645588 - protein, 5 aa, Entamoeba histolytica
NYERV

SEQ ID NO: 2645589 - protein, 6 aa, Entamoeba histolytica
NYETHE

SEQ ID NO: 2645590 - protein, 40 aa, Entamoeba histolytica
NYFDPDNESERVNKPDLINEDYSKTEESIFDDPDYEEYNK

SEQ ID NO: 2645591 - protein, 7 aa, Entamoeba histolytica
NYFNEST

SEQ ID NO: 2645592 - protein, 21 aa, Entamoeba histolytica
NYFPGTGDVDEVGIDEGKNYS

SEQ ID NO: 2645593 - protein, 26 aa, Entamoeba histolytica
NYFQSQQKTPRLESESKKKKGEHKTE

SEQ ID NO: 2645594 - protein, 10 aa, Entamoeba histolytica
NYGDKITNDT

SEQ ID NO: 2645595 - protein, 9 aa, Entamoeba histolytica
NYGEGDQRL

SEQ ID NO: 2645596 - protein, 23 aa, Entamoeba histolytica
NYGELDENAQINATFSASSAVTS

SEQ ID NO: 2645597 - protein, 10 aa, Entamoeba histolytica
NYGEPIGSDA

SEQ ID NO: 2645598 - protein, 5 aa, Entamoeba histolytica
NYGIS

SEQ ID NO: 2645599 - protein, 12 aa, Entamoeba histolytica
NYGRSKRPGIGM

SEQ ID NO: 2645600 - protein, 13 aa, Entamoeba histolytica
NYGSTQKFLPNTN

SEQ ID NO: 2645601 - protein, 6 aa, Entamoeba histolytica
NYHGQD

SEQ ID NO: 2645602 - protein, 6 aa, Entamoeba histolytica
NYHSSS

SEQ ID NO: 2645603 - protein, 10 aa, Entamoeba histolytica
NYHTNSSRQI

SEQ ID NO: 2645604 - protein, 8 aa, Entamoeba histolytica
NYIKPTPI

SEQ ID NO: 2645605 - protein, 5 aa, Entamoeba histolytica
NYIND

SEQ ID NO: 2645606 - protein, 8 aa, Entamoeba histolytica
NYITKDNT

SEQ ID NO: 2645607 - protein, 9 aa, Entamoeba histolytica
NYKAKETEI

SEQ ID NO: 2645608 - protein, 15 aa, Entamoeba histolytica
NYKETRKLEKKPEIE

SEQ ID NO: 2645609 - protein, 8 aa, Entamoeba histolytica
NYKGSDIS

SEQ ID NO: 2645610 - protein, 19 aa, Entamoeba histolytica
NYKINEDEISVGSSYPSSL

SEQ ID NO: 2645611 - protein, 21 aa, Entamoeba histolytica
NYKKEQRKNIKHHKDKQAQIK

SEQ ID NO: 2645612 - protein, 11 aa, Entamoeba histolytica
NYKKPLKKEIS

SEQ ID NO: 2645613 - protein, 5 aa, Entamoeba histolytica
NYKNG

SEQ ID NO: 2645614 - protein, 9 aa, Entamoeba histolytica
NYKPENAKK

SEQ ID NO: 2645615 - protein, 19 aa, Entamoeba histolytica
NYKPTQKKEENDSKNILPE

SEQ ID NO: 2645616 - protein, 11 aa, Entamoeba histolytica
NYKQMTGKRPM

SEQ ID NO: 2645617 - protein, 12 aa, Entamoeba histolytica
NYKSWASDPNDL

SEQ ID NO: 2645618 - protein, 16 aa, Entamoeba histolytica
NYKTINAKEAMQNPNS

SEQ ID NO: 2645619 - protein, 10 aa, Entamoeba histolytica
NYKTSNKVAQ

SEQ ID NO: 2645620 - protein, 5 aa, Entamoeba histolytica
NYLPP

SEQ ID NO: 2645621 - protein, 21 aa, Entamoeba histolytica
NYLSSNKNYIGTSFKSKFPFY

SEQ ID NO: 2645622 - protein, 5 aa, Entamoeba histolytica
NYNDY

SEQ ID NO: 2645623 - protein, 7 aa, Entamoeba histolytica
NYNEKKE

SEQ ID NO: 2645624 - protein, 10 aa, Entamoeba histolytica
NYNEPSGKGN

SEQ ID NO: 2645625 - protein, 18 aa, Entamoeba histolytica
NYNGVDENGIKKPINKKD

SEQ ID NO: 2645626 - protein, 13 aa, Entamoeba histolytica
NYNKPLPNNLEEQ

SEQ ID NO: 2645627 - protein, 4 aa, Entamoeba histolytica
NYNN

SEQ ID NO: 2645628 - protein, 8 aa, Entamoeba histolytica
NYNNYKKE

SEQ ID NO: 2645629 - protein, 4 aa, Entamoeba histolytica
NYNP

SEQ ID NO: 2645630 - protein, 6 aa, Entamoeba histolytica
NYNPKH

SEQ ID NO: 2645631 - protein, 9 aa, Entamoeba histolytica
NYNSKEEMK

SEQ ID NO: 2645632 - protein, 5 aa, Entamoeba histolytica
NYNSR

SEQ ID NO: 2645633 - protein, 19 aa, Entamoeba histolytica
NYPAKWTTPNKNYVRGYKK

SEQ ID NO: 2645634 - protein, 4 aa, Entamoeba histolytica
NYPE

SEQ ID NO: 2645635 - protein, 6 aa, Entamoeba histolytica
NYPESQ

SEQ ID NO: 2645636 - protein, 10 aa, Entamoeba histolytica
NYPIGDDGRP

SEQ ID NO: 2645637 - protein, 12 aa, Entamoeba histolytica
NYPKVPNRSQTK

SEQ ID NO: 2645638 - protein, 6 aa, Entamoeba histolytica
NYPLGG

SEQ ID NO: 2645639 - protein, 12 aa, Entamoeba histolytica
NYPPLAEQSNVS

SEQ ID NO: 2645640 - protein, 18 aa, Entamoeba histolytica
NYPPLKKRKENLSEIQST

SEQ ID NO: 2645641 - protein, 53 aa, Entamoeba histolytica
NYPPNLKTNTQSVSFGSSNHLTEKKHSTSLRPKLQKRTNRQKEEAKLKASGEL

SEQ ID NO: 2645642 - protein, 22 aa, Entamoeba histolytica
NYPPSTPAMNSQYTTQTPMPNY

SEQ ID NO: 2645643 - protein, 4 aa, Entamoeba histolytica
NYPQ

SEQ ID NO: 2645644 - protein, 9 aa, Entamoeba histolytica
NYPSCGGNG

SEQ ID NO: 2645645 - protein, 6 aa, Entamoeba histolytica
NYPTEN

SEQ ID NO: 2645646 - protein, 5 aa, Entamoeba histolytica
NYPTG

SEQ ID NO: 2645647 - protein, 5 aa, Entamoeba histolytica
NYQAT

SEQ ID NO: 2645648 - protein, 8 aa, Entamoeba histolytica
NYQDDSSI

SEQ ID NO: 2645649 - protein, 7 aa, Entamoeba histolytica
NYQERKN

SEQ ID NO: 2645650 - protein, 12 aa, Entamoeba histolytica
NYQNGSENEREE

SEQ ID NO: 2645651 - protein, 11 aa, Entamoeba histolytica
NYQNQRQPQIS

SEQ ID NO: 2645652 - protein, 7 aa, Entamoeba histolytica
NYQNTKT

SEQ ID NO: 2645653 - protein, 8 aa, Entamoeba histolytica
NYQPPEEM

SEQ ID NO: 2645654 - protein, 8 aa, Entamoeba histolytica
NYQPQFEE

SEQ ID NO: 2645655 - protein, 7 aa, Entamoeba histolytica
NYQSEQE

SEQ ID NO: 2645656 - protein, 7 aa, Entamoeba histolytica
NYRDTSL

SEQ ID NO: 2645657 - protein, 12 aa, Entamoeba histolytica
NYRKNSTKGKVK

SEQ ID NO: 2645658 - protein, 7 aa, Entamoeba histolytica
NYRPKST

SEQ ID NO: 2645659 - protein, 9 aa, Entamoeba histolytica
NYSDNHNPF

SEQ ID NO: 2645660 - protein, 5 aa, Entamoeba histolytica
NYSEE

SEQ ID NO: 2645661 - protein, 6 aa, Entamoeba histolytica
NYSFQE

SEQ ID NO: 2645662 - protein, 7 aa, Entamoeba histolytica
NYSHNNE

SEQ ID NO: 2645663 - protein, 11 aa, Entamoeba histolytica
NYSHPNQPQIT

SEQ ID NO: 2645664 - protein, 6 aa, Entamoeba histolytica
NYSNNE

SEQ ID NO: 2645665 - protein, 8 aa, Entamoeba histolytica
NYSPGKSV

SEQ ID NO: 2645666 - protein, 5 aa, Entamoeba histolytica
NYSRE

SEQ ID NO: 2645667 - protein, 6 aa, Entamoeba histolytica
NYSSDS

SEQ ID NO: 2645668 - protein, 19 aa, Entamoeba histolytica
NYSSKDNTWETEDDIRTKY

SEQ ID NO: 2645669 - protein, 4 aa, Entamoeba histolytica
NYST

SEQ ID NO: 2645670 - protein, 5 aa, Entamoeba histolytica
NYSTE

SEQ ID NO: 2645671 - protein, 6 aa, Entamoeba histolytica
NYSTLQ

SEQ ID NO: 2645672 - protein, 8 aa, Entamoeba histolytica
NYSTLTTG

SEQ ID NO: 2645673 - protein, 7 aa, Entamoeba histolytica
NYTEKYP

SEQ ID NO: 2645674 - protein, 4 aa, Entamoeba histolytica
NYTR

SEQ ID NO: 2645675 - protein, 6 aa, Entamoeba histolytica
NYTTND

SEQ ID NO: 2645676 - protein, 6 aa, Entamoeba histolytica
NYVGET

SEQ ID NO: 2645677 - protein, 9 aa, Entamoeba histolytica
NYVNKREVA

SEQ ID NO: 2645678 - protein, 8 aa, Entamoeba histolytica
NYVNNESI

SEQ ID NO: 2645679 - protein, 10 aa, Entamoeba histolytica
NYYKEDSSIQ

SEQ ID NO: 2645680 - protein, 8 aa, Entamoeba histolytica
PAAPKPNA

SEQ ID NO: 2645681 - protein, 7 aa, Entamoeba histolytica
PAASHPR

SEQ ID NO: 2645682 - protein, 11 aa, Entamoeba histolytica
PACTSRTNLDP

SEQ ID NO: 2645683 - protein, 4 aa, Entamoeba histolytica
PADG

SEQ ID NO: 2645684 - protein, 8 aa, Entamoeba histolytica
PADGKSKC

SEQ ID NO: 2645685 - protein, 13 aa, Entamoeba histolytica
PADKEKMKRTQRI

SEQ ID NO: 2645686 - protein, 7 aa, Entamoeba histolytica
PADKVGD

SEQ ID NO: 2645687 - protein, 9 aa, Entamoeba histolytica
PADSPNYRK

SEQ ID NO: 2645688 - protein, 7 aa, Entamoeba histolytica
PADSSEE

SEQ ID NO: 2645689 - protein, 7 aa, Entamoeba histolytica
PAEKGEY

SEQ ID NO: 2645690 - protein, 7 aa, Entamoeba histolytica
PAETAKV

SEQ ID NO: 2645691 - protein, 15 aa, Entamoeba histolytica
PAFSGDQSDVDHRDK

SEQ ID NO: 2645692 - protein, 5 aa, Entamoeba histolytica
PAFSS

SEQ ID NO: 2645693 - protein, 9 aa, Entamoeba histolytica
PAGEKNGVE

SEQ ID NO: 2645694 - protein, 4 aa, Entamoeba histolytica
PAGF

SEQ ID NO: 2645695 - protein, 6 aa, Entamoeba histolytica
PAGLPE

SEQ ID NO: 2645696 - protein, 10 aa, Entamoeba histolytica
PAGSTGYSKS

SEQ ID NO: 2645697 - protein, 11 aa, Entamoeba histolytica
PAHDPNDYNGA

SEQ ID NO: 2645698 - protein, 8 aa, Entamoeba histolytica
PAKPHGEA

SEQ ID NO: 2645699 - protein, 19 aa, Entamoeba histolytica
PAKPIRSDNVNTPAPQPIH

SEQ ID NO: 2645700 - protein, 5 aa, Entamoeba histolytica
PAKPL

SEQ ID NO: 2645701 - protein, 4 aa, Entamoeba histolytica
PAKS

SEQ ID NO: 2645702 - protein, 7 aa, Entamoeba histolytica
PAKSEQD

SEQ ID NO: 2645703 - protein, 9 aa, Entamoeba histolytica
PAKSNIKPI

SEQ ID NO: 2645704 - protein, 8 aa, Entamoeba histolytica
PAKYGRNS

SEQ ID NO: 2645705 - protein, 15 aa, Entamoeba histolytica
PAMANSNRKPPSRNL

SEQ ID NO: 2645706 - protein, 10 aa, Entamoeba histolytica
PANCSERHNS

SEQ ID NO: 2645707 - protein, 7 aa, Entamoeba histolytica
PANEEVE

SEQ ID NO: 2645708 - protein, 44 aa, Entamoeba histolytica
PANSNTISDTDRTPKESSHSTRRGSNQLLPPPSSTGIPIRQTPQ

SEQ ID NO: 2645709 - protein, 7 aa, Entamoeba histolytica
PANYAEA

SEQ ID NO: 2645710 - protein, 9 aa, Entamoeba histolytica
PAPAPKEID

SEQ ID NO: 2645711 - protein, 9 aa, Entamoeba histolytica
PAPEGSAPG

SEQ ID NO: 2645712 - protein, 8 aa, Entamoeba histolytica
PAPGDYTS

SEQ ID NO: 2645713 - protein, 9 aa, Entamoeba histolytica
PAPKDKEKQ

SEQ ID NO: 2645714 - protein, 5 aa, Entamoeba histolytica
PAPPF

SEQ ID NO: 2645715 - protein, 5 aa, Entamoeba histolytica
PAPPL

SEQ ID NO: 2645716 - protein, 8 aa, Entamoeba histolytica
PAPQPEWY

SEQ ID NO: 2645717 - protein, 7 aa, Entamoeba histolytica
PAPRGTG

SEQ ID NO: 2645718 - protein, 7 aa, Entamoeba histolytica
PAPTSIP

SEQ ID NO: 2645719 - protein, 5 aa, Entamoeba histolytica
PAQLQ

SEQ ID NO: 2645720 - protein, 8 aa, Entamoeba histolytica
PAQNYQTP

SEQ ID NO: 2645721 - protein, 4 aa, Entamoeba histolytica
PAQY

SEQ ID NO: 2645722 - protein, 12 aa, Entamoeba histolytica
PARGDKLSSPFQ

SEQ ID NO: 2645723 - protein, 6 aa, Entamoeba histolytica
PASATL

SEQ ID NO: 2645724 - protein, 5 aa, Entamoeba histolytica
PASEL

SEQ ID NO: 2645725 - protein, 11 aa, Entamoeba histolytica
PASGEAAKAYA

SEQ ID NO: 2645726 - protein, 6 aa, Entamoeba histolytica
PASGYV

SEQ ID NO: 2645727 - protein, 7 aa, Entamoeba histolytica
PASNIKG

SEQ ID NO: 2645728 - protein, 9 aa, Entamoeba histolytica
PASPSENAA

SEQ ID NO: 2645729 - protein, 18 aa, Entamoeba histolytica
PASRSIQQDPDGDDETLE

SEQ ID NO: 2645730 - protein, 13 aa, Entamoeba histolytica
PASSKFCGSCGHK

SEQ ID NO: 2645731 - protein, 6 aa, Entamoeba histolytica
PASVDE

SEQ ID NO: 2645732 - protein, 5 aa, Entamoeba histolytica
PATDK

SEQ ID NO: 2645733 - protein, 8 aa, Entamoeba histolytica
PATGSETN

SEQ ID NO: 2645734 - protein, 10 aa, Entamoeba histolytica
PATGSNDLDI

SEQ ID NO: 2645735 - protein, 10 aa, Entamoeba histolytica
PATKRSRSIL

SEQ ID NO: 2645736 - protein, 13 aa, Entamoeba histolytica
PATPIDSPPLIQF

SEQ ID NO: 2645737 - protein, 18 aa, Entamoeba histolytica
PATPMTPSMARAPPKTPG

SEQ ID NO: 2645738 - protein, 6 aa, Entamoeba histolytica
PATSHF

SEQ ID NO: 2645739 - protein, 10 aa, Entamoeba histolytica
PAVPSKPTRL

SEQ ID NO: 2645740 - protein, 5 aa, Entamoeba histolytica
PAVTP

SEQ ID NO: 2645741 - protein, 9 aa, Entamoeba histolytica
PAWTPDMTA

SEQ ID NO: 2645742 - protein, 11 aa, Entamoeba histolytica
PAYKESTGNPM

SEQ ID NO: 2645743 - protein, 14 aa, Entamoeba histolytica
PAYRTEWDSSMKSE

SEQ ID NO: 2645744 - protein, 5 aa, Entamoeba histolytica
PCNKR

SEQ ID NO: 2645745 - protein, 7 aa, Entamoeba histolytica
PCPSKNE

SEQ ID NO: 2645746 - protein, 13 aa, Entamoeba histolytica
PCQNDDENKNGGR

SEQ ID NO: 2645747 - protein, 8 aa, Entamoeba histolytica
PCRNKPPF

SEQ ID NO: 2645748 - protein, 14 aa, Entamoeba histolytica
PCSGDGTLRKSSNP

SEQ ID NO: 2645749 - protein, 10 aa, Entamoeba histolytica
PCSPGDKGAM

SEQ ID NO: 2645750 - protein, 10 aa, Entamoeba histolytica
PCTEGPGKII

SEQ ID NO: 2645751 - protein, 7 aa, Entamoeba histolytica
PCTSDTH

SEQ ID NO: 2645752 - protein, 8 aa, Entamoeba histolytica
PDAEEKVT

SEQ ID NO: 2645753 - protein, 6 aa, Entamoeba histolytica
PDASTA

SEQ ID NO: 2645754 - protein, 4 aa, Entamoeba histolytica
PDAT

SEQ ID NO: 2645755 - protein, 4 aa, Entamoeba histolytica
PDAV

SEQ ID NO: 2645756 - protein, 13 aa, Entamoeba histolytica
PDCTDACEDDNEF

SEQ ID NO: 2645757 - protein, 6 aa, Entamoeba histolytica
PDDDDF

SEQ ID NO: 2645758 - protein, 10 aa, Entamoeba histolytica
PDDDEVPKKE

SEQ ID NO: 2645759 - protein, 12 aa, Entamoeba histolytica
PDDGVENSDYGE

SEQ ID NO: 2645760 - protein, 4 aa, Entamoeba histolytica
PDDH

SEQ ID NO: 2645761 - protein, 5 aa, Entamoeba histolytica
PDDID

SEQ ID NO: 2645762 - protein, 7 aa, Entamoeba histolytica
PDDLLGK

SEQ ID NO: 2645763 - protein, 7 aa, Entamoeba histolytica
PDDPPIS

SEQ ID NO: 2645764 - protein, 25 aa, Entamoeba histolytica
PDDPRASRDHRNEFREQRNPQPFYS

SEQ ID NO: 2645765 - protein, 8 aa, Entamoeba histolytica
PDDPTLPS

SEQ ID NO: 2645766 - protein, 12 aa, Entamoeba histolytica
PDDSHGSRQGSV

SEQ ID NO: 2645767 - protein, 6 aa, Entamoeba histolytica
PDDSIS

SEQ ID NO: 2645768 - protein, 5 aa, Entamoeba histolytica
PDDTI

SEQ ID NO: 2645769 - protein, 9 aa, Entamoeba histolytica
PDDYPTESF

SEQ ID NO: 2645770 - protein, 6 aa, Entamoeba histolytica
PDDYTD

SEQ ID NO: 2645771 - protein, 8 aa, Entamoeba histolytica
PDEDENGM

SEQ ID NO: 2645772 - protein, 14 aa, Entamoeba histolytica
PDEEGKSTKRNSSD

SEQ ID NO: 2645773 - protein, 16 aa, Entamoeba histolytica
PDEEKVEMKDNSQTTP

SEQ ID NO: 2645774 - protein, 5 aa, Entamoeba histolytica
PDEEL

SEQ ID NO: 2645775 - protein, 5 aa, Entamoeba histolytica
PDEEP

SEQ ID NO: 2645776 - protein, 7 aa, Entamoeba histolytica
PDEEPEE

SEQ ID NO: 2645777 - protein, 5 aa, Entamoeba histolytica
PDEHG

SEQ ID NO: 2645778 - protein, 6 aa, Entamoeba histolytica
PDEKEE

SEQ ID NO: 2645779 - protein, 8 aa, Entamoeba histolytica
PDEKEWPD

SEQ ID NO: 2645780 - protein, 11 aa, Entamoeba histolytica
PDERSERMKED

SEQ ID NO: 2645781 - protein, 5 aa, Entamoeba histolytica
PDETG

SEQ ID NO: 2645782 - protein, 6 aa, Entamoeba histolytica
PDFESK

SEQ ID NO: 2645783 - protein, 10 aa, Entamoeba histolytica
PDFGETTSTL

SEQ ID NO: 2645784 - protein, 9 aa, Entamoeba histolytica
PDFQEPEKT

SEQ ID NO: 2645785 - protein, 11 aa, Entamoeba histolytica
PDFQPDAERET

SEQ ID NO: 2645786 - protein, 9 aa, Entamoeba histolytica
PDGDISGTL

SEQ ID NO: 2645787 - protein, 8 aa, Entamoeba histolytica
PDGENNKE

SEQ ID NO: 2645788 - protein, 5 aa, Entamoeba histolytica
PDGID

SEQ ID NO: 2645789 - protein, 17 aa, Entamoeba histolytica
PDGIQKPRFGEKLNKEA

SEQ ID NO: 2645790 - protein, 11 aa, Entamoeba histolytica
PDGIQRRRTEI

SEQ ID NO: 2645791 - protein, 8 aa, Entamoeba histolytica
PDGKKEKT

SEQ ID NO: 2645792 - protein, 13 aa, Entamoeba histolytica
PDGKNILSRYDIL

SEQ ID NO: 2645793 - protein, 4 aa, Entamoeba histolytica
PDGR

SEQ ID NO: 2645794 - protein, 8 aa, Entamoeba histolytica
PDGRPRNV

SEQ ID NO: 2645795 - protein, 4 aa, Entamoeba histolytica
PDGS

SEQ ID NO: 2645796 - protein, 33 aa, Entamoeba histolytica
PDGSEKGPKVKAEIEVKEKKQKKQPKKVEQNEK

SEQ ID NO: 2645797 - protein, 13 aa, Entamoeba histolytica
PDGSGNTKSAPVK

SEQ ID NO: 2645798 - protein, 10 aa, Entamoeba histolytica
PDGSLSTNEF

SEQ ID NO: 2645799 - protein, 8 aa, Entamoeba histolytica
PDGSSHKI

SEQ ID NO: 2645800 - protein, 7 aa, Entamoeba histolytica
PDGSTKK

SEQ ID NO: 2645801 - protein, 6 aa, Entamoeba histolytica
PDGTDY

SEQ ID NO: 2645802 - protein, 5 aa, Entamoeba histolytica
PDGTE

SEQ ID NO: 2645803 - protein, 7 aa, Entamoeba histolytica
PDGTKPY

SEQ ID NO: 2645804 - protein, 10 aa, Entamoeba histolytica
PDGVDERKAP

SEQ ID NO: 2645805 - protein, 7 aa, Entamoeba histolytica
PDGVTSP

SEQ ID NO: 2645806 - protein, 5 aa, Entamoeba histolytica
PDIDS

SEQ ID NO: 2645807 - protein, 12 aa, Entamoeba histolytica
PDIENKIDSPQR

SEQ ID NO: 2645808 - protein, 8 aa, Entamoeba histolytica
PDIKGVSS

SEQ ID NO: 2645809 - protein, 7 aa, Entamoeba histolytica
PDINNPL

SEQ ID NO: 2645810 - protein, 4 aa, Entamoeba histolytica
PDIP

SEQ ID NO: 2645811 - protein, 13 aa, Entamoeba histolytica
PDIPEQQNVTGKE

SEQ ID NO: 2645812 - protein, 4 aa, Entamoeba histolytica
PDIS

SEQ ID NO: 2645813 - protein, 13 aa, Entamoeba histolytica
PDKEEEEEQVEPE

SEQ ID NO: 2645814 - protein, 7 aa, Entamoeba histolytica
PDKEQSE

SEQ ID NO: 2645815 - protein, 4 aa, Entamoeba histolytica
PDKL

SEQ ID NO: 2645816 - protein, 7 aa, Entamoeba histolytica
PDKPSKP

SEQ ID NO: 2645817 - protein, 7 aa, Entamoeba histolytica
PDKPTID

SEQ ID NO: 2645818 - protein, 15 aa, Entamoeba histolytica
PDKPTPQPSKDSKLK

SEQ ID NO: 2645819 - protein, 9 aa, Entamoeba histolytica
PDKQTTFGI

SEQ ID NO: 2645820 - protein, 8 aa, Entamoeba histolytica
PDKTPNDI

SEQ ID NO: 2645821 - protein, 18 aa, Entamoeba histolytica
PDLGSGNDIKLGTNSSVQ

SEQ ID NO: 2645822 - protein, 6 aa, Entamoeba histolytica
PDLPTT

SEQ ID NO: 2645823 - protein, 4 aa, Entamoeba histolytica
PDLS

SEQ ID NO: 2645824 - protein, 11 aa, Entamoeba histolytica
PDNCNSRPKGF

SEQ ID NO: 2645825 - protein, 5 aa, Entamoeba histolytica
PDNDL

SEQ ID NO: 2645826 - protein, 16 aa, Entamoeba histolytica
PDNDYPRRIKRDKQSF

SEQ ID NO: 2645827 - protein, 15 aa, Entamoeba histolytica
PDNEGSQKLERKRHI

SEQ ID NO: 2645828 - protein, 7 aa, Entamoeba histolytica
PDNESKY

SEQ ID NO: 2645829 - protein, 9 aa, Entamoeba histolytica
PDNKSALST

SEQ ID NO: 2645830 - protein, 4 aa, Entamoeba histolytica
PDNL

SEQ ID NO: 2645831 - protein, 8 aa, Entamoeba histolytica
PDNLPPDI

SEQ ID NO: 2645832 - protein, 5 aa, Entamoeba histolytica
PDNNS

SEQ ID NO: 2645833 - protein, 7 aa, Entamoeba histolytica
PDNSQTK

SEQ ID NO: 2645834 - protein, 4 aa, Entamoeba histolytica
PDNT

SEQ ID NO: 2645835 - protein, 5 aa, Entamoeba histolytica
PDNVE

SEQ ID NO: 2645836 - protein, 7 aa, Entamoeba histolytica
PDPGDFD

SEQ ID NO: 2645837 - protein, 6 aa, Entamoeba histolytica
PDPKKL

SEQ ID NO: 2645838 - protein, 4 aa, Entamoeba histolytica
PDPQ

SEQ ID NO: 2645839 - protein, 7 aa, Entamoeba histolytica
PDPRKSD

SEQ ID NO: 2645840 - protein, 9 aa, Entamoeba histolytica
PDPSFKKGF

SEQ ID NO: 2645841 - protein, 7 aa, Entamoeba histolytica
PDPTPTQ

SEQ ID NO: 2645842 - protein, 5 aa, Entamoeba histolytica
PDPYE

SEQ ID NO: 2645843 - protein, 7 aa, Entamoeba histolytica
PDQISQK

SEQ ID NO: 2645844 - protein, 9 aa, Entamoeba histolytica
PDQKIAPSD

SEQ ID NO: 2645845 - protein, 15 aa, Entamoeba histolytica
PDQPKKVLNQKEASD

SEQ ID NO: 2645846 - protein, 25 aa, Entamoeba histolytica
PDQQVEEQKKENNFPKIQDDQSSIQ

SEQ ID NO: 2645847 - protein, 7 aa, Entamoeba histolytica
PDQTEEN

SEQ ID NO: 2645848 - protein, 5 aa, Entamoeba histolytica
PDQYN

SEQ ID NO: 2645849 - protein, 6 aa, Entamoeba histolytica
PDRAQG

SEQ ID NO: 2645850 - protein, 5 aa, Entamoeba histolytica
PDRES

SEQ ID NO: 2645851 - protein, 16 aa, Entamoeba histolytica
PDRNPNNKEEASEKFK

SEQ ID NO: 2645852 - protein, 9 aa, Entamoeba histolytica
PDSDDYDND

SEQ ID NO: 2645853 - protein, 12 aa, Entamoeba histolytica
PDSDEEGEEEYF

SEQ ID NO: 2645854 - protein, 7 aa, Entamoeba histolytica
PDSDPSL

SEQ ID NO: 2645855 - protein, 8 aa, Entamoeba histolytica
PDSDSPEC

SEQ ID NO: 2645856 - protein, 19 aa, Entamoeba histolytica
PDSEATKNFKRIYKEIITN

SEQ ID NO: 2645857 - protein, 4 aa, Entamoeba histolytica
PDSI

SEQ ID NO: 2645858 - protein, 23 aa, Entamoeba histolytica
PDSLSNSKNKSPSSKSPSCKSPL

SEQ ID NO: 2645859 - protein, 5 aa, Entamoeba histolytica
PDSPF

SEQ ID NO: 2645860 - protein, 12 aa, Entamoeba histolytica
PDSSASLLTPAD

SEQ ID NO: 2645861 - protein, 11 aa, Entamoeba histolytica
PDSSIGANSEV

SEQ ID NO: 2645862 - protein, 7 aa, Entamoeba histolytica
PDSSLEE

SEQ ID NO: 2645863 - protein, 5 aa, Entamoeba histolytica
PDSVT

SEQ ID NO: 2645864 - protein, 4 aa, Entamoeba histolytica
PDTD

SEQ ID NO: 2645865 - protein, 15 aa, Entamoeba histolytica
PDTEEQGDLATTQQV

SEQ ID NO: 2645866 - protein, 35 aa, Entamoeba histolytica
PDTEISEEEYITSEDEDLEIEDGKLEEEKVDVTTK

SEQ ID NO: 2645867 - protein, 4 aa, Entamoeba histolytica
PDTF

SEQ ID NO: 2645868 - protein, 5 aa, Entamoeba histolytica
PDTHQ

SEQ ID NO: 2645869 - protein, 11 aa, Entamoeba histolytica
PDTNPLDSNRQ

SEQ ID NO: 2645870 - protein, 7 aa, Entamoeba histolytica
PDTPGID

SEQ ID NO: 2645871 - protein, 5 aa, Entamoeba histolytica
PDTRN

SEQ ID NO: 2645872 - protein, 11 aa, Entamoeba histolytica
PDTSTGANSEV

SEQ ID NO: 2645873 - protein, 5 aa, Entamoeba histolytica
PDTTA

SEQ ID NO: 2645874 - protein, 7 aa, Entamoeba histolytica
PDTTPNC

SEQ ID NO: 2645875 - protein, 7 aa, Entamoeba histolytica
PDTTRLS

SEQ ID NO: 2645876 - protein, 5 aa, Entamoeba histolytica
PDVNK

SEQ ID NO: 2645877 - protein, 7 aa, Entamoeba histolytica
PDVPAQP

SEQ ID NO: 2645878 - protein, 7 aa, Entamoeba histolytica
PDVSNRV

SEQ ID NO: 2645879 - protein, 4 aa, Entamoeba histolytica
PDVT

SEQ ID NO: 2645880 - protein, 14 aa, Entamoeba histolytica
PDWGEEESQRGYPM

SEQ ID NO: 2645881 - protein, 13 aa, Entamoeba histolytica
PDYEENEDTNINE

SEQ ID NO: 2645882 - protein, 5 aa, Entamoeba histolytica
PDYHN

SEQ ID NO: 2645883 - protein, 4 aa, Entamoeba histolytica
PDYP

SEQ ID NO: 2645884 - protein, 8 aa, Entamoeba histolytica
PDYRGNWD

SEQ ID NO: 2645885 - protein, 21 aa, Entamoeba histolytica
PDYYNTDTDDYSTANGLNYHN

SEQ ID NO: 2645886 - protein, 18 aa, Entamoeba histolytica
PEAISQAKSHYKESKLTK

SEQ ID NO: 2645887 - protein, 8 aa, Entamoeba histolytica
PEAPMEKE

SEQ ID NO: 2645888 - protein, 6 aa, Entamoeba histolytica
PEARYG

SEQ ID NO: 2645889 - protein, 5 aa, Entamoeba histolytica
PECGP

SEQ ID NO: 2645890 - protein, 4 aa, Entamoeba histolytica
PECS

SEQ ID NO: 2645891 - protein, 6 aa, Entamoeba histolytica
PEDDEF

SEQ ID NO: 2645892 - protein, 10 aa, Entamoeba histolytica
PEDDNDTIHK

SEQ ID NO: 2645893 - protein, 8 aa, Entamoeba histolytica
PEDEDTPA

SEQ ID NO: 2645894 - protein, 19 aa, Entamoeba histolytica
PEDEESTHCESDSELSIER

SEQ ID NO: 2645895 - protein, 16 aa, Entamoeba histolytica
PEDELEKKAREAKEDA

SEQ ID NO: 2645896 - protein, 11 aa, Entamoeba histolytica
PEDGSVPTTKI

SEQ ID NO: 2645897 - protein, 11 aa, Entamoeba histolytica
PEDIETNQTNI

SEQ ID NO: 2645898 - protein, 5 aa, Entamoeba histolytica
PEDIT

SEQ ID NO: 2645899 - protein, 11 aa, Entamoeba histolytica
PEDKCAKAASF

SEQ ID NO: 2645900 - protein, 6 aa, Entamoeba histolytica
PEDKEI

SEQ ID NO: 2645901 - protein, 9 aa, Entamoeba histolytica
PEDKETELS

SEQ ID NO: 2645902 - protein, 8 aa, Entamoeba histolytica
PEDKTKTT

SEQ ID NO: 2645903 - protein, 7 aa, Entamoeba histolytica
PEDPLGK

SEQ ID NO: 2645904 - protein, 11 aa, Entamoeba histolytica
PEDPLNDNLTG

SEQ ID NO: 2645905 - protein, 7 aa, Entamoeba histolytica
PEDPTDV

SEQ ID NO: 2645906 - protein, 10 aa, Entamoeba histolytica
PEDRGKDFPN

SEQ ID NO: 2645907 - protein, 7 aa, Entamoeba histolytica
PEDSELD

SEQ ID NO: 2645908 - protein, 7 aa, Entamoeba histolytica
PEDSPYD

SEQ ID NO: 2645909 - protein, 4 aa, Entamoeba histolytica
PEDV

SEQ ID NO: 2645910 - protein, 5 aa, Entamoeba histolytica
PEDYI

SEQ ID NO: 2645911 - protein, 4 aa, Entamoeba histolytica
PEEC

SEQ ID NO: 2645912 - protein, 8 aa, Entamoeba histolytica
PEEDKEIT

SEQ ID NO: 2645913 - protein, 13 aa, Entamoeba histolytica
PEEEDSKRPKERH

SEQ ID NO: 2645914 - protein, 6 aa, Entamoeba histolytica
PEEENN

SEQ ID NO: 2645915 - protein, 4 aa, Entamoeba histolytica
PEEI

SEQ ID NO: 2645916 - protein, 6 aa, Entamoeba histolytica
PEEKQE

SEQ ID NO: 2645917 - protein, 7 aa, Entamoeba histolytica
PEELKNN

SEQ ID NO: 2645918 - protein, 4 aa, Entamoeba histolytica
PEEM

SEQ ID NO: 2645919 - protein, 5 aa, Entamoeba histolytica
PEENT

SEQ ID NO: 2645920 - protein, 5 aa, Entamoeba histolytica
PEENY

SEQ ID NO: 2645921 - protein, 9 aa, Entamoeba histolytica
PEEPAEPSN

SEQ ID NO: 2645922 - protein, 9 aa, Entamoeba histolytica
PEERDAEAI

SEQ ID NO: 2645923 - protein, 10 aa, Entamoeba histolytica
PEESAKAPAE

SEQ ID NO: 2645924 - protein, 5 aa, Entamoeba histolytica
PEETK

SEQ ID NO: 2645925 - protein, 9 aa, Entamoeba histolytica
PEETNTKEL

SEQ ID NO: 2645926 - protein, 5 aa, Entamoeba histolytica
PEEVN

SEQ ID NO: 2645927 - protein, 10 aa, Entamoeba histolytica
PEEVPEDRRN

SEQ ID NO: 2645928 - protein, 5 aa, Entamoeba histolytica
PEEVR

SEQ ID NO: 2645929 - protein, 4 aa, Entamoeba histolytica
PEEY

SEQ ID NO: 2645930 - protein, 17 aa, Entamoeba histolytica
PEEYDDIKRSEKEIERL

SEQ ID NO: 2645931 - protein, 5 aa, Entamoeba histolytica
PEEYR

SEQ ID NO: 2645932 - protein, 14 aa, Entamoeba histolytica
PEFEEAGKEDTPDA

SEQ ID NO: 2645933 - protein, 7 aa, Entamoeba histolytica
PEFGNKK

SEQ ID NO: 2645934 - protein, 5 aa, Entamoeba histolytica
PEFGT

SEQ ID NO: 2645935 - protein, 4 aa, Entamoeba histolytica
PEFH

SEQ ID NO: 2645936 - protein, 4 aa, Entamoeba histolytica
PEFP

SEQ ID NO: 2645937 - protein, 10 aa, Entamoeba histolytica
PEFPEPKNIM

SEQ ID NO: 2645938 - protein, 31 aa, Entamoeba histolytica
PEFPSQQQKTNDNQSVNTHQNNTTKEDDDIE

SEQ ID NO: 2645939 - protein, 7 aa, Entamoeba histolytica
PEFQSEG

SEQ ID NO: 2645940 - protein, 5 aa, Entamoeba histolytica
PEGCT

SEQ ID NO: 2645941 - protein, 10 aa, Entamoeba histolytica
PEGDITPEYT

SEQ ID NO: 2645942 - protein, 6 aa, Entamoeba histolytica
PEGEDT

SEQ ID NO: 2645943 - protein, 6 aa, Entamoeba histolytica
PEGEGI

SEQ ID NO: 2645944 - protein, 10 aa, Entamoeba histolytica
PEGGLPSDEL

SEQ ID NO: 2645945 - protein, 16 aa, Entamoeba histolytica
PEGKGNGLKVKDGDQV

SEQ ID NO: 2645946 - protein, 10 aa, Entamoeba histolytica
PEGLDPKSLE

SEQ ID NO: 2645947 - protein, 5 aa, Entamoeba histolytica
PEGMK

SEQ ID NO: 2645948 - protein, 4 aa, Entamoeba histolytica
PEGP

SEQ ID NO: 2645949 - protein, 7 aa, Entamoeba histolytica
PEGSEKA

SEQ ID NO: 2645950 - protein, 9 aa, Entamoeba histolytica
PEGTEYEGG

SEQ ID NO: 2645951 - protein, 9 aa, Entamoeba histolytica
PEHKTSDRI

SEQ ID NO: 2645952 - protein, 4 aa, Entamoeba histolytica
PEHP

SEQ ID NO: 2645953 - protein, 16 aa, Entamoeba histolytica
PEHPYNPTSPKPKIPS

SEQ ID NO: 2645954 - protein, 4 aa, Entamoeba histolytica
PEIK

SEQ ID NO: 2645955 - protein, 5 aa, Entamoeba histolytica
PEIKQ

SEQ ID NO: 2645956 - protein, 8 aa, Entamoeba histolytica
PEIPSQVK

SEQ ID NO: 2645957 - protein, 6 aa, Entamoeba histolytica
PEIQEQ

SEQ ID NO: 2645958 - protein, 17 aa, Entamoeba histolytica
PEIRNGEGRVPRPLPRS

SEQ ID NO: 2645959 - protein, 13 aa, Entamoeba histolytica
PEISTSNSYDQAS

SEQ ID NO: 2645960 - protein, 4 aa, Entamoeba histolytica
PEIT

SEQ ID NO: 2645961 - protein, 13 aa, Entamoeba histolytica
PEITSKDASYTSQ

SEQ ID NO: 2645962 - protein, 13 aa, Entamoeba histolytica
PEKFSPKEAPIGF

SEQ ID NO: 2645963 - protein, 14 aa, Entamoeba histolytica
PEKGTDTGKIKRKK

SEQ ID NO: 2645964 - protein, 10 aa, Entamoeba histolytica
PEKKVAGEGF

SEQ ID NO: 2645965 - protein, 7 aa, Entamoeba histolytica
PEKLSAY

SEQ ID NO: 2645966 - protein, 9 aa, Entamoeba histolytica
PEKNDETNE

SEQ ID NO: 2645967 - protein, 7 aa, Entamoeba histolytica
PEKPIST

SEQ ID NO: 2645968 - protein, 7 aa, Entamoeba histolytica
PEKQIPE

SEQ ID NO: 2645969 - protein, 13 aa, Entamoeba histolytica
PEKRATAEKALES

SEQ ID NO: 2645970 - protein, 9 aa, Entamoeba histolytica
PEKRSYKIE

SEQ ID NO: 2645971 - protein, 5 aa, Entamoeba histolytica
PEKSQ

SEQ ID NO: 2645972 - protein, 18 aa, Entamoeba histolytica
PEKTPSPNGDGQQSGISK

SEQ ID NO: 2645973 - protein, 25 aa, Entamoeba histolytica
PEKTSYEQNNNKTESYDTKKDDDQF

SEQ ID NO: 2645974 - protein, 11 aa, Entamoeba histolytica
PEKTTEDNNKY

SEQ ID NO: 2645975 - protein, 6 aa, Entamoeba histolytica
PEKVDI

SEQ ID NO: 2645976 - protein, 5 aa, Entamoeba histolytica
PEKVQ

SEQ ID NO: 2645977 - protein, 4 aa, Entamoeba histolytica
PEKW

SEQ ID NO: 2645978 - protein, 5 aa, Entamoeba histolytica
PEKYP

SEQ ID NO: 2645979 - protein, 7 aa, Entamoeba histolytica
PEKYSNK

SEQ ID NO: 2645980 - protein, 7 aa, Entamoeba histolytica
PELKESA

SEQ ID NO: 2645981 - protein, 12 aa, Entamoeba histolytica
PELKKCTSKNDQ

SEQ ID NO: 2645982 - protein, 10 aa, Entamoeba histolytica
PELKNEDDIE

SEQ ID NO: 2645983 - protein, 7 aa, Entamoeba histolytica
PELNKTQ

SEQ ID NO: 2645984 - protein, 4 aa, Entamoeba histolytica
PELP

SEQ ID NO: 2645985 - protein, 5 aa, Entamoeba histolytica
PELPA

SEQ ID NO: 2645986 - protein, 10 aa, Entamoeba histolytica
PELPKTRIPH

SEQ ID NO: 2645987 - protein, 8 aa, Entamoeba histolytica
PELPNSSA

SEQ ID NO: 2645988 - protein, 7 aa, Entamoeba histolytica
PELPQSN

SEQ ID NO: 2645989 - protein, 6 aa, Entamoeba histolytica
PELPSV

SEQ ID NO: 2645990 - protein, 9 aa, Entamoeba histolytica
PELQSAKDI

SEQ ID NO: 2645991 - protein, 5 aa, Entamoeba histolytica
PELRP

SEQ ID NO: 2645992 - protein, 5 aa, Entamoeba histolytica
PELRV

SEQ ID NO: 2645993 - protein, 4 aa, Entamoeba histolytica
PEMN

SEQ ID NO: 2645994 - protein, 9 aa, Entamoeba histolytica
PENAQGTFN

SEQ ID NO: 2645995 - protein, 4 aa, Entamoeba histolytica
PEND

SEQ ID NO: 2645996 - protein, 7 aa, Entamoeba histolytica
PENDKNI

SEQ ID NO: 2645997 - protein, 9 aa, Entamoeba histolytica
PENDSKKEE

SEQ ID NO: 2645998 - protein, 6 aa, Entamoeba histolytica
PENDSN

SEQ ID NO: 2645999 - protein, 7 aa, Entamoeba histolytica
PENDTDV

SEQ ID NO: 2646000 - protein, 5 aa, Entamoeba histolytica
PENEI

SEQ ID NO: 2646001 - protein, 8 aa, Entamoeba histolytica
PENEIEEV

SEQ ID NO: 2646002 - protein, 5 aa, Entamoeba histolytica
PENEL

SEQ ID NO: 2646003 - protein, 4 aa, Entamoeba histolytica
PENG

SEQ ID NO: 2646004 - protein, 6 aa, Entamoeba histolytica
PENGEA

SEQ ID NO: 2646005 - protein, 13 aa, Entamoeba histolytica
PENGEKTGSVGEE

SEQ ID NO: 2646006 - protein, 7 aa, Entamoeba histolytica
PENIEEL

SEQ ID NO: 2646007 - protein, 6 aa, Entamoeba histolytica
PENLES

SEQ ID NO: 2646008 - protein, 13 aa, Entamoeba histolytica
PENLKQPTSEGKI

SEQ ID NO: 2646009 - protein, 5 aa, Entamoeba histolytica
PENRM

SEQ ID NO: 2646010 - protein, 9 aa, Entamoeba histolytica
PENYNRNGT

SEQ ID NO: 2646011 - protein, 6 aa, Entamoeba histolytica
PEPEGY

SEQ ID NO: 2646012 - protein, 7 aa, Entamoeba histolytica
PEPEKRP

SEQ ID NO: 2646013 - protein, 7 aa, Entamoeba histolytica
PEPIPQG

SEQ ID NO: 2646014 - protein, 13 aa, Entamoeba histolytica
PEPKEITQTEGDV

SEQ ID NO: 2646015 - protein, 11 aa, Entamoeba histolytica
PEPMGKRNKTI

SEQ ID NO: 2646016 - protein, 10 aa, Entamoeba histolytica
PEPNTKNFNK

SEQ ID NO: 2646017 - protein, 12 aa, Entamoeba histolytica
PEPPKYENSPTN

SEQ ID NO: 2646018 - protein, 7 aa, Entamoeba histolytica
PEPPQGQ

SEQ ID NO: 2646019 - protein, 8 aa, Entamoeba histolytica
PEPPSNPQ

SEQ ID NO: 2646020 - protein, 27 aa, Entamoeba histolytica
PEPSQPIEEKKDSTVIEQGEEQQNKSK

SEQ ID NO: 2646021 - protein, 7 aa, Entamoeba histolytica
PEPTAAA

SEQ ID NO: 2646022 - protein, 4 aa, Entamoeba histolytica
PEQF

SEQ ID NO: 2646023 - protein, 6 aa, Entamoeba histolytica
PEQHPN

SEQ ID NO: 2646024 - protein, 9 aa, Entamoeba histolytica
PEQKEECIE

SEQ ID NO: 2646025 - protein, 6 aa, Entamoeba histolytica
PEQNTE

SEQ ID NO: 2646026 - protein, 4 aa, Entamoeba histolytica
PEQP

SEQ ID NO: 2646027 - protein, 5 aa, Entamoeba histolytica
PEQPK

SEQ ID NO: 2646028 - protein, 12 aa, Entamoeba histolytica
PEQQVSNCPGLD

SEQ ID NO: 2646029 - protein, 7 aa, Entamoeba histolytica
PEQRETG

SEQ ID NO: 2646030 - protein, 4 aa, Entamoeba histolytica
PEQY

SEQ ID NO: 2646031 - protein, 24 aa, Entamoeba histolytica
PERAINENKESQENEKTNKDDDQF

SEQ ID NO: 2646032 - protein, 10 aa, Entamoeba histolytica
PERKNDDDQH

SEQ ID NO: 2646033 - protein, 5 aa, Entamoeba histolytica
PERLA

SEQ ID NO: 2646034 - protein, 10 aa, Entamoeba histolytica
PERLPTGQIG

SEQ ID NO: 2646035 - protein, 5 aa, Entamoeba histolytica
PERNE

SEQ ID NO: 2646036 - protein, 16 aa, Entamoeba histolytica
PERNKSSGSLQSNSPD

SEQ ID NO: 2646037 - protein, 13 aa, Entamoeba histolytica
PERQAAISSNNTK

SEQ ID NO: 2646038 - protein, 5 aa, Entamoeba histolytica
PERQL

SEQ ID NO: 2646039 - protein, 6 aa, Entamoeba histolytica
PERVPK

SEQ ID NO: 2646040 - protein, 7 aa, Entamoeba histolytica
PERVPKA

SEQ ID NO: 2646041 - protein, 18 aa, Entamoeba histolytica
PERYNPPEISEIVAMDEM

SEQ ID NO: 2646042 - protein, 5 aa, Entamoeba histolytica
PESAS

SEQ ID NO: 2646043 - protein, 9 aa, Entamoeba histolytica
PESDSTTNY

SEQ ID NO: 2646044 - protein, 9 aa, Entamoeba histolytica
PESEELQNK

SEQ ID NO: 2646045 - protein, 16 aa, Entamoeba histolytica
PESEKPIPPRITPAFF

SEQ ID NO: 2646046 - protein, 16 aa, Entamoeba histolytica
PESEKPVPPRTTPSFF

SEQ ID NO: 2646047 - protein, 7 aa, Entamoeba histolytica
PESGENE

SEQ ID NO: 2646048 - protein, 35 aa, Entamoeba histolytica
PESHDESSQQTHLDETTTSHIDNEKQSEKQPEKKI

SEQ ID NO: 2646049 - protein, 8 aa, Entamoeba histolytica
PESKPQTI

SEQ ID NO: 2646050 - protein, 19 aa, Entamoeba histolytica
PESKQNAEQRKGRAGRTEA

SEQ ID NO: 2646051 - protein, 4 aa, Entamoeba histolytica
PESM

SEQ ID NO: 2646052 - protein, 10 aa, Entamoeba histolytica
PESNDSLNER

SEQ ID NO: 2646053 - protein, 9 aa, Entamoeba histolytica
PESNKYTKD

SEQ ID NO: 2646054 - protein, 7 aa, Entamoeba histolytica
PESPLCP

SEQ ID NO: 2646055 - protein, 5 aa, Entamoeba histolytica
PESQG

SEQ ID NO: 2646056 - protein, 5 aa, Entamoeba histolytica
PESSL

SEQ ID NO: 2646057 - protein, 6 aa, Entamoeba histolytica
PESTAY

SEQ ID NO: 2646058 - protein, 6 aa, Entamoeba histolytica
PESTQQ

SEQ ID NO: 2646059 - protein, 8 aa, Entamoeba histolytica
PETDPPSQ

SEQ ID NO: 2646060 - protein, 26 aa, Entamoeba histolytica
PETERNIENKVQPPLQPNPKEQTIDS

SEQ ID NO: 2646061 - protein, 4 aa, Entamoeba histolytica
PETG

SEQ ID NO: 2646062 - protein, 4 aa, Entamoeba histolytica
PETI

SEQ ID NO: 2646063 - protein, 12 aa, Entamoeba histolytica
PETIKNNKISYN

SEQ ID NO: 2646064 - protein, 12 aa, Entamoeba histolytica
PETKDENKDSTF

SEQ ID NO: 2646065 - protein, 11 aa, Entamoeba histolytica
PETKSLPKEYG

SEQ ID NO: 2646066 - protein, 4 aa, Entamoeba histolytica
PETN

SEQ ID NO: 2646067 - protein, 6 aa, Entamoeba histolytica
PETPND

SEQ ID NO: 2646068 - protein, 4 aa, Entamoeba histolytica
PETQ

SEQ ID NO: 2646069 - protein, 10 aa, Entamoeba histolytica
PETQETVKPH

SEQ ID NO: 2646070 - protein, 50 aa, Entamoeba histolytica
  misc_feature (14)..(47): Xaa can be any naturally occurring amino acid
PETQETVKPHPQFXXXXXXXXXXXXXXXXXXXXXXXXXXXXXXXXXXLDL

SEQ ID NO: 2646071 - protein, 15 aa, Entamoeba histolytica
PETQNKDEAKEEEEI

SEQ ID NO: 2646072 - protein, 10 aa, Entamoeba histolytica
PETVDGEEVQ

SEQ ID NO: 2646073 - protein, 7 aa, Entamoeba histolytica
PEVDSQV

SEQ ID NO: 2646074 - protein, 7 aa, Entamoeba histolytica
PEVGYSK

SEQ ID NO: 2646075 - protein, 4 aa, Entamoeba histolytica
PEVK

SEQ ID NO: 2646076 - protein, 5 aa, Entamoeba histolytica
PEVPE

SEQ ID NO: 2646077 - protein, 6 aa, Entamoeba histolytica
PEVPSN

SEQ ID NO: 2646078 - protein, 4 aa, Entamoeba histolytica
PEVQ

SEQ ID NO: 2646079 - protein, 71 aa, Entamoeba histolytica
PEVSEEENEQQKEDEGNEKEEQQMEEEEKVDKENEKQQEESNKEEENKQKEKTIKKPKIKKQQINKRKLAK

SEQ ID NO: 2646080 - protein, 7 aa, Entamoeba histolytica
PEVSPKV

SEQ ID NO: 2646081 - protein, 9 aa, Entamoeba histolytica
PEVSQEQKR

SEQ ID NO: 2646082 - protein, 4 aa, Entamoeba histolytica
PEYK

SEQ ID NO: 2646083 - protein, 7 aa, Entamoeba histolytica
PEYKESA

SEQ ID NO: 2646084 - protein, 5 aa, Entamoeba histolytica
PEYLN

SEQ ID NO: 2646085 - protein, 9 aa, Entamoeba histolytica
PEYSKRSGK

SEQ ID NO: 2646086 - protein, 10 aa, Entamoeba histolytica
PFDETSNLTP

SEQ ID NO: 2646087 - protein, 15 aa, Entamoeba histolytica
PFDGTLNESDKALGY

SEQ ID NO: 2646088 - protein, 13 aa, Entamoeba histolytica
PFEEDSFSLTVYL

SEQ ID NO: 2646089 - protein, 7 aa, Entamoeba histolytica
PFEEDST

SEQ ID NO: 2646090 - protein, 26 aa, Entamoeba histolytica
PFEEKEDKNPKQSLVKKRQKKSNTID

SEQ ID NO: 2646091 - protein, 11 aa, Entamoeba histolytica
PFEGVNGSGKH

SEQ ID NO: 2646092 - protein, 15 aa, Entamoeba histolytica
PFEHRNETKESEQTA

SEQ ID NO: 2646093 - protein, 7 aa, Entamoeba histolytica
PFESSPK

SEQ ID NO: 2646094 - protein, 9 aa, Entamoeba histolytica
PFESTGKEE

SEQ ID NO: 2646095 - protein, 8 aa, Entamoeba histolytica
PFGEQHDS

SEQ ID NO: 2646096 - protein, 4 aa, Entamoeba histolytica
PFGP

SEQ ID NO: 2646097 - protein, 20 aa, Entamoeba histolytica
PFGQTADEVKASYSTNKTLS

SEQ ID NO: 2646098 - protein, 5 aa, Entamoeba histolytica
PFGRP

SEQ ID NO: 2646099 - protein, 15 aa, Entamoeba histolytica
PFGSTNSLKELKRER

SEQ ID NO: 2646100 - protein, 5 aa, Entamoeba histolytica
PFGTT

SEQ ID NO: 2646101 - protein, 7 aa, Entamoeba histolytica
PFHPPKN

SEQ ID NO: 2646102 - protein, 11 aa, Entamoeba histolytica
PFINSEGDQVV

SEQ ID NO: 2646103 - protein, 9 aa, Entamoeba histolytica
PFKENYSST

SEQ ID NO: 2646104 - protein, 10 aa, Entamoeba histolytica
PFKKQTTLSL

SEQ ID NO: 2646105 - protein, 22 aa, Entamoeba histolytica
PFKTKQERSNANNYYNGTGIPG

SEQ ID NO: 2646106 - protein, 13 aa, Entamoeba histolytica
PFLGNGNDPDIIY

SEQ ID NO: 2646107 - protein, 14 aa, Entamoeba histolytica
PFMNENEQPLQQPN

SEQ ID NO: 2646108 - protein, 8 aa, Entamoeba histolytica
PFNASTPE

SEQ ID NO: 2646109 - protein, 9 aa, Entamoeba histolytica
PFNDKTPEA

SEQ ID NO: 2646110 - protein, 7 aa, Entamoeba histolytica
PFNEEKV

SEQ ID NO: 2646111 - protein, 13 aa, Entamoeba histolytica
PFNGNKSYEKDGK

SEQ ID NO: 2646112 - protein, 4 aa, Entamoeba histolytica
PFNS

SEQ ID NO: 2646113 - protein, 5 aa, Entamoeba histolytica
PFNSP

SEQ ID NO: 2646114 - protein, 10 aa, Entamoeba histolytica
PFNSPDENGM

SEQ ID NO: 2646115 - protein, 8 aa, Entamoeba histolytica
PFNSSTRE

SEQ ID NO: 2646116 - protein, 5 aa, Entamoeba histolytica
PFNTE

SEQ ID NO: 2646117 - protein, 8 aa, Entamoeba histolytica
PFNTSPRR

SEQ ID NO: 2646118 - protein, 6 aa, Entamoeba histolytica
PFPETN

SEQ ID NO: 2646119 - protein, 5 aa, Entamoeba histolytica
PFPKS

SEQ ID NO: 2646120 - protein, 10 aa, Entamoeba histolytica
PFPKSEYPHP

SEQ ID NO: 2646121 - protein, 5 aa, Entamoeba histolytica
PFPLP

SEQ ID NO: 2646122 - protein, 10 aa, Entamoeba histolytica
PFPPSNYKYD

SEQ ID NO: 2646123 - protein, 6 aa, Entamoeba histolytica
PFPQPW

SEQ ID NO: 2646124 - protein, 4 aa, Entamoeba histolytica
PFPR

SEQ ID NO: 2646125 - protein, 5 aa, Entamoeba histolytica
PFPSL

SEQ ID NO: 2646126 - protein, 9 aa, Entamoeba histolytica
PFPSNRNGV

SEQ ID NO: 2646127 - protein, 12 aa, Entamoeba histolytica
PFPTQSEDGNFG

SEQ ID NO: 2646128 - protein, 4 aa, Entamoeba histolytica
PFQD

SEQ ID NO: 2646129 - protein, 6 aa, Entamoeba histolytica
PFQGKT

SEQ ID NO: 2646130 - protein, 10 aa, Entamoeba histolytica
PFQKGEEEAY

SEQ ID NO: 2646131 - protein, 10 aa, Entamoeba histolytica
PFQSDNGQKY

SEQ ID NO: 2646132 - protein, 12 aa, Entamoeba histolytica
PFQSSRNQCTTQ

SEQ ID NO: 2646133 - protein, 5 aa, Entamoeba histolytica
PFRGG

SEQ ID NO: 2646134 - protein, 10 aa, Entamoeba histolytica
PFRGKSDKLT

SEQ ID NO: 2646135 - protein, 20 aa, Entamoeba histolytica
PFRTNAENTRRQQIACIAAK

SEQ ID NO: 2646136 - protein, 4 aa, Entamoeba histolytica
PFSD

SEQ ID NO: 2646137 - protein, 6 aa, Entamoeba histolytica
PFSEDN

SEQ ID NO: 2646138 - protein, 5 aa, Entamoeba histolytica
PFSPN

SEQ ID NO: 2646139 - protein, 7 aa, Entamoeba histolytica
PFSPNNN

SEQ ID NO: 2646140 - protein, 7 aa, Entamoeba histolytica
PFSPSSV

SEQ ID NO: 2646141 - protein, 8 aa, Entamoeba histolytica
PFSRTNNQ

SEQ ID NO: 2646142 - protein, 4 aa, Entamoeba histolytica
PFSS

SEQ ID NO: 2646143 - protein, 6 aa, Entamoeba histolytica
PFSSST

SEQ ID NO: 2646144 - protein, 5 aa, Entamoeba histolytica
PFTGR

SEQ ID NO: 2646145 - protein, 4 aa, Entamoeba histolytica
PFTM

SEQ ID NO: 2646146 - protein, 6 aa, Entamoeba histolytica
PFTNPN

SEQ ID NO: 2646147 - protein, 13 aa, Entamoeba histolytica
PFTNSKTIPGKSE

SEQ ID NO: 2646148 - protein, 4 aa, Entamoeba histolytica
PFTP

SEQ ID NO: 2646149 - protein, 4 aa, Entamoeba histolytica
PFTQ

SEQ ID NO: 2646150 - protein, 6 aa, Entamoeba histolytica
PFTTKS

SEQ ID NO: 2646151 - protein, 4 aa, Entamoeba histolytica
PFVN

SEQ ID NO: 2646152 - protein, 7 aa, Entamoeba histolytica
PGADPRE

SEQ ID NO: 2646153 - protein, 10 aa, Entamoeba histolytica
PGAKGTEWEG

SEQ ID NO: 2646154 - protein, 4 aa, Entamoeba histolytica
PGAR

SEQ ID NO: 2646155 - protein, 6 aa, Entamoeba histolytica
PGATQT

SEQ ID NO: 2646156 - protein, 5 aa, Entamoeba histolytica
PGCGK

SEQ ID NO: 2646157 - protein, 6 aa, Entamoeba histolytica
PGCGKT

SEQ ID NO: 2646158 - protein, 19 aa, Entamoeba histolytica
PGDCEGAYNDNAARSDGHI

SEQ ID NO: 2646159 - protein, 29 aa, Entamoeba histolytica
PGDCGGAYNDNAARSDGKISGFDAKQQDL

SEQ ID NO: 2646160 - protein, 5 aa, Entamoeba histolytica
PGDKI

SEQ ID NO: 2646161 - protein, 18 aa, Entamoeba histolytica
PGDSKENEGYIFDFFDDE

SEQ ID NO: 2646162 - protein, 5 aa, Entamoeba histolytica
PGDYD

SEQ ID NO: 2646163 - protein, 7 aa, Entamoeba histolytica
PGEAEAQ

SEQ ID NO: 2646164 - protein, 5 aa, Entamoeba histolytica
PGEEL

SEQ ID NO: 2646165 - protein, 14 aa, Entamoeba histolytica
PGEEMTETYTPEQI

SEQ ID NO: 2646166 - protein, 5 aa, Entamoeba histolytica
PGEKM

SEQ ID NO: 2646167 - protein, 9 aa, Entamoeba histolytica
PGEQGKHPL

SEQ ID NO: 2646168 - protein, 10 aa, Entamoeba histolytica
PGEQGKHPLW

SEQ ID NO: 2646169 - protein, 10 aa, Entamoeba histolytica
PGESDQAPGI

SEQ ID NO: 2646170 - protein, 21 aa, Entamoeba histolytica
PGESVYGEKRIAKEDAEGNKI

SEQ ID NO: 2646171 - protein, 8 aa, Entamoeba histolytica
PGETDEEF

SEQ ID NO: 2646172 - protein, 16 aa, Entamoeba histolytica
PGETITSVPTSKCNNS

SEQ ID NO: 2646173 - protein, 13 aa, Entamoeba histolytica
PGEVASTAGTSGV

SEQ ID NO: 2646174 - protein, 17 aa, Entamoeba histolytica
PGFDDSNGGINKDRQHM

SEQ ID NO: 2646175 - protein, 4 aa, Entamoeba histolytica
PGFE

SEQ ID NO: 2646176 - protein, 6 aa, Entamoeba histolytica
PGFGGQ

SEQ ID NO: 2646177 - protein, 5 aa, Entamoeba histolytica
PGFGT

SEQ ID NO: 2646178 - protein, 4 aa, Entamoeba histolytica
PGFH

SEQ ID NO: 2646179 - protein, 17 aa, Entamoeba histolytica
PGFNDPNGKEKENDNVK

SEQ ID NO: 2646180 - protein, 16 aa, Entamoeba histolytica
PGFNDSEGGRDKDRQW

SEQ ID NO: 2646181 - protein, 11 aa, Entamoeba histolytica
PGFNDTNNFDN

SEQ ID NO: 2646182 - protein, 12 aa, Entamoeba histolytica
PGFNGTDNFDNE

SEQ ID NO: 2646183 - protein, 12 aa, Entamoeba histolytica
PGFTSDSTPFTD

SEQ ID NO: 2646184 - protein, 11 aa, Entamoeba histolytica
PGGEDDDTEGI

SEQ ID NO: 2646185 - protein, 5 aa, Entamoeba histolytica
PGGLP

SEQ ID NO: 2646186 - protein, 12 aa, Entamoeba histolytica
PGGVSTEEIYDE

SEQ ID NO: 2646187 - protein, 5 aa, Entamoeba histolytica
PGHEA

SEQ ID NO: 2646188 - protein, 5 aa, Entamoeba histolytica
PGHKD

SEQ ID NO: 2646189 - protein, 5 aa, Entamoeba histolytica
PGHMA

SEQ ID NO: 2646190 - protein, 7 aa, Entamoeba histolytica
PGHPDLT

SEQ ID NO: 2646191 - protein, 4 aa, Entamoeba histolytica
PGHT

SEQ ID NO: 2646192 - protein, 4 aa, Entamoeba histolytica
PGID

SEQ ID NO: 2646193 - protein, 10 aa, Entamoeba histolytica
PGIDKKTLSV

SEQ ID NO: 2646194 - protein, 16 aa, Entamoeba histolytica
PGIDKRPWSSEEDEKI

SEQ ID NO: 2646195 - protein, 7 aa, Entamoeba histolytica
PGIGKTT

SEQ ID NO: 2646196 - protein, 4 aa, Entamoeba histolytica
PGII

SEQ ID NO: 2646197 - protein, 6 aa, Entamoeba histolytica
PGIKEV

SEQ ID NO: 2646198 - protein, 4 aa, Entamoeba histolytica
PGIN

SEQ ID NO: 2646199 - protein, 11 aa, Entamoeba histolytica
PGINDTNNFDN

SEQ ID NO: 2646200 - protein, 12 aa, Entamoeba histolytica
PGINSERKSNHK

SEQ ID NO: 2646201 - protein, 5 aa, Entamoeba histolytica
PGIPT

SEQ ID NO: 2646202 - protein, 6 aa, Entamoeba histolytica
PGIPTP

SEQ ID NO: 2646203 - protein, 8 aa, Entamoeba histolytica
PGIRGKYG

SEQ ID NO: 2646204 - protein, 5 aa, Entamoeba histolytica
PGISN

SEQ ID NO: 2646205 - protein, 5 aa, Entamoeba histolytica
PGITE

SEQ ID NO: 2646206 - protein, 5 aa, Entamoeba histolytica
PGITT

SEQ ID NO: 2646207 - protein, 23 aa, Entamoeba histolytica
PGKDTIEPTPDGIKKYLTTLKQT

SEQ ID NO: 2646208 - protein, 23 aa, Entamoeba histolytica
PGKDTIEPTSDGIKKYLTTLKQT

SEQ ID NO: 2646209 - protein, 10 aa, Entamoeba histolytica
PGKKGVKAED

SEQ ID NO: 2646210 - protein, 6 aa, Entamoeba histolytica
PGKLDH

SEQ ID NO: 2646211 - protein, 9 aa, Entamoeba histolytica
PGKNRRLRH

SEQ ID NO: 2646212 - protein, 9 aa, Entamoeba histolytica
PGKQDDIDG

SEQ ID NO: 2646213 - protein, 7 aa, Entamoeba histolytica
PGKSAET

SEQ ID NO: 2646214 - protein, 9 aa, Entamoeba histolytica
PGKTEDERR

SEQ ID NO: 2646215 - protein, 13 aa, Entamoeba histolytica
PGKTIGAPTLEQA

SEQ ID NO: 2646216 - protein, 9 aa, Entamoeba histolytica
PGKYNRREE

SEQ ID NO: 2646217 - protein, 4 aa, Entamoeba histolytica
PGLD

SEQ ID NO: 2646218 - protein, 10 aa, Entamoeba histolytica
PGLESFPGHD

SEQ ID NO: 2646219 - protein, 9 aa, Entamoeba histolytica
PGLGRDESV

SEQ ID NO: 2646220 - protein, 13 aa, Entamoeba histolytica
PGLHDDNHTSVGS

SEQ ID NO: 2646221 - protein, 11 aa, Entamoeba histolytica
PGLHDDNLTSI

SEQ ID NO: 2646222 - protein, 7 aa, Entamoeba histolytica
PGLPSRL

SEQ ID NO: 2646223 - protein, 6 aa, Entamoeba histolytica
PGLQDS

SEQ ID NO: 2646224 - protein, 10 aa, Entamoeba histolytica
PGLQDTQELN

SEQ ID NO: 2646225 - protein, 4 aa, Entamoeba histolytica
PGLS

SEQ ID NO: 2646226 - protein, 14 aa, Entamoeba histolytica
PGLTSAGGKLPDDI

SEQ ID NO: 2646227 - protein, 47 aa, Entamoeba histolytica
PGMPPPPPPPGMPGMPPPPPPPGMPGMPPPPPGMPGMPPPPPGMPGM

SEQ ID NO: 2646228 - protein, 77 aa, Entamoeba histolytica
PGMPPPPPPPGMPGMPPPPPPPGMPGMPPPPPGMPGMPPPPPGMPGMPPPPPGMPGMPPPPPGMPGMPPPPPGMPGM

SEQ ID NO: 2646229 - protein, 4 aa, Entamoeba histolytica
PGMT

SEQ ID NO: 2646230 - protein, 10 aa, Entamoeba histolytica
PGNDPAYMEG

SEQ ID NO: 2646231 - protein, 8 aa, Entamoeba histolytica
PGNDTEKV

SEQ ID NO: 2646232 - protein, 18 aa, Entamoeba histolytica
PGNIKEESEENDTTSSAL

SEQ ID NO: 2646233 - protein, 5 aa, Entamoeba histolytica
PGNKY

SEQ ID NO: 2646234 - protein, 8 aa, Entamoeba histolytica
PGNNGGDG

SEQ ID NO: 2646235 - protein, 7 aa, Entamoeba histolytica
PGNNGGF

SEQ ID NO: 2646236 - protein, 6 aa, Entamoeba histolytica
PGNPCG

SEQ ID NO: 2646237 - protein, 7 aa, Entamoeba histolytica
PGNPTGQ

SEQ ID NO: 2646238 - protein, 7 aa, Entamoeba histolytica
PGNRKAE

SEQ ID NO: 2646239 - protein, 8 aa, Entamoeba histolytica
PGNRPTNS

SEQ ID NO: 2646240 - protein, 5 aa, Entamoeba histolytica
PGNSE

SEQ ID NO: 2646241 - protein, 7 aa, Entamoeba histolytica
PGNSEYN

SEQ ID NO: 2646242 - protein, 4 aa, Entamoeba histolytica
PGNY

SEQ ID NO: 2646243 - protein, 11 aa, Entamoeba histolytica
PGQNDSDEELN

SEQ ID NO: 2646244 - protein, 5 aa, Entamoeba histolytica
PGQNP

SEQ ID NO: 2646245 - protein, 5 aa, Entamoeba histolytica
PGQPF

SEQ ID NO: 2646246 - protein, 4 aa, Entamoeba histolytica
PGQY

SEQ ID NO: 2646247 - protein, 9 aa, Entamoeba histolytica
PGRSRPDQG

SEQ ID NO: 2646248 - protein, 10 aa, Entamoeba histolytica
PGRTANQVKN

SEQ ID NO: 2646249 - protein, 5 aa, Entamoeba histolytica
PGSGE

SEQ ID NO: 2646250 - protein, 5 aa, Entamoeba histolytica
PGSGL

SEQ ID NO: 2646251 - protein, 7 aa, Entamoeba histolytica
PGSHENE

SEQ ID NO: 2646252 - protein, 9 aa, Entamoeba histolytica
PGSHTMTKE

SEQ ID NO: 2646253 - protein, 5 aa, Entamoeba histolytica
PGSIL

SEQ ID NO: 2646254 - protein, 14 aa, Entamoeba histolytica
PGSLNELREEGRRL

SEQ ID NO: 2646255 - protein, 12 aa, Entamoeba histolytica
PGSRERKKGYIS

SEQ ID NO: 2646256 - protein, 7 aa, Entamoeba histolytica
PGSSEYN

SEQ ID NO: 2646257 - protein, 8 aa, Entamoeba histolytica
PGSSEYNQ

SEQ ID NO: 2646258 - protein, 9 aa, Entamoeba histolytica
PGSSPSDVA

SEQ ID NO: 2646259 - protein, 4 aa, Entamoeba histolytica
PGTE

SEQ ID NO: 2646260 - protein, 7 aa, Entamoeba histolytica
PGTFRSS

SEQ ID NO: 2646261 - protein, 7 aa, Entamoeba histolytica
PGTGAWG

SEQ ID NO: 2646262 - protein, 6 aa, Entamoeba histolytica
PGTKIT

SEQ ID NO: 2646263 - protein, 8 aa, Entamoeba histolytica
PGTKNNER

SEQ ID NO: 2646264 - protein, 8 aa, Entamoeba histolytica
PGTLGNSK

SEQ ID NO: 2646265 - protein, 8 aa, Entamoeba histolytica
PGTNPPTY

SEQ ID NO: 2646266 - protein, 10 aa, Entamoeba histolytica
PGTPAAKMKQ

SEQ ID NO: 2646267 - protein, 13 aa, Entamoeba histolytica
PGTPNYSSTAGRC

SEQ ID NO: 2646268 - protein, 5 aa, Entamoeba histolytica
PGTVQ

SEQ ID NO: 2646269 - protein, 10 aa, Entamoeba histolytica
PGTYKANSGI

SEQ ID NO: 2646270 - protein, 8 aa, Entamoeba histolytica
PGVGGDRN

SEQ ID NO: 2646271 - protein, 4 aa, Entamoeba histolytica
PGVP

SEQ ID NO: 2646272 - protein, 7 aa, Entamoeba histolytica
PGVPPER

SEQ ID NO: 2646273 - protein, 22 aa, Entamoeba histolytica
PGWKDGTKLRYEGYGDEEPGVI

SEQ ID NO: 2646274 - protein, 4 aa, Entamoeba histolytica
PGYD

SEQ ID NO: 2646275 - protein, 17 aa, Entamoeba histolytica
PGYTKGSHYSDEKTANH

SEQ ID NO: 2646276 - protein, 4 aa, Entamoeba histolytica
PHCS

SEQ ID NO: 2646277 - protein, 23 aa, Entamoeba histolytica
PHDDHSDEDNYGNGDEGKKPIDA

SEQ ID NO: 2646278 - protein, 6 aa, Entamoeba histolytica
PHDSRI

SEQ ID NO: 2646279 - protein, 5 aa, Entamoeba histolytica
PHEAA

SEQ ID NO: 2646280 - protein, 4 aa, Entamoeba histolytica
PHEE

SEQ ID NO: 2646281 - protein, 12 aa, Entamoeba histolytica
PHEKRDNELEGK

SEQ ID NO: 2646282 - protein, 14 aa, Entamoeba histolytica
PHENSSETVSDDKT

SEQ ID NO: 2646283 - protein, 35 aa, Entamoeba histolytica
PHEREEKKRKTEKSKRCKEKEEKQIKRQITSKTQT

SEQ ID NO: 2646284 - protein, 5 aa, Entamoeba histolytica
PHFNT

SEQ ID NO: 2646285 - protein, 4 aa, Entamoeba histolytica
PHFP

SEQ ID NO: 2646286 - protein, 7 aa, Entamoeba histolytica
PHFPSSI

SEQ ID NO: 2646287 - protein, 9 aa, Entamoeba histolytica
PHGIAPTRF

SEQ ID NO: 2646288 - protein, 4 aa, Entamoeba histolytica
PHGN

SEQ ID NO: 2646289 - protein, 7 aa, Entamoeba histolytica
PHGSLDN

SEQ ID NO: 2646290 - protein, 20 aa, Entamoeba histolytica
PHHTSPQSNSPHALSPHTRY

SEQ ID NO: 2646291 - protein, 15 aa, Entamoeba histolytica
PHHTTATKITPKVQS

SEQ ID NO: 2646292 - protein, 4 aa, Entamoeba histolytica
PHIS

SEQ ID NO: 2646293 - protein, 21 aa, Entamoeba histolytica
PHKGNGGAICGNDGGVWGRSE

SEQ ID NO: 2646294 - protein, 16 aa, Entamoeba histolytica
PHKKESVTRISDGSRF

SEQ ID NO: 2646295 - protein, 8 aa, Entamoeba histolytica
PHKRSTTT

SEQ ID NO: 2646296 - protein, 19 aa, Entamoeba histolytica
PHLSEKDSKINWKSPLDKS

SEQ ID NO: 2646297 - protein, 6 aa, Entamoeba histolytica
PHNEKG

SEQ ID NO: 2646298 - protein, 6 aa, Entamoeba histolytica
PHPDDD

SEQ ID NO: 2646299 - protein, 11 aa, Entamoeba histolytica
PHPKRKDMKTT

SEQ ID NO: 2646300 - protein, 13 aa, Entamoeba histolytica
PHPSAPYEKVTEE

SEQ ID NO: 2646301 - protein, 12 aa, Entamoeba histolytica
PHPSPLAKGGFD

SEQ ID NO: 2646302 - protein, 7 aa, Entamoeba histolytica
PHPSSER

SEQ ID NO: 2646303 - protein, 6 aa, Entamoeba histolytica
PHQASS

SEQ ID NO: 2646304 - protein, 5 aa, Entamoeba histolytica
PHQKA

SEQ ID NO: 2646305 - protein, 8 aa, Entamoeba histolytica
PHQKNESP

SEQ ID NO: 2646306 - protein, 6 aa, Entamoeba histolytica
PHQLTS

SEQ ID NO: 2646307 - protein, 5 aa, Entamoeba histolytica
PHRID

SEQ ID NO: 2646308 - protein, 7 aa, Entamoeba histolytica
PHRKSRI

SEQ ID NO: 2646309 - protein, 24 aa, Entamoeba histolytica
PHRNTKKKETQNGTNLIGQNPKEL

SEQ ID NO: 2646310 - protein, 9 aa, Entamoeba histolytica
PHSITKNNH

SEQ ID NO: 2646311 - protein, 10 aa, Entamoeba histolytica
PHSKDEEKDF

SEQ ID NO: 2646312 - protein, 11 aa, Entamoeba histolytica
PHSPQYQQNNS

SEQ ID NO: 2646313 - protein, 6 aa, Entamoeba histolytica
PHSRIQ

SEQ ID NO: 2646314 - protein, 5 aa, Entamoeba histolytica
PHSSK

SEQ ID NO: 2646315 - protein, 4 aa, Entamoeba histolytica
PHTA

SEQ ID NO: 2646316 - protein, 20 aa, Entamoeba histolytica
PHTDEPMDSKGKKDKKDKKK

SEQ ID NO: 2646317 - protein, 4 aa, Entamoeba histolytica
PHTN

SEQ ID NO: 2646318 - protein, 4 aa, Entamoeba histolytica
PHTQ

SEQ ID NO: 2646319 - protein, 6 aa, Entamoeba histolytica
PHTVKQ

SEQ ID NO: 2646320 - protein, 8 aa, Entamoeba histolytica
PHVESSKE

SEQ ID NO: 2646321 - protein, 10 aa, Entamoeba histolytica
PIASDKIPEK

SEQ ID NO: 2646322 - protein, 5 aa, Entamoeba histolytica
PIATE

SEQ ID NO: 2646323 - protein, 10 aa, Entamoeba histolytica
PIDEDKPGFG

SEQ ID NO: 2646324 - protein, 6 aa, Entamoeba histolytica
PIDEET

SEQ ID NO: 2646325 - protein, 10 aa, Entamoeba histolytica
PIDESEEKTL

SEQ ID NO: 2646326 - protein, 8 aa, Entamoeba histolytica
PIDKTGNG

SEQ ID NO: 2646327 - protein, 10 aa, Entamoeba histolytica
PIDNSIKESA

SEQ ID NO: 2646328 - protein, 9 aa, Entamoeba histolytica
PIDSEEEQF

SEQ ID NO: 2646329 - protein, 16 aa, Entamoeba histolytica
PIDSTKKKYVKGKKNP

SEQ ID NO: 2646330 - protein, 4 aa, Entamoeba histolytica
PIDT

SEQ ID NO: 2646331 - protein, 6 aa, Entamoeba histolytica
PIEDAN

SEQ ID NO: 2646332 - protein, 5 aa, Entamoeba histolytica
PIEDT

SEQ ID NO: 2646333 - protein, 5 aa, Entamoeba histolytica
PIEEP

SEQ ID NO: 2646334 - protein, 4 aa, Entamoeba histolytica
PIEG

SEQ ID NO: 2646335 - protein, 5 aa, Entamoeba histolytica
PIEGN

SEQ ID NO: 2646336 - protein, 4 aa, Entamoeba histolytica
PIEH

SEQ ID NO: 2646337 - protein, 31 aa, Entamoeba histolytica
PIEKEQPKSEQIITETNEKEQNQLKTETVND

SEQ ID NO: 2646338 - protein, 9 aa, Entamoeba histolytica
PIEKNGGCN

SEQ ID NO: 2646339 - protein, 10 aa, Entamoeba histolytica
PIEKPKKGIS

SEQ ID NO: 2646340 - protein, 5 aa, Entamoeba histolytica
PIENA

SEQ ID NO: 2646341 - protein, 11 aa, Entamoeba histolytica
PIENKTKIQPF

SEQ ID NO: 2646342 - protein, 9 aa, Entamoeba histolytica
PIENRPQED

SEQ ID NO: 2646343 - protein, 13 aa, Entamoeba histolytica
PIEPSPKENKGGC

SEQ ID NO: 2646344 - protein, 5 aa, Entamoeba histolytica
PIEQQ

SEQ ID NO: 2646345 - protein, 8 aa, Entamoeba histolytica
PIESEGLN

SEQ ID NO: 2646346 - protein, 7 aa, Entamoeba histolytica
PIETPKK

SEQ ID NO: 2646347 - protein, 12 aa, Entamoeba histolytica
PIFETPSSYGYY

SEQ ID NO: 2646348 - protein, 16 aa, Entamoeba histolytica
PIFTNEEKDEKRFQSG

SEQ ID NO: 2646349 - protein, 8 aa, Entamoeba histolytica
PIGDNSSN

SEQ ID NO: 2646350 - protein, 6 aa, Entamoeba histolytica
PIGDVK

SEQ ID NO: 2646351 - protein, 13 aa, Entamoeba histolytica
PIGGGQDNDTGKI

SEQ ID NO: 2646352 - protein, 13 aa, Entamoeba histolytica
PIGGSEKESKENG

SEQ ID NO: 2646353 - protein, 6 aa, Entamoeba histolytica
PIGKHS

SEQ ID NO: 2646354 - protein, 5 aa, Entamoeba histolytica
PIGRK

SEQ ID NO: 2646355 - protein, 4 aa, Entamoeba histolytica
PIGS

SEQ ID NO: 2646356 - protein, 6 aa, Entamoeba histolytica
PIGSDG

SEQ ID NO: 2646357 - protein, 5 aa, Entamoeba histolytica
PIGSG

SEQ ID NO: 2646358 - protein, 5 aa, Entamoeba histolytica
PIGTH

SEQ ID NO: 2646359 - protein, 7 aa, Entamoeba histolytica
PIGTNGL

SEQ ID NO: 2646360 - protein, 10 aa, Entamoeba histolytica
PIHRASQADR

SEQ ID NO: 2646361 - protein, 9 aa, Entamoeba histolytica
PIITPGESS

SEQ ID NO: 2646362 - protein, 36 aa, Entamoeba histolytica
PIKDKKPKKKEKRTKKEEDNGDQKGSKISHKTNIST

SEQ ID NO: 2646363 - protein, 9 aa, Entamoeba histolytica
PIKENDNDG

SEQ ID NO: 2646364 - protein, 11 aa, Entamoeba histolytica
PIKGRKRGGGI

SEQ ID NO: 2646365 - protein, 11 aa, Entamoeba histolytica
PIKIGKRKATI

SEQ ID NO: 2646366 - protein, 30 aa, Entamoeba histolytica
PIKKEKEIADNKKPKSLNNELKKSEQKYPK

SEQ ID NO: 2646367 - protein, 12 aa, Entamoeba histolytica
PIKKEKEVEVDE

SEQ ID NO: 2646368 - protein, 7 aa, Entamoeba histolytica
PIKPLGK

SEQ ID NO: 2646369 - protein, 8 aa, Entamoeba histolytica
PIKQISQT

SEQ ID NO: 2646370 - protein, 16 aa, Entamoeba histolytica
PIKSTSKADSHRKTKL

SEQ ID NO: 2646371 - protein, 26 aa, Entamoeba histolytica
PIMGGPAPIRPKPVEQKNEESNEETI

SEQ ID NO: 2646372 - protein, 7 aa, Entamoeba histolytica
PINDRKS

SEQ ID NO: 2646373 - protein, 8 aa, Entamoeba histolytica
PINDTSEV

SEQ ID NO: 2646374 - protein, 4 aa, Entamoeba histolytica
PINE

SEQ ID NO: 2646375 - protein, 10 aa, Entamoeba histolytica
PINEEGPDII

SEQ ID NO: 2646376 - protein, 12 aa, Entamoeba histolytica
PINEQSSIQPNQ

SEQ ID NO: 2646377 - protein, 12 aa, Entamoeba histolytica
PININKQTKEIM

SEQ ID NO: 2646378 - protein, 9 aa, Entamoeba histolytica
PINKSSNEI

SEQ ID NO: 2646379 - protein, 4 aa, Entamoeba histolytica
PINN

SEQ ID NO: 2646380 - protein, 10 aa, Entamoeba histolytica
PINNENPVNQ

SEQ ID NO: 2646381 - protein, 10 aa, Entamoeba histolytica
PINNNKDNTI

SEQ ID NO: 2646382 - protein, 5 aa, Entamoeba histolytica
PINQN

SEQ ID NO: 2646383 - protein, 4 aa, Entamoeba histolytica
PINT

SEQ ID NO: 2646384 - protein, 73 aa, Entamoeba histolytica
PINTETPATTDSTTGTEKKEEEKPVEEEKKEEEKPVEEEKKEEEKPVEEEKKEEEKPVEEEKKEEKPAEEEKK

SEQ ID NO: 2646385 - protein, 24 aa, Entamoeba histolytica
PINTSTQLQRSNQIGQITPGNQPI

SEQ ID NO: 2646386 - protein, 4 aa, Entamoeba histolytica
PIPA

SEQ ID NO: 2646387 - protein, 11 aa, Entamoeba histolytica
PIPDKQSPTKQ

SEQ ID NO: 2646388 - protein, 7 aa, Entamoeba histolytica
PIPDSSE

SEQ ID NO: 2646389 - protein, 9 aa, Entamoeba histolytica
PIPEGDQDS

SEQ ID NO: 2646390 - protein, 11 aa, Entamoeba histolytica
PIPEIQRTNLS

SEQ ID NO: 2646391 - protein, 11 aa, Entamoeba histolytica
PIPKKTEEWVK

SEQ ID NO: 2646392 - protein, 6 aa, Entamoeba histolytica
PIPLPS

SEQ ID NO: 2646393 - protein, 4 aa, Entamoeba histolytica
PIPN

SEQ ID NO: 2646394 - protein, 14 aa, Entamoeba histolytica
PIPNSNPVCGSDDV

SEQ ID NO: 2646395 - protein, 6 aa, Entamoeba histolytica
PIPPKS

SEQ ID NO: 2646396 - protein, 9 aa, Entamoeba histolytica
PIPSKKRVS

SEQ ID NO: 2646397 - protein, 11 aa, Entamoeba histolytica
PIPSQGSHESH

SEQ ID NO: 2646398 - protein, 5 aa, Entamoeba histolytica
PIPTQ

SEQ ID NO: 2646399 - protein, 5 aa, Entamoeba histolytica
PIPYT

SEQ ID NO: 2646400 - protein, 11 aa, Entamoeba histolytica
PIQEKEGTQIL

SEQ ID NO: 2646401 - protein, 10 aa, Entamoeba histolytica
PIQGGAGTSL

SEQ ID NO: 2646402 - protein, 7 aa, Entamoeba histolytica
PIQHSGE

SEQ ID NO: 2646403 - protein, 4 aa, Entamoeba histolytica
PIQL

SEQ ID NO: 2646404 - protein, 7 aa, Entamoeba histolytica
PIQNDVP

SEQ ID NO: 2646405 - protein, 5 aa, Entamoeba histolytica
PIQPI

SEQ ID NO: 2646406 - protein, 17 aa, Entamoeba histolytica
PIQPINPGNPIMPSQPG

SEQ ID NO: 2646407 - protein, 9 aa, Entamoeba histolytica
PIQPPKKKT

SEQ ID NO: 2646408 - protein, 20 aa, Entamoeba histolytica
PIQSVQEQKPKIPKQSTTAL

SEQ ID NO: 2646409 - protein, 5 aa, Entamoeba histolytica
PISEP

SEQ ID NO: 2646410 - protein, 14 aa, Entamoeba histolytica
PISEPIQKTTTITR

SEQ ID NO: 2646411 - protein, 25 aa, Entamoeba histolytica
PISGQTLGTSGLRKRASEVENTPNY

SEQ ID NO: 2646412 - protein, 4 aa, Entamoeba histolytica
PISK

SEQ ID NO: 2646413 - protein, 7 aa, Entamoeba histolytica
PISNENN

SEQ ID NO: 2646414 - protein, 5 aa, Entamoeba histolytica
PISNQ

SEQ ID NO: 2646415 - protein, 7 aa, Entamoeba histolytica
PISPGDE

SEQ ID NO: 2646416 - protein, 15 aa, Entamoeba histolytica
PISPKETLHDDPARA

SEQ ID NO: 2646417 - protein, 4 aa, Entamoeba histolytica
PISQ

SEQ ID NO: 2646418 - protein, 37 aa, Entamoeba histolytica
PISQNSQNTLPTAQRHSITNELEKEEDDDDKQQINED

SEQ ID NO: 2646419 - protein, 10 aa, Entamoeba histolytica
PISQRHEKED

SEQ ID NO: 2646420 - protein, 9 aa, Entamoeba histolytica
PISRNGTTK

SEQ ID NO: 2646421 - protein, 4 aa, Entamoeba histolytica
PISS

SEQ ID NO: 2646422 - protein, 8 aa, Entamoeba histolytica
PISSEHQY

SEQ ID NO: 2646423 - protein, 8 aa, Entamoeba histolytica
PISTETIN

SEQ ID NO: 2646424 - protein, 4 aa, Entamoeba histolytica
PISY

SEQ ID NO: 2646425 - protein, 12 aa, Entamoeba histolytica
PITANRDAEEVS

SEQ ID NO: 2646426 - protein, 21 aa, Entamoeba histolytica
PITEKGDKDHCGKCGKEVSSG

SEQ ID NO: 2646427 - protein, 5 aa, Entamoeba histolytica
PITGE

SEQ ID NO: 2646428 - protein, 13 aa, Entamoeba histolytica
PITIKTQNNDLKK

SEQ ID NO: 2646429 - protein, 10 aa, Entamoeba histolytica
PITPTPHSNQ

SEQ ID NO: 2646430 - protein, 6 aa, Entamoeba histolytica
PITQDP

SEQ ID NO: 2646431 - protein, 10 aa, Entamoeba histolytica
PITQKDKENN

SEQ ID NO: 2646432 - protein, 66 aa, Entamoeba histolytica
PITQNPSEEIQNEYKQEVQAQDDYKNGNTSSEFYSTKQENNNNTQTTNETYEEDYVDEEKEKAFEE

SEQ ID NO: 2646433 - protein, 7 aa, Entamoeba histolytica
PITQTDS

SEQ ID NO: 2646434 - protein, 4 aa, Entamoeba histolytica
PITS

SEQ ID NO: 2646435 - protein, 5 aa, Entamoeba histolytica
PITSP

SEQ ID NO: 2646436 - protein, 11 aa, Entamoeba histolytica
PITSPQNLQRK

SEQ ID NO: 2646437 - protein, 20 aa, Entamoeba histolytica
PITSPSTPTGNMNRDNENND

SEQ ID NO: 2646438 - protein, 37 aa, Entamoeba histolytica
PITSRTPQPSRSSSTIYRSDTPTFTRRNNRSTNKDRW

SEQ ID NO: 2646439 - protein, 5 aa, Entamoeba histolytica
PIVPD

SEQ ID NO: 2646440 - protein, 10 aa, Entamoeba histolytica
PIVSEKAGER

SEQ ID NO: 2646441 - protein, 16 aa, Entamoeba histolytica
PIYDNYKDEDNEQWMN

SEQ ID NO: 2646442 - protein, 4 aa, Entamoeba histolytica
PIYE

SEQ ID NO: 2646443 - protein, 12 aa, Entamoeba histolytica
PIYPSKEPYCDD

SEQ ID NO: 2646444 - protein, 8 aa, Entamoeba histolytica
PIYSPGPK

SEQ ID NO: 2646445 - protein, 4 aa, Entamoeba histolytica
PIYV

SEQ ID NO: 2646446 - protein, 17 aa, Entamoeba histolytica
PKAAKGHSANAIKERQI

SEQ ID NO: 2646447 - protein, 4 aa, Entamoeba histolytica
PKAD

SEQ ID NO: 2646448 - protein, 7 aa, Entamoeba histolytica
PKAPRSF

SEQ ID NO: 2646449 - protein, 10 aa, Entamoeba histolytica
PKAQTKTPEL

SEQ ID NO: 2646450 - protein, 8 aa, Entamoeba histolytica
PKASDDAL

SEQ ID NO: 2646451 - protein, 8 aa, Entamoeba histolytica
PKASFNTY

SEQ ID NO: 2646452 - protein, 9 aa, Entamoeba histolytica
PKASSSTSI

SEQ ID NO: 2646453 - protein, 9 aa, Entamoeba histolytica
PKASTSESK

SEQ ID NO: 2646454 - protein, 6 aa, Entamoeba histolytica
PKATER

SEQ ID NO: 2646455 - protein, 4 aa, Entamoeba histolytica
PKAV

SEQ ID NO: 2646456 - protein, 10 aa, Entamoeba histolytica
PKAVDAVNAD

SEQ ID NO: 2646457 - protein, 7 aa, Entamoeba histolytica
PKAVDWR

SEQ ID NO: 2646458 - protein, 10 aa, Entamoeba histolytica
PKAYPRLSHP

SEQ ID NO: 2646459 - protein, 5 aa, Entamoeba histolytica
PKCKG

SEQ ID NO: 2646460 - protein, 5 aa, Entamoeba histolytica
PKCQS

SEQ ID NO: 2646461 - protein, 7 aa, Entamoeba histolytica
PKDADFQ

SEQ ID NO: 2646462 - protein, 9 aa, Entamoeba histolytica
PKDANGSVL

SEQ ID NO: 2646463 - protein, 14 aa, Entamoeba histolytica
PKDAYYGAQTMRAT

SEQ ID NO: 2646464 - protein, 8 aa, Entamoeba histolytica
PKDDSGLT

SEQ ID NO: 2646465 - protein, 9 aa, Entamoeba histolytica
PKDDSNDSL

SEQ ID NO: 2646466 - protein, 8 aa, Entamoeba histolytica
PKDEGKMT

SEQ ID NO: 2646467 - protein, 6 aa, Entamoeba histolytica
PKDEIP

SEQ ID NO: 2646468 - protein, 6 aa, Entamoeba histolytica
PKDEKL

SEQ ID NO: 2646469 - protein, 10 aa, Entamoeba histolytica
PKDEKYKITT

SEQ ID NO: 2646470 - protein, 15 aa, Entamoeba histolytica
PKDFTKSSISNKTEV

SEQ ID NO: 2646471 - protein, 7 aa, Entamoeba histolytica
PKDGQQN

SEQ ID NO: 2646472 - protein, 5 aa, Entamoeba histolytica
PKDHI

SEQ ID NO: 2646473 - protein, 4 aa, Entamoeba histolytica
PKDK

SEQ ID NO: 2646474 - protein, 9 aa, Entamoeba histolytica
PKDNEINNM

SEQ ID NO: 2646475 - protein, 5 aa, Entamoeba histolytica
PKDQE

SEQ ID NO: 2646476 - protein, 10 aa, Entamoeba histolytica
PKDQGKSAEE

SEQ ID NO: 2646477 - protein, 8 aa, Entamoeba histolytica
PKDRPDTN

SEQ ID NO: 2646478 - protein, 5 aa, Entamoeba histolytica
PKDSL

SEQ ID NO: 2646479 - protein, 8 aa, Entamoeba histolytica
PKDSNEEE

SEQ ID NO: 2646480 - protein, 7 aa, Entamoeba histolytica
PKDYPNK

SEQ ID NO: 2646481 - protein, 9 aa, Entamoeba histolytica
PKEAKRPTL

SEQ ID NO: 2646482 - protein, 7 aa, Entamoeba histolytica
PKECTYD

SEQ ID NO: 2646483 - protein, 4 aa, Entamoeba histolytica
PKED

SEQ ID NO: 2646484 - protein, 7 aa, Entamoeba histolytica
PKEEDMK

SEQ ID NO: 2646485 - protein, 10 aa, Entamoeba histolytica
PKEEKKSFFE

SEQ ID NO: 2646486 - protein, 7 aa, Entamoeba histolytica
PKEEKYT

SEQ ID NO: 2646487 - protein, 7 aa, Entamoeba histolytica
PKEENVT

SEQ ID NO: 2646488 - protein, 7 aa, Entamoeba histolytica
PKEETKK

SEQ ID NO: 2646489 - protein, 13 aa, Entamoeba histolytica
PKEFKAKSKPKFA

SEQ ID NO: 2646490 - protein, 9 aa, Entamoeba histolytica
PKEGDPSYP

SEQ ID NO: 2646491 - protein, 9 aa, Entamoeba histolytica
PKEGKTSTL

SEQ ID NO: 2646492 - protein, 4 aa, Entamoeba histolytica
PKEH

SEQ ID NO: 2646493 - protein, 10 aa, Entamoeba histolytica
PKEKAQIADT

SEQ ID NO: 2646494 - protein, 11 aa, Entamoeba histolytica
PKEKPSKSTAL

SEQ ID NO: 2646495 - protein, 4 aa, Entamoeba histolytica
PKEL

SEQ ID NO: 2646496 - protein, 9 aa, Entamoeba histolytica
PKENKGEVF

SEQ ID NO: 2646497 - protein, 9 aa, Entamoeba histolytica
PKENKYSTA

SEQ ID NO: 2646498 - protein, 8 aa, Entamoeba histolytica
PKEPLYSQ

SEQ ID NO: 2646499 - protein, 7 aa, Entamoeba histolytica
PKEPSQA

SEQ ID NO: 2646500 - protein, 6 aa, Entamoeba histolytica
PKEQEE

SEQ ID NO: 2646501 - protein, 15 aa, Entamoeba histolytica
PKEQEEKSKADAAKA

SEQ ID NO: 2646502 - protein, 11 aa, Entamoeba histolytica
PKEQYNEQQTL

SEQ ID NO: 2646503 - protein, 4 aa, Entamoeba histolytica
PKER

SEQ ID NO: 2646504 - protein, 12 aa, Entamoeba histolytica
PKERIDRTNCSN

SEQ ID NO: 2646505 - protein, 8 aa, Entamoeba histolytica
PKERKKEI

SEQ ID NO: 2646506 - protein, 7 aa, Entamoeba histolytica
PKERSEV

SEQ ID NO: 2646507 - protein, 13 aa, Entamoeba histolytica
PKESAMKYASDNE

SEQ ID NO: 2646508 - protein, 7 aa, Entamoeba histolytica
PKESKGF

SEQ ID NO: 2646509 - protein, 6 aa, Entamoeba histolytica
PKETDG

SEQ ID NO: 2646510 - protein, 45 aa, Entamoeba histolytica
PKETENNQKQQKQSKGKSQVTSGTKKVNPKKISQKETESCLKEEK

SEQ ID NO: 2646511 - protein, 5 aa, Entamoeba histolytica
PKETR

SEQ ID NO: 2646512 - protein, 6 aa, Entamoeba histolytica
PKETTK

SEQ ID NO: 2646513 - protein, 5 aa, Entamoeba histolytica
PKETV

SEQ ID NO: 2646514 - protein, 4 aa, Entamoeba histolytica
PKEV

SEQ ID NO: 2646515 - protein, 5 aa, Entamoeba histolytica
PKEVG

SEQ ID NO: 2646516 - protein, 8 aa, Entamoeba histolytica
PKEVGKFN

SEQ ID NO: 2646517 - protein, 14 aa, Entamoeba histolytica
PKEVKKEKHDIPKN

SEQ ID NO: 2646518 - protein, 21 aa, Entamoeba histolytica
PKEVQTTEEENKKEEENMSKE

SEQ ID NO: 2646519 - protein, 24 aa, Entamoeba histolytica
PKEYGKLKEENGEKKKKKDEKKRE

SEQ ID NO: 2646520 - protein, 7 aa, Entamoeba histolytica
PKEYSYN

SEQ ID NO: 2646521 - protein, 6 aa, Entamoeba histolytica
PKFDNE

SEQ ID NO: 2646522 - protein, 8 aa, Entamoeba histolytica
PKFGTNDE

SEQ ID NO: 2646523 - protein, 4 aa, Entamoeba histolytica
PKFK

SEQ ID NO: 2646524 - protein, 4 aa, Entamoeba histolytica
PKFN

SEQ ID NO: 2646525 - protein, 4 aa, Entamoeba histolytica
PKFT

SEQ ID NO: 2646526 - protein, 8 aa, Entamoeba histolytica
PKGARALK

SEQ ID NO: 2646527 - protein, 6 aa, Entamoeba histolytica
PKGDHD

SEQ ID NO: 2646528 - protein, 4 aa, Entamoeba histolytica
PKGG

SEQ ID NO: 2646529 - protein, 6 aa, Entamoeba histolytica
PKGGGE

SEQ ID NO: 2646530 - protein, 7 aa, Entamoeba histolytica
PKGGSNI

SEQ ID NO: 2646531 - protein, 5 aa, Entamoeba histolytica
PKGIE

SEQ ID NO: 2646532 - protein, 7 aa, Entamoeba histolytica
PKGIERN

SEQ ID NO: 2646533 - protein, 6 aa, Entamoeba histolytica
PKGKRY

SEQ ID NO: 2646534 - protein, 12 aa, Entamoeba histolytica
PKGMKSNDAPIL

SEQ ID NO: 2646535 - protein, 7 aa, Entamoeba histolytica
PKGMSNR

SEQ ID NO: 2646536 - protein, 9 aa, Entamoeba histolytica
PKGNSGEAV

SEQ ID NO: 2646537 - protein, 6 aa, Entamoeba histolytica
PKGTEI

SEQ ID NO: 2646538 - protein, 7 aa, Entamoeba histolytica
PKGVSAI

SEQ ID NO: 2646539 - protein, 102 aa, Entamoeba histolytica
PKGVVPPPSNTATAPPPPPPGASSVPPPPPPPGASSVPPPPPPPGASSVPPPPPPPGMPGMPPPPPPPGMPGMPPPPPLPGMPGMPPPPPGMPGMPPPPPGF

SEQ ID NO: 2646540 - protein, 13 aa, Entamoeba histolytica
PKHCSSFKKPKRV

SEQ ID NO: 2646541 - protein, 29 aa, Entamoeba histolytica
PKHEKEEEEDDEQTNEGVVETKENPFDKR

SEQ ID NO: 2646542 - protein, 15 aa, Entamoeba histolytica
PKHSPRYEEEDIEEE

SEQ ID NO: 2646543 - protein, 15 aa, Entamoeba histolytica
PKIANSFQNNTNQEK

SEQ ID NO: 2646544 - protein, 10 aa, Entamoeba histolytica
PKIEEEITGK

SEQ ID NO: 2646545 - protein, 15 aa, Entamoeba histolytica
PKIKEKEESAGPEDK

SEQ ID NO: 2646546 - protein, 5 aa, Entamoeba histolytica
PKIKT

SEQ ID NO: 2646547 - protein, 55 aa, Entamoeba histolytica
PKINEEEFKKEEIKQKEEEIKRKEIKKEERNENNILSQPKKIRKSTTTLNKERTR

SEQ ID NO: 2646548 - protein, 15 aa, Entamoeba histolytica
PKINKNKKEKKPRKD

SEQ ID NO: 2646549 - protein, 22 aa, Entamoeba histolytica
PKIPEDDQTITEEDESTTLEDD

SEQ ID NO: 2646550 - protein, 10 aa, Entamoeba histolytica
PKIPKPVAKP

SEQ ID NO: 2646551 - protein, 9 aa, Entamoeba histolytica
PKIPTTQEL

SEQ ID NO: 2646552 - protein, 6 aa, Entamoeba histolytica
PKISDK

SEQ ID NO: 2646553 - protein, 6 aa, Entamoeba histolytica
PKISSP

SEQ ID NO: 2646554 - protein, 8 aa, Entamoeba histolytica
PKISSPTI

SEQ ID NO: 2646555 - protein, 6 aa, Entamoeba histolytica
PKISTL

SEQ ID NO: 2646556 - protein, 9 aa, Entamoeba histolytica
PKKAKGEDS

SEQ ID NO: 2646557 - protein, 4 aa, Entamoeba histolytica
PKKD

SEQ ID NO: 2646558 - protein, 9 aa, Entamoeba histolytica
PKKDEEKMI

SEQ ID NO: 2646559 - protein, 20 aa, Entamoeba histolytica
PKKDGDKSIGQEIKEKQERE

SEQ ID NO: 2646560 - protein, 61 aa, Entamoeba histolytica
PKKEEKKPQPPKKEEKKPQPPKKESKVQQHQQPQKKEDKKPQHQQQPNQKQGKKNNKKNKK

SEQ ID NO: 2646561 - protein, 59 aa, Entamoeba histolytica
PKKEEKKPQPPKKEEKKPQPPKKESKVQQHQQPQKKEDKKPQQQPNQKQGKKNNKKNKK

SEQ ID NO: 2646562 - protein, 7 aa, Entamoeba histolytica
PKKESLK

SEQ ID NO: 2646563 - protein, 7 aa, Entamoeba histolytica
PKKFNKE

SEQ ID NO: 2646564 - protein, 12 aa, Entamoeba histolytica
PKKHGRGGQSSV

SEQ ID NO: 2646565 - protein, 4 aa, Entamoeba histolytica
PKKI

SEQ ID NO: 2646566 - protein, 15 aa, Entamoeba histolytica
PKKIDEGKKEKEQFK

SEQ ID NO: 2646567 - protein, 7 aa, Entamoeba histolytica
PKKIQSD

SEQ ID NO: 2646568 - protein, 10 aa, Entamoeba histolytica
PKKKGKALQE

SEQ ID NO: 2646569 - protein, 14 aa, Entamoeba histolytica
PKKKKEITKDILKY

SEQ ID NO: 2646570 - protein, 12 aa, Entamoeba histolytica
PKKKKELKQTPF

SEQ ID NO: 2646571 - protein, 15 aa, Entamoeba histolytica
PKKKLDKEIESKKEG

SEQ ID NO: 2646572 - protein, 18 aa, Entamoeba histolytica
PKKKREKKRNSSSRESVS

SEQ ID NO: 2646573 - protein, 14 aa, Entamoeba histolytica
PKKKTDKKPLSVTN

SEQ ID NO: 2646574 - protein, 10 aa, Entamoeba histolytica
PKKKVPKGTL

SEQ ID NO: 2646575 - protein, 7 aa, Entamoeba histolytica
PKKKYEY

SEQ ID NO: 2646576 - protein, 4 aa, Entamoeba histolytica
PKKM

SEQ ID NO: 2646577 - protein, 7 aa, Entamoeba histolytica
PKKMNRR

SEQ ID NO: 2646578 - protein, 7 aa, Entamoeba histolytica
PKKNEYD

SEQ ID NO: 2646579 - protein, 5 aa, Entamoeba histolytica
PKKNN

SEQ ID NO: 2646580 - protein, 7 aa, Entamoeba histolytica
PKKNSIQ

SEQ ID NO: 2646581 - protein, 4 aa, Entamoeba histolytica
PKKP

SEQ ID NO: 2646582 - protein, 11 aa, Entamoeba histolytica
PKKPKINIPTY

SEQ ID NO: 2646583 - protein, 13 aa, Entamoeba histolytica
PKKPKSNKEESVS

SEQ ID NO: 2646584 - protein, 9 aa, Entamoeba histolytica
PKKPLSQEL

SEQ ID NO: 2646585 - protein, 25 aa, Entamoeba histolytica
PKKPSTESKEEPKEKKKKKEEPVFS

SEQ ID NO: 2646586 - protein, 30 aa, Entamoeba histolytica
PKKPVGEKRQYKRKEKKESVNDGLKPLSSI

SEQ ID NO: 2646587 - protein, 12 aa, Entamoeba histolytica
PKKQHSESEVQL

SEQ ID NO: 2646588 - protein, 6 aa, Entamoeba histolytica
PKKREV

SEQ ID NO: 2646589 - protein, 8 aa, Entamoeba histolytica
PKKRSTVA

SEQ ID NO: 2646590 - protein, 29 aa, Entamoeba histolytica
PKKSKESKKSKKSKESKESKESKKSKKQS

SEQ ID NO: 2646591 - protein, 8 aa, Entamoeba histolytica
PKKTITEL

SEQ ID NO: 2646592 - protein, 50 aa, Entamoeba histolytica
PKKTKTNEKKHKKDETSSLEEKKKKDDDESKTKIPTKTSPKGDNRAHRRG

SEQ ID NO: 2646593 - protein, 31 aa, Entamoeba histolytica
PKKTPPQPYQKALPKPSASAQSTPKTSAPKR

SEQ ID NO: 2646594 - protein, 9 aa, Entamoeba histolytica
PKKTPSKSY

SEQ ID NO: 2646595 - protein, 8 aa, Entamoeba histolytica
PKKTQSKL

SEQ ID NO: 2646596 - protein, 7 aa, Entamoeba histolytica
PKKTTEK

SEQ ID NO: 2646597 - protein, 7 aa, Entamoeba histolytica
PKKTTFT

SEQ ID NO: 2646598 - protein, 12 aa, Entamoeba histolytica
PKKVKDTNSDDD

SEQ ID NO: 2646599 - protein, 4 aa, Entamoeba histolytica
PKKY

SEQ ID NO: 2646600 - protein, 5 aa, Entamoeba histolytica
PKKYA

SEQ ID NO: 2646601 - protein, 15 aa, Entamoeba histolytica
PKLAAEEADDAYKDV

SEQ ID NO: 2646602 - protein, 15 aa, Entamoeba histolytica
PKLAAEEADEAYKDV

SEQ ID NO: 2646603 - protein, 6 aa, Entamoeba histolytica
PKLCSG

SEQ ID NO: 2646604 - protein, 54 aa, Entamoeba histolytica
PKLDGNDSVDSKKIKTFENESSKRKVQKKSKISEVQEDKKEKKVKKRKGLGNEE

SEQ ID NO: 2646605 - protein, 7 aa, Entamoeba histolytica
PKLDGYD

SEQ ID NO: 2646606 - protein, 6 aa, Entamoeba histolytica
PKLGTN

SEQ ID NO: 2646607 - protein, 7 aa, Entamoeba histolytica
PKLKRTD

SEQ ID NO: 2646608 - protein, 15 aa, Entamoeba histolytica
PKLNESLSQPITPSL

SEQ ID NO: 2646609 - protein, 20 aa, Entamoeba histolytica
PKLNTKATRFQGGGMESQST

SEQ ID NO: 2646610 - protein, 7 aa, Entamoeba histolytica
PKLPGDT

SEQ ID NO: 2646611 - protein, 11 aa, Entamoeba histolytica
PKLPKEEPPYN

SEQ ID NO: 2646612 - protein, 6 aa, Entamoeba histolytica
PKLQKS

SEQ ID NO: 2646613 - protein, 7 aa, Entamoeba histolytica
PKLSEPV

SEQ ID NO: 2646614 - protein, 27 aa, Entamoeba histolytica
PKLTEEKAQKKDKKRSDSIDKESEPTL

SEQ ID NO: 2646615 - protein, 4 aa, Entamoeba histolytica
PKND

SEQ ID NO: 2646616 - protein, 8 aa, Entamoeba histolytica
PKNDTTIY

SEQ ID NO: 2646617 - protein, 6 aa, Entamoeba histolytica
PKNEDY

SEQ ID NO: 2646618 - protein, 8 aa, Entamoeba histolytica
PKNEEKEI

SEQ ID NO: 2646619 - protein, 5 aa, Entamoeba histolytica
PKNEF

SEQ ID NO: 2646620 - protein, 7 aa, Entamoeba histolytica
PKNETLT

SEQ ID NO: 2646621 - protein, 10 aa, Entamoeba histolytica
PKNGKEPIPK

SEQ ID NO: 2646622 - protein, 8 aa, Entamoeba histolytica
PKNGQPLR

SEQ ID NO: 2646623 - protein, 7 aa, Entamoeba histolytica
PKNHCKT

SEQ ID NO: 2646624 - protein, 32 aa, Entamoeba histolytica
PKNKIKNEPKIEEKQEEPKKEERRERGNDKHE

SEQ ID NO: 2646625 - protein, 8 aa, Entamoeba histolytica
PKNKKGGI

SEQ ID NO: 2646626 - protein, 8 aa, Entamoeba histolytica
PKNKRAPE

SEQ ID NO: 2646627 - protein, 4 aa, Entamoeba histolytica
PKNM

SEQ ID NO: 2646628 - protein, 9 aa, Entamoeba histolytica
PKNPISPET

SEQ ID NO: 2646629 - protein, 16 aa, Entamoeba histolytica
PKNQRRTTDPKTPDIE

SEQ ID NO: 2646630 - protein, 5 aa, Entamoeba histolytica
PKNRQ

SEQ ID NO: 2646631 - protein, 7 aa, Entamoeba histolytica
PKNTALE

SEQ ID NO: 2646632 - protein, 9 aa, Entamoeba histolytica
PKNVESDDL

SEQ ID NO: 2646633 - protein, 5 aa, Entamoeba histolytica
PKNVQ

SEQ ID NO: 2646634 - protein, 5 aa, Entamoeba histolytica
PKPDI

SEQ ID NO: 2646635 - protein, 8 aa, Entamoeba histolytica
PKPDQKTR

SEQ ID NO: 2646636 - protein, 19 aa, Entamoeba histolytica
PKPELDSIQTPSKKSCCFL

SEQ ID NO: 2646637 - protein, 7 aa, Entamoeba histolytica
PKPGTFI

SEQ ID NO: 2646638 - protein, 40 aa, Entamoeba histolytica
PKPISPQQQPMQPINPGKPIMPSQPISPGKPIMPSQPGFG

SEQ ID NO: 2646639 - protein, 6 aa, Entamoeba histolytica
PKPKEF

SEQ ID NO: 2646640 - protein, 8 aa, Entamoeba histolytica
PKPLPEDV

SEQ ID NO: 2646641 - protein, 5 aa, Entamoeba histolytica
PKPPE

SEQ ID NO: 2646642 - protein, 6 aa, Entamoeba histolytica
PKPPQT

SEQ ID NO: 2646643 - protein, 17 aa, Entamoeba histolytica
PKPPRENRHSIKEWIDK

SEQ ID NO: 2646644 - protein, 72 aa, Entamoeba histolytica
PKPPRENRHSIKEWIDKKRLKTKTSFRSTNEYQEKRDYERGIHLELQHYLPIEEKEEREEAINETKIEHPQN

SEQ ID NO: 2646645 - protein, 7 aa, Entamoeba histolytica
PKPPVTS

SEQ ID NO: 2646646 - protein, 8 aa, Entamoeba histolytica
PKPRPGGG

SEQ ID NO: 2646647 - protein, 10 aa, Entamoeba histolytica
PKPSSIPMKD

SEQ ID NO: 2646648 - protein, 7 aa, Entamoeba histolytica
PKPTKKV

SEQ ID NO: 2646649 - protein, 8 aa, Entamoeba histolytica
PKPTSTIK

SEQ ID NO: 2646650 - protein, 4 aa, Entamoeba histolytica
PKQA

SEQ ID NO: 2646651 - protein, 4 aa, Entamoeba histolytica
PKQF

SEQ ID NO: 2646652 - protein, 8 aa, Entamoeba histolytica
PKQGKTFT

SEQ ID NO: 2646653 - protein, 4 aa, Entamoeba histolytica
PKQI

SEQ ID NO: 2646654 - protein, 14 aa, Entamoeba histolytica
PKQKSSSLLSPNKT

SEQ ID NO: 2646655 - protein, 16 aa, Entamoeba histolytica
PKQPKHLSNEQIKNTI

SEQ ID NO: 2646656 - protein, 43 aa, Entamoeba histolytica
PKQPLKAPPLPPLPKGAKPKVSPNPNSPPKPKETLPPQSQRPI

SEQ ID NO: 2646657 - protein, 8 aa, Entamoeba histolytica
PKQPTVQD

SEQ ID NO: 2646658 - protein, 4 aa, Entamoeba histolytica
PKQR

SEQ ID NO: 2646659 - protein, 5 aa, Entamoeba histolytica
PKQRL

SEQ ID NO: 2646660 - protein, 5 aa, Entamoeba histolytica
PKQRT

SEQ ID NO: 2646661 - protein, 4 aa, Entamoeba histolytica
PKQS

SEQ ID NO: 2646662 - protein, 8 aa, Entamoeba histolytica
PKQSDTPI

SEQ ID NO: 2646663 - protein, 8 aa, Entamoeba histolytica
PKQSKNEH

SEQ ID NO: 2646664 - protein, 5 aa, Entamoeba histolytica
PKQTE

SEQ ID NO: 2646665 - protein, 15 aa, Entamoeba histolytica
PKQVPGLSSTPTDKI

SEQ ID NO: 2646666 - protein, 4 aa, Entamoeba histolytica
PKQW

SEQ ID NO: 2646667 - protein, 4 aa, Entamoeba histolytica
PKQY

SEQ ID NO: 2646668 - protein, 7 aa, Entamoeba histolytica
PKQYSEN

SEQ ID NO: 2646669 - protein, 7 aa, Entamoeba histolytica
PKRCSGR

SEQ ID NO: 2646670 - protein, 10 aa, Entamoeba histolytica
PKRESHGGST

SEQ ID NO: 2646671 - protein, 5 aa, Entamoeba histolytica
PKRFS

SEQ ID NO: 2646672 - protein, 4 aa, Entamoeba histolytica
PKRG

SEQ ID NO: 2646673 - protein, 6 aa, Entamoeba histolytica
PKRLTK

SEQ ID NO: 2646674 - protein, 15 aa, Entamoeba histolytica
PKRMPNPKQAYGDSG

SEQ ID NO: 2646675 - protein, 4 aa, Entamoeba histolytica
PKRQ

SEQ ID NO: 2646676 - protein, 7 aa, Entamoeba histolytica
PKRRHQN

SEQ ID NO: 2646677 - protein, 11 aa, Entamoeba histolytica
PKRSDSMGSIK

SEQ ID NO: 2646678 - protein, 9 aa, Entamoeba histolytica
PKRSNAGIN

SEQ ID NO: 2646679 - protein, 4 aa, Entamoeba histolytica
PKRW

SEQ ID NO: 2646680 - protein, 7 aa, Entamoeba histolytica
PKSDDID

SEQ ID NO: 2646681 - protein, 8 aa, Entamoeba histolytica
PKSDSKRV

SEQ ID NO: 2646682 - protein, 11 aa, Entamoeba histolytica
PKSDTQMSNVQ

SEQ ID NO: 2646683 - protein, 4 aa, Entamoeba histolytica
PKSE

SEQ ID NO: 2646684 - protein, 8 aa, Entamoeba histolytica
PKSELENA

SEQ ID NO: 2646685 - protein, 6 aa, Entamoeba histolytica
PKSESI

SEQ ID NO: 2646686 - protein, 7 aa, Entamoeba histolytica
PKSFEEE

SEQ ID NO: 2646687 - protein, 7 aa, Entamoeba histolytica
PKSFNAR

SEQ ID NO: 2646688 - protein, 5 aa, Entamoeba histolytica
PKSIP

SEQ ID NO: 2646689 - protein, 4 aa, Entamoeba histolytica
PKSM

SEQ ID NO: 2646690 - protein, 11 aa, Entamoeba histolytica
PKSNRNDVEPE

SEQ ID NO: 2646691 - protein, 16 aa, Entamoeba histolytica
PKSPFKADRIISISFD

SEQ ID NO: 2646692 - protein, 9 aa, Entamoeba histolytica
PKSRFTADE

SEQ ID NO: 2646693 - protein, 10 aa, Entamoeba histolytica
PKSRKYSHIQ

SEQ ID NO: 2646694 - protein, 6 aa, Entamoeba histolytica
PKSSSY

SEQ ID NO: 2646695 - protein, 7 aa, Entamoeba histolytica
PKSSYTD

SEQ ID NO: 2646696 - protein, 8 aa, Entamoeba histolytica
PKSTIDNW

SEQ ID NO: 2646697 - protein, 9 aa, Entamoeba histolytica
PKSTNPNRL

SEQ ID NO: 2646698 - protein, 4 aa, Entamoeba histolytica
PKSW

SEQ ID NO: 2646699 - protein, 7 aa, Entamoeba histolytica
PKSYMKE

SEQ ID NO: 2646700 - protein, 11 aa, Entamoeba histolytica
PKSYQNDGEDI

SEQ ID NO: 2646701 - protein, 5 aa, Entamoeba histolytica
PKTAE

SEQ ID NO: 2646702 - protein, 7 aa, Entamoeba histolytica
PKTESIS

SEQ ID NO: 2646703 - protein, 6 aa, Entamoeba histolytica
PKTGLT

SEQ ID NO: 2646704 - protein, 32 aa, Entamoeba histolytica
PKTGYKRKSIHSKTSCPNEAMKEKKDTSEFSK

SEQ ID NO: 2646705 - protein, 4 aa, Entamoeba histolytica
PKTH

SEQ ID NO: 2646706 - protein, 5 aa, Entamoeba histolytica
PKTIK

SEQ ID NO: 2646707 - protein, 13 aa, Entamoeba histolytica
PKTIPRNTSETND

SEQ ID NO: 2646708 - protein, 7 aa, Entamoeba histolytica
PKTKAGV

SEQ ID NO: 2646709 - protein, 11 aa, Entamoeba histolytica
PKTKETERKPF

SEQ ID NO: 2646710 - protein, 7 aa, Entamoeba histolytica
PKTKQEG

SEQ ID NO: 2646711 - protein, 10 aa, Entamoeba histolytica
PKTKQQTILD

SEQ ID NO: 2646712 - protein, 11 aa, Entamoeba histolytica
PKTKRKNDKKG

SEQ ID NO: 2646713 - protein, 9 aa, Entamoeba histolytica
PKTKTLAKA

SEQ ID NO: 2646714 - protein, 8 aa, Entamoeba histolytica
PKTKTPSI

SEQ ID NO: 2646715 - protein, 5 aa, Entamoeba histolytica
PKTKY

SEQ ID NO: 2646716 - protein, 10 aa, Entamoeba histolytica
PKTLNDVKGG

SEQ ID NO: 2646717 - protein, 9 aa, Entamoeba histolytica
PKTLTGEWE

SEQ ID NO: 2646718 - protein, 5 aa, Entamoeba histolytica
PKTMK

SEQ ID NO: 2646719 - protein, 6 aa, Entamoeba histolytica
PKTNAS

SEQ ID NO: 2646720 - protein, 6 aa, Entamoeba histolytica
PKTNIV

SEQ ID NO: 2646721 - protein, 11 aa, Entamoeba histolytica
PKTNPQPLYKP

SEQ ID NO: 2646722 - protein, 6 aa, Entamoeba histolytica
PKTPEA

SEQ ID NO: 2646723 - protein, 6 aa, Entamoeba histolytica
PKTPIN

SEQ ID NO: 2646724 - protein, 16 aa, Entamoeba histolytica
PKTPNVTSTPLVKPNS

SEQ ID NO: 2646725 - protein, 5 aa, Entamoeba histolytica
PKTPT

SEQ ID NO: 2646726 - protein, 8 aa, Entamoeba histolytica
PKTPTDMK

SEQ ID NO: 2646727 - protein, 7 aa, Entamoeba histolytica
PKTQESI

SEQ ID NO: 2646728 - protein, 6 aa, Entamoeba histolytica
PKTQQE

SEQ ID NO: 2646729 - protein, 29 aa, Entamoeba histolytica
PKTRAKPKRTDKKKPQIKPIAERSALDLF

SEQ ID NO: 2646730 - protein, 8 aa, Entamoeba histolytica
PKTRLRER

SEQ ID NO: 2646731 - protein, 18 aa, Entamoeba histolytica
PKTRYSTATGKTNEITDG

SEQ ID NO: 2646732 - protein, 5 aa, Entamoeba histolytica
PKTSI

SEQ ID NO: 2646733 - protein, 10 aa, Entamoeba histolytica
PKTSRTGYRG

SEQ ID NO: 2646734 - protein, 8 aa, Entamoeba histolytica
PKTTPTPI

SEQ ID NO: 2646735 - protein, 14 aa, Entamoeba histolytica
PKTTQEIRDLSNNE

SEQ ID NO: 2646736 - protein, 9 aa, Entamoeba histolytica
PKTVSNISG

SEQ ID NO: 2646737 - protein, 9 aa, Entamoeba histolytica
PKVAGYATG

SEQ ID NO: 2646738 - protein, 8 aa, Entamoeba histolytica
PKVETPVI

SEQ ID NO: 2646739 - protein, 10 aa, Entamoeba histolytica
PKVPEKPKKL

SEQ ID NO: 2646740 - protein, 7 aa, Entamoeba histolytica
PKVPPKG

SEQ ID NO: 2646741 - protein, 7 aa, Entamoeba histolytica
PKVPRES

SEQ ID NO: 2646742 - protein, 11 aa, Entamoeba histolytica
PKVQKSFEARK

SEQ ID NO: 2646743 - protein, 7 aa, Entamoeba histolytica
PKVQTGR

SEQ ID NO: 2646744 - protein, 30 aa, Entamoeba histolytica
PKVSGADDVSNIDEEFTNEDAQKMTPSENV

SEQ ID NO: 2646745 - protein, 9 aa, Entamoeba histolytica
PKVSKRAND

SEQ ID NO: 2646746 - protein, 4 aa, Entamoeba histolytica
PKVT

SEQ ID NO: 2646747 - protein, 9 aa, Entamoeba histolytica
PKWSGTVGS

SEQ ID NO: 2646748 - protein, 4 aa, Entamoeba histolytica
PKWT

SEQ ID NO: 2646749 - protein, 5 aa, Entamoeba histolytica
PKWTG

SEQ ID NO: 2646750 - protein, 8 aa, Entamoeba histolytica
PKYCSQRN

SEQ ID NO: 2646751 - protein, 8 aa, Entamoeba histolytica
PKYEGLDN

SEQ ID NO: 2646752 - protein, 5 aa, Entamoeba histolytica
PKYFS

SEQ ID NO: 2646753 - protein, 4 aa, Entamoeba histolytica
PKYK

SEQ ID NO: 2646754 - protein, 5 aa, Entamoeba histolytica
PKYKQ

SEQ ID NO: 2646755 - protein, 9 aa, Entamoeba histolytica
PKYNNQRYE

SEQ ID NO: 2646756 - protein, 4 aa, Entamoeba histolytica
PKYP

SEQ ID NO: 2646757 - protein, 6 aa, Entamoeba histolytica
PKYRKE

SEQ ID NO: 2646758 - protein, 4 aa, Entamoeba histolytica
PKYS

SEQ ID NO: 2646759 - protein, 6 aa, Entamoeba histolytica
PKYTES

SEQ ID NO: 2646760 - protein, 7 aa, Entamoeba histolytica
PKYTVNT

SEQ ID NO: 2646761 - protein, 16 aa, Entamoeba histolytica
PLAEKGKEFDSQTKYA

SEQ ID NO: 2646762 - protein, 15 aa, Entamoeba histolytica
PLAQEQNECGQRIEE

SEQ ID NO: 2646763 - protein, 16 aa, Entamoeba histolytica
PLAQTITSANDIEKTV

SEQ ID NO: 2646764 - protein, 17 aa, Entamoeba histolytica
PLDGKTTRAYWTSLYNL

SEQ ID NO: 2646765 - protein, 7 aa, Entamoeba histolytica
PLDNRTF

SEQ ID NO: 2646766 - protein, 4 aa, Entamoeba histolytica
PLDS

SEQ ID NO: 2646767 - protein, 8 aa, Entamoeba histolytica
PLDTEGLA

SEQ ID NO: 2646768 - protein, 8 aa, Entamoeba histolytica
PLDTESTN

SEQ ID NO: 2646769 - protein, 4 aa, Entamoeba histolytica
PLEA

SEQ ID NO: 2646770 - protein, 8 aa, Entamoeba histolytica
PLEDAKGK

SEQ ID NO: 2646771 - protein, 12 aa, Entamoeba histolytica
PLEDSKEEQEIY

SEQ ID NO: 2646772 - protein, 9 aa, Entamoeba histolytica
PLEGNSGGF

SEQ ID NO: 2646773 - protein, 19 aa, Entamoeba histolytica
PLEIKTETKPSTQQTSISS

SEQ ID NO: 2646774 - protein, 4 aa, Entamoeba histolytica
PLEP

SEQ ID NO: 2646775 - protein, 5 aa, Entamoeba histolytica
PLEPV

SEQ ID NO: 2646776 - protein, 5 aa, Entamoeba histolytica
PLEQR

SEQ ID NO: 2646777 - protein, 4 aa, Entamoeba histolytica
PLES

SEQ ID NO: 2646778 - protein, 24 aa, Entamoeba histolytica
PLESHSARARSISPNTIHSPTIPT

SEQ ID NO: 2646779 - protein, 6 aa, Entamoeba histolytica
PLESPR

SEQ ID NO: 2646780 - protein, 7 aa, Entamoeba histolytica
PLETKKP

SEQ ID NO: 2646781 - protein, 6 aa, Entamoeba histolytica
PLFDSD

SEQ ID NO: 2646782 - protein, 11 aa, Entamoeba histolytica
PLFPGSSTLNQ

SEQ ID NO: 2646783 - protein, 8 aa, Entamoeba histolytica
PLGEKESH

SEQ ID NO: 2646784 - protein, 4 aa, Entamoeba histolytica
PLGG

SEQ ID NO: 2646785 - protein, 9 aa, Entamoeba histolytica
PLGPDGKRD

SEQ ID NO: 2646786 - protein, 7 aa, Entamoeba histolytica
PLGPEPK

SEQ ID NO: 2646787 - protein, 8 aa, Entamoeba histolytica
PLGSGTYG

SEQ ID NO: 2646788 - protein, 11 aa, Entamoeba histolytica
PLHSKSKEEII

SEQ ID NO: 2646789 - protein, 6 aa, Entamoeba histolytica
PLHTEE

SEQ ID NO: 2646790 - protein, 5 aa, Entamoeba histolytica
PLKDQ

SEQ ID NO: 2646791 - protein, 36 aa, Entamoeba histolytica
PLKDTQRRNKHSFRKPRQQNEMKSLTRTNSEGFSER

SEQ ID NO: 2646792 - protein, 11 aa, Entamoeba histolytica
PLKENQKLGIP

SEQ ID NO: 2646793 - protein, 5 aa, Entamoeba histolytica
PLKEP

SEQ ID NO: 2646794 - protein, 8 aa, Entamoeba histolytica
PLKEQTEK

SEQ ID NO: 2646795 - protein, 5 aa, Entamoeba histolytica
PLKGM

SEQ ID NO: 2646796 - protein, 5 aa, Entamoeba histolytica
PLKKG

SEQ ID NO: 2646797 - protein, 12 aa, Entamoeba histolytica
PLKKSPKAQKKL

SEQ ID NO: 2646798 - protein, 4 aa, Entamoeba histolytica
PLKN

SEQ ID NO: 2646799 - protein, 7 aa, Entamoeba histolytica
PLKNEGI

SEQ ID NO: 2646800 - protein, 46 aa, Entamoeba histolytica
PLKPQKDKTSILKSPSLARTNTGVLPKETTKKLRASCSPKEKAELK

SEQ ID NO: 2646801 - protein, 19 aa, Entamoeba histolytica
PLKQKENIEKRGRPEEKDY

SEQ ID NO: 2646802 - protein, 11 aa, Entamoeba histolytica
PLKRESKRHKE

SEQ ID NO: 2646803 - protein, 10 aa, Entamoeba histolytica
PLLDKSKESL

SEQ ID NO: 2646804 - protein, 4 aa, Entamoeba histolytica
PLLG

SEQ ID NO: 2646805 - protein, 6 aa, Entamoeba histolytica
PLLPGG

SEQ ID NO: 2646806 - protein, 25 aa, Entamoeba histolytica
PLLSEEETDKDYEEGSDENSGEEEF

SEQ ID NO: 2646807 - protein, 23 aa, Entamoeba histolytica
PLLSPGRSLSFSSNDSSLAASED

SEQ ID NO: 2646808 - protein, 11 aa, Entamoeba histolytica
PLLSPQSSTFI

SEQ ID NO: 2646809 - protein, 5 aa, Entamoeba histolytica
PLLST

SEQ ID NO: 2646810 - protein, 40 aa, Entamoeba histolytica
PLNDSRNSLEVPNQKVESKSITPSSNGSSSQQQTGVKHQE

SEQ ID NO: 2646811 - protein, 7 aa, Entamoeba histolytica
PLNEENK

SEQ ID NO: 2646812 - protein, 11 aa, Entamoeba histolytica
PLNENKGIIPK

SEQ ID NO: 2646813 - protein, 10 aa, Entamoeba histolytica
PLNGDSKNEY

SEQ ID NO: 2646814 - protein, 5 aa, Entamoeba histolytica
PLNKA

SEQ ID NO: 2646815 - protein, 5 aa, Entamoeba histolytica
PLNKE

SEQ ID NO: 2646816 - protein, 9 aa, Entamoeba histolytica
PLNKKERTE

SEQ ID NO: 2646817 - protein, 8 aa, Entamoeba histolytica
PLNPTEKQ

SEQ ID NO: 2646818 - protein, 11 aa, Entamoeba histolytica
PLNQHNSSLNP

SEQ ID NO: 2646819 - protein, 20 aa, Entamoeba histolytica
PLNQPITQRNTNQPINIPSS

SEQ ID NO: 2646820 - protein, 6 aa, Entamoeba histolytica
PLNQST

SEQ ID NO: 2646821 - protein, 9 aa, Entamoeba histolytica
PLNSQNTSL

SEQ ID NO: 2646822 - protein, 23 aa, Entamoeba histolytica
PLNSTTKPEDELEEEYDDDSWDN

SEQ ID NO: 2646823 - protein, 8 aa, Entamoeba histolytica
PLNSTTSY

SEQ ID NO: 2646824 - protein, 16 aa, Entamoeba histolytica
PLNTPNSVSSSTTLTP

SEQ ID NO: 2646825 - protein, 7 aa, Entamoeba histolytica
PLPDEDL

SEQ ID NO: 2646826 - protein, 8 aa, Entamoeba histolytica
PLPDEKEV

SEQ ID NO: 2646827 - protein, 4 aa, Entamoeba histolytica
PLPE

SEQ ID NO: 2646828 - protein, 5 aa, Entamoeba histolytica
PLPEE

SEQ ID NO: 2646829 - protein, 5 aa, Entamoeba histolytica
PLPEG

SEQ ID NO: 2646830 - protein, 13 aa, Entamoeba histolytica
PLPEKNDTIDTDY

SEQ ID NO: 2646831 - protein, 5 aa, Entamoeba histolytica
PLPFS

SEQ ID NO: 2646832 - protein, 8 aa, Entamoeba histolytica
PLPGFSDS

SEQ ID NO: 2646833 - protein, 14 aa, Entamoeba histolytica
PLPGPIVPPQNTPA

SEQ ID NO: 2646834 - protein, 4 aa, Entamoeba histolytica
PLPK

SEQ ID NO: 2646835 - protein, 20 aa, Entamoeba histolytica
PLPLPSNPLTANPSSSALEE

SEQ ID NO: 2646836 - protein, 5 aa, Entamoeba histolytica
PLPMD

SEQ ID NO: 2646837 - protein, 9 aa, Entamoeba histolytica
PLPNAEDLK

SEQ ID NO: 2646838 - protein, 11 aa, Entamoeba histolytica
PLPNVKTPYSQ

SEQ ID NO: 2646839 - protein, 20 aa, Entamoeba histolytica
PLPPIDSNDESSSEQESEEI

SEQ ID NO: 2646840 - protein, 18 aa, Entamoeba histolytica
PLPPKVTTPSVKSSTHNM

SEQ ID NO: 2646841 - protein, 72 aa, Entamoeba histolytica
PLPPLPPKVHGKRKKALPPIPTDTTPQEQSTQSSTEELIPPPVPAPRKSKQPRLSASLTNEDIPDRSNRDRS

SEQ ID NO: 2646842 - protein, 7 aa, Entamoeba histolytica
PLPPSTV

SEQ ID NO: 2646843 - protein, 4 aa, Entamoeba histolytica
PLPQ

SEQ ID NO: 2646844 - protein, 6 aa, Entamoeba histolytica
PLPQPN

SEQ ID NO: 2646845 - protein, 16 aa, Entamoeba histolytica
PLPQTPSRNPSQQHQP

SEQ ID NO: 2646846 - protein, 13 aa, Entamoeba histolytica
PLPRTTQSNTQRA

SEQ ID NO: 2646847 - protein, 4 aa, Entamoeba histolytica
PLPT

SEQ ID NO: 2646848 - protein, 5 aa, Entamoeba histolytica
PLPTE

SEQ ID NO: 2646849 - protein, 5 aa, Entamoeba histolytica
PLPTS

SEQ ID NO: 2646850 - protein, 31 aa, Entamoeba histolytica
PLPVPPKPSGLSKTDPRKKPLPPSPGNKKNI

SEQ ID NO: 2646851 - protein, 9 aa, Entamoeba histolytica
PLQNTTSIT

SEQ ID NO: 2646852 - protein, 11 aa, Entamoeba histolytica
PLQPDKQIKEN

SEQ ID NO: 2646853 - protein, 18 aa, Entamoeba histolytica
PLQPQIKQEGQSSIPQQI

SEQ ID NO: 2646854 - protein, 4 aa, Entamoeba histolytica
PLQQ

SEQ ID NO: 2646855 - protein, 19 aa, Entamoeba histolytica
PLQQKRNIETRGRPEEKDY

SEQ ID NO: 2646856 - protein, 6 aa, Entamoeba histolytica
PLQQQK

SEQ ID NO: 2646857 - protein, 35 aa, Entamoeba histolytica
PLQRKKKKKKHGKKKLKKIPTPSSIEEDKELQKEE

SEQ ID NO: 2646858 - protein, 5 aa, Entamoeba histolytica
PLQSD

SEQ ID NO: 2646859 - protein, 6 aa, Entamoeba histolytica
PLQSGC

SEQ ID NO: 2646860 - protein, 10 aa, Entamoeba histolytica
PLQSQEQNVQ

SEQ ID NO: 2646861 - protein, 5 aa, Entamoeba histolytica
PLRKD

SEQ ID NO: 2646862 - protein, 12 aa, Entamoeba histolytica
PLRNYEDPNNKQ

SEQ ID NO: 2646863 - protein, 7 aa, Entamoeba histolytica
PLRQPVP

SEQ ID NO: 2646864 - protein, 13 aa, Entamoeba histolytica
PLRRRSKDSKTSS

SEQ ID NO: 2646865 - protein, 4 aa, Entamoeba histolytica
PLSD

SEQ ID NO: 2646866 - protein, 7 aa, Entamoeba histolytica
PLSDDIQ

SEQ ID NO: 2646867 - protein, 7 aa, Entamoeba histolytica
PLSEEEL

SEQ ID NO: 2646868 - protein, 10 aa, Entamoeba histolytica
PLSKQQKYCP

SEQ ID NO: 2646869 - protein, 26 aa, Entamoeba histolytica
PLSKSEAASGVKRKKPTTKAKESRKK

SEQ ID NO: 2646870 - protein, 6 aa, Entamoeba histolytica
PLSKSQ

SEQ ID NO: 2646871 - protein, 9 aa, Entamoeba histolytica
PLSKSSGDF

SEQ ID NO: 2646872 - protein, 10 aa, Entamoeba histolytica
PLSNPPKDQQ

SEQ ID NO: 2646873 - protein, 7 aa, Entamoeba histolytica
PLSPDAL

SEQ ID NO: 2646874 - protein, 18 aa, Entamoeba histolytica
PLSPGSSQSTSSSPLPSD

SEQ ID NO: 2646875 - protein, 4 aa, Entamoeba histolytica
PLSQ

SEQ ID NO: 2646876 - protein, 7 aa, Entamoeba histolytica
PLSSDDS

SEQ ID NO: 2646877 - protein, 12 aa, Entamoeba histolytica
PLSSKAKEDERI

SEQ ID NO: 2646878 - protein, 7 aa, Entamoeba histolytica
PLSSPIN

SEQ ID NO: 2646879 - protein, 6 aa, Entamoeba histolytica
PLSSPQ

SEQ ID NO: 2646880 - protein, 6 aa, Entamoeba histolytica
PLSSVS

SEQ ID NO: 2646881 - protein, 24 aa, Entamoeba histolytica
PLSTKEKNTLSNTSIRVESNGNSY

SEQ ID NO: 2646882 - protein, 8 aa, Entamoeba histolytica
PLSTPQEY

SEQ ID NO: 2646883 - protein, 5 aa, Entamoeba histolytica
PLTDG

SEQ ID NO: 2646884 - protein, 6 aa, Entamoeba histolytica
PLTDGE

SEQ ID NO: 2646885 - protein, 4 aa, Entamoeba histolytica
PLTE

SEQ ID NO: 2646886 - protein, 6 aa, Entamoeba histolytica
PLTEEN

SEQ ID NO: 2646887 - protein, 6 aa, Entamoeba histolytica
PLTGSL

SEQ ID NO: 2646888 - protein, 4 aa, Entamoeba histolytica
PLTR

SEQ ID NO: 2646889 - protein, 37 aa, Entamoeba histolytica
PLTRGQSEISLTPNSQKHENNTSSKCSVNKRSSTSGF

SEQ ID NO: 2646890 - protein, 4 aa, Entamoeba histolytica
PLTS

SEQ ID NO: 2646891 - protein, 33 aa, Entamoeba histolytica
PLTSKSAEIPDLKKSNESKTYLEEDVDKNDLPE

SEQ ID NO: 2646892 - protein, 6 aa, Entamoeba histolytica
PLTSRR

SEQ ID NO: 2646893 - protein, 9 aa, Entamoeba histolytica
PLTTREKAR

SEQ ID NO: 2646894 - protein, 5 aa, Entamoeba histolytica
PLTTT

SEQ ID NO: 2646895 - protein, 4 aa, Entamoeba histolytica
PLTY

SEQ ID NO: 2646896 - protein, 22 aa, Entamoeba histolytica
PLYKPKDPAHPNLQTGKSINKR

SEQ ID NO: 2646897 - protein, 7 aa, Entamoeba histolytica
PLYSPLG

SEQ ID NO: 2646898 - protein, 5 aa, Entamoeba histolytica
PMDDP

SEQ ID NO: 2646899 - protein, 5 aa, Entamoeba histolytica
PMEDS

SEQ ID NO: 2646900 - protein, 20 aa, Entamoeba histolytica
PMEDSLSSSSNPFEASTGYE

SEQ ID NO: 2646901 - protein, 94 aa, Entamoeba histolytica
PMEEESEDENIDKEEVSTEEGISEEEDISNEDDNENEEDISNEDDDDENEEEDEEEDDENDNENEEDEDISNEEEDEGEELESKSEEDIEEDID

SEQ ID NO: 2646902 - protein, 4 aa, Entamoeba histolytica
PMIG

SEQ ID NO: 2646903 - protein, 5 aa, Entamoeba histolytica
PMKRS

SEQ ID NO: 2646904 - protein, 16 aa, Entamoeba histolytica
PMNEFDDKKSIHTPTL

SEQ ID NO: 2646905 - protein, 4 aa, Entamoeba histolytica
PMPD

SEQ ID NO: 2646906 - protein, 7 aa, Entamoeba histolytica
PMPIPQK

SEQ ID NO: 2646907 - protein, 11 aa, Entamoeba histolytica
PMRTDDSSHNK

SEQ ID NO: 2646908 - protein, 9 aa, Entamoeba histolytica
PMSPSPKGT

SEQ ID NO: 2646909 - protein, 6 aa, Entamoeba histolytica
PMSPVE

SEQ ID NO: 2646910 - protein, 5 aa, Entamoeba histolytica
PMSYS

SEQ ID NO: 2646911 - protein, 11 aa, Entamoeba histolytica
PMTHAEKERMK

SEQ ID NO: 2646912 - protein, 6 aa, Entamoeba histolytica
PMTPSS

SEQ ID NO: 2646913 - protein, 23 aa, Entamoeba histolytica
PMYGRSGSLSPVDQSLKESPKEV

SEQ ID NO: 2646914 - protein, 8 aa, Entamoeba histolytica
PNAHEDPQ

SEQ ID NO: 2646915 - protein, 12 aa, Entamoeba histolytica
PNAPLKPGKGID

SEQ ID NO: 2646916 - protein, 4 aa, Entamoeba histolytica
PNAS

SEQ ID NO: 2646917 - protein, 7 aa, Entamoeba histolytica
PNASKLS

SEQ ID NO: 2646918 - protein, 9 aa, Entamoeba histolytica
PNASTSESK

SEQ ID NO: 2646919 - protein, 6 aa, Entamoeba histolytica
PNATKV

SEQ ID NO: 2646920 - protein, 5 aa, Entamoeba histolytica
PNDDA

SEQ ID NO: 2646921 - protein, 4 aa, Entamoeba histolytica
PNDE

SEQ ID NO: 2646922 - protein, 15 aa, Entamoeba histolytica
PNDEPEIVDIKKESS

SEQ ID NO: 2646923 - protein, 14 aa, Entamoeba histolytica
PNDFTNDPTLESRR

SEQ ID NO: 2646924 - protein, 18 aa, Entamoeba histolytica
PNDGIEEEELEDREYEKE

SEQ ID NO: 2646925 - protein, 7 aa, Entamoeba histolytica
PNDGYVN

SEQ ID NO: 2646926 - protein, 4 aa, Entamoeba histolytica
PNDH

SEQ ID NO: 2646927 - protein, 4 aa, Entamoeba histolytica
PNDK

SEQ ID NO: 2646928 - protein, 10 aa, Entamoeba histolytica
PNDKCASTLP

SEQ ID NO: 2646929 - protein, 5 aa, Entamoeba histolytica
PNDKN

SEQ ID NO: 2646930 - protein, 8 aa, Entamoeba histolytica
PNDKRTPL

SEQ ID NO: 2646931 - protein, 5 aa, Entamoeba histolytica
PNDQI

SEQ ID NO: 2646932 - protein, 10 aa, Entamoeba histolytica
PNDQISESSY

SEQ ID NO: 2646933 - protein, 4 aa, Entamoeba histolytica
PNDS

SEQ ID NO: 2646934 - protein, 8 aa, Entamoeba histolytica
PNDSCQSL

SEQ ID NO: 2646935 - protein, 5 aa, Entamoeba histolytica
PNDVK

SEQ ID NO: 2646936 - protein, 5 aa, Entamoeba histolytica
PNDYE

SEQ ID NO: 2646937 - protein, 4 aa, Entamoeba histolytica
PNED

SEQ ID NO: 2646938 - protein, 6 aa, Entamoeba histolytica
PNEEAA

SEQ ID NO: 2646939 - protein, 14 aa, Entamoeba histolytica
PNEEAKEERIDESN

SEQ ID NO: 2646940 - protein, 7 aa, Entamoeba histolytica
PNEEIQR

SEQ ID NO: 2646941 - protein, 8 aa, Entamoeba histolytica
PNEEPSID

SEQ ID NO: 2646942 - protein, 4 aa, Entamoeba histolytica
PNEF

SEQ ID NO: 2646943 - protein, 15 aa, Entamoeba histolytica
PNEFASETKDGLRNG

SEQ ID NO: 2646944 - protein, 7 aa, Entamoeba histolytica
PNEHSPE

SEQ ID NO: 2646945 - protein, 4 aa, Entamoeba histolytica
PNEI

SEQ ID NO: 2646946 - protein, 15 aa, Entamoeba histolytica
PNEIPPMYDPKPQQV

SEQ ID NO: 2646947 - protein, 9 aa, Entamoeba histolytica
PNEIQKNKR

SEQ ID NO: 2646948 - protein, 7 aa, Entamoeba histolytica
PNENQQL

SEQ ID NO: 2646949 - protein, 7 aa, Entamoeba histolytica
PNENTSF

SEQ ID NO: 2646950 - protein, 6 aa, Entamoeba histolytica
PNEPDV

SEQ ID NO: 2646951 - protein, 8 aa, Entamoeba histolytica
PNEPMPSL

SEQ ID NO: 2646952 - protein, 4 aa, Entamoeba histolytica
PNEQ

SEQ ID NO: 2646953 - protein, 7 aa, Entamoeba histolytica
PNEQNMD

SEQ ID NO: 2646954 - protein, 7 aa, Entamoeba histolytica
PNEQYQH

SEQ ID NO: 2646955 - protein, 22 aa, Entamoeba histolytica
PNERTKEQKKVTSTPQETPKHG

SEQ ID NO: 2646956 - protein, 7 aa, Entamoeba histolytica
PNESINN

SEQ ID NO: 2646957 - protein, 6 aa, Entamoeba histolytica
PNESTR

SEQ ID NO: 2646958 - protein, 4 aa, Entamoeba histolytica
PNET

SEQ ID NO: 2646959 - protein, 11 aa, Entamoeba histolytica
PNETGSESKVE

SEQ ID NO: 2646960 - protein, 13 aa, Entamoeba histolytica
PNETKKPQDWDAD

SEQ ID NO: 2646961 - protein, 5 aa, Entamoeba histolytica
PNETM

SEQ ID NO: 2646962 - protein, 8 aa, Entamoeba histolytica
PNETRPHS

SEQ ID NO: 2646963 - protein, 6 aa, Entamoeba histolytica
PNETSD

SEQ ID NO: 2646964 - protein, 9 aa, Entamoeba histolytica
PNETTKALS

SEQ ID NO: 2646965 - protein, 6 aa, Entamoeba histolytica
PNETTQ

SEQ ID NO: 2646966 - protein, 6 aa, Entamoeba histolytica
PNETTS

SEQ ID NO: 2646967 - protein, 4 aa, Entamoeba histolytica
PNEV

SEQ ID NO: 2646968 - protein, 5 aa, Entamoeba histolytica
PNEWK

SEQ ID NO: 2646969 - protein, 12 aa, Entamoeba histolytica
PNEYDTSQPSQI

SEQ ID NO: 2646970 - protein, 11 aa, Entamoeba histolytica
PNFRPTSATPT

SEQ ID NO: 2646971 - protein, 7 aa, Entamoeba histolytica
PNGDKYK

SEQ ID NO: 2646972 - protein, 17 aa, Entamoeba histolytica
PNGDPLYNENGEIEEIS

SEQ ID NO: 2646973 - protein, 7 aa, Entamoeba histolytica
PNGECDR

SEQ ID NO: 2646974 - protein, 7 aa, Entamoeba histolytica
PNGEGGV

SEQ ID NO: 2646975 - protein, 7 aa, Entamoeba histolytica
PNGGKLE

SEQ ID NO: 2646976 - protein, 6 aa, Entamoeba histolytica
PNGIQP

SEQ ID NO: 2646977 - protein, 4 aa, Entamoeba histolytica
PNGK

SEQ ID NO: 2646978 - protein, 9 aa, Entamoeba histolytica
PNGKEDPMR

SEQ ID NO: 2646979 - protein, 17 aa, Entamoeba histolytica
PNGKKIQRRFNKKDKLQ

SEQ ID NO: 2646980 - protein, 4 aa, Entamoeba histolytica
PNGL

SEQ ID NO: 2646981 - protein, 11 aa, Entamoeba histolytica
PNGLHGEPAEY

SEQ ID NO: 2646982 - protein, 5 aa, Entamoeba histolytica
PNGNP

SEQ ID NO: 2646983 - protein, 8 aa, Entamoeba histolytica
PNGQQKEL

SEQ ID NO: 2646984 - protein, 6 aa, Entamoeba histolytica
PNGQSK

SEQ ID NO: 2646985 - protein, 18 aa, Entamoeba histolytica
PNGQTVQKDASKKKGKKG

SEQ ID NO: 2646986 - protein, 5 aa, Entamoeba histolytica
PNGQY

SEQ ID NO: 2646987 - protein, 8 aa, Entamoeba histolytica
PNGTKKSI

SEQ ID NO: 2646988 - protein, 4 aa, Entamoeba histolytica
PNHE

SEQ ID NO: 2646989 - protein, 6 aa, Entamoeba histolytica
PNHGPH

SEQ ID NO: 2646990 - protein, 8 aa, Entamoeba histolytica
PNHNPSTT

SEQ ID NO: 2646991 - protein, 5 aa, Entamoeba histolytica
PNHPE

SEQ ID NO: 2646992 - protein, 5 aa, Entamoeba histolytica
PNHPL

SEQ ID NO: 2646993 - protein, 17 aa, Entamoeba histolytica
PNHQRKISSSCPNSPRS

SEQ ID NO: 2646994 - protein, 4 aa, Entamoeba histolytica
PNHS

SEQ ID NO: 2646995 - protein, 8 aa, Entamoeba histolytica
PNHVNHKG

SEQ ID NO: 2646996 - protein, 4 aa, Entamoeba histolytica
PNID

SEQ ID NO: 2646997 - protein, 16 aa, Entamoeba histolytica
PNIEEDEKNDPQIRSG

SEQ ID NO: 2646998 - protein, 6 aa, Entamoeba histolytica
PNIPNH

SEQ ID NO: 2646999 - protein, 5 aa, Entamoeba histolytica
PNIQK

SEQ ID NO: 2647000 - protein, 7 aa, Entamoeba histolytica
PNIREPK

SEQ ID NO: 2647001 - protein, 4 aa, Entamoeba histolytica
PNIT

SEQ ID NO: 2647002 - protein, 6 aa, Entamoeba histolytica
PNITPS

SEQ ID NO: 2647003 - protein, 5 aa, Entamoeba histolytica
PNKAD

SEQ ID NO: 2647004 - protein, 9 aa, Entamoeba histolytica
PNKCSPTEA

SEQ ID NO: 2647005 - protein, 12 aa, Entamoeba histolytica
PNKDEIKRKTDN

SEQ ID NO: 2647006 - protein, 14 aa, Entamoeba histolytica
PNKHDLRDVNNAER

SEQ ID NO: 2647007 - protein, 7 aa, Entamoeba histolytica
PNKHEGV

SEQ ID NO: 2647008 - protein, 4 aa, Entamoeba histolytica
PNKI

SEQ ID NO: 2647009 - protein, 11 aa, Entamoeba histolytica
PNKINGSRQEL

SEQ ID NO: 2647010 - protein, 10 aa, Entamoeba histolytica
PNKKRVSSLP

SEQ ID NO: 2647011 - protein, 8 aa, Entamoeba histolytica
PNKNESFK

SEQ ID NO: 2647012 - protein, 8 aa, Entamoeba histolytica
PNKNEYKI

SEQ ID NO: 2647013 - protein, 11 aa, Entamoeba histolytica
PNKNHLNTSEE

SEQ ID NO: 2647014 - protein, 6 aa, Entamoeba histolytica
PNKQEM

SEQ ID NO: 2647015 - protein, 7 aa, Entamoeba histolytica
PNKQNSV

SEQ ID NO: 2647016 - protein, 9 aa, Entamoeba histolytica
PNKRITPRE

SEQ ID NO: 2647017 - protein, 6 aa, Entamoeba histolytica
PNKSPN

SEQ ID NO: 2647018 - protein, 4 aa, Entamoeba histolytica
PNKY

SEQ ID NO: 2647019 - protein, 5 aa, Entamoeba histolytica
PNLES

SEQ ID NO: 2647020 - protein, 5 aa, Entamoeba histolytica
PNLGE

SEQ ID NO: 2647021 - protein, 4 aa, Entamoeba histolytica
PNLQ

SEQ ID NO: 2647022 - protein, 16 aa, Entamoeba histolytica
PNLQSFPGDDPIKPTK

SEQ ID NO: 2647023 - protein, 11 aa, Entamoeba histolytica
PNLSRKAKEQF

SEQ ID NO: 2647024 - protein, 5 aa, Entamoeba histolytica
PNLSS

SEQ ID NO: 2647025 - protein, 10 aa, Entamoeba histolytica
PNLTDGTAND

SEQ ID NO: 2647026 - protein, 8 aa, Entamoeba histolytica
PNMGGKST

SEQ ID NO: 2647027 - protein, 5 aa, Entamoeba histolytica
PNNDL

SEQ ID NO: 2647028 - protein, 7 aa, Entamoeba histolytica
PNNDPRV

SEQ ID NO: 2647029 - protein, 8 aa, Entamoeba histolytica
PNNDTENV

SEQ ID NO: 2647030 - protein, 6 aa, Entamoeba histolytica
PNNESY

SEQ ID NO: 2647031 - protein, 4 aa, Entamoeba histolytica
PNNF

SEQ ID NO: 2647032 - protein, 4 aa, Entamoeba histolytica
PNNL

SEQ ID NO: 2647033 - protein, 7 aa, Entamoeba histolytica
PNNNDKL

SEQ ID NO: 2647034 - protein, 6 aa, Entamoeba histolytica
PNNPHI

SEQ ID NO: 2647035 - protein, 5 aa, Entamoeba histolytica
PNNPL

SEQ ID NO: 2647036 - protein, 7 aa, Entamoeba histolytica
PNNQEKA

SEQ ID NO: 2647037 - protein, 5 aa, Entamoeba histolytica
PNNQF

SEQ ID NO: 2647038 - protein, 19 aa, Entamoeba histolytica
PNNQNQTDYQSETNAKENE

SEQ ID NO: 2647039 - protein, 12 aa, Entamoeba histolytica
PNNSGSYSREQI

SEQ ID NO: 2647040 - protein, 10 aa, Entamoeba histolytica
PNNSNEDSFT

SEQ ID NO: 2647041 - protein, 4 aa, Entamoeba histolytica
PNNT

SEQ ID NO: 2647042 - protein, 5 aa, Entamoeba histolytica
PNNTR

SEQ ID NO: 2647043 - protein, 7 aa, Entamoeba histolytica
PNNTTEK

SEQ ID NO: 2647044 - protein, 5 aa, Entamoeba histolytica
PNNYY

SEQ ID NO: 2647045 - protein, 17 aa, Entamoeba histolytica
PNPDDPLNTEAGETMKR

SEQ ID NO: 2647046 - protein, 10 aa, Entamoeba histolytica
PNPEYKESKM

SEQ ID NO: 2647047 - protein, 4 aa, Entamoeba histolytica
PNPF

SEQ ID NO: 2647048 - protein, 5 aa, Entamoeba histolytica
PNPHI

SEQ ID NO: 2647049 - protein, 6 aa, Entamoeba histolytica
PNPKNT

SEQ ID NO: 2647050 - protein, 9 aa, Entamoeba histolytica
PNPKQPNGQ

SEQ ID NO: 2647051 - protein, 7 aa, Entamoeba histolytica
PNPLITE

SEQ ID NO: 2647052 - protein, 7 aa, Entamoeba histolytica
PNPLPEE

SEQ ID NO: 2647053 - protein, 28 aa, Entamoeba histolytica
PNPMSTQQNGQFYEQQPSAINPQQAPQQ

SEQ ID NO: 2647054 - protein, 9 aa, Entamoeba histolytica
PNPNKQLPY

SEQ ID NO: 2647055 - protein, 8 aa, Entamoeba histolytica
PNPPEHSS

SEQ ID NO: 2647056 - protein, 14 aa, Entamoeba histolytica
PNPPLKNSSKNTLY

SEQ ID NO: 2647057 - protein, 8 aa, Entamoeba histolytica
PNPPPKTH

SEQ ID NO: 2647058 - protein, 4 aa, Entamoeba histolytica
PNPQ

SEQ ID NO: 2647059 - protein, 14 aa, Entamoeba histolytica
PNPRDPDQPIPESQ

SEQ ID NO: 2647060 - protein, 13 aa, Entamoeba histolytica
PNPSQFSDEEANK

SEQ ID NO: 2647061 - protein, 13 aa, Entamoeba histolytica
PNPSTESSQKRRI

SEQ ID NO: 2647062 - protein, 20 aa, Entamoeba histolytica
PNPSTKTSQVFSGPNSSVVS

SEQ ID NO: 2647063 - protein, 9 aa, Entamoeba histolytica
PNPSTMNDG

SEQ ID NO: 2647064 - protein, 10 aa, Entamoeba histolytica
PNQARVAVPD

SEQ ID NO: 2647065 - protein, 4 aa, Entamoeba histolytica
PNQE

SEQ ID NO: 2647066 - protein, 8 aa, Entamoeba histolytica
PNQEFTDA

SEQ ID NO: 2647067 - protein, 17 aa, Entamoeba histolytica
PNQEGDAQKLERKRHVG

SEQ ID NO: 2647068 - protein, 5 aa, Entamoeba histolytica
PNQIS

SEQ ID NO: 2647069 - protein, 13 aa, Entamoeba histolytica
PNQISTEKQTVPL

SEQ ID NO: 2647070 - protein, 6 aa, Entamoeba histolytica
PNQKKD

SEQ ID NO: 2647071 - protein, 4 aa, Entamoeba histolytica
PNQL

SEQ ID NO: 2647072 - protein, 19 aa, Entamoeba histolytica
PNQNDENKIFTTSAKDCSP

SEQ ID NO: 2647073 - protein, 16 aa, Entamoeba histolytica
PNQSQQDTLPPPVNPL

SEQ ID NO: 2647074 - protein, 8 aa, Entamoeba histolytica
PNQSYPNR

SEQ ID NO: 2647075 - protein, 4 aa, Entamoeba histolytica
PNQT

SEQ ID NO: 2647076 - protein, 8 aa, Entamoeba histolytica
PNQTETTV

SEQ ID NO: 2647077 - protein, 10 aa, Entamoeba histolytica
PNQTQTDQTE

SEQ ID NO: 2647078 - protein, 15 aa, Entamoeba histolytica
PNRKEEYKILSSKFD

SEQ ID NO: 2647079 - protein, 5 aa, Entamoeba histolytica
PNRLT

SEQ ID NO: 2647080 - protein, 6 aa, Entamoeba histolytica
PNRSHY

SEQ ID NO: 2647081 - protein, 7 aa, Entamoeba histolytica
PNRTDAQ

SEQ ID NO: 2647082 - protein, 8 aa, Entamoeba histolytica
PNRTKYNL

SEQ ID NO: 2647083 - protein, 9 aa, Entamoeba histolytica
PNSFTTNNN

SEQ ID NO: 2647084 - protein, 17 aa, Entamoeba histolytica
PNSGINENPQLNHSKSK

SEQ ID NO: 2647085 - protein, 8 aa, Entamoeba histolytica
PNSIANKI

SEQ ID NO: 2647086 - protein, 15 aa, Entamoeba histolytica
PNSISQKSSLEDLSS

SEQ ID NO: 2647087 - protein, 5 aa, Entamoeba histolytica
PNSKE

SEQ ID NO: 2647088 - protein, 8 aa, Entamoeba histolytica
PNSKKAKK

SEQ ID NO: 2647089 - protein, 31 aa, Entamoeba histolytica; identical to SEQ ID NO: 2571326

SEQ ID NO: 2647090 - protein, 5 aa, Entamoeba histolytica
PNSKV

SEQ ID NO: 2647091 - protein, 7 aa, Entamoeba histolytica
PNSLEEK

SEQ ID NO: 2647092 - protein, 20 aa, Entamoeba histolytica
PNSLENDGIIGNEPNKIEDV

SEQ ID NO: 2647093 - protein, 13 aa, Entamoeba histolytica
PNSNTCTKERATK

SEQ ID NO: 2647094 - protein, 6 aa, Entamoeba histolytica
PNSNVS

SEQ ID NO: 2647095 - protein, 6 aa, Entamoeba histolytica
PNSPDV

SEQ ID NO: 2647096 - protein, 6 aa, Entamoeba histolytica
PNSPRN

SEQ ID NO: 2647097 - protein, 6 aa, Entamoeba histolytica
PNSSIS

SEQ ID NO: 2647098 - protein, 5 aa, Entamoeba histolytica
PNSSL

SEQ ID NO: 2647099 - protein, 4 aa, Entamoeba histolytica
PNST

SEQ ID NO: 2647100 - protein, 5 aa, Entamoeba histolytica
PNSTI

SEQ ID NO: 2647101 - protein, 27 aa, Entamoeba histolytica
PNSTITEYYDDGEKKQHTVHSKKLDNG

SEQ ID NO: 2647102 - protein, 8 aa, Entamoeba histolytica
PNSTNIPG

SEQ ID NO: 2647103 - protein, 5 aa, Entamoeba histolytica
PNSVT

SEQ ID NO: 2647104 - protein, 11 aa, Entamoeba histolytica
PNSYEEGVELS

SEQ ID NO: 2647105 - protein, 7 aa, Entamoeba histolytica
PNTEAPS

SEQ ID NO: 2647106 - protein, 8 aa, Entamoeba histolytica
PNTEQEAS

SEQ ID NO: 2647107 - protein, 4 aa, Entamoeba histolytica
PNTI

SEQ ID NO: 2647108 - protein, 7 aa, Entamoeba histolytica
PNTINER

SEQ ID NO: 2647109 - protein, 6 aa, Entamoeba histolytica
PNTINS

SEQ ID NO: 2647110 - protein, 31 aa, Entamoeba histolytica
PNTKPEQPIKEKHNTNRKRRSSSSSTPRNTL

SEQ ID NO: 2647111 - protein, 9 aa, Entamoeba histolytica
PNTLPSSSR

SEQ ID NO: 2647112 - protein, 4 aa, Entamoeba histolytica
PNTM

SEQ ID NO: 2647113 - protein, 4 aa, Entamoeba histolytica
PNTN

SEQ ID NO: 2647114 - protein, 5 aa, Entamoeba histolytica
PNTNR

SEQ ID NO: 2647115 - protein, 5 aa, Entamoeba histolytica
PNTPH

SEQ ID NO: 2647116 - protein, 14 aa, Entamoeba histolytica
PNTQNYSEKRKPAY

SEQ ID NO: 2647117 - protein, 8 aa, Entamoeba histolytica
PNTTINNQ

SEQ ID NO: 2647118 - protein, 8 aa, Entamoeba histolytica
PNTTLQNE

SEQ ID NO: 2647119 - protein, 5 aa, Entamoeba histolytica
PNTTT

SEQ ID NO: 2647120 - protein, 28 aa, Entamoeba histolytica
PNTVPESPIIPSPKHEQQDELTKSNPIH

SEQ ID NO: 2647121 - protein, 7 aa, Entamoeba histolytica
PNVQGET

SEQ ID NO: 2647122 - protein, 45 aa, Entamoeba histolytica
PNVQTKRVKSETKKPEKVSTNNSKKSITKTIEKKPKKLNELTDEE

SEQ ID NO: 2647123 - protein, 5 aa, Entamoeba histolytica
PNVSS

SEQ ID NO: 2647124 - protein, 15 aa, Entamoeba histolytica
PNVTQDTSTKPPLPQ

SEQ ID NO: 2647125 - protein, 8 aa, Entamoeba histolytica
PNYDSTCD

SEQ ID NO: 2647126 - protein, 32 aa, Entamoeba histolytica
PNYESDEQLSRKSTNSKSYGKTKISNNSRRSL

SEQ ID NO: 2647127 - protein, 17 aa, Entamoeba histolytica
PNYGDEKSLPDDPYDGR

SEQ ID NO: 2647128 - protein, 4 aa, Entamoeba histolytica
PNYK

SEQ ID NO: 2647129 - protein, 14 aa, Entamoeba histolytica
PNYPQPNYGYSPYG

SEQ ID NO: 2647130 - protein, 11 aa, Entamoeba histolytica
PNYSDRNKGAG

SEQ ID NO: 2647131 - protein, 12 aa, Entamoeba histolytica
PNYYGYDGKEQI

SEQ ID NO: 2647132 - protein, 5 aa, Entamoeba histolytica
PPAAF

SEQ ID NO: 2647133 - protein, 5 aa, Entamoeba histolytica
PPALT

SEQ ID NO: 2647134 - protein, 11 aa, Entamoeba histolytica
PPASYFGPKGL

SEQ ID NO: 2647135 - protein, 20 aa, Entamoeba histolytica
PPCGKSKSAHFASASKEKAI

SEQ ID NO: 2647136 - protein, 7 aa, Entamoeba histolytica
PPDEQPL

SEQ ID NO: 2647137 - protein, 4 aa, Entamoeba histolytica
PPDG

SEQ ID NO: 2647138 - protein, 10 aa, Entamoeba histolytica
PPDKVKIDNK

SEQ ID NO: 2647139 - protein, 16 aa, Entamoeba histolytica
PPDPNNYKQNAQGVDS

SEQ ID NO: 2647140 - protein, 5 aa, Entamoeba histolytica
PPDQH

SEQ ID NO: 2647141 - protein, 9 aa, Entamoeba histolytica
PPDQQQQKD

SEQ ID NO: 2647142 - protein, 9 aa, Entamoeba histolytica
PPDTDPTKY

SEQ ID NO: 2647143 - protein, 5 aa, Entamoeba histolytica
PPDTI

SEQ ID NO: 2647144 - protein, 7 aa, Entamoeba histolytica
PPDTYYE

SEQ ID NO: 2647145 - protein, 6 aa, Entamoeba histolytica
PPEADS

SEQ ID NO: 2647146 - protein, 112 aa, Entamoeba histolytica
PPEEDEWKQVDKSGKIRPVKDKKGESKKQRKKKEEEEKKKRKEEEERKRKEEEERIKREEEERKRQEEEERIKREEEEKARKEEEEEKARKEEEEEKARKEEEERKRKEEEI

SEQ ID NO: 2647147 - protein, 10 aa, Entamoeba histolytica
PPEEPNTIDS

SEQ ID NO: 2647148 - protein, 21 aa, Entamoeba histolytica
PPEESDDGSGLDNKGNVGTKG

SEQ ID NO: 2647149 - protein, 6 aa, Entamoeba histolytica
PPEFPE

SEQ ID NO: 2647150 - protein, 4 aa, Entamoeba histolytica
PPEI

SEQ ID NO: 2647151 - protein, 4 aa, Entamoeba histolytica
PPEN

SEQ ID NO: 2647152 - protein, 9 aa, Entamoeba histolytica
PPENTPNAS

SEQ ID NO: 2647153 - protein, 13 aa, Entamoeba histolytica
PPEPIIQPPPQQY

SEQ ID NO: 2647154 - protein, 4 aa, Entamoeba histolytica
PPEQ

SEQ ID NO: 2647155 - protein, 16 aa, Entamoeba histolytica
PPEQFEKENNCKLQEN

SEQ ID NO: 2647156 - protein, 5 aa, Entamoeba histolytica
PPEQS

SEQ ID NO: 2647157 - protein, 4 aa, Entamoeba histolytica
PPFI

SEQ ID NO: 2647158 - protein, 11 aa, Entamoeba histolytica
PPFKGHSVSSI

SEQ ID NO: 2647159 - protein, 13 aa, Entamoeba histolytica
PPFKKKGNINLET

SEQ ID NO: 2647160 - protein, 7 aa, Entamoeba histolytica
PPFKNEE

SEQ ID NO: 2647161 - protein, 4 aa, Entamoeba histolytica
PPFP

SEQ ID NO: 2647162 - protein, 8 aa, Entamoeba histolytica
PPFQAATE

SEQ ID NO: 2647163 - protein, 4 aa, Entamoeba histolytica
PPFV

SEQ ID NO: 2647164 - protein, 7 aa, Entamoeba histolytica
PPGDSVT

SEQ ID NO: 2647165 - protein, 16 aa, Entamoeba histolytica
PPGEDEFGYESAAERW

SEQ ID NO: 2647166 - protein, 11 aa, Entamoeba histolytica
PPGEDEMSGEL

SEQ ID NO: 2647167 - protein, 5 aa, Entamoeba histolytica
PPGFP

SEQ ID NO: 2647168 - protein, 5 aa, Entamoeba histolytica
PPGIP

SEQ ID NO: 2647169 - protein, 6 aa, Entamoeba histolytica
PPGLGS

SEQ ID NO: 2647170 - protein, 6 aa, Entamoeba histolytica
PPGQIP

SEQ ID NO: 2647171 - protein, 9 aa, Entamoeba histolytica
PPGSGKTTS

SEQ ID NO: 2647172 - protein, 7 aa, Entamoeba histolytica
PPGTGKT

SEQ ID NO: 2647173 - protein, 10 aa, Entamoeba histolytica
PPGTGKTTTA

SEQ ID NO: 2647174 - protein, 7 aa, Entamoeba histolytica
PPGTYFT

SEQ ID NO: 2647175 - protein, 12 aa, Entamoeba histolytica
PPHCRKTHSQTA

SEQ ID NO: 2647176 - protein, 5 aa, Entamoeba histolytica
PPHGF

SEQ ID NO: 2647177 - protein, 4 aa, Entamoeba histolytica
PPHP

SEQ ID NO: 2647178 - protein, 8 aa, Entamoeba histolytica
PPHSPGPV

SEQ ID NO: 2647179 - protein, 4 aa, Entamoeba histolytica
PPIC

SEQ ID NO: 2647180 - protein, 4 aa, Entamoeba histolytica
PPID

SEQ ID NO: 2647181 - protein, 6 aa, Entamoeba histolytica
PPIDPQ

SEQ ID NO: 2647182 - protein, 10 aa, Entamoeba histolytica
PPIEPPNDAQ

SEQ ID NO: 2647183 - protein, 5 aa, Entamoeba histolytica
PPIGP

SEQ ID NO: 2647184 - protein, 4 aa, Entamoeba histolytica
PPII

SEQ ID NO: 2647185 - protein, 4 aa, Entamoeba histolytica
PPIK

SEQ ID NO: 2647186 - protein, 12 aa, Entamoeba histolytica
PPIPQKKNETKL

SEQ ID NO: 2647187 - protein, 5 aa, Entamoeba histolytica
PPIQT

SEQ ID NO: 2647188 - protein, 4 aa, Entamoeba histolytica
PPIR

SEQ ID NO: 2647189 - protein, 9 aa, Entamoeba histolytica
PPKDTNVPG

SEQ ID NO: 2647190 - protein, 12 aa, Entamoeba histolytica
PPKEGDESYPKY

SEQ ID NO: 2647191 - protein, 27 aa, Entamoeba histolytica
PPKEIKEEEKPIEQEEDDSKKIKPKEK

SEQ ID NO: 2647192 - protein, 10 aa, Entamoeba histolytica
PPKENLGNNN

SEQ ID NO: 2647193 - protein, 8 aa, Entamoeba histolytica
PPKGDEAL

SEQ ID NO: 2647194 - protein, 5 aa, Entamoeba histolytica
PPKGL

SEQ ID NO: 2647195 - protein, 4 aa, Entamoeba histolytica
PPKI

SEQ ID NO: 2647196 - protein, 7 aa, Entamoeba histolytica
PPKKPME

SEQ ID NO: 2647197 - protein, 28 aa, Entamoeba histolytica
PPKLPKRKNELPKRKKQYKTKDTSKPYK

SEQ ID NO: 2647198 - protein, 8 aa, Entamoeba histolytica
PPKPINTS

SEQ ID NO: 2647199 - protein, 10 aa, Entamoeba histolytica
PPKQCNYDES

SEQ ID NO: 2647200 - protein, 4 aa, Entamoeba histolytica
PPKR

SEQ ID NO: 2647201 - protein, 22 aa, Entamoeba histolytica
PPKRGKKTSVFTTRSPHRPNNI

SEQ ID NO: 2647202 - protein, 7 aa, Entamoeba histolytica
PPKTNMD

SEQ ID NO: 2647203 - protein, 5 aa, Entamoeba histolytica
PPKTT

SEQ ID NO: 2647204 - protein, 8 aa, Entamoeba histolytica
PPKYPKDS

SEQ ID NO: 2647205 - protein, 36 aa, Entamoeba histolytica
PPLEEKEKLSKGKKSLETHSEPSLNSSKEPEPKRKQ

SEQ ID NO: 2647206 - protein, 6 aa, Entamoeba histolytica
PPLPDN

SEQ ID NO: 2647207 - protein, 8 aa, Entamoeba histolytica
PPLPQDSP

SEQ ID NO: 2647208 - protein, 7 aa, Entamoeba histolytica
PPLPQQK

SEQ ID NO: 2647209 - protein, 13 aa, Entamoeba histolytica
PPLQSSNSFDNQL

SEQ ID NO: 2647210 - protein, 14 aa, Entamoeba histolytica
PPLSASQPRPPEDD

SEQ ID NO: 2647211 - protein, 13 aa, Entamoeba histolytica
PPLSHKGDGEKRR

SEQ ID NO: 2647212 - protein, 10 aa, Entamoeba histolytica
PPLTEEQERK

SEQ ID NO: 2647213 - protein, 11 aa, Entamoeba histolytica
PPMKTEESRQA

SEQ ID NO: 2647214 - protein, 10 aa, Entamoeba histolytica
PPMNPPENRE

SEQ ID NO: 2647215 - protein, 13 aa, Entamoeba histolytica
PPMNPQQNKKKMG

SEQ ID NO: 2647216 - protein, 6 aa, Entamoeba histolytica
PPMPKD

SEQ ID NO: 2647217 - protein, 6 aa, Entamoeba histolytica
PPNIPN

SEQ ID NO: 2647218 - protein, 6 aa, Entamoeba histolytica
PPNNDT

SEQ ID NO: 2647219 - protein, 4 aa, Entamoeba histolytica
PPNP

SEQ ID NO: 2647220 - protein, 5 aa, Entamoeba histolytica
PPNQR

SEQ ID NO: 2647221 - protein, 4 aa, Entamoeba histolytica
PPNS

SEQ ID NO: 2647222 - protein, 6 aa, Entamoeba histolytica
PPNVTG

SEQ ID NO: 2647223 - protein, 15 aa, Entamoeba histolytica
PPPAKPFINYTNPFL

SEQ ID NO: 2647224 - protein, 5 aa, Entamoeba histolytica
PPPEF

SEQ ID NO: 2647225 - protein, 4 aa, Entamoeba histolytica
PPPF

SEQ ID NO: 2647226 - protein, 5 aa, Entamoeba histolytica
PPPFE

SEQ ID NO: 2647227 - protein, 20 aa, Entamoeba histolytica
PPPISSSTSVSQSTSLNTST

SEQ ID NO: 2647228 - protein, 12 aa, Entamoeba histolytica
PPPKEESDDGGY

SEQ ID NO: 2647229 - protein, 6 aa, Entamoeba histolytica
PPPLKK

SEQ ID NO: 2647230 - protein, 4 aa, Entamoeba histolytica
PPPM

SEQ ID NO: 2647231 - protein, 25 aa, Entamoeba histolytica
PPPPPPPAPDKSTQQINNPHEDKKT

SEQ ID NO: 2647232 - protein, 28 aa, Entamoeba histolytica
PPPPPRKKSGFSSIKPTEKNTKHRSSGF

SEQ ID NO: 2647233 - protein, 7 aa, Entamoeba histolytica
PPPRKSC

SEQ ID NO: 2647234 - protein, 7 aa, Entamoeba histolytica
PPPRQTI

SEQ ID NO: 2647235 - protein, 40 aa, Entamoeba histolytica
PPPSQRGSTQTIHRSSVENKTISSQTNSTFKTPTKSDDFN

SEQ ID NO: 2647236 - protein, 11 aa, Entamoeba histolytica
PPPSVDSKYEY

SEQ ID NO: 2647237 - protein, 11 aa, Entamoeba histolytica
PPQFTTTSNNP

SEQ ID NO: 2647238 - protein, 10 aa, Entamoeba histolytica
PPQKGTVASE

SEQ ID NO: 2647239 - protein, 7 aa, Entamoeba histolytica
PPQKVED

SEQ ID NO: 2647240 - protein, 6 aa, Entamoeba histolytica
PPQNKY

SEQ ID NO: 2647241 - protein, 5 aa, Entamoeba histolytica
PPQPG

SEQ ID NO: 2647242 - protein, 31 aa, Entamoeba histolytica
PPQQLPNTSKQELTKPINETTQSDEKDLTLE

SEQ ID NO: 2647243 - protein, 4 aa, Entamoeba histolytica
PPQR

SEQ ID NO: 2647244 - protein, 5 aa, Entamoeba histolytica
PPQSK

SEQ ID NO: 2647245 - protein, 6 aa, Entamoeba histolytica
PPQSPQ

SEQ ID NO: 2647246 - protein, 7 aa, Entamoeba histolytica
PPRAAQK

SEQ ID NO: 2647247 - protein, 7 aa, Entamoeba histolytica
PPRAPQL

SEQ ID NO: 2647248 - protein, 7 aa, Entamoeba histolytica
PPRDSNP

SEQ ID NO: 2647249 - protein, 60 aa, Entamoeba histolytica
PPRNSTRSKHSSSTIISSSKVKDIDESHSQSPHNVKSSPSDKSDNDKIVSQKSPKEVKTR

SEQ ID NO: 2647250 - protein, 10 aa, Entamoeba histolytica
PPRQHLSDEE

SEQ ID NO: 2647251 - protein, 6 aa, Entamoeba histolytica
PPRSKS

SEQ ID NO: 2647252 - protein, 8 aa, Entamoeba histolytica
PPRSKSCL

SEQ ID NO: 2647253 - protein, 95 aa, Entamoeba histolytica
PPRSSTLSSRPINPAPLPPKPYHLPPKPDSPRSPRSKISSTHISQQQPVDNPRPTTAPPVPQKPKAKPPPPKTNVLSSSKSSDCSQPSSTTISSS

SEQ ID NO: 2647254 - protein, 8 aa, Entamoeba histolytica
PPRTGIHP

SEQ ID NO: 2647255 - protein, 5 aa, Entamoeba histolytica
PPSDY

SEQ ID NO: 2647256 - protein, 6 aa, Entamoeba histolytica
PPSFEN

SEQ ID NO: 2647257 - protein, 8 aa, Entamoeba histolytica
PPSGPDAW

SEQ ID NO: 2647258 - protein, 6 aa, Entamoeba histolytica
PPSGYS

SEQ ID NO: 2647259 - protein, 5 aa, Entamoeba histolytica
PPSIS

SEQ ID NO: 2647260 - protein, 27 aa, Entamoeba histolytica
PPSKYPQSPSQQRKQPTQMSPSSASPL

SEQ ID NO: 2647261 - protein, 4 aa, Entamoeba histolytica
PPSL

SEQ ID NO: 2647262 - protein, 6 aa, Entamoeba histolytica
PPSLNK

SEQ ID NO: 2647263 - protein, 7 aa, Entamoeba histolytica
PPSNVPK

SEQ ID NO: 2647264 - protein, 4 aa, Entamoeba histolytica
PPSR

SEQ ID NO: 2647265 - protein, 7 aa, Entamoeba histolytica
PPSTGPI

SEQ ID NO: 2647266 - protein, 4 aa, Entamoeba histolytica
PPSV

SEQ ID NO: 2647267 - protein, 4 aa, Entamoeba histolytica
PPSY

SEQ ID NO: 2647268 - protein, 5 aa, Entamoeba histolytica
PPSYN

SEQ ID NO: 2647269 - protein, 20 aa, Entamoeba histolytica
PPSYVEPPQSAAAITTETIT

SEQ ID NO: 2647270 - protein, 10 aa, Entamoeba histolytica
PPTEDPTHYE

SEQ ID NO: 2647271 - protein, 5 aa, Entamoeba histolytica
PPTGL

SEQ ID NO: 2647272 - protein, 4 aa, Entamoeba histolytica
PPTH

SEQ ID NO: 2647273 - protein, 4 aa, Entamoeba histolytica
PPTI

SEQ ID NO: 2647274 - protein, 6 aa, Entamoeba histolytica
PPTKAS

SEQ ID NO: 2647275 - protein, 9 aa, Entamoeba histolytica
PPTKSSDIV

SEQ ID NO: 2647276 - protein, 11 aa, Entamoeba histolytica
PPTLPEDWKTN

SEQ ID NO: 2647277 - protein, 20 aa, Entamoeba histolytica
PPTPQQPQFPNTSQPQFTDQ

SEQ ID NO: 2647278 - protein, 4 aa, Entamoeba histolytica
PPTR

SEQ ID NO: 2647279 - protein, 4 aa, Entamoeba histolytica
PPTS

SEQ ID NO: 2647280 - protein, 4 aa, Entamoeba histolytica
PPTT

SEQ ID NO: 2647281 - protein, 7 aa, Entamoeba histolytica
PPTTADV

SEQ ID NO: 2647282 - protein, 5 aa, Entamoeba histolytica
PPTTL

SEQ ID NO: 2647283 - protein, 6 aa, Entamoeba histolytica
PPTTNT

SEQ ID NO: 2647284 - protein, 7 aa, Entamoeba histolytica
PPTTPKL

SEQ ID NO: 2647285 - protein, 6 aa, Entamoeba histolytica
PPTTVT

SEQ ID NO: 2647286 - protein, 29 aa, Entamoeba histolytica
PPVPASSGVPTLPTIPQPTLPNQTRTQPV

SEQ ID NO: 2647287 - protein, 7 aa, Entamoeba histolytica
PPVRKNA

SEQ ID NO: 2647288 - protein, 5 aa, Entamoeba histolytica
PPVSP

SEQ ID NO: 2647289 - protein, 11 aa, Entamoeba histolytica
PPVTPGESLTD

SEQ ID NO: 2647290 - protein, 5 aa, Entamoeba histolytica
PPWGE

SEQ ID NO: 2647291 - protein, 10 aa, Entamoeba histolytica
PPYDGPNKRH

SEQ ID NO: 2647292 - protein, 15 aa, Entamoeba histolytica
PPYDPSPMRRPRRSP

SEQ ID NO: 2647293 - protein, 8 aa, Entamoeba histolytica
PPYKNKEI

SEQ ID NO: 2647294 - protein, 15 aa, Entamoeba histolytica
PPYKQQTQDINTNEI

SEQ ID NO: 2647295 - protein, 7 aa, Entamoeba histolytica
PPYMDDP

SEQ ID NO: 2647296 - protein, 12 aa, Entamoeba histolytica
PPYPAVTPTAAV

SEQ ID NO: 2647297 - protein, 12 aa, Entamoeba histolytica
PPYQLTNEEKKV

SEQ ID NO: 2647298 - protein, 7 aa, Entamoeba histolytica
PPYSQEM

SEQ ID NO: 2647299 - protein, 6 aa, Entamoeba histolytica
PPYYPQ

SEQ ID NO: 2647300 - protein, 8 aa, Entamoeba histolytica
PQADPKAC

SEQ ID NO: 2647301 - protein, 12 aa, Entamoeba histolytica
PQALTEDSGDID

SEQ ID NO: 2647302 - protein, 6 aa, Entamoeba histolytica
PQASEE

SEQ ID NO: 2647303 - protein, 5 aa, Entamoeba histolytica
PQDPI

SEQ ID NO: 2647304 - protein, 10 aa, Entamoeba histolytica
PQDTNDNKEL

SEQ ID NO: 2647305 - protein, 10 aa, Entamoeba histolytica
PQEADQETET

SEQ ID NO: 2647306 - protein, 21 aa, Entamoeba histolytica
PQEAIKRQNGVFSEKVCVFEK

SEQ ID NO: 2647307 - protein, 9 aa, Entamoeba histolytica
PQEEDRDNK

SEQ ID NO: 2647308 - protein, 12 aa, Entamoeba histolytica
PQEEEKKRKEEK

SEQ ID NO: 2647309 - protein, 4 aa, Entamoeba histolytica
PQEI

SEQ ID NO: 2647310 - protein, 5 aa, Entamoeba histolytica
PQELH

SEQ ID NO: 2647311 - protein, 5 aa, Entamoeba histolytica
PQENE

SEQ ID NO: 2647312 - protein, 8 aa, Entamoeba histolytica
PQERATAA

SEQ ID NO: 2647313 - protein, 9 aa, Entamoeba histolytica
PQERQGEEL

SEQ ID NO: 2647314 - protein, 6 aa, Entamoeba histolytica
PQESIK

SEQ ID NO: 2647315 - protein, 16 aa, Entamoeba histolytica
PQETQNQIQQQNLSSH

SEQ ID NO: 2647316 - protein, 4 aa, Entamoeba histolytica
PQEY

SEQ ID NO: 2647317 - protein, 7 aa, Entamoeba histolytica
PQEYPFD

SEQ ID NO: 2647318 - protein, 4 aa, Entamoeba histolytica
PQFN

SEQ ID NO: 2647319 - protein, 16 aa, Entamoeba histolytica
PQGCEESEMPAAANTE

SEQ ID NO: 2647320 - protein, 8 aa, Entamoeba histolytica
PQGENSGK

SEQ ID NO: 2647321 - protein, 10 aa, Entamoeba histolytica
PQGETPLTNP

SEQ ID NO: 2647322 - protein, 5 aa, Entamoeba histolytica
PQGGD

SEQ ID NO: 2647323 - protein, 5 aa, Entamoeba histolytica
PQGKG

SEQ ID NO: 2647324 - protein, 4 aa, Entamoeba histolytica
PQGV

SEQ ID NO: 2647325 - protein, 5 aa, Entamoeba histolytica
PQHDE

SEQ ID NO: 2647326 - protein, 6 aa, Entamoeba histolytica
PQHDFN

SEQ ID NO: 2647327 - protein, 5 aa, Entamoeba histolytica
PQHRQ

SEQ ID NO: 2647328 - protein, 10 aa, Entamoeba histolytica
PQIEDAGEKI

SEQ ID NO: 2647329 - protein, 5 aa, Entamoeba histolytica
PQIEE

SEQ ID NO: 2647330 - protein, 5 aa, Entamoeba histolytica
PQIGR

SEQ ID NO: 2647331 - protein, 8 aa, Entamoeba histolytica
PQIKYGEH

SEQ ID NO: 2647332 - protein, 7 aa, Entamoeba histolytica
PQINHET

SEQ ID NO: 2647333 - protein, 6 aa, Entamoeba histolytica
PQIPDS

SEQ ID NO: 2647334 - protein, 6 aa, Entamoeba histolytica
PQIPQT

SEQ ID NO: 2647335 - protein, 7 aa, Entamoeba histolytica
PQIPTQP

SEQ ID NO: 2647336 - protein, 6 aa, Entamoeba histolytica
PQIQSS

SEQ ID NO: 2647337 - protein, 4 aa, Entamoeba histolytica
PQIR

SEQ ID NO: 2647338 - protein, 8 aa, Entamoeba histolytica
PQISEDTD

SEQ ID NO: 2647339 - protein, 32 aa, Entamoeba histolytica
PQISPRKCNQGIDKKKPESLPNEDTQKPQQSI

SEQ ID NO: 2647340 - protein, 5 aa, Entamoeba histolytica
PQITE

SEQ ID NO: 2647341 - protein, 5 aa, Entamoeba histolytica
PQITT

SEQ ID NO: 2647342 - protein, 7 aa, Entamoeba histolytica
PQKDEEY

SEQ ID NO: 2647343 - protein, 8 aa, Entamoeba histolytica
PQKDENGL

SEQ ID NO: 2647344 - protein, 5 aa, Entamoeba histolytica
PQKEE

SEQ ID NO: 2647345 - protein, 8 aa, Entamoeba histolytica
PQKENETE

SEQ ID NO: 2647346 - protein, 5 aa, Entamoeba histolytica
PQKEV

SEQ ID NO: 2647347 - protein, 9 aa, Entamoeba histolytica
PQKKTQSKV

SEQ ID NO: 2647348 - protein, 4 aa, Entamoeba histolytica
PQKM

SEQ ID NO: 2647349 - protein, 15 aa, Entamoeba histolytica
PQKMKDTDVTNPIPI

SEQ ID NO: 2647350 - protein, 4 aa, Entamoeba histolytica
PQKP

SEQ ID NO: 2647351 - protein, 7 aa, Entamoeba histolytica
PQKPKNA

SEQ ID NO: 2647352 - protein, 13 aa, Entamoeba histolytica
PQKQEKKKRERTL

SEQ ID NO: 2647353 - protein, 5 aa, Entamoeba histolytica
PQKQQ

SEQ ID NO: 2647354 - protein, 4 aa, Entamoeba histolytica
PQKR

SEQ ID NO: 2647355 - protein, 7 aa, Entamoeba histolytica
PQKRPTF

SEQ ID NO: 2647356 - protein, 11 aa, Entamoeba histolytica
PQKRTQQTAID

SEQ ID NO: 2647357 - protein, 4 aa, Entamoeba histolytica
PQLM

SEQ ID NO: 2647358 - protein, 8 aa, Entamoeba histolytica
PQLNEEAK

SEQ ID NO: 2647359 - protein, 14 aa, Entamoeba histolytica
PQLPPQEGESGTDM

SEQ ID NO: 2647360 - protein, 13 aa, Entamoeba histolytica
PQLPSRKDGYPLR

SEQ ID NO: 2647361 - protein, 4 aa, Entamoeba histolytica
PQLQ

SEQ ID NO: 2647362 - protein, 4 aa, Entamoeba histolytica
PQLS

SEQ ID NO: 2647363 - protein, 13 aa, Entamoeba histolytica
PQLSNQPIKTLNL

SEQ ID NO: 2647364 - protein, 11 aa, Entamoeba histolytica
PQLTKSTDQME

SEQ ID NO: 2647365 - protein, 7 aa, Entamoeba histolytica
PQLTPTS

SEQ ID NO: 2647366 - protein, 6 aa, Entamoeba histolytica
PQLYTE

SEQ ID NO: 2647367 - protein, 4 aa, Entamoeba histolytica
PQMT

SEQ ID NO: 2647368 - protein, 11 aa, Entamoeba histolytica
PQNASYSQQTK

SEQ ID NO: 2647369 - protein, 5 aa, Entamoeba histolytica
PQNDQ

SEQ ID NO: 2647370 - protein, 5 aa, Entamoeba histolytica
PQNEE

SEQ ID NO: 2647371 - protein, 7 aa, Entamoeba histolytica
PQNEREV

SEQ ID NO: 2647372 - protein, 9 aa, Entamoeba histolytica
PQNGTGVSV

SEQ ID NO: 2647373 - protein, 10 aa, Entamoeba histolytica
PQNGYTKQDL

SEQ ID NO: 2647374 - protein, 6 aa, Entamoeba histolytica
PQNLKS

SEQ ID NO: 2647375 - protein, 4 aa, Entamoeba histolytica
PQNN

SEQ ID NO: 2647376 - protein, 6 aa, Entamoeba histolytica
PQNNNM

SEQ ID NO: 2647377 - protein, 13 aa, Entamoeba histolytica
PQNPFSDPETTTL

SEQ ID NO: 2647378 - protein, 7 aa, Entamoeba histolytica
PQNPIKD

SEQ ID NO: 2647379 - protein, 8 aa, Entamoeba histolytica
PQNPTGRV

SEQ ID NO: 2647380 - protein, 8 aa, Entamoeba histolytica
PQNPTQSQ

SEQ ID NO: 2647381 - protein, 12 aa, Entamoeba histolytica
PQNSVKEELKSK

SEQ ID NO: 2647382 - protein, 5 aa, Entamoeba histolytica
PQNTN

SEQ ID NO: 2647383 - protein, 5 aa, Entamoeba histolytica
PQNVD

SEQ ID NO: 2647384 - protein, 8 aa, Entamoeba histolytica
PQNVSKQR

SEQ ID NO: 2647385 - protein, 49 aa, Entamoeba histolytica
PQPIKKPYSKSIKEEDSQSKTGSVGSGGRKKKKENKKIMESPQKPSLID

SEQ ID NO: 2647386 - protein, 15 aa, Entamoeba histolytica
PQPKNLQAATTLETM

SEQ ID NO: 2647387 - protein, 15 aa, Entamoeba histolytica
PQPKPRKEGITPEEE

SEQ ID NO: 2647388 - protein, 15 aa, Entamoeba histolytica
PQPQPNGTNPTDSAD

SEQ ID NO: 2647389 - protein, 15 aa, Entamoeba histolytica
PQPRRPNKAAPVPKK

SEQ ID NO: 2647390 - protein, 11 aa, Entamoeba histolytica
PQPRSEETQEM

SEQ ID NO: 2647391 - protein, 9 aa, Entamoeba histolytica
PQPSATRNT

SEQ ID NO: 2647392 - protein, 6 aa, Entamoeba histolytica
PQPSET

SEQ ID NO: 2647393 - protein, 8 aa, Entamoeba histolytica
PQPSNEEM

SEQ ID NO: 2647394 - protein, 8 aa, Entamoeba histolytica
PQPSNTSL

SEQ ID NO: 2647395 - protein, 4 aa, Entamoeba histolytica
PQQF

SEQ ID NO: 2647396 - protein, 14 aa, Entamoeba histolytica
PQQIPEETTKADQY

SEQ ID NO: 2647397 - protein, 7 aa, Entamoeba histolytica
PQQIRET

SEQ ID NO: 2647398 - protein, 11 aa, Entamoeba histolytica
PQQKISEQISQ

SEQ ID NO: 2647399 - protein, 6 aa, Entamoeba histolytica
PQQLPA

SEQ ID NO: 2647400 - protein, 7 aa, Entamoeba histolytica
PQQNNGV

SEQ ID NO: 2647401 - protein, 7 aa, Entamoeba histolytica
PQQPSNW

SEQ ID NO: 2647402 - protein, 8 aa, Entamoeba histolytica
PQQPYYQQ

SEQ ID NO: 2647403 - protein, 9 aa, Entamoeba histolytica
PQQQTQQND

SEQ ID NO: 2647404 - protein, 10 aa, Entamoeba histolytica
PQQRTEEERK

SEQ ID NO: 2647405 - protein, 4 aa, Entamoeba histolytica
PQQT

SEQ ID NO: 2647406 - protein, 9 aa, Entamoeba histolytica
PQQTISKQF

SEQ ID NO: 2647407 - protein, 10 aa, Entamoeba histolytica
PQQTQKQQSS

SEQ ID NO: 2647408 - protein, 13 aa, Entamoeba histolytica
PQQVQDIKKESTI

SEQ ID NO: 2647409 - protein, 7 aa, Entamoeba histolytica
PQQYDGR

SEQ ID NO: 2647410 - protein, 12 aa, Entamoeba histolytica
PQRDYSSIGKYY

SEQ ID NO: 2647411 - protein, 20 aa, Entamoeba histolytica
PQRKQEVLPKNEPKSDEELS

SEQ ID NO: 2647412 - protein, 4 aa, Entamoeba histolytica
PQRL

SEQ ID NO: 2647413 - protein, 5 aa, Entamoeba histolytica
PQRPL

SEQ ID NO: 2647414 - protein, 5 aa, Entamoeba histolytica
PQRTS

SEQ ID NO: 2647415 - protein, 4 aa, Entamoeba histolytica
PQRV

SEQ ID NO: 2647416 - protein, 10 aa, Entamoeba histolytica
PQSAPKGNSL

SEQ ID NO: 2647417 - protein, 6 aa, Entamoeba histolytica
PQSAPV

SEQ ID NO: 2647418 - protein, 17 aa, Entamoeba histolytica
PQSDKKTGNENEEKRRM

SEQ ID NO: 2647419 - protein, 6 aa, Entamoeba histolytica
PQSFSQ

SEQ ID NO: 2647420 - protein, 7 aa, Entamoeba histolytica
PQSGEVL

SEQ ID NO: 2647421 - protein, 7 aa, Entamoeba histolytica
PQSKTEA

SEQ ID NO: 2647422 - protein, 7 aa, Entamoeba histolytica
PQSPLPH

SEQ ID NO: 2647423 - protein, 7 aa, Entamoeba histolytica
PQSPLSL

SEQ ID NO: 2647424 - protein, 25 aa, Entamoeba histolytica
PQSPNNNIYSSKGFETPSTMTYQQD

SEQ ID NO: 2647425 - protein, 4 aa, Entamoeba histolytica
PQSQ

SEQ ID NO: 2647426 - protein, 37 aa, Entamoeba histolytica
PQSQQEKNDEKPRRRGRNRERRRRDNAREYNQERTPI

SEQ ID NO: 2647427 - protein, 28 aa, Entamoeba histolytica
PQSRKDAEVKSHQPEDLPYKEENDLKIP

SEQ ID NO: 2647428 - protein, 10 aa, Entamoeba histolytica
PQSTPRMTGE

SEQ ID NO: 2647429 - protein, 4 aa, Entamoeba histolytica
PQSV

SEQ ID NO: 2647430 - protein, 7 aa, Entamoeba histolytica
PQTDNLK

SEQ ID NO: 2647431 - protein, 7 aa, Entamoeba histolytica
PQTEEAR

SEQ ID NO: 2647432 - protein, 15 aa, Entamoeba histolytica
PQTEQQNDKDNATEL

SEQ ID NO: 2647433 - protein, 4 aa, Entamoeba histolytica
PQTG

SEQ ID NO: 2647434 - protein, 8 aa, Entamoeba histolytica
PQTHEPEK

SEQ ID NO: 2647435 - protein, 7 aa, Entamoeba histolytica
PQTHKGF

SEQ ID NO: 2647436 - protein, 22 aa, Entamoeba histolytica
PQTIMTKSERRQEKKEEEEGER

SEQ ID NO: 2647437 - protein, 6 aa, Entamoeba histolytica
PQTNEC

SEQ ID NO: 2647438 - protein, 10 aa, Entamoeba histolytica
PQTNNDSTER

SEQ ID NO: 2647439 - protein, 5 aa, Entamoeba histolytica
PQTNV

SEQ ID NO: 2647440 - protein, 7 aa, Entamoeba histolytica
PQTPQDT

SEQ ID NO: 2647441 - protein, 13 aa, Entamoeba histolytica
PQTSTTDNKTDID

SEQ ID NO: 2647442 - protein, 21 aa, Entamoeba histolytica
PQTTEPKRSNSTKPKSPVHQQ

SEQ ID NO: 2647443 - protein, 12 aa, Entamoeba histolytica
PQTTESSPIPDL

SEQ ID NO: 2647444 - protein, 14 aa, Entamoeba histolytica
PQTTIQEETGMNVP

SEQ ID NO: 2647445 - protein, 6 aa, Entamoeba histolytica
PQTTPS

SEQ ID NO: 2647446 - protein, 6 aa, Entamoeba histolytica
PQTVPL

SEQ ID NO: 2647447 - protein, 7 aa, Entamoeba histolytica
PQVDDPE

SEQ ID NO: 2647448 - protein, 8 aa, Entamoeba histolytica
PQVNSNNR

SEQ ID NO: 2647449 - protein, 8 aa, Entamoeba histolytica
PQVQQPQN

SEQ ID NO: 2647450 - protein, 5 aa, Entamoeba histolytica
PQVQS

SEQ ID NO: 2647451 - protein, 4 aa, Entamoeba histolytica
PQVR

SEQ ID NO: 2647452 - protein, 12 aa, Entamoeba histolytica
PQVTSTISSSMN

SEQ ID NO: 2647453 - protein, 5 aa, Entamoeba histolytica
PQWAN

SEQ ID NO: 2647454 - protein, 5 aa, Entamoeba histolytica
PQWEK

SEQ ID NO: 2647455 - protein, 9 aa, Entamoeba histolytica
PQWTEEENQ

SEQ ID NO: 2647456 - protein, 7 aa, Entamoeba histolytica
PQYGDPN

SEQ ID NO: 2647457 - protein, 18 aa, Entamoeba histolytica
PQYGKGEFARIDDKSGQV

SEQ ID NO: 2647458 - protein, 4 aa, Entamoeba histolytica
PQYK

SEQ ID NO: 2647459 - protein, 6 aa, Entamoeba histolytica
PQYKPL

SEQ ID NO: 2647460 - protein, 16 aa, Entamoeba histolytica
PQYQNTQYNYSNSTIP

SEQ ID NO: 2647461 - protein, 16 aa, Entamoeba histolytica
PQYSRKTSVSRTSGLT

SEQ ID NO: 2647462 - protein, 4 aa, Entamoeba histolytica
PRAI

SEQ ID NO: 2647463 - protein, 4 aa, Entamoeba histolytica
PRCT

SEQ ID NO: 2647464 - protein, 19 aa, Entamoeba histolytica
PRDDENEELKKFNEESKAA

SEQ ID NO: 2647465 - protein, 7 aa, Entamoeba histolytica
PRDENNI

SEQ ID NO: 2647466 - protein, 4 aa, Entamoeba histolytica
PRDG

SEQ ID NO: 2647467 - protein, 6 aa, Entamoeba histolytica
PRDGST

SEQ ID NO: 2647468 - protein, 7 aa, Entamoeba histolytica
PRDGVNA

SEQ ID NO: 2647469 - protein, 7 aa, Entamoeba histolytica
PRDIQQI

SEQ ID NO: 2647470 - protein, 5 aa, Entamoeba histolytica
PRDNQ

SEQ ID NO: 2647471 - protein, 9 aa, Entamoeba histolytica
PRDTTNPNS

SEQ ID NO: 2647472 - protein, 7 aa, Entamoeba histolytica
PRDYEGK

SEQ ID NO: 2647473 - protein, 6 aa, Entamoeba histolytica
PRDYNP

SEQ ID NO: 2647474 - protein, 6 aa, Entamoeba histolytica
PREAKV

SEQ ID NO: 2647475 - protein, 10 aa, Entamoeba histolytica
PREEENLPEA

SEQ ID NO: 2647476 - protein, 4 aa, Entamoeba histolytica
PREK

SEQ ID NO: 2647477 - protein, 6 aa, Entamoeba histolytica
PREKKT

SEQ ID NO: 2647478 - protein, 16 aa, Entamoeba histolytica
PREKKTVERFSESTTQ

SEQ ID NO: 2647479 - protein, 14 aa, Entamoeba histolytica
PREKPLPASKEPTK

SEQ ID NO: 2647480 - protein, 10 aa, Entamoeba histolytica
PREKSQLKPD

SEQ ID NO: 2647481 - protein, 4 aa, Entamoeba histolytica
PREL

SEQ ID NO: 2647482 - protein, 9 aa, Entamoeba histolytica
PRETEEGTV

SEQ ID NO: 2647483 - protein, 35 aa, Entamoeba histolytica
PRETIEKTQPRGERFPRDGDEKNANFKHEFTKPKR

SEQ ID NO: 2647484 - protein, 15 aa, Entamoeba histolytica
PRETNTSSVIVSSNH

SEQ ID NO: 2647485 - protein, 6 aa, Entamoeba histolytica
PRETPK

SEQ ID NO: 2647486 - protein, 11 aa, Entamoeba histolytica
PREYFGTNSTL

SEQ ID NO: 2647487 - protein, 8 aa, Entamoeba histolytica
PRFGDTRG

SEQ ID NO: 2647488 - protein, 4 aa, Entamoeba histolytica
PRFP

SEQ ID NO: 2647489 - protein, 41 aa, Entamoeba histolytica
PRGDNQKRLEKDSGAKISIRGKDPKKLGKLSGYGDKDNEDS

SEQ ID NO: 2647490 - protein, 6 aa, Entamoeba histolytica
PRGGYI

SEQ ID NO: 2647491 - protein, 14 aa, Entamoeba histolytica
PRGMYTSGRGSSAV

SEQ ID NO: 2647492 - protein, 14 aa, Entamoeba histolytica
PRGREGKKEKIEEI

SEQ ID NO: 2647493 - protein, 5 aa, Entamoeba histolytica
PRGSE

SEQ ID NO: 2647494 - protein, 8 aa, Entamoeba histolytica
PRGTLAGS

SEQ ID NO: 2647495 - protein, 29 aa, Entamoeba histolytica
PRGTNAKMEISTTNKFNPIKQDLNKDGSL

SEQ ID NO: 2647496 - protein, 4 aa, Entamoeba histolytica
PRHE

SEQ ID NO: 2647497 - protein, 7 aa, Entamoeba histolytica
PRKDTDW

SEQ ID NO: 2647498 - protein, 10 aa, Entamoeba histolytica
PRKENEPEIT

SEQ ID NO: 2647499 - protein, 17 aa, Entamoeba histolytica
PRKKSENHSEELNQQKR

SEQ ID NO: 2647500 - protein, 10 aa, Entamoeba histolytica
PRKKSSKTAN

SEQ ID NO: 2647501 - protein, 8 aa, Entamoeba histolytica
PRKPGMQR

SEQ ID NO: 2647502 - protein, 14 aa, Entamoeba histolytica
PRKPNDSISKQATK

SEQ ID NO: 2647503 - protein, 6 aa, Entamoeba histolytica
PRKRSK

SEQ ID NO: 2647504 - protein, 6 aa, Entamoeba histolytica
PRKSSE

SEQ ID NO: 2647505 - protein, 28 aa, Entamoeba histolytica
PRKSSIPQSQPKQSQSQSQPQPTSNTVS

SEQ ID NO: 2647506 - protein, 11 aa, Entamoeba histolytica
PRKSVRSRSYS

SEQ ID NO: 2647507 - protein, 11 aa, Entamoeba histolytica
PRLFETSPSGL

SEQ ID NO: 2647508 - protein, 17 aa, Entamoeba histolytica
PRLNSEKEMSQLKKQAK

SEQ ID NO: 2647509 - protein, 17 aa, Entamoeba histolytica
PRLTSTEVQSKKRAFSL

SEQ ID NO: 2647510 - protein, 7 aa, Entamoeba histolytica
PRNAENK

SEQ ID NO: 2647511 - protein, 7 aa, Entamoeba histolytica
PRNDTDW

SEQ ID NO: 2647512 - protein, 16 aa, Entamoeba histolytica
PRNEEESKGDENKEDD

SEQ ID NO: 2647513 - protein, 8 aa, Entamoeba histolytica
PRNEENKN

SEQ ID NO: 2647514 - protein, 23 aa, Entamoeba histolytica
PRNESESSDKSKTRQEKELEEVE

SEQ ID NO: 2647515 - protein, 7 aa, Entamoeba histolytica
PRNGESA

SEQ ID NO: 2647516 - protein, 12 aa, Entamoeba histolytica
PRNKNDEQSLER

SEQ ID NO: 2647517 - protein, 4 aa, Entamoeba histolytica
PRNQ

SEQ ID NO: 2647518 - protein, 5 aa, Entamoeba histolytica
PRNYM

SEQ ID NO: 2647519 - protein, 5 aa, Entamoeba histolytica
PRPEL

SEQ ID NO: 2647520 - protein, 4 aa, Entamoeba histolytica
PRPL

SEQ ID NO: 2647521 - protein, 7 aa, Entamoeba histolytica
PRPPPYS

SEQ ID NO: 2647522 - protein, 24 aa, Entamoeba histolytica
PRPTKLAPKPSFLPPKPQSNAPRF

SEQ ID NO: 2647523 - protein, 22 aa, Entamoeba histolytica
PRQDYDKLDKTVRKVIESLIKP

SEQ ID NO: 2647524 - protein, 6 aa, Entamoeba histolytica
PRQENN

SEQ ID NO: 2647525 - protein, 5 aa, Entamoeba histolytica
PRQTD

SEQ ID NO: 2647526 - protein, 11 aa, Entamoeba histolytica
PRREDGLKNNP

SEQ ID NO: 2647527 - protein, 8 aa, Entamoeba histolytica
PRRIPSPM

SEQ ID NO: 2647528 - protein, 4 aa, Entamoeba histolytica
PRRR

SEQ ID NO: 2647529 - protein, 8 aa, Entamoeba histolytica
PRRSPTHL

SEQ ID NO: 2647530 - protein, 6 aa, Entamoeba histolytica
PRRTPN

SEQ ID NO: 2647531 - protein, 5 aa, Entamoeba histolytica
PRSAR

SEQ ID NO: 2647532 - protein, 7 aa, Entamoeba histolytica
PRSDNCS

SEQ ID NO: 2647533 - protein, 6 aa, Entamoeba histolytica
PRSEDR

SEQ ID NO: 2647534 - protein, 7 aa, Entamoeba histolytica
PRSEQTK

SEQ ID NO: 2647535 - protein, 6 aa, Entamoeba histolytica
PRSESD

SEQ ID NO: 2647536 - protein, 5 aa, Entamoeba histolytica
PRSFK

SEQ ID NO: 2647537 - protein, 6 aa, Entamoeba histolytica
PRSGST

SEQ ID NO: 2647538 - protein, 7 aa, Entamoeba histolytica
PRSGSTT

SEQ ID NO: 2647539 - protein, 5 aa, Entamoeba histolytica
PRSSG

SEQ ID NO: 2647540 - protein, 10 aa, Entamoeba histolytica
PRTEVSEMRN

SEQ ID NO: 2647541 - protein, 20 aa, Entamoeba histolytica
PRTKKTSIKINGNNITTATK

SEQ ID NO: 2647542 - protein, 4 aa, Entamoeba histolytica
PRTN

SEQ ID NO: 2647543 - protein, 7 aa, Entamoeba histolytica
PRTNHEV

SEQ ID NO: 2647544 - protein, 8 aa, Entamoeba histolytica
PRTPKEVR

SEQ ID NO: 2647545 - protein, 8 aa, Entamoeba histolytica
PRTPQQIN

SEQ ID NO: 2647546 - protein, 14 aa, Entamoeba histolytica
PRTTISNSIKNSLQ

SEQ ID NO: 2647547 - protein, 4 aa, Entamoeba histolytica
PRVR

SEQ ID NO: 2647548 - protein, 8 aa, Entamoeba histolytica
PSAAPMGM

SEQ ID NO: 2647549 - protein, 13 aa, Entamoeba histolytica
PSAFSTKGGQLTI

SEQ ID NO: 2647550 - protein, 5 aa, Entamoeba histolytica
PSARN

SEQ ID NO: 2647551 - protein, 10 aa, Entamoeba histolytica
PSARSLNTER

SEQ ID NO: 2647552 - protein, 5 aa, Entamoeba histolytica
PSASQ

SEQ ID NO: 2647553 - protein, 11 aa, Entamoeba histolytica
PSATNDHENDV

SEQ ID NO: 2647554 - protein, 5 aa, Entamoeba histolytica
PSATY

SEQ ID NO: 2647555 - protein, 6 aa, Entamoeba histolytica
PSAVDE

SEQ ID NO: 2647556 - protein, 17 aa, Entamoeba histolytica
PSAVNTNSVAQSSISQI

SEQ ID NO: 2647557 - protein, 5 aa, Entamoeba histolytica
PSCKN

SEQ ID NO: 2647558 - protein, 20 aa, Entamoeba histolytica
PSCNGSDKVATQELPEMEPG

SEQ ID NO: 2647559 - protein, 4 aa, Entamoeba histolytica
PSDE

SEQ ID NO: 2647560 - protein, 5 aa, Entamoeba histolytica
PSDET

SEQ ID NO: 2647561 - protein, 12 aa, Entamoeba histolytica
PSDIDGTSSIAQ

SEQ ID NO: 2647562 - protein, 5 aa, Entamoeba histolytica
PSDIR

SEQ ID NO: 2647563 - protein, 8 aa, Entamoeba histolytica
PSDKDKLA

SEQ ID NO: 2647564 - protein, 15 aa, Entamoeba histolytica
PSDKKYAPKYSYSSD

SEQ ID NO: 2647565 - protein, 5 aa, Entamoeba histolytica
PSDKN

SEQ ID NO: 2647566 - protein, 5 aa, Entamoeba histolytica
PSDLP

SEQ ID NO: 2647567 - protein, 4 aa, Entamoeba histolytica
PSDN

SEQ ID NO: 2647568 - protein, 9 aa, Entamoeba histolytica
PSDNDKEEV

SEQ ID NO: 2647569 - protein, 9 aa, Entamoeba histolytica
PSDRSMPLN

SEQ ID NO: 2647570 - protein, 9 aa, Entamoeba histolytica
PSDSNNIVN

SEQ ID NO: 2647571 - protein, 8 aa, Entamoeba histolytica
PSDTEPAP

SEQ ID NO: 2647572 - protein, 17 aa, Entamoeba histolytica
PSDVEKEIRNGRLKTDP

SEQ ID NO: 2647573 - protein, 13 aa, Entamoeba histolytica
PSDVRAYSICLFS

SEQ ID NO: 2647574 - protein, 13 aa, Entamoeba histolytica
PSDYKGVSPLTNR

SEQ ID NO: 2647575 - protein, 7 aa, Entamoeba histolytica
PSEEENH

SEQ ID NO: 2647576 - protein, 5 aa, Entamoeba histolytica
PSEER

SEQ ID NO: 2647577 - protein, 5 aa, Entamoeba histolytica
PSEEW

SEQ ID NO: 2647578 - protein, 4 aa, Entamoeba histolytica
PSEG

SEQ ID NO: 2647579 - protein, 4 aa, Entamoeba histolytica
PSEI

SEQ ID NO: 2647580 - protein, 20 aa, Entamoeba histolytica
PSEIDTEKNNDKIKELTERN

SEQ ID NO: 2647581 - protein, 21 aa, Entamoeba histolytica
PSEKGNDKYLSSQIEGEGSTT

SEQ ID NO: 2647582 - protein, 9 aa, Entamoeba histolytica
PSEKGSDKF

SEQ ID NO: 2647583 - protein, 6 aa, Entamoeba histolytica
PSEKQD

SEQ ID NO: 2647584 - protein, 14 aa, Entamoeba histolytica
PSELQGDAINHPPK

SEQ ID NO: 2647585 - protein, 18 aa, Entamoeba histolytica
PSENNSEITEDISKYEKV

SEQ ID NO: 2647586 - protein, 5 aa, Entamoeba histolytica
PSEPI

SEQ ID NO: 2647587 - protein, 5 aa, Entamoeba histolytica
PSEPT

SEQ ID NO: 2647588 - protein, 4 aa, Entamoeba histolytica
PSEQ

SEQ ID NO: 2647589 - protein, 9 aa, Entamoeba histolytica
PSEQYSEGR

SEQ ID NO: 2647590 - protein, 9 aa, Entamoeba histolytica
PSESELKDF

SEQ ID NO: 2647591 - protein, 8 aa, Entamoeba histolytica
PSETEPSV

SEQ ID NO: 2647592 - protein, 5 aa, Entamoeba histolytica
PSEYF

SEQ ID NO: 2647593 - protein, 4 aa, Entamoeba histolytica
PSFD

SEQ ID NO: 2647594 - protein, 4 aa, Entamoeba histolytica
PSFE

SEQ ID NO: 2647595 - protein, 9 aa, Entamoeba histolytica
PSFGKRNGM

SEQ ID NO: 2647596 - protein, 12 aa, Entamoeba histolytica
PSFKSRRPQIKK

SEQ ID NO: 2647597 - protein, 7 aa, Entamoeba histolytica
PSFNTPS

SEQ ID NO: 2647598 - protein, 5 aa, Entamoeba histolytica
PSFRR

SEQ ID NO: 2647599 - protein, 12 aa, Entamoeba histolytica
PSFYADKPQIST

SEQ ID NO: 2647600 - protein, 8 aa, Entamoeba histolytica
PSGAGKST

SEQ ID NO: 2647601 - protein, 7 aa, Entamoeba histolytica
PSGAPRV

SEQ ID NO: 2647602 - protein, 36 aa, Entamoeba histolytica
PSGAPTQQSENGYRQTQMSDDDDDDDQQRGGVECHQ

SEQ ID NO: 2647603 - protein, 9 aa, Entamoeba histolytica
PSGASTGVH

SEQ ID NO: 2647604 - protein, 7 aa, Entamoeba histolytica
PSGCAKT

SEQ ID NO: 2647605 - protein, 8 aa, Entamoeba histolytica
PSGCGKTT

SEQ ID NO: 2647606 - protein, 7 aa, Entamoeba histolytica
PSGDRFS

SEQ ID NO: 2647607 - protein, 14 aa, Entamoeba histolytica
PSGEYVASGGDDGS

SEQ ID NO: 2647608 - protein, 5 aa, Entamoeba histolytica
PSGGI

SEQ ID NO: 2647609 - protein, 4 aa, Entamoeba histolytica
PSGH

SEQ ID NO: 2647610 - protein, 5 aa, Entamoeba histolytica
PSGHL

SEQ ID NO: 2647611 - protein, 8 aa, Entamoeba histolytica
PSGKARDS

SEQ ID NO: 2647612 - protein, 6 aa, Entamoeba histolytica
PSGKFN

SEQ ID NO: 2647613 - protein, 5 aa, Entamoeba histolytica
PSGLE

SEQ ID NO: 2647614 - protein, 8 aa, Entamoeba histolytica
PSGQARLS

SEQ ID NO: 2647615 - protein, 6 aa, Entamoeba histolytica
PSGTEI

SEQ ID NO: 2647616 - protein, 10 aa, Entamoeba histolytica
PSGTQTADGY

SEQ ID NO: 2647617 - protein, 4 aa, Entamoeba histolytica
PSGV

SEQ ID NO: 2647618 - protein, 8 aa, Entamoeba histolytica
PSGVGTQA

SEQ ID NO: 2647619 - protein, 10 aa, Entamoeba histolytica
PSGYYRSGDD

SEQ ID NO: 2647620 - protein, 4 aa, Entamoeba histolytica
PSHA

SEQ ID NO: 2647621 - protein, 5 aa, Entamoeba histolytica
PSHAE

SEQ ID NO: 2647622 - protein, 5 aa, Entamoeba histolytica
PSHKG

SEQ ID NO: 2647623 - protein, 14 aa, Entamoeba histolytica
PSHSPNATQTLRPL

SEQ ID NO: 2647624 - protein, 5 aa, Entamoeba histolytica
PSIDE

SEQ ID NO: 2647625 - protein, 6 aa, Entamoeba histolytica
PSIDGD

SEQ ID NO: 2647626 - protein, 20 aa, Entamoeba histolytica
PSIEDDEELASRWPRYGDEI

SEQ ID NO: 2647627 - protein, 6 aa, Entamoeba histolytica
PSIEEE

SEQ ID NO: 2647628 - protein, 7 aa, Entamoeba histolytica
PSIEGSY

SEQ ID NO: 2647629 - protein, 6 aa, Entamoeba histolytica
PSIETI

SEQ ID NO: 2647630 - protein, 5 aa, Entamoeba histolytica
PSIGE

SEQ ID NO: 2647631 - protein, 4 aa, Entamoeba histolytica
PSIN

SEQ ID NO: 2647632 - protein, 9 aa, Entamoeba histolytica
PSINPKNPM

SEQ ID NO: 2647633 - protein, 7 aa, Entamoeba histolytica
PSIPEQQ

SEQ ID NO: 2647634 - protein, 14 aa, Entamoeba histolytica
PSIPGSRAGNNIAG

SEQ ID NO: 2647635 - protein, 8 aa, Entamoeba histolytica
PSIPNKES

SEQ ID NO: 2647636 - protein, 24 aa, Entamoeba histolytica
PSIPQTQPKTQQQNSTSISSKSHI

SEQ ID NO: 2647637 - protein, 6 aa, Entamoeba histolytica
PSIQNS

SEQ ID NO: 2647638 - protein, 4 aa, Entamoeba histolytica
PSIR

SEQ ID NO: 2647639 - protein, 4 aa, Entamoeba histolytica
PSIS

SEQ ID NO: 2647640 - protein, 7 aa, Entamoeba histolytica
PSISEKQ

SEQ ID NO: 2647641 - protein, 11 aa, Entamoeba histolytica
PSISSERDYKT

SEQ ID NO: 2647642 - protein, 6 aa, Entamoeba histolytica
PSITEG

SEQ ID NO: 2647643 - protein, 7 aa, Entamoeba histolytica
PSITPSL

SEQ ID NO: 2647644 - protein, 32 aa, Entamoeba histolytica
PSKAERTLSKQFSPKPTIESRNYSEKQKPKHQ

SEQ ID NO: 2647645 - protein, 5 aa, Entamoeba histolytica
PSKCN

SEQ ID NO: 2647646 - protein, 4 aa, Entamoeba histolytica
PSKD

SEQ ID NO: 2647647 - protein, 10 aa, Entamoeba histolytica
PSKDTRKSFV

SEQ ID NO: 2647648 - protein, 4 aa, Entamoeba histolytica
PSKE

SEQ ID NO: 2647649 - protein, 13 aa, Entamoeba histolytica
PSKETAKRKYEEE

SEQ ID NO: 2647650 - protein, 9 aa, Entamoeba histolytica
PSKETQPVK

SEQ ID NO: 2647651 - protein, 9 aa, Entamoeba histolytica
PSKETTTKE

SEQ ID NO: 2647652 - protein, 11 aa, Entamoeba histolytica
PSKFTSQPVPA

SEQ ID NO: 2647653 - protein, 5 aa, Entamoeba histolytica
PSKID

SEQ ID NO: 2647654 - protein, 9 aa, Entamoeba histolytica
PSKIQRDDY

SEQ ID NO: 2647655 - protein, 6 aa, Entamoeba histolytica
PSKISK

SEQ ID NO: 2647656 - protein, 4 aa, Entamoeba histolytica
PSKK

SEQ ID NO: 2647657 - protein, 10 aa, Entamoeba histolytica
PSKKDSSIDF

SEQ ID NO: 2647658 - protein, 7 aa, Entamoeba histolytica
PSKKTTV

SEQ ID NO: 2647659 - protein, 4 aa, Entamoeba histolytica
PSKL

SEQ ID NO: 2647660 - protein, 8 aa, Entamoeba histolytica
PSKNELPG

SEQ ID NO: 2647661 - protein, 11 aa, Entamoeba histolytica
PSKPKESENNS

SEQ ID NO: 2647662 - protein, 9 aa, Entamoeba histolytica
PSKPSKYDL

SEQ ID NO: 2647663 - protein, 8 aa, Entamoeba histolytica
PSKPSPVI

SEQ ID NO: 2647664 - protein, 8 aa, Entamoeba histolytica
PSKQVSAQ

SEQ ID NO: 2647665 - protein, 5 aa, Entamoeba histolytica
PSKRI

SEQ ID NO: 2647666 - protein, 7 aa, Entamoeba histolytica
PSKSALK

SEQ ID NO: 2647667 - protein, 10 aa, Entamoeba histolytica
PSKSTTEKQT

SEQ ID NO: 2647668 - protein, 22 aa, Entamoeba histolytica
PSKSVPSIPPHYKKANSTPEIT

SEQ ID NO: 2647669 - protein, 13 aa, Entamoeba histolytica
PSKTCQKGNKTGT

SEQ ID NO: 2647670 - protein, 6 aa, Entamoeba histolytica
PSKTEP

SEQ ID NO: 2647671 - protein, 7 aa, Entamoeba histolytica
PSKTGTN

SEQ ID NO: 2647672 - protein, 36 aa, Entamoeba histolytica
PSKTSEQNVEEEDDTAEMPDIQDPEEVLPEKESDLT

SEQ ID NO: 2647673 - protein, 7 aa, Entamoeba histolytica
PSKWGEP

SEQ ID NO: 2647674 - protein, 8 aa, Entamoeba histolytica
PSKYEPCT

SEQ ID NO: 2647675 - protein, 18 aa, Entamoeba histolytica
PSKYSKEIKELPTQSNKG

SEQ ID NO: 2647676 - protein, 17 aa, Entamoeba histolytica
PSLENNGFSSNNRGTGC

SEQ ID NO: 2647677 - protein, 4 aa, Entamoeba histolytica
PSLG

SEQ ID NO: 2647678 - protein, 6 aa, Entamoeba histolytica
PSLKDN

SEQ ID NO: 2647679 - protein, 12 aa, Entamoeba histolytica
PSLKDTSPSNGI

SEQ ID NO: 2647680 - protein, 15 aa, Entamoeba histolytica
PSLKERDSLLKWFVS

SEQ ID NO: 2647681 - protein, 9 aa, Entamoeba histolytica
PSLKESNRN

SEQ ID NO: 2647682 - protein, 8 aa, Entamoeba histolytica
PSLLSSEV

SEQ ID NO: 2647683 - protein, 6 aa, Entamoeba histolytica
PSLNNN

SEQ ID NO: 2647684 - protein, 20 aa, Entamoeba histolytica
PSLNQQSTTPLQENEIQTNP

SEQ ID NO: 2647685 - protein, 7 aa, Entamoeba histolytica
PSLPPKE

SEQ ID NO: 2647686 - protein, 6 aa, Entamoeba histolytica
PSLPPS

SEQ ID NO: 2647687 - protein, 7 aa, Entamoeba histolytica
PSLPQQP

SEQ ID NO: 2647688 - protein, 8 aa, Entamoeba histolytica
PSLPTPNI

SEQ ID NO: 2647689 - protein, 7 aa, Entamoeba histolytica
PSLPTRE

SEQ ID NO: 2647690 - protein, 7 aa, Entamoeba histolytica
PSLPTRQ

SEQ ID NO: 2647691 - protein, 4 aa, Entamoeba histolytica
PSLQ

SEQ ID NO: 2647692 - protein, 8 aa, Entamoeba histolytica
PSLQPPLR

SEQ ID NO: 2647693 - protein, 4 aa, Entamoeba histolytica
PSLS

SEQ ID NO: 2647694 - protein, 7 aa, Entamoeba histolytica
PSLSSPT

SEQ ID NO: 2647695 - protein, 6 aa, Entamoeba histolytica
PSLSYT

SEQ ID NO: 2647696 - protein, 8 aa, Entamoeba histolytica
PSLYKGNN

SEQ ID NO: 2647697 - protein, 10 aa, Entamoeba histolytica
PSMEKEDGEV

SEQ ID NO: 2647698 - protein, 17 aa, Entamoeba histolytica
PSMNKSPTIHPDPTSPR

SEQ ID NO: 2647699 - protein, 7 aa, Entamoeba histolytica
PSMQNKT

SEQ ID NO: 2647700 - protein, 30 aa, Entamoeba histolytica
PSMSPSSFTQTYQQPDDDFYGDDWENEDGF

SEQ ID NO: 2647701 - protein, 52 aa, Entamoeba histolytica
PSMTEEQKKHAKEEASKAGKTAYSGAKKAVKSEEFKQAKSQVASGAKAAVHS

SEQ ID NO: 2647702 - protein, 4 aa, Entamoeba histolytica
PSNA

SEQ ID NO: 2647703 - protein, 6 aa, Entamoeba histolytica
PSNDNL

SEQ ID NO: 2647704 - protein, 8 aa, Entamoeba histolytica
PSNDPQIE

SEQ ID NO: 2647705 - protein, 4 aa, Entamoeba histolytica
PSNE

SEQ ID NO: 2647706 - protein, 7 aa, Entamoeba histolytica
PSNEFYS

SEQ ID NO: 2647707 - protein, 10 aa, Entamoeba histolytica
PSNEPSHSYD

SEQ ID NO: 2647708 - protein, 8 aa, Entamoeba histolytica
PSNESQEE

SEQ ID NO: 2647709 - protein, 6 aa, Entamoeba histolytica
PSNGEA

SEQ ID NO: 2647710 - protein, 5 aa, Entamoeba histolytica
PSNGI

SEQ ID NO: 2647711 - protein, 5 aa, Entamoeba histolytica
PSNKP

SEQ ID NO: 2647712 - protein, 7 aa, Entamoeba histolytica
PSNKRGY

SEQ ID NO: 2647713 - protein, 8 aa, Entamoeba histolytica
PSNKRGYV

SEQ ID NO: 2647714 - protein, 7 aa, Entamoeba histolytica
PSNPAPF

SEQ ID NO: 2647715 - protein, 6 aa, Entamoeba histolytica
PSNQNR

SEQ ID NO: 2647716 - protein, 8 aa, Entamoeba histolytica
PSNTNPKF

SEQ ID NO: 2647717 - protein, 5 aa, Entamoeba histolytica
PSNTT

SEQ ID NO: 2647718 - protein, 12 aa, Entamoeba histolytica
PSNVNRTTRSHS

SEQ ID NO: 2647719 - protein, 12 aa, Entamoeba histolytica
PSNYNTSQNEME

SEQ ID NO: 2647720 - protein, 4 aa, Entamoeba histolytica
PSPE

SEQ ID NO: 2647721 - protein, 44 aa, Entamoeba histolytica
PSPEETETTTTPNEGQQHQQNITPVQPKQKENGTNNTPSKKRFD

SEQ ID NO: 2647722 - protein, 9 aa, Entamoeba histolytica
PSPERNSSL

SEQ ID NO: 2647723 - protein, 5 aa, Entamoeba histolytica
PSPFA

SEQ ID NO: 2647724 - protein, 9 aa, Entamoeba histolytica
PSPFDDNDD

SEQ ID NO: 2647725 - protein, 18 aa, Entamoeba histolytica
PSPGLGSAEAYTKRNKKL

SEQ ID NO: 2647726 - protein, 5 aa, Entamoeba histolytica
PSPHP

SEQ ID NO: 2647727 - protein, 5 aa, Entamoeba histolytica
PSPII

SEQ ID NO: 2647728 - protein, 24 aa, Entamoeba histolytica
PSPIQKPELAAYSPGIQRNQIRPS

SEQ ID NO: 2647729 - protein, 8 aa, Entamoeba histolytica
PSPKEEGS

SEQ ID NO: 2647730 - protein, 5 aa, Entamoeba histolytica
PSPKI

SEQ ID NO: 2647731 - protein, 7 aa, Entamoeba histolytica
PSPKIPG

SEQ ID NO: 2647732 - protein, 6 aa, Entamoeba histolytica
PSPKQY

SEQ ID NO: 2647733 - protein, 9 aa, Entamoeba histolytica
PSPNPEVRT

SEQ ID NO: 2647734 - protein, 10 aa, Entamoeba histolytica
PSPQKQQRMT

SEQ ID NO: 2647735 - protein, 23 aa, Entamoeba histolytica
PSPQNQSNISKKENTPTKALSTE

SEQ ID NO: 2647736 - protein, 11 aa, Entamoeba histolytica
PSPQQQKEGET

SEQ ID NO: 2647737 - protein, 14 aa, Entamoeba histolytica
PSPRNLEEGSKRGK

SEQ ID NO: 2647738 - protein, 7 aa, Entamoeba histolytica
PSPSEYF

SEQ ID NO: 2647739 - protein, 7 aa, Entamoeba histolytica
PSPSINL

SEQ ID NO: 2647740 - protein, 8 aa, Entamoeba histolytica
PSPTVSET

SEQ ID NO: 2647741 - protein, 7 aa, Entamoeba histolytica
PSPTYPD

SEQ ID NO: 2647742 - protein, 13 aa, Entamoeba histolytica
PSPVKTTKLTKAD

SEQ ID NO: 2647743 - protein, 5 aa, Entamoeba histolytica
PSQEV

SEQ ID NO: 2647744 - protein, 11 aa, Entamoeba histolytica
PSQFSSPPSTT

SEQ ID NO: 2647745 - protein, 4 aa, Entamoeba histolytica
PSQI

SEQ ID NO: 2647746 - protein, 17 aa, Entamoeba histolytica
PSQITKSSTKQSSKDDK

SEQ ID NO: 2647747 - protein, 9 aa, Entamoeba histolytica
PSQKQPNGR

SEQ ID NO: 2647748 - protein, 4 aa, Entamoeba histolytica
PSQN

SEQ ID NO: 2647749 - protein, 21 aa, Entamoeba histolytica
PSQPIQLSQSTSMLNRGFESG

SEQ ID NO: 2647750 - protein, 4 aa, Entamoeba histolytica
PSQQ

SEQ ID NO: 2647751 - protein, 5 aa, Entamoeba histolytica
PSQQD

SEQ ID NO: 2647752 - protein, 6 aa, Entamoeba histolytica
PSQQET

SEQ ID NO: 2647753 - protein, 14 aa, Entamoeba histolytica
PSQQITENQPKQLP

SEQ ID NO: 2647754 - protein, 14 aa, Entamoeba histolytica
PSQVQSMVPQQQLY

SEQ ID NO: 2647755 - protein, 6 aa, Entamoeba histolytica
PSQYGL

SEQ ID NO: 2647756 - protein, 14 aa, Entamoeba histolytica
PSRAYSSSYSSDKL

SEQ ID NO: 2647757 - protein, 10 aa, Entamoeba histolytica
PSRDDPTNAV

SEQ ID NO: 2647758 - protein, 5 aa, Entamoeba histolytica
PSRIK

SEQ ID NO: 2647759 - protein, 14 aa, Entamoeba histolytica
PSRKEEYSKYIEET

SEQ ID NO: 2647760 - protein, 6 aa, Entamoeba histolytica
PSRNNM

SEQ ID NO: 2647761 - protein, 4 aa, Entamoeba histolytica
PSRP

SEQ ID NO: 2647762 - protein, 4 aa, Entamoeba histolytica
PSRR

SEQ ID NO: 2647763 - protein, 9 aa, Entamoeba histolytica
PSRSDEQEY

SEQ ID NO: 2647764 - protein, 4 aa, Entamoeba histolytica
PSRT

SEQ ID NO: 2647765 - protein, 5 aa, Entamoeba histolytica
PSRTV

SEQ ID NO: 2647766 - protein, 6 aa, Entamoeba histolytica
PSSAEP

SEQ ID NO: 2647767 - protein, 4 aa, Entamoeba histolytica
PSSE

SEQ ID NO: 2647768 - protein, 15 aa, Entamoeba histolytica
PSSETIKQPFEKTDT

SEQ ID NO: 2647769 - protein, 10 aa, Entamoeba histolytica
PSSGKSAKIY

SEQ ID NO: 2647770 - protein, 19 aa, Entamoeba histolytica
PSSGKSAKIYSCKSCGFII

SEQ ID NO: 2647771 - protein, 5 aa, Entamoeba histolytica
PSSGL

SEQ ID NO: 2647772 - protein, 35 aa, Entamoeba histolytica
PSSGPNQSSGNSYRQNQIDSDDEDEYSRGNGECTQ

SEQ ID NO: 2647773 - protein, 5 aa, Entamoeba histolytica
PSSHI

SEQ ID NO: 2647774 - protein, 6 aa, Entamoeba histolytica
PSSIPP

SEQ ID NO: 2647775 - protein, 7 aa, Entamoeba histolytica
PSSIPPS

SEQ ID NO: 2647776 - protein, 7 aa, Entamoeba histolytica
PSSISSI

SEQ ID NO: 2647777 - protein, 7 aa, Entamoeba histolytica
PSSITKI

SEQ ID NO: 2647778 - protein, 14 aa, Entamoeba histolytica
PSSITSSGIGCFYG

SEQ ID NO: 2647779 - protein, 4 aa, Entamoeba histolytica
PSSK

SEQ ID NO: 2647780 - protein, 11 aa, Entamoeba histolytica
PSSKKESMRHK

SEQ ID NO: 2647781 - protein, 7 aa, Entamoeba histolytica
PSSKKNS

SEQ ID NO: 2647782 - protein, 11 aa, Entamoeba histolytica
PSSKRGIEKMS

SEQ ID NO: 2647783 - protein, 9 aa, Entamoeba histolytica
PSSLGGVGG

SEQ ID NO: 2647784 - protein, 5 aa, Entamoeba histolytica
PSSLK

SEQ ID NO: 2647785 - protein, 9 aa, Entamoeba histolytica
PSSLNTSQQ

SEQ ID NO: 2647786 - protein, 11 aa, Entamoeba histolytica
PSSLSKPKDTD

SEQ ID NO: 2647787 - protein, 12 aa, Entamoeba histolytica
PSSLTSNSNGKI

SEQ ID NO: 2647788 - protein, 14 aa, Entamoeba histolytica
PSSNEMEEEGEGNN

SEQ ID NO: 2647789 - protein, 5 aa, Entamoeba histolytica
PSSPL

SEQ ID NO: 2647790 - protein, 8 aa, Entamoeba histolytica
PSSPMAEN

SEQ ID NO: 2647791 - protein, 7 aa, Entamoeba histolytica
PSSPNKC

SEQ ID NO: 2647792 - protein, 4 aa, Entamoeba histolytica
PSSQ

SEQ ID NO: 2647793 - protein, 6 aa, Entamoeba histolytica
PSSQIQ

SEQ ID NO: 2647794 - protein, 5 aa, Entamoeba histolytica
PSSQN

SEQ ID NO: 2647795 - protein, 8 aa, Entamoeba histolytica
PSSQNENS

SEQ ID NO: 2647796 - protein, 7 aa, Entamoeba histolytica
PSSQRDI

SEQ ID NO: 2647797 - protein, 7 aa, Entamoeba histolytica
PSSQRPK

SEQ ID NO: 2647798 - protein, 14 aa, Entamoeba histolytica
PSSRGVWSNSDPTT

SEQ ID NO: 2647799 - protein, 10 aa, Entamoeba histolytica
PSSSKERQLV

SEQ ID NO: 2647800 - protein, 4 aa, Entamoeba histolytica
PSSV

SEQ ID NO: 2647801 - protein, 37 aa, Entamoeba histolytica
PSSVNNLNNPYSPYSTSYPPNKNQTISSSIPSTLSNE

SEQ ID NO: 2647802 - protein, 10 aa, Entamoeba histolytica
PSSVSSLGNN

SEQ ID NO: 2647803 - protein, 6 aa, Entamoeba histolytica
PSSVTS

SEQ ID NO: 2647804 - protein, 7 aa, Entamoeba histolytica
PSSVTSI

SEQ ID NO: 2647805 - protein, 5 aa, Entamoeba histolytica
PSSYY

SEQ ID NO: 2647806 - protein, 11 aa, Entamoeba histolytica
PSTAQSSSLNT

SEQ ID NO: 2647807 - protein, 8 aa, Entamoeba histolytica
PSTCYTSK

SEQ ID NO: 2647808 - protein, 6 aa, Entamoeba histolytica
PSTDHT

SEQ ID NO: 2647809 - protein, 8 aa, Entamoeba histolytica
PSTETKEW

SEQ ID NO: 2647810 - protein, 17 aa, Entamoeba histolytica
PSTETSTEHSGSTNRTL

SEQ ID NO: 2647811 - protein, 7 aa, Entamoeba histolytica
PSTGTMS

SEQ ID NO: 2647812 - protein, 4 aa, Entamoeba histolytica
PSTI

SEQ ID NO: 2647813 - protein, 5 aa, Entamoeba histolytica
PSTKE

SEQ ID NO: 2647814 - protein, 9 aa, Entamoeba histolytica
PSTKGEAQK

SEQ ID NO: 2647815 - protein, 12 aa, Entamoeba histolytica
PSTKKRASNELR

SEQ ID NO: 2647816 - protein, 15 aa, Entamoeba histolytica
PSTKSQLEQEFGNKK

SEQ ID NO: 2647817 - protein, 6 aa, Entamoeba histolytica
PSTLKR

SEQ ID NO: 2647818 - protein, 8 aa, Entamoeba histolytica
PSTNQVDT

SEQ ID NO: 2647819 - protein, 7 aa, Entamoeba histolytica
PSTNTTI

SEQ ID NO: 2647820 - protein, 4 aa, Entamoeba histolytica
PSTP

SEQ ID NO: 2647821 - protein, 13 aa, Entamoeba histolytica
PSTPLPNNQDDNE

SEQ ID NO: 2647822 - protein, 12 aa, Entamoeba histolytica
PSTSNLPLTKDP

SEQ ID NO: 2647823 - protein, 10 aa, Entamoeba histolytica
PSTSQPKDVL

SEQ ID NO: 2647824 - protein, 22 aa, Entamoeba histolytica
PSTSQQQSSKKLKKNHQYSSTN

SEQ ID NO: 2647825 - protein, 5 aa, Entamoeba histolytica
PSTSY

SEQ ID NO: 2647826 - protein, 13 aa, Entamoeba histolytica
PSTTPRNKRGLRP

SEQ ID NO: 2647827 - protein, 4 aa, Entamoeba histolytica
PSTV

SEQ ID NO: 2647828 - protein, 5 aa, Entamoeba histolytica
PSTVD

SEQ ID NO: 2647829 - protein, 4 aa, Entamoeba histolytica
PSTY

SEQ ID NO: 2647830 - protein, 7 aa, Entamoeba histolytica
PSTYSQQ

SEQ ID NO: 2647831 - protein, 7 aa, Entamoeba histolytica
PSVCPPS

SEQ ID NO: 2647832 - protein, 6 aa, Entamoeba histolytica
PSVEEG

SEQ ID NO: 2647833 - protein, 7 aa, Entamoeba histolytica
PSVEGHH

SEQ ID NO: 2647834 - protein, 7 aa, Entamoeba histolytica
PSVESIR

SEQ ID NO: 2647835 - protein, 10 aa, Entamoeba histolytica
PSVGGNEKFH

SEQ ID NO: 2647836 - protein, 13 aa, Entamoeba histolytica
PSVHSQNSSFEID

SEQ ID NO: 2647837 - protein, 7 aa, Entamoeba histolytica
PSVITNQ

SEQ ID NO: 2647838 - protein, 9 aa, Entamoeba histolytica
PSVKYQNDG

SEQ ID NO: 2647839 - protein, 41 aa, Entamoeba histolytica
PSVPAQLQPPLETVTSKKNHKKGSSSNDDETETNSDSETLV

SEQ ID NO: 2647840 - protein, 7 aa, Entamoeba histolytica
PSVPGQV

SEQ ID NO: 2647841 - protein, 4 aa, Entamoeba histolytica
PSVQ

SEQ ID NO: 2647842 - protein, 7 aa, Entamoeba histolytica
PSVQEGS

SEQ ID NO: 2647843 - protein, 9 aa, Entamoeba histolytica
PSVQRKTSH

SEQ ID NO: 2647844 - protein, 25 aa, Entamoeba histolytica
PSVTNYDNKIGKQDLPKPTLSPNEY

SEQ ID NO: 2647845 - protein, 7 aa, Entamoeba histolytica
PSYAARV

SEQ ID NO: 2647846 - protein, 22 aa, Entamoeba histolytica
PSYEDNPKEETPIECREKDKKL

SEQ ID NO: 2647847 - protein, 5 aa, Entamoeba histolytica
PSYGG

SEQ ID NO: 2647848 - protein, 4 aa, Entamoeba histolytica
PSYK

SEQ ID NO: 2647849 - protein, 4 aa, Entamoeba histolytica
PSYN

SEQ ID NO: 2647850 - protein, 17 aa, Entamoeba histolytica
PSYNSYSMSSQYHPYTP

SEQ ID NO: 2647851 - protein, 5 aa, Entamoeba histolytica
PSYPH

SEQ ID NO: 2647852 - protein, 33 aa, Entamoeba histolytica
PSYPKTSGNFETHSSLSKLGETETNKGVETQDS

SEQ ID NO: 2647853 - protein, 15 aa, Entamoeba histolytica
PSYQQSYQQTNYPIQ

SEQ ID NO: 2647854 - protein, 12 aa, Entamoeba histolytica
PSYSLPPKSTTV

SEQ ID NO: 2647855 - protein, 7 aa, Entamoeba histolytica
PSYYPQE

SEQ ID NO: 2647856 - protein, 10 aa, Entamoeba histolytica
PTADKKASEK

SEQ ID NO: 2647857 - protein, 10 aa, Entamoeba histolytica
PTAKQSELTQ

SEQ ID NO: 2647858 - protein, 5 aa, Entamoeba histolytica
PTAPA

SEQ ID NO: 2647859 - protein, 7 aa, Entamoeba histolytica
PTASLKS

SEQ ID NO: 2647860 - protein, 7 aa, Entamoeba histolytica
PTATENY

SEQ ID NO: 2647861 - protein, 17 aa, Entamoeba histolytica
PTAVNSKGKKKPAQSQV

SEQ ID NO: 2647862 - protein, 17 aa, Entamoeba histolytica
PTAVNSKGKKKPASSQV

SEQ ID NO: 2647863 - protein, 13 aa, Entamoeba histolytica
PTCPLNNPNGFSD

SEQ ID NO: 2647864 - protein, 4 aa, Entamoeba histolytica
PTDF

SEQ ID NO: 2647865 - protein, 4 aa, Entamoeba histolytica
PTDI

SEQ ID NO: 2647866 - protein, 11 aa, Entamoeba histolytica
PTDKSAARGTF

SEQ ID NO: 2647867 - protein, 10 aa, Entamoeba histolytica
PTDLKPPQLA

SEQ ID NO: 2647868 - protein, 12 aa, Entamoeba histolytica
PTDLPKKRGRKK

SEQ ID NO: 2647869 - protein, 8 aa, Entamoeba histolytica
PTDNHPSY

SEQ ID NO: 2647870 - protein, 5 aa, Entamoeba histolytica
PTDNK

SEQ ID NO: 2647871 - protein, 15 aa, Entamoeba histolytica
PTDNYDQPRGKQVNH

SEQ ID NO: 2647872 - protein, 10 aa, Entamoeba histolytica
PTDRQTPETN

SEQ ID NO: 2647873 - protein, 4 aa, Entamoeba histolytica
PTDS

SEQ ID NO: 2647874 - protein, 10 aa, Entamoeba histolytica
PTEEEISEDN

SEQ ID NO: 2647875 - protein, 15 aa, Entamoeba histolytica
PTEEESDEFLINPTL

SEQ ID NO: 2647876 - protein, 7 aa, Entamoeba histolytica
PTEEPYN

SEQ ID NO: 2647877 - protein, 10 aa, Entamoeba histolytica
PTEETQNEMV

SEQ ID NO: 2647878 - protein, 5 aa, Entamoeba histolytica
PTEGP

SEQ ID NO: 2647879 - protein, 8 aa, Entamoeba histolytica
PTEKKVGE

SEQ ID NO: 2647880 - protein, 14 aa, Entamoeba histolytica
PTELQENSNPIKPT

SEQ ID NO: 2647881 - protein, 10 aa, Entamoeba histolytica
PTENLNQKAM

SEQ ID NO: 2647882 - protein, 9 aa, Entamoeba histolytica
PTEPEEHSG

SEQ ID NO: 2647883 - protein, 5 aa, Entamoeba histolytica
PTEQE

SEQ ID NO: 2647884 - protein, 11 aa, Entamoeba histolytica
PTETDEDHKKT

SEQ ID NO: 2647885 - protein, 7 aa, Entamoeba histolytica
PTETKKT

SEQ ID NO: 2647886 - protein, 12 aa, Entamoeba histolytica
PTETSDDEDIIS

SEQ ID NO: 2647887 - protein, 6 aa, Entamoeba histolytica
PTFAPT

SEQ ID NO: 2647888 - protein, 12 aa, Entamoeba histolytica
PTFGGTTASYAM

SEQ ID NO: 2647889 - protein, 12 aa, Entamoeba histolytica
PTFGKEKKKAEL

SEQ ID NO: 2647890 - protein, 4 aa, Entamoeba histolytica
PTFK

SEQ ID NO: 2647891 - protein, 7 aa, Entamoeba histolytica
PTFNETD

SEQ ID NO: 2647892 - protein, 9 aa, Entamoeba histolytica
PTFPPQKEL

SEQ ID NO: 2647893 - protein, 20 aa, Entamoeba histolytica
PTFTSKPSYMKGASDSRPYI

SEQ ID NO: 2647894 - protein, 4 aa, Entamoeba histolytica
PTFV

SEQ ID NO: 2647895 - protein, 8 aa, Entamoeba histolytica
PTGAGKTT

SEQ ID NO: 2647896 - protein, 10 aa, Entamoeba histolytica
PTGDDYKKIS

SEQ ID NO: 2647897 - protein, 4 aa, Entamoeba histolytica
PTGG

SEQ ID NO: 2647898 - protein, 6 aa, Entamoeba histolytica
PTGGGK

SEQ ID NO: 2647899 - protein, 7 aa, Entamoeba histolytica
PTGGGKS

SEQ ID NO: 2647900 - protein, 4 aa, Entamoeba histolytica
PTGK

SEQ ID NO: 2647901 - protein, 12 aa, Entamoeba histolytica
PTGKIGQSLGIQ

SEQ ID NO: 2647902 - protein, 8 aa, Entamoeba histolytica
PTGPQNQR

SEQ ID NO: 2647903 - protein, 16 aa, Entamoeba histolytica
PTGSEAVDRKNTWRTR

SEQ ID NO: 2647904 - protein, 6 aa, Entamoeba histolytica
PTHEAN

SEQ ID NO: 2647905 - protein, 12 aa, Entamoeba histolytica
PTHNNGLDNEGY

SEQ ID NO: 2647906 - protein, 12 aa, Entamoeba histolytica
PTHNTKKQIQKE

SEQ ID NO: 2647907 - protein, 24 aa, Entamoeba histolytica
PTHPHERSSSISPQRKQRKQYTIT

SEQ ID NO: 2647908 - protein, 6 aa, Entamoeba histolytica
PTHPQG

SEQ ID NO: 2647909 - protein, 8 aa, Entamoeba histolytica
PTIDGTGF

SEQ ID NO: 2647910 - protein, 4 aa, Entamoeba histolytica
PTIE

SEQ ID NO: 2647911 - protein, 7 aa, Entamoeba histolytica
PTIEDSY

SEQ ID NO: 2647912 - protein, 6 aa, Entamoeba histolytica
PTIEET

SEQ ID NO: 2647913 - protein, 4 aa, Entamoeba histolytica
PTIG

SEQ ID NO: 2647914 - protein, 4 aa, Entamoeba histolytica
PTII

SEQ ID NO: 2647915 - protein, 4 aa, Entamoeba histolytica
PTIN

SEQ ID NO: 2647916 - protein, 4 aa, Entamoeba histolytica
PTIP

SEQ ID NO: 2647917 - protein, 10 aa, Entamoeba histolytica
PTIPASTPLS

SEQ ID NO: 2647918 - protein, 11 aa, Entamoeba histolytica
PTIPPSTPQKM

SEQ ID NO: 2647919 - protein, 32 aa, Entamoeba histolytica
PTIPTEKEVPSLTAKLEDEKVVEEKKIEVTKD

SEQ ID NO: 2647920 - protein, 5 aa, Entamoeba histolytica
PTIQN

SEQ ID NO: 2647921 - protein, 4 aa, Entamoeba histolytica
PTIR

SEQ ID NO: 2647922 - protein, 7 aa, Entamoeba histolytica
PTISEQP

SEQ ID NO: 2647923 - protein, 4 aa, Entamoeba histolytica
PTIT

SEQ ID NO: 2647924 - protein, 11 aa, Entamoeba histolytica
PTITCQPDKNK

SEQ ID NO: 2647925 - protein, 12 aa, Entamoeba histolytica
PTITQKSVSEIP

SEQ ID NO: 2647926 - protein, 15 aa, Entamoeba histolytica
PTKANITESSNDEKK

SEQ ID NO: 2647927 - protein, 8 aa, Entamoeba histolytica
PTKCPKAL

SEQ ID NO: 2647928 - protein, 4 aa, Entamoeba histolytica
PTKD

SEQ ID NO: 2647929 - protein, 8 aa, Entamoeba histolytica
PTKEDREN

SEQ ID NO: 2647930 - protein, 6 aa, Entamoeba histolytica
PTKEQE

SEQ ID NO: 2647931 - protein, 7 aa, Entamoeba histolytica
PTKESVD

SEQ ID NO: 2647932 - protein, 4 aa, Entamoeba histolytica
PTKG

SEQ ID NO: 2647933 - protein, 5 aa, Entamoeba histolytica
PTKGN

SEQ ID NO: 2647934 - protein, 6 aa, Entamoeba histolytica
PTKGNA

SEQ ID NO: 2647935 - protein, 13 aa, Entamoeba histolytica
PTKGSLSKPSDCL

SEQ ID NO: 2647936 - protein, 61 aa, Entamoeba histolytica
PTKGVSKEREIKKEQRTSLNNKSSLFKRKKDDEIVPKPQLSPRQNKGKTIIASPRKKPGKI

SEQ ID NO: 2647937 - protein, 7 aa, Entamoeba histolytica
PTKIESL

SEQ ID NO: 2647938 - protein, 9 aa, Entamoeba histolytica
PTKKEWEPQ

SEQ ID NO: 2647939 - protein, 8 aa, Entamoeba histolytica
PTKNNPNK

SEQ ID NO: 2647940 - protein, 9 aa, Entamoeba histolytica
PTKNWTKND

SEQ ID NO: 2647941 - protein, 7 aa, Entamoeba histolytica
PTKPQLD

SEQ ID NO: 2647942 - protein, 38 aa, Entamoeba histolytica
PTKPSIEQQLKAKEENSIPNEEKKEQLKKEMKQEANTI

SEQ ID NO: 2647943 - protein, 16 aa, Entamoeba histolytica
PTKRNGNTQNHPTNDV

SEQ ID NO: 2647944 - protein, 7 aa, Entamoeba histolytica
PTKSYRE

SEQ ID NO: 2647945 - protein, 7 aa, Entamoeba histolytica
PTKYQPL

SEQ ID NO: 2647946 - protein, 5 aa, Entamoeba histolytica
PTLDI

SEQ ID NO: 2647947 - protein, 6 aa, Entamoeba histolytica
PTLGEL

SEQ ID NO: 2647948 - protein, 4 aa, Entamoeba histolytica
PTLN

SEQ ID NO: 2647949 - protein, 19 aa, Entamoeba histolytica
PTLNGEKKKQVQQLPPSRS

SEQ ID NO: 2647950 - protein, 15 aa, Entamoeba histolytica
PTLNGQPNITTIPNG

SEQ ID NO: 2647951 - protein, 7 aa, Entamoeba histolytica
PTLQQKN

SEQ ID NO: 2647952 - protein, 5 aa, Entamoeba histolytica
PTLSE

SEQ ID NO: 2647953 - protein, 18 aa, Entamoeba histolytica
PTLSQQSSTIGEEVESTN

SEQ ID NO: 2647954 - protein, 10 aa, Entamoeba histolytica
PTLTPYSQEQ

SEQ ID NO: 2647955 - protein, 4 aa, Entamoeba histolytica
PTMD

SEQ ID NO: 2647956 - protein, 4 aa, Entamoeba histolytica
PTML

SEQ ID NO: 2647957 - protein, 12 aa, Entamoeba histolytica
PTMSATKKTDAY

SEQ ID NO: 2647958 - protein, 8 aa, Entamoeba histolytica
PTNDIPKD

SEQ ID NO: 2647959 - protein, 7 aa, Entamoeba histolytica
PTNEPQH

SEQ ID NO: 2647960 - protein, 8 aa, Entamoeba histolytica
PTNETITP

SEQ ID NO: 2647961 - protein, 5 aa, Entamoeba histolytica
PTNGA

SEQ ID NO: 2647962 - protein, 4 aa, Entamoeba histolytica
PTNH

SEQ ID NO: 2647963 - protein, 9 aa, Entamoeba histolytica
PTNHLDADS

SEQ ID NO: 2647964 - protein, 10 aa, Entamoeba histolytica
PTNKLKKIDD

SEQ ID NO: 2647965 - protein, 6 aa, Entamoeba histolytica
PTNKSI

SEQ ID NO: 2647966 - protein, 6 aa, Entamoeba histolytica
PTNNGT

SEQ ID NO: 2647967 - protein, 8 aa, Entamoeba histolytica
PTNPTNNR

SEQ ID NO: 2647968 - protein, 5 aa, Entamoeba histolytica
PTNQR

SEQ ID NO: 2647969 - protein, 7 aa, Entamoeba histolytica
PTNSNPL

SEQ ID NO: 2647970 - protein, 9 aa, Entamoeba histolytica
PTNTEEASW

SEQ ID NO: 2647971 - protein, 5 aa, Entamoeba histolytica
PTNVN

SEQ ID NO: 2647972 - protein, 5 aa, Entamoeba histolytica
PTNVS

SEQ ID NO: 2647973 - protein, 6 aa, Entamoeba histolytica
PTPAQI

SEQ ID NO: 2647974 - protein, 4 aa, Entamoeba histolytica
PTPD

SEQ ID NO: 2647975 - protein, 9 aa, Entamoeba histolytica
PTPDTQQIE

SEQ ID NO: 2647976 - protein, 5 aa, Entamoeba histolytica
PTPFE

SEQ ID NO: 2647977 - protein, 5 aa, Entamoeba histolytica
PTPIE

SEQ ID NO: 2647978 - protein, 10 aa, Entamoeba histolytica
PTPKRYNQNT

SEQ ID NO: 2647979 - protein, 7 aa, Entamoeba histolytica
PTPLNPR

SEQ ID NO: 2647980 - protein, 12 aa, Entamoeba histolytica
PTPNNSTNENTI

SEQ ID NO: 2647981 - protein, 7 aa, Entamoeba histolytica
PTPPNAR

SEQ ID NO: 2647982 - protein, 5 aa, Entamoeba histolytica
PTPQR

SEQ ID NO: 2647983 - protein, 6 aa, Entamoeba histolytica
PTPSKF

SEQ ID NO: 2647984 - protein, 8 aa, Entamoeba histolytica
PTPSPKRT

SEQ ID NO: 2647985 - protein, 7 aa, Entamoeba histolytica
PTPSQQN

SEQ ID NO: 2647986 - protein, 7 aa, Entamoeba histolytica
PTPSTHE

SEQ ID NO: 2647987 - protein, 8 aa, Entamoeba histolytica
PTPSVENI

SEQ ID NO: 2647988 - protein, 4 aa, Entamoeba histolytica
PTPV

SEQ ID NO: 2647989 - protein, 4 aa, Entamoeba histolytica
PTPY

SEQ ID NO: 2647990 - protein, 18 aa, Entamoeba histolytica
PTQADDQQQLTKKRHVGN

SEQ ID NO: 2647991 - protein, 5 aa, Entamoeba histolytica
PTQEE

SEQ ID NO: 2647992 - protein, 6 aa, Entamoeba histolytica
PTQEQR

SEQ ID NO: 2647993 - protein, 5 aa, Entamoeba histolytica
PTQFQ

SEQ ID NO: 2647994 - protein, 7 aa, Entamoeba histolytica
PTQINQK

SEQ ID NO: 2647995 - protein, 23 aa, Entamoeba histolytica
PTQRPLPPTPTQRPLPPTPTPQQ

SEQ ID NO: 2647996 - protein, 4 aa, Entamoeba histolytica
PTQS

SEQ ID NO: 2647997 - protein, 8 aa, Entamoeba histolytica
PTQTPYEG

SEQ ID NO: 2647998 - protein, 5 aa, Entamoeba histolytica
PTQTR

SEQ ID NO: 2647999 - protein, 5 aa, Entamoeba histolytica
PTQYG

SEQ ID NO: 2648000 - protein, 16 aa, Entamoeba histolytica
PTREDLGYDPEGADST

SEQ ID NO: 2648001 - protein, 4 aa, Entamoeba histolytica
PTRF

SEQ ID NO: 2648002 - protein, 4 aa, Entamoeba histolytica
PTRP

SEQ ID NO: 2648003 - protein, 4 aa, Entamoeba histolytica
PTRR

SEQ ID NO: 2648004 - protein, 10 aa, Entamoeba histolytica
PTSDHPSATV

SEQ ID NO: 2648005 - protein, 10 aa, Entamoeba histolytica
PTSDNDIQKL

SEQ ID NO: 2648006 - protein, 5 aa, Entamoeba histolytica
PTSDQ

SEQ ID NO: 2648007 - protein, 10 aa, Entamoeba histolytica
PTSESTKGIT

SEQ ID NO: 2648008 - protein, 5 aa, Entamoeba histolytica
PTSFD

SEQ ID NO: 2648009 - protein, 21 aa, Entamoeba histolytica
PTSLEASLSESHIDSKDMSPR

SEQ ID NO: 2648010 - protein, 4 aa, Entamoeba histolytica
PTSN

SEQ ID NO: 2648011 - protein, 8 aa, Entamoeba histolytica
PTSNTNRN

SEQ ID NO: 2648012 - protein, 59 aa, Entamoeba histolytica
  misc_feature (13)..(46): Xaa can be any naturally occurring amino acid
PTSNWTNEEMDTXXXXXXXXXXXXXXXXXXXXXXXXXXXXXXXXXXTKLFKRYSNFCFT

SEQ ID NO: 2648013 - protein, 6 aa, Entamoeba histolytica
PTSPID

SEQ ID NO: 2648014 - protein, 5 aa, Entamoeba histolytica
PTSPM

SEQ ID NO: 2648015 - protein, 9 aa, Entamoeba histolytica
PTSQCSKEE

SEQ ID NO: 2648016 - protein, 7 aa, Entamoeba histolytica
PTSQDHW

SEQ ID NO: 2648017 - protein, 7 aa, Entamoeba histolytica
PTSRELP

SEQ ID NO: 2648018 - protein, 10 aa, Entamoeba histolytica
PTSSDLNNDI

SEQ ID NO: 2648019 - protein, 14 aa, Entamoeba histolytica
PTSSPYTVTYCGEL

SEQ ID NO: 2648020 - protein, 17 aa, Entamoeba histolytica
PTSTLQNTTTGQPIQQP

SEQ ID NO: 2648021 - protein, 8 aa, Entamoeba histolytica
PTSTRRNL

SEQ ID NO: 2648022 - protein, 4 aa, Entamoeba histolytica
PTSV

SEQ ID NO: 2648023 - protein, 7 aa, Entamoeba histolytica
PTSVNEI

SEQ ID NO: 2648024 - protein, 6 aa, Entamoeba histolytica
PTSVSK

SEQ ID NO: 2648025 - protein, 10 aa, Entamoeba histolytica
PTSVSKIGNG

SEQ ID NO: 2648026 - protein, 5 aa, Entamoeba histolytica
PTSVT

SEQ ID NO: 2648027 - protein, 4 aa, Entamoeba histolytica
PTTA

SEQ ID NO: 2648028 - protein, 24 aa, Entamoeba histolytica
PTTDISQQPTNSKVNQPEERQVQP

SEQ ID NO: 2648029 - protein, 5 aa, Entamoeba histolytica
PTTEI

SEQ ID NO: 2648030 - protein, 4 aa, Entamoeba histolytica
PTTF

SEQ ID NO: 2648031 - protein, 17 aa, Entamoeba histolytica
PTTGITQQWRNSKNEIA

SEQ ID NO: 2648032 - protein, 5 aa, Entamoeba histolytica
PTTHY

SEQ ID NO: 2648033 - protein, 7 aa, Entamoeba histolytica
PTTIEPN

SEQ ID NO: 2648034 - protein, 6 aa, Entamoeba histolytica
PTTIPN

SEQ ID NO: 2648035 - protein, 25 aa, Entamoeba histolytica
PTTKQTNSKQTKSEIIQPTESFNPL

SEQ ID NO: 2648036 - protein, 5 aa, Entamoeba histolytica
PTTKY

SEQ ID NO: 2648037 - protein, 15 aa, Entamoeba histolytica
PTTLTDKQKRELLKI

SEQ ID NO: 2648038 - protein, 5 aa, Entamoeba histolytica
PTTNL

SEQ ID NO: 2648039 - protein, 7 aa, Entamoeba histolytica
PTTNPIY

SEQ ID NO: 2648040 - protein, 5 aa, Entamoeba histolytica
PTTNS

SEQ ID NO: 2648041 - protein, 4 aa, Entamoeba histolytica
PTTP

SEQ ID NO: 2648042 - protein, 7 aa, Entamoeba histolytica
PTTPSIQ

SEQ ID NO: 2648043 - protein, 8 aa, Entamoeba histolytica
PTTPYTDN

SEQ ID NO: 2648044 - protein, 15 aa, Entamoeba histolytica
PTTQKEAQSEEELND

SEQ ID NO: 2648045 - protein, 5 aa, Entamoeba histolytica
PTTRS

SEQ ID NO: 2648046 - protein, 40 aa, Entamoeba histolytica
PTTSNVQSDRKDNFTKENEDKNENNVDDDTITEVASETEE

SEQ ID NO: 2648047 - protein, 15 aa, Entamoeba histolytica
PTTSTRSDNSDNRFR

SEQ ID NO: 2648048 - protein, 4 aa, Entamoeba histolytica
PTTT

SEQ ID NO: 2648049 - protein, 8 aa, Entamoeba histolytica
PTTTHSGE

SEQ ID NO: 2648050 - protein, 16 aa, Entamoeba histolytica
PTTTPRLPSNYNSHQN

SEQ ID NO: 2648051 - protein, 6 aa, Entamoeba histolytica
PTTTPT

SEQ ID NO: 2648052 - protein, 8 aa, Entamoeba histolytica
PTTTPTYK

SEQ ID NO: 2648053 - protein, 5 aa, Entamoeba histolytica
PTTVP

SEQ ID NO: 2648054 - protein, 7 aa, Entamoeba histolytica
PTTVSEI

SEQ ID NO: 2648055 - protein, 5 aa, Entamoeba histolytica
PTVGG

SEQ ID NO: 2648056 - protein, 4 aa, Entamoeba histolytica
PTVN

SEQ ID NO: 2648057 - protein, 27 aa, Entamoeba histolytica
PTVQNNENEQKIVQTNKDENKPKNEVV

SEQ ID NO: 2648058 - protein, 8 aa, Entamoeba histolytica
PTVSTEGL

SEQ ID NO: 2648059 - protein, 4 aa, Entamoeba histolytica
PTYF

SEQ ID NO: 2648060 - protein, 22 aa, Entamoeba histolytica
PTYLSQEQKDELKKVLSNVSNW

SEQ ID NO: 2648061 - protein, 22 aa, Entamoeba histolytica
PTYLSQQQKDDLKKVLKTVHNW

SEQ ID NO: 2648062 - protein, 4 aa, Entamoeba histolytica
PTYP

SEQ ID NO: 2648063 - protein, 9 aa, Entamoeba histolytica
PTYPSPYGA

SEQ ID NO: 2648064 - protein, 6 aa, Entamoeba histolytica
PTYPTD

SEQ ID NO: 2648065 - protein, 7 aa, Entamoeba histolytica
PTYRSIH

SEQ ID NO: 2648066 - protein, 5 aa, Entamoeba histolytica
PTYRT

SEQ ID NO: 2648067 - protein, 8 aa, Entamoeba histolytica
PTYTQQQK

SEQ ID NO: 2648068 - protein, 10 aa, Entamoeba histolytica
PVAAGTVGNG

SEQ ID NO: 2648069 - protein, 33 aa, Entamoeba histolytica
PVAEQVKASSSHKSRSSHHTHLGEKKEKQNSAI

SEQ ID NO: 2648070 - protein, 6 aa, Entamoeba histolytica
PVAGET

SEQ ID NO: 2648071 - protein, 8 aa, Entamoeba histolytica
PVDDPNYN

SEQ ID NO: 2648072 - protein, 8 aa, Entamoeba histolytica
PVDEKYGR

SEQ ID NO: 2648073 - protein, 4 aa, Entamoeba histolytica
PVDP

SEQ ID NO: 2648074 - protein, 7 aa, Entamoeba histolytica
PVDPQLT

SEQ ID NO: 2648075 - protein, 17 aa, Entamoeba histolytica
PVDTHTQTSNLSKEKKL

SEQ ID NO: 2648076 - protein, 11 aa, Entamoeba histolytica
PVEDDEDERKF

SEQ ID NO: 2648077 - protein, 15 aa, Entamoeba histolytica
PVEGTETRVNASADC

SEQ ID NO: 2648078 - protein, 13 aa, Entamoeba histolytica
PVEGTVQRNRKAR

SEQ ID NO: 2648079 - protein, 14 aa, Entamoeba histolytica
PVEKDNDDKETSQI

SEQ ID NO: 2648080 - protein, 27 aa, Entamoeba histolytica
PVEPYKETTQQNDISQPIQQQNEFTQE

SEQ ID NO: 2648081 - protein, 12 aa, Entamoeba histolytica
PVEQPKKGKEIK

SEQ ID NO: 2648082 - protein, 7 aa, Entamoeba histolytica
PVEQSET

SEQ ID NO: 2648083 - protein, 18 aa, Entamoeba histolytica
PVETANEWKEGTSNEPDM

SEQ ID NO: 2648084 - protein, 4 aa, Entamoeba histolytica
PVGD

SEQ ID NO: 2648085 - protein, 12 aa, Entamoeba histolytica
PVGDKPQPPEPN

SEQ ID NO: 2648086 - protein, 11 aa, Entamoeba histolytica
PVGKYTQPFKT

SEQ ID NO: 2648087 - protein, 5 aa, Entamoeba histolytica
PVGNG

SEQ ID NO: 2648088 - protein, 4 aa, Entamoeba histolytica
PVID

SEQ ID NO: 2648089 - protein, 10 aa, Entamoeba histolytica
PVITQEGKEI

SEQ ID NO: 2648090 - protein, 4 aa, Entamoeba histolytica
PVKK

SEQ ID NO: 2648091 - protein, 10 aa, Entamoeba histolytica
PVKKDKEEIE

SEQ ID NO: 2648092 - protein, 4 aa, Entamoeba histolytica
PVKR

SEQ ID NO: 2648093 - protein, 24 aa, Entamoeba histolytica
PVKSDDKNKSQSSLKVENKTDDWG

SEQ ID NO: 2648094 - protein, 10 aa, Entamoeba histolytica
PVKSTPQSQI

SEQ ID NO: 2648095 - protein, 8 aa, Entamoeba histolytica
PVLESEDE

SEQ ID NO: 2648096 - protein, 4 aa, Entamoeba histolytica
PVNE

SEQ ID NO: 2648097 - protein, 35 aa, Entamoeba histolytica
PVNEPTTTTQQPYVPPVPQQQSISSQTTGNSSSNW

SEQ ID NO: 2648098 - protein, 9 aa, Entamoeba histolytica
PVNKPTYGK

SEQ ID NO: 2648099 - protein, 5 aa, Entamoeba histolytica
PVPER

SEQ ID NO: 2648100 - protein, 12 aa, Entamoeba histolytica
PVPSPSFTPNSS

SEQ ID NO: 2648101 - protein, 15 aa, Entamoeba histolytica
PVPSYPVPPSLDMTF

SEQ ID NO: 2648102 - protein, 5 aa, Entamoeba histolytica
PVPTP

SEQ ID NO: 2648103 - protein, 6 aa, Entamoeba histolytica
PVPTTT

SEQ ID NO: 2648104 - protein, 23 aa, Entamoeba histolytica
PVQKPKGRKKTNFSEEEEVPTES

SEQ ID NO: 2648105 - protein, 7 aa, Entamoeba histolytica
PVQNEKK

SEQ ID NO: 2648106 - protein, 8 aa, Entamoeba histolytica
PVRDGNAK

SEQ ID NO: 2648107 - protein, 4 aa, Entamoeba histolytica
PVRG

SEQ ID NO: 2648108 - protein, 30 aa, Entamoeba histolytica
PVRKNNNPQQTNQNEEEEMSEEMSDEEESD

SEQ ID NO: 2648109 - protein, 13 aa, Entamoeba histolytica
PVRKRSNSTRSGI

SEQ ID NO: 2648110 - protein, 5 aa, Entamoeba histolytica
PVRRD

SEQ ID NO: 2648111 - protein, 12 aa, Entamoeba histolytica
PVRTIKNSSKIS

SEQ ID NO: 2648112 - protein, 5 aa, Entamoeba histolytica
PVSDN

SEQ ID NO: 2648113 - protein, 10 aa, Entamoeba histolytica
PVSDRDSMRN

SEQ ID NO: 2648114 - protein, 12 aa, Entamoeba histolytica
PVSKEQRRKEPQ

SEQ ID NO: 2648115 - protein, 7 aa, Entamoeba histolytica
PVSKGKE

SEQ ID NO: 2648116 - protein, 34 aa, Entamoeba histolytica
PVSQPPPPIQKTEQTNQLNNGTNTPPLEQSEESI

SEQ ID NO: 2648117 - protein, 6 aa, Entamoeba histolytica
PVSQPT

SEQ ID NO: 2648118 - protein, 17 aa, Entamoeba histolytica
PVSRKSSFALPAPRQSI

SEQ ID NO: 2648119 - protein, 12 aa, Entamoeba histolytica
PVSSDRKPNTQL

SEQ ID NO: 2648120 - protein, 6 aa, Entamoeba histolytica
PVSSIQ

SEQ ID NO: 2648121 - protein, 8 aa, Entamoeba histolytica
PVSVPTSS

SEQ ID NO: 2648122 - protein, 29 aa, Entamoeba histolytica
PVTDPSSSTSSNTNSLNSSVNKTQNNAIP

SEQ ID NO: 2648123 - protein, 5 aa, Entamoeba histolytica
PVTGT

SEQ ID NO: 2648124 - protein, 4 aa, Entamoeba histolytica
PVTL

SEQ ID NO: 2648125 - protein, 7 aa, Entamoeba histolytica
PVTSEGC

SEQ ID NO: 2648126 - protein, 27 aa, Entamoeba histolytica
PVVAEEPKKVVEKKEEKKSKAGKKNAK

SEQ ID NO: 2648127 - protein, 27 aa, Entamoeba histolytica
PVVAEEPKKVVEKKEEKKSKAGKKTAK

SEQ ID NO: 2648128 - protein, 4 aa, Entamoeba histolytica
PVVE

SEQ ID NO: 2648129 - protein, 4 aa, Entamoeba histolytica
PVVP

SEQ ID NO: 2648130 - protein, 4 aa, Entamoeba histolytica
PVYQ

SEQ ID NO: 2648131 - protein, 28 aa, Entamoeba histolytica
PWGETPSTKKVNKEKKSNEENCQSQQQH

SEQ ID NO: 2648132 - protein, 14 aa, Entamoeba histolytica
PWGGPTKCRNKRSL

SEQ ID NO: 2648133 - protein, 9 aa, Entamoeba histolytica
PWNPPIPSN

SEQ ID NO: 2648134 - protein, 8 aa, Entamoeba histolytica
PWPKDSSI

SEQ ID NO: 2648135 - protein, 11 aa, Entamoeba histolytica
PWTSEEDNEIL

SEQ ID NO: 2648136 - protein, 10 aa, Entamoeba histolytica
PWTSNDDEKL

SEQ ID NO: 2648137 - protein, 5 aa, Entamoeba histolytica
PWTTK

SEQ ID NO: 2648138 - protein, 7 aa, Entamoeba histolytica
PYAPSAL

SEQ ID NO: 2648139 - protein, 10 aa, Entamoeba histolytica
PYDDDVPDDW

SEQ ID NO: 2648140 - protein, 18 aa, Entamoeba histolytica
PYDDDVPDDWGYASEQSI

SEQ ID NO: 2648141 - protein, 7 aa, Entamoeba histolytica
PYDDNKE

SEQ ID NO: 2648142 - protein, 6 aa, Entamoeba histolytica
PYDGEV

SEQ ID NO: 2648143 - protein, 7 aa, Entamoeba histolytica
PYDGSKN

SEQ ID NO: 2648144 - protein, 10 aa, Entamoeba histolytica
PYDVPSTFRE

SEQ ID NO: 2648145 - protein, 6 aa, Entamoeba histolytica
PYEEKY

SEQ ID NO: 2648146 - protein, 19 aa, Entamoeba histolytica
PYEENEINRYKEQKNKLEY

SEQ ID NO: 2648147 - protein, 5 aa, Entamoeba histolytica
PYEGY

SEQ ID NO: 2648148 - protein, 37 aa, Entamoeba histolytica
PYEQNQLTQTPSTQTQSENKFPITSQPKKIRTETYSG

SEQ ID NO: 2648149 - protein, 13 aa, Entamoeba histolytica
PYESNVSSKYSGY

SEQ ID NO: 2648150 - protein, 4 aa, Entamoeba histolytica
PYFD

SEQ ID NO: 2648151 - protein, 6 aa, Entamoeba histolytica
PYFGNG

SEQ ID NO: 2648152 - protein, 4 aa, Entamoeba histolytica
PYFT

SEQ ID NO: 2648153 - protein, 5 aa, Entamoeba histolytica
PYGAP

SEQ ID NO: 2648154 - protein, 5 aa, Entamoeba histolytica
PYGDL

SEQ ID NO: 2648155 - protein, 6 aa, Entamoeba histolytica
PYGGNQ

SEQ ID NO: 2648156 - protein, 13 aa, Entamoeba histolytica
PYGNARVTKDGVS

SEQ ID NO: 2648157 - protein, 56 aa, Entamoeba histolytica
PYGPNAAKCTKAQTTESKTEEQSNEEKKGESKDEQQPTESKETTKKDVKKGKEQKK

SEQ ID NO: 2648158 - protein, 5 aa, Entamoeba histolytica
PYGQR

SEQ ID NO: 2648159 - protein, 6 aa, Entamoeba histolytica
PYGTKP

SEQ ID NO: 2648160 - protein, 8 aa, Entamoeba histolytica
PYIKKGQA

SEQ ID NO: 2648161 - protein, 13 aa, Entamoeba histolytica
PYIPTSPKPKIPS

SEQ ID NO: 2648162 - protein, 4 aa, Entamoeba histolytica
PYIS

SEQ ID NO: 2648163 - protein, 4 aa, Entamoeba histolytica
PYKE

SEQ ID NO: 2648164 - protein, 5 aa, Entamoeba histolytica
PYKNE

SEQ ID NO: 2648165 - protein, 33 aa, Entamoeba histolytica
PYKQTKERVECSTKTTNEKKGSRTSTFYSQNGM

SEQ ID NO: 2648166 - protein, 13 aa, Entamoeba histolytica
PYKRSTGANIEQP

SEQ ID NO: 2648167 - protein, 12 aa, Entamoeba histolytica
PYKSNGYTSSQV

SEQ ID NO: 2648168 - protein, 4 aa, Entamoeba histolytica
PYLK

SEQ ID NO: 2648169 - protein, 8 aa, Entamoeba histolytica
PYNEKADI

SEQ ID NO: 2648170 - protein, 4 aa, Entamoeba histolytica
PYNP

SEQ ID NO: 2648171 - protein, 5 aa, Entamoeba histolytica
PYNPS

SEQ ID NO: 2648172 - protein, 4 aa, Entamoeba histolytica
PYNS

SEQ ID NO: 2648173 - protein, 5 aa, Entamoeba histolytica
PYNTP

SEQ ID NO: 2648174 - protein, 8 aa, Entamoeba histolytica
PYNVPPTR

SEQ ID NO: 2648175 - protein, 41 aa, Entamoeba histolytica
PYNYPQPNTYPYPQQQNTTQPNPYRNQQMTSSTLNPPGTYL

SEQ ID NO: 2648176 - protein, 5 aa, Entamoeba histolytica
PYPDH

SEQ ID NO: 2648177 - protein, 13 aa, Entamoeba histolytica
PYPDWKEGEEPPH

SEQ ID NO: 2648178 - protein, 5 aa, Entamoeba histolytica
PYPKE

SEQ ID NO: 2648179 - protein, 5 aa, Entamoeba histolytica
PYPPD

SEQ ID NO: 2648180 - protein, 6 aa, Entamoeba histolytica
PYPSEL

SEQ ID NO: 2648181 - protein, 4 aa, Entamoeba histolytica
PYQN

SEQ ID NO: 2648182 - protein, 7 aa, Entamoeba histolytica
PYQPYQP

SEQ ID NO: 2648183 - protein, 4 aa, Entamoeba histolytica
PYRG

SEQ ID NO: 2648184 - protein, 5 aa, Entamoeba histolytica
PYRHD

SEQ ID NO: 2648185 - protein, 5 aa, Entamoeba histolytica
PYRRA

SEQ ID NO: 2648186 - protein, 6 aa, Entamoeba histolytica
PYRRTT

SEQ ID NO: 2648187 - protein, 4 aa, Entamoeba histolytica
PYRT

SEQ ID NO: 2648188 - protein, 8 aa, Entamoeba histolytica
PYSDATNN

SEQ ID NO: 2648189 - protein, 7 aa, Entamoeba histolytica
PYSEHSS

SEQ ID NO: 2648190 - protein, 7 aa, Entamoeba histolytica
PYSEPSN

SEQ ID NO: 2648191 - protein, 12 aa, Entamoeba histolytica
PYSESYDQDQYY

SEQ ID NO: 2648192 - protein, 5 aa, Entamoeba histolytica
PYSGR

SEQ ID NO: 2648193 - protein, 4 aa, Entamoeba histolytica
PYSI

SEQ ID NO: 2648194 - protein, 4 aa, Entamoeba histolytica
PYSL

SEQ ID NO: 2648195 - protein, 10 aa, Entamoeba histolytica
PYSQQGPTTI

SEQ ID NO: 2648196 - protein, 6 aa, Entamoeba histolytica
PYSSSW

SEQ ID NO: 2648197 - protein, 9 aa, Entamoeba histolytica
PYSSTEKDV

SEQ ID NO: 2648198 - protein, 6 aa, Entamoeba histolytica
PYTGRP

SEQ ID NO: 2648199 - protein, 15 aa, Entamoeba histolytica
PYTSKGYSSSQVPKN

SEQ ID NO: 2648200 - protein, 8 aa, Entamoeba histolytica
PYTSPDGQ

SEQ ID NO: 2648201 - protein, 5 aa, Entamoeba histolytica
PYTTI

SEQ ID NO: 2648202 - protein, 5 aa, Entamoeba histolytica
PYVPS

SEQ ID NO: 2648203 - protein, 12 aa, Entamoeba histolytica
PYVPSEEPVDER

SEQ ID NO: 2648204 - protein, 4 aa, Entamoeba histolytica
PYYG

SEQ ID NO: 2648205 - protein, 5 aa, Entamoeba histolytica
QAAED

SEQ ID NO: 2648206 - protein, 8 aa, Entamoeba histolytica
QAAFGQAK

SEQ ID NO: 2648207 - protein, 48 aa, Entamoeba histolytica
  misc_feature (15)..(48): Xaa can be any naturally occurring amino acid
QAAFGQAKAFKDAVXXXXXXXXXXXXXXXXXXXXXXXXXXXXXXXXXX

SEQ ID NO: 2648208 - protein, 12 aa, Entamoeba histolytica
QAANNASGINSD

SEQ ID NO: 2648209 - protein, 14 aa, Entamoeba histolytica
QAAQKEMEEVFNKK

SEQ ID NO: 2648210 - protein, 4 aa, Entamoeba histolytica
QAAR

SEQ ID NO: 2648211 - protein, 23 aa, Entamoeba histolytica
QAAREAARREAEERRNKKQEERL

SEQ ID NO: 2648212 - protein, 9 aa, Entamoeba histolytica
QAAREKNEL

SEQ ID NO: 2648213 - protein, 8 aa, Entamoeba histolytica
QAARYDAN

SEQ ID NO: 2648214 - protein, 6 aa, Entamoeba histolytica
QAASEG

SEQ ID NO: 2648215 - protein, 10 aa, Entamoeba histolytica
QAATDPETGI

SEQ ID NO: 2648216 - protein, 4 aa, Entamoeba histolytica
QADD

SEQ ID NO: 2648217 - protein, 10 aa, Entamoeba histolytica
QADGDYNPDV

SEQ ID NO: 2648218 - protein, 5 aa, Entamoeba histolytica
QADIK

SEQ ID NO: 2648219 - protein, 6 aa, Entamoeba histolytica
QADKIE

SEQ ID NO: 2648220 - protein, 6 aa, Entamoeba histolytica
QADNKK

SEQ ID NO: 2648221 - protein, 6 aa, Entamoeba histolytica
QADNQR

SEQ ID NO: 2648222 - protein, 6 aa, Entamoeba histolytica
QADPSL

SEQ ID NO: 2648223 - protein, 6 aa, Entamoeba histolytica
QADPSS

SEQ ID NO: 2648224 - protein, 10 aa, Entamoeba histolytica
QADQKPREEV

SEQ ID NO: 2648225 - protein, 13 aa, Entamoeba histolytica
QADSLRKSKPELL

SEQ ID NO: 2648226 - protein, 9 aa, Entamoeba histolytica
QAEAVEEDL

SEQ ID NO: 2648227 - protein, 5 aa, Entamoeba histolytica
QAEDE

SEQ ID NO: 2648228 - protein, 7 aa, Entamoeba histolytica
QAEDPKA

SEQ ID NO: 2648229 - protein, 14 aa, Entamoeba histolytica
QAEEEDLENIPEQT

SEQ ID NO: 2648230 - protein, 8 aa, Entamoeba histolytica
QAEEVGRR

SEQ ID NO: 2648231 - protein, 9 aa, Entamoeba histolytica
QAEGDRNGI

SEQ ID NO: 2648232 - protein, 5 aa, Entamoeba histolytica
QAEGS

SEQ ID NO: 2648233 - protein, 4 aa, Entamoeba histolytica
QAEH

SEQ ID NO: 2648234 - protein, 15 aa, Entamoeba histolytica
QAEKKENRLKGVEAT

SEQ ID NO: 2648235 - protein, 4 aa, Entamoeba histolytica
QAEN

SEQ ID NO: 2648236 - protein, 33 aa, Entamoeba histolytica
QAEPPKEEKIEKEVEEQPQQVTKEDTQSGPFEN

SEQ ID NO: 2648237 - protein, 17 aa, Entamoeba histolytica
QAEPQLKRSHSSQITRK

SEQ ID NO: 2648238 - protein, 11 aa, Entamoeba histolytica
QAESTDDKYRK

SEQ ID NO: 2648239 - protein, 41 aa, Entamoeba histolytica; identical to SEQ ID NO: 2453187

SEQ ID NO: 2648240 - protein, 10 aa, Entamoeba histolytica
QAGCQGSKSH

SEQ ID NO: 2648241 - protein, 8 aa, Entamoeba histolytica
QAGGDIGK

SEQ ID NO: 2648242 - protein, 10 aa, Entamoeba histolytica
QAGGHGGSHQ

SEQ ID NO: 2648243 - protein, 16 aa, Entamoeba histolytica
QAGIRKKDLQDETTRK

SEQ ID NO: 2648244 - protein, 5 aa, Entamoeba histolytica
QAGNN

SEQ ID NO: 2648245 - protein, 6 aa, Entamoeba histolytica
QAHPQE

SEQ ID NO: 2648246 - protein, 4 aa, Entamoeba histolytica
QAIE

SEQ ID NO: 2648247 - protein, 11 aa, Entamoeba histolytica
QAIGARSQSCR

SEQ ID NO: 2648248 - protein, 12 aa, Entamoeba histolytica
QAIKKTKEQLAA

SEQ ID NO: 2648249 - protein, 17 aa, Entamoeba histolytica
QAINEKDKIGKELAEKI

SEQ ID NO: 2648250 - protein, 7 aa, Entamoeba histolytica
QAIPGDN

SEQ ID NO: 2648251 - protein, 5 aa, Entamoeba histolytica
QAKDL

SEQ ID NO: 2648252 - protein, 10 aa, Entamoeba histolytica
QAKEEEKDFA

SEQ ID NO: 2648253 - protein, 9 aa, Entamoeba histolytica
QAKEIGGNK

SEQ ID NO: 2648254 - protein, 9 aa, Entamoeba histolytica
QAKEKYGDA

SEQ ID NO: 2648255 - protein, 5 aa, Entamoeba histolytica
QAKEN

SEQ ID NO: 2648256 - protein, 28 aa, Entamoeba histolytica
QAKKESASRGLKAARAAAKAKKEAEVKT

SEQ ID NO: 2648257 - protein, 22 aa, Entamoeba histolytica
QAKKKAEEQQKLSSQEEEKKVI

SEQ ID NO: 2648258 - protein, 14 aa, Entamoeba histolytica
QAKNELSKKLEDAQ

SEQ ID NO: 2648259 - protein, 9 aa, Entamoeba histolytica
QAKNVLPKT

SEQ ID NO: 2648260 - protein, 14 aa, Entamoeba histolytica
QAKPDDIEECNDGN

SEQ ID NO: 2648261 - protein, 17 aa, Entamoeba histolytica
QAKPQGEKEIREKTGIE

SEQ ID NO: 2648262 - protein, 5 aa, Entamoeba histolytica
QAKSA

SEQ ID NO: 2648263 - protein, 9 aa, Entamoeba histolytica
QAKSSDFTS

SEQ ID NO: 2648264 - protein, 6 aa, Entamoeba histolytica
QAKTSD

SEQ ID NO: 2648265 - protein, 7 aa, Entamoeba histolytica
QALPPSK

SEQ ID NO: 2648266 - protein, 9 aa, Entamoeba histolytica
QALSPDEKI

SEQ ID NO: 2648267 - protein, 8 aa, Entamoeba histolytica
QANATANK

SEQ ID NO: 2648268 - protein, 4 aa, Entamoeba histolytica
QANH

SEQ ID NO: 2648269 - protein, 8 aa, Entamoeba histolytica
QANKEGVE

SEQ ID NO: 2648270 - protein, 12 aa, Entamoeba histolytica
QANNTTSSSDGV

SEQ ID NO: 2648271 - protein, 6 aa, Entamoeba histolytica
QANQED

SEQ ID NO: 2648272 - protein, 7 aa, Entamoeba histolytica
QANQRNK

SEQ ID NO: 2648273 - protein, 11 aa, Entamoeba histolytica
QANQYFPSYGS

SEQ ID NO: 2648274 - protein, 7 aa, Entamoeba histolytica
QANTNGI

SEQ ID NO: 2648275 - protein, 9 aa, Entamoeba histolytica
QANYKYKQE

SEQ ID NO: 2648276 - protein, 11 aa, Entamoeba histolytica
QAPAKAKGQIS

SEQ ID NO: 2648277 - protein, 5 aa, Entamoeba histolytica
QAPDI

SEQ ID NO: 2648278 - protein, 7 aa, Entamoeba histolytica
QAPEERA

SEQ ID NO: 2648279 - protein, 5 aa, Entamoeba histolytica
QAPKV

SEQ ID NO: 2648280 - protein, 4 aa, Entamoeba histolytica
QAPN

SEQ ID NO: 2648281 - protein, 14 aa, Entamoeba histolytica
QAPPQRQRSRPSNT

SEQ ID NO: 2648282 - protein, 7 aa, Entamoeba histolytica
QAPTEDD

SEQ ID NO: 2648283 - protein, 6 aa, Entamoeba histolytica
QAPTTT

SEQ ID NO: 2648284 - protein, 10 aa, Entamoeba histolytica
QAQEQGELSF

SEQ ID NO: 2648285 - protein, 8 aa, Entamoeba histolytica
QAQGDFNR

SEQ ID NO: 2648286 - protein, 4 aa, Entamoeba histolytica
QAQI

SEQ ID NO: 2648287 - protein, 8 aa, Entamoeba histolytica
QAQKSTDD

SEQ ID NO: 2648288 - protein, 19 aa, Entamoeba histolytica
QAQQEQHQEQEVEKSTQTD

SEQ ID NO: 2648289 - protein, 25 aa, Entamoeba histolytica
QAQRETKKAEIEQQKQEEELSRQEE

SEQ ID NO: 2648290 - protein, 11 aa, Entamoeba histolytica
QAQSGTGKTAA

SEQ ID NO: 2648291 - protein, 4 aa, Entamoeba histolytica
QAQT

SEQ ID NO: 2648292 - protein, 12 aa, Entamoeba histolytica
QAQYKKEKDCVL

SEQ ID NO: 2648293 - protein, 12 aa, Entamoeba histolytica
QAREKHLLIILE

SEQ ID NO: 2648294 - protein, 11 aa, Entamoeba histolytica
QARKDQEEKQR

SEQ ID NO: 2648295 - protein, 7 aa, Entamoeba histolytica
QARNQNE

SEQ ID NO: 2648296 - protein, 6 aa, Entamoeba histolytica
QASEHS

SEQ ID NO: 2648297 - protein, 5 aa, Entamoeba histolytica
QASQG

SEQ ID NO: 2648298 - protein, 10 aa, Entamoeba histolytica
QASQGEPGEI

SEQ ID NO: 2648299 - protein, 6 aa, Entamoeba histolytica
QASVAT

SEQ ID NO: 2648300 - protein, 11 aa, Entamoeba histolytica
QATASKKKSGW

SEQ ID NO: 2648301 - protein, 8 aa, Entamoeba histolytica
QATESAQE

SEQ ID NO: 2648302 - protein, 9 aa, Entamoeba histolytica
QATGKSEQL

SEQ ID NO: 2648303 - protein, 12 aa, Entamoeba histolytica
QATGYASDAYTA

SEQ ID NO: 2648304 - protein, 10 aa, Entamoeba histolytica
QATIETGKDY

SEQ ID NO: 2648305 - protein, 5 aa, Entamoeba histolytica
QATIK

SEQ ID NO: 2648306 - protein, 11 aa, Entamoeba histolytica
QATKTSAQQLE

SEQ ID NO: 2648307 - protein, 62 aa, Entamoeba histolytica
QATNTKEIKSDDNQQQKTETQKEISNSIEEDKNKSKTQIEKEEEQEIQKENTESQEQETSDI

SEQ ID NO: 2648308 - protein, 4 aa, Entamoeba histolytica
QATP

SEQ ID NO: 2648309 - protein, 9 aa, Entamoeba histolytica
QATQIQQQQ

SEQ ID NO: 2648310 - protein, 4 aa, Entamoeba histolytica
QATS

SEQ ID NO: 2648311 - protein, 53 aa, Entamoeba histolytica
QATTLEKQESFETPSISTPPLNIPQDRRSYIPDDEDEDELKELEGYDPNITVD

SEQ ID NO: 2648312 - protein, 5 aa, Entamoeba histolytica
QAVES

SEQ ID NO: 2648313 - protein, 6 aa, Entamoeba histolytica
QAVKEG

SEQ ID NO: 2648314 - protein, 6 aa, Entamoeba histolytica
QAVPTE

SEQ ID NO: 2648315 - protein, 8 aa, Entamoeba histolytica
QAVQENKP

SEQ ID NO: 2648316 - protein, 7 aa, Entamoeba histolytica
QAVSPNE

SEQ ID NO: 2648317 - protein, 12 aa, Entamoeba histolytica
QAVSTQIERGTP

SEQ ID NO: 2648318 - protein, 16 aa, Entamoeba histolytica
QAYSSQDQEYEKNEFY

SEQ ID NO: 2648319 - protein, 4 aa, Entamoeba histolytica
QCAQ

SEQ ID NO: 2648320 - protein, 17 aa, Entamoeba histolytica
QCDKAREELQKEKGSIQ

SEQ ID NO: 2648321 - protein, 7 aa, Entamoeba histolytica
QCEGGST

SEQ ID NO: 2648322 - protein, 9 aa, Entamoeba histolytica
QCEQEESLD

SEQ ID NO: 2648323 - protein, 6 aa, Entamoeba histolytica
QCESSH

SEQ ID NO: 2648324 - protein, 17 aa, Entamoeba histolytica
QCGAGQPKIPPAKKADF

SEQ ID NO: 2648325 - protein, 17 aa, Entamoeba histolytica
QCGKQNDAQRSERYKEL

SEQ ID NO: 2648326 - protein, 5 aa, Entamoeba histolytica
QCGNA

SEQ ID NO: 2648327 - protein, 8 aa, Entamoeba histolytica
QCKNTKEI

SEQ ID NO: 2648328 - protein, 8 aa, Entamoeba histolytica
QCKSTDNT

SEQ ID NO: 2648329 - protein, 10 aa, Entamoeba histolytica
QCNDSQGEDI

SEQ ID NO: 2648330 - protein, 6 aa, Entamoeba histolytica
QCNSEG

SEQ ID NO: 2648331 - protein, 7 aa, Entamoeba histolytica
QCRDDEK

SEQ ID NO: 2648332 - protein, 5 aa, Entamoeba histolytica
QCSER

SEQ ID NO: 2648333 - protein, 8 aa, Entamoeba histolytica
QCSNAEKK

SEQ ID NO: 2648334 - protein, 11 aa, Entamoeba histolytica
QCSRKESKVTF

SEQ ID NO: 2648335 - protein, 8 aa, Entamoeba histolytica
QCTNEQKS

SEQ ID NO: 2648336 - protein, 5 aa, Entamoeba histolytica
QCTQQ

SEQ ID NO: 2648337 - protein, 11 aa, Entamoeba histolytica
QCTSDSSSPLI

SEQ ID NO: 2648338 - protein, 11 aa, Entamoeba histolytica
QDADDRPKEQF

SEQ ID NO: 2648339 - protein, 5 aa, Entamoeba histolytica
QDAEI

SEQ ID NO: 2648340 - protein, 60 aa, Entamoeba histolytica
QDAKNEKLKEKTTKDKIIEEKERDIKKIEKEYEKQKGLINSAKKKKARAEEEKKQNEKAV

SEQ ID NO: 2648341 - protein, 5 aa, Entamoeba histolytica
QDAPD

SEQ ID NO: 2648342 - protein, 12 aa, Entamoeba histolytica
QDATSTSGFTEQ

SEQ ID NO: 2648343 - protein, 8 aa, Entamoeba histolytica
QDCEEEEG

SEQ ID NO: 2648344 - protein, 12 aa, Entamoeba histolytica
QDDKRTDDTKNV

SEQ ID NO: 2648345 - protein, 9 aa, Entamoeba histolytica
QDDNDKELK

SEQ ID NO: 2648346 - protein, 12 aa, Entamoeba histolytica
QDDNRNNETQPL

SEQ ID NO: 2648347 - protein, 9 aa, Entamoeba histolytica
QDDNSSRFI

SEQ ID NO: 2648348 - protein, 5 aa, Entamoeba histolytica
QDDNY

SEQ ID NO: 2648349 - protein, 9 aa, Entamoeba histolytica
QDDSIQENL

SEQ ID NO: 2648350 - protein, 8 aa, Entamoeba histolytica
QDDSPDTA

SEQ ID NO: 2648351 - protein, 26 aa, Entamoeba histolytica
QDDVNNKTTENERKKKRDQEIQEEIN

SEQ ID NO: 2648352 - protein, 14 aa, Entamoeba histolytica
QDEAKEKNSTIGEL

SEQ ID NO: 2648353 - protein, 23 aa, Entamoeba histolytica
QDEEDDDDSENADPLKPKIEEDL

SEQ ID NO: 2648354 - protein, 8 aa, Entamoeba histolytica
QDEFQKGC

SEQ ID NO: 2648355 - protein, 12 aa, Entamoeba histolytica
QDEGYEAKKGFY

SEQ ID NO: 2648356 - protein, 7 aa, Entamoeba histolytica
QDEKSKK

SEQ ID NO: 2648357 - protein, 6 aa, Entamoeba histolytica
QDEKTD

SEQ ID NO: 2648358 - protein, 5 aa, Entamoeba histolytica
QDELR

SEQ ID NO: 2648359 - protein, 5 aa, Entamoeba histolytica
QDELV

SEQ ID NO: 2648360 - protein, 10 aa, Entamoeba histolytica
QDEPPKKEIK

SEQ ID NO: 2648361 - protein, 10 aa, Entamoeba histolytica
QDEQNKDQVA

SEQ ID NO: 2648362 - protein, 7 aa, Entamoeba histolytica
QDETIET

SEQ ID NO: 2648363 - protein, 5 aa, Entamoeba histolytica
QDFQD

SEQ ID NO: 2648364 - protein, 14 aa, Entamoeba histolytica
QDGDVTVSNDGATI

SEQ ID NO: 2648365 - protein, 6 aa, Entamoeba histolytica
QDGEHT

SEQ ID NO: 2648366 - protein, 8 aa, Entamoeba histolytica
QDGFAEQN

SEQ ID NO: 2648367 - protein, 8 aa, Entamoeba histolytica
QDGKTTMA

SEQ ID NO: 2648368 - protein, 13 aa, Entamoeba histolytica
QDGLLQPGEEQNV

SEQ ID NO: 2648369 - protein, 11 aa, Entamoeba histolytica
QDGLRQAGLES

SEQ ID NO: 2648370 - protein, 6 aa, Entamoeba histolytica
QDGNLG

SEQ ID NO: 2648371 - protein, 5 aa, Entamoeba histolytica
QDGTI

SEQ ID NO: 2648372 - protein, 6 aa, Entamoeba histolytica
QDHNNA

SEQ ID NO: 2648373 - protein, 5 aa, Entamoeba histolytica
QDHQP

SEQ ID NO: 2648374 - protein, 4 aa, Entamoeba histolytica
QDIA

SEQ ID NO: 2648375 - protein, 5 aa, Entamoeba histolytica
QDIAT

SEQ ID NO: 2648376 - protein, 54 aa, Entamoeba histolytica
QDIEDAKTLYKDKTEKKEFEKERKENENKETEIKENTNSNNDDDGIKKEDKIDI

SEQ ID NO: 2648377 - protein, 19 aa, Entamoeba histolytica
QDIESHKKEHIRKPNTRNH

SEQ ID NO: 2648378 - protein, 9 aa, Entamoeba histolytica
QDIETERKR

SEQ ID NO: 2648379 - protein, 6 aa, Entamoeba histolytica
QDIGNE

SEQ ID NO: 2648380 - protein, 14 aa, Entamoeba histolytica
QDIKERKRKSAMYT

SEQ ID NO: 2648381 - protein, 4 aa, Entamoeba histolytica
QDIN

SEQ ID NO: 2648382 - protein, 13 aa, Entamoeba histolytica
QDINKDNSKNILP

SEQ ID NO: 2648383 - protein, 6 aa, Entamoeba histolytica
QDISNY

SEQ ID NO: 2648384 - protein, 6 aa, Entamoeba histolytica
QDITDE

SEQ ID NO: 2648385 - protein, 9 aa, Entamoeba histolytica
QDKDERPSI

SEQ ID NO: 2648386 - protein, 13 aa, Entamoeba histolytica
QDKDFIEKVEEMI

SEQ ID NO: 2648387 - protein, 11 aa, Entamoeba histolytica
QDKDGKIKASD

SEQ ID NO: 2648388 - protein, 11 aa, Entamoeba histolytica
QDKEVGDGTTT

SEQ ID NO: 2648389 - protein, 5 aa, Entamoeba histolytica
QDKGI

SEQ ID NO: 2648390 - protein, 25 aa, Entamoeba histolytica
QDKINTKEEKAEKKKNPNNKLKNEW

SEQ ID NO: 2648391 - protein, 6 aa, Entamoeba histolytica
QDKKED

SEQ ID NO: 2648392 - protein, 6 aa, Entamoeba histolytica
QDKPSC

SEQ ID NO: 2648393 - protein, 6 aa, Entamoeba histolytica
QDKQEI

SEQ ID NO: 2648394 - protein, 7 aa, Entamoeba histolytica
QDKSDGL

SEQ ID NO: 2648395 - protein, 7 aa, Entamoeba histolytica
QDKSEFN

SEQ ID NO: 2648396 - protein, 58 aa, Entamoeba histolytica
QDKTPIKTTGLKEESQVCTEQKSYNKQPLTQSQPSVIQPTATPKPKEETQQDKKEEHF

SEQ ID NO: 2648397 - protein, 6 aa, Entamoeba histolytica
QDKWES

SEQ ID NO: 2648398 - protein, 7 aa, Entamoeba histolytica
QDKYTEA

SEQ ID NO: 2648399 - protein, 4 aa, Entamoeba histolytica
QDLE

SEQ ID NO: 2648400 - protein, 13 aa, Entamoeba histolytica
QDLEESYSPSPFN

SEQ ID NO: 2648401 - protein, 8 aa, Entamoeba histolytica
QDLPKTPF

SEQ ID NO: 2648402 - protein, 8 aa, Entamoeba histolytica
QDLQDEIT

SEQ ID NO: 2648403 - protein, 10 aa, Entamoeba histolytica
QDMEKQDKLG

SEQ ID NO: 2648404 - protein, 4 aa, Entamoeba histolytica
QDMS

SEQ ID NO: 2648405 - protein, 8 aa, Entamoeba histolytica
QDNDNDED

SEQ ID NO: 2648406 - protein, 7 aa, Entamoeba histolytica
QDNDRKI

SEQ ID NO: 2648407 - protein, 4 aa, Entamoeba histolytica
QDNF

SEQ ID NO: 2648408 - protein, 5 aa, Entamoeba histolytica
QDNFD

SEQ ID NO: 2648409 - protein, 15 aa, Entamoeba histolytica
QDNITIKSKDEKKFA

SEQ ID NO: 2648410 - protein, 6 aa, Entamoeba histolytica
QDNKND

SEQ ID NO: 2648411 - protein, 5 aa, Entamoeba histolytica
QDNNT

SEQ ID NO: 2648412 - protein, 13 aa, Entamoeba histolytica
QDNQIKKVSPVEV

SEQ ID NO: 2648413 - protein, 9 aa, Entamoeba histolytica
QDNQPNSSL

SEQ ID NO: 2648414 - protein, 5 aa, Entamoeba histolytica
QDNQV

SEQ ID NO: 2648415 - protein, 4 aa, Entamoeba histolytica
QDNS

SEQ ID NO: 2648416 - protein, 8 aa, Entamoeba histolytica
QDNSHASD

SEQ ID NO: 2648417 - protein, 7 aa, Entamoeba histolytica
QDNSTEV

SEQ ID NO: 2648418 - protein, 5 aa, Entamoeba histolytica
QDPAF

SEQ ID NO: 2648419 - protein, 6 aa, Entamoeba histolytica
QDPIPS

SEQ ID NO: 2648420 - protein, 13 aa, Entamoeba histolytica
QDPKTPKTCNYDG

SEQ ID NO: 2648421 - protein, 6 aa, Entamoeba histolytica
QDPLPE

SEQ ID NO: 2648422 - protein, 8 aa, Entamoeba histolytica
QDPSHAEL

SEQ ID NO: 2648423 - protein, 5 aa, Entamoeba histolytica
QDPVT

SEQ ID NO: 2648424 - protein, 7 aa, Entamoeba histolytica
QDQDKNP

SEQ ID NO: 2648425 - protein, 27 aa, Entamoeba histolytica
QDQEFQQRNGYQALDQQETPQENVPKN

SEQ ID NO: 2648426 - protein, 7 aa, Entamoeba histolytica
QDQFDSK

SEQ ID NO: 2648427 - protein, 14 aa, Entamoeba histolytica
QDQKEKINQNVIRL

SEQ ID NO: 2648428 - protein, 9 aa, Entamoeba histolytica
QDQKQRNEL

SEQ ID NO: 2648429 - protein, 4 aa, Entamoeba histolytica
QDQL

SEQ ID NO: 2648430 - protein, 6 aa, Entamoeba histolytica
QDRIKA

SEQ ID NO: 2648431 - protein, 7 aa, Entamoeba histolytica
QDRINGN

SEQ ID NO: 2648432 - protein, 19 aa, Entamoeba histolytica
QDRKKKSSQKSHRPSHQPI

SEQ ID NO: 2648433 - protein, 16 aa, Entamoeba histolytica
QDRRERRRSPRRGFEN

SEQ ID NO: 2648434 - protein, 19 aa, Entamoeba histolytica
QDSETNTLQYQQEEISPEV

SEQ ID NO: 2648435 - protein, 9 aa, Entamoeba histolytica
QDSGSIGVT

SEQ ID NO: 2648436 - protein, 5 aa, Entamoeba histolytica
QDSID

SEQ ID NO: 2648437 - protein, 20 aa, Entamoeba histolytica
QDSIDKKKKEINEKKRRKRK

SEQ ID NO: 2648438 - protein, 13 aa, Entamoeba histolytica
QDSKDEKEASKNL

SEQ ID NO: 2648439 - protein, 8 aa, Entamoeba histolytica
QDSNKNTA

SEQ ID NO: 2648440 - protein, 11 aa, Entamoeba histolytica
QDSNKVDSQIE

SEQ ID NO: 2648441 - protein, 7 aa, Entamoeba histolytica
QDSPGVD

SEQ ID NO: 2648442 - protein, 38 aa, Entamoeba histolytica
QDSREDINGVNKELQQGNEEDQCVKPSSMGLKSSAAQI

SEQ ID NO: 2648443 - protein, 4 aa, Entamoeba histolytica
QDSS

SEQ ID NO: 2648444 - protein, 7 aa, Entamoeba histolytica
QDSSTRK

SEQ ID NO: 2648445 - protein, 6 aa, Entamoeba histolytica
QDTPDG

SEQ ID NO: 2648446 - protein, 8 aa, Entamoeba histolytica
QDTQSNVR

SEQ ID NO: 2648447 - protein, 4 aa, Entamoeba histolytica
QDTS

SEQ ID NO: 2648448 - protein, 12 aa, Entamoeba histolytica
QDTVESSTTVTQ

SEQ ID NO: 2648449 - protein, 4 aa, Entamoeba histolytica
QDVN

SEQ ID NO: 2648450 - protein, 14 aa, Entamoeba histolytica
QDVPVSTEETSKEQ

SEQ ID NO: 2648451 - protein, 6 aa, Entamoeba histolytica
QDVTVR

SEQ ID NO: 2648452 - protein, 4 aa, Entamoeba histolytica
QDYE

SEQ ID NO: 2648453 - protein, 8 aa, Entamoeba histolytica
QDYEEAPI

SEQ ID NO: 2648454 - protein, 10 aa, Entamoeba histolytica
QDYERKYKDI

SEQ ID NO: 2648455 - protein, 6 aa, Entamoeba histolytica
QDYNSG

SEQ ID NO: 2648456 - protein, 9 aa, Entamoeba histolytica
QDYSETPLP

SEQ ID NO: 2648457 - protein, 13 aa, Entamoeba histolytica
QDYSSIGNKSGLS

SEQ ID NO: 2648458 - protein, 7 aa, Entamoeba histolytica
QDYSSPY

SEQ ID NO: 2648459 - protein, 5 aa, Entamoeba histolytica
QDYTT

SEQ ID NO: 2648460 - protein, 8 aa, Entamoeba histolytica
QEAARQRD

SEQ ID NO: 2648461 - protein, 5 aa, Entamoeba histolytica
QEADE

SEQ ID NO: 2648462 - protein, 22 aa, Entamoeba histolytica
QEAERKEKERKAEEERLQKEHE

SEQ ID NO: 2648463 - protein, 9 aa, Entamoeba histolytica
QEAHTRGEL

SEQ ID NO: 2648464 - protein, 7 aa, Entamoeba histolytica
QEAHYNN

SEQ ID NO: 2648465 - protein, 7 aa, Entamoeba histolytica
QEAIDGT

SEQ ID NO: 2648466 - protein, 14 aa, Entamoeba histolytica
QEAKADEKVGEKLN

SEQ ID NO: 2648467 - protein, 8 aa, Entamoeba histolytica
QEAKEAID

SEQ ID NO: 2648468 - protein, 9 aa, Entamoeba histolytica
QEAKQSMAE

SEQ ID NO: 2648469 - protein, 5 aa, Entamoeba histolytica
QEANE

SEQ ID NO: 2648470 - protein, 5 aa, Entamoeba histolytica
QEARE

SEQ ID NO: 2648471 - protein, 7 aa, Entamoeba histolytica
QEASISR

SEQ ID NO: 2648472 - protein, 7 aa, Entamoeba histolytica
QEATINE

SEQ ID NO: 2648473 - protein, 9 aa, Entamoeba histolytica
QEDDLTDIG

SEQ ID NO: 2648474 - protein, 19 aa, Entamoeba histolytica
QEDDNDEPLNHEDEKDELK

SEQ ID NO: 2648475 - protein, 11 aa, Entamoeba histolytica
QEDEDVGKMSG

SEQ ID NO: 2648476 - protein, 8 aa, Entamoeba histolytica
QEDGKWAS

SEQ ID NO: 2648477 - protein, 6 aa, Entamoeba histolytica
QEDGNI

SEQ ID NO: 2648478 - protein, 7 aa, Entamoeba histolytica
QEDINNP

SEQ ID NO: 2648479 - protein, 67 aa, Entamoeba histolytica
QEDLEKKEENNEVKSQDKKDHKKHEKKDHKKEEKKPKSSAVHSKEETKDNNTKENKSKEVKANIDEE

SEQ ID NO: 2648480 - protein, 18 aa, Entamoeba histolytica
QEDNYQQPSCETNSYTSQ

SEQ ID NO: 2648481 - protein, 25 aa, Entamoeba histolytica
QEDQQQLTQSTPIMTQKKEDTQNNS

SEQ ID NO: 2648482 - protein, 12 aa, Entamoeba histolytica
QEDSEKKTEWGY

SEQ ID NO: 2648483 - protein, 9 aa, Entamoeba histolytica
QEDSKPKKF

SEQ ID NO: 2648484 - protein, 5 aa, Entamoeba histolytica
QEDYN

SEQ ID NO: 2648485 - protein, 8 aa, Entamoeba histolytica
QEEAQTEI

SEQ ID NO: 2648486 - protein, 15 aa, Entamoeba histolytica
QEEDGEDEQMKKENN

SEQ ID NO: 2648487 - protein, 5 aa, Entamoeba histolytica
QEEDN

SEQ ID NO: 2648488 - protein, 13 aa, Entamoeba histolytica
QEEEEEEEEEEDD

SEQ ID NO: 2648489 - protein, 21 aa, Entamoeba histolytica
QEEEEEKRRIEKQKKKETIKM

SEQ ID NO: 2648490 - protein, 8 aa, Entamoeba histolytica
QEEEESNN

SEQ ID NO: 2648491 - protein, 33 aa, Entamoeba histolytica
QEEEHEEESSSSSSEDSQEEPKEVEDIEHKKGN

SEQ ID NO: 2648492 - protein, 6 aa, Entamoeba histolytica
QEEEKD

SEQ ID NO: 2648493 - protein, 12 aa, Entamoeba histolytica
QEEEKKRIEEEI

SEQ ID NO: 2648494 - protein, 16 aa, Entamoeba histolytica
QEEEKYTKIKQNEKNK

SEQ ID NO: 2648495 - protein, 11 aa, Entamoeba histolytica
QEEENKKEEEI

SEQ ID NO: 2648496 - protein, 16 aa, Entamoeba histolytica
QEEERKQKELADKREK

SEQ ID NO: 2648497 - protein, 8 aa, Entamoeba histolytica
QEEEVPNP

SEQ ID NO: 2648498 - protein, 5 aa, Entamoeba histolytica
QEEGY

SEQ ID NO: 2648499 - protein, 11 aa, Entamoeba histolytica
QEEHEKECRKY

SEQ ID NO: 2648500 - protein, 4 aa, Entamoeba histolytica
QEEI

SEQ ID NO: 2648501 - protein, 7 aa, Entamoeba histolytica
QEEIERE

SEQ ID NO: 2648502 - protein, 6 aa, Entamoeba histolytica
QEEIES

SEQ ID NO: 2648503 - protein, 6 aa, Entamoeba histolytica
QEEITE

SEQ ID NO: 2648504 - protein, 29 aa, Entamoeba histolytica
QEEKKEETKDGIQKKSESTKEVNISTSKE

SEQ ID NO: 2648505 - protein, 7 aa, Entamoeba histolytica
QEEKKEI

SEQ ID NO: 2648506 - protein, 17 aa, Entamoeba histolytica
QEEKKLTMEEEAEQRAI

SEQ ID NO: 2648507 - protein, 5 aa, Entamoeba histolytica
QEEKP

SEQ ID NO: 2648508 - protein, 39 aa, Entamoeba histolytica
QEELEEEERRNNEIQKEQPEHDENNITQQHKTKQSQLPL

SEQ ID NO: 2648509 - protein, 13 aa, Entamoeba histolytica
QEEMDKEDAEMRQ

SEQ ID NO: 2648510 - protein, 4 aa, Entamoeba histolytica
QEEN

SEQ ID NO: 2648511 - protein, 19 aa, Entamoeba histolytica
QEENTNNDRINKDQNSLVQ

SEQ ID NO: 2648512 - protein, 8 aa, Entamoeba histolytica
QEENYENA

SEQ ID NO: 2648513 - protein, 5 aa, Entamoeba histolytica
QEEQR

SEQ ID NO: 2648514 - protein, 6 aa, Entamoeba histolytica
QEESKE

SEQ ID NO: 2648515 - protein, 7 aa, Entamoeba histolytica
QEESKSR

SEQ ID NO: 2648516 - protein, 11 aa, Entamoeba histolytica
QEESNDYSITQ

SEQ ID NO: 2648517 - protein, 7 aa, Entamoeba histolytica
QEESPEL

SEQ ID NO: 2648518 - protein, 5 aa, Entamoeba histolytica
QEESS

SEQ ID NO: 2648519 - protein, 4 aa, Entamoeba histolytica
QEET

SEQ ID NO: 2648520 - protein, 7 aa, Entamoeba histolytica
QEETKEV

SEQ ID NO: 2648521 - protein, 45 aa, Entamoeba histolytica
QEETKSQEGTPKRCDSSNELERVRSASPVGEPEPEEKKKKKTSLS

SEQ ID NO: 2648522 - protein, 17 aa, Entamoeba histolytica
QEETNEEKQKEPEINGS

SEQ ID NO: 2648523 - protein, 30 aa, Entamoeba histolytica
QEEVDEEEKEEESNEMSEEEVSEPQNNTTT

SEQ ID NO: 2648524 - protein, 12 aa, Entamoeba histolytica
QEEVKKEGLDEE

SEQ ID NO: 2648525 - protein, 11 aa, Entamoeba histolytica
QEEVNKKTPYE

SEQ ID NO: 2648526 - protein, 11 aa, Entamoeba histolytica
QEFEEECKNRG

SEQ ID NO: 2648527 - protein, 9 aa, Entamoeba histolytica
QEFKDTEAD

SEQ ID NO: 2648528 - protein, 5 aa, Entamoeba histolytica
QEFKE

SEQ ID NO: 2648529 - protein, 6 aa, Entamoeba histolytica
QEFNDE

SEQ ID NO: 2648530 - protein, 11 aa, Entamoeba histolytica
QEFNQKDENDA

SEQ ID NO: 2648531 - protein, 8 aa, Entamoeba histolytica
QEFPEDTG

SEQ ID NO: 2648532 - protein, 4 aa, Entamoeba histolytica
QEFT

SEQ ID NO: 2648533 - protein, 8 aa, Entamoeba histolytica
QEGDQTDV

SEQ ID NO: 2648534 - protein, 8 aa, Entamoeba histolytica
QEGDVGED

SEQ ID NO: 2648535 - protein, 9 aa, Entamoeba histolytica
QEGHESTKL

SEQ ID NO: 2648536 - protein, 4 aa, Entamoeba histolytica
QEGI

SEQ ID NO: 2648537 - protein, 6 aa, Entamoeba histolytica
QEGLEL

SEQ ID NO: 2648538 - protein, 6 aa, Entamoeba histolytica
QEGNEK

SEQ ID NO: 2648539 - protein, 53 aa, Entamoeba histolytica
QEGNNKSSEEEVNKEELNNEEDKKEEDKKEENERNKNENNDEDSQKKKEEFKK

SEQ ID NO: 2648540 - protein, 8 aa, Entamoeba histolytica
QEGSPAYK

SEQ ID NO: 2648541 - protein, 9 aa, Entamoeba histolytica
QEHDRDNYR

SEQ ID NO: 2648542 - protein, 10 aa, Entamoeba histolytica
QEHEENIQYQ

SEQ ID NO: 2648543 - protein, 4 aa, Entamoeba histolytica
QEHP

SEQ ID NO: 2648544 - protein, 8 aa, Entamoeba histolytica
QEHPEDDE

SEQ ID NO: 2648545 - protein, 7 aa, Entamoeba histolytica
QEHTNTV

SEQ ID NO: 2648546 - protein, 6 aa, Entamoeba histolytica
QEIEAD

SEQ ID NO: 2648547 - protein, 20 aa, Entamoeba histolytica
QEIENNKKEVENSKKEVEDM

SEQ ID NO: 2648548 - protein, 16 aa, Entamoeba histolytica
QEIENNTNNVTNEQQR

SEQ ID NO: 2648549 - protein, 21 aa, Entamoeba histolytica
QEIKDESREQQLQRERAERLE

SEQ ID NO: 2648550 - protein, 27 aa, Entamoeba histolytica
QEIKETKEELKPLKEYQPTSSVPTKVV

SEQ ID NO: 2648551 - protein, 5 aa, Entamoeba histolytica
QEIKP

SEQ ID NO: 2648552 - protein, 17 aa, Entamoeba histolytica
QEIKPDIQQEIDEESKK

SEQ ID NO: 2648553 - protein, 12 aa, Entamoeba histolytica
QEINEFNKNHIL

SEQ ID NO: 2648554 - protein, 5 aa, Entamoeba histolytica
QEING

SEQ ID NO: 2648555 - protein, 11 aa, Entamoeba histolytica
QEIPTMSKQQS

SEQ ID NO: 2648556 - protein, 14 aa, Entamoeba histolytica
QEIQENAKNEEELK

SEQ ID NO: 2648557 - protein, 30 aa, Entamoeba histolytica
QEIQQNQFPSMGNDNKLPSFEPTQPQQNQF

SEQ ID NO: 2648558 - protein, 4 aa, Entamoeba histolytica
QEIR

SEQ ID NO: 2648559 - protein, 17 aa, Entamoeba histolytica
QEIREKEYQRFRDGESR

SEQ ID NO: 2648560 - protein, 30 aa, Entamoeba histolytica
QEISGEREKEQKEEKKKEDKKEKDKTIESL

SEQ ID NO: 2648561 - protein, 5 aa, Entamoeba histolytica
QEIST

SEQ ID NO: 2648562 - protein, 36 aa, Entamoeba histolytica
QEITEPNKSNDNTSINEMSTTTPINSEPSQDTKQKI

SEQ ID NO: 2648563 - protein, 9 aa, Entamoeba histolytica
QEITKENTL

SEQ ID NO: 2648564 - protein, 11 aa, Entamoeba histolytica
QEITSGAQRIH

SEQ ID NO: 2648565 - protein, 9 aa, Entamoeba histolytica
QEKAKELKR

SEQ ID NO: 2648566 - protein, 4 aa, Entamoeba histolytica
QEKD

SEQ ID NO: 2648567 - protein, 13 aa, Entamoeba histolytica
QEKDAKKEKRNAG

SEQ ID NO: 2648568 - protein, 16 aa, Entamoeba histolytica
QEKDEEEGKNSDSSKC

SEQ ID NO: 2648569 - protein, 9 aa, Entamoeba histolytica
QEKEDLKKK

SEQ ID NO: 2648570 - protein, 10 aa, Entamoeba histolytica
QEKEEDDFFK

SEQ ID NO: 2648571 - protein, 13 aa, Entamoeba histolytica
QEKEEKENELKEQ

SEQ ID NO: 2648572 - protein, 6 aa, Entamoeba histolytica
QEKEEY

SEQ ID NO: 2648573 - protein, 6 aa, Entamoeba histolytica
QEKEFG

SEQ ID NO: 2648574 - protein, 6 aa, Entamoeba histolytica
QEKEIE

SEQ ID NO: 2648575 - protein, 15 aa, Entamoeba histolytica
QEKEINNKLNEQISK

SEQ ID NO: 2648576 - protein, 17 aa, Entamoeba histolytica
QEKEKCKKKEQEMNSEQ

SEQ ID NO: 2648577 - protein, 6 aa, Entamoeba histolytica
QEKERM

SEQ ID NO: 2648578 - protein, 7 aa, Entamoeba histolytica
QEKETMN

SEQ ID NO: 2648579 - protein, 4 aa, Entamoeba histolytica
QEKG

SEQ ID NO: 2648580 - protein, 6 aa, Entamoeba histolytica
QEKGSC

SEQ ID NO: 2648581 - protein, 8 aa, Entamoeba histolytica
QEKGSSLN

SEQ ID NO: 2648582 - protein, 5 aa, Entamoeba histolytica
QEKID

SEQ ID NO: 2648583 - protein, 12 aa, Entamoeba histolytica
QEKKEEEREITA

SEQ ID NO: 2648584 - protein, 5 aa, Entamoeba histolytica
QEKKK

SEQ ID NO: 2648585 - protein, 8 aa, Entamoeba histolytica
QEKKKDKI

SEQ ID NO: 2648586 - protein, 6 aa, Entamoeba histolytica
QEKKLF

SEQ ID NO: 2648587 - protein, 5 aa, Entamoeba histolytica
QEKKR

SEQ ID NO: 2648588 - protein, 8 aa, Entamoeba histolytica
QEKKTINP

SEQ ID NO: 2648589 - protein, 6 aa, Entamoeba histolytica
QEKKYS

SEQ ID NO: 2648590 - protein, 9 aa, Entamoeba histolytica
QEKLEEKGR

SEQ ID NO: 2648591 - protein, 8 aa, Entamoeba histolytica
QEKLEPKT

SEQ ID NO: 2648592 - protein, 8 aa, Entamoeba histolytica
QEKLQNEK

SEQ ID NO: 2648593 - protein, 6 aa, Entamoeba histolytica
QEKNEH

SEQ ID NO: 2648594 - protein, 5 aa, Entamoeba histolytica
QEKNF

SEQ ID NO: 2648595 - protein, 10 aa, Entamoeba histolytica
QEKNQEGKVI

SEQ ID NO: 2648596 - protein, 4 aa, Entamoeba histolytica
QEKQ

SEQ ID NO: 2648597 - protein, 10 aa, Entamoeba histolytica
QEKQKKLSSI

SEQ ID NO: 2648598 - protein, 13 aa, Entamoeba histolytica
QEKQKQEETIETK

SEQ ID NO: 2648599 - protein, 10 aa, Entamoeba histolytica
QEKQQKDFEG

SEQ ID NO: 2648600 - protein, 6 aa, Entamoeba histolytica
QEKQTI

SEQ ID NO: 2648601 - protein, 7 aa, Entamoeba histolytica
QEKRDNF

SEQ ID NO: 2648602 - protein, 9 aa, Entamoeba histolytica
QEKRTSKQL

SEQ ID NO: 2648603 - protein, 7 aa, Entamoeba histolytica
QEKSGTV

SEQ ID NO: 2648604 - protein, 15 aa, Entamoeba histolytica
QEKTLKEQTEHETES

SEQ ID NO: 2648605 - protein, 7 aa, Entamoeba histolytica
QEKTYKK

SEQ ID NO: 2648606 - protein, 6 aa, Entamoeba histolytica
QEKYET

SEQ ID NO: 2648607 - protein, 4 aa, Entamoeba histolytica
QELD

SEQ ID NO: 2648608 - protein, 4 aa, Entamoeba histolytica
QELE

SEQ ID NO: 2648609 - protein, 20 aa, Entamoeba histolytica
QELEDEENKNKDLTNELQQT

SEQ ID NO: 2648610 - protein, 6 aa, Entamoeba histolytica
QELEEK

SEQ ID NO: 2648611 - protein, 6 aa, Entamoeba histolytica
QELEGR

SEQ ID NO: 2648612 - protein, 21 aa, Entamoeba histolytica
QELEKKEKENQLIKDSNEKLQ

SEQ ID NO: 2648613 - protein, 13 aa, Entamoeba histolytica
QELENKNKADRRR

SEQ ID NO: 2648614 - protein, 17 aa, Entamoeba histolytica
QELEPVTQNESPGPLHN

SEQ ID NO: 2648615 - protein, 8 aa, Entamoeba histolytica
QELEQTKN

SEQ ID NO: 2648616 - protein, 16 aa, Entamoeba histolytica
QELETEKENRKSQESF

SEQ ID NO: 2648617 - protein, 9 aa, Entamoeba histolytica
QELETENKY

SEQ ID NO: 2648618 - protein, 4 aa, Entamoeba histolytica
QELK

SEQ ID NO: 2648619 - protein, 22 aa, Entamoeba histolytica
QELKEEFKRNTQIYSRSPHDKQ

SEQ ID NO: 2648620 - protein, 5 aa, Entamoeba histolytica
QELKK

SEQ ID NO: 2648621 - protein, 26 aa, Entamoeba histolytica
QELKNGADITSKFEEQSKANKKLEEE

SEQ ID NO: 2648622 - protein, 24 aa, Entamoeba histolytica
QELKNKEEEIITETDKSNKALAAQ

SEQ ID NO: 2648623 - protein, 7 aa, Entamoeba histolytica
QELKPDE

SEQ ID NO: 2648624 - protein, 7 aa, Entamoeba histolytica
QELNEEK

SEQ ID NO: 2648625 - protein, 11 aa, Entamoeba histolytica
QELNNKEDKQV

SEQ ID NO: 2648626 - protein, 10 aa, Entamoeba histolytica
QELNTNITGS

SEQ ID NO: 2648627 - protein, 50 aa, Entamoeba histolytica; identical to SEQ ID NO: 2453577

SEQ ID NO: 2648628 - protein, 14 aa, Entamoeba histolytica
QELSPSNKQKNKKK

SEQ ID NO: 2648629 - protein, 9 aa, Entamoeba histolytica
QELSTDAGL

SEQ ID NO: 2648630 - protein, 10 aa, Entamoeba histolytica
QELSTSEKTQ

SEQ ID NO: 2648631 - protein, 8 aa, Entamoeba histolytica
QELTGDDL

SEQ ID NO: 2648632 - protein, 11 aa, Entamoeba histolytica
QEMANPNDKCS

SEQ ID NO: 2648633 - protein, 7 aa, Entamoeba histolytica
QEMATSY

SEQ ID NO: 2648634 - protein, 4 aa, Entamoeba histolytica
QEMD

SEQ ID NO: 2648635 - protein, 8 aa, Entamoeba histolytica
QEMDERRN

SEQ ID NO: 2648636 - protein, 8 aa, Entamoeba histolytica
QEMKENED

SEQ ID NO: 2648637 - protein, 6 aa, Entamoeba histolytica
QEMKHK

SEQ ID NO: 2648638 - protein, 15 aa, Entamoeba histolytica
QEMNVEENQPYCQTS

SEQ ID NO: 2648639 - protein, 5 aa, Entamoeba histolytica
QEMRT

SEQ ID NO: 2648640 - protein, 39 aa, Entamoeba histolytica
QEMSRTRSELSTPPLVADKSNEKSRAESLPSEARKERSL

SEQ ID NO: 2648641 - protein, 22 aa, Entamoeba histolytica
QENDDNNKTHHDDETDEHQEDS

SEQ ID NO: 2648642 - protein, 40 aa, Entamoeba histolytica
QENDIKEDKKENDIKEDKKENDIKEDKKENDIKDEERQEE

SEQ ID NO: 2648643 - protein, 7 aa, Entamoeba histolytica
QENEDEI

SEQ ID NO: 2648644 - protein, 10 aa, Entamoeba histolytica
QENENEIEKK

SEQ ID NO: 2648645 - protein, 5 aa, Entamoeba histolytica
QENEV

SEQ ID NO: 2648646 - protein, 6 aa, Entamoeba histolytica
QENFKN

SEQ ID NO: 2648647 - protein, 22 aa, Entamoeba histolytica
QENGKSGALIEERDSSNTSISN

SEQ ID NO: 2648648 - protein, 9 aa, Entamoeba histolytica
QENKKKIEI

SEQ ID NO: 2648649 - protein, 15 aa, Entamoeba histolytica
QENKNIEKKIPLEGS

SEQ ID NO: 2648650 - protein, 9 aa, Entamoeba histolytica
QENKPSKEY

SEQ ID NO: 2648651 - protein, 17 aa, Entamoeba histolytica
QENKRIKDNKREQARIQ

SEQ ID NO: 2648652 - protein, 15 aa, Entamoeba histolytica
QENKRTNDINDYKTK

SEQ ID NO: 2648653 - protein, 25 aa, Entamoeba histolytica
QENKSSYSLPPDFENDDLNDGPGTT

SEQ ID NO: 2648654 - protein, 5 aa, Entamoeba histolytica
QENKV

SEQ ID NO: 2648655 - protein, 4 aa, Entamoeba histolytica
QENL

SEQ ID NO: 2648656 - protein, 7 aa, Entamoeba histolytica
QENNDLK

SEQ ID NO: 2648657 - protein, 11 aa, Entamoeba histolytica
QENNSEHTAPH

SEQ ID NO: 2648658 - protein, 8 aa, Entamoeba histolytica
QENNTAIP

SEQ ID NO: 2648659 - protein, 25 aa, Entamoeba histolytica
QENNTKKKTDSTTITSSQKQIETTI

SEQ ID NO: 2648660 - protein, 5 aa, Entamoeba histolytica
QENPH

SEQ ID NO: 2648661 - protein, 5 aa, Entamoeba histolytica
QENPN

SEQ ID NO: 2648662 - protein, 6 aa, Entamoeba histolytica
QENPSV

SEQ ID NO: 2648663 - protein, 8 aa, Entamoeba histolytica
QENRQNTV

SEQ ID NO: 2648664 - protein, 12 aa, Entamoeba histolytica
QENSIEESKNLE

SEQ ID NO: 2648665 - protein, 9 aa, Entamoeba histolytica
QENSLNEEI

SEQ ID NO: 2648666 - protein, 7 aa, Entamoeba histolytica
QENSNEF

SEQ ID NO: 2648667 - protein, 13 aa, Entamoeba histolytica
QENSSQPTEELEG

SEQ ID NO: 2648668 - protein, 6 aa, Entamoeba histolytica
QEPFSK

SEQ ID NO: 2648669 - protein, 4 aa, Entamoeba histolytica
QEPI

SEQ ID NO: 2648670 - protein, 14 aa, Entamoeba histolytica
QEPIEKVKRKEQDK

SEQ ID NO: 2648671 - protein, 22 aa, Entamoeba histolytica
QEPKRVKKTKVIKKTSSENEEF

SEQ ID NO: 2648672 - protein, 6 aa, Entamoeba histolytica
QEPKSM

SEQ ID NO: 2648673 - protein, 27 aa, Entamoeba histolytica
QEPKVDIQDDEGEWQEVKPKTQKKKGG

SEQ ID NO: 2648674 - protein, 16 aa, Entamoeba histolytica
QEPNPGFGDDAAEKVQ

SEQ ID NO: 2648675 - protein, 7 aa, Entamoeba histolytica
QEPPEDG

SEQ ID NO: 2648676 - protein, 7 aa, Entamoeba histolytica
QEPPTGS

SEQ ID NO: 2648677 - protein, 27 aa, Entamoeba histolytica
QEPQPNIQDDEGEWQEVKSKTQKKKGG

SEQ ID NO: 2648678 - protein, 7 aa, Entamoeba histolytica
QEPQPPA

SEQ ID NO: 2648679 - protein, 8 aa, Entamoeba histolytica
QEPSLSNF

SEQ ID NO: 2648680 - protein, 10 aa, Entamoeba histolytica
QEPTPGQITE

SEQ ID NO: 2648681 - protein, 4 aa, Entamoeba histolytica
QEPY

SEQ ID NO: 2648682 - protein, 8 aa, Entamoeba histolytica
QEQENSQK

SEQ ID NO: 2648683 - protein, 6 aa, Entamoeba histolytica
QEQESK

SEQ ID NO: 2648684 - protein, 4 aa, Entamoeba histolytica
QEQF

SEQ ID NO: 2648685 - protein, 9 aa, Entamoeba histolytica
QEQFQRDGC

SEQ ID NO: 2648686 - protein, 8 aa, Entamoeba histolytica
QEQGEAMA

SEQ ID NO: 2648687 - protein, 6 aa, Entamoeba histolytica
QEQGTV

SEQ ID NO: 2648688 - protein, 5 aa, Entamoeba histolytica
QEQHE

SEQ ID NO: 2648689 - protein, 8 aa, Entamoeba histolytica
QEQHSKAY

SEQ ID NO: 2648690 - protein, 4 aa, Entamoeba histolytica
QEQK

SEQ ID NO: 2648691 - protein, 9 aa, Entamoeba histolytica
QEQKKSIQD

SEQ ID NO: 2648692 - protein, 9 aa, Entamoeba histolytica
QEQNPEAVP

SEQ ID NO: 2648693 - protein, 4 aa, Entamoeba histolytica
QEQP

SEQ ID NO: 2648694 - protein, 5 aa, Entamoeba histolytica
QEQQI

SEQ ID NO: 2648695 - protein, 4 aa, Entamoeba histolytica
QEQR

SEQ ID NO: 2648696 - protein, 10 aa, Entamoeba histolytica
QEQSEKNSII

SEQ ID NO: 2648697 - protein, 6 aa, Entamoeba histolytica
QEQSFN

SEQ ID NO: 2648698 - protein, 16 aa, Entamoeba histolytica
QEQSKRQLQKEETKKL

SEQ ID NO: 2648699 - protein, 9 aa, Entamoeba histolytica
QEQSNLGEE

SEQ ID NO: 2648700 - protein, 13 aa, Entamoeba histolytica
QEQSSSQQYPPLG

SEQ ID NO: 2648701 - protein, 7 aa, Entamoeba histolytica
QEQSTSY

SEQ ID NO: 2648702 - protein, 7 aa, Entamoeba histolytica
QEQTKNK

SEQ ID NO: 2648703 - protein, 19 aa, Entamoeba histolytica
QEQTQSLKSTTADVSSHSV

SEQ ID NO: 2648704 - protein, 7 aa, Entamoeba histolytica
QEQVEEL

SEQ ID NO: 2648705 - protein, 13 aa, Entamoeba histolytica
QERCKQDKANKRM

SEQ ID NO: 2648706 - protein, 23 aa, Entamoeba histolytica
QERDSTKEQIKQSDKLKDTYNDL

SEQ ID NO: 2648707 - protein, 5 aa, Entamoeba histolytica
QERIN

SEQ ID NO: 2648708 - protein, 13 aa, Entamoeba histolytica
QERIQDQKQGKTY

SEQ ID NO: 2648709 - protein, 9 aa, Entamoeba histolytica
QERKEEQKV

SEQ ID NO: 2648710 - protein, 6 aa, Entamoeba histolytica
QERKKE

SEQ ID NO: 2648711 - protein, 6 aa, Entamoeba histolytica
QERKTF

SEQ ID NO: 2648712 - protein, 5 aa, Entamoeba histolytica
QERLN

SEQ ID NO: 2648713 - protein, 5 aa, Entamoeba histolytica
QERLR

SEQ ID NO: 2648714 - protein, 6 aa, Entamoeba histolytica
QERNEL

SEQ ID NO: 2648715 - protein, 6 aa, Entamoeba histolytica
QERPNI

SEQ ID NO: 2648716 - protein, 9 aa, Entamoeba histolytica
QERPSNTLS

SEQ ID NO: 2648717 - protein, 24 aa, Entamoeba histolytica
QERTCQQENSSTTPVQPNNNPIEE

SEQ ID NO: 2648718 - protein, 8 aa, Entamoeba histolytica
QERTSENV

SEQ ID NO: 2648719 - protein, 9 aa, Entamoeba histolytica
QESAEEKRI

SEQ ID NO: 2648720 - protein, 5 aa, Entamoeba histolytica
QESAT

SEQ ID NO: 2648721 - protein, 14 aa, Entamoeba histolytica
QESEDESDENEIQN

SEQ ID NO: 2648722 - protein, 4 aa, Entamoeba histolytica
QESF

SEQ ID NO: 2648723 - protein, 16 aa, Entamoeba histolytica
QESKIHEKVNQKPLKE

SEQ ID NO: 2648724 - protein, 11 aa, Entamoeba histolytica
QESKPVETQKV

SEQ ID NO: 2648725 - protein, 8 aa, Entamoeba histolytica
QESKQPLE

SEQ ID NO: 2648726 - protein, 5 aa, Entamoeba histolytica
QESKS

SEQ ID NO: 2648727 - protein, 16 aa, Entamoeba histolytica
QESKSRRKINTYNYTS

SEQ ID NO: 2648728 - protein, 8 aa, Entamoeba histolytica
QESNELDV

SEQ ID NO: 2648729 - protein, 6 aa, Entamoeba histolytica
QESPEM

SEQ ID NO: 2648730 - protein, 4 aa, Entamoeba histolytica
QESR

SEQ ID NO: 2648731 - protein, 7 aa, Entamoeba histolytica
QESSAHQ

SEQ ID NO: 2648732 - protein, 5 aa, Entamoeba histolytica
QESSF

SEQ ID NO: 2648733 - protein, 9 aa, Entamoeba histolytica
QESTKNKGI

SEQ ID NO: 2648734 - protein, 6 aa, Entamoeba histolytica
QESVKP

SEQ ID NO: 2648735 - protein, 21 aa, Entamoeba histolytica
QETAPITTTTEETIKPEIQQN

SEQ ID NO: 2648736 - protein, 5 aa, Entamoeba histolytica
QETDL

SEQ ID NO: 2648737 - protein, 13 aa, Entamoeba histolytica
QETEESSNQKGVL

SEQ ID NO: 2648738 - protein, 11 aa, Entamoeba histolytica
QETEKDRLKDI

SEQ ID NO: 2648739 - protein, 8 aa, Entamoeba histolytica
QETEYKKG

SEQ ID NO: 2648740 - protein, 6 aa, Entamoeba histolytica
QETFRN

SEQ ID NO: 2648741 - protein, 5 aa, Entamoeba histolytica
QETHK

SEQ ID NO: 2648742 - protein, 30 aa, Entamoeba histolytica
QETHSNQMSQTTIPTQSLPTVSTESLKETT

SEQ ID NO: 2648743 - protein, 7 aa, Entamoeba histolytica
QETKPAL

SEQ ID NO: 2648744 - protein, 7 aa, Entamoeba histolytica
QETNIDE

SEQ ID NO: 2648745 - protein, 19 aa, Entamoeba histolytica
QETNQEFDSIDESEEWEDP

SEQ ID NO: 2648746 - protein, 6 aa, Entamoeba histolytica
QETNRS

SEQ ID NO: 2648747 - protein, 7 aa, Entamoeba histolytica
QETPPLQ

SEQ ID NO: 2648748 - protein, 9 aa, Entamoeba histolytica
QETQPSNEV

SEQ ID NO: 2648749 - protein, 4 aa, Entamoeba histolytica
QETS

SEQ ID NO: 2648750 - protein, 9 aa, Entamoeba histolytica
QETTKRGIY

SEQ ID NO: 2648751 - protein, 10 aa, Entamoeba histolytica
QETTNTQHNK

SEQ ID NO: 2648752 - protein, 5 aa, Entamoeba histolytica
QETYE

SEQ ID NO: 2648753 - protein, 6 aa, Entamoeba histolytica
QETYTN

SEQ ID NO: 2648754 - protein, 6 aa, Entamoeba histolytica
QEVDKD

SEQ ID NO: 2648755 - protein, 9 aa, Entamoeba histolytica
QEVDSTEDI

SEQ ID NO: 2648756 - protein, 9 aa, Entamoeba histolytica
QEVEEASKE

SEQ ID NO: 2648757 - protein, 21 aa, Entamoeba histolytica
QEVEKVKKRENMKKQEELDRK

SEQ ID NO: 2648758 - protein, 14 aa, Entamoeba histolytica
QEVNNKKKLKEKGL

SEQ ID NO: 2648759 - protein, 9 aa, Entamoeba histolytica
QEVQGMKTR

SEQ ID NO: 2648760 - protein, 5 aa, Entamoeba histolytica
QEVQI

SEQ ID NO: 2648761 - protein, 13 aa, Entamoeba histolytica
QEVSESLEETIDS

SEQ ID NO: 2648762 - protein, 14 aa, Entamoeba histolytica
QEYISSPSKIYSQN

SEQ ID NO: 2648763 - protein, 6 aa, Entamoeba histolytica
QEYRSE

SEQ ID NO: 2648764 - protein, 4 aa, Entamoeba histolytica
QEYS

SEQ ID NO: 2648765 - protein, 84 aa, Entamoeba histolytica
QEYSKSESYSPSRSRSYSRSYSYSRSRSTSRSRRRHYYSSERGRSYSRRRSYSRRNDRHYEYNRRSYSSRRSYDSSPRSKSRRR

SEQ ID NO: 2648766 - protein, 6 aa, Entamoeba histolytica
QEYSQV

SEQ ID NO: 2648767 - protein, 6 aa, Entamoeba histolytica
QEYTKQ

SEQ ID NO: 2648768 - protein, 6 aa, Entamoeba histolytica
QEYTPV

SEQ ID NO: 2648769 - protein, 6 aa, Entamoeba histolytica
QEYTSD

SEQ ID NO: 2648770 - protein, 4 aa, Entamoeba histolytica
QFDE

SEQ ID NO: 2648771 - protein, 11 aa, Entamoeba histolytica
QFDEQRKQDAL

SEQ ID NO: 2648772 - protein, 7 aa, Entamoeba histolytica
QFDGEGS

SEQ ID NO: 2648773 - protein, 4 aa, Entamoeba histolytica
QFDP

SEQ ID NO: 2648774 - protein, 19 aa, Entamoeba histolytica
QFEAQPKWKQQKQKHALKL

SEQ ID NO: 2648775 - protein, 4 aa, Entamoeba histolytica
QFEE

SEQ ID NO: 2648776 - protein, 5 aa, Entamoeba histolytica
QFEGM

SEQ ID NO: 2648777 - protein, 13 aa, Entamoeba histolytica
QFENCSDKIRKNS

SEQ ID NO: 2648778 - protein, 5 aa, Entamoeba histolytica
QFENE

SEQ ID NO: 2648779 - protein, 10 aa, Entamoeba histolytica
QFEPKSNYQE

SEQ ID NO: 2648780 - protein, 7 aa, Entamoeba histolytica
QFEPTET

SEQ ID NO: 2648781 - protein, 10 aa, Entamoeba histolytica
QFGCNGKEPY

SEQ ID NO: 2648782 - protein, 5 aa, Entamoeba histolytica
QFGEE

SEQ ID NO: 2648783 - protein, 16 aa, Entamoeba histolytica
QFGENKQGNNEIVSYF

SEQ ID NO: 2648784 - protein, 4 aa, Entamoeba histolytica
QFGG

SEQ ID NO: 2648785 - protein, 11 aa, Entamoeba histolytica
QFGNPDNTAAH

SEQ ID NO: 2648786 - protein, 29 aa, Entamoeba histolytica
QFGNRRGGRGAPRGRGARKDGASDGWTPV

SEQ ID NO: 2648787 - protein, 8 aa, Entamoeba histolytica
QFGSNDKS

SEQ ID NO: 2648788 - protein, 19 aa, Entamoeba histolytica
QFGTNPITELSPDEKSKPF

SEQ ID NO: 2648789 - protein, 6 aa, Entamoeba histolytica
QFHSSN

SEQ ID NO: 2648790 - protein, 13 aa, Entamoeba histolytica
QFKGKKQIESAKA

SEQ ID NO: 2648791 - protein, 5 aa, Entamoeba histolytica
QFKKE

SEQ ID NO: 2648792 - protein, 8 aa, Entamoeba histolytica
QFKKEPSF

SEQ ID NO: 2648793 - protein, 10 aa, Entamoeba histolytica
QFKKREPPRM

SEQ ID NO: 2648794 - protein, 12 aa, Entamoeba histolytica
QFKNFSKGEEEM

SEQ ID NO: 2648795 - protein, 4 aa, Entamoeba histolytica
QFKS

SEQ ID NO: 2648796 - protein, 9 aa, Entamoeba histolytica
QFNDKDQHD

SEQ ID NO: 2648797 - protein, 5 aa, Entamoeba histolytica
QFNDY

SEQ ID NO: 2648798 - protein, 5 aa, Entamoeba histolytica
QFNEE

SEQ ID NO: 2648799 - protein, 6 aa, Entamoeba histolytica
QFNEPQ

SEQ ID NO: 2648800 - protein, 4 aa, Entamoeba histolytica
QFNN

SEQ ID NO: 2648801 - protein, 5 aa, Entamoeba histolytica
QFNNE

SEQ ID NO: 2648802 - protein, 23 aa, Entamoeba histolytica
QFNNEKKQTSFVNQENSFKGEIT

SEQ ID NO: 2648803 - protein, 10 aa, Entamoeba histolytica
QFNQKDENDA

SEQ ID NO: 2648804 - protein, 4 aa, Entamoeba histolytica
QFNS

SEQ ID NO: 2648805 - protein, 5 aa, Entamoeba histolytica
QFNSN

SEQ ID NO: 2648806 - protein, 10 aa, Entamoeba histolytica
QFPHVSGEQL

SEQ ID NO: 2648807 - protein, 7 aa, Entamoeba histolytica
QFPNNDN

SEQ ID NO: 2648808 - protein, 7 aa, Entamoeba histolytica
QFPSKIS

SEQ ID NO: 2648809 - protein, 6 aa, Entamoeba histolytica
QFPSTG

SEQ ID NO: 2648810 - protein, 4 aa, Entamoeba histolytica
QFQT

SEQ ID NO: 2648811 - protein, 5 aa, Entamoeba histolytica
QFRNE

SEQ ID NO: 2648812 - protein, 9 aa, Entamoeba histolytica
QFSEQSKSI

SEQ ID NO: 2648813 - protein, 83 aa, Entamoeba histolytica
QFSHTSSKEYYANELKKGESNRRGDENERKRSRSRHSRSHSRHFKGSKRHHSRSRSRRERRRSRSRSPRRDKDRDRSKRDSHR

SEQ ID NO: 2648814 - protein, 11 aa, Entamoeba histolytica
QFSPDTSTGAK

SEQ ID NO: 2648815 - protein, 7 aa, Entamoeba histolytica
QFSPSSS

SEQ ID NO: 2648816 - protein, 10 aa, Entamoeba histolytica
QFSRNTSDLF

SEQ ID NO: 2648817 - protein, 9 aa, Entamoeba histolytica
QFSSQYKAT

SEQ ID NO: 2648818 - protein, 5 aa, Entamoeba histolytica
QFTDP

SEQ ID NO: 2648819 - protein, 8 aa, Entamoeba histolytica
QFTEEKHE

SEQ ID NO: 2648820 - protein, 27 aa, Entamoeba histolytica
QFTNQIDTKDKEEQNKENIKKSIETEG

SEQ ID NO: 2648821 - protein, 11 aa, Entamoeba histolytica
QFTNRGKRASD

SEQ ID NO: 2648822 - protein, 4 aa, Entamoeba histolytica
QFTQ

SEQ ID NO: 2648823 - protein, 4 aa, Entamoeba histolytica
QFTS

SEQ ID NO: 2648824 - protein, 8 aa, Entamoeba histolytica
QGANPESI

SEQ ID NO: 2648825 - protein, 5 aa, Entamoeba histolytica
QGAPE

SEQ ID NO: 2648826 - protein, 10 aa, Entamoeba histolytica
QGAQGTQPVC

SEQ ID NO: 2648827 - protein, 13 aa, Entamoeba histolytica
QGARNRLQQYDSH

SEQ ID NO: 2648828 - protein, 14 aa, Entamoeba histolytica
QGARNRLQRYDSPN

SEQ ID NO: 2648829 - protein, 11 aa, Entamoeba histolytica
QGASEDDTKNL

SEQ ID NO: 2648830 - protein, 8 aa, Entamoeba histolytica
QGATPVST

SEQ ID NO: 2648831 - protein, 6 aa, Entamoeba histolytica
QGDACS

SEQ ID NO: 2648832 - protein, 9 aa, Entamoeba histolytica
QGDCGTIEE

SEQ ID NO: 2648833 - protein, 7 aa, Entamoeba histolytica
QGDGKSG

SEQ ID NO: 2648834 - protein, 16 aa, Entamoeba histolytica
QGDGLNSGFGEEDEYN

SEQ ID NO: 2648835 - protein, 5 aa, Entamoeba histolytica
QGDGV

SEQ ID NO: 2648836 - protein, 10 aa, Entamoeba histolytica
QGDRSKEKIS

SEQ ID NO: 2648837 - protein, 5 aa, Entamoeba histolytica
QGDRY

SEQ ID NO: 2648838 - protein, 9 aa, Entamoeba histolytica
QGEEKSGNS

SEQ ID NO: 2648839 - protein, 22 aa, Entamoeba histolytica
QGEEMPAKGKLRYEKERNYKEG

SEQ ID NO: 2648840 - protein, 8 aa, Entamoeba histolytica
QGEENCTT

SEQ ID NO: 2648841 - protein, 6 aa, Entamoeba histolytica
QGEIER

SEQ ID NO: 2648842 - protein, 7 aa, Entamoeba histolytica
QGEIKAN

SEQ ID NO: 2648843 - protein, 4 aa, Entamoeba histolytica
QGEL

SEQ ID NO: 2648844 - protein, 6 aa, Entamoeba histolytica
QGEPIK

SEQ ID NO: 2648845 - protein, 9 aa, Entamoeba histolytica
QGEQRENTV

SEQ ID NO: 2648846 - protein, 9 aa, Entamoeba histolytica
QGESASDQI

SEQ ID NO: 2648847 - protein, 20 aa, Entamoeba histolytica
QGEVREEHKQVKGRTSETVL

SEQ ID NO: 2648848 - protein, 7 aa, Entamoeba histolytica
QGFEGDT

SEQ ID NO: 2648849 - protein, 10 aa, Entamoeba histolytica
QGFNSNEQSL

SEQ ID NO: 2648850 - protein, 9 aa, Entamoeba histolytica
QGFSRSSSV

SEQ ID NO: 2648851 - protein, 11 aa, Entamoeba histolytica
QGGEQQPPFPY

SEQ ID NO: 2648852 - protein, 5 aa, Entamoeba histolytica
QGGFV

SEQ ID NO: 2648853 - protein, 7 aa, Entamoeba histolytica
QGGKKDF

SEQ ID NO: 2648854 - protein, 7 aa, Entamoeba histolytica
QGGNAKF

SEQ ID NO: 2648855 - protein, 4 aa, Entamoeba histolytica
QGGY

SEQ ID NO: 2648856 - protein, 5 aa, Entamoeba histolytica
QGGYG

SEQ ID NO: 2648857 - protein, 7 aa, Entamoeba histolytica
QGHNGGI

SEQ ID NO: 2648858 - protein, 4 aa, Entamoeba histolytica
QGID

SEQ ID NO: 2648859 - protein, 11 aa, Entamoeba histolytica
QGIKKEQQQQF

SEQ ID NO: 2648860 - protein, 4 aa, Entamoeba histolytica
QGIN

SEQ ID NO: 2648861 - protein, 25 aa, Entamoeba histolytica
QGINEEREKNKIIEEKYSKEVNNLN

SEQ ID NO: 2648862 - protein, 11 aa, Entamoeba histolytica
QGIVSTSADGT

SEQ ID NO: 2648863 - protein, 4 aa, Entamoeba histolytica
QGIY

SEQ ID NO: 2648864 - protein, 8 aa, Entamoeba histolytica
QGKAGRKT

SEQ ID NO: 2648865 - protein, 5 aa, Entamoeba histolytica
QGKAQ

SEQ ID NO: 2648866 - protein, 5 aa, Entamoeba histolytica
QGKEI

SEQ ID NO: 2648867 - protein, 15 aa, Entamoeba histolytica
QGKEITRERKPKQIK

SEQ ID NO: 2648868 - protein, 8 aa, Entamoeba histolytica
QGKEPIGF

SEQ ID NO: 2648869 - protein, 7 aa, Entamoeba histolytica
QGKEPKE

SEQ ID NO: 2648870 - protein, 5 aa, Entamoeba histolytica
QGKES

SEQ ID NO: 2648871 - protein, 7 aa, Entamoeba histolytica
QGKFNEA

SEQ ID NO: 2648872 - protein, 23 aa, Entamoeba histolytica
QGKFNPQKDRKPPKKPSFIGKEM

SEQ ID NO: 2648873 - protein, 4 aa, Entamoeba histolytica
QGKG

SEQ ID NO: 2648874 - protein, 15 aa, Entamoeba histolytica
QGKGKKGKKTTEGKL

SEQ ID NO: 2648875 - protein, 7 aa, Entamoeba histolytica
QGKGYGS

SEQ ID NO: 2648876 - protein, 8 aa, Entamoeba histolytica
QGKIDKGH

SEQ ID NO: 2648877 - protein, 26 aa, Entamoeba histolytica
QGKIGKDANGEAFSEDCKKSGITPKL

SEQ ID NO: 2648878 - protein, 8 aa, Entamoeba histolytica
QGKKRKPV

SEQ ID NO: 2648879 - protein, 10 aa, Entamoeba histolytica
QGKKYYKEQQ

SEQ ID NO: 2648880 - protein, 55 aa, Entamoeba histolytica
QGKKYYNNYHQKEEKKDDKEKGGHEYPTKRYNRGGLTQEKRNEIKKVNEELRKRH

SEQ ID NO: 2648881 - protein, 8 aa, Entamoeba histolytica
QGKMSTGK

SEQ ID NO: 2648882 - protein, 7 aa, Entamoeba histolytica
QGKNGPV

SEQ ID NO: 2648883 - protein, 4 aa, Entamoeba histolytica
QGKR

SEQ ID NO: 2648884 - protein, 7 aa, Entamoeba histolytica
QGKRNVG

SEQ ID NO: 2648885 - protein, 10 aa, Entamoeba histolytica
QGKSGEIPKD

SEQ ID NO: 2648886 - protein, 5 aa, Entamoeba histolytica
QGKVS

SEQ ID NO: 2648887 - protein, 9 aa, Entamoeba histolytica
QGKWNSKEV

SEQ ID NO: 2648888 - protein, 11 aa, Entamoeba histolytica
QGKYRQEGRNY

SEQ ID NO: 2648889 - protein, 8 aa, Entamoeba histolytica
QGLDSKEI

SEQ ID NO: 2648890 - protein, 5 aa, Entamoeba histolytica
QGLGL

SEQ ID NO: 2648891 - protein, 6 aa, Entamoeba histolytica
QGLRER

SEQ ID NO: 2648892 - protein, 4 aa, Entamoeba histolytica
QGLT

SEQ ID NO: 2648893 - protein, 5 aa, Entamoeba histolytica
QGLTG

SEQ ID NO: 2648894 - protein, 5 aa, Entamoeba histolytica
QGMDP

SEQ ID NO: 2648895 - protein, 7 aa, Entamoeba histolytica
QGMDTDS

SEQ ID NO: 2648896 - protein, 4 aa, Entamoeba histolytica
QGNE

SEQ ID NO: 2648897 - protein, 8 aa, Entamoeba histolytica
QGNEEKAL

SEQ ID NO: 2648898 - protein, 9 aa, Entamoeba histolytica
QGNEERKEV

SEQ ID NO: 2648899 - protein, 14 aa, Entamoeba histolytica
QGNGLNEDKEIFSN

SEQ ID NO: 2648900 - protein, 4 aa, Entamoeba histolytica
QGNK

SEQ ID NO: 2648901 - protein, 9 aa, Entamoeba histolytica
QGNKREAQV

SEQ ID NO: 2648902 - protein, 4 aa, Entamoeba histolytica
QGNM

SEQ ID NO: 2648903 - protein, 6 aa, Entamoeba histolytica
QGNNGI

SEQ ID NO: 2648904 - protein, 17 aa, Entamoeba histolytica
QGNNRPVKGKHKTNAIK

SEQ ID NO: 2648905 - protein, 8 aa, Entamoeba histolytica
QGNNWQDQ

SEQ ID NO: 2648906 - protein, 5 aa, Entamoeba histolytica
QGNQK

SEQ ID NO: 2648907 - protein, 5 aa, Entamoeba histolytica
QGNQY

SEQ ID NO: 2648908 - protein, 7 aa, Entamoeba histolytica
QGNRCKE

SEQ ID NO: 2648909 - protein, 9 aa, Entamoeba histolytica
QGNRNEIEG

SEQ ID NO: 2648910 - protein, 8 aa, Entamoeba histolytica
QGNSPLFD

SEQ ID NO: 2648911 - protein, 8 aa, Entamoeba histolytica
QGNSSCTE

SEQ ID NO: 2648912 - protein, 5 aa, Entamoeba histolytica
QGNTF

SEQ ID NO: 2648913 - protein, 11 aa, Entamoeba histolytica
QGNTGSTTEEC

SEQ ID NO: 2648914 - protein, 6 aa, Entamoeba histolytica
QGNTRT

SEQ ID NO: 2648915 - protein, 11 aa, Entamoeba histolytica
QGNVPQAYKET

SEQ ID NO: 2648916 - protein, 19 aa, Entamoeba histolytica
QGPIEDLPPSPLPTQSPSI

SEQ ID NO: 2648917 - protein, 9 aa, Entamoeba histolytica
QGPNGEPTC

SEQ ID NO: 2648918 - protein, 10 aa, Entamoeba histolytica
QGPPGTGKTK

SEQ ID NO: 2648919 - protein, 13 aa, Entamoeba histolytica
QGPPGTGKTVTSA

SEQ ID NO: 2648920 - protein, 9 aa, Entamoeba histolytica
QGPPPPSMF

SEQ ID NO: 2648921 - protein, 18 aa, Entamoeba histolytica
QGPPTHPIPEDDGKIDTE

SEQ ID NO: 2648922 - protein, 14 aa, Entamoeba histolytica
QGPQVTEQKVEEQQ

SEQ ID NO: 2648923 - protein, 14 aa, Entamoeba histolytica
QGPSFNKRSKPVAN

SEQ ID NO: 2648924 - protein, 8 aa, Entamoeba histolytica
QGPYKKIS

SEQ ID NO: 2648925 - protein, 10 aa, Entamoeba histolytica
QGQDLSDDKI

SEQ ID NO: 2648926 - protein, 5 aa, Entamoeba histolytica
QGQKF

SEQ ID NO: 2648927 - protein, 7 aa, Entamoeba histolytica
QGQSTLG

SEQ ID NO: 2648928 - protein, 4 aa, Entamoeba histolytica
QGQY

SEQ ID NO: 2648929 - protein, 5 aa, Entamoeba histolytica
QGRED

SEQ ID NO: 2648930 - protein, 36 aa, Entamoeba histolytica
QGREIKEKETTKIPQINKTKYGMNRHKPSKRRISNK

SEQ ID NO: 2648931 - protein, 8 aa, Entamoeba histolytica
QGRRREDV

SEQ ID NO: 2648932 - protein, 5 aa, Entamoeba histolytica
QGRSW

SEQ ID NO: 2648933 - protein, 10 aa, Entamoeba histolytica
QGRVEPKNEI

SEQ ID NO: 2648934 - protein, 5 aa, Entamoeba histolytica
QGRWD

SEQ ID NO: 2648935 - protein, 12 aa, Entamoeba histolytica
QGRWDTRRHFIE

SEQ ID NO: 2648936 - protein, 10 aa, Entamoeba histolytica
QGSEEKNKFY

SEQ ID NO: 2648937 - protein, 18 aa, Entamoeba histolytica
QGSENEYHYATDEGNKDL

SEQ ID NO: 2648938 - protein, 9 aa, Entamoeba histolytica
QGSETANNY

SEQ ID NO: 2648939 - protein, 5 aa, Entamoeba histolytica
QGSFG

SEQ ID NO: 2648940 - protein, 7 aa, Entamoeba histolytica
QGSFNDK

SEQ ID NO: 2648941 - protein, 5 aa, Entamoeba histolytica
QGSGD

SEQ ID NO: 2648942 - protein, 8 aa, Entamoeba histolytica
QGSGKSEL

SEQ ID NO: 2648943 - protein, 19 aa, Entamoeba histolytica
QGSIGELRKKSAQQEKGIQ

SEQ ID NO: 2648944 - protein, 10 aa, Entamoeba histolytica
QGSNKDYINP

SEQ ID NO: 2648945 - protein, 7 aa, Entamoeba histolytica
QGSSKNI

SEQ ID NO: 2648946 - protein, 5 aa, Entamoeba histolytica
QGSSY

SEQ ID NO: 2648947 - protein, 10 aa, Entamoeba histolytica
QGTDPKSMEI

SEQ ID NO: 2648948 - protein, 9 aa, Entamoeba histolytica
QGTEQVQGQ

SEQ ID NO: 2648949 - protein, 5 aa, Entamoeba histolytica
QGTGN

SEQ ID NO: 2648950 - protein, 4 aa, Entamoeba histolytica
QGTL

SEQ ID NO: 2648951 - protein, 12 aa, Entamoeba histolytica
QGTNEKRIPGNK

SEQ ID NO: 2648952 - protein, 4 aa, Entamoeba histolytica
QGTP

SEQ ID NO: 2648953 - protein, 4 aa, Entamoeba histolytica
QGTQ

SEQ ID NO: 2648954 - protein, 40 aa, Entamoeba histolytica
QGTSLEQTQPVIEQQKKPQTEPTNPNGKKQRGRPKLDHNR

SEQ ID NO: 2648955 - protein, 6 aa, Entamoeba histolytica
QGTSVT

SEQ ID NO: 2648956 - protein, 5 aa, Entamoeba histolytica
QGTTQ

SEQ ID NO: 2648957 - protein, 8 aa, Entamoeba histolytica
QGTTTQNF

SEQ ID NO: 2648958 - protein, 4 aa, Entamoeba histolytica
QGTV

SEQ ID NO: 2648959 - protein, 7 aa, Entamoeba histolytica
QGTVNSR

SEQ ID NO: 2648960 - protein, 16 aa, Entamoeba histolytica
QGVAPKTAARRCENNR

SEQ ID NO: 2648961 - protein, 6 aa, Entamoeba histolytica
QGVEGV

SEQ ID NO: 2648962 - protein, 7 aa, Entamoeba histolytica
QGVEPKS

SEQ ID NO: 2648963 - protein, 6 aa, Entamoeba histolytica
QGVETE

SEQ ID NO: 2648964 - protein, 4 aa, Entamoeba histolytica
QGVG

SEQ ID NO: 2648965 - protein, 18 aa, Entamoeba histolytica
QGVNGSGPVKVKQDQTNT

SEQ ID NO: 2648966 - protein, 7 aa, Entamoeba histolytica
QGVSNED

SEQ ID NO: 2648967 - protein, 5 aa, Entamoeba histolytica
QGVTK

SEQ ID NO: 2648968 - protein, 8 aa, Entamoeba histolytica
QGVYQGEH

SEQ ID NO: 2648969 - protein, 4 aa, Entamoeba histolytica
QGWE

SEQ ID NO: 2648970 - protein, 5 aa, Entamoeba histolytica
QGWNK

SEQ ID NO: 2648971 - protein, 4 aa, Entamoeba histolytica
QGYE

SEQ ID NO: 2648972 - protein, 11 aa, Entamoeba histolytica
QGYESKVPSIS

SEQ ID NO: 2648973 - protein, 6 aa, Entamoeba histolytica
QGYGTG

SEQ ID NO: 2648974 - protein, 4 aa, Entamoeba histolytica
QGYI

SEQ ID NO: 2648975 - protein, 6 aa, Entamoeba histolytica
QGYIDA

SEQ ID NO: 2648976 - protein, 30 aa, Entamoeba histolytica
QGYNDSITSTTTSFDSLNNKNINTQEKCYE

SEQ ID NO: 2648977 - protein, 7 aa, Entamoeba histolytica
QGYTSGK

SEQ ID NO: 2648978 - protein, 6 aa, Entamoeba histolytica
QHANES

SEQ ID NO: 2648979 - protein, 7 aa, Entamoeba histolytica
QHANSSY

SEQ ID NO: 2648980 - protein, 4 aa, Entamoeba histolytica
QHAP

SEQ ID NO: 2648981 - protein, 14 aa, Entamoeba histolytica
QHDFNGNTNTRSAI

SEQ ID NO: 2648982 - protein, 10 aa, Entamoeba histolytica
QHDKNQNNTS

SEQ ID NO: 2648983 - protein, 9 aa, Entamoeba histolytica
QHDNKQTNR

SEQ ID NO: 2648984 - protein, 10 aa, Entamoeba histolytica
QHDNRVNEKK

SEQ ID NO: 2648985 - protein, 5 aa, Entamoeba histolytica
QHEFT

SEQ ID NO: 2648986 - protein, 5 aa, Entamoeba histolytica
QHGIK

SEQ ID NO: 2648987 - protein, 13 aa, Entamoeba histolytica
QHIKQSKEINEQD

SEQ ID NO: 2648988 - protein, 11 aa, Entamoeba histolytica
QHIKRSKPMKL

SEQ ID NO: 2648989 - protein, 9 aa, Entamoeba histolytica
QHKETQQSA

SEQ ID NO: 2648990 - protein, 20 aa, Entamoeba histolytica
QHKNDDEKAQYDISLQIQPR

SEQ ID NO: 2648991 - protein, 6 aa, Entamoeba histolytica
QHKNKN

SEQ ID NO: 2648992 - protein, 35 aa, Entamoeba histolytica
QHKPTTVHHEEKEEPKEEPKNEEPKEEPKNEESIK

SEQ ID NO: 2648993 - protein, 10 aa, Entamoeba histolytica
QHKTQQDSRA

SEQ ID NO: 2648994 - protein, 14 aa, Entamoeba histolytica
QHKTSTVPINSHSD

SEQ ID NO: 2648995 - protein, 4 aa, Entamoeba histolytica
QHLK

SEQ ID NO: 2648996 - protein, 12 aa, Entamoeba histolytica
QHLSSESNISEN

SEQ ID NO: 2648997 - protein, 5 aa, Entamoeba histolytica
QHNEN

SEQ ID NO: 2648998 - protein, 7 aa, Entamoeba histolytica
QHNKEKL

SEQ ID NO: 2648999 - protein, 7 aa, Entamoeba histolytica
QHNNNEE

SEQ ID NO: 2649000 - protein, 5 aa, Entamoeba histolytica
QHNNP

SEQ ID NO: 2649001 - protein, 7 aa, Entamoeba histolytica
QHNPTIG

SEQ ID NO: 2649002 - protein, 6 aa, Entamoeba histolytica
QHPDND

SEQ ID NO: 2649003 - protein, 24 aa, Entamoeba histolytica
QHPPKEPTPNQPLTSDEIAKQGQM

SEQ ID NO: 2649004 - protein, 38 aa, Entamoeba histolytica
QHPQNQNKEKDHRKKSTREESRKPKPIAEKQPKVEKAP

SEQ ID NO: 2649005 - protein, 4 aa, Entamoeba histolytica
QHPT

SEQ ID NO: 2649006 - protein, 5 aa, Entamoeba histolytica
QHPTK

SEQ ID NO: 2649007 - protein, 23 aa, Entamoeba histolytica
QHQDTSAPVEATPVVEEKGEVVE

SEQ ID NO: 2649008 - protein, 8 aa, Entamoeba histolytica
QHQEDKEL

SEQ ID NO: 2649009 - protein, 4 aa, Entamoeba histolytica
QHQF

SEQ ID NO: 2649010 - protein, 4 aa, Entamoeba histolytica
QHQK

SEQ ID NO: 2649011 - protein, 9 aa, Entamoeba histolytica
QHQNEQTKL

SEQ ID NO: 2649012 - protein, 5 aa, Entamoeba histolytica
QHQNY

SEQ ID NO: 2649013 - protein, 9 aa, Entamoeba histolytica
QHQQQKKKE

SEQ ID NO: 2649014 - protein, 7 aa, Entamoeba histolytica
QHQSEYN

SEQ ID NO: 2649015 - protein, 4 aa, Entamoeba histolytica
QHQY

SEQ ID NO: 2649016 - protein, 10 aa, Entamoeba histolytica
QHREETNERM

SEQ ID NO: 2649017 - protein, 10 aa, Entamoeba histolytica
QHREQSPNDF

SEQ ID NO: 2649018 - protein, 5 aa, Entamoeba histolytica
QHRGK

SEQ ID NO: 2649019 - protein, 8 aa, Entamoeba histolytica
QHRRRSEI

SEQ ID NO: 2649020 - protein, 5 aa, Entamoeba histolytica
QHSLE

SEQ ID NO: 2649021 - protein, 9 aa, Entamoeba histolytica
QHSNDQDKI

SEQ ID NO: 2649022 - protein, 18 aa, Entamoeba histolytica
QHSPKTTALGFGYQSFEE

SEQ ID NO: 2649023 - protein, 5 aa, Entamoeba histolytica
QHSPT

SEQ ID NO: 2649024 - protein, 9 aa, Entamoeba histolytica
QHSQKRHSE

SEQ ID NO: 2649025 - protein, 13 aa, Entamoeba histolytica
QHSQPIQNNQFSN

SEQ ID NO: 2649026 - protein, 5 aa, Entamoeba histolytica
QHSRD

SEQ ID NO: 2649027 - protein, 10 aa, Entamoeba histolytica
QHSSQYPQQF

SEQ ID NO: 2649028 - protein, 6 aa, Entamoeba histolytica
QHSSTE

SEQ ID NO: 2649029 - protein, 14 aa, Entamoeba histolytica
QHSVDKKYYNDGED

SEQ ID NO: 2649030 - protein, 13 aa, Entamoeba histolytica
QHTKKEDQKGLYS

SEQ ID NO: 2649031 - protein, 6 aa, Entamoeba histolytica
QHTNTE

SEQ ID NO: 2649032 - protein, 12 aa, Entamoeba histolytica
QHTSPRQSPKKI

SEQ ID NO: 2649033 - protein, 12 aa, Entamoeba histolytica
QHTSSHSKPIKS

SEQ ID NO: 2649034 - protein, 19 aa, Entamoeba histolytica
QHVNDKSESVSEGSNNSSS

SEQ ID NO: 2649035 - protein, 5 aa, Entamoeba histolytica
QHVNS

SEQ ID NO: 2649036 - protein, 11 aa, Entamoeba histolytica
QHYEEHKGKGF

SEQ ID NO: 2649037 - protein, 5 aa, Entamoeba histolytica
QIAGE

SEQ ID NO: 2649038 - protein, 19 aa, Entamoeba histolytica
QIAKKKAEEEKKKIGNEKN

SEQ ID NO: 2649039 - protein, 7 aa, Entamoeba histolytica
QIAPTWE

SEQ ID NO: 2649040 - protein, 5 aa, Entamoeba histolytica
QIDGN

SEQ ID NO: 2649041 - protein, 17 aa, Entamoeba histolytica
QIDKNDTPIPSCFELIK

SEQ ID NO: 2649042 - protein, 4 aa, Entamoeba histolytica
QIDP

SEQ ID NO: 2649043 - protein, 5 aa, Entamoeba histolytica
QIDQR

SEQ ID NO: 2649044 - protein, 9 aa, Entamoeba histolytica
QIDRQNTIQ

SEQ ID NO: 2649045 - protein, 12 aa, Entamoeba histolytica
QIDSKELDYISQ

SEQ ID NO: 2649046 - protein, 7 aa, Entamoeba histolytica
QIDSNEY

SEQ ID NO: 2649047 - protein, 5 aa, Entamoeba histolytica
QIDYA

SEQ ID NO: 2649048 - protein, 7 aa, Entamoeba histolytica
QIEDTST

SEQ ID NO: 2649049 - protein, 7 aa, Entamoeba histolytica
QIEEDPE

SEQ ID NO: 2649050 - protein, 13 aa, Entamoeba histolytica
QIEEENDKEKEEL

SEQ ID NO: 2649051 - protein, 15 aa, Entamoeba histolytica
QIEEERKKEQEINEK

SEQ ID NO: 2649052 - protein, 14 aa, Entamoeba histolytica
QIEEGKKKGRIELN

SEQ ID NO: 2649053 - protein, 24 aa, Entamoeba histolytica
QIEELKQKNEENTKENIEKQNQIN

SEQ ID NO: 2649054 - protein, 14 aa, Entamoeba histolytica
QIEENEDKKKEFEK

SEQ ID NO: 2649055 - protein, 11 aa, Entamoeba histolytica
QIEENKKGPQL

SEQ ID NO: 2649056 - protein, 13 aa, Entamoeba histolytica
QIEFNSSKEKELH

SEQ ID NO: 2649057 - protein, 4 aa, Entamoeba histolytica
QIEG

SEQ ID NO: 2649058 - protein, 7 aa, Entamoeba histolytica
QIEGGAF

SEQ ID NO: 2649059 - protein, 7 aa, Entamoeba histolytica
QIEINNK

SEQ ID NO: 2649060 - protein, 25 aa, Entamoeba histolytica
QIEKKSNDEEEIQIEKEKIEKFFAQ

SEQ ID NO: 2649061 - protein, 25 aa, Entamoeba histolytica
QIEKKSNDKEEIQIQKEKIEKFFAQ

SEQ ID NO: 2649062 - protein, 9 aa, Entamoeba histolytica
QIENESKKQ

SEQ ID NO: 2649063 - protein, 7 aa, Entamoeba histolytica
QIENPSV

SEQ ID NO: 2649064 - protein, 25 aa, Entamoeba histolytica
QIENQKIQNQNDELKKINQTKENEK

SEQ ID NO: 2649065 - protein, 4 aa, Entamoeba histolytica
QIEQ

SEQ ID NO: 2649066 - protein, 10 aa, Entamoeba histolytica
QIEQDQCSGI

SEQ ID NO: 2649067 - protein, 90 aa, Entamoeba histolytica
QIEQEKQRKLEEERKKKEEAIKRKKEEEERKRKEEERRKREEAERKRKEEEERKRKEEEAKRKIEQERQRKIEEERRKKEEEEQRRLEEE

SEQ ID NO: 2649068 - protein, 10 aa, Entamoeba histolytica
QIEQKKEIEK

SEQ ID NO: 2649069 - protein, 9 aa, Entamoeba histolytica
QIESEGGSC

SEQ ID NO: 2649070 - protein, 8 aa, Entamoeba histolytica
QIESGKGL

SEQ ID NO: 2649071 - protein, 8 aa, Entamoeba histolytica
QIESKKEK

SEQ ID NO: 2649072 - protein, 11 aa, Entamoeba histolytica
QIESKLKDSYL

SEQ ID NO: 2649073 - protein, 5 aa, Entamoeba histolytica
QIESL

SEQ ID NO: 2649074 - protein, 6 aa, Entamoeba histolytica
QIESRK

SEQ ID NO: 2649075 - protein, 4 aa, Entamoeba histolytica
QIET

SEQ ID NO: 2649076 - protein, 12 aa, Entamoeba histolytica
QIGGNKLTRESR

SEQ ID NO: 2649077 - protein, 4 aa, Entamoeba histolytica
QIGN

SEQ ID NO: 2649078 - protein, 5 aa, Entamoeba histolytica
QIGNE

SEQ ID NO: 2649079 - protein, 5 aa, Entamoeba histolytica
QIGNH

SEQ ID NO: 2649080 - protein, 10 aa, Entamoeba histolytica
QIGRNRNAPD

SEQ ID NO: 2649081 - protein, 8 aa, Entamoeba histolytica
QIGTNSYD

SEQ ID NO: 2649082 - protein, 10 aa, Entamoeba histolytica
QIIPNNNPEW

SEQ ID NO: 2649083 - protein, 12 aa, Entamoeba histolytica
QIKDESCSDIPK

SEQ ID NO: 2649084 - protein, 7 aa, Entamoeba histolytica
QIKEAGG

SEQ ID NO: 2649085 - protein, 10 aa, Entamoeba histolytica
QIKEEDKNEH

SEQ ID NO: 2649086 - protein, 10 aa, Entamoeba histolytica
QIKEETEKNV

SEQ ID NO: 2649087 - protein, 9 aa, Entamoeba histolytica
QIKEGKEVP

SEQ ID NO: 2649088 - protein, 5 aa, Entamoeba histolytica
QIKEN

SEQ ID NO: 2649089 - protein, 23 aa, Entamoeba histolytica
QIKENETSNTSNHIRPSLPGNYE

SEQ ID NO: 2649090 - protein, 19 aa, Entamoeba histolytica
QIKKENQRKVKENEELNTE

SEQ ID NO: 2649091 - protein, 7 aa, Entamoeba histolytica
QIKKPTS

SEQ ID NO: 2649092 - protein, 10 aa, Entamoeba histolytica
QIKNDNAELR

SEQ ID NO: 2649093 - protein, 33 aa, Entamoeba histolytica
QIKNERDNISNEFNKTKEEIKQKENETIQLNEE

SEQ ID NO: 2649094 - protein, 12 aa, Entamoeba histolytica
QIKNGSSKSPRL

SEQ ID NO: 2649095 - protein, 14 aa, Entamoeba histolytica
QIKNKKTGNGLGDN

SEQ ID NO: 2649096 - protein, 15 aa, Entamoeba histolytica
QIKNNERNKRKLPSI

SEQ ID NO: 2649097 - protein, 5 aa, Entamoeba histolytica
QIKPF

SEQ ID NO: 2649098 - protein, 6 aa, Entamoeba histolytica
QIKQAD

SEQ ID NO: 2649099 - protein, 7 aa, Entamoeba histolytica
QIKQDEE

SEQ ID NO: 2649100 - protein, 13 aa, Entamoeba histolytica
QIKRESKSFEAIQ

SEQ ID NO: 2649101 - protein, 4 aa, Entamoeba histolytica
QIKT

SEQ ID NO: 2649102 - protein, 30 aa, Entamoeba histolytica
QIKTEKQEIENELNQTKDEKQKIEDEKSKL

SEQ ID NO: 2649103 - protein, 5 aa, Entamoeba histolytica
QIKTQ

SEQ ID NO: 2649104 - protein, 6 aa, Entamoeba histolytica
QIKTSE

SEQ ID NO: 2649105 - protein, 5 aa, Entamoeba histolytica
QILNS

SEQ ID NO: 2649106 - protein, 14 aa, Entamoeba histolytica
QILSTEDKKSPKEF

SEQ ID NO: 2649107 - protein, 4 aa, Entamoeba histolytica
QIND

SEQ ID NO: 2649108 - protein, 15 aa, Entamoeba histolytica
QINDKEMKEIPSTTQ

SEQ ID NO: 2649109 - protein, 4 aa, Entamoeba histolytica
QINE

SEQ ID NO: 2649110 - protein, 6 aa, Entamoeba histolytica
QINEGK

SEQ ID NO: 2649111 - protein, 18 aa, Entamoeba histolytica
QINEKEGVVSNNREETLN

SEQ ID NO: 2649112 - protein, 13 aa, Entamoeba histolytica
QINEKKKKLNYNG

SEQ ID NO: 2649113 - protein, 27 aa, Entamoeba histolytica
QINESKDINEVEPSAQLTLSQKEAQPV

SEQ ID NO: 2649114 - protein, 5 aa, Entamoeba histolytica
QINET

SEQ ID NO: 2649115 - protein, 6 aa, Entamoeba histolytica
QINKEQ

SEQ ID NO: 2649116 - protein, 4 aa, Entamoeba histolytica
QINP

SEQ ID NO: 2649117 - protein, 6 aa, Entamoeba histolytica
QINQES

SEQ ID NO: 2649118 - protein, 13 aa, Entamoeba histolytica
QINQQKDKKREDI

SEQ ID NO: 2649119 - protein, 11 aa, Entamoeba histolytica
QINQQQEDEEI

SEQ ID NO: 2649120 - protein, 7 aa, Entamoeba histolytica
QINQSQK

SEQ ID NO: 2649121 - protein, 6 aa, Entamoeba histolytica
QINQST

SEQ ID NO: 2649122 - protein, 8 aa, Entamoeba histolytica
QINSSSKD

SEQ ID NO: 2649123 - protein, 7 aa, Entamoeba histolytica
QINTEKE

SEQ ID NO: 2649124 - protein, 8 aa, Entamoeba histolytica
QIPDSKKT

SEQ ID NO: 2649125 - protein, 5 aa, Entamoeba histolytica
QIPEA

SEQ ID NO: 2649126 - protein, 13 aa, Entamoeba histolytica
QIPGTGAAGGLGG

SEQ ID NO: 2649127 - protein, 20 aa, Entamoeba histolytica
QIPIKSNKEERKKNKERNTK

SEQ ID NO: 2649128 - protein, 9 aa, Entamoeba histolytica
QIPKAIGNQ

SEQ ID NO: 2649129 - protein, 13 aa, Entamoeba histolytica
QIPKAPKKGYKYI

SEQ ID NO: 2649130 - protein, 7 aa, Entamoeba histolytica
QIPLSDE

SEQ ID NO: 2649131 - protein, 42 aa, Entamoeba histolytica
QIPNAEDKLDNKKKPKIPKIEKDDKTKKQPSRKRKTKEIEKN

SEQ ID NO: 2649132 - protein, 9 aa, Entamoeba histolytica
QIPNAPQKK

SEQ ID NO: 2649133 - protein, 63 aa, Entamoeba histolytica
QIPNQQIPNQQIPNQQIPNQQIPNQQQPVNTLNQQQPVNTFNQQPTQINSSNQQQEKGDDDEI

SEQ ID NO: 2649134 - protein, 17 aa, Entamoeba histolytica
QIPNTPPTEMEENQPDV

SEQ ID NO: 2649135 - protein, 8 aa, Entamoeba histolytica
QIPPPPRL

SEQ ID NO: 2649136 - protein, 18 aa, Entamoeba histolytica
QIPPQTETNNKTYRSSKS

SEQ ID NO: 2649137 - protein, 5 aa, Entamoeba histolytica
QIPSI

SEQ ID NO: 2649138 - protein, 6 aa, Entamoeba histolytica
QIPSKT

SEQ ID NO: 2649139 - protein, 9 aa, Entamoeba histolytica
QIPSNNELD

SEQ ID NO: 2649140 - protein, 12 aa, Entamoeba histolytica
QIPSPGGVQQQQ

SEQ ID NO: 2649141 - protein, 11 aa, Entamoeba histolytica
QIPSSLKEYPS

SEQ ID NO: 2649142 - protein, 13 aa, Entamoeba histolytica
QIPSTDKMNLSGN

SEQ ID NO: 2649143 - protein, 19 aa, Entamoeba histolytica
QIQNKEEQIEYQSDDNVNN

SEQ ID NO: 2649144 - protein, 13 aa, Entamoeba histolytica
QIQNKKTGNGFGD

SEQ ID NO: 2649145 - protein, 14 aa, Entamoeba histolytica
QIQNKKTGNGLGDN

SEQ ID NO: 2649146 - protein, 20 aa, Entamoeba histolytica
QIQNNEQKSIIQSKENQYNQ

SEQ ID NO: 2649147 - protein, 5 aa, Entamoeba histolytica
QIQQE

SEQ ID NO: 2649148 - protein, 15 aa, Entamoeba histolytica
QIQTPRGDTSDPTSL

SEQ ID NO: 2649149 - protein, 10 aa, Entamoeba histolytica
QIRAEKAKTQ

SEQ ID NO: 2649150 - protein, 9 aa, Entamoeba histolytica
QIRERAGKR

SEQ ID NO: 2649151 - protein, 6 aa, Entamoeba histolytica
QIRSGD

SEQ ID NO: 2649152 - protein, 8 aa, Entamoeba histolytica
QIRSTEGF

SEQ ID NO: 2649153 - protein, 6 aa, Entamoeba histolytica
QISEKD

SEQ ID NO: 2649154 - protein, 5 aa, Entamoeba histolytica
QISGS

SEQ ID NO: 2649155 - protein, 9 aa, Entamoeba histolytica
QISKGKKSY

SEQ ID NO: 2649156 - protein, 6 aa, Entamoeba histolytica
QISNRE

SEQ ID NO: 2649157 - protein, 21 aa, Entamoeba histolytica
QISPSQTLSPMRKKRKQYTIT

SEQ ID NO: 2649158 - protein, 12 aa, Entamoeba histolytica
QISQDDDTKTKD

SEQ ID NO: 2649159 - protein, 11 aa, Entamoeba histolytica
QISQIPNDVST

SEQ ID NO: 2649160 - protein, 5 aa, Entamoeba histolytica
QISQT

SEQ ID NO: 2649161 - protein, 4 aa, Entamoeba histolytica
QISR

SEQ ID NO: 2649162 - protein, 7 aa, Entamoeba histolytica
QISSEEC

SEQ ID NO: 2649163 - protein, 13 aa, Entamoeba histolytica
QISSKEGHESVHQ

SEQ ID NO: 2649164 - protein, 9 aa, Entamoeba histolytica
QISSRTSAI

SEQ ID NO: 2649165 - protein, 15 aa, Entamoeba histolytica
QISSTGTTQSTNGRI

SEQ ID NO: 2649166 - protein, 4 aa, Entamoeba histolytica
QISV

SEQ ID NO: 2649167 - protein, 25 aa, Entamoeba histolytica
QISYQSKRPIKSENSSFKRSSPCPR

SEQ ID NO: 2649168 - protein, 4 aa, Entamoeba histolytica
QITE

SEQ ID NO: 2649169 - protein, 10 aa, Entamoeba histolytica
QITEEINTSQ

SEQ ID NO: 2649170 - protein, 6 aa, Entamoeba histolytica
QITENP

SEQ ID NO: 2649171 - protein, 6 aa, Entamoeba histolytica
QITGHS

SEQ ID NO: 2649172 - protein, 6 aa, Entamoeba histolytica
QITGNH

SEQ ID NO: 2649173 - protein, 4 aa, Entamoeba histolytica
QITH

SEQ ID NO: 2649174 - protein, 7 aa, Entamoeba histolytica
QITKRKE

SEQ ID NO: 2649175 - protein, 5 aa, Entamoeba histolytica
QITNT

SEQ ID NO: 2649176 - protein, 8 aa, Entamoeba histolytica
QITNTDNF

SEQ ID NO: 2649177 - protein, 5 aa, Entamoeba histolytica
QITPS

SEQ ID NO: 2649178 - protein, 28 aa, Entamoeba histolytica
QITQETKIQEGVSSTKKRTLPNNGNKPL

SEQ ID NO: 2649179 - protein, 7 aa, Entamoeba histolytica
QITQGQS

SEQ ID NO: 2649180 - protein, 12 aa, Entamoeba histolytica
QITQKKGYKKGN

SEQ ID NO: 2649181 - protein, 5 aa, Entamoeba histolytica
QITSI

SEQ ID NO: 2649182 - protein, 9 aa, Entamoeba histolytica
QITSIGDID

SEQ ID NO: 2649183 - protein, 7 aa, Entamoeba histolytica
QITSQND

SEQ ID NO: 2649184 - protein, 4 aa, Entamoeba histolytica
QITT

SEQ ID NO: 2649185 - protein, 5 aa, Entamoeba histolytica
QIVDN

SEQ ID NO: 2649186 - protein, 20 aa, Entamoeba histolytica
QIVTRNKSNDSLRKIGREER

SEQ ID NO: 2649187 - protein, 10 aa, Entamoeba histolytica
QIYNNNPRNI

SEQ ID NO: 2649188 - protein, 9 aa, Entamoeba histolytica
QKADEQIKD

SEQ ID NO: 2649189 - protein, 6 aa, Entamoeba histolytica
QKAEDV

SEQ ID NO: 2649190 - protein, 13 aa, Entamoeba histolytica
QKAEETLKNAELT

SEQ ID NO: 2649191 - protein, 7 aa, Entamoeba histolytica
QKAGFAI

SEQ ID NO: 2649192 - protein, 14 aa, Entamoeba histolytica
QKAKITTKIDPTNN

SEQ ID NO: 2649193 - protein, 40 aa, Entamoeba histolytica
QKALEEKQKKEKEEFERKQKEEKEKREKEMAEKKRREDER

SEQ ID NO: 2649194 - protein, 6 aa, Entamoeba histolytica
QKALNE

SEQ ID NO: 2649195 - protein, 25 aa, Entamoeba histolytica
QKANEEKIKNLNTTSGQIKKEIDEL

SEQ ID NO: 2649196 - protein, 8 aa, Entamoeba histolytica
QKAQSEDR

SEQ ID NO: 2649197 - protein, 18 aa, Entamoeba histolytica
QKARGRGRNQLGTLGSGN

SEQ ID NO: 2649198 - protein, 9 aa, Entamoeba histolytica
QKARKALSD

SEQ ID NO: 2649199 - protein, 7 aa, Entamoeba histolytica
QKATGEF

SEQ ID NO: 2649200 - protein, 8 aa, Entamoeba histolytica
QKATNGEW

SEQ ID NO: 2649201 - protein, 9 aa, Entamoeba histolytica
QKCSEDEPI

SEQ ID NO: 2649202 - protein, 9 aa, Entamoeba histolytica
QKCSEEEIN

SEQ ID NO: 2649203 - protein, 9 aa, Entamoeba histolytica
QKCSQELDE

SEQ ID NO: 2649204 - protein, 10 aa, Entamoeba histolytica
QKDDDERKEF

SEQ ID NO: 2649205 - protein, 6 aa, Entamoeba histolytica
QKDDIY

SEQ ID NO: 2649206 - protein, 14 aa, Entamoeba histolytica
QKDEFTEKWSGAND

SEQ ID NO: 2649207 - protein, 8 aa, Entamoeba histolytica
QKDEHKKK

SEQ ID NO: 2649208 - protein, 8 aa, Entamoeba histolytica
QKDETHKN

SEQ ID NO: 2649209 - protein, 8 aa, Entamoeba histolytica
QKDFNSSR

SEQ ID NO: 2649210 - protein, 7 aa, Entamoeba histolytica
QKDGYSF

SEQ ID NO: 2649211 - protein, 9 aa, Entamoeba histolytica
QKDISKPIE

SEQ ID NO: 2649212 - protein, 9 aa, Entamoeba histolytica
QKDKNKKEM

SEQ ID NO: 2649213 - protein, 7 aa, Entamoeba histolytica
QKDLGMK

SEQ ID NO: 2649214 - protein, 10 aa, Entamoeba histolytica
QKDNETPQQI

SEQ ID NO: 2649215 - protein, 6 aa, Entamoeba histolytica
QKDNEV

SEQ ID NO: 2649216 - protein, 7 aa, Entamoeba histolytica
QKDNTIA

SEQ ID NO: 2649217 - protein, 11 aa, Entamoeba histolytica
QKDPEDRLTNP

SEQ ID NO: 2649218 - protein, 8 aa, Entamoeba histolytica
QKDPVYAT

SEQ ID NO: 2649219 - protein, 8 aa, Entamoeba histolytica
QKDRKSIA

SEQ ID NO: 2649220 - protein, 5 aa, Entamoeba histolytica
QKDSH

SEQ ID NO: 2649221 - protein, 9 aa, Entamoeba histolytica
QKDTEASDM

SEQ ID NO: 2649222 - protein, 8 aa, Entamoeba histolytica
QKDTTDQR

SEQ ID NO: 2649223 - protein, 9 aa, Entamoeba histolytica
QKDTTIKSN

SEQ ID NO: 2649224 - protein, 8 aa, Entamoeba histolytica
QKEAEEWQ

SEQ ID NO: 2649225 - protein, 6 aa, Entamoeba histolytica
QKEAEK

SEQ ID NO: 2649226 - protein, 5 aa, Entamoeba histolytica
QKEAQ

SEQ ID NO: 2649227 - protein, 57 aa, Entamoeba histolytica
QKEAQDNEEMSEEDEEKEEKKENETKEDEKKEDEEKESEEKEENKENNKENNKENNI

SEQ ID NO: 2649228 - protein, 7 aa, Entamoeba histolytica
QKECDEE

SEQ ID NO: 2649229 - protein, 5 aa, Entamoeba histolytica
QKECE

SEQ ID NO: 2649230 - protein, 9 aa, Entamoeba histolytica
QKEDIQSSL

SEQ ID NO: 2649231 - protein, 7 aa, Entamoeba histolytica
QKEDQAL

SEQ ID NO: 2649232 - protein, 9 aa, Entamoeba histolytica
QKEEDEPDN

SEQ ID NO: 2649233 - protein, 15 aa, Entamoeba histolytica
QKEEEIKKLNERNEE

SEQ ID NO: 2649234 - protein, 5 aa, Entamoeba histolytica
QKEEK

SEQ ID NO: 2649235 - protein, 17 aa, Entamoeba histolytica
QKEEKKDVRKDKGISEK

SEQ ID NO: 2649236 - protein, 7 aa, Entamoeba histolytica
QKEEKTN

SEQ ID NO: 2649237 - protein, 5 aa, Entamoeba histolytica
QKEEL

SEQ ID NO: 2649238 - protein, 15 aa, Entamoeba histolytica
QKEELTRQIAQFSKK

SEQ ID NO: 2649239 - protein, 6 aa, Entamoeba histolytica
QKEENL

SEQ ID NO: 2649240 - protein, 22 aa, Entamoeba histolytica
QKEEYSNEEEEEEIEDKLDEQL

SEQ ID NO: 2649241 - protein, 4 aa, Entamoeba histolytica
QKEF

SEQ ID NO: 2649242 - protein, 17 aa, Entamoeba histolytica
QKEFEEQEQIPCGDATK

SEQ ID NO: 2649243 - protein, 8 aa, Entamoeba histolytica
QKEGEDIS

SEQ ID NO: 2649244 - protein, 4 aa, Entamoeba histolytica
QKEI

SEQ ID NO: 2649245 - protein, 8 aa, Entamoeba histolytica
QKEIDTRA

SEQ ID NO: 2649246 - protein, 18 aa, Entamoeba histolytica
QKEIEEARKKGKNNPYPF

SEQ ID NO: 2649247 - protein, 75 aa, Entamoeba histolytica
QKEIEEEERRAKEEEERKAKEEEERKAKEEEERQAKEEEERQAKEEEERKAREEAERKAREEAERKAKELEEEEK

SEQ ID NO: 2649248 - protein, 20 aa, Entamoeba histolytica
QKEIERVKKEEERCNNVEQN

SEQ ID NO: 2649249 - protein, 12 aa, Entamoeba histolytica
QKEIHKTQQTIS

SEQ ID NO: 2649250 - protein, 30 aa, Entamoeba histolytica
QKEIKQENNHTQKDTDDNGETQKENQINIQ

SEQ ID NO: 2649251 - protein, 28 aa, Entamoeba histolytica
QKEISEEKKKAKGKKRNKIKPRKRPARV

SEQ ID NO: 2649252 - protein, 7 aa, Entamoeba histolytica
QKEISEK

SEQ ID NO: 2649253 - protein, 25 aa, Entamoeba histolytica
QKEKDKKEEKNQQQEHKELPKEENV

SEQ ID NO: 2649254 - protein, 9 aa, Entamoeba histolytica
QKEKDNNNL

SEQ ID NO: 2649255 - protein, 12 aa, Entamoeba histolytica
QKEKEEEIQGKE

SEQ ID NO: 2649256 - protein, 13 aa, Entamoeba histolytica
QKEKEESKQYEEN

SEQ ID NO: 2649257 - protein, 20 aa, Entamoeba histolytica
QKEKHSGNGIATGLAKGTES

SEQ ID NO: 2649258 - protein, 9 aa, Entamoeba histolytica
QKEKIKGKK

SEQ ID NO: 2649259 - protein, 7 aa, Entamoeba histolytica
QKEKKEL

SEQ ID NO: 2649260 - protein, 7 aa, Entamoeba histolytica
QKEKREI

SEQ ID NO: 2649261 - protein, 9 aa, Entamoeba histolytica
QKEKTNREQ

SEQ ID NO: 2649262 - protein, 8 aa, Entamoeba histolytica
QKELDNTS

SEQ ID NO: 2649263 - protein, 6 aa, Entamoeba histolytica
QKELPI

SEQ ID NO: 2649264 - protein, 5 aa, Entamoeba histolytica
QKELT

SEQ ID NO: 2649265 - protein, 19 aa, Entamoeba histolytica
QKEMDRQMKEREDKSLQTT

SEQ ID NO: 2649266 - protein, 8 aa, Entamoeba histolytica
QKEMPSKN

SEQ ID NO: 2649267 - protein, 4 aa, Entamoeba histolytica
QKEN

SEQ ID NO: 2649268 - protein, 15 aa, Entamoeba histolytica
QKENEEIKKQNECIE

SEQ ID NO: 2649269 - protein, 8 aa, Entamoeba histolytica
QKENKQEI

SEQ ID NO: 2649270 - protein, 9 aa, Entamoeba histolytica
QKENNEKIE

SEQ ID NO: 2649271 - protein, 9 aa, Entamoeba histolytica
QKENRLKER

SEQ ID NO: 2649272 - protein, 7 aa, Entamoeba histolytica
QKEREKM

SEQ ID NO: 2649273 - protein, 12 aa, Entamoeba histolytica
QKEREKTEDAYS

SEQ ID NO: 2649274 - protein, 7 aa, Entamoeba histolytica
QKEREMN

SEQ ID NO: 2649275 - protein, 6 aa, Entamoeba histolytica
QKERGE

SEQ ID NO: 2649276 - protein, 7 aa, Entamoeba histolytica
QKERKTP

SEQ ID NO: 2649277 - protein, 9 aa, Entamoeba histolytica
QKERQTKRV

SEQ ID NO: 2649278 - protein, 6 aa, Entamoeba histolytica
QKESDV

SEQ ID NO: 2649279 - protein, 31 aa, Entamoeba histolytica
QKESKDFNDSKDSINSSKSSSLGGFLSKERF

SEQ ID NO: 2649280 - protein, 5 aa, Entamoeba histolytica
QKESN

SEQ ID NO: 2649281 - protein, 7 aa, Entamoeba histolytica
QKESNHE

SEQ ID NO: 2649282 - protein, 10 aa, Entamoeba histolytica
QKESTKIEEE

SEQ ID NO: 2649283 - protein, 12 aa, Entamoeba histolytica
QKESVSTTNQLQ

SEQ ID NO: 2649284 - protein, 6 aa, Entamoeba histolytica
QKETIP

SEQ ID NO: 2649285 - protein, 8 aa, Entamoeba histolytica
QKETVDPI

SEQ ID NO: 2649286 - protein, 4 aa, Entamoeba histolytica
QKEV

SEQ ID NO: 2649287 - protein, 5 aa, Entamoeba histolytica
QKEVE

SEQ ID NO: 2649288 - protein, 18 aa, Entamoeba histolytica
QKEVEEKEMTDKKRMERL

SEQ ID NO: 2649289 - protein, 6 aa, Entamoeba histolytica
QKEVES

SEQ ID NO: 2649290 - protein, 6 aa, Entamoeba histolytica
QKEVPY

SEQ ID NO: 2649291 - protein, 12 aa, Entamoeba histolytica
QKEVSEKTETIN

SEQ ID NO: 2649292 - protein, 6 aa, Entamoeba histolytica
QKEVSS

SEQ ID NO: 2649293 - protein, 12 aa, Entamoeba histolytica
QKEVTQGIPPMN

SEQ ID NO: 2649294 - protein, 7 aa, Entamoeba histolytica
QKEYSQS

SEQ ID NO: 2649295 - protein, 15 aa, Entamoeba histolytica
QKFQSSTEKTSTPQF

SEQ ID NO: 2649296 - protein, 8 aa, Entamoeba histolytica
QKFTDGSA

SEQ ID NO: 2649297 - protein, 39 aa, Entamoeba histolytica
QKGALPQAQGVEVTDESEGIKVDKKKYKDATKPSKLKYK

SEQ ID NO: 2649298 - protein, 6 aa, Entamoeba histolytica
QKGCGA

SEQ ID NO: 2649299 - protein, 7 aa, Entamoeba histolytica
QKGDYKT

SEQ ID NO: 2649300 - protein, 4 aa, Entamoeba histolytica
QKGE

SEQ ID NO: 2649301 - protein, 7 aa, Entamoeba histolytica
QKGEDEK

SEQ ID NO: 2649302 - protein, 8 aa, Entamoeba histolytica
QKGFEEKQ

SEQ ID NO: 2649303 - protein, 10 aa, Entamoeba histolytica
QKGGINDSSV

SEQ ID NO: 2649304 - protein, 6 aa, Entamoeba histolytica
QKGIKE

SEQ ID NO: 2649305 - protein, 7 aa, Entamoeba histolytica
QKGLDNW

SEQ ID NO: 2649306 - protein, 5 aa, Entamoeba histolytica
QKGND

SEQ ID NO: 2649307 - protein, 9 aa, Entamoeba histolytica
QKGNEDEKE

SEQ ID NO: 2649308 - protein, 10 aa, Entamoeba histolytica
QKGNNAYQAP

SEQ ID NO: 2649309 - protein, 6 aa, Entamoeba histolytica
QKGNNP

SEQ ID NO: 2649310 - protein, 6 aa, Entamoeba histolytica
QKGQIT

SEQ ID NO: 2649311 - protein, 15 aa, Entamoeba histolytica
QKGRAKTRTTAAEKR

SEQ ID NO: 2649312 - protein, 15 aa, Entamoeba histolytica
QKGRAKTRTTSAEKR

SEQ ID NO: 2649313 - protein, 12 aa, Entamoeba histolytica
QKGRCPTCGAYF

SEQ ID NO: 2649314 - protein, 13 aa, Entamoeba histolytica
QKGRENETFDDSN

SEQ ID NO: 2649315 - protein, 11 aa, Entamoeba histolytica
QKGRRKYYTGD

SEQ ID NO: 2649316 - protein, 7 aa, Entamoeba histolytica
QKGSPLG

SEQ ID NO: 2649317 - protein, 5 aa, Entamoeba histolytica
QKGTQ

SEQ ID NO: 2649318 - protein, 11 aa, Entamoeba histolytica
QKGTSNQKTEL

SEQ ID NO: 2649319 - protein, 5 aa, Entamoeba histolytica
QKGYD

SEQ ID NO: 2649320 - protein, 8 aa, Entamoeba histolytica
QKGYGEIS

SEQ ID NO: 2649321 - protein, 6 aa, Entamoeba histolytica
QKHEPK

SEQ ID NO: 2649322 - protein, 6 aa, Entamoeba histolytica
QKHGKD

SEQ ID NO: 2649323 - protein, 7 aa, Entamoeba histolytica
QKHGSNG

SEQ ID NO: 2649324 - protein, 9 aa, Entamoeba histolytica
QKHKSINES

SEQ ID NO: 2649325 - protein, 14 aa, Entamoeba histolytica
QKHNASSLLRSGSA

SEQ ID NO: 2649326 - protein, 11 aa, Entamoeba histolytica
QKHNNKNSLYP

SEQ ID NO: 2649327 - protein, 7 aa, Entamoeba histolytica
QKHPNEE

SEQ ID NO: 2649328 - protein, 7 aa, Entamoeba histolytica
QKIDDAE

SEQ ID NO: 2649329 - protein, 9 aa, Entamoeba histolytica
QKIDERDNL

SEQ ID NO: 2649330 - protein, 9 aa, Entamoeba histolytica
QKIDSQVHD

SEQ ID NO: 2649331 - protein, 4 aa, Entamoeba histolytica
QKIE

SEQ ID NO: 2649332 - protein, 9 aa, Entamoeba histolytica
QKIEEGSNN

SEQ ID NO: 2649333 - protein, 8 aa, Entamoeba histolytica
QKIEEPPK

SEQ ID NO: 2649334 - protein, 21 aa, Entamoeba histolytica
QKIEKKSRLSETSKKNRKSHY

SEQ ID NO: 2649335 - protein, 11 aa, Entamoeba histolytica
QKIERSKSAPK

SEQ ID NO: 2649336 - protein, 7 aa, Entamoeba histolytica
QKIGNGG

SEQ ID NO: 2649337 - protein, 6 aa, Entamoeba histolytica
QKIGTK

SEQ ID NO: 2649338 - protein, 13 aa, Entamoeba histolytica
QKIKSKNSQMKKD

SEQ ID NO: 2649339 - protein, 8 aa, Entamoeba histolytica
QKIKSSEF

SEQ ID NO: 2649340 - protein, 9 aa, Entamoeba histolytica
QKINASSQE

SEQ ID NO: 2649341 - protein, 18 aa, Entamoeba histolytica
QKINQYGNLPRKEKIEEM

SEQ ID NO: 2649342 - protein, 13 aa, Entamoeba histolytica
QKIQSQRTGVNEI

SEQ ID NO: 2649343 - protein, 10 aa, Entamoeba histolytica
QKIRENQEKY

SEQ ID NO: 2649344 - protein, 5 aa, Entamoeba histolytica
QKISN

SEQ ID NO: 2649345 - protein, 8 aa, Entamoeba histolytica
QKISNGVK

SEQ ID NO: 2649346 - protein, 11 aa, Entamoeba histolytica
QKISTENDDQL

SEQ ID NO: 2649347 - protein, 5 aa, Entamoeba histolytica
QKITD

SEQ ID NO: 2649348 - protein, 11 aa, Entamoeba histolytica
QKITKKSTLGE

SEQ ID NO: 2649349 - protein, 27 aa, Entamoeba histolytica
QKKADEHKLKGNEYLNAKDYSKAIDEY

SEQ ID NO: 2649350 - protein, 8 aa, Entamoeba histolytica
QKKADSIR

SEQ ID NO: 2649351 - protein, 29 aa, Entamoeba histolytica
QKKAKAAQKKAQKKAKAAQKKAQKKAKML

SEQ ID NO: 2649352 - protein, 14 aa, Entamoeba histolytica
QKKAKGKELSRAEG

SEQ ID NO: 2649353 - protein, 11 aa, Entamoeba histolytica
QKKASGVDSTK

SEQ ID NO: 2649354 - protein, 7 aa, Entamoeba histolytica
QKKDGYS

SEQ ID NO: 2649355 - protein, 8 aa, Entamoeba histolytica
QKKDINEF

SEQ ID NO: 2649356 - protein, 9 aa, Entamoeba histolytica
QKKDKQHVT

SEQ ID NO: 2649357 - protein, 4 aa, Entamoeba histolytica
QKKE

SEQ ID NO: 2649358 - protein, 9 aa, Entamoeba histolytica
QKKEEKKKT

SEQ ID NO: 2649359 - protein, 20 aa, Entamoeba histolytica
QKKEKEEENIKNKKEEEARE

SEQ ID NO: 2649360 - protein, 15 aa, Entamoeba histolytica
QKKEKIEGGPQNKYD

SEQ ID NO: 2649361 - protein, 19 aa, Entamoeba histolytica
QKKEKKEIELDGEKSKLGL

SEQ ID NO: 2649362 - protein, 33 aa, Entamoeba histolytica
QKKEMEEEIKEKEKIKEKEINQIQRNKEEIKKE

SEQ ID NO: 2649363 - protein, 8 aa, Entamoeba histolytica
QKKENDIQ

SEQ ID NO: 2649364 - protein, 22 aa, Entamoeba histolytica
QKKEPTTTSSVDDRQEKSPQEI

SEQ ID NO: 2649365 - protein, 10 aa, Entamoeba histolytica
QKKEQNELNK

SEQ ID NO: 2649366 - protein, 22 aa, Entamoeba histolytica
QKKESSQDEETHTNKEDKHSYS

SEQ ID NO: 2649367 - protein, 6 aa, Entamoeba histolytica
QKKEVV

SEQ ID NO: 2649368 - protein, 11 aa, Entamoeba histolytica
QKKFENEEGQD

SEQ ID NO: 2649369 - protein, 4 aa, Entamoeba histolytica
QKKG

SEQ ID NO: 2649370 - protein, 7 aa, Entamoeba histolytica
QKKGDSI

SEQ ID NO: 2649371 - protein, 5 aa, Entamoeba histolytica
QKKGI

SEQ ID NO: 2649372 - protein, 11 aa, Entamoeba histolytica
QKKGKKDKTCI

SEQ ID NO: 2649373 - protein, 8 aa, Entamoeba histolytica
QKKGTKEF

SEQ ID NO: 2649374 - protein, 5 aa, Entamoeba histolytica
QKKIE

SEQ ID NO: 2649375 - protein, 18 aa, Entamoeba histolytica
QKKIESDFTTKKENAIHE

SEQ ID NO: 2649376 - protein, 5 aa, Entamoeba histolytica
QKKIT

SEQ ID NO: 2649377 - protein, 10 aa, Entamoeba histolytica
QKKITAKAIE

SEQ ID NO: 2649378 - protein, 11 aa, Entamoeba histolytica
QKKKEAESIDS

SEQ ID NO: 2649379 - protein, 13 aa, Entamoeba histolytica
QKKKEEKLKETSP

SEQ ID NO: 2649380 - protein, 13 aa, Entamoeba histolytica
QKKKKEDDSFNYN

SEQ ID NO: 2649381 - protein, 10 aa, Entamoeba histolytica
QKKKLESESY

SEQ ID NO: 2649382 - protein, 14 aa, Entamoeba histolytica
QKKKQQFESEIGEM

SEQ ID NO: 2649383 - protein, 13 aa, Entamoeba histolytica
QKKKSEIAQRESE

SEQ ID NO: 2649384 - protein, 35 aa, Entamoeba histolytica
QKKLEENDENINTIKNDKKAFTDKINTDDKPTKIE

SEQ ID NO: 2649385 - protein, 19 aa, Entamoeba histolytica
QKKMRTETNEKDEKNNTFK

SEQ ID NO: 2649386 - protein, 6 aa, Entamoeba histolytica
QKKNGV

SEQ ID NO: 2649387 - protein, 15 aa, Entamoeba histolytica
QKKNIQEISEDHENA

SEQ ID NO: 2649388 - protein, 8 aa, Entamoeba histolytica
QKKNNIKQ

SEQ ID NO: 2649389 - protein, 20 aa, Entamoeba histolytica
QKKNYITGKAGRLDTHKAAR

SEQ ID NO: 2649390 - protein, 6 aa, Entamoeba histolytica
QKKPKL

SEQ ID NO: 2649391 - protein, 8 aa, Entamoeba histolytica
QKKPPKSL

SEQ ID NO: 2649392 - protein, 8 aa, Entamoeba histolytica
QKKQIGRG

SEQ ID NO: 2649393 - protein, 9 aa, Entamoeba histolytica
QKKREADNN

SEQ ID NO: 2649394 - protein, 9 aa, Entamoeba histolytica
QKKREELSN

SEQ ID NO: 2649395 - protein, 11 aa, Entamoeba histolytica
QKKRENNMEKR

SEQ ID NO: 2649396 - protein, 20 aa, Entamoeba histolytica
QKKRKTEKNDEKKWSKEEDR

SEQ ID NO: 2649397 - protein, 42 aa, Entamoeba histolytica
QKKSDAKKLAQQKASELSAEKKSREKLEKQKGKEQKAIDEKY

SEQ ID NO: 2649398 - protein, 12 aa, Entamoeba histolytica
QKKSKQKQKPIE

SEQ ID NO: 2649399 - protein, 35 aa, Entamoeba histolytica
QKKTLKTNKGVSPKSKVNSPKQETELEKVLKAHQH

SEQ ID NO: 2649400 - protein, 33 aa, Entamoeba histolytica
QKKYPKLAKPNQPLGSPSQLTRNGLTNSPYKTH

SEQ ID NO: 2649401 - protein, 9 aa, Entamoeba histolytica
QKLDDPSPL

SEQ ID NO: 2649402 - protein, 9 aa, Entamoeba histolytica
QKLGERALP

SEQ ID NO: 2649403 - protein, 10 aa, Entamoeba histolytica
QKLKDKENKV

SEQ ID NO: 2649404 - protein, 6 aa, Entamoeba histolytica
QKLNGN

SEQ ID NO: 2649405 - protein, 6 aa, Entamoeba histolytica
QKLNKI

SEQ ID NO: 2649406 - protein, 4 aa, Entamoeba histolytica
QKLP

SEQ ID NO: 2649407 - protein, 5 aa, Entamoeba histolytica
QKLPP

SEQ ID NO: 2649408 - protein, 8 aa, Entamoeba histolytica
QKLQEQEE

SEQ ID NO: 2649409 - protein, 7 aa, Entamoeba histolytica
QKLQQTI

SEQ ID NO: 2649410 - protein, 12 aa, Entamoeba histolytica
QKLRQPETIPLK

SEQ ID NO: 2649411 - protein, 5 aa, Entamoeba histolytica
QKLTI

SEQ ID NO: 2649412 - protein, 6 aa, Entamoeba histolytica
QKLTKE

SEQ ID NO: 2649413 - protein, 8 aa, Entamoeba histolytica
QKLTNMKA

SEQ ID NO: 2649414 - protein, 15 aa, Entamoeba histolytica
QKMKGATNVDAIADQ

SEQ ID NO: 2649415 - protein, 4 aa, Entamoeba histolytica
QKMR

SEQ ID NO: 2649416 - protein, 11 aa, Entamoeba histolytica
QKMSDGKLTVG

SEQ ID NO: 2649417 - protein, 6 aa, Entamoeba histolytica
QKMSEH

SEQ ID NO: 2649418 - protein, 10 aa, Entamoeba histolytica
QKMSGKNAQF

SEQ ID NO: 2649419 - protein, 9 aa, Entamoeba histolytica
QKNAEIEQK

SEQ ID NO: 2649420 - protein, 6 aa, Entamoeba histolytica
QKNCDE

SEQ ID NO: 2649421 - protein, 7 aa, Entamoeba histolytica
QKNCGAA

SEQ ID NO: 2649422 - protein, 8 aa, Entamoeba histolytica
QKNDKFQQ

SEQ ID NO: 2649423 - protein, 8 aa, Entamoeba histolytica
QKNEEKEM

SEQ ID NO: 2649424 - protein, 10 aa, Entamoeba histolytica
QKNEIDADSA

SEQ ID NO: 2649425 - protein, 7 aa, Entamoeba histolytica
QKNEKVI

SEQ ID NO: 2649426 - protein, 5 aa, Entamoeba histolytica
QKNGD

SEQ ID NO: 2649427 - protein, 5 aa, Entamoeba histolytica
QKNGK

SEQ ID NO: 2649428 - protein, 7 aa, Entamoeba histolytica
QKNGNKE

SEQ ID NO: 2649429 - protein, 11 aa, Entamoeba histolytica
QKNGSGNGEEY

SEQ ID NO: 2649430 - protein, 8 aa, Entamoeba histolytica
QKNIEKEE

SEQ ID NO: 2649431 - protein, 23 aa, Entamoeba histolytica
QKNKDNPEELESKWNELESFYKN

SEQ ID NO: 2649432 - protein, 7 aa, Entamoeba histolytica
QKNLKSH

SEQ ID NO: 2649433 - protein, 7 aa, Entamoeba histolytica
QKNLSTI

SEQ ID NO: 2649434 - protein, 17 aa, Entamoeba histolytica
QKNMDEDDSEDEMEPME

SEQ ID NO: 2649435 - protein, 6 aa, Entamoeba histolytica
QKNMTS

SEQ ID NO: 2649436 - protein, 6 aa, Entamoeba histolytica
QKNNRI

SEQ ID NO: 2649437 - protein, 5 aa, Entamoeba histolytica
QKNQI

SEQ ID NO: 2649438 - protein, 21 aa, Entamoeba histolytica
QKNQQHTPTHQVSSAPIQNEV

SEQ ID NO: 2649439 - protein, 10 aa, Entamoeba histolytica
QKNRGQSKLS

SEQ ID NO: 2649440 - protein, 8 aa, Entamoeba histolytica
QKNSEGLN

SEQ ID NO: 2649441 - protein, 13 aa, Entamoeba histolytica
QKNTKEQSDYSSS

SEQ ID NO: 2649442 - protein, 10 aa, Entamoeba histolytica
QKNTNDLSQR

SEQ ID NO: 2649443 - protein, 11 aa, Entamoeba histolytica
QKNTPKDHKDY

SEQ ID NO: 2649444 - protein, 12 aa, Entamoeba histolytica
QKNVQTDANVND

SEQ ID NO: 2649445 - protein, 8 aa, Entamoeba histolytica
QKNYTQEP

SEQ ID NO: 2649446 - protein, 5 aa, Entamoeba histolytica
QKPAE

SEQ ID NO: 2649447 - protein, 4 aa, Entamoeba histolytica
QKPD

SEQ ID NO: 2649448 - protein, 4 aa, Entamoeba histolytica
QKPE

SEQ ID NO: 2649449 - protein, 4 aa, Entamoeba histolytica
QKPF

SEQ ID NO: 2649450 - protein, 5 aa, Entamoeba histolytica
QKPFD

SEQ ID NO: 2649451 - protein, 4 aa, Entamoeba histolytica
QKPH

SEQ ID NO: 2649452 - protein, 9 aa, Entamoeba histolytica
QKPIESDAP

SEQ ID NO: 2649453 - protein, 6 aa, Entamoeba histolytica
QKPIKS

SEQ ID NO: 2649454 - protein, 7 aa, Entamoeba histolytica
QKPKEDV

SEQ ID NO: 2649455 - protein, 5 aa, Entamoeba histolytica
QKPKK

SEQ ID NO: 2649456 - protein, 11 aa, Entamoeba histolytica
QKPKPKTEHEA

SEQ ID NO: 2649457 - protein, 18 aa, Entamoeba histolytica
QKPKQEEQEKKEKDKLSF

SEQ ID NO: 2649458 - protein, 19 aa, Entamoeba histolytica
QKPLHQPKQQEENQKKNPK

SEQ ID NO: 2649459 - protein, 8 aa, Entamoeba histolytica
QKPLKDFN

SEQ ID NO: 2649460 - protein, 7 aa, Entamoeba histolytica
QKPLNPW

SEQ ID NO: 2649461 - protein, 7 aa, Entamoeba histolytica
QKPLTGP

SEQ ID NO: 2649462 - protein, 8 aa, Entamoeba histolytica
QKPNFKGR

SEQ ID NO: 2649463 - protein, 6 aa, Entamoeba histolytica
QKPNNK

SEQ ID NO: 2649464 - protein, 8 aa, Entamoeba histolytica
QKPPCSYT

SEQ ID NO: 2649465 - protein, 4 aa, Entamoeba histolytica
QKPS

SEQ ID NO: 2649466 - protein, 5 aa, Entamoeba histolytica
QKPSI

SEQ ID NO: 2649467 - protein, 6 aa, Entamoeba histolytica
QKPSVE

SEQ ID NO: 2649468 - protein, 7 aa, Entamoeba histolytica
QKPTDTI

SEQ ID NO: 2649469 - protein, 7 aa, Entamoeba histolytica
QKPTGTV

SEQ ID NO: 2649470 - protein, 7 aa, Entamoeba histolytica
QKPTKGR

SEQ ID NO: 2649471 - protein, 8 aa, Entamoeba histolytica
QKPTQAIY

SEQ ID NO: 2649472 - protein, 5 aa, Entamoeba histolytica
QKPVR

SEQ ID NO: 2649473 - protein, 29 aa, Entamoeba histolytica
QKPVSSNPQNVLSQSSGSEPTQSHTPVTR

SEQ ID NO: 2649474 - protein, 6 aa, Entamoeba histolytica
QKPWYS

SEQ ID NO: 2649475 - protein, 9 aa, Entamoeba histolytica
QKPYTAKSD

SEQ ID NO: 2649476 - protein, 9 aa, Entamoeba histolytica
QKPYTFGDA

SEQ ID NO: 2649477 - protein, 32 aa, Entamoeba histolytica
QKQDTTPLTNSSSGSLQPSSSSTNSKDNKPMG

SEQ ID NO: 2649478 - protein, 19 aa, Entamoeba histolytica
QKQEDNKEEEEGVFKEDQK

SEQ ID NO: 2649479 - protein, 15 aa, Entamoeba histolytica
QKQEEALKRKAEEAA

SEQ ID NO: 2649480 - protein, 5 aa, Entamoeba histolytica
QKQEI

SEQ ID NO: 2649481 - protein, 37 aa, Entamoeba histolytica
QKQEMSHEEPTGNTDKGLQKSINSSTPSPKEDHSELT

SEQ ID NO: 2649482 - protein, 12 aa, Entamoeba histolytica
QKQGLKGFQPGN

SEQ ID NO: 2649483 - protein, 10 aa, Entamoeba histolytica
QKQIEEGGPF

SEQ ID NO: 2649484 - protein, 7 aa, Entamoeba histolytica
QKQKEKY

SEQ ID NO: 2649485 - protein, 9 aa, Entamoeba histolytica
QKQKELEKL

SEQ ID NO: 2649486 - protein, 4 aa, Entamoeba histolytica
QKQL

SEQ ID NO: 2649487 - protein, 12 aa, Entamoeba histolytica
QKQLANNQKKEK

SEQ ID NO: 2649488 - protein, 12 aa, Entamoeba histolytica
QKQLGERDNTIS

SEQ ID NO: 2649489 - protein, 14 aa, Entamoeba histolytica
QKQMQHNNSVKQLS

SEQ ID NO: 2649490 - protein, 7 aa, Entamoeba histolytica
QKQMTED

SEQ ID NO: 2649491 - protein, 19 aa, Entamoeba histolytica
QKQPENITSINTANKQKLD

SEQ ID NO: 2649492 - protein, 8 aa, Entamoeba histolytica
QKQQESQV

SEQ ID NO: 2649493 - protein, 12 aa, Entamoeba histolytica
QKQQGKNPQEVA

SEQ ID NO: 2649494 - protein, 13 aa, Entamoeba histolytica
QKQRASVGSTQPL

SEQ ID NO: 2649495 - protein, 17 aa, Entamoeba histolytica
QKQRKINKETFKNNEKE

SEQ ID NO: 2649496 - protein, 12 aa, Entamoeba histolytica
QKQRYEKGEDAI

SEQ ID NO: 2649497 - protein, 30 aa, Entamoeba histolytica
QKQSQSQQLDASQSVNLNQPPTSQSQFSSC

SEQ ID NO: 2649498 - protein, 18 aa, Entamoeba histolytica
QKQTAAYLQTEEEVKGCE

SEQ ID NO: 2649499 - protein, 9 aa, Entamoeba histolytica
QKQTKKAIF

SEQ ID NO: 2649500 - protein, 9 aa, Entamoeba histolytica
QKQTPPTDS

SEQ ID NO: 2649501 - protein, 11 aa, Entamoeba histolytica
QKQTSAGQRTR

SEQ ID NO: 2649502 - protein, 7 aa, Entamoeba histolytica
QKQVEEL

SEQ ID NO: 2649503 - protein, 16 aa, Entamoeba histolytica
QKQVNAPKRGKGYSSV

SEQ ID NO: 2649504 - protein, 5 aa, Entamoeba histolytica
QKQYD

SEQ ID NO: 2649505 - protein, 13 aa, Entamoeba histolytica
QKQYDKQKKISES

SEQ ID NO: 2649506 - protein, 40 aa, Entamoeba histolytica
QKQYPKVKDEYYKKPKAPKDIKTVTEKSNNESEKKITHSH

SEQ ID NO: 2649507 - protein, 8 aa, Entamoeba histolytica
QKQYQQAR

SEQ ID NO: 2649508 - protein, 25 aa, Entamoeba histolytica
QKRAKAAQKRTAKSVSKRASRSNRV

SEQ ID NO: 2649509 - protein, 8 aa, Entamoeba histolytica
QKREDELM

SEQ ID NO: 2649510 - protein, 12 aa, Entamoeba histolytica
QKREKWRKERKE

SEQ ID NO: 2649511 - protein, 14 aa, Entamoeba histolytica
QKRESSFETYPQPE

SEQ ID NO: 2649512 - protein, 11 aa, Entamoeba histolytica
QKRGINENEID

SEQ ID NO: 2649513 - protein, 6 aa, Entamoeba histolytica
QKRGNK

SEQ ID NO: 2649514 - protein, 6 aa, Entamoeba histolytica
QKRGPL

SEQ ID NO: 2649515 - protein, 17 aa, Entamoeba histolytica
QKRHSNRHREKSKTREI

SEQ ID NO: 2649516 - protein, 5 aa, Entamoeba histolytica
QKRIE

SEQ ID NO: 2649517 - protein, 6 aa, Entamoeba histolytica
QKRING

SEQ ID NO: 2649518 - protein, 11 aa, Entamoeba histolytica
QKRKEKAGKWD

SEQ ID NO: 2649519 - protein, 34 aa, Entamoeba histolytica
QKRKQAKPSLEQKSSPKQPTTKKKEEEKESKSGL

SEQ ID NO: 2649520 - protein, 11 aa, Entamoeba histolytica
QKRKTDRKALD

SEQ ID NO: 2649521 - protein, 7 aa, Entamoeba histolytica
QKRNGID

SEQ ID NO: 2649522 - protein, 9 aa, Entamoeba histolytica
QKRNQGNQK

SEQ ID NO: 2649523 - protein, 28 aa, Entamoeba histolytica
QKRNTLPNSQTPRLDEKERMKENRRTIS

SEQ ID NO: 2649524 - protein, 5 aa, Entamoeba histolytica
QKRPF

SEQ ID NO: 2649525 - protein, 10 aa, Entamoeba histolytica
QKRPSIKPND

SEQ ID NO: 2649526 - protein, 21 aa, Entamoeba histolytica
QKRQETIVTPTATPIAPEISP

SEQ ID NO: 2649527 - protein, 19 aa, Entamoeba histolytica
QKRSCSTCDSEKLNNNSLS

SEQ ID NO: 2649528 - protein, 5 aa, Entamoeba histolytica
QKRTV

SEQ ID NO: 2649529 - protein, 5 aa, Entamoeba histolytica
QKSAR

SEQ ID NO: 2649530 - protein, 14 aa, Entamoeba histolytica
QKSDGTQLNERMRK

SEQ ID NO: 2649531 - protein, 9 aa, Entamoeba histolytica
QKSENNPTF

SEQ ID NO: 2649532 - protein, 8 aa, Entamoeba histolytica
QKSEPKYS

SEQ ID NO: 2649533 - protein, 9 aa, Entamoeba histolytica
QKSGIERRK

SEQ ID NO: 2649534 - protein, 6 aa, Entamoeba histolytica
QKSGRY

SEQ ID NO: 2649535 - protein, 8 aa, Entamoeba histolytica
QKSGTPIS

SEQ ID NO: 2649536 - protein, 13 aa, Entamoeba histolytica
QKSHNEYSEEESE

SEQ ID NO: 2649537 - protein, 4 aa, Entamoeba histolytica
QKSI

SEQ ID NO: 2649538 - protein, 13 aa, Entamoeba histolytica
QKSIKNKSYGNKL

SEQ ID NO: 2649539 - protein, 7 aa, Entamoeba histolytica
QKSIPLT

SEQ ID NO: 2649540 - protein, 8 aa, Entamoeba histolytica
QKSKANKF

SEQ ID NO: 2649541 - protein, 11 aa, Entamoeba histolytica
QKSKIEAPKGY

SEQ ID NO: 2649542 - protein, 8 aa, Entamoeba histolytica
QKSKNNFK

SEQ ID NO: 2649543 - protein, 9 aa, Entamoeba histolytica
QKSKSNSDD

SEQ ID NO: 2649544 - protein, 6 aa, Entamoeba histolytica
QKSKYR

SEQ ID NO: 2649545 - protein, 5 aa, Entamoeba histolytica
QKSLE

SEQ ID NO: 2649546 - protein, 9 aa, Entamoeba histolytica
QKSMETEKK

SEQ ID NO: 2649547 - protein, 10 aa, Entamoeba histolytica
QKSMSTQSLQ

SEQ ID NO: 2649548 - protein, 20 aa, Entamoeba histolytica
QKSNIRKGEVEMTSNGITSF

SEQ ID NO: 2649549 - protein, 16 aa, Entamoeba histolytica
QKSNSQENDTSVSQAI

SEQ ID NO: 2649550 - protein, 6 aa, Entamoeba histolytica
QKSNTR

SEQ ID NO: 2649551 - protein, 10 aa, Entamoeba histolytica
QKSQQYKVNT

SEQ ID NO: 2649552 - protein, 7 aa, Entamoeba histolytica
QKSQTFK

SEQ ID NO: 2649553 - protein, 7 aa, Entamoeba histolytica
QKSRDGT

SEQ ID NO: 2649554 - protein, 8 aa, Entamoeba histolytica
QKSSDEVP

SEQ ID NO: 2649555 - protein, 7 aa, Entamoeba histolytica
QKSSFEN

SEQ ID NO: 2649556 - protein, 7 aa, Entamoeba histolytica
QKSSNIQ

SEQ ID NO: 2649557 - protein, 7 aa, Entamoeba histolytica
QKSSSDR

SEQ ID NO: 2649558 - protein, 10 aa, Entamoeba histolytica
QKSSSSPSTA

SEQ ID NO: 2649559 - protein, 4 aa, Entamoeba histolytica
QKSY

SEQ ID NO: 2649560 - protein, 6 aa, Entamoeba histolytica
QKSYLP

SEQ ID NO: 2649561 - protein, 9 aa, Entamoeba histolytica
QKTDGSTEI

SEQ ID NO: 2649562 - protein, 7 aa, Entamoeba histolytica
QKTDLEY

SEQ ID NO: 2649563 - protein, 8 aa, Entamoeba histolytica
QKTDTELY

SEQ ID NO: 2649564 - protein, 24 aa, Entamoeba histolytica
QKTEDGNKAIEALNDKEVQELTKT

SEQ ID NO: 2649565 - protein, 23 aa, Entamoeba histolytica
QKTEINSGDKLSNSGVQKQVQST

SEQ ID NO: 2649566 - protein, 8 aa, Entamoeba histolytica
QKTEKYGK

SEQ ID NO: 2649567 - protein, 17 aa, Entamoeba histolytica
QKTEQAKQLQQQFQNYL

SEQ ID NO: 2649568 - protein, 23 aa, Entamoeba histolytica
QKTEQKEKKREEEKPKKNNSFKD

SEQ ID NO: 2649569 - protein, 20 aa, Entamoeba histolytica
QKTERKDADIERLEKEARRD

SEQ ID NO: 2649570 - protein, 4 aa, Entamoeba histolytica
QKTF

SEQ ID NO: 2649571 - protein, 7 aa, Entamoeba histolytica
QKTGEEL

SEQ ID NO: 2649572 - protein, 6 aa, Entamoeba histolytica
QKTGIA

SEQ ID NO: 2649573 - protein, 7 aa, Entamoeba histolytica
QKTGKMK

SEQ ID NO: 2649574 - protein, 11 aa, Entamoeba histolytica
QKTGNKKEEQI

SEQ ID NO: 2649575 - protein, 4 aa, Entamoeba histolytica
QKTI

SEQ ID NO: 2649576 - protein, 5 aa, Entamoeba histolytica
QKTIG

SEQ ID NO: 2649577 - protein, 7 aa, Entamoeba histolytica
QKTINNN

SEQ ID NO: 2649578 - protein, 8 aa, Entamoeba histolytica
QKTISQED

SEQ ID NO: 2649579 - protein, 55 aa, Entamoeba histolytica; identical to SEQ ID NO: 2454533

SEQ ID NO: 2649580 - protein, 7 aa, Entamoeba histolytica
QKTKEEY

SEQ ID NO: 2649581 - protein, 10 aa, Entamoeba histolytica
QKTKGQECSI

SEQ ID NO: 2649582 - protein, 12 aa, Entamoeba histolytica
QKTKNIHNWFIW

SEQ ID NO: 2649583 - protein, 6 aa, Entamoeba histolytica
QKTLER

SEQ ID NO: 2649584 - protein, 7 aa, Entamoeba histolytica
QKTLESG

SEQ ID NO: 2649585 - protein, 29 aa, Entamoeba histolytica
QKTLHKKNLAKKEKLRSETQKLENEKKVV

SEQ ID NO: 2649586 - protein, 6 aa, Entamoeba histolytica
QKTLPT

SEQ ID NO: 2649587 - protein, 7 aa, Entamoeba histolytica
QKTNNDF

SEQ ID NO: 2649588 - protein, 8 aa, Entamoeba histolytica
QKTNPKDD

SEQ ID NO: 2649589 - protein, 8 aa, Entamoeba histolytica
QKTNQITT

SEQ ID NO: 2649590 - protein, 11 aa, Entamoeba histolytica
QKTPKRTKELN

SEQ ID NO: 2649591 - protein, 8 aa, Entamoeba histolytica
QKTPREMN

SEQ ID NO: 2649592 - protein, 8 aa, Entamoeba histolytica
QKTPTTIN

SEQ ID NO: 2649593 - protein, 25 aa, Entamoeba histolytica
QKTQKQLKAMEAKAKSAKKCEGKNL

SEQ ID NO: 2649594 - protein, 6 aa, Entamoeba histolytica
QKTQLT

SEQ ID NO: 2649595 - protein, 16 aa, Entamoeba histolytica
QKTQNQNIEDKTINEV

SEQ ID NO: 2649596 - protein, 7 aa, Entamoeba histolytica
QKTQSDV

SEQ ID NO: 2649597 - protein, 4 aa, Entamoeba histolytica
QKTS

SEQ ID NO: 2649598 - protein, 11 aa, Entamoeba histolytica
QKTTETRRGGR

SEQ ID NO: 2649599 - protein, 15 aa, Entamoeba histolytica
QKTTNESQSSNQNQV

SEQ ID NO: 2649600 - protein, 4 aa, Entamoeba histolytica
QKTV

SEQ ID NO: 2649601 - protein, 9 aa, Entamoeba histolytica
QKTYDDDSV

SEQ ID NO: 2649602 - protein, 6 aa, Entamoeba histolytica
QKTYET

SEQ ID NO: 2649603 - protein, 11 aa, Entamoeba histolytica
QKTYGAKGPAI

SEQ ID NO: 2649604 - protein, 26 aa, Entamoeba histolytica
QKVEEESIEESSDNDNIEKDKEQEIL

SEQ ID NO: 2649605 - protein, 7 aa, Entamoeba histolytica
QKVERYD

SEQ ID NO: 2649606 - protein, 5 aa, Entamoeba histolytica
QKVGN

SEQ ID NO: 2649607 - protein, 12 aa, Entamoeba histolytica
QKVNKEGQHQEL

SEQ ID NO: 2649608 - protein, 7 aa, Entamoeba histolytica
QKWGSKL

SEQ ID NO: 2649609 - protein, 16 aa, Entamoeba histolytica
QKYDNPKYKDEKCKEG

SEQ ID NO: 2649610 - protein, 15 aa, Entamoeba histolytica
QKYDSEEDFNENENA

SEQ ID NO: 2649611 - protein, 5 aa, Entamoeba histolytica
QKYGP

SEQ ID NO: 2649612 - protein, 15 aa, Entamoeba histolytica
QKYGQKKVGVEEGPK

SEQ ID NO: 2649613 - protein, 4 aa, Entamoeba histolytica
QKYI

SEQ ID NO: 2649614 - protein, 12 aa, Entamoeba histolytica
QKYNALKNDKQN

SEQ ID NO: 2649615 - protein, 8 aa, Entamoeba histolytica
QKYPSSAN

SEQ ID NO: 2649616 - protein, 6 aa, Entamoeba histolytica
QKYSGA

SEQ ID NO: 2649617 - protein, 6 aa, Entamoeba histolytica
QKYSGY

SEQ ID NO: 2649618 - protein, 6 aa, Entamoeba histolytica
QKYSNL

SEQ ID NO: 2649619 - protein, 6 aa, Entamoeba histolytica
QKYTDI

SEQ ID NO: 2649620 - protein, 14 aa, Entamoeba histolytica
QLADSKYAGARSDP

SEQ ID NO: 2649621 - protein, 5 aa, Entamoeba histolytica
QLAEG

SEQ ID NO: 2649622 - protein, 8 aa, Entamoeba histolytica
QLAERPST

SEQ ID NO: 2649623 - protein, 5 aa, Entamoeba histolytica
QLAES

SEQ ID NO: 2649624 - protein, 26 aa, Entamoeba histolytica
QLAKSRKSEKRKSVVAPKKPLSPASK

SEQ ID NO: 2649625 - protein, 5 aa, Entamoeba histolytica
QLAQE

SEQ ID NO: 2649626 - protein, 17 aa, Entamoeba histolytica
QLAQTTPLTLTPSFFKD

SEQ ID NO: 2649627 - protein, 4 aa, Entamoeba histolytica
QLDE

SEQ ID NO: 2649628 - protein, 10 aa, Entamoeba histolytica
QLDENSKSSD

SEQ ID NO: 2649629 - protein, 7 aa, Entamoeba histolytica
QLDEQTK

SEQ ID NO: 2649630 - protein, 8 aa, Entamoeba histolytica
QLDKSGNV

SEQ ID NO: 2649631 - protein, 11 aa, Entamoeba histolytica
QLDNAKESMEA

SEQ ID NO: 2649632 - protein, 5 aa, Entamoeba histolytica
QLDQT

SEQ ID NO: 2649633 - protein, 7 aa, Entamoeba histolytica
QLDSSTV

SEQ ID NO: 2649634 - protein, 12 aa, Entamoeba histolytica
QLDTDCKTNDVN

SEQ ID NO: 2649635 - protein, 25 aa, Entamoeba histolytica
QLEAKKQEELEREQKVKSQTRNHPN

SEQ ID NO: 2649636 - protein, 5 aa, Entamoeba histolytica
QLEDR

SEQ ID NO: 2649637 - protein, 5 aa, Entamoeba histolytica
QLEDS

SEQ ID NO: 2649638 - protein, 4 aa, Entamoeba histolytica
QLEE

SEQ ID NO: 2649639 - protein, 50 aa, Entamoeba histolytica
QLEECQKKAEESKKSAEAAAEKATASKKSAEAAAARQKEAQAAEEEVTKA

SEQ ID NO: 2649640 - protein, 24 aa, Entamoeba histolytica
QLEEGTSGNVSQPEPKKPTTGGND

SEQ ID NO: 2649641 - protein, 24 aa, Entamoeba histolytica
QLEEKEKHSEELKEEIDNSSGLPL

SEQ ID NO: 2649642 - protein, 12 aa, Entamoeba histolytica
QLEEKHAEEERK

SEQ ID NO: 2649643 - protein, 7 aa, Entamoeba histolytica
QLEEQKR

SEQ ID NO: 2649644 - protein, 18 aa, Entamoeba histolytica
QLEKEQEEQLEKEQEIEE

SEQ ID NO: 2649645 - protein, 8 aa, Entamoeba histolytica
QLEKNTPV

SEQ ID NO: 2649646 - protein, 4 aa, Entamoeba histolytica
QLEN

SEQ ID NO: 2649647 - protein, 10 aa, Entamoeba histolytica
QLENDSAFSR

SEQ ID NO: 2649648 - protein, 5 aa, Entamoeba histolytica
QLENE

SEQ ID NO: 2649649 - protein, 10 aa, Entamoeba histolytica
QLENSTGKIS

SEQ ID NO: 2649650 - protein, 8 aa, Entamoeba histolytica
QLEPPANP

SEQ ID NO: 2649651 - protein, 5 aa, Entamoeba histolytica
QLEPQ

SEQ ID NO: 2649652 - protein, 10 aa, Entamoeba histolytica
QLEQDKKNLE

SEQ ID NO: 2649653 - protein, 16 aa, Entamoeba histolytica
QLEQKHKEKEERKRIK

SEQ ID NO: 2649654 - protein, 10 aa, Entamoeba histolytica
QLERNSNSNY

SEQ ID NO: 2649655 - protein, 9 aa, Entamoeba histolytica
QLESEGEEW

SEQ ID NO: 2649656 - protein, 9 aa, Entamoeba histolytica
QLESELTKR

SEQ ID NO: 2649657 - protein, 15 aa, Entamoeba histolytica
QLGGKPKFYDTGDSS

SEQ ID NO: 2649658 - protein, 8 aa, Entamoeba histolytica
QLGNDNDL

SEQ ID NO: 2649659 - protein, 8 aa, Entamoeba histolytica
QLGNENKA

SEQ ID NO: 2649660 - protein, 11 aa, Entamoeba histolytica
QLGRSTKTSPS

SEQ ID NO: 2649661 - protein, 5 aa, Entamoeba histolytica
QLGTE

SEQ ID NO: 2649662 - protein, 19 aa, Entamoeba histolytica
QLGTNGNTIVGNSAKDDIH

SEQ ID NO: 2649663 - protein, 5 aa, Entamoeba histolytica
QLGTV

SEQ ID NO: 2649664 - protein, 9 aa, Entamoeba histolytica
QLHSQQPSI

SEQ ID NO: 2649665 - protein, 5 aa, Entamoeba histolytica
QLIPE

SEQ ID NO: 2649666 - protein, 12 aa, Entamoeba histolytica
QLKAQSKNKEEL

SEQ ID NO: 2649667 - protein, 7 aa, Entamoeba histolytica
QLKDEND

SEQ ID NO: 2649668 - protein, 29 aa, Entamoeba histolytica
QLKEEKDAMEEEQVNENPQIEELEQDEGQ

SEQ ID NO: 2649669 - protein, 6 aa, Entamoeba histolytica
QLKEKD

SEQ ID NO: 2649670 - protein, 6 aa, Entamoeba histolytica
QLKENP

SEQ ID NO: 2649671 - protein, 12 aa, Entamoeba histolytica
QLKEQETKTSEL

SEQ ID NO: 2649672 - protein, 16 aa, Entamoeba histolytica
QLKERDETKELNSQNV

SEQ ID NO: 2649673 - protein, 9 aa, Entamoeba histolytica
QLKGTDITE

SEQ ID NO: 2649674 - protein, 9 aa, Entamoeba histolytica
QLKKEAEPI

SEQ ID NO: 2649675 - protein, 8 aa, Entamoeba histolytica
QLKKGGVP

SEQ ID NO: 2649676 - protein, 9 aa, Entamoeba histolytica
QLKKKPNNQ

SEQ ID NO: 2649677 - protein, 15 aa, Entamoeba histolytica
QLKPKEKPDKRSLPR

SEQ ID NO: 2649678 - protein, 20 aa, Entamoeba histolytica
QLKPQPSPPQSSSVARTPHN

SEQ ID NO: 2649679 - protein, 17 aa, Entamoeba histolytica
QLKQLSPNEISSKKWQK

SEQ ID NO: 2649680 - protein, 13 aa, Entamoeba histolytica
QLKQSTQRHNKEL

SEQ ID NO: 2649681 - protein, 24 aa, Entamoeba histolytica
QLKSQKSEEPKVEITPQVTQPLKP

SEQ ID NO: 2649682 - protein, 5 aa, Entamoeba histolytica
QLKSY

SEQ ID NO: 2649683 - protein, 22 aa, Entamoeba histolytica
QLKTDNDQKENELNQVRHEKDE

SEQ ID NO: 2649684 - protein, 5 aa, Entamoeba histolytica
QLKTK

SEQ ID NO: 2649685 - protein, 7 aa, Entamoeba histolytica
QLLPTNG

SEQ ID NO: 2649686 - protein, 16 aa, Entamoeba histolytica
QLMKKSSSEAKIHKSK

SEQ ID NO: 2649687 - protein, 10 aa, Entamoeba histolytica
QLNADDLRDL

SEQ ID NO: 2649688 - protein, 8 aa, Entamoeba histolytica
QLNDKSKT

SEQ ID NO: 2649689 - protein, 12 aa, Entamoeba histolytica
QLNEEKINKEVS

SEQ ID NO: 2649690 - protein, 12 aa, Entamoeba histolytica
QLNEESEENEEV

SEQ ID NO: 2649691 - protein, 16 aa, Entamoeba histolytica
QLNKQTPSVSKSKRIN

SEQ ID NO: 2649692 - protein, 12 aa, Entamoeba histolytica
QLNKSKQEEKGC

SEQ ID NO: 2649693 - protein, 7 aa, Entamoeba histolytica
QLNNENK

SEQ ID NO: 2649694 - protein, 19 aa, Entamoeba histolytica
QLNNNENQKEHQLNPHEEN

SEQ ID NO: 2649695 - protein, 8 aa, Entamoeba histolytica
QLNPRQTY

SEQ ID NO: 2649696 - protein, 24 aa, Entamoeba histolytica
QLNPTNSITTNTIPDIPKETPINS

SEQ ID NO: 2649697 - protein, 6 aa, Entamoeba histolytica
QLNQRE

SEQ ID NO: 2649698 - protein, 5 aa, Entamoeba histolytica
QLNSI

SEQ ID NO: 2649699 - protein, 13 aa, Entamoeba histolytica
QLNTQNQTNSPFK

SEQ ID NO: 2649700 - protein, 6 aa, Entamoeba histolytica
QLPDGA

SEQ ID NO: 2649701 - protein, 48 aa, Entamoeba histolytica
QLPEKEKEQELINKDKESFEVKEEKPQKIKTKDEIKPKKIQKKGLTSI

SEQ ID NO: 2649702 - protein, 5 aa, Entamoeba histolytica
QLPEQ

SEQ ID NO: 2649703 - protein, 6 aa, Entamoeba histolytica
QLPGNK

SEQ ID NO: 2649704 - protein, 7 aa, Entamoeba histolytica
QLPHTAT

SEQ ID NO: 2649705 - protein, 5 aa, Entamoeba histolytica
QLPNK

SEQ ID NO: 2649706 - protein, 5 aa, Entamoeba histolytica
QLPNS

SEQ ID NO: 2649707 - protein, 4 aa, Entamoeba histolytica
QLPP

SEQ ID NO: 2649708 - protein, 24 aa, Entamoeba histolytica
QLPPPTNSNYYSPFTPSSLNYQGT

SEQ ID NO: 2649709 - protein, 6 aa, Entamoeba histolytica
QLPPSV

SEQ ID NO: 2649710 - protein, 6 aa, Entamoeba histolytica
QLPPTN

SEQ ID NO: 2649711 - protein, 13 aa, Entamoeba histolytica
QLPRTKRRSSRIR

SEQ ID NO: 2649712 - protein, 12 aa, Entamoeba histolytica
QLPSAKDRETVE

SEQ ID NO: 2649713 - protein, 5 aa, Entamoeba histolytica
QLPSD

SEQ ID NO: 2649714 - protein, 5 aa, Entamoeba histolytica
QLPSQ

SEQ ID NO: 2649715 - protein, 18 aa, Entamoeba histolytica
QLPSSLSEQTSTYPTTIP

SEQ ID NO: 2649716 - protein, 8 aa, Entamoeba histolytica
QLPSTNYC

SEQ ID NO: 2649717 - protein, 4 aa, Entamoeba histolytica
QLPT

SEQ ID NO: 2649718 - protein, 6 aa, Entamoeba histolytica
QLPTDQ

SEQ ID NO: 2649719 - protein, 7 aa, Entamoeba histolytica
QLPTEQK

SEQ ID NO: 2649720 - protein, 9 aa, Entamoeba histolytica
QLPTSITGT

SEQ ID NO: 2649721 - protein, 6 aa, Entamoeba histolytica
QLQDGT

SEQ ID NO: 2649722 - protein, 5 aa, Entamoeba histolytica
QLQED

SEQ ID NO: 2649723 - protein, 13 aa, Entamoeba histolytica
QLQESKKNENQVI

SEQ ID NO: 2649724 - protein, 7 aa, Entamoeba histolytica
QLQGENR

SEQ ID NO: 2649725 - protein, 136 aa, Entamoeba histolytica
QLQKEKKQEVCKEDNNEKVIKEPKTEEKKEKKSKKKEAKIVEKEKEEIEKEEVSIKETKEEETKEDKKAIKKPKDENVEKKEKKEAKKEEGHKKLSKEEKKALKKQKKAKKEAKKQVDEENEEKEVESKPQTSEVQ

SEQ ID NO: 2649726 - protein, 6 aa, Entamoeba histolytica
QLQKPT

SEQ ID NO: 2649727 - protein, 8 aa, Entamoeba histolytica
QLQNERGD

SEQ ID NO: 2649728 - protein, 18 aa, Entamoeba histolytica
QLQSYKDAVEEDRQRDKA

SEQ ID NO: 2649729 - protein, 10 aa, Entamoeba histolytica
QLRAETEKEL

SEQ ID NO: 2649730 - protein, 8 aa, Entamoeba histolytica
QLRDDSSM

SEQ ID NO: 2649731 - protein, 12 aa, Entamoeba histolytica
QLRKNKDGSGYD

SEQ ID NO: 2649732 - protein, 7 aa, Entamoeba histolytica
QLRPTQN

SEQ ID NO: 2649733 - protein, 5 aa, Entamoeba histolytica
QLSEE

SEQ ID NO: 2649734 - protein, 20 aa, Entamoeba histolytica
QLSEEVSKLEEKYKKFKDQK

SEQ ID NO: 2649735 - protein, 7 aa, Entamoeba histolytica
QLSETST

SEQ ID NO: 2649736 - protein, 9 aa, Entamoeba histolytica
QLSGGEKTI

SEQ ID NO: 2649737 - protein, 11 aa, Entamoeba histolytica
QLSIKDEGKTI

SEQ ID NO: 2649738 - protein, 8 aa, Entamoeba histolytica
QLSKTSSK

SEQ ID NO: 2649739 - protein, 17 aa, Entamoeba histolytica
QLSNDPGINITNPPTTI

SEQ ID NO: 2649740 - protein, 20 aa, Entamoeba histolytica
QLSPSKVETPFGKDSKVTLT

SEQ ID NO: 2649741 - protein, 7 aa, Entamoeba histolytica
QLSQSNI

SEQ ID NO: 2649742 - protein, 7 aa, Entamoeba histolytica
QLSREDY

SEQ ID NO: 2649743 - protein, 10 aa, Entamoeba histolytica
QLSREEDNSF

SEQ ID NO: 2649744 - protein, 5 aa, Entamoeba histolytica
QLSRR

SEQ ID NO: 2649745 - protein, 12 aa, Entamoeba histolytica
QLSSEDPESKLE

SEQ ID NO: 2649746 - protein, 9 aa, Entamoeba histolytica
QLSSQPPDF

SEQ ID NO: 2649747 - protein, 15 aa, Entamoeba histolytica
QLTAPQRKDKTEQKK

SEQ ID NO: 2649748 - protein, 9 aa, Entamoeba histolytica
QLTEEEKQE

SEQ ID NO: 2649749 - protein, 9 aa, Entamoeba histolytica
QLTENYKNS

SEQ ID NO: 2649750 - protein, 12 aa, Entamoeba histolytica
QLTEQQKNDTTQ

SEQ ID NO: 2649751 - protein, 6 aa, Entamoeba histolytica
QLTESD

SEQ ID NO: 2649752 - protein, 6 aa, Entamoeba histolytica
QLTGRI

SEQ ID NO: 2649753 - protein, 5 aa, Entamoeba histolytica
QLTKQ

SEQ ID NO: 2649754 - protein, 6 aa, Entamoeba histolytica
QLTNGG

SEQ ID NO: 2649755 - protein, 14 aa, Entamoeba histolytica
QLTNKQTEAQQNTV

SEQ ID NO: 2649756 - protein, 41 aa, Entamoeba histolytica
QLTNPYSSYKLESQNNNQPYSLNETETTKPIKPPTHYYNYS

SEQ ID NO: 2649757 - protein, 11 aa, Entamoeba histolytica
QLTNQKEIKRN

SEQ ID NO: 2649758 - protein, 12 aa, Entamoeba histolytica
QLTNSVARSSAF

SEQ ID NO: 2649759 - protein, 4 aa, Entamoeba histolytica
QLTP

SEQ ID NO: 2649760 - protein, 5 aa, Entamoeba histolytica
QLTPL

SEQ ID NO: 2649761 - protein, 10 aa, Entamoeba histolytica
QLTQEQANAL

SEQ ID NO: 2649762 - protein, 8 aa, Entamoeba histolytica
QLTSTNSV

SEQ ID NO: 2649763 - protein, 5 aa, Entamoeba histolytica
QLVGE

SEQ ID NO: 2649764 - protein, 12 aa, Entamoeba histolytica
QMAEDSAKAIES

SEQ ID NO: 2649765 - protein, 15 aa, Entamoeba histolytica
QMAGRAGRRGKDAAG

SEQ ID NO: 2649766 - protein, 10 aa, Entamoeba histolytica
QMAPPGKKGG

SEQ ID NO: 2649767 - protein, 8 aa, Entamoeba histolytica
QMARANGD

SEQ ID NO: 2649768 - protein, 17 aa, Entamoeba histolytica
QMEEQQKEEEQKIRDQQ

SEQ ID NO: 2649769 - protein, 12 aa, Entamoeba histolytica
QMENEKKELKTK

SEQ ID NO: 2649770 - protein, 7 aa, Entamoeba histolytica
QMERNKK

SEQ ID NO: 2649771 - protein, 6 aa, Entamoeba histolytica
QMERQE

SEQ ID NO: 2649772 - protein, 4 aa, Entamoeba histolytica
QMEY

SEQ ID NO: 2649773 - protein, 7 aa, Entamoeba histolytica
QMGDPGL

SEQ ID NO: 2649774 - protein, 11 aa, Entamoeba histolytica
QMGPPFNKESM

SEQ ID NO: 2649775 - protein, 4 aa, Entamoeba histolytica
QMKE

SEQ ID NO: 2649776 - protein, 19 aa, Entamoeba histolytica
QMKENNEKHKNKEEELEKE

SEQ ID NO: 2649777 - protein, 8 aa, Entamoeba histolytica
QMKESVQN

SEQ ID NO: 2649778 - protein, 18 aa, Entamoeba histolytica
QMKNKEEGIQQTTNKKED

SEQ ID NO: 2649779 - protein, 14 aa, Entamoeba histolytica
QMKQEEYKQKAKEL

SEQ ID NO: 2649780 - protein, 6 aa, Entamoeba histolytica
QMNDNE

SEQ ID NO: 2649781 - protein, 32 aa, Entamoeba histolytica
QMNEEKEEKIEKQENKRIEKPQTRKEREEYQK

SEQ ID NO: 2649782 - protein, 9 aa, Entamoeba histolytica
QMNNSGISS

SEQ ID NO: 2649783 - protein, 10 aa, Entamoeba histolytica
QMPGGQYSNL

SEQ ID NO: 2649784 - protein, 18 aa, Entamoeba histolytica
QMPQNNNYNNYPTGARYA

SEQ ID NO: 2649785 - protein, 8 aa, Entamoeba histolytica
QMSEEERK

SEQ ID NO: 2649786 - protein, 6 aa, Entamoeba histolytica
QMSKEL

SEQ ID NO: 2649787 - protein, 6 aa, Entamoeba histolytica
QMSTYK

SEQ ID NO: 2649788 - protein, 4 aa, Entamoeba histolytica
QMTE

SEQ ID NO: 2649789 - protein, 11 aa, Entamoeba histolytica
QMTPDTKEECS

SEQ ID NO: 2649790 - protein, 6 aa, Entamoeba histolytica
QMTPQQ

SEQ ID NO: 2649791 - protein, 9 aa, Entamoeba histolytica
QMTTTGDNR

SEQ ID NO: 2649792 - protein, 10 aa, Entamoeba histolytica
QNAAKDASEL

SEQ ID NO: 2649793 - protein, 10 aa, Entamoeba histolytica
QNAGDDETFN

SEQ ID NO: 2649794 - protein, 13 aa, Entamoeba histolytica
QNANNSIELTQQD

SEQ ID NO: 2649795 - protein, 10 aa, Entamoeba histolytica
QNAPENENEV

SEQ ID NO: 2649796 - protein, 5 aa, Entamoeba histolytica
QNAPF

SEQ ID NO: 2649797 - protein, 10 aa, Entamoeba histolytica
QNAPKSFVKT

SEQ ID NO: 2649798 - protein, 9 aa, Entamoeba histolytica
QNAQIGSKI

SEQ ID NO: 2649799 - protein, 8 aa, Entamoeba histolytica
QNATEAKG

SEQ ID NO: 2649800 - protein, 33 aa, Entamoeba histolytica
QNAVQQPSNQQTVHSQTSPQNNGLQTPNQTQQL

SEQ ID NO: 2649801 - protein, 10 aa, Entamoeba histolytica
QNCEGPPTIE

SEQ ID NO: 2649802 - protein, 8 aa, Entamoeba histolytica
QNCSDKPI

SEQ ID NO: 2649803 - protein, 16 aa, Entamoeba histolytica
QNCSGSLGAANEYLPD

SEQ ID NO: 2649804 - protein, 7 aa, Entamoeba histolytica
QNCSSSN

SEQ ID NO: 2649805 - protein, 4 aa, Entamoeba histolytica
QNDD

SEQ ID NO: 2649806 - protein, 5 aa, Entamoeba histolytica
QNDDE

SEQ ID NO: 2649807 - protein, 13 aa, Entamoeba histolytica
QNDDFNEKDMKDK

SEQ ID NO: 2649808 - protein, 5 aa, Entamoeba histolytica
QNDDK

SEQ ID NO: 2649809 - protein, 14 aa, Entamoeba histolytica
QNDDSGDQSNTIED

SEQ ID NO: 2649810 - protein, 6 aa, Entamoeba histolytica
QNDEAS

SEQ ID NO: 2649811 - protein, 13 aa, Entamoeba histolytica
QNDEEEVAEETNA

SEQ ID NO: 2649812 - protein, 6 aa, Entamoeba histolytica
QNDEHD

SEQ ID NO: 2649813 - protein, 6 aa, Entamoeba histolytica
QNDEKI

SEQ ID NO: 2649814 - protein, 6 aa, Entamoeba histolytica
QNDENI

SEQ ID NO: 2649815 - protein, 25 aa, Entamoeba histolytica
QNDFEPPKSHTSFTEPHTPSSTKYI

SEQ ID NO: 2649816 - protein, 10 aa, Entamoeba histolytica
QNDIGKSLAQ

SEQ ID NO: 2649817 - protein, 18 aa, Entamoeba histolytica
QNDKERMKKNIFDIIKGL

SEQ ID NO: 2649818 - protein, 11 aa, Entamoeba histolytica
QNDMNSYKRRG

SEQ ID NO: 2649819 - protein, 6 aa, Entamoeba histolytica
QNDMSS

SEQ ID NO: 2649820 - protein, 6 aa, Entamoeba histolytica
QNDNIN

SEQ ID NO: 2649821 - protein, 12 aa, Entamoeba histolytica
QNDNTLSMLLKN

SEQ ID NO: 2649822 - protein, 11 aa, Entamoeba histolytica
QNDPDPDENIE

SEQ ID NO: 2649823 - protein, 7 aa, Entamoeba histolytica
QNDPREV

SEQ ID NO: 2649824 - protein, 7 aa, Entamoeba histolytica
QNDPSLI

SEQ ID NO: 2649825 - protein, 6 aa, Entamoeba histolytica
QNDQHS

SEQ ID NO: 2649826 - protein, 9 aa, Entamoeba histolytica
QNDTKDNKF

SEQ ID NO: 2649827 - protein, 13 aa, Entamoeba histolytica
QNDVNNEIKSSSL

SEQ ID NO: 2649828 - protein, 6 aa, Entamoeba histolytica
QNDYKN

SEQ ID NO: 2649829 - protein, 14 aa, Entamoeba histolytica
QNDYNGTTKKWKDE

SEQ ID NO: 2649830 - protein, 4 aa, Entamoeba histolytica
QNED

SEQ ID NO: 2649831 - protein, 11 aa, Entamoeba histolytica
QNEDSKKEEER

SEQ ID NO: 2649832 - protein, 8 aa, Entamoeba histolytica
QNEDTDEG

SEQ ID NO: 2649833 - protein, 8 aa, Entamoeba histolytica
QNEECKKK

SEQ ID NO: 2649834 - protein, 9 aa, Entamoeba histolytica
QNEEKWDTC

SEQ ID NO: 2649835 - protein, 10 aa, Entamoeba histolytica
QNEENEYKKL

SEQ ID NO: 2649836 - protein, 14 aa, Entamoeba histolytica
QNEGSNNNALEQYT

SEQ ID NO: 2649837 - protein, 6 aa, Entamoeba histolytica
QNEGTI

SEQ ID NO: 2649838 - protein, 5 aa, Entamoeba histolytica
QNEGV

SEQ ID NO: 2649839 - protein, 6 aa, Entamoeba histolytica
QNEIGT

SEQ ID NO: 2649840 - protein, 13 aa, Entamoeba histolytica
QNEINEKINQNDE

SEQ ID NO: 2649841 - protein, 6 aa, Entamoeba histolytica
QNEINN

SEQ ID NO: 2649842 - protein, 5 aa, Entamoeba histolytica
QNEIS

SEQ ID NO: 2649843 - protein, 16 aa, Entamoeba histolytica
QNEKLRSQILSLKEKF

SEQ ID NO: 2649844 - protein, 7 aa, Entamoeba histolytica
QNEKQEW

SEQ ID NO: 2649845 - protein, 9 aa, Entamoeba histolytica
QNEKQREEL

SEQ ID NO: 2649846 - protein, 13 aa, Entamoeba histolytica
QNEKTRAVGADIE

SEQ ID NO: 2649847 - protein, 14 aa, Entamoeba histolytica
QNELEKSKKEITEI

SEQ ID NO: 2649848 - protein, 8 aa, Entamoeba histolytica
QNELSDPS

SEQ ID NO: 2649849 - protein, 7 aa, Entamoeba histolytica
QNENDQL

SEQ ID NO: 2649850 - protein, 7 aa, Entamoeba histolytica
QNENDTL

SEQ ID NO: 2649851 - protein, 7 aa, Entamoeba histolytica
QNEPDLN

SEQ ID NO: 2649852 - protein, 9 aa, Entamoeba histolytica
QNEPDPEFP

SEQ ID NO: 2649853 - protein, 7 aa, Entamoeba histolytica
QNEPNSY

SEQ ID NO: 2649854 - protein, 10 aa, Entamoeba histolytica
QNEPPTRSSD

SEQ ID NO: 2649855 - protein, 17 aa, Entamoeba histolytica
QNEPRQYSVQSTTDNEI

SEQ ID NO: 2649856 - protein, 4 aa, Entamoeba histolytica
QNEQ

SEQ ID NO: 2649857 - protein, 21 aa, Entamoeba histolytica
QNEQDATRTYAETKEIQKEIE

SEQ ID NO: 2649858 - protein, 6 aa, Entamoeba histolytica
QNEQKT

SEQ ID NO: 2649859 - protein, 8 aa, Entamoeba histolytica
QNEQPKKK

SEQ ID NO: 2649860 - protein, 12 aa, Entamoeba histolytica
QNEREAARKNAI

SEQ ID NO: 2649861 - protein, 15 aa, Entamoeba histolytica
QNERLKKENDEAKEI

SEQ ID NO: 2649862 - protein, 5 aa, Entamoeba histolytica
QNERN

SEQ ID NO: 2649863 - protein, 11 aa, Entamoeba histolytica
QNERNQIQPED

SEQ ID NO: 2649864 - protein, 9 aa, Entamoeba histolytica
QNESGYIPR

SEQ ID NO: 2649865 - protein, 9 aa, Entamoeba histolytica
QNESISTDE

SEQ ID NO: 2649866 - protein, 15 aa, Entamoeba histolytica
QNESITSDKKETDEE

SEQ ID NO: 2649867 - protein, 28 aa, Entamoeba histolytica
QNESLRNKNKESKSPSSSLSDSIEEEKE

SEQ ID NO: 2649868 - protein, 38 aa, Entamoeba histolytica
QNESQSQSTTKQSQSQLSQPITSQEESQTLKKEQKKKV

SEQ ID NO: 2649869 - protein, 5 aa, Entamoeba histolytica
QNEST

SEQ ID NO: 2649870 - protein, 7 aa, Entamoeba histolytica
QNETECP

SEQ ID NO: 2649871 - protein, 4 aa, Entamoeba histolytica
QNEV

SEQ ID NO: 2649872 - protein, 38 aa, Entamoeba histolytica
QNEVKHKDDNIKVSGTKTSVISNQQNTSETSKKTHVEI

SEQ ID NO: 2649873 - protein, 6 aa, Entamoeba histolytica
QNEYQK

SEQ ID NO: 2649874 - protein, 4 aa, Entamoeba histolytica
QNFE

SEQ ID NO: 2649875 - protein, 6 aa, Entamoeba histolytica
QNFQRK

SEQ ID NO: 2649876 - protein, 4 aa, Entamoeba histolytica
QNFT

SEQ ID NO: 2649877 - protein, 8 aa, Entamoeba histolytica
QNGAINPS

SEQ ID NO: 2649878 - protein, 6 aa, Entamoeba histolytica
QNGCKS

SEQ ID NO: 2649879 - protein, 8 aa, Entamoeba histolytica
QNGEIPSV

SEQ ID NO: 2649880 - protein, 6 aa, Entamoeba histolytica
QNGELE

SEQ ID NO: 2649881 - protein, 5 aa, Entamoeba histolytica
QNGEN

SEQ ID NO: 2649882 - protein, 5 aa, Entamoeba histolytica
QNGET

SEQ ID NO: 2649883 - protein, 6 aa, Entamoeba histolytica
QNGGNI

SEQ ID NO: 2649884 - protein, 12 aa, Entamoeba histolytica
QNGGYPDDLPPV

SEQ ID NO: 2649885 - protein, 6 aa, Entamoeba histolytica
QNGHYQ

SEQ ID NO: 2649886 - protein, 14 aa, Entamoeba histolytica
QNGITSNTLNPQEV

SEQ ID NO: 2649887 - protein, 4 aa, Entamoeba histolytica
QNGL

SEQ ID NO: 2649888 - protein, 8 aa, Entamoeba histolytica
QNGLSGEE

SEQ ID NO: 2649889 - protein, 7 aa, Entamoeba histolytica
QNGMSSM

SEQ ID NO: 2649890 - protein, 7 aa, Entamoeba histolytica
QNGNEKN

SEQ ID NO: 2649891 - protein, 11 aa, Entamoeba histolytica
QNGNTSTAEEG

SEQ ID NO: 2649892 - protein, 4 aa, Entamoeba histolytica
QNGP

SEQ ID NO: 2649893 - protein, 5 aa, Entamoeba histolytica
QNGPI

SEQ ID NO: 2649894 - protein, 6 aa, Entamoeba histolytica
QNGQLR

SEQ ID NO: 2649895 - protein, 13 aa, Entamoeba histolytica
QNGQQTFLPEPNH

SEQ ID NO: 2649896 - protein, 5 aa, Entamoeba histolytica
QNGQS

SEQ ID NO: 2649897 - protein, 8 aa, Entamoeba histolytica
QNGSSELN

SEQ ID NO: 2649898 - protein, 7 aa, Entamoeba histolytica
QNGTEEL

SEQ ID NO: 2649899 - protein, 8 aa, Entamoeba histolytica
QNGTGKTT

SEQ ID NO: 2649900 - protein, 15 aa, Entamoeba histolytica
QNGTPSFQEKTNQKI

SEQ ID NO: 2649901 - protein, 4 aa, Entamoeba histolytica
QNGV

SEQ ID NO: 2649902 - protein, 9 aa, Entamoeba histolytica
QNGVTSDGQ

SEQ ID NO: 2649903 - protein, 12 aa, Entamoeba histolytica
QNGYIEKENQQA

SEQ ID NO: 2649904 - protein, 5 aa, Entamoeba histolytica
QNHEA

SEQ ID NO: 2649905 - protein, 5 aa, Entamoeba histolytica
QNHED

SEQ ID NO: 2649906 - protein, 7 aa, Entamoeba histolytica
QNHEKGK

SEQ ID NO: 2649907 - protein, 12 aa, Entamoeba histolytica
QNHEMSQESNEF

SEQ ID NO: 2649908 - protein, 12 aa, Entamoeba histolytica
QNHPKEAEKELE

SEQ ID NO: 2649909 - protein, 5 aa, Entamoeba histolytica
QNHPT

SEQ ID NO: 2649910 - protein, 4 aa, Entamoeba histolytica
QNHT

SEQ ID NO: 2649911 - protein, 12 aa, Entamoeba histolytica
QNHTKKGKISVS

SEQ ID NO: 2649912 - protein, 8 aa, Entamoeba histolytica
QNHTNGKN

SEQ ID NO: 2649913 - protein, 5 aa, Entamoeba histolytica
QNIDK

SEQ ID NO: 2649914 - protein, 12 aa, Entamoeba histolytica
QNIEKSQLQNTE

SEQ ID NO: 2649915 - protein, 10 aa, Entamoeba histolytica
QNIETQTINE

SEQ ID NO: 2649916 - protein, 16 aa, Entamoeba histolytica
QNIKEEKSKRDEETTR

SEQ ID NO: 2649917 - protein, 7 aa, Entamoeba histolytica
QNINEED

SEQ ID NO: 2649918 - protein, 17 aa, Entamoeba histolytica
QNIPIKGSKRLQNHEEG

SEQ ID NO: 2649919 - protein, 6 aa, Entamoeba histolytica
QNIPNG

SEQ ID NO: 2649920 - protein, 6 aa, Entamoeba histolytica
QNIPQN

SEQ ID NO: 2649921 - protein, 9 aa, Entamoeba histolytica
QNIPQTEDT

SEQ ID NO: 2649922 - protein, 10 aa, Entamoeba histolytica
QNIPSKPMQL

SEQ ID NO: 2649923 - protein, 4 aa, Entamoeba histolytica
QNIQ

SEQ ID NO: 2649924 - protein, 5 aa, Entamoeba histolytica
QNIQE

SEQ ID NO: 2649925 - protein, 9 aa, Entamoeba histolytica
QNIQEEETS

SEQ ID NO: 2649926 - protein, 15 aa, Entamoeba histolytica
QNIRSQRKKTSKLTD

SEQ ID NO: 2649927 - protein, 9 aa, Entamoeba histolytica
QNITPTPKS

SEQ ID NO: 2649928 - protein, 18 aa, Entamoeba histolytica
QNKDGGYRDKPSKKPDLY

SEQ ID NO: 2649929 - protein, 4 aa, Entamoeba histolytica
QNKE

SEQ ID NO: 2649930 - protein, 5 aa, Entamoeba histolytica
QNKEE

SEQ ID NO: 2649931 - protein, 14 aa, Entamoeba histolytica
QNKEESKRNCPSLS

SEQ ID NO: 2649932 - protein, 8 aa, Entamoeba histolytica
QNKEKQIK

SEQ ID NO: 2649933 - protein, 5 aa, Entamoeba histolytica
QNKER

SEQ ID NO: 2649934 - protein, 16 aa, Entamoeba histolytica
QNKEVEKEATHTTPQS

SEQ ID NO: 2649935 - protein, 7 aa, Entamoeba histolytica
QNKFPQS

SEQ ID NO: 2649936 - protein, 4 aa, Entamoeba histolytica
QNKG

SEQ ID NO: 2649937 - protein, 10 aa, Entamoeba histolytica
QNKGLGTDNV

SEQ ID NO: 2649938 - protein, 5 aa, Entamoeba histolytica
QNKGV

SEQ ID NO: 2649939 - protein, 14 aa, Entamoeba histolytica
QNKHPGSSGTTKNV

SEQ ID NO: 2649940 - protein, 19 aa, Entamoeba histolytica
QNKIEGDITQEVKTEEEIK

SEQ ID NO: 2649941 - protein, 12 aa, Entamoeba histolytica
QNKIGEKRKEIE

SEQ ID NO: 2649942 - protein, 7 aa, Entamoeba histolytica
QNKKEEG

SEQ ID NO: 2649943 - protein, 7 aa, Entamoeba histolytica
QNKNGLI

SEQ ID NO: 2649944 - protein, 6 aa, Entamoeba histolytica
QNKNIR

SEQ ID NO: 2649945 - protein, 9 aa, Entamoeba histolytica
QNKPEYQEE

SEQ ID NO: 2649946 - protein, 8 aa, Entamoeba histolytica
QNKPIPKT

SEQ ID NO: 2649947 - protein, 10 aa, Entamoeba histolytica
QNKREFNEVG

SEQ ID NO: 2649948 - protein, 10 aa, Entamoeba histolytica
QNKRTKNQQL

SEQ ID NO: 2649949 - protein, 8 aa, Entamoeba histolytica
QNKRWNSQ

SEQ ID NO: 2649950 - protein, 5 aa, Entamoeba histolytica
QNKSF

SEQ ID NO: 2649951 - protein, 25 aa, Entamoeba histolytica
QNKSYIPSTCANGELTQGYEDPTGL

SEQ ID NO: 2649952 - protein, 6 aa, Entamoeba histolytica
QNKTAL

SEQ ID NO: 2649953 - protein, 10 aa, Entamoeba histolytica
QNKTKELITE

SEQ ID NO: 2649954 - protein, 5 aa, Entamoeba histolytica
QNKTN

SEQ ID NO: 2649955 - protein, 8 aa, Entamoeba histolytica
QNKTNATL

SEQ ID NO: 2649956 - protein, 10 aa, Entamoeba histolytica
QNKTNSESFC

SEQ ID NO: 2649957 - protein, 6 aa, Entamoeba histolytica
QNKVDD

SEQ ID NO: 2649958 - protein, 4 aa, Entamoeba histolytica
QNKY

SEQ ID NO: 2649959 - protein, 4 aa, Entamoeba histolytica
QNLA

SEQ ID NO: 2649960 - protein, 7 aa, Entamoeba histolytica
QNLENNS

SEQ ID NO: 2649961 - protein, 8 aa, Entamoeba histolytica
QNLKNQPL

SEQ ID NO: 2649962 - protein, 10 aa, Entamoeba histolytica
QNLNPQQKKA

SEQ ID NO: 2649963 - protein, 14 aa, Entamoeba histolytica
QNLNQQPQHTIPQQ

SEQ ID NO: 2649964 - protein, 5 aa, Entamoeba histolytica
QNLPK

SEQ ID NO: 2649965 - protein, 8 aa, Entamoeba histolytica
QNLPRTGS

SEQ ID NO: 2649966 - protein, 7 aa, Entamoeba histolytica
QNLSKEE

SEQ ID NO: 2649967 - protein, 19 aa, Entamoeba histolytica
QNLSKQEVKPLEVKPNQTE

SEQ ID NO: 2649968 - protein, 6 aa, Entamoeba histolytica
QNLSYE

SEQ ID NO: 2649969 - protein, 6 aa, Entamoeba histolytica
QNMARR

SEQ ID NO: 2649970 - protein, 14 aa, Entamoeba histolytica
QNMNDEQLSLTGKR

SEQ ID NO: 2649971 - protein, 9 aa, Entamoeba histolytica
QNNDGNTPL

SEQ ID NO: 2649972 - protein, 4 aa, Entamoeba histolytica
QNNE

SEQ ID NO: 2649973 - protein, 7 aa, Entamoeba histolytica
QNNEIKN

SEQ ID NO: 2649974 - protein, 8 aa, Entamoeba histolytica
QNNELTKA

SEQ ID NO: 2649975 - protein, 8 aa, Entamoeba histolytica
QNNEQAKK

SEQ ID NO: 2649976 - protein, 16 aa, Entamoeba histolytica
QNNETVDTTLCSKINL

SEQ ID NO: 2649977 - protein, 7 aa, Entamoeba histolytica
QNNFQDI

SEQ ID NO: 2649978 - protein, 10 aa, Entamoeba histolytica
QNNHKDYTDT

SEQ ID NO: 2649979 - protein, 7 aa, Entamoeba histolytica
QNNKENA

SEQ ID NO: 2649980 - protein, 6 aa, Entamoeba histolytica
QNNKGG

SEQ ID NO: 2649981 - protein, 6 aa, Entamoeba histolytica
QNNLSQ

SEQ ID NO: 2649982 - protein, 6 aa, Entamoeba histolytica
QNNNIT

SEQ ID NO: 2649983 - protein, 9 aa, Entamoeba histolytica
QNNNNTKEI

SEQ ID NO: 2649984 - protein, 8 aa, Entamoeba histolytica
QNNNSFNN

SEQ ID NO: 2649985 - protein, 6 aa, Entamoeba histolytica
QNNPNI

SEQ ID NO: 2649986 - protein, 7 aa, Entamoeba histolytica
QNNPNIE

SEQ ID NO: 2649987 - protein, 13 aa, Entamoeba histolytica
QNNQKGTNYLSPS

SEQ ID NO: 2649988 - protein, 17 aa, Entamoeba histolytica
QNNQQSGFGNNTQQINS

SEQ ID NO: 2649989 - protein, 9 aa, Entamoeba histolytica
QNNQSSTIS

SEQ ID NO: 2649990 - protein, 16 aa, Entamoeba histolytica
QNNRNIHREPERDIQK

SEQ ID NO: 2649991 - protein, 9 aa, Entamoeba histolytica
QNNSIDDTF

SEQ ID NO: 2649992 - protein, 7 aa, Entamoeba histolytica
QNNTEKL

SEQ ID NO: 2649993 - protein, 18 aa, Entamoeba histolytica
QNNTEKSEATTTSSTSMI

SEQ ID NO: 2649994 - protein, 12 aa, Entamoeba histolytica
QNNTMTGEGPTI

SEQ ID NO: 2649995 - protein, 6 aa, Entamoeba histolytica
QNNTSK

SEQ ID NO: 2649996 - protein, 5 aa, Entamoeba histolytica
QNNTY

SEQ ID NO: 2649997 - protein, 6 aa, Entamoeba histolytica
QNNVKD

SEQ ID NO: 2649998 - protein, 7 aa, Entamoeba histolytica
QNNYEES

SEQ ID NO: 2649999 - protein, 5 aa, Entamoeba histolytica
QNNYS

SEQ ID NO: 2650000 - protein, 6 aa, Entamoeba histolytica
QNNYTN

SEQ ID NO: 2650001 - protein, 5 aa, Entamoeba histolytica
QNPDF

SEQ ID NO: 2650002 - protein, 7 aa, Entamoeba histolytica
QNPENSD

SEQ ID NO: 2650003 - protein, 20 aa, Entamoeba histolytica
QNPETLPLKDEKEETSHPQI

SEQ ID NO: 2650004 - protein, 15 aa, Entamoeba histolytica
QNPHRRVSQPPYEIT

SEQ ID NO: 2650005 - protein, 7 aa, Entamoeba histolytica
QNPKERL

SEQ ID NO: 2650006 - protein, 7 aa, Entamoeba histolytica
QNPKPYN

SEQ ID NO: 2650007 - protein, 15 aa, Entamoeba histolytica
QNPLGEGSGRKGLPQ

SEQ ID NO: 2650008 - protein, 6 aa, Entamoeba histolytica
QNPLKK

SEQ ID NO: 2650009 - protein, 9 aa, Entamoeba histolytica
QNPLKTQKG

SEQ ID NO: 2650010 - protein, 4 aa, Entamoeba histolytica
QNPN

SEQ ID NO: 2650011 - protein, 7 aa, Entamoeba histolytica
QNPNESL

SEQ ID NO: 2650012 - protein, 11 aa, Entamoeba histolytica
QNPPNTYGGRK

SEQ ID NO: 2650013 - protein, 7 aa, Entamoeba histolytica
QNPPQKV

SEQ ID NO: 2650014 - protein, 5 aa, Entamoeba histolytica
QNPQA

SEQ ID NO: 2650015 - protein, 21 aa, Entamoeba histolytica
QNPQAQQSQSHQSYDLSQQKK

SEQ ID NO: 2650016 - protein, 7 aa, Entamoeba histolytica
QNPQDRL

SEQ ID NO: 2650017 - protein, 15 aa, Entamoeba histolytica
QNPREEKPIDRQKNV

SEQ ID NO: 2650018 - protein, 13 aa, Entamoeba histolytica
QNPRKEEDADSWR

SEQ ID NO: 2650019 - protein, 6 aa, Entamoeba histolytica
QNPSEF

SEQ ID NO: 2650020 - protein, 15 aa, Entamoeba histolytica
QNPSIDKTRKANPFS

SEQ ID NO: 2650021 - protein, 16 aa, Entamoeba histolytica
QNPSLRQQAEAQLTSF

SEQ ID NO: 2650022 - protein, 7 aa, Entamoeba histolytica
QNPSNLD

SEQ ID NO: 2650023 - protein, 7 aa, Entamoeba histolytica
QNPTALE

SEQ ID NO: 2650024 - protein, 6 aa, Entamoeba histolytica
QNPTPY

SEQ ID NO: 2650025 - protein, 5 aa, Entamoeba histolytica
QNPTT

SEQ ID NO: 2650026 - protein, 7 aa, Entamoeba histolytica
QNPYGSN

SEQ ID NO: 2650027 - protein, 16 aa, Entamoeba histolytica
QNQDSYNANKKSIKID

SEQ ID NO: 2650028 - protein, 5 aa, Entamoeba histolytica
QNQEG

SEQ ID NO: 2650029 - protein, 7 aa, Entamoeba histolytica
QNQEKKY

SEQ ID NO: 2650030 - protein, 14 aa, Entamoeba histolytica
QNQIGPVTTQDGLE

SEQ ID NO: 2650031 - protein, 6 aa, Entamoeba histolytica
QNQLKE

SEQ ID NO: 2650032 - protein, 11 aa, Entamoeba histolytica
QNQNISEGDSF

SEQ ID NO: 2650033 - protein, 8 aa, Entamoeba histolytica
QNQNPSFT

SEQ ID NO: 2650034 - protein, 7 aa, Entamoeba histolytica
QNQPISN

SEQ ID NO: 2650035 - protein, 6 aa, Entamoeba histolytica
QNQPNG

SEQ ID NO: 2650036 - protein, 10 aa, Entamoeba histolytica
QNQPSQTPVD

SEQ ID NO: 2650037 - protein, 4 aa, Entamoeba histolytica
QNQQ

SEQ ID NO: 2650038 - protein, 5 aa, Entamoeba histolytica
QNQQN

SEQ ID NO: 2650039 - protein, 9 aa, Entamoeba histolytica
QNQQREFPT

SEQ ID NO: 2650040 - protein, 9 aa, Entamoeba histolytica
QNQQSTKSL

SEQ ID NO: 2650041 - protein, 6 aa, Entamoeba histolytica
QNQRKD

SEQ ID NO: 2650042 - protein, 11 aa, Entamoeba histolytica
QNQRTNDNNRR

SEQ ID NO: 2650043 - protein, 15 aa, Entamoeba histolytica
QNQSQSNSLESSSLE

SEQ ID NO: 2650044 - protein, 12 aa, Entamoeba histolytica
QNQTGNEALQKG

SEQ ID NO: 2650045 - protein, 7 aa, Entamoeba histolytica
QNQTIKE

SEQ ID NO: 2650046 - protein, 4 aa, Entamoeba histolytica
QNQY

SEQ ID NO: 2650047 - protein, 9 aa, Entamoeba histolytica
QNREIKEEV

SEQ ID NO: 2650048 - protein, 5 aa, Entamoeba histolytica
QNREK

SEQ ID NO: 2650049 - protein, 4 aa, Entamoeba histolytica
QNRK

SEQ ID NO: 2650050 - protein, 35 aa, Entamoeba histolytica
QNRMTTDYSSKQKQTDSIDLASPDSSELPPIDNNE

SEQ ID NO: 2650051 - protein, 7 aa, Entamoeba histolytica
QNRPYNA

SEQ ID NO: 2650052 - protein, 4 aa, Entamoeba histolytica
QNRT

SEQ ID NO: 2650053 - protein, 4 aa, Entamoeba histolytica
QNRW

SEQ ID NO: 2650054 - protein, 19 aa, Entamoeba histolytica
QNSCSSSGLTFSSSSESDF

SEQ ID NO: 2650055 - protein, 6 aa, Entamoeba histolytica
QNSDMT

SEQ ID NO: 2650056 - protein, 5 aa, Entamoeba histolytica
QNSEI

SEQ ID NO: 2650057 - protein, 17 aa, Entamoeba histolytica
QNSETASGVHRDKEYAE

SEQ ID NO: 2650058 - protein, 6 aa, Entamoeba histolytica
QNSITD

SEQ ID NO: 2650059 - protein, 37 aa, Entamoeba histolytica
QNSITTDISKQKTVITQQTTKQPVNTYNRTYKYQQNL

SEQ ID NO: 2650060 - protein, 4 aa, Entamoeba histolytica
QNSK

SEQ ID NO: 2650061 - protein, 8 aa, Entamoeba histolytica
QNSKKNQK

SEQ ID NO: 2650062 - protein, 11 aa, Entamoeba histolytica
QNSKRDPHSLK

SEQ ID NO: 2650063 - protein, 21 aa, Entamoeba histolytica
QNSNTAISKKAISAIDNNAYG

SEQ ID NO: 2650064 - protein, 9 aa, Entamoeba histolytica
QNSPNFYTP

SEQ ID NO: 2650065 - protein, 13 aa, Entamoeba histolytica
QNSQQLPQEYTPF

SEQ ID NO: 2650066 - protein, 5 aa, Entamoeba histolytica
QNSQS

SEQ ID NO: 2650067 - protein, 6 aa, Entamoeba histolytica
QNSSIQ

SEQ ID NO: 2650068 - protein, 9 aa, Entamoeba histolytica
QNSSKDKLS

SEQ ID NO: 2650069 - protein, 12 aa, Entamoeba histolytica
QNSSKVPSLNSN

SEQ ID NO: 2650070 - protein, 8 aa, Entamoeba histolytica
QNSTELKK

SEQ ID NO: 2650071 - protein, 6 aa, Entamoeba histolytica
QNSTLS

SEQ ID NO: 2650072 - protein, 9 aa, Entamoeba histolytica
QNSTNNYSI

SEQ ID NO: 2650073 - protein, 4 aa, Entamoeba histolytica
QNSY

SEQ ID NO: 2650074 - protein, 7 aa, Entamoeba histolytica
QNSYTPY

SEQ ID NO: 2650075 - protein, 4 aa, Entamoeba histolytica
QNTD

SEQ ID NO: 2650076 - protein, 6 aa, Entamoeba histolytica
QNTDTL

SEQ ID NO: 2650077 - protein, 15 aa, Entamoeba histolytica
QNTEIQDDSERLSVS

SEQ ID NO: 2650078 - protein, 10 aa, Entamoeba histolytica
QNTEKEKKEV

SEQ ID NO: 2650079 - protein, 6 aa, Entamoeba histolytica
QNTFQS

SEQ ID NO: 2650080 - protein, 7 aa, Entamoeba histolytica
QNTGKIE

SEQ ID NO: 2650081 - protein, 7 aa, Entamoeba histolytica
QNTGKSI

SEQ ID NO: 2650082 - protein, 46 aa, Entamoeba histolytica
QNTGNETKELPKITNSLENVQKGIKQTQEKNVSFEDETKEEEISKE

SEQ ID NO: 2650083 - protein, 16 aa, Entamoeba histolytica
QNTKINNEIDSTDMEI

SEQ ID NO: 2650084 - protein, 6 aa, Entamoeba histolytica
QNTKSL

SEQ ID NO: 2650085 - protein, 5 aa, Entamoeba histolytica
QNTNE

SEQ ID NO: 2650086 - protein, 14 aa, Entamoeba histolytica
QNTNLIKTDYSIFF

SEQ ID NO: 2650087 - protein, 7 aa, Entamoeba histolytica
QNTPLGN

SEQ ID NO: 2650088 - protein, 7 aa, Entamoeba histolytica
QNTPPDN

SEQ ID NO: 2650089 - protein, 5 aa, Entamoeba histolytica
QNTPR

SEQ ID NO: 2650090 - protein, 8 aa, Entamoeba histolytica
QNTQNTSQ

SEQ ID NO: 2650091 - protein, 5 aa, Entamoeba histolytica
QNTQQ

SEQ ID NO: 2650092 - protein, 20 aa, Entamoeba histolytica
QNTSGETEKVKEIGKKIQEE

SEQ ID NO: 2650093 - protein, 10 aa, Entamoeba histolytica
QNTVEKEKAY

SEQ ID NO: 2650094 - protein, 10 aa, Entamoeba histolytica
QNVETQTQIN

SEQ ID NO: 2650095 - protein, 4 aa, Entamoeba histolytica
QNVP

SEQ ID NO: 2650096 - protein, 6 aa, Entamoeba histolytica
QNVPSI

SEQ ID NO: 2650097 - protein, 6 aa, Entamoeba histolytica
QNVPSY

SEQ ID NO: 2650098 - protein, 7 aa, Entamoeba histolytica
QNVQPTL

SEQ ID NO: 2650099 - protein, 26 aa, Entamoeba histolytica
QNVSQSNQQPIKSFEDKKSDYSQSPL

SEQ ID NO: 2650100 - protein, 7 aa, Entamoeba histolytica
QNVSSNS

SEQ ID NO: 2650101 - protein, 6 aa, Entamoeba histolytica
QNWNRS

SEQ ID NO: 2650102 - protein, 5 aa, Entamoeba histolytica
QNYES

SEQ ID NO: 2650103 - protein, 8 aa, Entamoeba histolytica
QNYPKSKP

SEQ ID NO: 2650104 - protein, 97 aa, Entamoeba histolytica
QNYQHPDDMGTQQEYTMEDAQSHKQEIPEQPPQLPPPRRGASSANRSLNPTLSSNDSVRRGGFKSTSLSNYEQPTTSVSAPPLNPGFKGRGTLRGGY

SEQ ID NO: 2650105 - protein, 5 aa, Entamoeba histolytica
QNYQI

SEQ ID NO: 2650106 - protein, 10 aa, Entamoeba histolytica
QNYSAPNNRQ

SEQ ID NO: 2650107 - protein, 8 aa, Entamoeba histolytica
QNYYGPTR

SEQ ID NO: 2650108 - protein, 7 aa, Entamoeba histolytica
QPAEKDD

SEQ ID NO: 2650109 - protein, 9 aa, Entamoeba histolytica
QPAKKSITT

SEQ ID NO: 2650110 - protein, 26 aa, Entamoeba histolytica
QPALKPKKKRGRSVAEISQESTNYNA

SEQ ID NO: 2650111 - protein, 9 aa, Entamoeba histolytica
QPANGGLGT

SEQ ID NO: 2650112 - protein, 5 aa, Entamoeba histolytica
QPAQF

SEQ ID NO: 2650113 - protein, 9 aa, Entamoeba histolytica
QPATNNSFK

SEQ ID NO: 2650114 - protein, 10 aa, Entamoeba histolytica
QPCAKDSRAH

SEQ ID NO: 2650115 - protein, 6 aa, Entamoeba histolytica
QPCDPS

SEQ ID NO: 2650116 - protein, 5 aa, Entamoeba histolytica
QPCYK

SEQ ID NO: 2650117 - protein, 5 aa, Entamoeba histolytica
QPDDK

SEQ ID NO: 2650118 - protein, 14 aa, Entamoeba histolytica
QPDEDDCKNERSNV

SEQ ID NO: 2650119 - protein, 13 aa, Entamoeba histolytica
QPDGSSQPLTTET

SEQ ID NO: 2650120 - protein, 5 aa, Entamoeba histolytica
QPDII

SEQ ID NO: 2650121 - protein, 4 aa, Entamoeba histolytica
QPDK

SEQ ID NO: 2650122 - protein, 12 aa, Entamoeba histolytica
QPDLPNDENGLS

SEQ ID NO: 2650123 - protein, 5 aa, Entamoeba histolytica
QPDLS

SEQ ID NO: 2650124 - protein, 6 aa, Entamoeba histolytica
QPDSIQ

SEQ ID NO: 2650125 - protein, 7 aa, Entamoeba histolytica
QPDSQDL

SEQ ID NO: 2650126 - protein, 4 aa, Entamoeba histolytica
QPDV

SEQ ID NO: 2650127 - protein, 4 aa, Entamoeba histolytica
QPEA

SEQ ID NO: 2650128 - protein, 6 aa, Entamoeba histolytica
QPECSK

SEQ ID NO: 2650129 - protein, 5 aa, Entamoeba histolytica
QPEED

SEQ ID NO: 2650130 - protein, 4 aa, Entamoeba histolytica
QPEK

SEQ ID NO: 2650131 - protein, 5 aa, Entamoeba histolytica
QPEKK

SEQ ID NO: 2650132 - protein, 4 aa, Entamoeba histolytica
QPEP

SEQ ID NO: 2650133 - protein, 12 aa, Entamoeba histolytica
QPEQFQSDASSL

SEQ ID NO: 2650134 - protein, 4 aa, Entamoeba histolytica
QPER

SEQ ID NO: 2650135 - protein, 8 aa, Entamoeba histolytica
QPERTEED

SEQ ID NO: 2650136 - protein, 4 aa, Entamoeba histolytica
QPET

SEQ ID NO: 2650137 - protein, 14 aa, Entamoeba histolytica
QPETIQESSSEIEY

SEQ ID NO: 2650138 - protein, 5 aa, Entamoeba histolytica
QPEVN

SEQ ID NO: 2650139 - protein, 12 aa, Entamoeba histolytica
QPEYPTQPHEKR

SEQ ID NO: 2650140 - protein, 6 aa, Entamoeba histolytica
QPFDEA

SEQ ID NO: 2650141 - protein, 9 aa, Entamoeba histolytica
QPFDGTTSY

SEQ ID NO: 2650142 - protein, 5 aa, Entamoeba histolytica
QPFDP

SEQ ID NO: 2650143 - protein, 9 aa, Entamoeba histolytica
QPFDQKDEI

SEQ ID NO: 2650144 - protein, 6 aa, Entamoeba histolytica
QPFEKA

SEQ ID NO: 2650145 - protein, 4 aa, Entamoeba histolytica
QPFG

SEQ ID NO: 2650146 - protein, 26 aa, Entamoeba histolytica
QPFKKESSTSPKSPRSPRVASAPQES

SEQ ID NO: 2650147 - protein, 22 aa, Entamoeba histolytica
QPFNKKKQQTTNLQKDRENDQQ

SEQ ID NO: 2650148 - protein, 9 aa, Entamoeba histolytica
QPFNQQDEF

SEQ ID NO: 2650149 - protein, 7 aa, Entamoeba histolytica
QPFPPFT

SEQ ID NO: 2650150 - protein, 6 aa, Entamoeba histolytica
QPGDGK

SEQ ID NO: 2650151 - protein, 5 aa, Entamoeba histolytica
QPGFT

SEQ ID NO: 2650152 - protein, 5 aa, Entamoeba histolytica
QPGIA

SEQ ID NO: 2650153 - protein, 4 aa, Entamoeba histolytica
QPGK

SEQ ID NO: 2650154 - protein, 8 aa, Entamoeba histolytica
QPGSFSVS

SEQ ID NO: 2650155 - protein, 8 aa, Entamoeba histolytica
QPGTLGSK

SEQ ID NO: 2650156 - protein, 7 aa, Entamoeba histolytica
QPGYPYN

SEQ ID NO: 2650157 - protein, 4 aa, Entamoeba histolytica
QPHE

SEQ ID NO: 2650158 - protein, 16 aa, Entamoeba histolytica
QPHIQQPTAQQPSVTN

SEQ ID NO: 2650159 - protein, 4 aa, Entamoeba histolytica
QPHQ

SEQ ID NO: 2650160 - protein, 4 aa, Entamoeba histolytica
QPID

SEQ ID NO: 2650161 - protein, 9 aa, Entamoeba histolytica
QPIHKSSTS

SEQ ID NO: 2650162 - protein, 13 aa, Entamoeba histolytica
QPIHNNDNDLPSI

SEQ ID NO: 2650163 - protein, 9 aa, Entamoeba histolytica
QPIKRKPNE

SEQ ID NO: 2650164 - protein, 25 aa, Entamoeba histolytica
QPINKTKTKELINEEETRKNERKSS

SEQ ID NO: 2650165 - protein, 6 aa, Entamoeba histolytica
QPINPS

SEQ ID NO: 2650166 - protein, 16 aa, Entamoeba histolytica
QPIPLTTTPQELETNP

SEQ ID NO: 2650167 - protein, 8 aa, Entamoeba histolytica
QPIQETKR

SEQ ID NO: 2650168 - protein, 5 aa, Entamoeba histolytica
QPIQK

SEQ ID NO: 2650169 - protein, 21 aa, Entamoeba histolytica
QPIQNEEQEIVKEEKPKEIEE

SEQ ID NO: 2650170 - protein, 24 aa, Entamoeba histolytica
QPIQQNTNKFPSFNQTQEQSQQFQ

SEQ ID NO: 2650171 - protein, 13 aa, Entamoeba histolytica
QPIRPRPTRLSNN

SEQ ID NO: 2650172 - protein, 9 aa, Entamoeba histolytica
QPISNQSIP

SEQ ID NO: 2650173 - protein, 17 aa, Entamoeba histolytica
QPISPGKPIMPSQPGFG

SEQ ID NO: 2650174 - protein, 7 aa, Entamoeba histolytica
QPISRKS

SEQ ID NO: 2650175 - protein, 5 aa, Entamoeba histolytica
QPISS

SEQ ID NO: 2650176 - protein, 13 aa, Entamoeba histolytica
QPISSNQSETYPD

SEQ ID NO: 2650177 - protein, 17 aa, Entamoeba histolytica
QPITAKPSLMETTPSPH

SEQ ID NO: 2650178 - protein, 9 aa, Entamoeba histolytica
QPITPRKES

SEQ ID NO: 2650179 - protein, 4 aa, Entamoeba histolytica
QPIY

SEQ ID NO: 2650180 - protein, 7 aa, Entamoeba histolytica
QPIYQPP

SEQ ID NO: 2650181 - protein, 48 aa, Entamoeba histolytica
QPKAVEEADEKKRKKEQEEIQKQRRKEEKEREKQAKKQKKEEKKNSKK

SEQ ID NO: 2650182 - protein, 9 aa, Entamoeba histolytica
QPKDKSPIP

SEQ ID NO: 2650183 - protein, 4 aa, Entamoeba histolytica
QPKE

SEQ ID NO: 2650184 - protein, 10 aa, Entamoeba histolytica
QPKEFGEEEI

SEQ ID NO: 2650185 - protein, 11 aa, Entamoeba histolytica
QPKEGNINERK

SEQ ID NO: 2650186 - protein, 6 aa, Entamoeba histolytica
QPKKTY

SEQ ID NO: 2650187 - protein, 6 aa, Entamoeba histolytica
QPKNLK

SEQ ID NO: 2650188 - protein, 6 aa, Entamoeba histolytica
QPKPIE

SEQ ID NO: 2650189 - protein, 27 aa, Entamoeba histolytica
QPKPISPQSGVPMKPSYSIEPTSNNTN

SEQ ID NO: 2650190 - protein, 10 aa, Entamoeba histolytica
QPKQKEESVY

SEQ ID NO: 2650191 - protein, 9 aa, Entamoeba histolytica
QPKTNESNI

SEQ ID NO: 2650192 - protein, 7 aa, Entamoeba histolytica
QPKTNTL

SEQ ID NO: 2650193 - protein, 14 aa, Entamoeba histolytica
QPKTPIQPSPSPVF

SEQ ID NO: 2650194 - protein, 8 aa, Entamoeba histolytica
QPKTSPNF

SEQ ID NO: 2650195 - protein, 8 aa, Entamoeba histolytica
QPLGPQRI

SEQ ID NO: 2650196 - protein, 11 aa, Entamoeba histolytica
QPLKGNPSNSG

SEQ ID NO: 2650197 - protein, 5 aa, Entamoeba histolytica
QPLKP

SEQ ID NO: 2650198 - protein, 6 aa, Entamoeba histolytica
QPLNPD

SEQ ID NO: 2650199 - protein, 7 aa, Entamoeba histolytica
QPLPDSF

SEQ ID NO: 2650200 - protein, 4 aa, Entamoeba histolytica
QPLQ

SEQ ID NO: 2650201 - protein, 7 aa, Entamoeba histolytica
QPLRQKR

SEQ ID NO: 2650202 - protein, 6 aa, Entamoeba histolytica
QPLSTT

SEQ ID NO: 2650203 - protein, 4 aa, Entamoeba histolytica
QPMP

SEQ ID NO: 2650204 - protein, 5 aa, Entamoeba histolytica
QPNDK

SEQ ID NO: 2650205 - protein, 5 aa, Entamoeba histolytica
QPNDL

SEQ ID NO: 2650206 - protein, 12 aa, Entamoeba histolytica
QPNDTRITKYFI

SEQ ID NO: 2650207 - protein, 8 aa, Entamoeba histolytica
QPNENNEL

SEQ ID NO: 2650208 - protein, 27 aa, Entamoeba histolytica
QPNINTIKKDSDVLTQTTKQPSKKSNV

SEQ ID NO: 2650209 - protein, 16 aa, Entamoeba histolytica
QPNITPPDCPIPEAES

SEQ ID NO: 2650210 - protein, 5 aa, Entamoeba histolytica
QPNKV

SEQ ID NO: 2650211 - protein, 10 aa, Entamoeba histolytica
QPNKYGKGKK

SEQ ID NO: 2650212 - protein, 10 aa, Entamoeba histolytica
QPNNCQNRKS

SEQ ID NO: 2650213 - protein, 35 aa, Entamoeba histolytica
QPNNNDVYKKSDSVRAITGNRNVNSTQPLTKSKSN

SEQ ID NO: 2650214 - protein, 9 aa, Entamoeba histolytica
QPNPERDRK

SEQ ID NO: 2650215 - protein, 29 aa, Entamoeba histolytica
QPNPKQWKGEKGVKEGKRTRAVKPGKVVI

SEQ ID NO: 2650216 - protein, 7 aa, Entamoeba histolytica
QPNPSNY

SEQ ID NO: 2650217 - protein, 17 aa, Entamoeba histolytica
QPNQKEDNSSINQKEES

SEQ ID NO: 2650218 - protein, 5 aa, Entamoeba histolytica
QPNQS

SEQ ID NO: 2650219 - protein, 16 aa, Entamoeba histolytica
QPNREKLSQENTDKTR

SEQ ID NO: 2650220 - protein, 13 aa, Entamoeba histolytica
QPNSKNNDVEGAV

SEQ ID NO: 2650221 - protein, 7 aa, Entamoeba histolytica
QPNTTPL

SEQ ID NO: 2650222 - protein, 6 aa, Entamoeba histolytica
QPNVES

SEQ ID NO: 2650223 - protein, 5 aa, Entamoeba histolytica
QPPEK

SEQ ID NO: 2650224 - protein, 4 aa, Entamoeba histolytica
QPPI

SEQ ID NO: 2650225 - protein, 7 aa, Entamoeba histolytica
QPPIRQE

SEQ ID NO: 2650226 - protein, 5 aa, Entamoeba histolytica
QPPIT

SEQ ID NO: 2650227 - protein, 8 aa, Entamoeba histolytica
QPPKIPPF

SEQ ID NO: 2650228 - protein, 11 aa, Entamoeba histolytica
QPPKTEQQNPF

SEQ ID NO: 2650229 - protein, 31 aa, Entamoeba histolytica
QPPLKTESKTKEELKKEEKELKKQKQMEEKK

SEQ ID NO: 2650230 - protein, 6 aa, Entamoeba histolytica
QPPLNT

SEQ ID NO: 2650231 - protein, 38 aa, Entamoeba histolytica
QPPLPPDQFTQPPLPPDQFTQPPPPPQQPYYAPPPPPQ

SEQ ID NO: 2650232 - protein, 6 aa, Entamoeba histolytica
QPPNSS

SEQ ID NO: 2650233 - protein, 7 aa, Entamoeba histolytica
QPPPAQY

SEQ ID NO: 2650234 - protein, 6 aa, Entamoeba histolytica
QPPPLK

SEQ ID NO: 2650235 - protein, 9 aa, Entamoeba histolytica
QPPPQQQQV

SEQ ID NO: 2650236 - protein, 5 aa, Entamoeba histolytica
QPPQE

SEQ ID NO: 2650237 - protein, 12 aa, Entamoeba histolytica
QPPQQPLKETNQ

SEQ ID NO: 2650238 - protein, 6 aa, Entamoeba histolytica
QPPTAK

SEQ ID NO: 2650239 - protein, 6 aa, Entamoeba histolytica
QPPTVN

SEQ ID NO: 2650240 - protein, 26 aa, Entamoeba histolytica
QPPVPTLSSPTSTLPPPTTSTTYPLS

SEQ ID NO: 2650241 - protein, 7 aa, Entamoeba histolytica
QPPYSHN

SEQ ID NO: 2650242 - protein, 16 aa, Entamoeba histolytica
QPPYTSTYPSQYQPPY

SEQ ID NO: 2650243 - protein, 5 aa, Entamoeba histolytica
QPQAY

SEQ ID NO: 2650244 - protein, 7 aa, Entamoeba histolytica
QPQEASK

SEQ ID NO: 2650245 - protein, 36 aa, Entamoeba histolytica
QPQEQKSNNTQEMKQERRERGGEIANQGNKRNVEKI

SEQ ID NO: 2650246 - protein, 16 aa, Entamoeba histolytica
QPQHHKTTSSSQFNQP

SEQ ID NO: 2650247 - protein, 5 aa, Entamoeba histolytica
QPQHY

SEQ ID NO: 2650248 - protein, 5 aa, Entamoeba histolytica
QPQIE

SEQ ID NO: 2650249 - protein, 5 aa, Entamoeba histolytica
QPQLD

SEQ ID NO: 2650250 - protein, 18 aa, Entamoeba histolytica
QPQNITSASTVSYNPSQS

SEQ ID NO: 2650251 - protein, 22 aa, Entamoeba histolytica
QPQNNRSITEKENITLTEKQQV

SEQ ID NO: 2650252 - protein, 21 aa, Entamoeba histolytica
QPQPGTCPVTPPSQSKRNIPN

SEQ ID NO: 2650253 - protein, 5 aa, Entamoeba histolytica
QPQPI

SEQ ID NO: 2650254 - protein, 6 aa, Entamoeba histolytica
QPQQEY

SEQ ID NO: 2650255 - protein, 11 aa, Entamoeba histolytica
QPQQHPARDAQ

SEQ ID NO: 2650256 - protein, 16 aa, Entamoeba histolytica
QPQQSISITNPKEDEN

SEQ ID NO: 2650257 - protein, 8 aa, Entamoeba histolytica
QPQRNTEL

SEQ ID NO: 2650258 - protein, 17 aa, Entamoeba histolytica
QPQRTEANGEKKEGDCK

SEQ ID NO: 2650259 - protein, 11 aa, Entamoeba histolytica
QPQSNQPPSID

SEQ ID NO: 2650260 - protein, 5 aa, Entamoeba histolytica
QPRCD

SEQ ID NO: 2650261 - protein, 9 aa, Entamoeba histolytica
QPRGTRTKT

SEQ ID NO: 2650262 - protein, 8 aa, Entamoeba histolytica
QPRKEEGF

SEQ ID NO: 2650263 - protein, 13 aa, Entamoeba histolytica
QPRKRSKNQPKPI

SEQ ID NO: 2650264 - protein, 10 aa, Entamoeba histolytica
QPRPSSTSLP

SEQ ID NO: 2650265 - protein, 5 aa, Entamoeba histolytica
QPRST

SEQ ID NO: 2650266 - protein, 13 aa, Entamoeba histolytica
QPSANKYKNLNGI

SEQ ID NO: 2650267 - protein, 9 aa, Entamoeba histolytica
QPSEDQSNS

SEQ ID NO: 2650268 - protein, 16 aa, Entamoeba histolytica
QPSEEEKKEYVEGDER

SEQ ID NO: 2650269 - protein, 5 aa, Entamoeba histolytica
QPSEL

SEQ ID NO: 2650270 - protein, 8 aa, Entamoeba histolytica
QPSELPSL

SEQ ID NO: 2650271 - protein, 14 aa, Entamoeba histolytica
QPSFQSSSTTLNTD

SEQ ID NO: 2650272 - protein, 5 aa, Entamoeba histolytica
QPSGF

SEQ ID NO: 2650273 - protein, 5 aa, Entamoeba histolytica
QPSLN

SEQ ID NO: 2650274 - protein, 4 aa, Entamoeba histolytica
QPSM

SEQ ID NO: 2650275 - protein, 6 aa, Entamoeba histolytica
QPSNDW

SEQ ID NO: 2650276 - protein, 14 aa, Entamoeba histolytica
QPSNESIPYGSNTK

SEQ ID NO: 2650277 - protein, 17 aa, Entamoeba histolytica
QPSPSGNTQTKSPSSFD

SEQ ID NO: 2650278 - protein, 14 aa, Entamoeba histolytica
QPSQKSNTPTIKKD

SEQ ID NO: 2650279 - protein, 16 aa, Entamoeba histolytica
QPSRNQKRVKEQEMKR

SEQ ID NO: 2650280 - protein, 30 aa, Entamoeba histolytica
QPSSEKSTPRTLSPRQRGENKAKLESTKSG

SEQ ID NO: 2650281 - protein, 11 aa, Entamoeba histolytica
QPSSKREGFTT

SEQ ID NO: 2650282 - protein, 20 aa, Entamoeba histolytica
QPSSQEKYGDLNEPNANGVE

SEQ ID NO: 2650283 - protein, 6 aa, Entamoeba histolytica
QPSSSF

SEQ ID NO: 2650284 - protein, 18 aa, Entamoeba histolytica
QPSTADGSLTIRGGSTSV

SEQ ID NO: 2650285 - protein, 7 aa, Entamoeba histolytica
QPSTSSF

SEQ ID NO: 2650286 - protein, 8 aa, Entamoeba histolytica
QPSTSSLY

SEQ ID NO: 2650287 - protein, 5 aa, Entamoeba histolytica
QPSYP

SEQ ID NO: 2650288 - protein, 9 aa, Entamoeba histolytica
QPSYPSSTF

SEQ ID NO: 2650289 - protein, 4 aa, Entamoeba histolytica
QPTA

SEQ ID NO: 2650290 - protein, 5 aa, Entamoeba histolytica
QPTDD

SEQ ID NO: 2650291 - protein, 10 aa, Entamoeba histolytica
QPTDPKIKEQ

SEQ ID NO: 2650292 - protein, 6 aa, Entamoeba histolytica
QPTESV

SEQ ID NO: 2650293 - protein, 6 aa, Entamoeba histolytica
QPTIPN

SEQ ID NO: 2650294 - protein, 5 aa, Entamoeba histolytica
QPTIT

SEQ ID NO: 2650295 - protein, 18 aa, Entamoeba histolytica
QPTKTSAKKIKKVTPGTR

SEQ ID NO: 2650296 - protein, 4 aa, Entamoeba histolytica
QPTL

SEQ ID NO: 2650297 - protein, 6 aa, Entamoeba histolytica
QPTLPN

SEQ ID NO: 2650298 - protein, 6 aa, Entamoeba histolytica
QPTNLN

SEQ ID NO: 2650299 - protein, 8 aa, Entamoeba histolytica
QPTNRPSF

SEQ ID NO: 2650300 - protein, 7 aa, Entamoeba histolytica
QPTNSRG

SEQ ID NO: 2650301 - protein, 21 aa, Entamoeba histolytica
QPTNTQQLTEPIQKGNQYDQH

SEQ ID NO: 2650302 - protein, 14 aa, Entamoeba histolytica
QPTPTYENKPIPHK

SEQ ID NO: 2650303 - protein, 9 aa, Entamoeba histolytica
QPTQKPDHL

SEQ ID NO: 2650304 - protein, 17 aa, Entamoeba histolytica
QPTQQQQQPIQQTSNSA

SEQ ID NO: 2650305 - protein, 7 aa, Entamoeba histolytica
QPTSDQL

SEQ ID NO: 2650306 - protein, 5 aa, Entamoeba histolytica
QPTSM

SEQ ID NO: 2650307 - protein, 9 aa, Entamoeba histolytica
QPTSQHEYT

SEQ ID NO: 2650308 - protein, 16 aa, Entamoeba histolytica
QPTSSTLQTPQNDIPL

SEQ ID NO: 2650309 - protein, 7 aa, Entamoeba histolytica
QPTVREP

SEQ ID NO: 2650310 - protein, 15 aa, Entamoeba histolytica
QPTYIKKESDEDTVS

SEQ ID NO: 2650311 - protein, 27 aa, Entamoeba histolytica
QPVDDDYKENEPTKRKQLNKRKPGKKH

SEQ ID NO: 2650312 - protein, 6 aa, Entamoeba histolytica
QPVEKV

SEQ ID NO: 2650313 - protein, 9 aa, Entamoeba histolytica
QPVKPSNYL

SEQ ID NO: 2650314 - protein, 5 aa, Entamoeba histolytica
QPVLQ

SEQ ID NO: 2650315 - protein, 4 aa, Entamoeba histolytica
QPVN

SEQ ID NO: 2650316 - protein, 15 aa, Entamoeba histolytica
QPVNKQINGDEKKDM

SEQ ID NO: 2650317 - protein, 18 aa, Entamoeba histolytica
QPVNRPERFDATRLHNDK

SEQ ID NO: 2650318 - protein, 4 aa, Entamoeba histolytica
QPVP

SEQ ID NO: 2650319 - protein, 6 aa, Entamoeba histolytica
QPYISE

SEQ ID NO: 2650320 - protein, 17 aa, Entamoeba histolytica
QPYNNSPGLIPSTTKDI

SEQ ID NO: 2650321 - protein, 5 aa, Entamoeba histolytica
QPYQV

SEQ ID NO: 2650322 - protein, 4 aa, Entamoeba histolytica
QPYS

SEQ ID NO: 2650323 - protein, 24 aa, Entamoeba histolytica
QQADGKQNIPQQQYTGSNPQQQPY

SEQ ID NO: 2650324 - protein, 6 aa, Entamoeba histolytica
QQAEKA

SEQ ID NO: 2650325 - protein, 23 aa, Entamoeba histolytica
QQAEQKAEQQRHEQAQTSGNEKL

SEQ ID NO: 2650326 - protein, 13 aa, Entamoeba histolytica
QQAKQRDSNEQYQ

SEQ ID NO: 2650327 - protein, 7 aa, Entamoeba histolytica
QQAKTDR

SEQ ID NO: 2650328 - protein, 4 aa, Entamoeba histolytica
QQAN

SEQ ID NO: 2650329 - protein, 5 aa, Entamoeba histolytica
QQASV

SEQ ID NO: 2650330 - protein, 6 aa, Entamoeba histolytica
QQCQQR

SEQ ID NO: 2650331 - protein, 5 aa, Entamoeba histolytica
QQDAY

SEQ ID NO: 2650332 - protein, 21 aa, Entamoeba histolytica
QQDGSDSQEIVQNSNSSTEEK

SEQ ID NO: 2650333 - protein, 9 aa, Entamoeba histolytica
QQDNSQPFL

SEQ ID NO: 2650334 - protein, 10 aa, Entamoeba histolytica
QQDSNTIRDL

SEQ ID NO: 2650335 - protein, 4 aa, Entamoeba histolytica
QQED

SEQ ID NO: 2650336 - protein, 17 aa, Entamoeba histolytica
QQEDSLSDEKSCDEEIT

SEQ ID NO: 2650337 - protein, 11 aa, Entamoeba histolytica
QQEEDEKEESY

SEQ ID NO: 2650338 - protein, 16 aa, Entamoeba histolytica
QQEEEKKRRLLEENKG

SEQ ID NO: 2650339 - protein, 9 aa, Entamoeba histolytica
QQEEKTQEF

SEQ ID NO: 2650340 - protein, 5 aa, Entamoeba histolytica
QQEEL

SEQ ID NO: 2650341 - protein, 18 aa, Entamoeba histolytica
QQEEMQESPRPKTPEEFN

SEQ ID NO: 2650342 - protein, 10 aa, Entamoeba histolytica
QQEENNKQEI

SEQ ID NO: 2650343 - protein, 17 aa, Entamoeba histolytica
QQEESTQSLNQNERDSI

SEQ ID NO: 2650344 - protein, 46 aa, Entamoeba histolytica
QQEETKEKRQVEIENETVKKPHTTNKEIKTTTSFTKQNKKETKVEK

SEQ ID NO: 2650345 - protein, 14 aa, Entamoeba histolytica
QQEGNKNQQQQRRS

SEQ ID NO: 2650346 - protein, 8 aa, Entamoeba histolytica
QQEINSSN

SEQ ID NO: 2650347 - protein, 9 aa, Entamoeba histolytica
QQEKEKKVK

SEQ ID NO: 2650348 - protein, 7 aa, Entamoeba histolytica
QQEKPQE

SEQ ID NO: 2650349 - protein, 18 aa, Entamoeba histolytica
QQEKPSKPLPLKKGDTVR

SEQ ID NO: 2650350 - protein, 5 aa, Entamoeba histolytica
QQEKS

SEQ ID NO: 2650351 - protein, 12 aa, Entamoeba histolytica
QQELSDKKYAER

SEQ ID NO: 2650352 - protein, 12 aa, Entamoeba histolytica
QQENDVKDYSFD

SEQ ID NO: 2650353 - protein, 9 aa, Entamoeba histolytica
QQENIDNNT

SEQ ID NO: 2650354 - protein, 6 aa, Entamoeba histolytica
QQENSQ

SEQ ID NO: 2650355 - protein, 8 aa, Entamoeba histolytica
QQEPNALN

SEQ ID NO: 2650356 - protein, 23 aa, Entamoeba histolytica
QQEQLTEKHGDKKKKEKEKDKKK

SEQ ID NO: 2650357 - protein, 6 aa, Entamoeba histolytica
QQEQSL

SEQ ID NO: 2650358 - protein, 6 aa, Entamoeba histolytica
QQERSL

SEQ ID NO: 2650359 - protein, 6 aa, Entamoeba histolytica
QQESIA

SEQ ID NO: 2650360 - protein, 12 aa, Entamoeba histolytica
QQESTVENNEVP

SEQ ID NO: 2650361 - protein, 20 aa, Entamoeba histolytica
QQESYEKPSFTSTTLIKQGL

SEQ ID NO: 2650362 - protein, 10 aa, Entamoeba histolytica
QQETKKYAQL

SEQ ID NO: 2650363 - protein, 9 aa, Entamoeba histolytica
QQETQKFTS

SEQ ID NO: 2650364 - protein, 5 aa, Entamoeba histolytica
QQFKT

SEQ ID NO: 2650365 - protein, 5 aa, Entamoeba histolytica
QQFNQ

SEQ ID NO: 2650366 - protein, 4 aa, Entamoeba histolytica
QQFT

SEQ ID NO: 2650367 - protein, 13 aa, Entamoeba histolytica
QQGIKKEGEEEFN

SEQ ID NO: 2650368 - protein, 8 aa, Entamoeba histolytica
QQGNNDEA

SEQ ID NO: 2650369 - protein, 7 aa, Entamoeba histolytica
QQGNRNK

SEQ ID NO: 2650370 - protein, 23 aa, Entamoeba histolytica
QQGQQQVQQPGLQLGSSDMSGEF

SEQ ID NO: 2650371 - protein, 9 aa, Entamoeba histolytica
QQGSQNNKA

SEQ ID NO: 2650372 - protein, 20 aa, Entamoeba histolytica
QQGTYTAQDNVYESKPIKRY

SEQ ID NO: 2650373 - protein, 13 aa, Entamoeba histolytica
QQGYTKPSGIQQK

SEQ ID NO: 2650374 - protein, 4 aa, Entamoeba histolytica
QQHK

SEQ ID NO: 2650375 - protein, 22 aa, Entamoeba histolytica
QQHSENIEVTKPSDENEATTEV

SEQ ID NO: 2650376 - protein, 4 aa, Entamoeba histolytica
QQID

SEQ ID NO: 2650377 - protein, 5 aa, Entamoeba histolytica
QQIDQ

SEQ ID NO: 2650378 - protein, 5 aa, Entamoeba histolytica
QQIDR

SEQ ID NO: 2650379 - protein, 16 aa, Entamoeba histolytica
QQIEEEKKEEKTMEED

SEQ ID NO: 2650380 - protein, 5 aa, Entamoeba histolytica
QQIES

SEQ ID NO: 2650381 - protein, 8 aa, Entamoeba histolytica
QQIHNEEE

SEQ ID NO: 2650382 - protein, 5 aa, Entamoeba histolytica
QQIKR

SEQ ID NO: 2650383 - protein, 10 aa, Entamoeba histolytica
QQINQPSSGC

SEQ ID NO: 2650384 - protein, 32 aa, Entamoeba histolytica
QQINSQPNNLNKQTLNSNKSPDTPKRSPGSIQ

SEQ ID NO: 2650385 - protein, 10 aa, Entamoeba histolytica
QQINSSGVIE

SEQ ID NO: 2650386 - protein, 7 aa, Entamoeba histolytica
QQIPSNG

SEQ ID NO: 2650387 - protein, 10 aa, Entamoeba histolytica
QQIPTDTSNI

SEQ ID NO: 2650388 - protein, 5 aa, Entamoeba histolytica
QQIQQ

SEQ ID NO: 2650389 - protein, 8 aa, Entamoeba histolytica
QQIRDETE

SEQ ID NO: 2650390 - protein, 37 aa, Entamoeba histolytica
QQISNDDKTKENNEENGSGKFAQSTERTQSRNTETSI

SEQ ID NO: 2650391 - protein, 16 aa, Entamoeba histolytica
QQISNKFSDPLKKTHA

SEQ ID NO: 2650392 - protein, 10 aa, Entamoeba histolytica
QQKDEKIKEL

SEQ ID NO: 2650393 - protein, 8 aa, Entamoeba histolytica
QQKEKPDV

SEQ ID NO: 2650394 - protein, 8 aa, Entamoeba histolytica
QQKGESFV

SEQ ID NO: 2650395 - protein, 4 aa, Entamoeba histolytica
QQKI

SEQ ID NO: 2650396 - protein, 21 aa, Entamoeba histolytica
QQKINARNAEVQKSQNENDAL

SEQ ID NO: 2650397 - protein, 9 aa, Entamoeba histolytica
QQKKGTFEY

SEQ ID NO: 2650398 - protein, 10 aa, Entamoeba histolytica
QQKKKEVDRT

SEQ ID NO: 2650399 - protein, 32 aa, Entamoeba histolytica; identical to SEQ ID NO: 2455321

SEQ ID NO: 2650400 - protein, 14 aa, Entamoeba histolytica
QQKLSNHENDLTDT

SEQ ID NO: 2650401 - protein, 5 aa, Entamoeba histolytica
QQKND

SEQ ID NO: 2650402 - protein, 13 aa, Entamoeba histolytica
QQKNISKKVNEYK

SEQ ID NO: 2650403 - protein, 19 aa, Entamoeba histolytica
QQKNNISRHGTKTLSRNIT

SEQ ID NO: 2650404 - protein, 9 aa, Entamoeba histolytica
QQKNVQTDT

SEQ ID NO: 2650405 - protein, 6 aa, Entamoeba histolytica
QQKPNE

SEQ ID NO: 2650406 - protein, 7 aa, Entamoeba histolytica
QQKPVQK

SEQ ID NO: 2650407 - protein, 8 aa, Entamoeba histolytica
QQKRASLE

SEQ ID NO: 2650408 - protein, 23 aa, Entamoeba histolytica
QQKSSSSTLPAKSNLHERGGRVG

SEQ ID NO: 2650409 - protein, 4 aa, Entamoeba histolytica
QQKT

SEQ ID NO: 2650410 - protein, 8 aa, Entamoeba histolytica
QQKTNTVA

SEQ ID NO: 2650411 - protein, 7 aa, Entamoeba histolytica
QQKYTIP

SEQ ID NO: 2650412 - protein, 33 aa, Entamoeba histolytica
QQLEDETSQPPPPVPPRRSPKPKPCSYAPPADF

SEQ ID NO: 2650413 - protein, 8 aa, Entamoeba histolytica
QQLPQNQR

SEQ ID NO: 2650414 - protein, 8 aa, Entamoeba histolytica
QQLPQQQK

SEQ ID NO: 2650415 - protein, 21 aa, Entamoeba histolytica
QQLTSKKEAAIEKAKEADSNY

SEQ ID NO: 2650416 - protein, 4 aa, Entamoeba histolytica
QQLV

SEQ ID NO: 2650417 - protein, 4 aa, Entamoeba histolytica
QQMA

SEQ ID NO: 2650418 - protein, 13 aa, Entamoeba histolytica
QQMKASKEFNDPA

SEQ ID NO: 2650419 - protein, 6 aa, Entamoeba histolytica
QQMKEY

SEQ ID NO: 2650420 - protein, 6 aa, Entamoeba histolytica
QQMKKE

SEQ ID NO: 2650421 - protein, 5 aa, Entamoeba histolytica
QQMRT

SEQ ID NO: 2650422 - protein, 15 aa, Entamoeba histolytica
QQNEHQQKQSSQESM

SEQ ID NO: 2650423 - protein, 18 aa, Entamoeba histolytica
QQNELRSKKGVSPIYDTS

SEQ ID NO: 2650424 - protein, 11 aa, Entamoeba histolytica
QQNENISTSQL

SEQ ID NO: 2650425 - protein, 4 aa, Entamoeba histolytica
QQNG

SEQ ID NO: 2650426 - protein, 4 aa, Entamoeba histolytica
QQNH

SEQ ID NO: 2650427 - protein, 8 aa, Entamoeba histolytica
QQNHPEKL

SEQ ID NO: 2650428 - protein, 8 aa, Entamoeba histolytica
QQNIPQPV

SEQ ID NO: 2650429 - protein, 8 aa, Entamoeba histolytica
QQNKGEYK

SEQ ID NO: 2650430 - protein, 9 aa, Entamoeba histolytica
QQNKRSIDT

SEQ ID NO: 2650431 - protein, 8 aa, Entamoeba histolytica
QQNKSKGY

SEQ ID NO: 2650432 - protein, 5 aa, Entamoeba histolytica
QQNKY

SEQ ID NO: 2650433 - protein, 27 aa, Entamoeba histolytica
QQNNTIYNTYSEKNEEEDNDQESDDEL

SEQ ID NO: 2650434 - protein, 7 aa, Entamoeba histolytica
QQNNTYK

SEQ ID NO: 2650435 - protein, 6 aa, Entamoeba histolytica
QQNNWG

SEQ ID NO: 2650436 - protein, 4 aa, Entamoeba histolytica
QQNP

SEQ ID NO: 2650437 - protein, 115 aa, Entamoeba histolytica
QQNPFGTPNNTTQPQFGTNSSFAGFNTNQTSGTTNPFNSTGSSVSGANNPFATTQNNTTTPFTTGTTNPFNTTNNTTNSTTNPFNTNTTSTNNPFNTNTTNNPFSTNNTTNGTTN

SEQ ID NO: 2650438 - protein, 18 aa, Entamoeba histolytica
QQNQQTASQINELSNRSL

SEQ ID NO: 2650439 - protein, 14 aa, Entamoeba histolytica
QQNQSTPSSQPKIE

SEQ ID NO: 2650440 - protein, 6 aa, Entamoeba histolytica
QQNREV

SEQ ID NO: 2650441 - protein, 4 aa, Entamoeba histolytica
QQNS

SEQ ID NO: 2650442 - protein, 9 aa, Entamoeba histolytica
QQNSEERGD

SEQ ID NO: 2650443 - protein, 5 aa, Entamoeba histolytica
QQNSK

SEQ ID NO: 2650444 - protein, 7 aa, Entamoeba histolytica
QQNSKQF

SEQ ID NO: 2650445 - protein, 8 aa, Entamoeba histolytica
QQNTARQF

SEQ ID NO: 2650446 - protein, 6 aa, Entamoeba histolytica
QQNTGG

SEQ ID NO: 2650447 - protein, 9 aa, Entamoeba histolytica
QQNTTKDES

SEQ ID NO: 2650448 - protein, 4 aa, Entamoeba histolytica
QQPA

SEQ ID NO: 2650449 - protein, 8 aa, Entamoeba histolytica
QQPAASTL

SEQ ID NO: 2650450 - protein, 15 aa, Entamoeba histolytica
QQPAPSQQPQIQQQA

SEQ ID NO: 2650451 - protein, 20 aa, Entamoeba histolytica
QQPATTTPVQQPKPQPKPDV

SEQ ID NO: 2650452 - protein, 5 aa, Entamoeba histolytica
QQPCQ

SEQ ID NO: 2650453 - protein, 8 aa, Entamoeba histolytica
QQPDAFEY

SEQ ID NO: 2650454 - protein, 9 aa, Entamoeba histolytica
QQPDNPNNK

SEQ ID NO: 2650455 - protein, 9 aa, Entamoeba histolytica
QQPEDSDRK

SEQ ID NO: 2650456 - protein, 8 aa, Entamoeba histolytica
QQPEPDFP

SEQ ID NO: 2650457 - protein, 13 aa, Entamoeba histolytica
QQPIESPIQPSIS

SEQ ID NO: 2650458 - protein, 21 aa, Entamoeba histolytica
QQPKGLPDIKEKPKRTATKPI

SEQ ID NO: 2650459 - protein, 5 aa, Entamoeba histolytica
QQPKL

SEQ ID NO: 2650460 - protein, 14 aa, Entamoeba histolytica
QQPLQPSAPKRMST

SEQ ID NO: 2650461 - protein, 5 aa, Entamoeba histolytica
QQPLT

SEQ ID NO: 2650462 - protein, 5 aa, Entamoeba histolytica
QQPMT

SEQ ID NO: 2650463 - protein, 8 aa, Entamoeba histolytica
QQPNDLPN

SEQ ID NO: 2650464 - protein, 10 aa, Entamoeba histolytica
QQPNPSQQYP

SEQ ID NO: 2650465 - protein, 10 aa, Entamoeba histolytica
QQPNSSSHEE

SEQ ID NO: 2650466 - protein, 6 aa, Entamoeba histolytica
QQPNVS

SEQ ID NO: 2650467 - protein, 25 aa, Entamoeba histolytica
QQPPLDPGQANAQPPHQQCQPMFPH

SEQ ID NO: 2650468 - protein, 9 aa, Entamoeba histolytica
QQPQATSLQ

SEQ ID NO: 2650469 - protein, 9 aa, Entamoeba histolytica
QQPQFQQST

SEQ ID NO: 2650470 - protein, 8 aa, Entamoeba histolytica
QQPQIGQP

SEQ ID NO: 2650471 - protein, 11 aa, Entamoeba histolytica
QQPQKQTTNDM

SEQ ID NO: 2650472 - protein, 9 aa, Entamoeba histolytica
QQPQPSRDC

SEQ ID NO: 2650473 - protein, 5 aa, Entamoeba histolytica
QQPQQ

SEQ ID NO: 2650474 - protein, 17 aa, Entamoeba histolytica
QQPQQCYNSRPQTIAST

SEQ ID NO: 2650475 - protein, 14 aa, Entamoeba histolytica
QQPQQTENHAASSA

SEQ ID NO: 2650476 - protein, 33 aa, Entamoeba histolytica
QQPQSTQQPNFQQPQSTQQPNFQQPQNAQQPNP

SEQ ID NO: 2650477 - protein, 8 aa, Entamoeba histolytica
QQPSLEKQ

SEQ ID NO: 2650478 - protein, 8 aa, Entamoeba histolytica
QQPSPKLK

SEQ ID NO: 2650479 - protein, 4 aa, Entamoeba histolytica
QQPT

SEQ ID NO: 2650480 - protein, 23 aa, Entamoeba histolytica
QQPTFNQPPQNPMPNPYIPPQQT

SEQ ID NO: 2650481 - protein, 21 aa, Entamoeba histolytica
QQPTKPDRKPRKTRGGVVAQD

SEQ ID NO: 2650482 - protein, 19 aa, Entamoeba histolytica
QQPTQNNGLNQPQTAQPVQ

SEQ ID NO: 2650483 - protein, 16 aa, Entamoeba histolytica
QQPTQPMGYQQPAAST

SEQ ID NO: 2650484 - protein, 14 aa, Entamoeba histolytica
QQPVNQKKEQPKQN

SEQ ID NO: 2650485 - protein, 13 aa, Entamoeba histolytica
QQPYERPWKKLLY

SEQ ID NO: 2650486 - protein, 5 aa, Entamoeba histolytica
QQQEI

SEQ ID NO: 2650487 - protein, 10 aa, Entamoeba histolytica
QQQEKPQNVE

SEQ ID NO: 2650488 - protein, 14 aa, Entamoeba histolytica
QQQFNTSNNNVTNQ

SEQ ID NO: 2650489 - protein, 8 aa, Entamoeba histolytica
QQQGKKVN

SEQ ID NO: 2650490 - protein, 5 aa, Entamoeba histolytica
QQQIS

SEQ ID NO: 2650491 - protein, 15 aa, Entamoeba histolytica
QQQKAAEEKIQQERN

SEQ ID NO: 2650492 - protein, 5 aa, Entamoeba histolytica
QQQKD

SEQ ID NO: 2650493 - protein, 26 aa, Entamoeba histolytica
QQQKDSSQPKVKEDDNKTEEIKKEIT

SEQ ID NO: 2650494 - protein, 5 aa, Entamoeba histolytica
QQQKE

SEQ ID NO: 2650495 - protein, 85 aa, Entamoeba histolytica
QQQKERKEIQAHASETSKKIYEGSSVKKQKRIEEEKKAKEQKKIEKSKIKKEKRAERNKEKKEEEKFVSGTKKDKNEKKPKKNNK

SEQ ID NO: 2650496 - protein, 10 aa, Entamoeba histolytica
QQQKPIEDVR

SEQ ID NO: 2650497 - protein, 21 aa, Entamoeba histolytica
QQQLGEKEENDNNSIVQEKKD

SEQ ID NO: 2650498 - protein, 25 aa, Entamoeba histolytica
QQQLNEKERQLKEEEEKRKQIENEL

SEQ ID NO: 2650499 - protein, 7 aa, Entamoeba histolytica
QQQLQSK

SEQ ID NO: 2650500 - protein, 5 aa, Entamoeba histolytica
QQQNI

SEQ ID NO: 2650501 - protein, 7 aa, Entamoeba histolytica
QQQNNQW

SEQ ID NO: 2650502 - protein, 12 aa, Entamoeba histolytica
QQQNPSSSQDLP

SEQ ID NO: 2650503 - protein, 8 aa, Entamoeba histolytica
QQQNQFRE

SEQ ID NO: 2650504 - protein, 7 aa, Entamoeba histolytica
QQQNTNN

SEQ ID NO: 2650505 - protein, 6 aa, Entamoeba histolytica
QQQPNL

SEQ ID NO: 2650506 - protein, 25 aa, Entamoeba histolytica
QQQPQKDTEIPVPGSKTETTFNKER

SEQ ID NO: 2650507 - protein, 10 aa, Entamoeba histolytica
QQQPQQQGIQ

SEQ ID NO: 2650508 - protein, 13 aa, Entamoeba histolytica
QQQPSEESKEEVR

SEQ ID NO: 2650509 - protein, 37 aa, Entamoeba histolytica
QQQQKKERKPKQKAPKVDNEGAKIDTRKRLDKEGNFP

SEQ ID NO: 2650510 - protein, 22 aa, Entamoeba histolytica
QQQSPTTPKALPEYSNSQEQPF

SEQ ID NO: 2650511 - protein, 4 aa, Entamoeba histolytica
QQQT

SEQ ID NO: 2650512 - protein, 6 aa, Entamoeba histolytica
QQQTLN

SEQ ID NO: 2650513 - protein, 9 aa, Entamoeba histolytica
QQQTSINRL

SEQ ID NO: 2650514 - protein, 10 aa, Entamoeba histolytica
QQQTSKPQLV

SEQ ID NO: 2650515 - protein, 18 aa, Entamoeba histolytica
QQQYPGYGINPEAERYNQ

SEQ ID NO: 2650516 - protein, 9 aa, Entamoeba histolytica
QQQYQPNSY

SEQ ID NO: 2650517 - protein, 28 aa, Entamoeba histolytica
QQRAQKESELSQVSPRRPQPPTPKRGVT

SEQ ID NO: 2650518 - protein, 17 aa, Entamoeba histolytica
QQRDQDKPKYLQNVCVI

SEQ ID NO: 2650519 - protein, 14 aa, Entamoeba histolytica
QQRDQDKPKYLQNY

SEQ ID NO: 2650520 - protein, 11 aa, Entamoeba histolytica
QQRDTTTNPIN

SEQ ID NO: 2650521 - protein, 6 aa, Entamoeba histolytica
QQREIN

SEQ ID NO: 2650522 - protein, 4 aa, Entamoeba histolytica
QQRI

SEQ ID NO: 2650523 - protein, 6 aa, Entamoeba histolytica
QQRIDN

SEQ ID NO: 2650524 - protein, 11 aa, Entamoeba histolytica
QQRMSTPNKRE

SEQ ID NO: 2650525 - protein, 4 aa, Entamoeba histolytica
QQRN

SEQ ID NO: 2650526 - protein, 12 aa, Entamoeba histolytica
QQRPHKIGEYPG

SEQ ID NO: 2650527 - protein, 7 aa, Entamoeba histolytica
QQRPPFY

SEQ ID NO: 2650528 - protein, 27 aa, Entamoeba histolytica
QQRPPQQSSTETTESSLPINANSKSVH

SEQ ID NO: 2650529 - protein, 8 aa, Entamoeba histolytica
QQRPTTMA

SEQ ID NO: 2650530 - protein, 6 aa, Entamoeba histolytica
QQRQGL

SEQ ID NO: 2650531 - protein, 10 aa, Entamoeba histolytica
QQRQNRSAEY

SEQ ID NO: 2650532 - protein, 32 aa, Entamoeba histolytica
QQSCDKSSLISDEINKEKSLEKQEKKEPIQPV

SEQ ID NO: 2650533 - protein, 35 aa, Entamoeba histolytica
QQSCKESSVEEKIPKRKVTKQDESKKKRLSRVFGS

SEQ ID NO: 2650534 - protein, 15 aa, Entamoeba histolytica
QQSDASVNTNNKTQN

SEQ ID NO: 2650535 - protein, 10 aa, Entamoeba histolytica
QQSEEDIDGI

SEQ ID NO: 2650536 - protein, 6 aa, Entamoeba histolytica
QQSERL

SEQ ID NO: 2650537 - protein, 9 aa, Entamoeba histolytica
QQSGETKGE

SEQ ID NO: 2650538 - protein, 9 aa, Entamoeba histolytica
QQSKENKKF

SEQ ID NO: 2650539 - protein, 14 aa, Entamoeba histolytica
QQSKVENSKIQQYE

SEQ ID NO: 2650540 - protein, 7 aa, Entamoeba histolytica
QQSNDSL

SEQ ID NO: 2650541 - protein, 9 aa, Entamoeba histolytica
QQSNGDGIA

SEQ ID NO: 2650542 - protein, 6 aa, Entamoeba histolytica
QQSNID

SEQ ID NO: 2650543 - protein, 18 aa, Entamoeba histolytica
QQSNSSISNNQKPLPPLP

SEQ ID NO: 2650544 - protein, 8 aa, Entamoeba histolytica
QQSNSTKA

SEQ ID NO: 2650545 - protein, 12 aa, Entamoeba histolytica
QQSNYMRRCYEI

SEQ ID NO: 2650546 - protein, 11 aa, Entamoeba histolytica
QQSPKRKPSNL

SEQ ID NO: 2650547 - protein, 5 aa, Entamoeba histolytica
QQSPR

SEQ ID NO: 2650548 - protein, 10 aa, Entamoeba histolytica
QQSSKSNFNE

SEQ ID NO: 2650549 - protein, 21 aa, Entamoeba histolytica
QQSSQTEKPALPIRRKVNPPI

SEQ ID NO: 2650550 - protein, 7 aa, Entamoeba histolytica
QQSSVQS

SEQ ID NO: 2650551 - protein, 4 aa, Entamoeba histolytica
QQST

SEQ ID NO: 2650552 - protein, 7 aa, Entamoeba histolytica
QQSTTRS

SEQ ID NO: 2650553 - protein, 8 aa, Entamoeba histolytica
QQSVDEGV

SEQ ID NO: 2650554 - protein, 4 aa, Entamoeba histolytica
QQSY

SEQ ID NO: 2650555 - protein, 4 aa, Entamoeba histolytica
QQTE

SEQ ID NO: 2650556 - protein, 9 aa, Entamoeba histolytica
QQTESSDLV

SEQ ID NO: 2650557 - protein, 6 aa, Entamoeba histolytica
QQTGLQ

SEQ ID NO: 2650558 - protein, 6 aa, Entamoeba histolytica
QQTHEE

SEQ ID NO: 2650559 - protein, 8 aa, Entamoeba histolytica
QQTINNNP

SEQ ID NO: 2650560 - protein, 6 aa, Entamoeba histolytica
QQTKQE

SEQ ID NO: 2650561 - protein, 20 aa, Entamoeba histolytica
QQTNNQNQTQQVTSQPQQSF

SEQ ID NO: 2650562 - protein, 7 aa, Entamoeba histolytica
QQTNQFR

SEQ ID NO: 2650563 - protein, 17 aa, Entamoeba histolytica
QQTNSGMSDQQKQYSSA

SEQ ID NO: 2650564 - protein, 15 aa, Entamoeba histolytica
QQTNSPSLEQNKSHT

SEQ ID NO: 2650565 - protein, 4 aa, Entamoeba histolytica
QQTQ

SEQ ID NO: 2650566 - protein, 8 aa, Entamoeba histolytica
QQTQGNAQ

SEQ ID NO: 2650567 - protein, 14 aa, Entamoeba histolytica
QQTQKRSSTASSVI

SEQ ID NO: 2650568 - protein, 8 aa, Entamoeba histolytica
QQTQLSSS

SEQ ID NO: 2650569 - protein, 21 aa, Entamoeba histolytica
QQTQSQVINAGQDSQEIHEAE

SEQ ID NO: 2650570 - protein, 13 aa, Entamoeba histolytica
QQTQTARRPTKTG

SEQ ID NO: 2650571 - protein, 8 aa, Entamoeba histolytica
QQTQTKEE

SEQ ID NO: 2650572 - protein, 5 aa, Entamoeba histolytica
QQTRN

SEQ ID NO: 2650573 - protein, 4 aa, Entamoeba histolytica
QQTS

SEQ ID NO: 2650574 - protein, 5 aa, Entamoeba histolytica
QQTSQ

SEQ ID NO: 2650575 - protein, 6 aa, Entamoeba histolytica
QQTSQG

SEQ ID NO: 2650576 - protein, 8 aa, Entamoeba histolytica
QQTSQLTE

SEQ ID NO: 2650577 - protein, 11 aa, Entamoeba histolytica
QQTSSTEEIKQ

SEQ ID NO: 2650578 - protein, 11 aa, Entamoeba histolytica
QQTTENIVKSE

SEQ ID NO: 2650579 - protein, 15 aa, Entamoeba histolytica
QQTTTAKSFSPSIGL

SEQ ID NO: 2650580 - protein, 14 aa, Entamoeba histolytica
QQVAAEKKARLEGA

SEQ ID NO: 2650581 - protein, 6 aa, Entamoeba histolytica
QQVEEQ

SEQ ID NO: 2650582 - protein, 27 aa, Entamoeba histolytica
QQVKPIKTNKKRLPTQTRKSNLSNPKL

SEQ ID NO: 2650583 - protein, 7 aa, Entamoeba histolytica
QQVNNTN

SEQ ID NO: 2650584 - protein, 14 aa, Entamoeba histolytica
QQVNQTSEKQEENV

SEQ ID NO: 2650585 - protein, 8 aa, Entamoeba histolytica
QQVNQYPH

SEQ ID NO: 2650586 - protein, 16 aa, Entamoeba histolytica
QQVQENEKRRKEVEHK

SEQ ID NO: 2650587 - protein, 28 aa, Entamoeba histolytica
QQVQPKSVNQQVNETSQMPTNELPSIRD

SEQ ID NO: 2650588 - protein, 7 aa, Entamoeba histolytica
QQVSPLS

SEQ ID NO: 2650589 - protein, 11 aa, Entamoeba histolytica
QQVSPRSKLGE

SEQ ID NO: 2650590 - protein, 16 aa, Entamoeba histolytica
QQYENQIQEKEQKEQI

SEQ ID NO: 2650591 - protein, 17 aa, Entamoeba histolytica
QQYEPTPYKKVEAEPVA

SEQ ID NO: 2650592 - protein, 14 aa, Entamoeba histolytica
QQYKENENKKAEDF

SEQ ID NO: 2650593 - protein, 5 aa, Entamoeba histolytica
QQYND

SEQ ID NO: 2650594 - protein, 14 aa, Entamoeba histolytica
QQYSGTKMTKSAWD

SEQ ID NO: 2650595 - protein, 7 aa, Entamoeba histolytica
QQYSTQK

SEQ ID NO: 2650596 - protein, 5 aa, Entamoeba histolytica
QQYTP

SEQ ID NO: 2650597 - protein, 11 aa, Entamoeba histolytica
QQYTPANVGER

SEQ ID NO: 2650598 - protein, 12 aa, Entamoeba histolytica
QRAAKKAAKECK

SEQ ID NO: 2650599 - protein, 11 aa, Entamoeba histolytica
QRAEEKNISGV

SEQ ID NO: 2650600 - protein, 8 aa, Entamoeba histolytica
QRAHSENA

SEQ ID NO: 2650601 - protein, 8 aa, Entamoeba histolytica
QRANQQQI

SEQ ID NO: 2650602 - protein, 21 aa, Entamoeba histolytica
QRAQGNKAATNIRKAKETFRE

SEQ ID NO: 2650603 - protein, 13 aa, Entamoeba histolytica
QRARQEKHLTQKE

SEQ ID NO: 2650604 - protein, 4 aa, Entamoeba histolytica
QRAS

SEQ ID NO: 2650605 - protein, 12 aa, Entamoeba histolytica
QRASSNGDDNRL

SEQ ID NO: 2650606 - protein, 10 aa, Entamoeba histolytica
QRAYDAQQIQ

SEQ ID NO: 2650607 - protein, 7 aa, Entamoeba histolytica
QRCDGRG

SEQ ID NO: 2650608 - protein, 11 aa, Entamoeba histolytica
QRDRIDQNINN

SEQ ID NO: 2650609 - protein, 10 aa, Entamoeba histolytica
QRDSELSTTI

SEQ ID NO: 2650610 - protein, 7 aa, Entamoeba histolytica
QRDSLKS

SEQ ID NO: 2650611 - protein, 7 aa, Entamoeba histolytica
QRDSYAS

SEQ ID NO: 2650612 - protein, 6 aa, Entamoeba histolytica
QREDGS

SEQ ID NO: 2650613 - protein, 4 aa, Entamoeba histolytica
QREE

SEQ ID NO: 2650614 - protein, 5 aa, Entamoeba histolytica
QREEA

SEQ ID NO: 2650615 - protein, 8 aa, Entamoeba histolytica
QREEKYSD

SEQ ID NO: 2650616 - protein, 7 aa, Entamoeba histolytica
QREHNRN

SEQ ID NO: 2650617 - protein, 6 aa, Entamoeba histolytica
QREIGE

SEQ ID NO: 2650618 - protein, 20 aa, Entamoeba histolytica
QREKASITKDNLKKKNILEQ

SEQ ID NO: 2650619 - protein, 33 aa, Entamoeba histolytica
QREKEEDDKKEMIRKQEEERIKQAQKEEEEKEH

SEQ ID NO: 2650620 - protein, 12 aa, Entamoeba histolytica
QREKRVGYDGSI

SEQ ID NO: 2650621 - protein, 4 aa, Entamoeba histolytica
QREN

SEQ ID NO: 2650622 - protein, 7 aa, Entamoeba histolytica
QRESIQN

SEQ ID NO: 2650623 - protein, 5 aa, Entamoeba histolytica
QRETK

SEQ ID NO: 2650624 - protein, 10 aa, Entamoeba histolytica
QREYNKQRNS

SEQ ID NO: 2650625 - protein, 7 aa, Entamoeba histolytica
QRFEDEG

SEQ ID NO: 2650626 - protein, 15 aa, Entamoeba histolytica
QRFNDSNEVNEKEEQ

SEQ ID NO: 2650627 - protein, 5 aa, Entamoeba histolytica
QRGEI

SEQ ID NO: 2650628 - protein, 13 aa, Entamoeba histolytica
QRGGRGNAGGQHH

SEQ ID NO: 2650629 - protein, 7 aa, Entamoeba histolytica
QRGKEEL

SEQ ID NO: 2650630 - protein, 13 aa, Entamoeba histolytica
QRGKERRESGRTT

SEQ ID NO: 2650631 - protein, 8 aa, Entamoeba histolytica
QRGNTEIE

SEQ ID NO: 2650632 - protein, 17 aa, Entamoeba histolytica
QRGQRNSPLAIPPEQTL

SEQ ID NO: 2650633 - protein, 12 aa, Entamoeba histolytica
QRGRDGSLNTPE

SEQ ID NO: 2650634 - protein, 8 aa, Entamoeba histolytica
QRGSDGNL

SEQ ID NO: 2650635 - protein, 13 aa, Entamoeba histolytica
QRGTDDRLSQDER

SEQ ID NO: 2650636 - protein, 8 aa, Entamoeba histolytica
QRGTMNTV

SEQ ID NO: 2650637 - protein, 10 aa, Entamoeba histolytica
QRGTRSTKYT

SEQ ID NO: 2650638 - protein, 5 aa, Entamoeba histolytica
QRGVA

SEQ ID NO: 2650639 - protein, 4 aa, Entamoeba histolytica
QRHN

SEQ ID NO: 2650640 - protein, 15 aa, Entamoeba histolytica
QRIPQQQVQQSPNGI

SEQ ID NO: 2650641 - protein, 4 aa, Entamoeba histolytica
QRIQ

SEQ ID NO: 2650642 - protein, 4 aa, Entamoeba histolytica
QRIS

SEQ ID NO: 2650643 - protein, 14 aa, Entamoeba histolytica
QRITNKSNNNVEKL

SEQ ID NO: 2650644 - protein, 5 aa, Entamoeba histolytica
QRIYT

SEQ ID NO: 2650645 - protein, 17 aa, Entamoeba histolytica
QRKDELNSLEESKTTGA

SEQ ID NO: 2650646 - protein, 8 aa, Entamoeba histolytica
QRKEEEPI

SEQ ID NO: 2650647 - protein, 26 aa, Entamoeba histolytica
QRKEKEEYDAKHAGDKKEEETKEEEK

SEQ ID NO: 2650648 - protein, 21 aa, Entamoeba histolytica
QRKEKEEYDAKHAGDKKEEKK

SEQ ID NO: 2650649 - protein, 4 aa, Entamoeba histolytica
QRKG

SEQ ID NO: 2650650 - protein, 6 aa, Entamoeba histolytica
QRKGFG

SEQ ID NO: 2650651 - protein, 9 aa, Entamoeba histolytica
QRKGTISTS

SEQ ID NO: 2650652 - protein, 5 aa, Entamoeba histolytica
QRKGY

SEQ ID NO: 2650653 - protein, 77 aa, Entamoeba histolytica
QRKHKDTSKSDHEKPHQNTHQKSQQNKNKSGIKRQNNSKYTQPLKQRSNPFGAKVSDELKKEYQEKKQRKESNEDAI

SEQ ID NO: 2650654 - protein, 4 aa, Entamoeba histolytica
QRKK

SEQ ID NO: 2650655 - protein, 17 aa, Entamoeba histolytica
QRKKEKENEEEEENELN

SEQ ID NO: 2650656 - protein, 8 aa, Entamoeba histolytica
QRKKENKD

SEQ ID NO: 2650657 - protein, 16 aa, Entamoeba histolytica
QRKKPQSQRKKQNNTT

SEQ ID NO: 2650658 - protein, 15 aa, Entamoeba histolytica
QRKLEEEAANAAAEQ

SEQ ID NO: 2650659 - protein, 7 aa, Entamoeba histolytica
QRKNYDD

SEQ ID NO: 2650660 - protein, 9 aa, Entamoeba histolytica
QRKRYYQKN

SEQ ID NO: 2650661 - protein, 8 aa, Entamoeba histolytica
QRKSDGTV

SEQ ID NO: 2650662 - protein, 5 aa, Entamoeba histolytica
QRKSS

SEQ ID NO: 2650663 - protein, 9 aa, Entamoeba histolytica
QRKTNKIQS

SEQ ID NO: 2650664 - protein, 5 aa, Entamoeba histolytica
QRKTT

SEQ ID NO: 2650665 - protein, 5 aa, Entamoeba histolytica
QRKVE

SEQ ID NO: 2650666 - protein, 11 aa, Entamoeba histolytica
QRLGAKSIDEI

SEQ ID NO: 2650667 - protein, 5 aa, Entamoeba histolytica
QRLRG

SEQ ID NO: 2650668 - protein, 10 aa, Entamoeba histolytica
QRLTDQQQKS

SEQ ID NO: 2650669 - protein, 16 aa, Entamoeba histolytica
QRMENTTFDSSDPFDY

SEQ ID NO: 2650670 - protein, 33 aa, Entamoeba histolytica
QRMNEENKLDSSKTEAESKVSFEQTAEIKNDNM

SEQ ID NO: 2650671 - protein, 10 aa, Entamoeba histolytica
QRMTPEQAAQ

SEQ ID NO: 2650672 - protein, 13 aa, Entamoeba histolytica
QRMTPKQANRKVE

SEQ ID NO: 2650673 - protein, 8 aa, Entamoeba histolytica
QRNDGDVS

SEQ ID NO: 2650674 - protein, 7 aa, Entamoeba histolytica
QRNEEFN

SEQ ID NO: 2650675 - protein, 10 aa, Entamoeba histolytica
QRNEKEGLIP

SEQ ID NO: 2650676 - protein, 9 aa, Entamoeba histolytica
QRNENGNMK

SEQ ID NO: 2650677 - protein, 5 aa, Entamoeba histolytica
QRNET

SEQ ID NO: 2650678 - protein, 8 aa, Entamoeba histolytica
QRNGEMKP

SEQ ID NO: 2650679 - protein, 17 aa, Entamoeba histolytica
QRNGIKAPDTGNDLSEP

SEQ ID NO: 2650680 - protein, 7 aa, Entamoeba histolytica
QRNGRKC

SEQ ID NO: 2650681 - protein, 11 aa, Entamoeba histolytica
QRNNSLPGDEV

SEQ ID NO: 2650682 - protein, 8 aa, Entamoeba histolytica
QRNPDWKY

SEQ ID NO: 2650683 - protein, 14 aa, Entamoeba histolytica
QRNQIKREKELNKT

SEQ ID NO: 2650684 - protein, 11 aa, Entamoeba histolytica
QRNSDCENSSH

SEQ ID NO: 2650685 - protein, 7 aa, Entamoeba histolytica
QRNSSAL

SEQ ID NO: 2650686 - protein, 13 aa, Entamoeba histolytica
QRPASSTGVVPSK

SEQ ID NO: 2650687 - protein, 5 aa, Entamoeba histolytica
QRPPR

SEQ ID NO: 2650688 - protein, 6 aa, Entamoeba histolytica
QRPYEG

SEQ ID NO: 2650689 - protein, 12 aa, Entamoeba histolytica
QRQANPKKFDNA

SEQ ID NO: 2650690 - protein, 11 aa, Entamoeba histolytica
QRQCEHAGERY

SEQ ID NO: 2650691 - protein, 9 aa, Entamoeba histolytica
QRQERSNKV

SEQ ID NO: 2650692 - protein, 15 aa, Entamoeba histolytica
QRQETHNNSTFLLDD

SEQ ID NO: 2650693 - protein, 9 aa, Entamoeba histolytica
QRQSPSNLG

SEQ ID NO: 2650694 - protein, 7 aa, Entamoeba histolytica
QRQSQVE

SEQ ID NO: 2650695 - protein, 4 aa, Entamoeba histolytica
QRQT

SEQ ID NO: 2650696 - protein, 4 aa, Entamoeba histolytica
QRRE

SEQ ID NO: 2650697 - protein, 4 aa, Entamoeba histolytica
QRRG

SEQ ID NO: 2650698 - protein, 7 aa, Entamoeba histolytica
QRRISSN

SEQ ID NO: 2650699 - protein, 15 aa, Entamoeba histolytica
QRRLEEEAAAAAAAQ

SEQ ID NO: 2650700 - protein, 7 aa, Entamoeba histolytica
QRRNNNV

SEQ ID NO: 2650701 - protein, 19 aa, Entamoeba histolytica
QRRNTKTRKSVKKVTVTRR

SEQ ID NO: 2650702 - protein, 9 aa, Entamoeba histolytica
QRRPTEESI

SEQ ID NO: 2650703 - protein, 6 aa, Entamoeba histolytica
QRRSTT

SEQ ID NO: 2650704 - protein, 5 aa, Entamoeba histolytica
QRRSV

SEQ ID NO: 2650705 - protein, 5 aa, Entamoeba histolytica
QRRTG

SEQ ID NO: 2650706 - protein, 5 aa, Entamoeba histolytica
QRSAS

SEQ ID NO: 2650707 - protein, 4 aa, Entamoeba histolytica
QRSD

SEQ ID NO: 2650708 - protein, 10 aa, Entamoeba histolytica
QRSEDKSVTS

SEQ ID NO: 2650709 - protein, 9 aa, Entamoeba histolytica
QRSEETRKS

SEQ ID NO: 2650710 - protein, 5 aa, Entamoeba histolytica
QRSGL

SEQ ID NO: 2650711 - protein, 8 aa, Entamoeba histolytica
QRSGMKKD

SEQ ID NO: 2650712 - protein, 35 aa, Entamoeba histolytica
QRSKGSPSSSDRSSERSSERNESNRLKRSSQIQEQ

SEQ ID NO: 2650713 - protein, 10 aa, Entamoeba histolytica
QRSLGGGADM

SEQ ID NO: 2650714 - protein, 29 aa, Entamoeba histolytica
QRSMTTISNPAPRPIQPPPITTSITQSQQ

SEQ ID NO: 2650715 - protein, 9 aa, Entamoeba histolytica
QRSQDGNVK

SEQ ID NO: 2650716 - protein, 7 aa, Entamoeba histolytica
QRSQSPS

SEQ ID NO: 2650717 - protein, 5 aa, Entamoeba histolytica
QRSQY

SEQ ID NO: 2650718 - protein, 9 aa, Entamoeba histolytica
QRSSASMGN

SEQ ID NO: 2650719 - protein, 6 aa, Entamoeba histolytica
QRSTVR

SEQ ID NO: 2650720 - protein, 6 aa, Entamoeba histolytica
QRTDRD

SEQ ID NO: 2650721 - protein, 5 aa, Entamoeba histolytica
QRTEI

SEQ ID NO: 2650722 - protein, 6 aa, Entamoeba histolytica
QRTESM

SEQ ID NO: 2650723 - protein, 11 aa, Entamoeba histolytica
QRTISNDEDAI

SEQ ID NO: 2650724 - protein, 10 aa, Entamoeba histolytica
QRTKDGDPMD

SEQ ID NO: 2650725 - protein, 7 aa, Entamoeba histolytica
QRTKNQL

SEQ ID NO: 2650726 - protein, 24 aa, Entamoeba histolytica
QRTKNSLELKDENHKNSQKKDEET

SEQ ID NO: 2650727 - protein, 8 aa, Entamoeba histolytica
QRTKTTPF

SEQ ID NO: 2650728 - protein, 9 aa, Entamoeba histolytica
QRTNGYDNR

SEQ ID NO: 2650729 - protein, 8 aa, Entamoeba histolytica
QRTNPADV

SEQ ID NO: 2650730 - protein, 17 aa, Entamoeba histolytica
QRTNPKGINDKLDETLS

SEQ ID NO: 2650731 - protein, 8 aa, Entamoeba histolytica
QRTNQDDW

SEQ ID NO: 2650732 - protein, 5 aa, Entamoeba histolytica
QRTSK

SEQ ID NO: 2650733 - protein, 10 aa, Entamoeba histolytica
QRVIQESDEK

SEQ ID NO: 2650734 - protein, 16 aa, Entamoeba histolytica
QRVQQRRPSQQRSTTI

SEQ ID NO: 2650735 - protein, 9 aa, Entamoeba histolytica
QRVSPSEKV

SEQ ID NO: 2650736 - protein, 5 aa, Entamoeba histolytica
QRYFE

SEQ ID NO: 2650737 - protein, 7 aa, Entamoeba histolytica
QRYGKKV

SEQ ID NO: 2650738 - protein, 6 aa, Entamoeba histolytica
QRYKEL

SEQ ID NO: 2650739 - protein, 5 aa, Entamoeba histolytica
QRYNI

SEQ ID NO: 2650740 - protein, 23 aa, Entamoeba histolytica
QRYQRESGKIVSDTKNDIPQYTV

SEQ ID NO: 2650741 - protein, 10 aa, Entamoeba histolytica
QRYSKTGKKI

SEQ ID NO: 2650742 - protein, 7 aa, Entamoeba histolytica
QRYSQRM

SEQ ID NO: 2650743 - protein, 5 aa, Entamoeba histolytica
QRYSR

SEQ ID NO: 2650744 - protein, 10 aa, Entamoeba histolytica
QRYTDPSLAG

SEQ ID NO: 2650745 - protein, 11 aa, Entamoeba histolytica
QSAADGNINPN

SEQ ID NO: 2650746 - protein, 8 aa, Entamoeba histolytica
QSADKETL

SEQ ID NO: 2650747 - protein, 5 aa, Entamoeba histolytica
QSAEL

SEQ ID NO: 2650748 - protein, 4 aa, Entamoeba histolytica
QSAF

SEQ ID NO: 2650749 - protein, 4 aa, Entamoeba histolytica
QSAH

SEQ ID NO: 2650750 - protein, 5 aa, Entamoeba histolytica
QSANS

SEQ ID NO: 2650751 - protein, 6 aa, Entamoeba histolytica
QSAPPK

SEQ ID NO: 2650752 - protein, 19 aa, Entamoeba histolytica
QSATHKTINCGTNKPERSV

SEQ ID NO: 2650753 - protein, 6 aa, Entamoeba histolytica
QSCAKA

SEQ ID NO: 2650754 - protein, 11 aa, Entamoeba histolytica
QSCDQVEKKDI

SEQ ID NO: 2650755 - protein, 8 aa, Entamoeba histolytica
QSCHPDEK

SEQ ID NO: 2650756 - protein, 5 aa, Entamoeba histolytica
QSCSE

SEQ ID NO: 2650757 - protein, 16 aa, Entamoeba histolytica
QSDAIGGTPQKKKNPL

SEQ ID NO: 2650758 - protein, 6 aa, Entamoeba histolytica
QSDDSY

SEQ ID NO: 2650759 - protein, 7 aa, Entamoeba histolytica
QSDIESN

SEQ ID NO: 2650760 - protein, 5 aa, Entamoeba histolytica
QSDIK

SEQ ID NO: 2650761 - protein, 6 aa, Entamoeba histolytica
QSDKGS

SEQ ID NO: 2650762 - protein, 5 aa, Entamoeba histolytica
QSDKI

SEQ ID NO: 2650763 - protein, 6 aa, Entamoeba histolytica
QSDKRK

SEQ ID NO: 2650764 - protein, 7 aa, Entamoeba histolytica
QSDKTKN

SEQ ID NO: 2650765 - protein, 4 aa, Entamoeba histolytica
QSDN

SEQ ID NO: 2650766 - protein, 9 aa, Entamoeba histolytica
QSDPKNTDY

SEQ ID NO: 2650767 - protein, 7 aa, Entamoeba histolytica
QSDPNKA

SEQ ID NO: 2650768 - protein, 10 aa, Entamoeba histolytica
QSDPSSPIPQ

SEQ ID NO: 2650769 - protein, 35 aa, Entamoeba histolytica
QSDPVASSAPSPSPNPVQPQEETLKPQVSTSSSAG

SEQ ID NO: 2650770 - protein, 5 aa, Entamoeba histolytica
QSDRC

SEQ ID NO: 2650771 - protein, 4 aa, Entamoeba histolytica
QSDS

SEQ ID NO: 2650772 - protein, 12 aa, Entamoeba histolytica
QSDSKQEELHDN

SEQ ID NO: 2650773 - protein, 4 aa, Entamoeba histolytica
QSDV

SEQ ID NO: 2650774 - protein, 6 aa, Entamoeba histolytica
QSEDTS

SEQ ID NO: 2650775 - protein, 5 aa, Entamoeba histolytica
QSEEE

SEQ ID NO: 2650776 - protein, 11 aa, Entamoeba histolytica
QSEEEQTENQL

SEQ ID NO: 2650777 - protein, 9 aa, Entamoeba histolytica
QSEEIEHSA

SEQ ID NO: 2650778 - protein, 5 aa, Entamoeba histolytica
QSEEM

SEQ ID NO: 2650779 - protein, 11 aa, Entamoeba histolytica
QSEESKRISSP

SEQ ID NO: 2650780 - protein, 15 aa, Entamoeba histolytica
QSEGTSDITNSEISQ

SEQ ID NO: 2650781 - protein, 12 aa, Entamoeba histolytica
QSEISKASNKQY

SEQ ID NO: 2650782 - protein, 8 aa, Entamoeba histolytica
QSEKHSKQ

SEQ ID NO: 2650783 - protein, 20 aa, Entamoeba histolytica
QSEKSVNNEIDKPLTKEELE

SEQ ID NO: 2650784 - protein, 18 aa, Entamoeba histolytica
QSELDTAKQRCDSDKKWA

SEQ ID NO: 2650785 - protein, 8 aa, Entamoeba histolytica
QSELPPQS

SEQ ID NO: 2650786 - protein, 6 aa, Entamoeba histolytica
QSENDL

SEQ ID NO: 2650787 - protein, 5 aa, Entamoeba histolytica
QSENE

SEQ ID NO: 2650788 - protein, 5 aa, Entamoeba histolytica
QSENG

SEQ ID NO: 2650789 - protein, 6 aa, Entamoeba histolytica
QSEQEQ

SEQ ID NO: 2650790 - protein, 10 aa, Entamoeba histolytica
QSESASENSR

SEQ ID NO: 2650791 - protein, 6 aa, Entamoeba histolytica
QSETSQ

SEQ ID NO: 2650792 - protein, 6 aa, Entamoeba histolytica
QSEVEA

SEQ ID NO: 2650793 - protein, 12 aa, Entamoeba histolytica
QSEWSEKEEYEQ

SEQ ID NO: 2650794 - protein, 9 aa, Entamoeba histolytica
QSEYNEDET

SEQ ID NO: 2650795 - protein, 4 aa, Entamoeba histolytica
QSFE

SEQ ID NO: 2650796 - protein, 9 aa, Entamoeba histolytica
QSFEEKKSV

SEQ ID NO: 2650797 - protein, 4 aa, Entamoeba histolytica
QSFG

SEQ ID NO: 2650798 - protein, 9 aa, Entamoeba histolytica
QSFKSTRTI

SEQ ID NO: 2650799 - protein, 5 aa, Entamoeba histolytica
QSFPS

SEQ ID NO: 2650800 - protein, 4 aa, Entamoeba histolytica
QSFQ

SEQ ID NO: 2650801 - protein, 7 aa, Entamoeba histolytica
QSFQQEK

SEQ ID NO: 2650802 - protein, 12 aa, Entamoeba histolytica
QSFQTDKSISEA

SEQ ID NO: 2650803 - protein, 7 aa, Entamoeba histolytica
QSFTAPP

SEQ ID NO: 2650804 - protein, 7 aa, Entamoeba histolytica
QSGEQTI

SEQ ID NO: 2650805 - protein, 6 aa, Entamoeba histolytica
QSGFHS

SEQ ID NO: 2650806 - protein, 5 aa, Entamoeba histolytica
QSGHL

SEQ ID NO: 2650807 - protein, 24 aa, Entamoeba histolytica
QSGKEKTQELKNEIEKETETAKKG

SEQ ID NO: 2650808 - protein, 7 aa, Entamoeba histolytica
QSGKTTF

SEQ ID NO: 2650809 - protein, 5 aa, Entamoeba histolytica
QSGNR

SEQ ID NO: 2650810 - protein, 8 aa, Entamoeba histolytica
QSGPYDGF

SEQ ID NO: 2650811 - protein, 4 aa, Entamoeba histolytica
QSGQ

SEQ ID NO: 2650812 - protein, 9 aa, Entamoeba histolytica
QSGQRDENC

SEQ ID NO: 2650813 - protein, 9 aa, Entamoeba histolytica
QSGQSREVV

SEQ ID NO: 2650814 - protein, 14 aa, Entamoeba histolytica
QSGRSLTKEGRKDM

SEQ ID NO: 2650815 - protein, 6 aa, Entamoeba histolytica
QSGSNF

SEQ ID NO: 2650816 - protein, 8 aa, Entamoeba histolytica
QSGSTSVL

SEQ ID NO: 2650817 - protein, 7 aa, Entamoeba histolytica
QSGTNQI

SEQ ID NO: 2650818 - protein, 5 aa, Entamoeba histolytica
QSGYE

SEQ ID NO: 2650819 - protein, 5 aa, Entamoeba histolytica
QSGYQ

SEQ ID NO: 2650820 - protein, 22 aa, Entamoeba histolytica
QSHKAHRNGFYKPKKSAYMSTK

SEQ ID NO: 2650821 - protein, 5 aa, Entamoeba histolytica
QSHPG

SEQ ID NO: 2650822 - protein, 10 aa, Entamoeba histolytica
QSHQPTGEKV

SEQ ID NO: 2650823 - protein, 6 aa, Entamoeba histolytica
QSIARK

SEQ ID NO: 2650824 - protein, 8 aa, Entamoeba histolytica
QSIDPNKY

SEQ ID NO: 2650825 - protein, 6 aa, Entamoeba histolytica
QSIEDN

SEQ ID NO: 2650826 - protein, 10 aa, Entamoeba histolytica
QSIGEPSTQM

SEQ ID NO: 2650827 - protein, 4 aa, Entamoeba histolytica
QSIH

SEQ ID NO: 2650828 - protein, 5 aa, Entamoeba histolytica
QSIHD

SEQ ID NO: 2650829 - protein, 10 aa, Entamoeba histolytica
QSIKPNRIRD

SEQ ID NO: 2650830 - protein, 7 aa, Entamoeba histolytica
QSINGKD

SEQ ID NO: 2650831 - protein, 19 aa, Entamoeba histolytica
QSINRQGFQQQTQTTLPQT

SEQ ID NO: 2650832 - protein, 14 aa, Entamoeba histolytica
QSIPDEATLSHSSQ

SEQ ID NO: 2650833 - protein, 19 aa, Entamoeba histolytica
QSIPQKQQKNTSITKTTIQ

SEQ ID NO: 2650834 - protein, 22 aa, Entamoeba histolytica
QSIPQLPKTDRKELEKELESET

SEQ ID NO: 2650835 - protein, 16 aa, Entamoeba histolytica
QSIPSDSTSPSYPCTN

SEQ ID NO: 2650836 - protein, 11 aa, Entamoeba histolytica
QSIQSTLSTSV

SEQ ID NO: 2650837 - protein, 5 aa, Entamoeba histolytica
QSIQT

SEQ ID NO: 2650838 - protein, 6 aa, Entamoeba histolytica
QSIQTM

SEQ ID NO: 2650839 - protein, 4 aa, Entamoeba histolytica
QSIS

SEQ ID NO: 2650840 - protein, 10 aa, Entamoeba histolytica
QSISNGQLPH

SEQ ID NO: 2650841 - protein, 7 aa, Entamoeba histolytica
QSISPRP

SEQ ID NO: 2650842 - protein, 9 aa, Entamoeba histolytica
QSISPTNSI

SEQ ID NO: 2650843 - protein, 12 aa, Entamoeba histolytica
QSISSKTNESDE

SEQ ID NO: 2650844 - protein, 16 aa, Entamoeba histolytica
QSIYGPNNKLTLKVFV

SEQ ID NO: 2650845 - protein, 10 aa, Entamoeba histolytica
QSKDFGDGYI

SEQ ID NO: 2650846 - protein, 4 aa, Entamoeba histolytica
QSKE

SEQ ID NO: 2650847 - protein, 7 aa, Entamoeba histolytica
QSKEHWE

SEQ ID NO: 2650848 - protein, 12 aa, Entamoeba histolytica
QSKEKGGEEGYY

SEQ ID NO: 2650849 - protein, 7 aa, Entamoeba histolytica
QSKEQCE

SEQ ID NO: 2650850 - protein, 6 aa, Entamoeba histolytica
QSKEVQ

SEQ ID NO: 2650851 - protein, 4 aa, Entamoeba histolytica
QSKK

SEQ ID NO: 2650852 - protein, 9 aa, Entamoeba histolytica
QSKKEKVSS

SEQ ID NO: 2650853 - protein, 10 aa, Entamoeba histolytica
QSKKGVSAEM

SEQ ID NO: 2650854 - protein, 14 aa, Entamoeba histolytica
QSKKKYSQKPLNRS

SEQ ID NO: 2650855 - protein, 7 aa, Entamoeba histolytica
QSKLNKN

SEQ ID NO: 2650856 - protein, 7 aa, Entamoeba histolytica
QSKLQIN

SEQ ID NO: 2650857 - protein, 9 aa, Entamoeba histolytica
QSKNGTLLP

SEQ ID NO: 2650858 - protein, 21 aa, Entamoeba histolytica
QSKNTRQPEGVSTKAGKQHSA

SEQ ID NO: 2650859 - protein, 6 aa, Entamoeba histolytica
QSKPID

SEQ ID NO: 2650860 - protein, 38 aa, Entamoeba histolytica
QSKPIEQSKPIEQSKPIEQSKPIEQSKPIEQSKPQNVE

SEQ ID NO: 2650861 - protein, 19 aa, Entamoeba histolytica
QSKPIPLKKNEKKYCCCLI

SEQ ID NO: 2650862 - protein, 12 aa, Entamoeba histolytica
QSKPLPKKIPTA

SEQ ID NO: 2650863 - protein, 9 aa, Entamoeba histolytica
QSKPQVTST

SEQ ID NO: 2650864 - protein, 9 aa, Entamoeba histolytica
QSKQKGDEE

SEQ ID NO: 2650865 - protein, 10 aa, Entamoeba histolytica
QSKQNCVSSV

SEQ ID NO: 2650866 - protein, 7 aa, Entamoeba histolytica
QSKRAEL

SEQ ID NO: 2650867 - protein, 8 aa, Entamoeba histolytica
QSKSEGLA

SEQ ID NO: 2650868 - protein, 8 aa, Entamoeba histolytica
QSKSLTES

SEQ ID NO: 2650869 - protein, 14 aa, Entamoeba histolytica
QSKSPSNSVTNSSL

SEQ ID NO: 2650870 - protein, 7 aa, Entamoeba histolytica
QSKSWEA

SEQ ID NO: 2650871 - protein, 4 aa, Entamoeba histolytica
QSKT

SEQ ID NO: 2650872 - protein, 8 aa, Entamoeba histolytica
QSKTNSNF

SEQ ID NO: 2650873 - protein, 9 aa, Entamoeba histolytica
QSKTTNSVS

SEQ ID NO: 2650874 - protein, 6 aa, Entamoeba histolytica
QSKTYN

SEQ ID NO: 2650875 - protein, 9 aa, Entamoeba histolytica
QSKVSLSSQ

SEQ ID NO: 2650876 - protein, 11 aa, Entamoeba histolytica
QSLASSDYDAA

SEQ ID NO: 2650877 - protein, 14 aa, Entamoeba histolytica
QSLDEGKAVSGDEY

SEQ ID NO: 2650878 - protein, 6 aa, Entamoeba histolytica
QSLDQQ

SEQ ID NO: 2650879 - protein, 4 aa, Entamoeba histolytica
QSLE

SEQ ID NO: 2650880 - protein, 13 aa, Entamoeba histolytica
QSLEDEDQTLYNR

SEQ ID NO: 2650881 - protein, 5 aa, Entamoeba histolytica
QSLER

SEQ ID NO: 2650882 - protein, 10 aa, Entamoeba histolytica
QSLGDKKGLV

SEQ ID NO: 2650883 - protein, 9 aa, Entamoeba histolytica
QSLGEEQSM

SEQ ID NO: 2650884 - protein, 12 aa, Entamoeba histolytica
QSLGKQSVLSKE

SEQ ID NO: 2650885 - protein, 5 aa, Entamoeba histolytica
QSLGT

SEQ ID NO: 2650886 - protein, 17 aa, Entamoeba histolytica
QSLKELDSGVQRKEGND

SEQ ID NO: 2650887 - protein, 6 aa, Entamoeba histolytica
QSLNPS

SEQ ID NO: 2650888 - protein, 21 aa, Entamoeba histolytica
QSLPSAKVKHPQHKKLNEQKL

SEQ ID NO: 2650889 - protein, 5 aa, Entamoeba histolytica
QSLQQ

SEQ ID NO: 2650890 - protein, 17 aa, Entamoeba histolytica
QSLQTTSSDLPPPPPTF

SEQ ID NO: 2650891 - protein, 6 aa, Entamoeba histolytica
QSLSEF

SEQ ID NO: 2650892 - protein, 25 aa, Entamoeba histolytica
QSLSRSDSIESLNESLRESSTKNSL

SEQ ID NO: 2650893 - protein, 13 aa, Entamoeba histolytica
QSLTSEDIEDCKV

SEQ ID NO: 2650894 - protein, 4 aa, Entamoeba histolytica
QSME

SEQ ID NO: 2650895 - protein, 5 aa, Entamoeba histolytica
QSNDI

SEQ ID NO: 2650896 - protein, 9 aa, Entamoeba histolytica
QSNDWKDQF

SEQ ID NO: 2650897 - protein, 12 aa, Entamoeba histolytica
QSNEKPEARIQP

SEQ ID NO: 2650898 - protein, 9 aa, Entamoeba histolytica
QSNEYYEKN

SEQ ID NO: 2650899 - protein, 9 aa, Entamoeba histolytica
QSNFASSDA

SEQ ID NO: 2650900 - protein, 12 aa, Entamoeba histolytica
QSNFEKDNQLNV

SEQ ID NO: 2650901 - protein, 8 aa, Entamoeba histolytica
QSNGERPH

SEQ ID NO: 2650902 - protein, 10 aa, Entamoeba histolytica
QSNIENESEK

SEQ ID NO: 2650903 - protein, 5 aa, Entamoeba histolytica
QSNIY

SEQ ID NO: 2650904 - protein, 8 aa, Entamoeba histolytica
QSNKNEVD

SEQ ID NO: 2650905 - protein, 5 aa, Entamoeba histolytica
QSNNH

SEQ ID NO: 2650906 - protein, 5 aa, Entamoeba histolytica
QSNNS

SEQ ID NO: 2650907 - protein, 17 aa, Entamoeba histolytica
QSNNSSELTSASSVDSS

SEQ ID NO: 2650908 - protein, 18 aa, Entamoeba histolytica
QSNNWKDSLEKSIPSRYF

SEQ ID NO: 2650909 - protein, 7 aa, Entamoeba histolytica
QSNPGKK

SEQ ID NO: 2650910 - protein, 10 aa, Entamoeba histolytica
QSNQNDTFDP

SEQ ID NO: 2650911 - protein, 7 aa, Entamoeba histolytica
QSNQSNI

SEQ ID NO: 2650912 - protein, 23 aa, Entamoeba histolytica
QSNSQLTVDKQKNKSQKERETKI

SEQ ID NO: 2650913 - protein, 8 aa, Entamoeba histolytica
QSNTEKLR

SEQ ID NO: 2650914 - protein, 5 aa, Entamoeba histolytica
QSNTI

SEQ ID NO: 2650915 - protein, 10 aa, Entamoeba histolytica
QSNYLKETNQ

SEQ ID NO: 2650916 - protein, 6 aa, Entamoeba histolytica
QSNYQS

SEQ ID NO: 2650917 - protein, 7 aa, Entamoeba histolytica
QSPAGVT

SEQ ID NO: 2650918 - protein, 4 aa, Entamoeba histolytica
QSPD

SEQ ID NO: 2650919 - protein, 15 aa, Entamoeba histolytica
QSPDGKIKKPEEIKE

SEQ ID NO: 2650920 - protein, 10 aa, Entamoeba histolytica
QSPEEMKGYT

SEQ ID NO: 2650921 - protein, 7 aa, Entamoeba histolytica
QSPFDPD

SEQ ID NO: 2650922 - protein, 6 aa, Entamoeba histolytica
QSPFED

SEQ ID NO: 2650923 - protein, 13 aa, Entamoeba histolytica
QSPGLTASPAIAE

SEQ ID NO: 2650924 - protein, 16 aa, Entamoeba histolytica
QSPGPNRRGQIGSRHN

SEQ ID NO: 2650925 - protein, 4 aa, Entamoeba histolytica
QSPH

SEQ ID NO: 2650926 - protein, 18 aa, Entamoeba histolytica
QSPIEKRNSRGMSAFRPV

SEQ ID NO: 2650927 - protein, 5 aa, Entamoeba histolytica
QSPIK

SEQ ID NO: 2650928 - protein, 9 aa, Entamoeba histolytica
QSPINTQPM

SEQ ID NO: 2650929 - protein, 5 aa, Entamoeba histolytica
QSPKF

SEQ ID NO: 2650930 - protein, 8 aa, Entamoeba histolytica
QSPKFGSS

SEQ ID NO: 2650931 - protein, 5 aa, Entamoeba histolytica
QSPLK

SEQ ID NO: 2650932 - protein, 7 aa, Entamoeba histolytica
QSPNELN

SEQ ID NO: 2650933 - protein, 6 aa, Entamoeba histolytica
QSPNTI

SEQ ID NO: 2650934 - protein, 5 aa, Entamoeba histolytica
QSPPI

SEQ ID NO: 2650935 - protein, 6 aa, Entamoeba histolytica
QSPPIP

SEQ ID NO: 2650936 - protein, 5 aa, Entamoeba histolytica
QSPRN

SEQ ID NO: 2650937 - protein, 12 aa, Entamoeba histolytica
QSPRPSLTPEQA

SEQ ID NO: 2650938 - protein, 6 aa, Entamoeba histolytica
QSPSDL

SEQ ID NO: 2650939 - protein, 8 aa, Entamoeba histolytica
QSPSTAVS

SEQ ID NO: 2650940 - protein, 17 aa, Entamoeba histolytica
QSPTAITTTPITTTPRK

SEQ ID NO: 2650941 - protein, 16 aa, Entamoeba histolytica
QSPTSSMKEYQLKKDY

SEQ ID NO: 2650942 - protein, 16 aa, Entamoeba histolytica
QSPTTMDINDGCFDYP

SEQ ID NO: 2650943 - protein, 7 aa, Entamoeba histolytica
QSPVQAA

SEQ ID NO: 2650944 - protein, 5 aa, Entamoeba histolytica
QSPYP

SEQ ID NO: 2650945 - protein, 8 aa, Entamoeba histolytica
QSQDKQIA

SEQ ID NO: 2650946 - protein, 6 aa, Entamoeba histolytica
QSQEYV

SEQ ID NO: 2650947 - protein, 7 aa, Entamoeba histolytica
QSQIDDL

SEQ ID NO: 2650948 - protein, 5 aa, Entamoeba histolytica
QSQIE

SEQ ID NO: 2650949 - protein, 18 aa, Entamoeba histolytica
QSQIKKSLSKKKLDPENY

SEQ ID NO: 2650950 - protein, 7 aa, Entamoeba histolytica
QSQISDD

SEQ ID NO: 2650951 - protein, 5 aa, Entamoeba histolytica
QSQKQ

SEQ ID NO: 2650952 - protein, 4 aa, Entamoeba histolytica
QSQL

SEQ ID NO: 2650953 - protein, 4 aa, Entamoeba histolytica
QSQN

SEQ ID NO: 2650954 - protein, 8 aa, Entamoeba histolytica
QSQNEIQK

SEQ ID NO: 2650955 - protein, 7 aa, Entamoeba histolytica
QSQPIDV

SEQ ID NO: 2650956 - protein, 17 aa, Entamoeba histolytica
QSQRTEKLSKITGRHAS

SEQ ID NO: 2650957 - protein, 6 aa, Entamoeba histolytica
QSQSGI

SEQ ID NO: 2650958 - protein, 9 aa, Entamoeba histolytica
QSQSGSGKT

SEQ ID NO: 2650959 - protein, 6 aa, Entamoeba histolytica
QSQSTL

SEQ ID NO: 2650960 - protein, 9 aa, Entamoeba histolytica
QSQTGSGKT

SEQ ID NO: 2650961 - protein, 6 aa, Entamoeba histolytica
QSQTKA

SEQ ID NO: 2650962 - protein, 6 aa, Entamoeba histolytica
QSQTQR

SEQ ID NO: 2650963 - protein, 9 aa, Entamoeba histolytica
QSREHNPIH

SEQ ID NO: 2650964 - protein, 5 aa, Entamoeba histolytica
QSREV

SEQ ID NO: 2650965 - protein, 22 aa, Entamoeba histolytica
QSRGSLSRKQPFGGSTSSPVLL

SEQ ID NO: 2650966 - protein, 9 aa, Entamoeba histolytica
QSRKEKGYN

SEQ ID NO: 2650967 - protein, 11 aa, Entamoeba histolytica
QSRKQTLMKQN

SEQ ID NO: 2650968 - protein, 4 aa, Entamoeba histolytica
QSRM

SEQ ID NO: 2650969 - protein, 9 aa, Entamoeba histolytica
QSRSKIEAR

SEQ ID NO: 2650970 - protein, 6 aa, Entamoeba histolytica
QSRSVT

SEQ ID NO: 2650971 - protein, 21 aa, Entamoeba histolytica
QSRYQNNQNNNTTQTNRNAQY

SEQ ID NO: 2650972 - protein, 9 aa, Entamoeba histolytica
QSRYRNETE

SEQ ID NO: 2650973 - protein, 8 aa, Entamoeba histolytica
QSSANVAD

SEQ ID NO: 2650974 - protein, 6 aa, Entamoeba histolytica
QSSDDF

SEQ ID NO: 2650975 - protein, 6 aa, Entamoeba histolytica
QSSDDV

SEQ ID NO: 2650976 - protein, 8 aa, Entamoeba histolytica
QSSDSAIS

SEQ ID NO: 2650977 - protein, 12 aa, Entamoeba histolytica
QSSDYTSKSPFA

SEQ ID NO: 2650978 - protein, 4 aa, Entamoeba histolytica
QSSE

SEQ ID NO: 2650979 - protein, 11 aa, Entamoeba histolytica
QSSEDKKAIRD

SEQ ID NO: 2650980 - protein, 10 aa, Entamoeba histolytica
QSSEEESKNN

SEQ ID NO: 2650981 - protein, 26 aa, Entamoeba histolytica
QSSEEKHKIDEFEKQKSEKEERLNEL

SEQ ID NO: 2650982 - protein, 8 aa, Entamoeba histolytica
QSSESVNS

SEQ ID NO: 2650983 - protein, 15 aa, Entamoeba histolytica
QSSFNSTQSQKKEFN

SEQ ID NO: 2650984 - protein, 6 aa, Entamoeba histolytica
QSSFRA

SEQ ID NO: 2650985 - protein, 6 aa, Entamoeba histolytica
QSSINN

SEQ ID NO: 2650986 - protein, 11 aa, Entamoeba histolytica
QSSIQTHKRSS

SEQ ID NO: 2650987 - protein, 4 aa, Entamoeba histolytica
QSSK

SEQ ID NO: 2650988 - protein, 4 aa, Entamoeba histolytica
QSSL

SEQ ID NO: 2650989 - protein, 6 aa, Entamoeba histolytica
QSSLDN

SEQ ID NO: 2650990 - protein, 10 aa, Entamoeba histolytica
QSSLPGVQRN

SEQ ID NO: 2650991 - protein, 5 aa, Entamoeba histolytica
QSSLS

SEQ ID NO: 2650992 - protein, 8 aa, Entamoeba histolytica
QSSNPTYS

SEQ ID NO: 2650993 - protein, 7 aa, Entamoeba histolytica
QSSPIPI

SEQ ID NO: 2650994 - protein, 10 aa, Entamoeba histolytica
QSSPKSIQDI

SEQ ID NO: 2650995 - protein, 7 aa, Entamoeba histolytica
QSSPNYS

SEQ ID NO: 2650996 - protein, 5 aa, Entamoeba histolytica
QSSQF

SEQ ID NO: 2650997 - protein, 7 aa, Entamoeba histolytica
QSSQIRR

SEQ ID NO: 2650998 - protein, 8 aa, Entamoeba histolytica
QSSQSVDD

SEQ ID NO: 2650999 - protein, 15 aa, Entamoeba histolytica
QSSQVKSSSSSSPSL

SEQ ID NO: 2651000 - protein, 7 aa, Entamoeba histolytica
QSSRADI

SEQ ID NO: 2651001 - protein, 9 aa, Entamoeba histolytica
QSSSETKEE

SEQ ID NO: 2651002 - protein, 10 aa, Entamoeba histolytica
QSSSGNEPNA

SEQ ID NO: 2651003 - protein, 8 aa, Entamoeba histolytica
QSSSLDGT

SEQ ID NO: 2651004 - protein, 8 aa, Entamoeba histolytica
QSSSQPCA

SEQ ID NO: 2651005 - protein, 6 aa, Entamoeba histolytica
QSSSSL

SEQ ID NO: 2651006 - protein, 7 aa, Entamoeba histolytica
QSSSTCT

SEQ ID NO: 2651007 - protein, 8 aa, Entamoeba histolytica
QSSSYEPS

SEQ ID NO: 2651008 - protein, 10 aa, Entamoeba histolytica
QSSTNSDNTV

SEQ ID NO: 2651009 - protein, 6 aa, Entamoeba histolytica
QSSVPN

SEQ ID NO: 2651010 - protein, 4 aa, Entamoeba histolytica
QSTA

SEQ ID NO: 2651011 - protein, 6 aa, Entamoeba histolytica
QSTAKT

SEQ ID NO: 2651012 - protein, 8 aa, Entamoeba histolytica
QSTASPSL

SEQ ID NO: 2651013 - protein, 6 aa, Entamoeba histolytica
QSTAVS

SEQ ID NO: 2651014 - protein, 9 aa, Entamoeba histolytica
QSTELDGEG

SEQ ID NO: 2651015 - protein, 7 aa, Entamoeba histolytica
QSTEPPM

SEQ ID NO: 2651016 - protein, 5 aa, Entamoeba histolytica
QSTFE

SEQ ID NO: 2651017 - protein, 7 aa, Entamoeba histolytica
QSTFQSK

SEQ ID NO: 2651018 - protein, 4 aa, Entamoeba histolytica
QSTG

SEQ ID NO: 2651019 - protein, 8 aa, Entamoeba histolytica
QSTGVKPI

SEQ ID NO: 2651020 - protein, 6 aa, Entamoeba histolytica
QSTHLP

SEQ ID NO: 2651021 - protein, 4 aa, Entamoeba histolytica
QSTK

SEQ ID NO: 2651022 - protein, 10 aa, Entamoeba histolytica
QSTKNKYVTP

SEQ ID NO: 2651023 - protein, 8 aa, Entamoeba histolytica
QSTKPNDN

SEQ ID NO: 2651024 - protein, 8 aa, Entamoeba histolytica
QSTKSTVH

SEQ ID NO: 2651025 - protein, 4 aa, Entamoeba histolytica
QSTN

SEQ ID NO: 2651026 - protein, 9 aa, Entamoeba histolytica
QSTQLEPKI

SEQ ID NO: 2651027 - protein, 5 aa, Entamoeba histolytica
QSTQN

SEQ ID NO: 2651028 - protein, 7 aa, Entamoeba histolytica
QSTSCDK

SEQ ID NO: 2651029 - protein, 59 aa, Entamoeba histolytica
QSTSFTPQSAVPQQPAQSNVTPSPTTSTPTQKENNTQTKQPTQQNKPSQPKPTVQADDW

SEQ ID NO: 2651030 - protein, 5 aa, Entamoeba histolytica
QSTSL

SEQ ID NO: 2651031 - protein, 21 aa, Entamoeba histolytica
QSTTSGPRSSQFGTSSPNGFL

SEQ ID NO: 2651032 - protein, 18 aa, Entamoeba histolytica
QSTTSSASFIRPTEDNGW

SEQ ID NO: 2651033 - protein, 6 aa, Entamoeba histolytica
QSTTTS

SEQ ID NO: 2651034 - protein, 7 aa, Entamoeba histolytica
QSTTYED

SEQ ID NO: 2651035 - protein, 4 aa, Entamoeba histolytica
QSVE

SEQ ID NO: 2651036 - protein, 9 aa, Entamoeba histolytica
QSVEKTQDV

SEQ ID NO: 2651037 - protein, 19 aa, Entamoeba histolytica
QSVEQSSESNSMSSFTDEE

SEQ ID NO: 2651038 - protein, 7 aa, Entamoeba histolytica
QSVGKTC

SEQ ID NO: 2651039 - protein, 8 aa, Entamoeba histolytica
QSVGKTSL

SEQ ID NO: 2651040 - protein, 9 aa, Entamoeba histolytica
QSVKESLKN

SEQ ID NO: 2651041 - protein, 19 aa, Entamoeba histolytica
QSVKSSQINECRNREASFS

SEQ ID NO: 2651042 - protein, 7 aa, Entamoeba histolytica
QSVPSEN

SEQ ID NO: 2651043 - protein, 32 aa, Entamoeba histolytica
QSVPSTNKQTATELSENDSSSDNKVTKEMSED

SEQ ID NO: 2651044 - protein, 9 aa, Entamoeba histolytica
QSVSNQQQA

SEQ ID NO: 2651045 - protein, 4 aa, Entamoeba histolytica
QSVT

SEQ ID NO: 2651046 - protein, 6 aa, Entamoeba histolytica
QSVTTR

SEQ ID NO: 2651047 - protein, 6 aa, Entamoeba histolytica
QSVVGN

SEQ ID NO: 2651048 - protein, 9 aa, Entamoeba histolytica
QSWKGTKEV

SEQ ID NO: 2651049 - protein, 19 aa, Entamoeba histolytica
QSWRKSTTQLPSSSISPPV

SEQ ID NO: 2651050 - protein, 12 aa, Entamoeba histolytica
QSYEEKFGNGEI

SEQ ID NO: 2651051 - protein, 12 aa, Entamoeba histolytica
QSYLNSHTQGVD

SEQ ID NO: 2651052 - protein, 8 aa, Entamoeba histolytica
QSYPNQSL

SEQ ID NO: 2651053 - protein, 5 aa, Entamoeba histolytica
QSYQE

SEQ ID NO: 2651054 - protein, 8 aa, Entamoeba histolytica
QSYQGYPI

SEQ ID NO: 2651055 - protein, 5 aa, Entamoeba histolytica
QSYSP

SEQ ID NO: 2651056 - protein, 6 aa, Entamoeba histolytica
QSYSSE

SEQ ID NO: 2651057 - protein, 6 aa, Entamoeba histolytica
QSYYRK

SEQ ID NO: 2651058 - protein, 22 aa, Entamoeba histolytica
QTAAEESKPKATGKTKEIAKAE

SEQ ID NO: 2651059 - protein, 5 aa, Entamoeba histolytica
QTAEI

SEQ ID NO: 2651060 - protein, 19 aa, Entamoeba histolytica
QTAGKHPGIPQGKPTMNQI

SEQ ID NO: 2651061 - protein, 10 aa, Entamoeba histolytica
QTAGNSSGTV

SEQ ID NO: 2651062 - protein, 7 aa, Entamoeba histolytica
QTAKTNV

SEQ ID NO: 2651063 - protein, 7 aa, Entamoeba histolytica
QTAPKQI

SEQ ID NO: 2651064 - protein, 9 aa, Entamoeba histolytica
QTAPRNSNG

SEQ ID NO: 2651065 - protein, 13 aa, Entamoeba histolytica
QTAQEALDTAEDM

SEQ ID NO: 2651066 - protein, 16 aa, Entamoeba histolytica
QTAQEENPNSGSNDNC

SEQ ID NO: 2651067 - protein, 10 aa, Entamoeba histolytica
QTARNKVEKA

SEQ ID NO: 2651068 - protein, 7 aa, Entamoeba histolytica
QTARNNL

SEQ ID NO: 2651069 - protein, 9 aa, Entamoeba histolytica
QTASELKEQ

SEQ ID NO: 2651070 - protein, 7 aa, Entamoeba histolytica
QTATLPT

SEQ ID NO: 2651071 - protein, 6 aa, Entamoeba histolytica
QTCGGN

SEQ ID NO: 2651072 - protein, 36 aa, Entamoeba histolytica
QTCGKGDKRIAKPRTRVETSSETSEQITTNKSASAM

SEQ ID NO: 2651073 - protein, 13 aa, Entamoeba histolytica
QTCKKSKTCLQGN

SEQ ID NO: 2651074 - protein, 19 aa, Entamoeba histolytica
QTCKTDKKHPGLEDTQKVR

SEQ ID NO: 2651075 - protein, 9 aa, Entamoeba histolytica
QTDCSKKVE

SEQ ID NO: 2651076 - protein, 10 aa, Entamoeba histolytica
QTDDEQSSQL

SEQ ID NO: 2651077 - protein, 11 aa, Entamoeba histolytica
QTDDGFGYRPT

SEQ ID NO: 2651078 - protein, 4 aa, Entamoeba histolytica
QTDE

SEQ ID NO: 2651079 - protein, 12 aa, Entamoeba histolytica
QTDIRAANENTD

SEQ ID NO: 2651080 - protein, 5 aa, Entamoeba histolytica
QTDKG

SEQ ID NO: 2651081 - protein, 6 aa, Entamoeba histolytica
QTDKGK

SEQ ID NO: 2651082 - protein, 8 aa, Entamoeba histolytica
QTDKGSVQ

SEQ ID NO: 2651083 - protein, 17 aa, Entamoeba histolytica
QTDKNKMEKKNKRQRKI

SEQ ID NO: 2651084 - protein, 8 aa, Entamoeba histolytica
QTDKSNKC

SEQ ID NO: 2651085 - protein, 4 aa, Entamoeba histolytica
QTDL

SEQ ID NO: 2651086 - protein, 6 aa, Entamoeba histolytica
QTDQIS

SEQ ID NO: 2651087 - protein, 10 aa, Entamoeba histolytica
QTDSDDSFFD

SEQ ID NO: 2651088 - protein, 9 aa, Entamoeba histolytica
QTDSKEVEV

SEQ ID NO: 2651089 - protein, 18 aa, Entamoeba histolytica
QTDSKGIETDDKGEVVSG

SEQ ID NO: 2651090 - protein, 4 aa, Entamoeba histolytica
QTDT

SEQ ID NO: 2651091 - protein, 5 aa, Entamoeba histolytica
QTDTP

SEQ ID NO: 2651092 - protein, 6 aa, Entamoeba histolytica
QTEDKN

SEQ ID NO: 2651093 - protein, 4 aa, Entamoeba histolytica
QTEE

SEQ ID NO: 2651094 - protein, 15 aa, Entamoeba histolytica
QTEECSDTKQPKYAS

SEQ ID NO: 2651095 - protein, 9 aa, Entamoeba histolytica
QTEEELRRS

SEQ ID NO: 2651096 - protein, 16 aa, Entamoeba histolytica
QTEEITKEIQNTQNRI

SEQ ID NO: 2651097 - protein, 8 aa, Entamoeba histolytica
QTEGFSGS

SEQ ID NO: 2651098 - protein, 7 aa, Entamoeba histolytica
QTEGGQT

SEQ ID NO: 2651099 - protein, 8 aa, Entamoeba histolytica
QTEGKGVN

SEQ ID NO: 2651100 - protein, 4 aa, Entamoeba histolytica
QTEI

SEQ ID NO: 2651101 - protein, 12 aa, Entamoeba histolytica
QTEINALKSGLG

SEQ ID NO: 2651102 - protein, 17 aa, Entamoeba histolytica
QTEINGLKKQNEELKKK

SEQ ID NO: 2651103 - protein, 12 aa, Entamoeba histolytica
QTEKASVEEETT

SEQ ID NO: 2651104 - protein, 5 aa, Entamoeba histolytica
QTEKE

SEQ ID NO: 2651105 - protein, 10 aa, Entamoeba histolytica
QTEKLAKGEV

SEQ ID NO: 2651106 - protein, 5 aa, Entamoeba histolytica
QTENG

SEQ ID NO: 2651107 - protein, 5 aa, Entamoeba histolytica
QTEPL

SEQ ID NO: 2651108 - protein, 8 aa, Entamoeba histolytica
QTERIERK

SEQ ID NO: 2651109 - protein, 4 aa, Entamoeba histolytica
QTES

SEQ ID NO: 2651110 - protein, 7 aa, Entamoeba histolytica
QTESDVR

SEQ ID NO: 2651111 - protein, 4 aa, Entamoeba histolytica
QTFP

SEQ ID NO: 2651112 - protein, 4 aa, Entamoeba histolytica
QTFS

SEQ ID NO: 2651113 - protein, 8 aa, Entamoeba histolytica
QTGATTLA

SEQ ID NO: 2651114 - protein, 13 aa, Entamoeba histolytica
QTGGDIRLSPEEY

SEQ ID NO: 2651115 - protein, 7 aa, Entamoeba histolytica
QTGHSGS

SEQ ID NO: 2651116 - protein, 5 aa, Entamoeba histolytica
QTGKI

SEQ ID NO: 2651117 - protein, 7 aa, Entamoeba histolytica
QTGKKIG

SEQ ID NO: 2651118 - protein, 14 aa, Entamoeba histolytica
QTGKTGKKPVGQND

SEQ ID NO: 2651119 - protein, 8 aa, Entamoeba histolytica
QTGKVQPE

SEQ ID NO: 2651120 - protein, 4 aa, Entamoeba histolytica
QTGN

SEQ ID NO: 2651121 - protein, 7 aa, Entamoeba histolytica
QTGRKES

SEQ ID NO: 2651122 - protein, 9 aa, Entamoeba histolytica
QTGSEERID

SEQ ID NO: 2651123 - protein, 6 aa, Entamoeba histolytica
QTGSLP

SEQ ID NO: 2651124 - protein, 19 aa, Entamoeba histolytica
QTGTGKTYTMEGEEENEGV

SEQ ID NO: 2651125 - protein, 6 aa, Entamoeba histolytica
QTGVTL

SEQ ID NO: 2651126 - protein, 7 aa, Entamoeba histolytica
QTHEQKV

SEQ ID NO: 2651127 - protein, 8 aa, Entamoeba histolytica
QTHNSQSK

SEQ ID NO: 2651128 - protein, 10 aa, Entamoeba histolytica
QTHQELNQSQ

SEQ ID NO: 2651129 - protein, 9 aa, Entamoeba histolytica
QTHSPYQTR

SEQ ID NO: 2651130 - protein, 5 aa, Entamoeba histolytica
QTIDP

SEQ ID NO: 2651131 - protein, 4 aa, Entamoeba histolytica
QTIE

SEQ ID NO: 2651132 - protein, 5 aa, Entamoeba histolytica
QTIEN

SEQ ID NO: 2651133 - protein, 5 aa, Entamoeba histolytica
QTIET

SEQ ID NO: 2651134 - protein, 13 aa, Entamoeba histolytica
QTIGKNDRMQDTA

SEQ ID NO: 2651135 - protein, 14 aa, Entamoeba histolytica
QTIKPKRKIENSYI

SEQ ID NO: 2651136 - protein, 21 aa, Entamoeba histolytica
QTIKQERKETQSKVSSISEKT

SEQ ID NO: 2651137 - protein, 6 aa, Entamoeba histolytica
QTIKSA

SEQ ID NO: 2651138 - protein, 7 aa, Entamoeba histolytica
QTINGKT

SEQ ID NO: 2651139 - protein, 72 aa, Entamoeba histolytica
QTINKEEDIKEEDIKEDKQKKSLTNDESTEGKQQQHTELNEKETIQTSEDENSIIENSEQEYNEDGPKEGNW

SEQ ID NO: 2651140 - protein, 4 aa, Entamoeba histolytica
QTIP

SEQ ID NO: 2651141 - protein, 8 aa, Entamoeba histolytica
QTIPPNEK

SEQ ID NO: 2651142 - protein, 5 aa, Entamoeba histolytica
QTIQD

SEQ ID NO: 2651143 - protein, 34 aa, Entamoeba histolytica
QTIQQQQNQINELTRKKEETSKEDMDKIPPTLEE

SEQ ID NO: 2651144 - protein, 7 aa, Entamoeba histolytica
QTISGEK

SEQ ID NO: 2651145 - protein, 4 aa, Entamoeba histolytica
QTIT

SEQ ID NO: 2651146 - protein, 7 aa, Entamoeba histolytica
QTKANAD

SEQ ID NO: 2651147 - protein, 8 aa, Entamoeba histolytica
QTKDDCED

SEQ ID NO: 2651148 - protein, 6 aa, Entamoeba histolytica
QTKDGN

SEQ ID NO: 2651149 - protein, 4 aa, Entamoeba histolytica
QTKE

SEQ ID NO: 2651150 - protein, 7 aa, Entamoeba histolytica
QTKEEIE

SEQ ID NO: 2651151 - protein, 6 aa, Entamoeba histolytica
QTKEIT

SEQ ID NO: 2651152 - protein, 8 aa, Entamoeba histolytica
QTKEKEPL

SEQ ID NO: 2651153 - protein, 4 aa, Entamoeba histolytica
QTKF

SEQ ID NO: 2651154 - protein, 6 aa, Entamoeba histolytica
QTKGDS

SEQ ID NO: 2651155 - protein, 7 aa, Entamoeba histolytica
QTKGVYE

SEQ ID NO: 2651156 - protein, 37 aa, Entamoeba histolytica
QTKHGSVLDDDPQIKRELDDESSEDYSSNEDDTDPEY

SEQ ID NO: 2651157 - protein, 5 aa, Entamoeba histolytica
QTKIK

SEQ ID NO: 2651158 - protein, 14 aa, Entamoeba histolytica
QTKKKKQNKKITGF

SEQ ID NO: 2651159 - protein, 24 aa, Entamoeba histolytica
QTKKKVPPPLPKQSHPKLTQQIPN

SEQ ID NO: 2651160 - protein, 6 aa, Entamoeba histolytica
QTKKPT

SEQ ID NO: 2651161 - protein, 7 aa, Entamoeba histolytica
QTKKQEI

SEQ ID NO: 2651162 - protein, 7 aa, Entamoeba histolytica
QTKNDEV

SEQ ID NO: 2651163 - protein, 9 aa, Entamoeba histolytica
QTKNHLESK

SEQ ID NO: 2651164 - protein, 5 aa, Entamoeba histolytica
QTKQD

SEQ ID NO: 2651165 - protein, 8 aa, Entamoeba histolytica
QTKQEDME

SEQ ID NO: 2651166 - protein, 13 aa, Entamoeba histolytica
QTKQEKESINNEL

SEQ ID NO: 2651167 - protein, 9 aa, Entamoeba histolytica
QTKRTKCTE

SEQ ID NO: 2651168 - protein, 6 aa, Entamoeba histolytica
QTKSSE

SEQ ID NO: 2651169 - protein, 11 aa, Entamoeba histolytica
QTKSTSPRDSL

SEQ ID NO: 2651170 - protein, 27 aa, Entamoeba histolytica
QTKTIQNDINENQNEVSDIEKKEDEWD

SEQ ID NO: 2651171 - protein, 10 aa, Entamoeba histolytica
QTKTKRKTYC

SEQ ID NO: 2651172 - protein, 32 aa, Entamoeba histolytica
QTLDNASQMINSSDAIKTKDPLLTPPSSPKQI

SEQ ID NO: 2651173 - protein, 10 aa, Entamoeba histolytica
QTLDSSSNYD

SEQ ID NO: 2651174 - protein, 4 aa, Entamoeba histolytica
QTLE

SEQ ID NO: 2651175 - protein, 16 aa, Entamoeba histolytica
QTLHQSSHHASSQSIN

SEQ ID NO: 2651176 - protein, 4 aa, Entamoeba histolytica
QTLN

SEQ ID NO: 2651177 - protein, 4 aa, Entamoeba histolytica
QTLP

SEQ ID NO: 2651178 - protein, 8 aa, Entamoeba histolytica
QTLQNNTL

SEQ ID NO: 2651179 - protein, 6 aa, Entamoeba histolytica
QTLRPT

SEQ ID NO: 2651180 - protein, 12 aa, Entamoeba histolytica
QTLSEENTEDDM

SEQ ID NO: 2651181 - protein, 5 aa, Entamoeba histolytica
QTLSG

SEQ ID NO: 2651182 - protein, 6 aa, Entamoeba histolytica
QTNDFG

SEQ ID NO: 2651183 - protein, 6 aa, Entamoeba histolytica
QTNDFN

SEQ ID NO: 2651184 - protein, 6 aa, Entamoeba histolytica
QTNDYS

SEQ ID NO: 2651185 - protein, 6 aa, Entamoeba histolytica
QTNEGN

SEQ ID NO: 2651186 - protein, 5 aa, Entamoeba histolytica
QTNGG

SEQ ID NO: 2651187 - protein, 10 aa, Entamoeba histolytica
QTNGLTSIPA

SEQ ID NO: 2651188 - protein, 14 aa, Entamoeba histolytica
QTNGPNTTTQIPQY

SEQ ID NO: 2651189 - protein, 10 aa, Entamoeba histolytica
QTNGSTLPQN

SEQ ID NO: 2651190 - protein, 6 aa, Entamoeba histolytica
QTNIEQ

SEQ ID NO: 2651191 - protein, 10 aa, Entamoeba histolytica
QTNKIKPPKI

SEQ ID NO: 2651192 - protein, 10 aa, Entamoeba histolytica
QTNKITENEV

SEQ ID NO: 2651193 - protein, 10 aa, Entamoeba histolytica
QTNKVQQGDI

SEQ ID NO: 2651194 - protein, 5 aa, Entamoeba histolytica
QTNKY

SEQ ID NO: 2651195 - protein, 8 aa, Entamoeba histolytica
QTNNEIKE

SEQ ID NO: 2651196 - protein, 6 aa, Entamoeba histolytica
QTNNSW

SEQ ID NO: 2651197 - protein, 6 aa, Entamoeba histolytica
QTNNYT

SEQ ID NO: 2651198 - protein, 7 aa, Entamoeba histolytica
QTNPKSS

SEQ ID NO: 2651199 - protein, 6 aa, Entamoeba histolytica
QTNPTL

SEQ ID NO: 2651200 - protein, 6 aa, Entamoeba histolytica
QTNQID

SEQ ID NO: 2651201 - protein, 17 aa, Entamoeba histolytica
QTNRNRRDSISYTNSYT

SEQ ID NO: 2651202 - protein, 8 aa, Entamoeba histolytica
QTNSADLQ

SEQ ID NO: 2651203 - protein, 5 aa, Entamoeba histolytica
QTNSH

SEQ ID NO: 2651204 - protein, 6 aa, Entamoeba histolytica
QTNSTM

SEQ ID NO: 2651205 - protein, 46 aa, Entamoeba histolytica
QTNSTVNGCEKEKHECERKMSQESVDQCSTNLRKKEVETTKEQKYE

SEQ ID NO: 2651206 - protein, 9 aa, Entamoeba histolytica
QTNTDEIRK

SEQ ID NO: 2651207 - protein, 8 aa, Entamoeba histolytica
QTNTNPLK

SEQ ID NO: 2651208 - protein, 18 aa, Entamoeba histolytica
QTNTNQKSEKFFIRRLLI

SEQ ID NO: 2651209 - protein, 10 aa, Entamoeba histolytica
QTNVKDKGLS

SEQ ID NO: 2651210 - protein, 12 aa, Entamoeba histolytica
QTNYSTPEQTSR

SEQ ID NO: 2651211 - protein, 4 aa, Entamoeba histolytica
QTPD

SEQ ID NO: 2651212 - protein, 5 aa, Entamoeba histolytica
QTPDI

SEQ ID NO: 2651213 - protein, 5 aa, Entamoeba histolytica
QTPEL

SEQ ID NO: 2651214 - protein, 7 aa, Entamoeba histolytica
QTPEQPI

SEQ ID NO: 2651215 - protein, 7 aa, Entamoeba histolytica
QTPGRYS

SEQ ID NO: 2651216 - protein, 10 aa, Entamoeba histolytica
QTPHNHPDYP

SEQ ID NO: 2651217 - protein, 5 aa, Entamoeba histolytica
QTPKE

SEQ ID NO: 2651218 - protein, 17 aa, Entamoeba histolytica
QTPKGEKKKEKEIEEQS

SEQ ID NO: 2651219 - protein, 13 aa, Entamoeba histolytica
QTPLKDAQNEIKE

SEQ ID NO: 2651220 - protein, 4 aa, Entamoeba histolytica
QTPN

SEQ ID NO: 2651221 - protein, 17 aa, Entamoeba histolytica
QTPNDPPRKSSFVGTPE

SEQ ID NO: 2651222 - protein, 9 aa, Entamoeba histolytica
QTPNGPKRV

SEQ ID NO: 2651223 - protein, 9 aa, Entamoeba histolytica
QTPNKQINY

SEQ ID NO: 2651224 - protein, 6 aa, Entamoeba histolytica
QTPPYL

SEQ ID NO: 2651225 - protein, 9 aa, Entamoeba histolytica
QTPQEITKE

SEQ ID NO: 2651226 - protein, 9 aa, Entamoeba histolytica
QTPQETAYD

SEQ ID NO: 2651227 - protein, 5 aa, Entamoeba histolytica
QTPQS

SEQ ID NO: 2651228 - protein, 9 aa, Entamoeba histolytica
QTPRDIQQV

SEQ ID NO: 2651229 - protein, 4 aa, Entamoeba histolytica
QTPS

SEQ ID NO: 2651230 - protein, 8 aa, Entamoeba histolytica
QTPSDDSL

SEQ ID NO: 2651231 - protein, 8 aa, Entamoeba histolytica
QTPSDIET

SEQ ID NO: 2651232 - protein, 8 aa, Entamoeba histolytica
QTPSLQPG

SEQ ID NO: 2651233 - protein, 166 aa, Entamoeba histolytica
QTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQPQNQPQDNGKQDHNKPEPQQQNHPQQNEKQDNKNTTTSDISHDK

SEQ ID NO: 2651234 - protein, 12 aa, Entamoeba histolytica
QTQAAKTHIGTT

SEQ ID NO: 2651235 - protein, 34 aa, Entamoeba histolytica
QTQEDNTKKRRSSQQGGSKRNSRRRSSVSLKPEH

SEQ ID NO: 2651236 - protein, 6 aa, Entamoeba histolytica
QTQERC

SEQ ID NO: 2651237 - protein, 7 aa, Entamoeba histolytica
QTQFDEQ

SEQ ID NO: 2651238 - protein, 6 aa, Entamoeba histolytica
QTQGEM

SEQ ID NO: 2651239 - protein, 13 aa, Entamoeba histolytica
QTQISPQINNNTS

SEQ ID NO: 2651240 - protein, 4 aa, Entamoeba histolytica
QTQK

SEQ ID NO: 2651241 - protein, 4 aa, Entamoeba histolytica
QTQL

SEQ ID NO: 2651242 - protein, 6 aa, Entamoeba histolytica
QTQNSS

SEQ ID NO: 2651243 - protein, 6 aa, Entamoeba histolytica
QTQPNK

SEQ ID NO: 2651244 - protein, 9 aa, Entamoeba histolytica
QTQQATRQV

SEQ ID NO: 2651245 - protein, 25 aa, Entamoeba histolytica
QTQRDASISNGSNQNFTPPLPQSPA

SEQ ID NO: 2651246 - protein, 7 aa, Entamoeba histolytica
QTQTEPH

SEQ ID NO: 2651247 - protein, 8 aa, Entamoeba histolytica
QTQTNSDA

SEQ ID NO: 2651248 - protein, 8 aa, Entamoeba histolytica
QTQVEATG

SEQ ID NO: 2651249 - protein, 8 aa, Entamoeba histolytica
QTRESSTV

SEQ ID NO: 2651250 - protein, 6 aa, Entamoeba histolytica
QTRGPT

SEQ ID NO: 2651251 - protein, 8 aa, Entamoeba histolytica
QTRGVREN

SEQ ID NO: 2651252 - protein, 10 aa, Entamoeba histolytica
QTRINRRKIQ

SEQ ID NO: 2651253 - protein, 11 aa, Entamoeba histolytica
QTRKNSKTPKD

SEQ ID NO: 2651254 - protein, 7 aa, Entamoeba histolytica
QTRNGTG

SEQ ID NO: 2651255 - protein, 11 aa, Entamoeba histolytica
QTRQQRSTFNP

SEQ ID NO: 2651256 - protein, 13 aa, Entamoeba histolytica
QTRRPIGTGPGGV

SEQ ID NO: 2651257 - protein, 5 aa, Entamoeba histolytica
QTRSA

SEQ ID NO: 2651258 - protein, 5 aa, Entamoeba histolytica
QTRTA

SEQ ID NO: 2651259 - protein, 9 aa, Entamoeba histolytica
QTRTLNDKN

SEQ ID NO: 2651260 - protein, 7 aa, Entamoeba histolytica
QTRTSLP

SEQ ID NO: 2651261 - protein, 7 aa, Entamoeba histolytica
QTRYKGW

SEQ ID NO: 2651262 - protein, 9 aa, Entamoeba histolytica
QTSDVEADV

SEQ ID NO: 2651263 - protein, 8 aa, Entamoeba histolytica
QTSEGRIR

SEQ ID NO: 2651264 - protein, 4 aa, Entamoeba histolytica
QTSF

SEQ ID NO: 2651265 - protein, 14 aa, Entamoeba histolytica
QTSGDVQDKINTKK

SEQ ID NO: 2651266 - protein, 6 aa, Entamoeba histolytica
QTSKEV

SEQ ID NO: 2651267 - protein, 5 aa, Entamoeba histolytica
QTSKI

SEQ ID NO: 2651268 - protein, 7 aa, Entamoeba histolytica
QTSKTTS

SEQ ID NO: 2651269 - protein, 14 aa, Entamoeba histolytica
QTSLNKSLKGVNNN

SEQ ID NO: 2651270 - protein, 9 aa, Entamoeba histolytica
QTSMNQPDF

SEQ ID NO: 2651271 - protein, 7 aa, Entamoeba histolytica
QTSNAKE

SEQ ID NO: 2651272 - protein, 9 aa, Entamoeba histolytica
QTSNGPKRV

SEQ ID NO: 2651273 - protein, 13 aa, Entamoeba histolytica
QTSPTFNNPPLVP

SEQ ID NO: 2651274 - protein, 6 aa, Entamoeba histolytica
QTSPYY

SEQ ID NO: 2651275 - protein, 5 aa, Entamoeba histolytica
QTSSL

SEQ ID NO: 2651276 - protein, 7 aa, Entamoeba histolytica
QTSTELR

SEQ ID NO: 2651277 - protein, 14 aa, Entamoeba histolytica
QTSTKEGTNTPSWN

SEQ ID NO: 2651278 - protein, 14 aa, Entamoeba histolytica
QTTEEAKQTKDYLN

SEQ ID NO: 2651279 - protein, 10 aa, Entamoeba histolytica
QTTFEEKEEI

SEQ ID NO: 2651280 - protein, 15 aa, Entamoeba histolytica
QTTGGQLSGSSNTWT

SEQ ID NO: 2651281 - protein, 6 aa, Entamoeba histolytica
QTTGHP

SEQ ID NO: 2651282 - protein, 20 aa, Entamoeba histolytica
QTTIGNNNGGATTSVNISGG

SEQ ID NO: 2651283 - protein, 6 aa, Entamoeba histolytica
QTTIKT

SEQ ID NO: 2651284 - protein, 5 aa, Entamoeba histolytica
QTTIS

SEQ ID NO: 2651285 - protein, 17 aa, Entamoeba histolytica
QTTMNGNDKHKVEEPKS

SEQ ID NO: 2651286 - protein, 4 aa, Entamoeba histolytica
QTTN

SEQ ID NO: 2651287 - protein, 5 aa, Entamoeba histolytica
QTTNG

SEQ ID NO: 2651288 - protein, 7 aa, Entamoeba histolytica
QTTPRNP

SEQ ID NO: 2651289 - protein, 7 aa, Entamoeba histolytica
QTTQGDI

SEQ ID NO: 2651290 - protein, 5 aa, Entamoeba histolytica
QTTQN

SEQ ID NO: 2651291 - protein, 7 aa, Entamoeba histolytica
QTTQSSV

SEQ ID NO: 2651292 - protein, 11 aa, Entamoeba histolytica
QTTQYIPASSV

SEQ ID NO: 2651293 - protein, 5 aa, Entamoeba histolytica
QTTRL

SEQ ID NO: 2651294 - protein, 13 aa, Entamoeba histolytica
QTTSKENSNKKKQ

SEQ ID NO: 2651295 - protein, 17 aa, Entamoeba histolytica
QTTSTKNNKKYRHGGSN

SEQ ID NO: 2651296 - protein, 26 aa, Entamoeba histolytica
QTTTQQSNKKTIDESIRKSCDEERDI

SEQ ID NO: 2651297 - protein, 10 aa, Entamoeba histolytica
QTTYSSKSDL

SEQ ID NO: 2651298 - protein, 7 aa, Entamoeba histolytica
QTVEQET

SEQ ID NO: 2651299 - protein, 6 aa, Entamoeba histolytica
QTVGNY

SEQ ID NO: 2651300 - protein, 86 aa, Entamoeba histolytica
QTVKEKDVKQKSQKTVENNIKPKQAIEKEITPNESRKIVEEENNVITKKQKGVEEGKESIPKSKEVIEEKGTKQNESRKMEEEKNN

SEQ ID NO: 2651301 - protein, 20 aa, Entamoeba histolytica
QTVKQKQDNPQTKSKKKDIV

SEQ ID NO: 2651302 - protein, 10 aa, Entamoeba histolytica
QTVNGGRVSD

SEQ ID NO: 2651303 - protein, 4 aa, Entamoeba histolytica
QTVP

SEQ ID NO: 2651304 - protein, 9 aa, Entamoeba histolytica
QTVQEQTNK

SEQ ID NO: 2651305 - protein, 11 aa, Entamoeba histolytica
QTVSGTDNTLE

SEQ ID NO: 2651306 - protein, 18 aa, Entamoeba histolytica
QTVSKSIEKETEVEKKSQ

SEQ ID NO: 2651307 - protein, 10 aa, Entamoeba histolytica
QTVSQQPKDV

SEQ ID NO: 2651308 - protein, 10 aa, Entamoeba histolytica
QTVTTSQTDT

SEQ ID NO: 2651309 - protein, 16 aa, Entamoeba histolytica
QTYEDSKMKGTLPQNI

SEQ ID NO: 2651310 - protein, 12 aa, Entamoeba histolytica
QTYENSPKLSTN

SEQ ID NO: 2651311 - protein, 6 aa, Entamoeba histolytica
QTYKSK

SEQ ID NO: 2651312 - protein, 5 aa, Entamoeba histolytica
QTYSG

SEQ ID NO: 2651313 - protein, 7 aa, Entamoeba histolytica
QTYSNDE

SEQ ID NO: 2651314 - protein, 8 aa, Entamoeba histolytica
QTYSSSKR

SEQ ID NO: 2651315 - protein, 4 aa, Entamoeba histolytica
QTYT

SEQ ID NO: 2651316 - protein, 13 aa, Entamoeba histolytica
QVANSSSKVTVND

SEQ ID NO: 2651317 - protein, 19 aa, Entamoeba histolytica
QVDAERATKAAIENASNYP

SEQ ID NO: 2651318 - protein, 12 aa, Entamoeba histolytica
QVDAPTQKLRKP

SEQ ID NO: 2651319 - protein, 14 aa, Entamoeba histolytica
QVDIEGKKEYERQR

SEQ ID NO: 2651320 - protein, 11 aa, Entamoeba histolytica
QVDNEKDTTAA

SEQ ID NO: 2651321 - protein, 14 aa, Entamoeba histolytica
QVDTLQSLESLTSS

SEQ ID NO: 2651322 - protein, 7 aa, Entamoeba histolytica
QVEAAQG

SEQ ID NO: 2651323 - protein, 4 aa, Entamoeba histolytica
QVEE

SEQ ID NO: 2651324 - protein, 11 aa, Entamoeba histolytica
QVEEASNGSVS

SEQ ID NO: 2651325 - protein, 27 aa, Entamoeba histolytica
QVEEDNDNTSTKDNNEQQEEKKPFDLE

SEQ ID NO: 2651326 - protein, 7 aa, Entamoeba histolytica
QVEEGTD

SEQ ID NO: 2651327 - protein, 6 aa, Entamoeba histolytica
QVEEHQ

SEQ ID NO: 2651328 - protein, 11 aa, Entamoeba histolytica
QVEKSDTQIPK

SEQ ID NO: 2651329 - protein, 7 aa, Entamoeba histolytica
QVENPTT

SEQ ID NO: 2651330 - protein, 5 aa, Entamoeba histolytica
QVEPL

SEQ ID NO: 2651331 - protein, 6 aa, Entamoeba histolytica
QVEQDI

SEQ ID NO: 2651332 - protein, 11 aa, Entamoeba histolytica
QVEQLSTGSLD

SEQ ID NO: 2651333 - protein, 15 aa, Entamoeba histolytica
QVETKTRVYEPAPPR

SEQ ID NO: 2651334 - protein, 5 aa, Entamoeba histolytica
QVEYT

SEQ ID NO: 2651335 - protein, 7 aa, Entamoeba histolytica
QVFSNDS

SEQ ID NO: 2651336 - protein, 6 aa, Entamoeba histolytica
QVGHPM

SEQ ID NO: 2651337 - protein, 7 aa, Entamoeba histolytica
QVKDDTD

SEQ ID NO: 2651338 - protein, 8 aa, Entamoeba histolytica
QVKEDKEQ

SEQ ID NO: 2651339 - protein, 22 aa, Entamoeba histolytica
QVKEENNTSQIQQKSFTSENIP

SEQ ID NO: 2651340 - protein, 5 aa, Entamoeba histolytica
QVKGG

SEQ ID NO: 2651341 - protein, 21 aa, Entamoeba histolytica
QVKKPRRLNTLSKRKKEMASI

SEQ ID NO: 2651342 - protein, 9 aa, Entamoeba histolytica
QVKKTKKTI

SEQ ID NO: 2651343 - protein, 48 aa, Entamoeba histolytica
QVKSVQKEEQDKRKRSKVDEYIKSNDYQRIDESDEENASKIINKETQK

SEQ ID NO: 2651344 - protein, 4 aa, Entamoeba histolytica
QVKT

SEQ ID NO: 2651345 - protein, 17 aa, Entamoeba histolytica
QVLPDTTKGTTINPNVD

SEQ ID NO: 2651346 - protein, 8 aa, Entamoeba histolytica
QVNDGYGA

SEQ ID NO: 2651347 - protein, 29 aa, Entamoeba histolytica
QVNGLKKELSELKQTTIPNSGASSSLGIP

SEQ ID NO: 2651348 - protein, 16 aa, Entamoeba histolytica
QVNGPEDVMKIMKEMG

SEQ ID NO: 2651349 - protein, 16 aa, Entamoeba histolytica
QVNIPKAQQPNPNNSH

SEQ ID NO: 2651350 - protein, 11 aa, Entamoeba histolytica
QVNITGDERCN

SEQ ID NO: 2651351 - protein, 12 aa, Entamoeba histolytica
QVNKQTGTTRSI

SEQ ID NO: 2651352 - protein, 7 aa, Entamoeba histolytica
QVNPKPH

SEQ ID NO: 2651353 - protein, 5 aa, Entamoeba histolytica
QVPEE

SEQ ID NO: 2651354 - protein, 6 aa, Entamoeba histolytica
QVPGKH

SEQ ID NO: 2651355 - protein, 6 aa, Entamoeba histolytica
QVPIGS

SEQ ID NO: 2651356 - protein, 4 aa, Entamoeba histolytica
QVPQ

SEQ ID NO: 2651357 - protein, 102 aa, Entamoeba histolytica
QVPSNDSNSSSLPLPPSIPTTSQQSSSSLPPPPPPGTQPIPGVPPPPPGVPGATGVPPPPPPPGMPGAPPPPPPMGKGMPPPPGLAPAQTKLNKKAIKPAEK

SEQ ID NO: 2651358 - protein, 6 aa, Entamoeba histolytica
QVQDDG

SEQ ID NO: 2651359 - protein, 23 aa, Entamoeba histolytica
QVQKKKAEYLKKEQEKKNKQFEQ

SEQ ID NO: 2651360 - protein, 20 aa, Entamoeba histolytica
QVQNARGEAQENTTQQPQTR

SEQ ID NO: 2651361 - protein, 6 aa, Entamoeba histolytica
QVQPKE

SEQ ID NO: 2651362 - protein, 31 aa, Entamoeba histolytica
QVQPPSSEKQTTEDVPQPIQPQVKKQSANDH

SEQ ID NO: 2651363 - protein, 13 aa, Entamoeba histolytica
QVQQEQSYNLQPP

SEQ ID NO: 2651364 - protein, 14 aa, Entamoeba histolytica
QVQQETDLPPEIPQ

SEQ ID NO: 2651365 - protein, 24 aa, Entamoeba histolytica
QVQQSSLKVQENKESFDDLERKKQ

SEQ ID NO: 2651366 - protein, 6 aa, Entamoeba histolytica
QVQSWN

SEQ ID NO: 2651367 - protein, 29 aa, Entamoeba histolytica
QVRSGEKVDLSKKKIKEGFKAKAKESFNI

SEQ ID NO: 2651368 - protein, 8 aa, Entamoeba histolytica
QVSDENKP

SEQ ID NO: 2651369 - protein, 4 aa, Entamoeba histolytica
QVSE

SEQ ID NO: 2651370 - protein, 5 aa, Entamoeba histolytica
QVSNE

SEQ ID NO: 2651371 - protein, 6 aa, Entamoeba histolytica
QVSNEE

SEQ ID NO: 2651372 - protein, 13 aa, Entamoeba histolytica
QVSPEDAKDFAKS

SEQ ID NO: 2651373 - protein, 10 aa, Entamoeba histolytica
QVSSNTPDIN

SEQ ID NO: 2651374 - protein, 15 aa, Entamoeba histolytica
QVSSYSSAVSRAYYP

SEQ ID NO: 2651375 - protein, 11 aa, Entamoeba histolytica
QVSTDNGTNWR

SEQ ID NO: 2651376 - protein, 12 aa, Entamoeba histolytica
QVSTKNQDKNYL

SEQ ID NO: 2651377 - protein, 11 aa, Entamoeba histolytica
QVTDNKTTIKT

SEQ ID NO: 2651378 - protein, 10 aa, Entamoeba histolytica
QVTERDKSLK

SEQ ID NO: 2651379 - protein, 13 aa, Entamoeba histolytica
QVTGKRIGKDVQL

SEQ ID NO: 2651380 - protein, 8 aa, Entamoeba histolytica
QVTKNTKI

SEQ ID NO: 2651381 - protein, 8 aa, Entamoeba histolytica
QVTNKNSH

SEQ ID NO: 2651382 - protein, 17 aa, Entamoeba histolytica
QVTNNPENDGCINAVLL

SEQ ID NO: 2651383 - protein, 13 aa, Entamoeba histolytica
QVTPHSINTTPSA

SEQ ID NO: 2651384 - protein, 13 aa, Entamoeba histolytica
QVTPSSITNYTTS

SEQ ID NO: 2651385 - protein, 6 aa, Entamoeba histolytica
QVTPTY

SEQ ID NO: 2651386 - protein, 11 aa, Entamoeba histolytica
QVTQQSQQPIL

SEQ ID NO: 2651387 - protein, 12 aa, Entamoeba histolytica
QVTQRKRYKKGN

SEQ ID NO: 2651388 - protein, 6 aa, Entamoeba histolytica
QVTRSS

SEQ ID NO: 2651389 - protein, 4 aa, Entamoeba histolytica
QVTT

SEQ ID NO: 2651390 - protein, 9 aa, Entamoeba histolytica
QVTTKKLPK

SEQ ID NO: 2651391 - protein, 19 aa, Entamoeba histolytica
QVVSEQDQLPKSSEVEEKK

SEQ ID NO: 2651392 - protein, 19 aa, Entamoeba histolytica
QVYDSSSKPKDEKAKIKPW

SEQ ID NO: 2651393 - protein, 4 aa, Entamoeba histolytica
QVYG

SEQ ID NO: 2651394 - protein, 16 aa, Entamoeba histolytica
QVYGGSDQRTNTGKLG

SEQ ID NO: 2651395 - protein, 10 aa, Entamoeba histolytica
QVYPNPPAPL

SEQ ID NO: 2651396 - protein, 21 aa, Entamoeba histolytica
QWETPKDKYMEKPQPGTDSTY

SEQ ID NO: 2651397 - protein, 15 aa, Entamoeba histolytica
QWNLENKKSSVYNEK

SEQ ID NO: 2651398 - protein, 24 aa, Entamoeba histolytica
QWNQQKNSEDQPQPSSNQQGDSNG

SEQ ID NO: 2651399 - protein, 5 aa, Entamoeba histolytica
QWNSS

SEQ ID NO: 2651400 - protein, 5 aa, Entamoeba histolytica
QWSPT

SEQ ID NO: 2651401 - protein, 7 aa, Entamoeba histolytica
QWTSESS

SEQ ID NO: 2651402 - protein, 9 aa, Entamoeba histolytica
QYADRNGKR

SEQ ID NO: 2651403 - protein, 16 aa, Entamoeba histolytica
QYAHEDCNELNLENPI

SEQ ID NO: 2651404 - protein, 14 aa, Entamoeba histolytica
QYANDSVRERERRD

SEQ ID NO: 2651405 - protein, 17 aa, Entamoeba histolytica
QYASEIKKDMSSNQIKT

SEQ ID NO: 2651406 - protein, 10 aa, Entamoeba histolytica
QYDDDASEVE

SEQ ID NO: 2651407 - protein, 24 aa, Entamoeba histolytica
QYDEYTTSRSSKPTQHKEKGKKIE

SEQ ID NO: 2651408 - protein, 4 aa, Entamoeba histolytica
QYDI

SEQ ID NO: 2651409 - protein, 5 aa, Entamoeba histolytica
QYDIS

SEQ ID NO: 2651410 - protein, 6 aa, Entamoeba histolytica
QYDPES

SEQ ID NO: 2651411 - protein, 5 aa, Entamoeba histolytica
QYDPT

SEQ ID NO: 2651412 - protein, 5 aa, Entamoeba histolytica
QYDSQ

SEQ ID NO: 2651413 - protein, 19 aa, Entamoeba histolytica
QYEEIEEENIQSKKDIDIK

SEQ ID NO: 2651414 - protein, 7 aa, Entamoeba histolytica
QYEGGTT

SEQ ID NO: 2651415 - protein, 4 aa, Entamoeba histolytica
QYEK

SEQ ID NO: 2651416 - protein, 8 aa, Entamoeba histolytica
QYEKEIEQ

SEQ ID NO: 2651417 - protein, 9 aa, Entamoeba histolytica
QYENGESVN

SEQ ID NO: 2651418 - protein, 6 aa, Entamoeba histolytica
QYEQQR

SEQ ID NO: 2651419 - protein, 5 aa, Entamoeba histolytica
QYESG

SEQ ID NO: 2651420 - protein, 7 aa, Entamoeba histolytica
QYESYNG

SEQ ID NO: 2651421 - protein, 9 aa, Entamoeba histolytica
QYESYNQDI

SEQ ID NO: 2651422 - protein, 4 aa, Entamoeba histolytica
QYGA

SEQ ID NO: 2651423 - protein, 7 aa, Entamoeba histolytica
QYGAEPS

SEQ ID NO: 2651424 - protein, 4 aa, Entamoeba histolytica
QYGE

SEQ ID NO: 2651425 - protein, 4 aa, Entamoeba histolytica
QYGP

SEQ ID NO: 2651426 - protein, 6 aa, Entamoeba histolytica
QYGQHQ

SEQ ID NO: 2651427 - protein, 9 aa, Entamoeba histolytica
QYGSEQEVK

SEQ ID NO: 2651428 - protein, 13 aa, Entamoeba histolytica
QYGTTSCGTTQYA

SEQ ID NO: 2651429 - protein, 4 aa, Entamoeba histolytica
QYHT

SEQ ID NO: 2651430 - protein, 9 aa, Entamoeba histolytica
QYIGTSTSM

SEQ ID NO: 2651431 - protein, 8 aa, Entamoeba histolytica
QYKKKEDL

SEQ ID NO: 2651432 - protein, 18 aa, Entamoeba histolytica
QYKKTVPSLTLSGPTSFA

SEQ ID NO: 2651433 - protein, 10 aa, Entamoeba histolytica
QYKSGCTTDV

SEQ ID NO: 2651434 - protein, 23 aa, Entamoeba histolytica
QYKSKEQENIQSNLTTPKESLNQ

SEQ ID NO: 2651435 - protein, 4 aa, Entamoeba histolytica
QYKT

SEQ ID NO: 2651436 - protein, 4 aa, Entamoeba histolytica
QYLE

SEQ ID NO: 2651437 - protein, 7 aa, Entamoeba histolytica
QYMKPQS

SEQ ID NO: 2651438 - protein, 4 aa, Entamoeba histolytica
QYNA

SEQ ID NO: 2651439 - protein, 9 aa, Entamoeba histolytica
QYNPSGKYN

SEQ ID NO: 2651440 - protein, 5 aa, Entamoeba histolytica
QYNQE

SEQ ID NO: 2651441 - protein, 4 aa, Entamoeba histolytica
QYNT

SEQ ID NO: 2651442 - protein, 6 aa, Entamoeba histolytica
QYPKGD

SEQ ID NO: 2651443 - protein, 5 aa, Entamoeba histolytica
QYPKL

SEQ ID NO: 2651444 - protein, 4 aa, Entamoeba histolytica
QYPN

SEQ ID NO: 2651445 - protein, 18 aa, Entamoeba histolytica
QYPSNGTEFSSPYLSNTP

SEQ ID NO: 2651446 - protein, 6 aa, Entamoeba histolytica
QYQCSE

SEQ ID NO: 2651447 - protein, 17 aa, Entamoeba histolytica
QYQNEIRSSTKISNTNI

SEQ ID NO: 2651448 - protein, 6 aa, Entamoeba histolytica
QYQPPK

SEQ ID NO: 2651449 - protein, 13 aa, Entamoeba histolytica
QYQQQQYQQPIQQ

SEQ ID NO: 2651450 - protein, 15 aa, Entamoeba histolytica
QYQQQSSNDQIKRRS

SEQ ID NO: 2651451 - protein, 6 aa, Entamoeba histolytica
QYSAEN

SEQ ID NO: 2651452 - protein, 6 aa, Entamoeba histolytica
QYSDTQ

SEQ ID NO: 2651453 - protein, 12 aa, Entamoeba histolytica
QYSEGHGKTIDQ

SEQ ID NO: 2651454 - protein, 26 aa, Entamoeba histolytica
QYSKKQNTKPEKLKEIKKKKKELKKK

SEQ ID NO: 2651455 - protein, 7 aa, Entamoeba histolytica
QYSKNNN

SEQ ID NO: 2651456 - protein, 11 aa, Entamoeba histolytica
QYSKNNPEQAE

SEQ ID NO: 2651457 - protein, 4 aa, Entamoeba histolytica
QYSQ

SEQ ID NO: 2651458 - protein, 7 aa, Entamoeba histolytica
QYSSEKK

SEQ ID NO: 2651459 - protein, 7 aa, Entamoeba histolytica
QYSSTFP

SEQ ID NO: 2651460 - protein, 47 aa, Entamoeba histolytica
QYSSTQSTARTDNSISSVPQKDLSKGGDEIKDSDQLIGSGKASHQLT

SEQ ID NO: 2651461 - protein, 4 aa, Entamoeba histolytica
QYTK

SEQ ID NO: 2651462 - protein, 13 aa, Entamoeba histolytica
QYTSSSQKKQKPT

SEQ ID NO: 2651463 - protein, 54 aa, Entamoeba histolytica
QYTTSNRNGNFNTKPLSVSPMETSTPFDESDNSQQYHEDELQQPVDEKPIEEQT

SEQ ID NO: 2651464 - protein, 8 aa, Entamoeba histolytica
QYYPKGEN

SEQ ID NO: 2651465 - protein, 12 aa, Entamoeba histolytica
QYYQQQPQQQYQ

SEQ ID NO: 2651466 - protein, 11 aa, Entamoeba histolytica
RAADNTEKPHI

SEQ ID NO: 2651467 - protein, 20 aa, Entamoeba histolytica
RAAEERNKKEKEDQKKRINQ

SEQ ID NO: 2651468 - protein, 71 aa, Entamoeba histolytica
RAAEKKKAKKVVKSKKGKKEESSDEESEEEEEKKPVNKETKKAVKKTTKKKNKKGKKREEDDDSDDDKYEL

SEQ ID NO: 2651469 - protein, 18 aa, Entamoeba histolytica
RAASNYDANEDDDDSAEW

SEQ ID NO: 2651470 - protein, 5 aa, Entamoeba histolytica
RADEK

SEQ ID NO: 2651471 - protein, 5 aa, Entamoeba histolytica
RADET

SEQ ID NO: 2651472 - protein, 9 aa, Entamoeba histolytica
RADGDDPAR

SEQ ID NO: 2651473 - protein, 7 aa, Entamoeba histolytica
RADSEEY

SEQ ID NO: 2651474 - protein, 48 aa, Entamoeba histolytica
RAEAEKATKRALEAEERIEENRKAARAAEEKELKERVGREEEARAKET

SEQ ID NO: 2651475 - protein, 10 aa, Entamoeba histolytica
RAEEADKRDH

SEQ ID NO: 2651476 - protein, 8 aa, Entamoeba histolytica
RAEEDYNN

SEQ ID NO: 2651477 - protein, 9 aa, Entamoeba histolytica
RAEENRKKI

SEQ ID NO: 2651478 - protein, 7 aa, Entamoeba histolytica
RAEGQDE

SEQ ID NO: 2651479 - protein, 8 aa, Entamoeba histolytica
RAEGTRIK

SEQ ID NO: 2651480 - protein, 18 aa, Entamoeba histolytica
RAEKPDQKENETKQKEQE

SEQ ID NO: 2651481 - protein, 7 aa, Entamoeba histolytica
RAEKSHP

SEQ ID NO: 2651482 - protein, 5 aa, Entamoeba histolytica
RAEPI

SEQ ID NO: 2651483 - protein, 10 aa, Entamoeba histolytica
RAEQKSDEYQ

SEQ ID NO: 2651484 - protein, 8 aa, Entamoeba histolytica
RAEQSRTV

SEQ ID NO: 2651485 - protein, 8 aa, Entamoeba histolytica
RAESAPIS

SEQ ID NO: 2651486 - protein, 14 aa, Entamoeba histolytica
RAETGDRDITEFSE

SEQ ID NO: 2651487 - protein, 10 aa, Entamoeba histolytica
RAFGDDSTLM

SEQ ID NO: 2651488 - protein, 4 aa, Entamoeba histolytica
RAGA

SEQ ID NO: 2651489 - protein, 5 aa, Entamoeba histolytica
RAGGL

SEQ ID NO: 2651490 - protein, 7 aa, Entamoeba histolytica
RAGMGRC

SEQ ID NO: 2651491 - protein, 4 aa, Entamoeba histolytica
RAGS

SEQ ID NO: 2651492 - protein, 8 aa, Entamoeba histolytica
RAGSTVES

SEQ ID NO: 2651493 - protein, 13 aa, Entamoeba histolytica
RAGTRTKGRSHKY

SEQ ID NO: 2651494 - protein, 6 aa, Entamoeba histolytica
RAIKGI

SEQ ID NO: 2651495 - protein, 6 aa, Entamoeba histolytica
RAIPTG

SEQ ID NO: 2651496 - protein, 7 aa, Entamoeba histolytica
RAISEGK

SEQ ID NO: 2651497 - protein, 5 aa, Entamoeba histolytica
RAISS

SEQ ID NO: 2651498 - protein, 7 aa, Entamoeba histolytica
RAKEIEE

SEQ ID NO: 2651499 - protein, 129 aa, Entamoeba histolytica
RAKENIKKLDNERKNQQPLQYSQNSYSTIPQQYPPSFNPPPLQENNTSKPYPSSYSSSYSQNKNTTQYPSSYVTSQQQNNLTQYPSSYSPSNQLNNQPPSYPSSYTVSKSNQPVNRYPTTQTSPPSISV

SEQ ID NO: 2651500 - protein, 6 aa, Entamoeba histolytica
RAKGEL

SEQ ID NO: 2651501 - protein, 4 aa, Entamoeba histolytica
RAKK

SEQ ID NO: 2651502 - protein, 12 aa, Entamoeba histolytica
RAKKAAVKVIEA

SEQ ID NO: 2651503 - protein, 7 aa, Entamoeba histolytica
RAKKGVS

SEQ ID NO: 2651504 - protein, 10 aa, Entamoeba histolytica
RAKKNNDLGG

SEQ ID NO: 2651505 - protein, 10 aa, Entamoeba histolytica
RAKKNVDGYQ

SEQ ID NO: 2651506 - protein, 10 aa, Entamoeba histolytica
RAKLKKSDFE

SEQ ID NO: 2651507 - protein, 8 aa, Entamoeba histolytica
RAKNPETT

SEQ ID NO: 2651508 - protein, 12 aa, Entamoeba histolytica
RAKRSFSCGGNT

SEQ ID NO: 2651509 - protein, 4 aa, Entamoeba histolytica
RAKS

SEQ ID NO: 2651510 - protein, 9 aa, Entamoeba histolytica
RAKSPDKVK

SEQ ID NO: 2651511 - protein, 7 aa, Entamoeba histolytica
RAKTSGG

SEQ ID NO: 2651512 - protein, 10 aa, Entamoeba histolytica
RAKVHKKPVA

SEQ ID NO: 2651513 - protein, 7 aa, Entamoeba histolytica
RAKYQQT

SEQ ID NO: 2651514 - protein, 6 aa, Entamoeba histolytica
RALNGK

SEQ ID NO: 2651515 - protein, 6 aa, Entamoeba histolytica
RALNRK

SEQ ID NO: 2651516 - protein, 4 aa, Entamoeba histolytica
RALR

SEQ ID NO: 2651517 - protein, 12 aa, Entamoeba histolytica
RALRETSQKHHQ

SEQ ID NO: 2651518 - protein, 9 aa, Entamoeba histolytica
RALSSSVEK

SEQ ID NO: 2651519 - protein, 32 aa, Entamoeba histolytica; identical to SEQ ID NO: 2456449

SEQ ID NO: 2651520 - protein, 12 aa, Entamoeba histolytica
RANDPNVDKEGQ

SEQ ID NO: 2651521 - protein, 21 aa, Entamoeba histolytica
RANIRERQQRRKQDLESRKQM

SEQ ID NO: 2651522 - protein, 7 aa, Entamoeba histolytica
RANNPCT

SEQ ID NO: 2651523 - protein, 12 aa, Entamoeba histolytica
RANNRRRQTRKS

SEQ ID NO: 2651524 - protein, 6 aa, Entamoeba histolytica
RANNRY

SEQ ID NO: 2651525 - protein, 9 aa, Entamoeba histolytica
RANNSDNAI

SEQ ID NO: 2651526 - protein, 7 aa, Entamoeba histolytica
RANQNTL

SEQ ID NO: 2651527 - protein, 13 aa, Entamoeba histolytica
RANQTAPSSPRKL

SEQ ID NO: 2651528 - protein, 10 aa, Entamoeba histolytica
RANSEPLRKR

SEQ ID NO: 2651529 - protein, 19 aa, Entamoeba histolytica
RANSNYDATDNDGDDSEVW

SEQ ID NO: 2651530 - protein, 4 aa, Entamoeba histolytica
RAPI

SEQ ID NO: 2651531 - protein, 13 aa, Entamoeba histolytica
RAPITKKEKYEEF

SEQ ID NO: 2651532 - protein, 8 aa, Entamoeba histolytica
RAPNEEIK

SEQ ID NO: 2651533 - protein, 5 aa, Entamoeba histolytica
RAPPK

SEQ ID NO: 2651534 - protein, 6 aa, Entamoeba histolytica
RAPVGG

SEQ ID NO: 2651535 - protein, 6 aa, Entamoeba histolytica
RAQDGA

SEQ ID NO: 2651536 - protein, 8 aa, Entamoeba histolytica
RAQEEVKR

SEQ ID NO: 2651537 - protein, 11 aa, Entamoeba histolytica
RAQKRSQIMNQ

SEQ ID NO: 2651538 - protein, 16 aa, Entamoeba histolytica
RAQLQKQLSSNKALEY

SEQ ID NO: 2651539 - protein, 14 aa, Entamoeba histolytica
RAQPTSRLSLPPKG

SEQ ID NO: 2651540 - protein, 9 aa, Entamoeba histolytica
RAQQKTAIT

SEQ ID NO: 2651541 - protein, 28 aa, Entamoeba histolytica
RAQSQSKKRGSNESPTFARSVSKEGLTV

SEQ ID NO: 2651542 - protein, 7 aa, Entamoeba histolytica
RAQTPSV

SEQ ID NO: 2651543 - protein, 6 aa, Entamoeba histolytica
RAQWAS

SEQ ID NO: 2651544 - protein, 8 aa, Entamoeba histolytica
RARDTRSR

SEQ ID NO: 2651545 - protein, 9 aa, Entamoeba histolytica
RARSRSPLM

SEQ ID NO: 2651546 - protein, 13 aa, Entamoeba histolytica
RARYDSSPGSFTE

SEQ ID NO: 2651547 - protein, 8 aa, Entamoeba histolytica
RASDPREM

SEQ ID NO: 2651548 - protein, 7 aa, Entamoeba histolytica
RASEKNK

SEQ ID NO: 2651549 - protein, 6 aa, Entamoeba histolytica
RASEMV

SEQ ID NO: 2651550 - protein, 7 aa, Entamoeba histolytica
RASFGDN

SEQ ID NO: 2651551 - protein, 6 aa, Entamoeba histolytica
RASGIS

SEQ ID NO: 2651552 - protein, 6 aa, Entamoeba histolytica
RASGNP

SEQ ID NO: 2651553 - protein, 9 aa, Entamoeba histolytica
RASKEKSRL

SEQ ID NO: 2651554 - protein, 10 aa, Entamoeba histolytica
RASPENEKTP

SEQ ID NO: 2651555 - protein, 8 aa, Entamoeba histolytica
RASPQVPY

SEQ ID NO: 2651556 - protein, 29 aa, Entamoeba histolytica
RASPRKAAEAKAKEEAEAKKIQEENEKKI

SEQ ID NO: 2651557 - protein, 7 aa, Entamoeba histolytica
RASPTMG

SEQ ID NO: 2651558 - protein, 11 aa, Entamoeba histolytica
RASRNVRAECN

SEQ ID NO: 2651559 - protein, 11 aa, Entamoeba histolytica
RASSTLRKSAK

SEQ ID NO: 2651560 - protein, 11 aa, Entamoeba histolytica
RASTERDSAQQ

SEQ ID NO: 2651561 - protein, 9 aa, Entamoeba histolytica
RASVGSRND

SEQ ID NO: 2651562 - protein, 11 aa, Entamoeba histolytica
RATADASQIRS

SEQ ID NO: 2651563 - protein, 8 aa, Entamoeba histolytica
RATDGYTG

SEQ ID NO: 2651564 - protein, 5 aa, Entamoeba histolytica
RATNE

SEQ ID NO: 2651565 - protein, 5 aa, Entamoeba histolytica
RATNP

SEQ ID NO: 2651566 - protein, 4 aa, Entamoeba histolytica
RATQ

SEQ ID NO: 2651567 - protein, 5 aa, Entamoeba histolytica
RATSI

SEQ ID NO: 2651568 - protein, 9 aa, Entamoeba histolytica
RATSTSKEW

SEQ ID NO: 2651569 - protein, 5 aa, Entamoeba histolytica
RATWD

SEQ ID NO: 2651570 - protein, 8 aa, Entamoeba histolytica
RAVSKEDA

SEQ ID NO: 2651571 - protein, 12 aa, Entamoeba histolytica
RAVVKDQSSIEE

SEQ ID NO: 2651572 - protein, 6 aa, Entamoeba histolytica
RAYPDT

SEQ ID NO: 2651573 - protein, 13 aa, Entamoeba histolytica
RCDNGKKNFPENL

SEQ ID NO: 2651574 - protein, 10 aa, Entamoeba histolytica
RCDQPKPKIN

SEQ ID NO: 2651575 - protein, 9 aa, Entamoeba histolytica
RCDSPSSPI

SEQ ID NO: 2651576 - protein, 6 aa, Entamoeba histolytica
RCEAKS

SEQ ID NO: 2651577 - protein, 5 aa, Entamoeba histolytica
RCERD

SEQ ID NO: 2651578 - protein, 5 aa, Entamoeba histolytica
RCERG

SEQ ID NO: 2651579 - protein, 11 aa, Entamoeba histolytica
RCESDSEIISE

SEQ ID NO: 2651580 - protein, 8 aa, Entamoeba histolytica
RCKGGLND

SEQ ID NO: 2651581 - protein, 16 aa, Entamoeba histolytica
RCKNCGSSEHTTKDCL

SEQ ID NO: 2651582 - protein, 15 aa, Entamoeba histolytica
RCKNPGMCLSLFSFS

SEQ ID NO: 2651583 - protein, 8 aa, Entamoeba histolytica
RCKQREKF

SEQ ID NO: 2651584 - protein, 5 aa, Entamoeba histolytica
RCKRA

SEQ ID NO: 2651585 - protein, 11 aa, Entamoeba histolytica
RCNAEGNDKEM

SEQ ID NO: 2651586 - protein, 7 aa, Entamoeba histolytica
RCNESSE

SEQ ID NO: 2651587 - protein, 8 aa, Entamoeba histolytica
RCQTNTKE

SEQ ID NO: 2651588 - protein, 5 aa, Entamoeba histolytica
RCSEF

SEQ ID NO: 2651589 - protein, 6 aa, Entamoeba histolytica
RCSKEE

SEQ ID NO: 2651590 - protein, 7 aa, Entamoeba histolytica
RCSKTNN

SEQ ID NO: 2651591 - protein, 5 aa, Entamoeba histolytica
RCSKV

SEQ ID NO: 2651592 - protein, 8 aa, Entamoeba histolytica
RCSNCNKD

SEQ ID NO: 2651593 - protein, 5 aa, Entamoeba histolytica
RCSSE

SEQ ID NO: 2651594 - protein, 33 aa, Entamoeba histolytica
RCSTVERGVNKRQESEEREKKNRSTKPKRNSRR

SEQ ID NO: 2651595 - protein, 9 aa, Entamoeba histolytica
RCTTSEVGE

SEQ ID NO: 2651596 - protein, 11 aa, Entamoeba histolytica
RCTTTTNTPLA

SEQ ID NO: 2651597 - protein, 11 aa, Entamoeba histolytica
RCVTGSSDKSI

SEQ ID NO: 2651598 - protein, 11 aa, Entamoeba histolytica
RCVTGSSDKSM

SEQ ID NO: 2651599 - protein, 6 aa, Entamoeba histolytica
RDAARY

SEQ ID NO: 2651600 - protein, 5 aa, Entamoeba histolytica
RDAED

SEQ ID NO: 2651601 - protein, 12 aa, Entamoeba histolytica
RDCKRSGQGETD

SEQ ID NO: 2651602 - protein, 4 aa, Entamoeba histolytica
RDCN

SEQ ID NO: 2651603 - protein, 29 aa, Entamoeba histolytica
RDCPNKNEKKEKKGGIKRKTKEQKQDPKH

SEQ ID NO: 2651604 - protein, 16 aa, Entamoeba histolytica
RDCPNNPKGIYPQGGG

SEQ ID NO: 2651605 - protein, 7 aa, Entamoeba histolytica
RDCQKEE

SEQ ID NO: 2651606 - protein, 9 aa, Entamoeba histolytica
RDDAASSFK

SEQ ID NO: 2651607 - protein, 5 aa, Entamoeba histolytica
RDDCL

SEQ ID NO: 2651608 - protein, 13 aa, Entamoeba histolytica
RDDEATVPEKYHT

SEQ ID NO: 2651609 - protein, 8 aa, Entamoeba histolytica
RDDFGDTI

SEQ ID NO: 2651610 - protein, 15 aa, Entamoeba histolytica
RDDFGSSDKDTAYEG

SEQ ID NO: 2651611 - protein, 5 aa, Entamoeba histolytica
RDDFS

SEQ ID NO: 2651612 - protein, 7 aa, Entamoeba histolytica
RDDGTVE

SEQ ID NO: 2651613 - protein, 10 aa, Entamoeba histolytica
RDDIRQENNA

SEQ ID NO: 2651614 - protein, 7 aa, Entamoeba histolytica
RDDKPST

SEQ ID NO: 2651615 - protein, 5 aa, Entamoeba histolytica
RDDLQ

SEQ ID NO: 2651616 - protein, 6 aa, Entamoeba histolytica
RDDPVP

SEQ ID NO: 2651617 - protein, 13 aa, Entamoeba histolytica
RDDREEHDRQREE

SEQ ID NO: 2651618 - protein, 16 aa, Entamoeba histolytica
RDDRELARKELSKPKK

SEQ ID NO: 2651619 - protein, 5 aa, Entamoeba histolytica
RDDSI

SEQ ID NO: 2651620 - protein, 33 aa, Entamoeba histolytica; identical to SEQ ID NO: 2456538

SEQ ID NO: 2651621 - protein, 5 aa, Entamoeba histolytica
RDDTT

SEQ ID NO: 2651622 - protein, 26 aa, Entamoeba histolytica
RDEDEKKIKPMEEENKVLENKNEVPV

SEQ ID NO: 2651623 - protein, 7 aa, Entamoeba histolytica
RDEDLPK

SEQ ID NO: 2651624 - protein, 30 aa, Entamoeba histolytica
RDEEEDDQFDEEKEKRERARDERRREREEF

SEQ ID NO: 2651625 - protein, 4 aa, Entamoeba histolytica
RDEF

SEQ ID NO: 2651626 - protein, 4 aa, Entamoeba histolytica
RDEI

SEQ ID NO: 2651627 - protein, 5 aa, Entamoeba histolytica
RDEIE

SEQ ID NO: 2651628 - protein, 7 aa, Entamoeba histolytica
RDEKELS

SEQ ID NO: 2651629 - protein, 6 aa, Entamoeba histolytica
RDEKVR

SEQ ID NO: 2651630 - protein, 8 aa, Entamoeba histolytica
RDENGAKR

SEQ ID NO: 2651631 - protein, 7 aa, Entamoeba histolytica
RDENGIR

SEQ ID NO: 2651632 - protein, 7 aa, Entamoeba histolytica
RDENNTI

SEQ ID NO: 2651633 - protein, 6 aa, Entamoeba histolytica
RDENQK

SEQ ID NO: 2651634 - protein, 5 aa, Entamoeba histolytica
RDENV

SEQ ID NO: 2651635 - protein, 21 aa, Entamoeba histolytica
RDEQDKQTQKDYEESVKRVEE

SEQ ID NO: 2651636 - protein, 12 aa, Entamoeba histolytica
RDEQDNGLFHYI

SEQ ID NO: 2651637 - protein, 7 aa, Entamoeba histolytica
RDEQPNS

SEQ ID NO: 2651638 - protein, 9 aa, Entamoeba histolytica
RDERDEMKK

SEQ ID NO: 2651639 - protein, 7 aa, Entamoeba histolytica
RDETKAI

SEQ ID NO: 2651640 - protein, 7 aa, Entamoeba histolytica
RDEYEME

SEQ ID NO: 2651641 - protein, 12 aa, Entamoeba histolytica
RDFENASDNYLR

SEQ ID NO: 2651642 - protein, 11 aa, Entamoeba histolytica
RDFNEKERLDK

SEQ ID NO: 2651643 - protein, 8 aa, Entamoeba histolytica
RDFTKTTG

SEQ ID NO: 2651644 - protein, 4 aa, Entamoeba histolytica
RDGA

SEQ ID NO: 2651645 - protein, 9 aa, Entamoeba histolytica
RDGDPDADV

SEQ ID NO: 2651646 - protein, 13 aa, Entamoeba histolytica
RDGELKPGQKGIS

SEQ ID NO: 2651647 - protein, 7 aa, Entamoeba histolytica
RDGICTE

SEQ ID NO: 2651648 - protein, 15 aa, Entamoeba histolytica
RDGKYLASSSEDGTL

SEQ ID NO: 2651649 - protein, 5 aa, Entamoeba histolytica
RDGPN

SEQ ID NO: 2651650 - protein, 4 aa, Entamoeba histolytica
RDGQ

SEQ ID NO: 2651651 - protein, 7 aa, Entamoeba histolytica
RDGQKKK

SEQ ID NO: 2651652 - protein, 6 aa, Entamoeba histolytica
RDGSKY

SEQ ID NO: 2651653 - protein, 8 aa, Entamoeba histolytica
RDGSSGGI

SEQ ID NO: 2651654 - protein, 10 aa, Entamoeba histolytica
RDGTAPSPDD

SEQ ID NO: 2651655 - protein, 9 aa, Entamoeba histolytica
RDGYESDRS

SEQ ID NO: 2651656 - protein, 4 aa, Entamoeba histolytica
RDIE

SEQ ID NO: 2651657 - protein, 5 aa, Entamoeba histolytica
RDIEE

SEQ ID NO: 2651658 - protein, 19 aa, Entamoeba histolytica
RDINSRNSFKINERKQLRE

SEQ ID NO: 2651659 - protein, 16 aa, Entamoeba histolytica
RDITEEEKEKREQKNK

SEQ ID NO: 2651660 - protein, 8 aa, Entamoeba histolytica
RDKDIGEE

SEQ ID NO: 2651661 - protein, 12 aa, Entamoeba histolytica
RDKDIMPKDPDY

SEQ ID NO: 2651662 - protein, 7 aa, Entamoeba histolytica
RDKEEKV

SEQ ID NO: 2651663 - protein, 5 aa, Entamoeba histolytica
RDKEI

SEQ ID NO: 2651664 - protein, 8 aa, Entamoeba histolytica
RDKENTTL

SEQ ID NO: 2651665 - protein, 5 aa, Entamoeba histolytica
RDKIK

SEQ ID NO: 2651666 - protein, 9 aa, Entamoeba histolytica
RDKIRKERK

SEQ ID NO: 2651667 - protein, 37 aa, Entamoeba histolytica; identical to SEQ ID NO: 2456589

SEQ ID NO: 2651668 - protein, 8 aa, Entamoeba histolytica
RDKNQINH

SEQ ID NO: 2651669 - protein, 8 aa, Entamoeba histolytica
RDKPSEEH

SEQ ID NO: 2651670 - protein, 14 aa, Entamoeba histolytica
RDKQVEAEEKKPIL

SEQ ID NO: 2651671 - protein, 9 aa, Entamoeba histolytica
RDKRKNSIY

SEQ ID NO: 2651672 - protein, 6 aa, Entamoeba histolytica
RDKRTF

SEQ ID NO: 2651673 - protein, 4 aa, Entamoeba histolytica
RDKT

SEQ ID NO: 2651674 - protein, 8 aa, Entamoeba histolytica
RDKTRAGL

SEQ ID NO: 2651675 - protein, 22 aa, Entamoeba histolytica
RDKVSSALEPMKSQDCFIGNMD

SEQ ID NO: 2651676 - protein, 7 aa, Entamoeba histolytica
RDLDARK

SEQ ID NO: 2651677 - protein, 5 aa, Entamoeba histolytica
RDLDT

SEQ ID NO: 2651678 - protein, 7 aa, Entamoeba histolytica
RDLNTGK

SEQ ID NO: 2651679 - protein, 14 aa, Entamoeba histolytica
RDLQANETGQLTPL

SEQ ID NO: 2651680 - protein, 9 aa, Entamoeba histolytica
RDLQEKQDD

SEQ ID NO: 2651681 - protein, 4 aa, Entamoeba histolytica
RDLR

SEQ ID NO: 2651682 - protein, 4 aa, Entamoeba histolytica
RDMN

SEQ ID NO: 2651683 - protein, 7 aa, Entamoeba histolytica
RDNADKK

SEQ ID NO: 2651684 - protein, 5 aa, Entamoeba histolytica
RDNDS

SEQ ID NO: 2651685 - protein, 6 aa, Entamoeba histolytica
RDNENC

SEQ ID NO: 2651686 - protein, 5 aa, Entamoeba histolytica
RDNES

SEQ ID NO: 2651687 - protein, 11 aa, Entamoeba histolytica
RDNGAKKNIAE

SEQ ID NO: 2651688 - protein, 12 aa, Entamoeba histolytica
RDNGAKSESSWE

SEQ ID NO: 2651689 - protein, 5 aa, Entamoeba histolytica
RDNGS

SEQ ID NO: 2651690 - protein, 6 aa, Entamoeba histolytica
RDNGSA

SEQ ID NO: 2651691 - protein, 6 aa, Entamoeba histolytica
RDNINT

SEQ ID NO: 2651692 - protein, 15 aa, Entamoeba histolytica
RDNLSKREKEYQNNI

SEQ ID NO: 2651693 - protein, 6 aa, Entamoeba histolytica
RDNNDV

SEQ ID NO: 2651694 - protein, 5 aa, Entamoeba histolytica
RDNNF

SEQ ID NO: 2651695 - protein, 10 aa, Entamoeba histolytica
RDNPNVKSMR

SEQ ID NO: 2651696 - protein, 8 aa, Entamoeba histolytica
RDNPSSTI

SEQ ID NO: 2651697 - protein, 7 aa, Entamoeba histolytica
RDNSKRD

SEQ ID NO: 2651698 - protein, 11 aa, Entamoeba histolytica
RDNSNEEQGVN

SEQ ID NO: 2651699 - protein, 5 aa, Entamoeba histolytica
RDNSQ

SEQ ID NO: 2651700 - protein, 6 aa, Entamoeba histolytica
RDNVDS

SEQ ID NO: 2651701 - protein, 4 aa, Entamoeba histolytica
RDNY

SEQ ID NO: 2651702 - protein, 7 aa, Entamoeba histolytica
RDPASPF

SEQ ID NO: 2651703 - protein, 18 aa, Entamoeba histolytica
RDPEEEINGEKEQISEPV

SEQ ID NO: 2651704 - protein, 8 aa, Entamoeba histolytica
RDPGTGEN

SEQ ID NO: 2651705 - protein, 7 aa, Entamoeba histolytica
RDPGYQS

SEQ ID NO: 2651706 - protein, 7 aa, Entamoeba histolytica
RDPHGNV

SEQ ID NO: 2651707 - protein, 13 aa, Entamoeba histolytica
RDPMGTRSKHVEE

SEQ ID NO: 2651708 - protein, 4 aa, Entamoeba histolytica
RDPR

SEQ ID NO: 2651709 - protein, 21 aa, Entamoeba histolytica
RDPRRLQEKEETTMENEEPKR

SEQ ID NO: 2651710 - protein, 6 aa, Entamoeba histolytica
RDPSSF

SEQ ID NO: 2651711 - protein, 7 aa, Entamoeba histolytica
RDPSSLP

SEQ ID NO: 2651712 - protein, 8 aa, Entamoeba histolytica
RDPSSPIP

SEQ ID NO: 2651713 - protein, 10 aa, Entamoeba histolytica
RDPTKRPQIS

SEQ ID NO: 2651714 - protein, 12 aa, Entamoeba histolytica
RDQEEPNNSQSK

SEQ ID NO: 2651715 - protein, 10 aa, Entamoeba histolytica
RDQKKKVEDI

SEQ ID NO: 2651716 - protein, 12 aa, Entamoeba histolytica
RDQPYMTRGRQR

SEQ ID NO: 2651717 - protein, 12 aa, Entamoeba histolytica
RDQRTQELKDKL

SEQ ID NO: 2651718 - protein, 5 aa, Entamoeba histolytica
RDQTG

SEQ ID NO: 2651719 - protein, 8 aa, Entamoeba histolytica
RDQTNNSK

SEQ ID NO: 2651720 - protein, 6 aa, Entamoeba histolytica
RDQYKT

SEQ ID NO: 2651721 - protein, 10 aa, Entamoeba histolytica
RDRISNQHKG

SEQ ID NO: 2651722 - protein, 12 aa, Entamoeba histolytica
RDRLTMSSDQPS

SEQ ID NO: 2651723 - protein, 6 aa, Entamoeba histolytica
RDRRKQ

SEQ ID NO: 2651724 - protein, 7 aa, Entamoeba histolytica
RDRSAAA

SEQ ID NO: 2651725 - protein, 7 aa, Entamoeba histolytica
RDRSGTL

SEQ ID NO: 2651726 - protein, 61 aa, Entamoeba histolytica
RDRSKTSLGSDDGHRHHSTRDRSSTLEKPERTPSTPEERKARREAREAREKERAARRAKGE

SEQ ID NO: 2651727 - protein, 19 aa, Entamoeba histolytica
RDRYENDDCYSPRERSPNN

SEQ ID NO: 2651728 - protein, 9 aa, Entamoeba histolytica
RDRYSEKYG

SEQ ID NO: 2651729 - protein, 9 aa, Entamoeba histolytica
RDSEINGKP

SEQ ID NO: 2651730 - protein, 4 aa, Entamoeba histolytica
RDSF

SEQ ID NO: 2651731 - protein, 5 aa, Entamoeba histolytica
RDSGA

SEQ ID NO: 2651732 - protein, 10 aa, Entamoeba histolytica
RDSKNQQTCK

SEQ ID NO: 2651733 - protein, 18 aa, Entamoeba histolytica
RDSKTNPKGFSKNDPTIK

SEQ ID NO: 2651734 - protein, 6 aa, Entamoeba histolytica
RDSLQK

SEQ ID NO: 2651735 - protein, 6 aa, Entamoeba histolytica
RDSQNK

SEQ ID NO: 2651736 - protein, 13 aa, Entamoeba histolytica
RDSREDPKRLEKR

SEQ ID NO: 2651737 - protein, 7 aa, Entamoeba histolytica
RDSSEDI

SEQ ID NO: 2651738 - protein, 5 aa, Entamoeba histolytica
RDSTD

SEQ ID NO: 2651739 - protein, 16 aa, Entamoeba histolytica
RDTEELKENHKKTMAR

SEQ ID NO: 2651740 - protein, 5 aa, Entamoeba histolytica
RDTGD

SEQ ID NO: 2651741 - protein, 7 aa, Entamoeba histolytica
RDTGTTN

SEQ ID NO: 2651742 - protein, 9 aa, Entamoeba histolytica
RDTKADKAI

SEQ ID NO: 2651743 - protein, 9 aa, Entamoeba histolytica
RDTKFNLNG

SEQ ID NO: 2651744 - protein, 9 aa, Entamoeba histolytica
RDTKRSPRE

SEQ ID NO: 2651745 - protein, 6 aa, Entamoeba histolytica
RDTPTS

SEQ ID NO: 2651746 - protein, 14 aa, Entamoeba histolytica
RDTQQTTSSEEGFV

SEQ ID NO: 2651747 - protein, 9 aa, Entamoeba histolytica
RDTSKYGEF

SEQ ID NO: 2651748 - protein, 7 aa, Entamoeba histolytica
RDTTGAT

SEQ ID NO: 2651749 - protein, 8 aa, Entamoeba histolytica
RDVAPDSG

SEQ ID NO: 2651750 - protein, 5 aa, Entamoeba histolytica
RDVNG

SEQ ID NO: 2651751 - protein, 5 aa, Entamoeba histolytica
RDYEG

SEQ ID NO: 2651752 - protein, 7 aa, Entamoeba histolytica
REAAALD

SEQ ID NO: 2651753 - protein, 10 aa, Entamoeba histolytica
READEDTKQV

SEQ ID NO: 2651754 - protein, 9 aa, Entamoeba histolytica
READTPFDQ

SEQ ID NO: 2651755 - protein, 17 aa, Entamoeba histolytica
REAEEKKKQEELERKNE

SEQ ID NO: 2651756 - protein, 20 aa, Entamoeba histolytica
REAEERRKRENGIKDPEPEF

SEQ ID NO: 2651757 - protein, 37 aa, Entamoeba histolytica
REAERLRQEAARLKEEEERLKQEAERLKKEKEETERF

SEQ ID NO: 2651758 - protein, 8 aa, Entamoeba histolytica
REAGLESS

SEQ ID NO: 2651759 - protein, 8 aa, Entamoeba histolytica
REAKDDQE

SEQ ID NO: 2651760 - protein, 7 aa, Entamoeba histolytica
REAKERI

SEQ ID NO: 2651761 - protein, 7 aa, Entamoeba histolytica
REANFEQ

SEQ ID NO: 2651762 - protein, 4 aa, Entamoeba histolytica
REAQ

SEQ ID NO: 2651763 - protein, 13 aa, Entamoeba histolytica
REARSNGMNPRQE

SEQ ID NO: 2651764 - protein, 4 aa, Entamoeba histolytica
RECQ

SEQ ID NO: 2651765 - protein, 9 aa, Entamoeba histolytica
REDDRSHNP

SEQ ID NO: 2651766 - protein, 8 aa, Entamoeba histolytica
REDDTSLE

SEQ ID NO: 2651767 - protein, 5 aa, Entamoeba histolytica
REDEL

SEQ ID NO: 2651768 - protein, 18 aa, Entamoeba histolytica
REDERDKIYREKQRFGDP

SEQ ID NO: 2651769 - protein, 6 aa, Entamoeba histolytica
REDETM

SEQ ID NO: 2651770 - protein, 6 aa, Entamoeba histolytica
REDGWI

SEQ ID NO: 2651771 - protein, 4 aa, Entamoeba histolytica
REDI

SEQ ID NO: 2651772 - protein, 8 aa, Entamoeba histolytica
REDIEQHK

SEQ ID NO: 2651773 - protein, 9 aa, Entamoeba histolytica
REDKTHSDA

SEQ ID NO: 2651774 - protein, 4 aa, Entamoeba histolytica
REDL

SEQ ID NO: 2651775 - protein, 5 aa, Entamoeba histolytica
REDNL

SEQ ID NO: 2651776 - protein, 5 aa, Entamoeba histolytica
REDNN

SEQ ID NO: 2651777 - protein, 18 aa, Entamoeba histolytica
REDSLKKEEEEKEKDFLE

SEQ ID NO: 2651778 - protein, 5 aa, Entamoeba histolytica
REDTI

SEQ ID NO: 2651779 - protein, 17 aa, Entamoeba histolytica
REDTTKIKEEKEEEEHL

SEQ ID NO: 2651780 - protein, 4 aa, Entamoeba histolytica
REDV

SEQ ID NO: 2651781 - protein, 7 aa, Entamoeba histolytica
REDVEKD

SEQ ID NO: 2651782 - protein, 4 aa, Entamoeba histolytica
REDW

SEQ ID NO: 2651783 - protein, 5 aa, Entamoeba histolytica
REDYN

SEQ ID NO: 2651784 - protein, 20 aa, Entamoeba histolytica
REEAEKRKKEEAQEEEEENE

SEQ ID NO: 2651785 - protein, 6 aa, Entamoeba histolytica
REEAHG

SEQ ID NO: 2651786 - protein, 23 aa, Entamoeba histolytica
REEDRVATPPTRSGGGDDGTDDL

SEQ ID NO: 2651787 - protein, 6 aa, Entamoeba histolytica
REEDVA

SEQ ID NO: 2651788 - protein, 25 aa, Entamoeba histolytica
REEEKIKEEERQKNEEKKKQREKEE

SEQ ID NO: 2651789 - protein, 62 aa, Entamoeba histolytica
REEESKKKESINPTPNNTKPVETKIEEPQGIVSTDKPNDTKVKEEIKKEGMPPARKKRPPPL

SEQ ID NO: 2651790 - protein, 6 aa, Entamoeba histolytica
REEEST

SEQ ID NO: 2651791 - protein, 12 aa, Entamoeba histolytica
REEFEEQCQKDG

SEQ ID NO: 2651792 - protein, 4 aa, Entamoeba histolytica
REEG

SEQ ID NO: 2651793 - protein, 4 aa, Entamoeba histolytica
REEI

SEQ ID NO: 2651794 - protein, 7 aa, Entamoeba histolytica
REEIDNA

SEQ ID NO: 2651795 - protein, 19 aa, Entamoeba histolytica
REEIGKNYEEIKGNKGELE

SEQ ID NO: 2651796 - protein, 7 aa, Entamoeba histolytica
REEIGNN

SEQ ID NO: 2651797 - protein, 12 aa, Entamoeba histolytica
REEIKKGSNIND

SEQ ID NO: 2651798 - protein, 8 aa, Entamoeba histolytica
REEKRDKE

SEQ ID NO: 2651799 - protein, 12 aa, Entamoeba histolytica
REELKQEGVSGN

SEQ ID NO: 2651800 - protein, 6 aa, Entamoeba histolytica
REEPLQ

SEQ ID NO: 2651801 - protein, 8 aa, Entamoeba histolytica
REEPYNSR

SEQ ID NO: 2651802 - protein, 13 aa, Entamoeba histolytica
REEQTNCEEKKEN

SEQ ID NO: 2651803 - protein, 5 aa, Entamoeba histolytica
REERH

SEQ ID NO: 2651804 - protein, 16 aa, Entamoeba histolytica
REERRDITRAEKAERM

SEQ ID NO: 2651805 - protein, 4 aa, Entamoeba histolytica
REES

SEQ ID NO: 2651806 - protein, 7 aa, Entamoeba histolytica
REESANK

SEQ ID NO: 2651807 - protein, 5 aa, Entamoeba histolytica
REESD

SEQ ID NO: 2651808 - protein, 4 aa, Entamoeba histolytica
REET

SEQ ID NO: 2651809 - protein, 17 aa, Entamoeba histolytica
REEVGDIPSENLKNKTK

SEQ ID NO: 2651810 - protein, 7 aa, Entamoeba histolytica
REEVGKE

SEQ ID NO: 2651811 - protein, 4 aa, Entamoeba histolytica
REEW

SEQ ID NO: 2651812 - protein, 5 aa, Entamoeba histolytica
REEYP

SEQ ID NO: 2651813 - protein, 5 aa, Entamoeba histolytica
REFPE

SEQ ID NO: 2651814 - protein, 9 aa, Entamoeba histolytica
REFRNAQTI

SEQ ID NO: 2651815 - protein, 4 aa, Entamoeba histolytica
REGE

SEQ ID NO: 2651816 - protein, 5 aa, Entamoeba histolytica
REGEE

SEQ ID NO: 2651817 - protein, 17 aa, Entamoeba histolytica
REGEKSEEHLPGKKGCT

SEQ ID NO: 2651818 - protein, 6 aa, Entamoeba histolytica
REGENI

SEQ ID NO: 2651819 - protein, 10 aa, Entamoeba histolytica
REGEPPRREE

SEQ ID NO: 2651820 - protein, 18 aa, Entamoeba histolytica
REGERARYQPHADDPNRQ

SEQ ID NO: 2651821 - protein, 14 aa, Entamoeba histolytica
REGKDNMSVIVVSF

SEQ ID NO: 2651822 - protein, 9 aa, Entamoeba histolytica
REGKQNEMK

SEQ ID NO: 2651823 - protein, 9 aa, Entamoeba histolytica
REGKSKTFA

SEQ ID NO: 2651824 - protein, 10 aa, Entamoeba histolytica
REGLKTQGTI

SEQ ID NO: 2651825 - protein, 6 aa, Entamoeba histolytica
REGPVG

SEQ ID NO: 2651826 - protein, 5 aa, Entamoeba histolytica
REGRD

SEQ ID NO: 2651827 - protein, 7 aa, Entamoeba histolytica
REGRVSY

SEQ ID NO: 2651828 - protein, 5 aa, Entamoeba histolytica
REGSK

SEQ ID NO: 2651829 - protein, 7 aa, Entamoeba histolytica
REGSSNI

SEQ ID NO: 2651830 - protein, 6 aa, Entamoeba histolytica
REGSSY

SEQ ID NO: 2651831 - protein, 6 aa, Entamoeba histolytica
REHKQE

SEQ ID NO: 2651832 - protein, 7 aa, Entamoeba histolytica
REHNSAM

SEQ ID NO: 2651833 - protein, 18 aa, Entamoeba histolytica
REHSEEKKVDLEETEELS

SEQ ID NO: 2651834 - protein, 12 aa, Entamoeba histolytica
REIDPDQTVARG

SEQ ID NO: 2651835 - protein, 11 aa, Entamoeba histolytica
REINDKFDDNA

SEQ ID NO: 2651836 - protein, 7 aa, Entamoeba histolytica
REIPKEK

SEQ ID NO: 2651837 - protein, 6 aa, Entamoeba histolytica
REIQAG

SEQ ID NO: 2651838 - protein, 9 aa, Entamoeba histolytica
REIQPDEDE

SEQ ID NO: 2651839 - protein, 22 aa, Entamoeba histolytica
REIREKKTGRSIGTDKAGSSLF

SEQ ID NO: 2651840 - protein, 5 aa, Entamoeba histolytica
REISP

SEQ ID NO: 2651841 - protein, 4 aa, Entamoeba histolytica
REIT

SEQ ID NO: 2651842 - protein, 14 aa, Entamoeba histolytica
REITRESKRLEREE

SEQ ID NO: 2651843 - protein, 6 aa, Entamoeba histolytica
REITSN

SEQ ID NO: 2651844 - protein, 10 aa, Entamoeba histolytica
REITTGSSDN

SEQ ID NO: 2651845 - protein, 4 aa, Entamoeba histolytica
REKE

SEQ ID NO: 2651846 - protein, 5 aa, Entamoeba histolytica
REKED

SEQ ID NO: 2651847 - protein, 16 aa, Entamoeba histolytica
REKEDEKVLSKDQTPL

SEQ ID NO: 2651848 - protein, 32 aa, Entamoeba histolytica
REKEELPDDAEELLKSTKEDFDKEEDEIDPEI

SEQ ID NO: 2651849 - protein, 10 aa, Entamoeba histolytica
REKEEQEELE

SEQ ID NO: 2651850 - protein, 25 aa, Entamoeba histolytica
REKELKEELGNVNNEIDAVKEEKRE

SEQ ID NO: 2651851 - protein, 8 aa, Entamoeba histolytica
REKENTVK

SEQ ID NO: 2651852 - protein, 12 aa, Entamoeba histolytica
REKEYQGEMEED

SEQ ID NO: 2651853 - protein, 19 aa, Entamoeba histolytica
REKKKNEKEMKDNKTLAQK

SEQ ID NO: 2651854 - protein, 9 aa, Entamoeba histolytica
REKKNDNVQ

SEQ ID NO: 2651855 - protein, 77 aa, Entamoeba histolytica
REKLEEKAKELIESERRSETRKSLVEESKIEREKMKERIKERWSEEEIKPRNERLSEKRKRDRKDEIPEDNEIKKKT

SEQ ID NO: 2651856 - protein, 7 aa, Entamoeba histolytica
REKNPDA

SEQ ID NO: 2651857 - protein, 8 aa, Entamoeba histolytica
REKPGKTT

SEQ ID NO: 2651858 - protein, 17 aa, Entamoeba histolytica
REKRENRKHEQCKPKKN

SEQ ID NO: 2651859 - protein, 12 aa, Entamoeba histolytica
REKRGIGISDND

SEQ ID NO: 2651860 - protein, 22 aa, Entamoeba histolytica
REKRIEQMKEKKKQIKKEWSSN

SEQ ID NO: 2651861 - protein, 6 aa, Entamoeba histolytica
REKRQK

SEQ ID NO: 2651862 - protein, 64 aa, Entamoeba histolytica
REKSKEKLTMKKSETTASQHQLPTPVGGFKKPSEIKKATPSKTTSTQHPLKPSPYNQNNTPQRP

SEQ ID NO: 2651863 - protein, 5 aa, Entamoeba histolytica
REKTT

SEQ ID NO: 2651864 - protein, 5 aa, Entamoeba histolytica
REKVE

SEQ ID NO: 2651865 - protein, 5 aa, Entamoeba histolytica
REKYS

SEQ ID NO: 2651866 - protein, 6 aa, Entamoeba histolytica
RELDEA

SEQ ID NO: 2651867 - protein, 4 aa, Entamoeba histolytica
RELE

SEQ ID NO: 2651868 - protein, 5 aa, Entamoeba histolytica
RELEK

SEQ ID NO: 2651869 - protein, 64 aa, Entamoeba histolytica
RELEQEQHKNEENTTINKEEQINTEQEKLKEPIKTNEINNNESVESSQITKKELDSDEEQKELE

SEQ ID NO: 2651870 - protein, 9 aa, Entamoeba histolytica
RELERSGKL

SEQ ID NO: 2651871 - protein, 22 aa, Entamoeba histolytica
RELHQPQQKLNETEEKKKRCLL

SEQ ID NO: 2651872 - protein, 10 aa, Entamoeba histolytica
RELNENSPEI

SEQ ID NO: 2651873 - protein, 12 aa, Entamoeba histolytica
RELTSSKFSASI

SEQ ID NO: 2651874 - protein, 41 aa, Entamoeba histolytica
REMDQSDDDFESSNDHLHEETDGEDINDDNIMSEDEGDDNY

SEQ ID NO: 2651875 - protein, 8 aa, Entamoeba histolytica
REMKEESK

SEQ ID NO: 2651876 - protein, 10 aa, Entamoeba histolytica
REMKNLESYQ

SEQ ID NO: 2651877 - protein, 10 aa, Entamoeba histolytica
REMKQASDNY

SEQ ID NO: 2651878 - protein, 5 aa, Entamoeba histolytica
REMND

SEQ ID NO: 2651879 - protein, 12 aa, Entamoeba histolytica
REMTDKDKDHYQ

SEQ ID NO: 2651880 - protein, 5 aa, Entamoeba histolytica
RENAP

SEQ ID NO: 2651881 - protein, 12 aa, Entamoeba histolytica
RENDEKKELELA

SEQ ID NO: 2651882 - protein, 20 aa, Entamoeba histolytica
RENDNTEQLTESSKRKTSKL

SEQ ID NO: 2651883 - protein, 12 aa, Entamoeba histolytica
RENEEKIEGGKI

SEQ ID NO: 2651884 - protein, 8 aa, Entamoeba histolytica
RENEENEA

SEQ ID NO: 2651885 - protein, 8 aa, Entamoeba histolytica
RENEEPSI

SEQ ID NO: 2651886 - protein, 6 aa, Entamoeba histolytica
RENENG

SEQ ID NO: 2651887 - protein, 7 aa, Entamoeba histolytica
RENGIEY

SEQ ID NO: 2651888 - protein, 8 aa, Entamoeba histolytica
RENGMGDD

SEQ ID NO: 2651889 - protein, 14 aa, Entamoeba histolytica
RENGNKKVSDSYLS

SEQ ID NO: 2651890 - protein, 6 aa, Entamoeba histolytica
RENGTM

SEQ ID NO: 2651891 - protein, 13 aa, Entamoeba histolytica
RENLTESNEETNH

SEQ ID NO: 2651892 - protein, 6 aa, Entamoeba histolytica
RENNET

SEQ ID NO: 2651893 - protein, 5 aa, Entamoeba histolytica
RENPT

SEQ ID NO: 2651894 - protein, 7 aa, Entamoeba histolytica
RENPTNI

SEQ ID NO: 2651895 - protein, 5 aa, Entamoeba histolytica
RENQN

SEQ ID NO: 2651896 - protein, 11 aa, Entamoeba histolytica
RENSKRETPLT

SEQ ID NO: 2651897 - protein, 10 aa, Entamoeba histolytica
RENTVGKRKK

SEQ ID NO: 2651898 - protein, 17 aa, Entamoeba histolytica
RENVREKGSRGKGMSTL

SEQ ID NO: 2651899 - protein, 16 aa, Entamoeba histolytica
RENVREKGSRGKGMTT

SEQ ID NO: 2651900 - protein, 4 aa, Entamoeba histolytica
REPA

SEQ ID NO: 2651901 - protein, 12 aa, Entamoeba histolytica
REPKYPSTKPIT

SEQ ID NO: 2651902 - protein, 10 aa, Entamoeba histolytica
REPNEEKVKE

SEQ ID NO: 2651903 - protein, 6 aa, Entamoeba histolytica
REPNKY

SEQ ID NO: 2651904 - protein, 27 aa, Entamoeba histolytica
REPPQRQTNVVEKDTSEETRVSKEREE

SEQ ID NO: 2651905 - protein, 8 aa, Entamoeba histolytica
REPPREQQ

SEQ ID NO: 2651906 - protein, 7 aa, Entamoeba histolytica
REPSTEA

SEQ ID NO: 2651907 - protein, 5 aa, Entamoeba histolytica
REPTE

SEQ ID NO: 2651908 - protein, 17 aa, Entamoeba histolytica
REQDRNETSVIQQKSDE

SEQ ID NO: 2651909 - protein, 11 aa, Entamoeba histolytica
REQDSNPGIRD

SEQ ID NO: 2651910 - protein, 6 aa, Entamoeba histolytica
REQEIK

SEQ ID NO: 2651911 - protein, 28 aa, Entamoeba histolytica
REQEQRQEIKEQNKTQDNGIESKKELME

SEQ ID NO: 2651912 - protein, 5 aa, Entamoeba histolytica
REQER

SEQ ID NO: 2651913 - protein, 4 aa, Entamoeba histolytica
REQG

SEQ ID NO: 2651914 - protein, 5 aa, Entamoeba histolytica
REQIK

SEQ ID NO: 2651915 - protein, 11 aa, Entamoeba histolytica
REQKDNFTKEY

SEQ ID NO: 2651916 - protein, 7 aa, Entamoeba histolytica
REQKIRA

SEQ ID NO: 2651917 - protein, 12 aa, Entamoeba histolytica
REQLGTKYNGKE

SEQ ID NO: 2651918 - protein, 6 aa, Entamoeba histolytica
REQLTN

SEQ ID NO: 2651919 - protein, 12 aa, Entamoeba histolytica
REQPPPPLSSRD

SEQ ID NO: 2651920 - protein, 7 aa, Entamoeba histolytica
REQYSKS

SEQ ID NO: 2651921 - protein, 4 aa, Entamoeba histolytica
RERA

SEQ ID NO: 2651922 - protein, 14 aa, Entamoeba histolytica
RERDKTTTINTGDR

SEQ ID NO: 2651923 - protein, 10 aa, Entamoeba histolytica
REREEEKNPI

SEQ ID NO: 2651924 - protein, 26 aa, Entamoeba histolytica
REREEGNFDRDGNYTKFKREDGEKDN

SEQ ID NO: 2651925 - protein, 12 aa, Entamoeba histolytica
REREESQEQEKI

SEQ ID NO: 2651926 - protein, 5 aa, Entamoeba histolytica
RERFG

SEQ ID NO: 2651927 - protein, 10 aa, Entamoeba histolytica
RERKNGKGVG

SEQ ID NO: 2651928 - protein, 6 aa, Entamoeba histolytica
RERPSA

SEQ ID NO: 2651929 - protein, 29 aa, Entamoeba histolytica
RERQNTKISKQVKKQYHKSKSTIAISGPV

SEQ ID NO: 2651930 - protein, 11 aa, Entamoeba histolytica
RERRKKAEYEL

SEQ ID NO: 2651931 - protein, 7 aa, Entamoeba histolytica
RERSKAI

SEQ ID NO: 2651932 - protein, 15 aa, Entamoeba histolytica
RERTKEVRRAKRDEL

SEQ ID NO: 2651933 - protein, 30 aa, Entamoeba histolytica
RESCRTSSSIECETTRDVPRDISREQQRMP

SEQ ID NO: 2651934 - protein, 9 aa, Entamoeba histolytica
RESEQIKPN

SEQ ID NO: 2651935 - protein, 18 aa, Entamoeba histolytica
RESFSKRKERASASMIEN

SEQ ID NO: 2651936 - protein, 7 aa, Entamoeba histolytica
RESGFKE

SEQ ID NO: 2651937 - protein, 7 aa, Entamoeba histolytica
RESGRNE

SEQ ID NO: 2651938 - protein, 18 aa, Entamoeba histolytica
RESGTTGIYNKDGSVNKE

SEQ ID NO: 2651939 - protein, 5 aa, Entamoeba histolytica
RESHN

SEQ ID NO: 2651940 - protein, 5 aa, Entamoeba histolytica
RESKH

SEQ ID NO: 2651941 - protein, 18 aa, Entamoeba histolytica
RESKHSQLKCQEKRDKGL

SEQ ID NO: 2651942 - protein, 10 aa, Entamoeba histolytica
RESKPKPGTL

SEQ ID NO: 2651943 - protein, 7 aa, Entamoeba histolytica
RESKPKQ

SEQ ID NO: 2651944 - protein, 7 aa, Entamoeba histolytica
RESKQSN

SEQ ID NO: 2651945 - protein, 10 aa, Entamoeba histolytica
RESKSGMGRG

SEQ ID NO: 2651946 - protein, 13 aa, Entamoeba histolytica
RESKSKDIAGDEE

SEQ ID NO: 2651947 - protein, 6 aa, Entamoeba histolytica
RESNDY

SEQ ID NO: 2651948 - protein, 10 aa, Entamoeba histolytica
RESNEEKIEE

SEQ ID NO: 2651949 - protein, 8 aa, Entamoeba histolytica
RESNPQYL

SEQ ID NO: 2651950 - protein, 14 aa, Entamoeba histolytica
RESQQDNESIQEEW

SEQ ID NO: 2651951 - protein, 6 aa, Entamoeba histolytica
RESSIV

SEQ ID NO: 2651952 - protein, 10 aa, Entamoeba histolytica
RESSKKITQA

SEQ ID NO: 2651953 - protein, 8 aa, Entamoeba histolytica
RESTATAN

SEQ ID NO: 2651954 - protein, 11 aa, Entamoeba histolytica
RESTLSRDEYR

SEQ ID NO: 2651955 - protein, 4 aa, Entamoeba histolytica
RESV

SEQ ID NO: 2651956 - protein, 4 aa, Entamoeba histolytica
RETC

SEQ ID NO: 2651957 - protein, 8 aa, Entamoeba histolytica
RETEKNID

SEQ ID NO: 2651958 - protein, 75 aa, Entamoeba histolytica
RETEKSEYFSKPTNDDFSDEFEEDDDDDYFDDSNDEDDEDPENEDDFDDQEDDFKLSSSSDDDGEEDDDEPEDEE

SEQ ID NO: 2651959 - protein, 10 aa, Entamoeba histolytica
RETKENEYKG

SEQ ID NO: 2651960 - protein, 9 aa, Entamoeba histolytica
RETKKSKGC

SEQ ID NO: 2651961 - protein, 11 aa, Entamoeba histolytica
RETLKKEYENG

SEQ ID NO: 2651962 - protein, 4 aa, Entamoeba histolytica
RETM

SEQ ID NO: 2651963 - protein, 13 aa, Entamoeba histolytica
RETMSSYEKQRNS

SEQ ID NO: 2651964 - protein, 4 aa, Entamoeba histolytica
RETN

SEQ ID NO: 2651965 - protein, 6 aa, Entamoeba histolytica
RETNEA

SEQ ID NO: 2651966 - protein, 16 aa, Entamoeba histolytica
RETNRKKKERAKNSEC

SEQ ID NO: 2651967 - protein, 8 aa, Entamoeba histolytica
RETNTTYK

SEQ ID NO: 2651968 - protein, 7 aa, Entamoeba histolytica
RETRNST

SEQ ID NO: 2651969 - protein, 8 aa, Entamoeba histolytica
RETSELAK

SEQ ID NO: 2651970 - protein, 39 aa, Entamoeba histolytica
RETSIKHTKRRTNKSHVKKTVKEHESESKKEKVSSIRNN

SEQ ID NO: 2651971 - protein, 10 aa, Entamoeba histolytica
RETTEPVWPQ

SEQ ID NO: 2651972 - protein, 11 aa, Entamoeba histolytica
RETTQGIDPEE

SEQ ID NO: 2651973 - protein, 5 aa, Entamoeba histolytica
RETVN

SEQ ID NO: 2651974 - protein, 6 aa, Entamoeba histolytica
REVCGG

SEQ ID NO: 2651975 - protein, 6 aa, Entamoeba histolytica
REVDKE

SEQ ID NO: 2651976 - protein, 4 aa, Entamoeba histolytica
REVN

SEQ ID NO: 2651977 - protein, 9 aa, Entamoeba histolytica
REVNGEVKR

SEQ ID NO: 2651978 - protein, 117 aa, Entamoeba histolytica
REVQTTDVQLPQQKKQAEDEDTITESNQHNSDTDTSTETRDDGDNNPTTGEEKNEKIKNEKSITVPAEPNQSTFMETEKNNNYGKETSLRREGGEEQKTEASKIYPQESKEENKTLV

SEQ ID NO: 2651979 - protein, 10 aa, Entamoeba histolytica
REVTETKEEL

SEQ ID NO: 2651980 - protein, 9 aa, Entamoeba histolytica
REYDKQTAS

SEQ ID NO: 2651981 - protein, 9 aa, Entamoeba histolytica
REYEEEFEE

SEQ ID NO: 2651982 - protein, 12 aa, Entamoeba histolytica
REYGNEVLSYQT

SEQ ID NO: 2651983 - protein, 16 aa, Entamoeba histolytica
REYKEKKIQLIKDSIV

SEQ ID NO: 2651984 - protein, 18 aa, Entamoeba histolytica
REYKQTALKSSTNDSSYS

SEQ ID NO: 2651985 - protein, 6 aa, Entamoeba histolytica
REYNRR

SEQ ID NO: 2651986 - protein, 17 aa, Entamoeba histolytica
REYNSHENLKNPDCLSG

SEQ ID NO: 2651987 - protein, 4 aa, Entamoeba histolytica
REYP

SEQ ID NO: 2651988 - protein, 11 aa, Entamoeba histolytica
REYPNSLKEGD

SEQ ID NO: 2651989 - protein, 11 aa, Entamoeba histolytica
REYPNSLKEGN

SEQ ID NO: 2651990 - protein, 11 aa, Entamoeba histolytica
REYPNSLTEGN

SEQ ID NO: 2651991 - protein, 8 aa, Entamoeba histolytica
REYSKSRC

SEQ ID NO: 2651992 - protein, 5 aa, Entamoeba histolytica
REYTE

SEQ ID NO: 2651993 - protein, 13 aa, Entamoeba histolytica
RFAGKKEKAPKIS

SEQ ID NO: 2651994 - protein, 10 aa, Entamoeba histolytica
RFAPTGRNNQ

SEQ ID NO: 2651995 - protein, 4 aa, Entamoeba histolytica
RFAS

SEQ ID NO: 2651996 - protein, 10 aa, Entamoeba histolytica
RFDNKSEVED

SEQ ID NO: 2651997 - protein, 4 aa, Entamoeba histolytica
RFEE

SEQ ID NO: 2651998 - protein, 15 aa, Entamoeba histolytica
RFEENPKRKSLKLTK

SEQ ID NO: 2651999 - protein, 9 aa, Entamoeba histolytica
RFEGTRKEN

SEQ ID NO: 2652000 - protein, 4 aa, Entamoeba histolytica
RFEK

SEQ ID NO: 2652001 - protein, 11 aa, Entamoeba histolytica
RFENDTMSKFE

SEQ ID NO: 2652002 - protein, 5 aa, Entamoeba histolytica
RFENK

SEQ ID NO: 2652003 - protein, 11 aa, Entamoeba histolytica
RFESKSYKDFK

SEQ ID NO: 2652004 - protein, 9 aa, Entamoeba histolytica
RFESPRDQE

SEQ ID NO: 2652005 - protein, 6 aa, Entamoeba histolytica
RFGEGP

SEQ ID NO: 2652006 - protein, 4 aa, Entamoeba histolytica
RFGG

SEQ ID NO: 2652007 - protein, 6 aa, Entamoeba histolytica
RFGGPE

SEQ ID NO: 2652008 - protein, 17 aa, Entamoeba histolytica
RFGKSGLKQKSNGGSRK

SEQ ID NO: 2652009 - protein, 7 aa, Entamoeba histolytica
RFGPSDM

SEQ ID NO: 2652010 - protein, 5 aa, Entamoeba histolytica
RFHST

SEQ ID NO: 2652011 - protein, 11 aa, Entamoeba histolytica
RFNDDKKAKLV

SEQ ID NO: 2652012 - protein, 5 aa, Entamoeba histolytica
RFNEE

SEQ ID NO: 2652013 - protein, 10 aa, Entamoeba histolytica
RFNTSSEYEK

SEQ ID NO: 2652014 - protein, 4 aa, Entamoeba histolytica
RFPP

SEQ ID NO: 2652015 - protein, 6 aa, Entamoeba histolytica
RFPTKS

SEQ ID NO: 2652016 - protein, 5 aa, Entamoeba histolytica
RFQRR

SEQ ID NO: 2652017 - protein, 36 aa, Entamoeba histolytica
RFSDDLEDEYSEEDEYSISSDYTSSTDDDEKEMETS

SEQ ID NO: 2652018 - protein, 8 aa, Entamoeba histolytica
RFSKQSSK

SEQ ID NO: 2652019 - protein, 12 aa, Entamoeba histolytica
RFSQEEKEELKN

SEQ ID NO: 2652020 - protein, 10 aa, Entamoeba histolytica
RFTANTSKDF

SEQ ID NO: 2652021 - protein, 9 aa, Entamoeba histolytica
RFTEAKNTI

SEQ ID NO: 2652022 - protein, 6 aa, Entamoeba histolytica
RFTGEV

SEQ ID NO: 2652023 - protein, 10 aa, Entamoeba histolytica
RFTSQYEPTI

SEQ ID NO: 2652024 - protein, 4 aa, Entamoeba histolytica
RGAD

SEQ ID NO: 2652025 - protein, 4 aa, Entamoeba histolytica
RGAF

SEQ ID NO: 2652026 - protein, 9 aa, Entamoeba histolytica
RGANPTGKY

SEQ ID NO: 2652027 - protein, 9 aa, Entamoeba histolytica
RGAPPVGDG

SEQ ID NO: 2652028 - protein, 8 aa, Entamoeba histolytica
RGASPYQY

SEQ ID NO: 2652029 - protein, 8 aa, Entamoeba histolytica
RGASSPAL

SEQ ID NO: 2652030 - protein, 13 aa, Entamoeba histolytica
RGCRDQLKEQGVY

SEQ ID NO: 2652031 - protein, 10 aa, Entamoeba histolytica
RGCSSHERVG

SEQ ID NO: 2652032 - protein, 6 aa, Entamoeba histolytica
RGDDLK

SEQ ID NO: 2652033 - protein, 7 aa, Entamoeba histolytica
RGDEKKS

SEQ ID NO: 2652034 - protein, 5 aa, Entamoeba histolytica
RGDER

SEQ ID NO: 2652035 - protein, 4 aa, Entamoeba histolytica
RGDF

SEQ ID NO: 2652036 - protein, 5 aa, Entamoeba histolytica
RGDFS

SEQ ID NO: 2652037 - protein, 4 aa, Entamoeba histolytica
RGDG

SEQ ID NO: 2652038 - protein, 4 aa, Entamoeba histolytica
RGDI

SEQ ID NO: 2652039 - protein, 12 aa, Entamoeba histolytica
RGDITETTQPFE

SEQ ID NO: 2652040 - protein, 12 aa, Entamoeba histolytica
RGDKKENKGTIE

SEQ ID NO: 2652041 - protein, 9 aa, Entamoeba histolytica
RGDNSTDQL

SEQ ID NO: 2652042 - protein, 5 aa, Entamoeba histolytica
RGDPY

SEQ ID NO: 2652043 - protein, 22 aa, Entamoeba histolytica
RGDRYYSEAEEAREEEREKRIR

SEQ ID NO: 2652044 - protein, 7 aa, Entamoeba histolytica
RGDTFTN

SEQ ID NO: 2652045 - protein, 11 aa, Entamoeba histolytica
RGDTKTQSPTV

SEQ ID NO: 2652046 - protein, 4 aa, Entamoeba histolytica
RGDV

SEQ ID NO: 2652047 - protein, 7 aa, Entamoeba histolytica
RGEGERI

SEQ ID NO: 2652048 - protein, 12 aa, Entamoeba histolytica
RGEGQKTNDEGM

SEQ ID NO: 2652049 - protein, 9 aa, Entamoeba histolytica
RGEKDQKDV

SEQ ID NO: 2652050 - protein, 18 aa, Entamoeba histolytica
RGEKKENKGSIEKAQVHG

SEQ ID NO: 2652051 - protein, 10 aa, Entamoeba histolytica
RGEKPQSGLG

SEQ ID NO: 2652052 - protein, 9 aa, Entamoeba histolytica
RGEQSPEGK

SEQ ID NO: 2652053 - protein, 11 aa, Entamoeba histolytica
RGERNEKLGRT

SEQ ID NO: 2652054 - protein, 7 aa, Entamoeba histolytica
RGESEYD

SEQ ID NO: 2652055 - protein, 13 aa, Entamoeba histolytica
RGESSLNHDKYGD

SEQ ID NO: 2652056 - protein, 8 aa, Entamoeba histolytica
RGETTTIQ

SEQ ID NO: 2652057 - protein, 65 aa, Entamoeba histolytica
RGEVKENKEVITEGIKDERKTEDETEKKEDDKKEKQENKGETEGKEEDGKIKVEKEHTKSRWGNS

SEQ ID NO: 2652058 - protein, 17 aa, Entamoeba histolytica
RGFSGEMKGETTKTEMA

SEQ ID NO: 2652059 - protein, 62 aa, Entamoeba histolytica
RGGAPRGGRGGSNGRGGFGGDNKGPRSAGRGAPRGGRGGAKGGAKGGAKGRGGIGSKGGVQI

SEQ ID NO: 2652060 - protein, 5 aa, Entamoeba histolytica
RGGDE

SEQ ID NO: 2652061 - protein, 5 aa, Entamoeba histolytica
RGGDL

SEQ ID NO: 2652062 - protein, 6 aa, Entamoeba histolytica
RGGGSE

SEQ ID NO: 2652063 - protein, 6 aa, Entamoeba histolytica
RGGKKL

SEQ ID NO: 2652064 - protein, 15 aa, Entamoeba histolytica
RGGKNEESEEDDEIE

SEQ ID NO: 2652065 - protein, 8 aa, Entamoeba histolytica
RGGKTSHA

SEQ ID NO: 2652066 - protein, 5 aa, Entamoeba histolytica
RGGKV

SEQ ID NO: 2652067 - protein, 13 aa, Entamoeba histolytica
RGGLDVSSGSTGI

SEQ ID NO: 2652068 - protein, 7 aa, Entamoeba histolytica
RGGNDYK

SEQ ID NO: 2652069 - protein, 6 aa, Entamoeba histolytica
RGGNIG

SEQ ID NO: 2652070 - protein, 5 aa, Entamoeba histolytica
RGGNQ

SEQ ID NO: 2652071 - protein, 7 aa, Entamoeba histolytica
RGGRDIE

SEQ ID NO: 2652072 - protein, 26 aa, Entamoeba histolytica
RGGRRQMNKQSSHSFPLTNSKETKDE

SEQ ID NO: 2652073 - protein, 19 aa, Entamoeba histolytica
RGGSPLKTENGNVLDQSEE

SEQ ID NO: 2652074 - protein, 29 aa, Entamoeba histolytica
RGGTSLKKSTDRVLQPPKEELTAQQKGDL

SEQ ID NO: 2652075 - protein, 8 aa, Entamoeba histolytica
RGHKRDTS

SEQ ID NO: 2652076 - protein, 5 aa, Entamoeba histolytica
RGHPR

SEQ ID NO: 2652077 - protein, 4 aa, Entamoeba histolytica
RGIG

SEQ ID NO: 2652078 - protein, 13 aa, Entamoeba histolytica
RGIGKNNKVVKQQ

SEQ ID NO: 2652079 - protein, 5 aa, Entamoeba histolytica
RGINE

SEQ ID NO: 2652080 - protein, 8 aa, Entamoeba histolytica
RGIPDPTK

SEQ ID NO: 2652081 - protein, 6 aa, Entamoeba histolytica
RGIPGM

SEQ ID NO: 2652082 - protein, 5 aa, Entamoeba histolytica
RGIQK

SEQ ID NO: 2652083 - protein, 5 aa, Entamoeba histolytica
RGITN

SEQ ID NO: 2652084 - protein, 9 aa, Entamoeba histolytica
RGKDKKLDK

SEQ ID NO: 2652085 - protein, 15 aa, Entamoeba histolytica
RGKGMFKGDPTLKED

SEQ ID NO: 2652086 - protein, 12 aa, Entamoeba histolytica
RGKKDTNKGKFN

SEQ ID NO: 2652087 - protein, 9 aa, Entamoeba histolytica
RGKKQINKG

SEQ ID NO: 2652088 - protein, 5 aa, Entamoeba histolytica
RGKND

SEQ ID NO: 2652089 - protein, 5 aa, Entamoeba histolytica
RGKPE

SEQ ID NO: 2652090 - protein, 8 aa, Entamoeba histolytica
RGKPQSLS

SEQ ID NO: 2652091 - protein, 16 aa, Entamoeba histolytica
RGKQENQSTKDKKCFI

SEQ ID NO: 2652092 - protein, 9 aa, Entamoeba histolytica
RGKQKEKPL

SEQ ID NO: 2652093 - protein, 9 aa, Entamoeba histolytica
RGKQQQTLP

SEQ ID NO: 2652094 - protein, 17 aa, Entamoeba histolytica
RGKSTREASKQLKVSPS

SEQ ID NO: 2652095 - protein, 11 aa, Entamoeba histolytica
RGKTPQKPSLE

SEQ ID NO: 2652096 - protein, 7 aa, Entamoeba histolytica
RGKWSTE

SEQ ID NO: 2652097 - protein, 4 aa, Entamoeba histolytica
RGKY

SEQ ID NO: 2652098 - protein, 4 aa, Entamoeba histolytica
RGLD

SEQ ID NO: 2652099 - protein, 10 aa, Entamoeba histolytica
RGLPKEYNEF

SEQ ID NO: 2652100 - protein, 8 aa, Entamoeba histolytica
RGLSPSDI

SEQ ID NO: 2652101 - protein, 9 aa, Entamoeba histolytica
RGLSQPQST

SEQ ID NO: 2652102 - protein, 6 aa, Entamoeba histolytica
RGLTGK

SEQ ID NO: 2652103 - protein, 6 aa, Entamoeba histolytica
RGMAAS

SEQ ID NO: 2652104 - protein, 4 aa, Entamoeba histolytica
RGMS

SEQ ID NO: 2652105 - protein, 37 aa, Entamoeba histolytica
RGMTITSKDESLESDKKRKKRHNTTKETSTPVLPSGS

SEQ ID NO: 2652106 - protein, 6 aa, Entamoeba histolytica
RGNDTV

SEQ ID NO: 2652107 - protein, 7 aa, Entamoeba histolytica
RGNEAFK

SEQ ID NO: 2652108 - protein, 6 aa, Entamoeba histolytica
RGNESF

SEQ ID NO: 2652109 - protein, 11 aa, Entamoeba histolytica
RGNGRGQFKNP

SEQ ID NO: 2652110 - protein, 4 aa, Entamoeba histolytica
RGNK

SEQ ID NO: 2652111 - protein, 15 aa, Entamoeba histolytica
RGNLPQKKMESLPDI

SEQ ID NO: 2652112 - protein, 5 aa, Entamoeba histolytica
RGNSA

SEQ ID NO: 2652113 - protein, 14 aa, Entamoeba histolytica
RGNSPSLSPPLKDD

SEQ ID NO: 2652114 - protein, 5 aa, Entamoeba histolytica
RGNTR

SEQ ID NO: 2652115 - protein, 9 aa, Entamoeba histolytica
RGNVRSKGY

SEQ ID NO: 2652116 - protein, 7 aa, Entamoeba histolytica
RGPITEE

SEQ ID NO: 2652117 - protein, 9 aa, Entamoeba histolytica
RGQEKNDIY

SEQ ID NO: 2652118 - protein, 15 aa, Entamoeba histolytica
RGQGEGLLAECESAT

SEQ ID NO: 2652119 - protein, 5 aa, Entamoeba histolytica
RGQGL

SEQ ID NO: 2652120 - protein, 9 aa, Entamoeba histolytica
RGQKIESGA

SEQ ID NO: 2652121 - protein, 7 aa, Entamoeba histolytica
RGQQIGG

SEQ ID NO: 2652122 - protein, 7 aa, Entamoeba histolytica
RGQSAQT

SEQ ID NO: 2652123 - protein, 9 aa, Entamoeba histolytica
RGQSQSQVQ

SEQ ID NO: 2652124 - protein, 5 aa, Entamoeba histolytica
RGQYS

SEQ ID NO: 2652125 - protein, 38 aa, Entamoeba histolytica; identical to SEQ ID NO: 2457041

SEQ ID NO: 2652126 - protein, 4 aa, Entamoeba histolytica
RGRK

SEQ ID NO: 2652127 - protein, 5 aa, Entamoeba histolytica
RGRKA

SEQ ID NO: 2652128 - protein, 18 aa, Entamoeba histolytica
RGRNPDPSALLKKLNLID

SEQ ID NO: 2652129 - protein, 24 aa, Entamoeba histolytica
RGRTQQTQTQTPTQPQQEPSVEEE

SEQ ID NO: 2652130 - protein, 10 aa, Entamoeba histolytica
RGSADMKSGL

SEQ ID NO: 2652131 - protein, 4 aa, Entamoeba histolytica
RGSF

SEQ ID NO: 2652132 - protein, 5 aa, Entamoeba histolytica
RGSGI

SEQ ID NO: 2652133 - protein, 5 aa, Entamoeba histolytica
RGSGM

SEQ ID NO: 2652134 - protein, 4 aa, Entamoeba histolytica
RGSK

SEQ ID NO: 2652135 - protein, 7 aa, Entamoeba histolytica
RGSKPTI

SEQ ID NO: 2652136 - protein, 8 aa, Entamoeba histolytica
RGSQESSR

SEQ ID NO: 2652137 - protein, 4 aa, Entamoeba histolytica
RGSS

SEQ ID NO: 2652138 - protein, 5 aa, Entamoeba histolytica
RGSSG

SEQ ID NO: 2652139 - protein, 5 aa, Entamoeba histolytica
RGSSP

SEQ ID NO: 2652140 - protein, 5 aa, Entamoeba histolytica
RGTAG

SEQ ID NO: 2652141 - protein, 5 aa, Entamoeba histolytica
RGTDD

SEQ ID NO: 2652142 - protein, 7 aa, Entamoeba histolytica
RGTDPMS

SEQ ID NO: 2652143 - protein, 11 aa, Entamoeba histolytica
RGTDRKCQGYV

SEQ ID NO: 2652144 - protein, 7 aa, Entamoeba histolytica
RGTEHEP

SEQ ID NO: 2652145 - protein, 14 aa, Entamoeba histolytica
RGTIDEVSKEYSHC

SEQ ID NO: 2652146 - protein, 7 aa, Entamoeba histolytica
RGTLNGG

SEQ ID NO: 2652147 - protein, 4 aa, Entamoeba histolytica
RGTS

SEQ ID NO: 2652148 - protein, 4 aa, Entamoeba histolytica
RGTY

SEQ ID NO: 2652149 - protein, 6 aa, Entamoeba histolytica
RGVAPN

SEQ ID NO: 2652150 - protein, 6 aa, Entamoeba histolytica
RGVDED

SEQ ID NO: 2652151 - protein, 7 aa, Entamoeba histolytica
RGVSAKQ

SEQ ID NO: 2652152 - protein, 9 aa, Entamoeba histolytica
RGVSSDGTP

SEQ ID NO: 2652153 - protein, 4 aa, Entamoeba histolytica
RGVT

SEQ ID NO: 2652154 - protein, 13 aa, Entamoeba histolytica
RGYCTGYGPSRHC

SEQ ID NO: 2652155 - protein, 19 aa, Entamoeba histolytica
RGYNEQKRTENVSSKIASI

SEQ ID NO: 2652156 - protein, 7 aa, Entamoeba histolytica
RGYPNDR

SEQ ID NO: 2652157 - protein, 6 aa, Entamoeba histolytica
RHDEQE

SEQ ID NO: 2652158 - protein, 7 aa, Entamoeba histolytica
RHDSESP

SEQ ID NO: 2652159 - protein, 10 aa, Entamoeba histolytica
RHEEGRSRQE

SEQ ID NO: 2652160 - protein, 8 aa, Entamoeba histolytica
RHEENKEA

SEQ ID NO: 2652161 - protein, 5 aa, Entamoeba histolytica
RHEPL

SEQ ID NO: 2652162 - protein, 6 aa, Entamoeba histolytica
RHEPYN

SEQ ID NO: 2652163 - protein, 19 aa, Entamoeba histolytica
RHEQRKRFRESGKRTQPMR

SEQ ID NO: 2652164 - protein, 6 aa, Entamoeba histolytica
RHESVA

SEQ ID NO: 2652165 - protein, 11 aa, Entamoeba histolytica
RHETKTSKTFS

SEQ ID NO: 2652166 - protein, 21 aa, Entamoeba histolytica
RHETKTSKTFSENDSSYDEVE

SEQ ID NO: 2652167 - protein, 6 aa, Entamoeba histolytica
RHGGEN

SEQ ID NO: 2652168 - protein, 16 aa, Entamoeba histolytica
RHGSGNGDSGSKSGSV

SEQ ID NO: 2652169 - protein, 6 aa, Entamoeba histolytica
RHKEKL

SEQ ID NO: 2652170 - protein, 15 aa, Entamoeba histolytica
RHKGKLNESTQQQKL

SEQ ID NO: 2652171 - protein, 5 aa, Entamoeba histolytica
RHKKE

SEQ ID NO: 2652172 - protein, 9 aa, Entamoeba histolytica
RHKKNCTTR

SEQ ID NO: 2652173 - protein, 20 aa, Entamoeba histolytica
RHNDNKPVSRYSVPSNEESV

SEQ ID NO: 2652174 - protein, 8 aa, Entamoeba histolytica
RHNETNNF

SEQ ID NO: 2652175 - protein, 5 aa, Entamoeba histolytica
RHNSR

SEQ ID NO: 2652176 - protein, 5 aa, Entamoeba histolytica
RHNTP

SEQ ID NO: 2652177 - protein, 4 aa, Entamoeba histolytica
RHPN

SEQ ID NO: 2652178 - protein, 7 aa, Entamoeba histolytica
RHPPPSL

SEQ ID NO: 2652179 - protein, 12 aa, Entamoeba histolytica
RHQRESKTMSKI

SEQ ID NO: 2652180 - protein, 7 aa, Entamoeba histolytica
RHRLGSN

SEQ ID NO: 2652181 - protein, 6 aa, Entamoeba histolytica
RHRRTT

SEQ ID NO: 2652182 - protein, 22 aa, Entamoeba histolytica
RHRSSTETEKSQYRKLGREWGD

SEQ ID NO: 2652183 - protein, 21 aa, Entamoeba histolytica
RHSEPTKRIEEENNIPIDTTT

SEQ ID NO: 2652184 - protein, 5 aa, Entamoeba histolytica
RHSKD

SEQ ID NO: 2652185 - protein, 7 aa, Entamoeba histolytica
RHTDGIS

SEQ ID NO: 2652186 - protein, 5 aa, Entamoeba histolytica
RICEG

SEQ ID NO: 2652187 - protein, 16 aa, Entamoeba histolytica
RIDAKEALNHPFISFY

SEQ ID NO: 2652188 - protein, 4 aa, Entamoeba histolytica
RIDK

SEQ ID NO: 2652189 - protein, 13 aa, Entamoeba histolytica
RIDSGNSSTIDKL

SEQ ID NO: 2652190 - protein, 21 aa, Entamoeba histolytica
RIDSGNSSTIDKLSDRDKYYS

SEQ ID NO: 2652191 - protein, 13 aa, Entamoeba histolytica
RIDSGNSSTINKL

SEQ ID NO: 2652192 - protein, 16 aa, Entamoeba histolytica
RIDSKEKRKLTKTEKL

SEQ ID NO: 2652193 - protein, 5 aa, Entamoeba histolytica
RIDVN

SEQ ID NO: 2652194 - protein, 22 aa, Entamoeba histolytica
RIEAKISEEKFKKQKEQEEEFE

SEQ ID NO: 2652195 - protein, 9 aa, Entamoeba histolytica
RIEDESPEA

SEQ ID NO: 2652196 - protein, 8 aa, Entamoeba histolytica
RIEDNNNF

SEQ ID NO: 2652197 - protein, 4 aa, Entamoeba histolytica
RIEE

SEQ ID NO: 2652198 - protein, 12 aa, Entamoeba histolytica
RIEEDPLSEGYN

SEQ ID NO: 2652199 - protein, 24 aa, Entamoeba histolytica
RIEEEERKLQEEEEENERKLQEEE

SEQ ID NO: 2652200 - protein, 6 aa, Entamoeba histolytica
RIEESE

SEQ ID NO: 2652201 - protein, 9 aa, Entamoeba histolytica
RIEKDEQKL

SEQ ID NO: 2652202 - protein, 15 aa, Entamoeba histolytica
RIEKEENERKEENKI

SEQ ID NO: 2652203 - protein, 6 aa, Entamoeba histolytica
RIEKER

SEQ ID NO: 2652204 - protein, 7 aa, Entamoeba histolytica
RIENRQT

SEQ ID NO: 2652205 - protein, 7 aa, Entamoeba histolytica
RIEPKDG

SEQ ID NO: 2652206 - protein, 8 aa, Entamoeba histolytica
RIEPTENG

SEQ ID NO: 2652207 - protein, 12 aa, Entamoeba histolytica
RIEREKERQIQE

SEQ ID NO: 2652208 - protein, 6 aa, Entamoeba histolytica
RIERRG

SEQ ID NO: 2652209 - protein, 13 aa, Entamoeba histolytica
RIERSDRIDRGDR

SEQ ID NO: 2652210 - protein, 7 aa, Entamoeba histolytica
RIERTQD

SEQ ID NO: 2652211 - protein, 20 aa, Entamoeba histolytica
RIESHSSSTSSLKSNTPKEM

SEQ ID NO: 2652212 - protein, 6 aa, Entamoeba histolytica
RIESTT

SEQ ID NO: 2652213 - protein, 38 aa, Entamoeba histolytica
RIETNAKDEKSSTSNKLSSNEKKETKTIPKMPVGGGAV

SEQ ID NO: 2652214 - protein, 11 aa, Entamoeba histolytica
RIGADSREAGV

SEQ ID NO: 2652215 - protein, 14 aa, Entamoeba histolytica
RIGEGSEKLEDEED

SEQ ID NO: 2652216 - protein, 6 aa, Entamoeba histolytica
RIGERP

SEQ ID NO: 2652217 - protein, 6 aa, Entamoeba histolytica
RIGGEG

SEQ ID NO: 2652218 - protein, 5 aa, Entamoeba histolytica
RIGKT

SEQ ID NO: 2652219 - protein, 5 aa, Entamoeba histolytica
RIGNS

SEQ ID NO: 2652220 - protein, 6 aa, Entamoeba histolytica
RIGQKN

SEQ ID NO: 2652221 - protein, 8 aa, Entamoeba histolytica
RIGQTKPV

SEQ ID NO: 2652222 - protein, 7 aa, Entamoeba histolytica
RIGSNEK

SEQ ID NO: 2652223 - protein, 5 aa, Entamoeba histolytica
RIKDN

SEQ ID NO: 2652224 - protein, 9 aa, Entamoeba histolytica
RIKDSSTTS

SEQ ID NO: 2652225 - protein, 16 aa, Entamoeba histolytica
RIKEEEKKKGEEIKEE

SEQ ID NO: 2652226 - protein, 12 aa, Entamoeba histolytica
RIKENKQKALNQ

SEQ ID NO: 2652227 - protein, 10 aa, Entamoeba histolytica
RIKERAKTEM

SEQ ID NO: 2652228 - protein, 6 aa, Entamoeba histolytica
RIKNDP

SEQ ID NO: 2652229 - protein, 8 aa, Entamoeba histolytica
RIKNTPPQ

SEQ ID NO: 2652230 - protein, 6 aa, Entamoeba histolytica
RINKER

SEQ ID NO: 2652231 - protein, 12 aa, Entamoeba histolytica
RINKRQAQQKRM

SEQ ID NO: 2652232 - protein, 13 aa, Entamoeba histolytica
RINSEPSDISSSI

SEQ ID NO: 2652233 - protein, 4 aa, Entamoeba histolytica
RINY

SEQ ID NO: 2652234 - protein, 5 aa, Entamoeba histolytica
RIPEG

SEQ ID NO: 2652235 - protein, 16 aa, Entamoeba histolytica
RIPEKSKCEEDNIEER

SEQ ID NO: 2652236 - protein, 7 aa, Entamoeba histolytica
RIPENEK

SEQ ID NO: 2652237 - protein, 5 aa, Entamoeba histolytica
RIPIK

SEQ ID NO: 2652238 - protein, 7 aa, Entamoeba histolytica
RIPPQTP

SEQ ID NO: 2652239 - protein, 5 aa, Entamoeba histolytica
RIPQG

SEQ ID NO: 2652240 - protein, 5 aa, Entamoeba histolytica
RIPRS

SEQ ID NO: 2652241 - protein, 9 aa, Entamoeba histolytica
RIPSNNRDQ

SEQ ID NO: 2652242 - protein, 4 aa, Entamoeba histolytica
RIPT

SEQ ID NO: 2652243 - protein, 11 aa, Entamoeba histolytica
RIQAEEGHWDP

SEQ ID NO: 2652244 - protein, 7 aa, Entamoeba histolytica
RIQASKK

SEQ ID NO: 2652245 - protein, 9 aa, Entamoeba histolytica
RIQDKEDID

SEQ ID NO: 2652246 - protein, 6 aa, Entamoeba histolytica
RIQEGQ

SEQ ID NO: 2652247 - protein, 5 aa, Entamoeba histolytica
RIQES

SEQ ID NO: 2652248 - protein, 19 aa, Entamoeba histolytica
RIQNGKKQIEYTSGDGLHG

SEQ ID NO: 2652249 - protein, 17 aa, Entamoeba histolytica
RIQSKSPNLQQIPKQSF

SEQ ID NO: 2652250 - protein, 4 aa, Entamoeba histolytica
RIRD

SEQ ID NO: 2652251 - protein, 10 aa, Entamoeba histolytica
RIRDTRMGKT

SEQ ID NO: 2652252 - protein, 5 aa, Entamoeba histolytica
RIREE

SEQ ID NO: 2652253 - protein, 13 aa, Entamoeba histolytica
RIRGDPKTPDIHQ

SEQ ID NO: 2652254 - protein, 17 aa, Entamoeba histolytica
RIRGGSMNGPNPITPDL

SEQ ID NO: 2652255 - protein, 12 aa, Entamoeba histolytica
RIRKETPARGVN

SEQ ID NO: 2652256 - protein, 13 aa, Entamoeba histolytica
RIRPTKPKEQLKI

SEQ ID NO: 2652257 - protein, 8 aa, Entamoeba histolytica
RIRSTNEL

SEQ ID NO: 2652258 - protein, 6 aa, Entamoeba histolytica
RIRTNS

SEQ ID NO: 2652259 - protein, 4 aa, Entamoeba histolytica
RISD

SEQ ID NO: 2652260 - protein, 5 aa, Entamoeba histolytica
RISDG

SEQ ID NO: 2652261 - protein, 9 aa, Entamoeba histolytica
RISEDCQQD

SEQ ID NO: 2652262 - protein, 7 aa, Entamoeba histolytica
RISEGTL

SEQ ID NO: 2652263 - protein, 15 aa, Entamoeba histolytica
RISEKGSKKLPLTKD

SEQ ID NO: 2652264 - protein, 5 aa, Entamoeba histolytica
RISKG

SEQ ID NO: 2652265 - protein, 34 aa, Entamoeba histolytica
RISNDETKINQEDMPNIENKQKKSLTNSKDVEQN

SEQ ID NO: 2652266 - protein, 7 aa, Entamoeba histolytica
RISRSQP

SEQ ID NO: 2652267 - protein, 5 aa, Entamoeba histolytica
RISSE

SEQ ID NO: 2652268 - protein, 82 aa, Entamoeba histolytica
RITAKNQKKDYGGVGNYGGISSSSYGNYSSNTTSFGSDDFNSFNKPASTYGGYHDDPQPTSTTYSNNPQPTYGRPGTYKDNV

SEQ ID NO: 2652269 - protein, 11 aa, Entamoeba histolytica
RITGDDEEKLR

SEQ ID NO: 2652270 - protein, 34 aa, Entamoeba histolytica
RITNPENKEIDISNTDTITTEDTIPSLKTNEEAI

SEQ ID NO: 2652271 - protein, 16 aa, Entamoeba histolytica
RITPDKTASDLGLQDG

SEQ ID NO: 2652272 - protein, 6 aa, Entamoeba histolytica
RITPKE

SEQ ID NO: 2652273 - protein, 5 aa, Entamoeba histolytica
RITPS

SEQ ID NO: 2652274 - protein, 10 aa, Entamoeba histolytica
RITQSKSFKE

SEQ ID NO: 2652275 - protein, 15 aa, Entamoeba histolytica
RITSIPDSIQKASNL

SEQ ID NO: 2652276 - protein, 5 aa, Entamoeba histolytica
RITSN

SEQ ID NO: 2652277 - protein, 7 aa, Entamoeba histolytica
RITSREK

SEQ ID NO: 2652278 - protein, 9 aa, Entamoeba histolytica
RITTGSREL

SEQ ID NO: 2652279 - protein, 14 aa, Entamoeba histolytica
RITTKNVSNRYSTK

SEQ ID NO: 2652280 - protein, 6 aa, Entamoeba histolytica
RKAAES

SEQ ID NO: 2652281 - protein, 19 aa, Entamoeba histolytica
RKAEIEVTGDSAGISDPSY

SEQ ID NO: 2652282 - protein, 11 aa, Entamoeba histolytica
RKAERKARKVE

SEQ ID NO: 2652283 - protein, 9 aa, Entamoeba histolytica
RKAKPIGTS

SEQ ID NO: 2652284 - protein, 18 aa, Entamoeba histolytica
RKAKYSSDEEYKEAIEEE

SEQ ID NO: 2652285 - protein, 4 aa, Entamoeba histolytica
RKAL

SEQ ID NO: 2652286 - protein, 7 aa, Entamoeba histolytica
RKAMKDK

SEQ ID NO: 2652287 - protein, 24 aa, Entamoeba histolytica
RKANASRGKLKREQIEDEENLTVE

SEQ ID NO: 2652288 - protein, 6 aa, Entamoeba histolytica
RKANIK

SEQ ID NO: 2652289 - protein, 35 aa, Entamoeba histolytica
RKANKEGLNKKKTKKITKKQNKKMDKIKKGSNNRL

SEQ ID NO: 2652290 - protein, 6 aa, Entamoeba histolytica
RKAPAL

SEQ ID NO: 2652291 - protein, 5 aa, Entamoeba histolytica
RKARH

SEQ ID NO: 2652292 - protein, 10 aa, Entamoeba histolytica
RKASAKYPEW

SEQ ID NO: 2652293 - protein, 40 aa, Entamoeba histolytica
RKASEEDNYYDYEDEEDDYSAEPMEHQPFGGNGNDPDIIY

SEQ ID NO: 2652294 - protein, 8 aa, Entamoeba histolytica
RKASKKNK

SEQ ID NO: 2652295 - protein, 17 aa, Entamoeba histolytica
RKASLDPKEGEDTLSNQ

SEQ ID NO: 2652296 - protein, 11 aa, Entamoeba histolytica
RKASNKNPDEF

SEQ ID NO: 2652297 - protein, 20 aa, Entamoeba histolytica
RKASSTSLLPTQKKTTLTRQ

SEQ ID NO: 2652298 - protein, 24 aa, Entamoeba histolytica
RKATADLQEANEKKAEVEAQRDKL

SEQ ID NO: 2652299 - protein, 23 aa, Entamoeba histolytica
RKATPKPAKAEPTDSDTKKKGHS

SEQ ID NO: 2652300 - protein, 10 aa, Entamoeba histolytica
RKATSQTKRS

SEQ ID NO: 2652301 - protein, 21 aa, Entamoeba histolytica
RKAVPDLDPTPLEEDNAMDRS

SEQ ID NO: 2652302 - protein, 7 aa, Entamoeba histolytica
RKAVTTD

SEQ ID NO: 2652303 - protein, 4 aa, Entamoeba histolytica
RKCQ

SEQ ID NO: 2652304 - protein, 4 aa, Entamoeba histolytica
RKDD

SEQ ID NO: 2652305 - protein, 8 aa, Entamoeba histolytica
RKDDGKQV

SEQ ID NO: 2652306 - protein, 9 aa, Entamoeba histolytica
RKDDPNSFK

SEQ ID NO: 2652307 - protein, 7 aa, Entamoeba histolytica
RKDDSKV

SEQ ID NO: 2652308 - protein, 6 aa, Entamoeba histolytica
RKDEDT

SEQ ID NO: 2652309 - protein, 6 aa, Entamoeba histolytica
RKDELE

SEQ ID NO: 2652310 - protein, 8 aa, Entamoeba histolytica
RKDESKIE

SEQ ID NO: 2652311 - protein, 4 aa, Entamoeba histolytica
RKDG

SEQ ID NO: 2652312 - protein, 9 aa, Entamoeba histolytica
RKDGNPPQF

SEQ ID NO: 2652313 - protein, 20 aa, Entamoeba histolytica
RKDIADDEYDDDDDSSDEWS

SEQ ID NO: 2652314 - protein, 11 aa, Entamoeba histolytica
RKDKESETRRR

SEQ ID NO: 2652315 - protein, 10 aa, Entamoeba histolytica
RKDKETADKL

SEQ ID NO: 2652316 - protein, 7 aa, Entamoeba histolytica
RKDKKVR

SEQ ID NO: 2652317 - protein, 8 aa, Entamoeba histolytica
RKDKSVSI

SEQ ID NO: 2652318 - protein, 6 aa, Entamoeba histolytica
RKDLSY

SEQ ID NO: 2652319 - protein, 11 aa, Entamoeba histolytica
RKDNKQTTTEF

SEQ ID NO: 2652320 - protein, 8 aa, Entamoeba histolytica
RKDNPQRV

SEQ ID NO: 2652321 - protein, 12 aa, Entamoeba histolytica
RKDPEPTSITTP

SEQ ID NO: 2652322 - protein, 104 aa, Entamoeba histolytica
RKDQRPSNSGVPSFVGGSSRSQQQRGNGSSDTYTPPRTGGSGYNNSAYQQRPGASSSVASFTSKRSSGYSNSGASFNNRGPRTNGGSSSVASFTSGGSRGGYRK

SEQ ID NO: 2652323 - protein, 7 aa, Entamoeba histolytica
RKDRVSE

SEQ ID NO: 2652324 - protein, 6 aa, Entamoeba histolytica
RKDSDT

SEQ ID NO: 2652325 - protein, 7 aa, Entamoeba histolytica
RKDSFDR

SEQ ID NO: 2652326 - protein, 9 aa, Entamoeba histolytica
RKDSRKFNE

SEQ ID NO: 2652327 - protein, 4 aa, Entamoeba histolytica
RKDT

SEQ ID NO: 2652328 - protein, 5 aa, Entamoeba histolytica
RKDTL

SEQ ID NO: 2652329 - protein, 5 aa, Entamoeba histolytica
RKDYP

SEQ ID NO: 2652330 - protein, 19 aa, Entamoeba histolytica
RKDYSSNKYEEVPKDKCVI

SEQ ID NO: 2652331 - protein, 47 aa, Entamoeba histolytica
RKEADLEEANENLDIEKKDRMNKEKQVKKLEGELKETKDKLNAAIAE

SEQ ID NO: 2652332 - protein, 6 aa, Entamoeba histolytica
RKEAEA

SEQ ID NO: 2652333 - protein, 4 aa, Entamoeba histolytica
RKEC

SEQ ID NO: 2652334 - protein, 7 aa, Entamoeba histolytica
RKEDGVS

SEQ ID NO: 2652335 - protein, 6 aa, Entamoeba histolytica
RKEDKA

SEQ ID NO: 2652336 - protein, 31 aa, Entamoeba histolytica
RKEDSRSRSKSHSLSNSKSVSRSTSPSFNKE

SEQ ID NO: 2652337 - protein, 13 aa, Entamoeba histolytica
RKEDVITGRSKNL

SEQ ID NO: 2652338 - protein, 7 aa, Entamoeba histolytica
RKEEAEQ

SEQ ID NO: 2652339 - protein, 8 aa, Entamoeba histolytica
RKEEDQKL

SEQ ID NO: 2652340 - protein, 27 aa, Entamoeba histolytica
RKEEEDITKTEKGDDLEKTLPPSNMEE

SEQ ID NO: 2652341 - protein, 14 aa, Entamoeba histolytica
RKEEENKVSHQNPI

SEQ ID NO: 2652342 - protein, 6 aa, Entamoeba histolytica
RKEEFQ

SEQ ID NO: 2652343 - protein, 9 aa, Entamoeba histolytica
RKEEKAQLK

SEQ ID NO: 2652344 - protein, 6 aa, Entamoeba histolytica
RKEEKS

SEQ ID NO: 2652345 - protein, 25 aa, Entamoeba histolytica
RKEELESNKTRTTENEEKERNELDS

SEQ ID NO: 2652346 - protein, 9 aa, Entamoeba histolytica
RKEEMSADT

SEQ ID NO: 2652347 - protein, 5 aa, Entamoeba histolytica
RKEEN

SEQ ID NO: 2652348 - protein, 9 aa, Entamoeba histolytica
RKEEREKQI

SEQ ID NO: 2652349 - protein, 18 aa, Entamoeba histolytica
RKEFEQGVTKERQNPKRW

SEQ ID NO: 2652350 - protein, 5 aa, Entamoeba histolytica
RKEFK

SEQ ID NO: 2652351 - protein, 8 aa, Entamoeba histolytica
RKEGASPF

SEQ ID NO: 2652352 - protein, 9 aa, Entamoeba histolytica
RKEGKIETQ

SEQ ID NO: 2652353 - protein, 5 aa, Entamoeba histolytica
RKEGM

SEQ ID NO: 2652354 - protein, 10 aa, Entamoeba histolytica
RKEGSGEAIK

SEQ ID NO: 2652355 - protein, 11 aa, Entamoeba histolytica
RKEHLKEKNSI

SEQ ID NO: 2652356 - protein, 4 aa, Entamoeba histolytica
RKEI

SEQ ID NO: 2652357 - protein, 13 aa, Entamoeba histolytica
RKEIENEKEIPKD

SEQ ID NO: 2652358 - protein, 8 aa, Entamoeba histolytica
RKEITDYN

SEQ ID NO: 2652359 - protein, 8 aa, Entamoeba histolytica
RKEITPQR

SEQ ID NO: 2652360 - protein, 8 aa, Entamoeba histolytica
RKEKDLKT

SEQ ID NO: 2652361 - protein, 8 aa, Entamoeba histolytica
RKEKEDQL

SEQ ID NO: 2652362 - protein, 12 aa, Entamoeba histolytica
RKEKEEEETKEL

SEQ ID NO: 2652363 - protein, 12 aa, Entamoeba histolytica
RKEKEEERARER

SEQ ID NO: 2652364 - protein, 6 aa, Entamoeba histolytica
RKEKQF

SEQ ID NO: 2652365 - protein, 18 aa, Entamoeba histolytica
RKEKSQTGVPKSKQDKDM

SEQ ID NO: 2652366 - protein, 7 aa, Entamoeba histolytica
RKEKVDK

SEQ ID NO: 2652367 - protein, 17 aa, Entamoeba histolytica
RKELEECKTEITDAKER

SEQ ID NO: 2652368 - protein, 7 aa, Entamoeba histolytica
RKELESL

SEQ ID NO: 2652369 - protein, 17 aa, Entamoeba histolytica
RKELETLKEKKDKAEKY

SEQ ID NO: 2652370 - protein, 6 aa, Entamoeba histolytica
RKELFD

SEQ ID NO: 2652371 - protein, 13 aa, Entamoeba histolytica
RKELKEGEKTTMD

SEQ ID NO: 2652372 - protein, 20 aa, Entamoeba histolytica
RKELKKEKKISEERAKKEYE

SEQ ID NO: 2652373 - protein, 10 aa, Entamoeba histolytica
RKELPSSASS

SEQ ID NO: 2652374 - protein, 8 aa, Entamoeba histolytica
RKELTPPW

SEQ ID NO: 2652375 - protein, 34 aa, Entamoeba histolytica
RKEMKPDECEKSSCIKDQPQIQNVTKDQPQIQNV

SEQ ID NO: 2652376 - protein, 6 aa, Entamoeba histolytica
RKENDS

SEQ ID NO: 2652377 - protein, 5 aa, Entamoeba histolytica
RKENT

SEQ ID NO: 2652378 - protein, 10 aa, Entamoeba histolytica
RKEPTSCKRP

SEQ ID NO: 2652379 - protein, 7 aa, Entamoeba histolytica
RKEQQRC

SEQ ID NO: 2652380 - protein, 21 aa, Entamoeba histolytica
RKEQQTPLQSPKDSNHSSPRY

SEQ ID NO: 2652381 - protein, 9 aa, Entamoeba histolytica
RKEQRKINR

SEQ ID NO: 2652382 - protein, 23 aa, Entamoeba histolytica
RKEQTNDGLSEKEEKQEQYSKKF

SEQ ID NO: 2652383 - protein, 7 aa, Entamoeba histolytica
RKEREDV

SEQ ID NO: 2652384 - protein, 9 aa, Entamoeba histolytica
RKERFEEER

SEQ ID NO: 2652385 - protein, 13 aa, Entamoeba histolytica
RKESAQENALHLN

SEQ ID NO: 2652386 - protein, 10 aa, Entamoeba histolytica
RKESEPEYNK

SEQ ID NO: 2652387 - protein, 5 aa, Entamoeba histolytica
RKESF

SEQ ID NO: 2652388 - protein, 8 aa, Entamoeba histolytica
RKESKEYL

SEQ ID NO: 2652389 - protein, 6 aa, Entamoeba histolytica
RKESKV

SEQ ID NO: 2652390 - protein, 10 aa, Entamoeba histolytica
RKESQKEYNV

SEQ ID NO: 2652391 - protein, 5 aa, Entamoeba histolytica
RKETF

SEQ ID NO: 2652392 - protein, 16 aa, Entamoeba histolytica
RKEVEEGAKRKEHKDI

SEQ ID NO: 2652393 - protein, 4 aa, Entamoeba histolytica
RKEY

SEQ ID NO: 2652394 - protein, 12 aa, Entamoeba histolytica
RKEYEDKDRKIQ

SEQ ID NO: 2652395 - protein, 8 aa, Entamoeba histolytica
RKEYKRLD

SEQ ID NO: 2652396 - protein, 4 aa, Entamoeba histolytica
RKFD

SEQ ID NO: 2652397 - protein, 5 aa, Entamoeba histolytica
RKFDR

SEQ ID NO: 2652398 - protein, 8 aa, Entamoeba histolytica
RKFNQEKK

SEQ ID NO: 2652399 - protein, 6 aa, Entamoeba histolytica
RKFPNY

SEQ ID NO: 2652400 - protein, 11 aa, Entamoeba histolytica
RKFTTKTKREK

SEQ ID NO: 2652401 - protein, 8 aa, Entamoeba histolytica
RKGASYTP

SEQ ID NO: 2652402 - protein, 8 aa, Entamoeba histolytica
RKGDKSPS

SEQ ID NO: 2652403 - protein, 13 aa, Entamoeba histolytica
RKGDRIDVNDEEE

SEQ ID NO: 2652404 - protein, 6 aa, Entamoeba histolytica
RKGEEI

SEQ ID NO: 2652405 - protein, 19 aa, Entamoeba histolytica
RKGEFETGFDKGGQTREHS

SEQ ID NO: 2652406 - protein, 6 aa, Entamoeba histolytica
RKGELT

SEQ ID NO: 2652407 - protein, 5 aa, Entamoeba histolytica
RKGES

SEQ ID NO: 2652408 - protein, 7 aa, Entamoeba histolytica
RKGESVD

SEQ ID NO: 2652409 - protein, 8 aa, Entamoeba histolytica
RKGEYGEG

SEQ ID NO: 2652410 - protein, 9 aa, Entamoeba histolytica
RKGGKFSPL

SEQ ID NO: 2652411 - protein, 6 aa, Entamoeba histolytica
RKGGPW

SEQ ID NO: 2652412 - protein, 8 aa, Entamoeba histolytica
RKGGRDDI

SEQ ID NO: 2652413 - protein, 7 aa, Entamoeba histolytica
RKGGSSK

SEQ ID NO: 2652414 - protein, 9 aa, Entamoeba histolytica
RKGHNPQEM

SEQ ID NO: 2652415 - protein, 4 aa, Entamoeba histolytica
RKGI

SEQ ID NO: 2652416 - protein, 8 aa, Entamoeba histolytica
RKGIGGRS

SEQ ID NO: 2652417 - protein, 10 aa, Entamoeba histolytica
RKGKEDDSSL

SEQ ID NO: 2652418 - protein, 4 aa, Entamoeba histolytica
RKGL

SEQ ID NO: 2652419 - protein, 6 aa, Entamoeba histolytica
RKGLNG

SEQ ID NO: 2652420 - protein, 9 aa, Entamoeba histolytica
RKGMSSPAL

SEQ ID NO: 2652421 - protein, 9 aa, Entamoeba histolytica
RKGQMEGKT

SEQ ID NO: 2652422 - protein, 12 aa, Entamoeba histolytica
RKGRDGPLNTPE

SEQ ID NO: 2652423 - protein, 9 aa, Entamoeba histolytica
RKGRTRQRD

SEQ ID NO: 2652424 - protein, 4 aa, Entamoeba histolytica
RKGS

SEQ ID NO: 2652425 - protein, 17 aa, Entamoeba histolytica
RKGSLDSDIKEVKPNKI

SEQ ID NO: 2652426 - protein, 5 aa, Entamoeba histolytica
RKGSN

SEQ ID NO: 2652427 - protein, 6 aa, Entamoeba histolytica
RKGSYE

SEQ ID NO: 2652428 - protein, 17 aa, Entamoeba histolytica
RKGVKEKTSLRRYENNK

SEQ ID NO: 2652429 - protein, 7 aa, Entamoeba histolytica
RKHAKQP

SEQ ID NO: 2652430 - protein, 16 aa, Entamoeba histolytica
RKIDGDDEQIEKPSAL

SEQ ID NO: 2652431 - protein, 12 aa, Entamoeba histolytica
RKIDRTKGTTFT

SEQ ID NO: 2652432 - protein, 5 aa, Entamoeba histolytica
RKIEE

SEQ ID NO: 2652433 - protein, 30 aa, Entamoeba histolytica
RKIEEDTVSDVKPKVDQKGDGKSRLNELYG

SEQ ID NO: 2652434 - protein, 5 aa, Entamoeba histolytica
RKIER

SEQ ID NO: 2652435 - protein, 13 aa, Entamoeba histolytica
RKIGETDFPVDAE

SEQ ID NO: 2652436 - protein, 6 aa, Entamoeba histolytica
RKINQK

SEQ ID NO: 2652437 - protein, 4 aa, Entamoeba histolytica
RKIQ

SEQ ID NO: 2652438 - protein, 7 aa, Entamoeba histolytica
RKISDSA

SEQ ID NO: 2652439 - protein, 4 aa, Entamoeba histolytica
RKIT

SEQ ID NO: 2652440 - protein, 6 aa, Entamoeba histolytica
RKITGT

SEQ ID NO: 2652441 - protein, 8 aa, Entamoeba histolytica
RKKDGQRD

SEQ ID NO: 2652442 - protein, 16 aa, Entamoeba histolytica
RKKDIKSQNNNSKGDI

SEQ ID NO: 2652443 - protein, 11 aa, Entamoeba histolytica
RKKDKKSGQSQ

SEQ ID NO: 2652444 - protein, 18 aa, Entamoeba histolytica
RKKDRQQMKKMNEEERIA

SEQ ID NO: 2652445 - protein, 18 aa, Entamoeba histolytica
RKKEAQLAEKDVEPEYSI

SEQ ID NO: 2652446 - protein, 14 aa, Entamoeba histolytica
RKKEEEFNTLKEEK

SEQ ID NO: 2652447 - protein, 14 aa, Entamoeba histolytica
RKKEGFKKTQNENQ

SEQ ID NO: 2652448 - protein, 10 aa, Entamoeba histolytica
RKKEGTKRMS

SEQ ID NO: 2652449 - protein, 7 aa, Entamoeba histolytica
RKKEIKK

SEQ ID NO: 2652450 - protein, 22 aa, Entamoeba histolytica
RKKELKEGEKTTMDKYGENCVV

SEQ ID NO: 2652451 - protein, 8 aa, Entamoeba histolytica
RKKELNKI

SEQ ID NO: 2652452 - protein, 15 aa, Entamoeba histolytica
RKKEQRIREQHPPTE

SEQ ID NO: 2652453 - protein, 14 aa, Entamoeba histolytica
RKKEWTKKIKKNEI

SEQ ID NO: 2652454 - protein, 5 aa, Entamoeba histolytica
RKKGI

SEQ ID NO: 2652455 - protein, 27 aa, Entamoeba histolytica
RKKGKNLSKRQAKRKALKSQQHKDGEA

SEQ ID NO: 2652456 - protein, 8 aa, Entamoeba histolytica
RKKGSTTI

SEQ ID NO: 2652457 - protein, 6 aa, Entamoeba histolytica
RKKISL

SEQ ID NO: 2652458 - protein, 8 aa, Entamoeba histolytica
RKKKDEQH

SEQ ID NO: 2652459 - protein, 10 aa, Entamoeba histolytica
RKKKNGYRES

SEQ ID NO: 2652460 - protein, 10 aa, Entamoeba histolytica
RKKKNSYKES

SEQ ID NO: 2652461 - protein, 7 aa, Entamoeba histolytica
RKKNELY

SEQ ID NO: 2652462 - protein, 7 aa, Entamoeba histolytica
RKKNMNE

SEQ ID NO: 2652463 - protein, 15 aa, Entamoeba histolytica
RKKNQPHWNGKDNEH

SEQ ID NO: 2652464 - protein, 8 aa, Entamoeba histolytica
RKKPGKTS

SEQ ID NO: 2652465 - protein, 14 aa, Entamoeba histolytica
RKKPRDSNASITSQ

SEQ ID NO: 2652466 - protein, 18 aa, Entamoeba histolytica
RKKPTPHRKKQPGDDTTS

SEQ ID NO: 2652467 - protein, 90 aa, Entamoeba histolytica
RKKQQQASNKNNKFNNQRASTNIQQSSTSSIKNNQNQQPAKQMKNNKNNKKNNIKKQIQKKNNSGNKKQIQKKNNSVGLTQQEKRNYAQQ

SEQ ID NO: 2652468 - protein, 19 aa, Entamoeba histolytica
RKKREEEEAKERKKQEEER

SEQ ID NO: 2652469 - protein, 34 aa, Entamoeba histolytica
RKKREEEEEAKEKNRREEERRKEKERKKQEGERL

SEQ ID NO: 2652470 - protein, 8 aa, Entamoeba histolytica
RKKRKEMY

SEQ ID NO: 2652471 - protein, 9 aa, Entamoeba histolytica
RKKRSDPNQ

SEQ ID NO: 2652472 - protein, 8 aa, Entamoeba histolytica
RKKRTRDI

SEQ ID NO: 2652473 - protein, 14 aa, Entamoeba histolytica
RKKRTRQKEKDLIT

SEQ ID NO: 2652474 - protein, 10 aa, Entamoeba histolytica
RKKSQNEDEI

SEQ ID NO: 2652475 - protein, 9 aa, Entamoeba histolytica
RKKTDTGLS

SEQ ID NO: 2652476 - protein, 37 aa, Entamoeba histolytica
RKKTSQTRSRYSWSSRSATSLYSPTQSISKESGSISN

SEQ ID NO: 2652477 - protein, 8 aa, Entamoeba histolytica
RKKVPEFD

SEQ ID NO: 2652478 - protein, 10 aa, Entamoeba histolytica
RKLAKTIKQR

SEQ ID NO: 2652479 - protein, 11 aa, Entamoeba histolytica
RKLDTDSARIR

SEQ ID NO: 2652480 - protein, 69 aa, Entamoeba histolytica
  misc_feature (31)..(64): Xaa can be any naturally occurring amino acid
RKLEEDRKVLEEDKENEKDEKIIIKDEINIXXXXXXXXXXXXXXXXXXXXXXXXXXXXXXXXXXKKKKK

SEQ ID NO: 2652481 - protein, 10 aa, Entamoeba histolytica
RKLKNSPIYE

SEQ ID NO: 2652482 - protein, 12 aa, Entamoeba histolytica
RKLSDKLKGPWD

SEQ ID NO: 2652483 - protein, 8 aa, Entamoeba histolytica
RKLSENVD

SEQ ID NO: 2652484 - protein, 6 aa, Entamoeba histolytica
RKLTKQ

SEQ ID NO: 2652485 - protein, 9 aa, Entamoeba histolytica
RKLTPEETQ

SEQ ID NO: 2652486 - protein, 9 aa, Entamoeba histolytica
RKLTQSKDR

SEQ ID NO: 2652487 - protein, 19 aa, Entamoeba histolytica
RKLTSRPANMRTVSDTNIL

SEQ ID NO: 2652488 - protein, 17 aa, Entamoeba histolytica
RKMNKKDSTQIDSVQTE

SEQ ID NO: 2652489 - protein, 6 aa, Entamoeba histolytica
RKMQKS

SEQ ID NO: 2652490 - protein, 9 aa, Entamoeba histolytica
RKNAQGDPF

SEQ ID NO: 2652491 - protein, 6 aa, Entamoeba histolytica
RKNARK

SEQ ID NO: 2652492 - protein, 5 aa, Entamoeba histolytica
RKNDN

SEQ ID NO: 2652493 - protein, 8 aa, Entamoeba histolytica
RKNEEQRV

SEQ ID NO: 2652494 - protein, 6 aa, Entamoeba histolytica
RKNELS

SEQ ID NO: 2652495 - protein, 108 aa, Entamoeba histolytica
RKNEMVEQAKAKANDAQSQIDSKKDELTKAENSLKDLEEDTKKEKDKVDAAQKQLRKAKEQRKDLLSKEKDAQREIEELKDKEKSERDKEREQKRAARRAAKKKEREM

SEQ ID NO: 2652496 - protein, 12 aa, Entamoeba histolytica
RKNEVQELKEGQ

SEQ ID NO: 2652497 - protein, 16 aa, Entamoeba histolytica
RKNKESILIKDDTPQQ

SEQ ID NO: 2652498 - protein, 14 aa, Entamoeba histolytica
RKNLKDEKKEIEEE

SEQ ID NO: 2652499 - protein, 11 aa, Entamoeba histolytica
RKNNEKEEEEI

SEQ ID NO: 2652500 - protein, 7 aa, Entamoeba histolytica
RKNNNEL

SEQ ID NO: 2652501 - protein, 16 aa, Entamoeba histolytica
RKNNNLSVPTHPTTSV

SEQ ID NO: 2652502 - protein, 7 aa, Entamoeba histolytica
RKNNQWI

SEQ ID NO: 2652503 - protein, 6 aa, Entamoeba histolytica
RKNPRK

SEQ ID NO: 2652504 - protein, 8 aa, Entamoeba histolytica
RKNQEITP

SEQ ID NO: 2652505 - protein, 10 aa, Entamoeba histolytica
RKNQPYTAKA

SEQ ID NO: 2652506 - protein, 8 aa, Entamoeba histolytica
RKNQRIQK

SEQ ID NO: 2652507 - protein, 9 aa, Entamoeba histolytica
RKNRNRESA

SEQ ID NO: 2652508 - protein, 22 aa, Entamoeba histolytica
RKNRQSCFSPSSITQSIDYNTE

SEQ ID NO: 2652509 - protein, 10 aa, Entamoeba histolytica
RKNSSEDKKG

SEQ ID NO: 2652510 - protein, 8 aa, Entamoeba histolytica
RKNTTNEQ

SEQ ID NO: 2652511 - protein, 11 aa, Entamoeba histolytica
RKPAGKASVSK

SEQ ID NO: 2652512 - protein, 15 aa, Entamoeba histolytica
RKPDRSVTPPNRIEQ

SEQ ID NO: 2652513 - protein, 7 aa, Entamoeba histolytica
RKPEETE

SEQ ID NO: 2652514 - protein, 9 aa, Entamoeba histolytica
RKPEGDIRT

SEQ ID NO: 2652515 - protein, 5 aa, Entamoeba histolytica
RKPEL

SEQ ID NO: 2652516 - protein, 9 aa, Entamoeba histolytica
RKPEMKRKV

SEQ ID NO: 2652517 - protein, 16 aa, Entamoeba histolytica
RKPIETRKLSTGRVES

SEQ ID NO: 2652518 - protein, 23 aa, Entamoeba histolytica
RKPKETDTITSEFNKKKEEWEKQ

SEQ ID NO: 2652519 - protein, 8 aa, Entamoeba histolytica
RKPLDGRK

SEQ ID NO: 2652520 - protein, 8 aa, Entamoeba histolytica
RKPLTEAK

SEQ ID NO: 2652521 - protein, 30 aa, Entamoeba histolytica
RKPLVPSKSPKAKTMKEQPALTKSCPTGEW

SEQ ID NO: 2652522 - protein, 12 aa, Entamoeba histolytica
RKPNNLKKTLQE

SEQ ID NO: 2652523 - protein, 4 aa, Entamoeba histolytica
RKPQ

SEQ ID NO: 2652524 - protein, 6 aa, Entamoeba histolytica
RKPQYT

SEQ ID NO: 2652525 - protein, 7 aa, Entamoeba histolytica
RKPSIIK

SEQ ID NO: 2652526 - protein, 8 aa, Entamoeba histolytica
RKPTNKMD

SEQ ID NO: 2652527 - protein, 4 aa, Entamoeba histolytica
RKPV

SEQ ID NO: 2652528 - protein, 8 aa, Entamoeba histolytica
RKQADGKD

SEQ ID NO: 2652529 - protein, 8 aa, Entamoeba histolytica
RKQAEGKD

SEQ ID NO: 2652530 - protein, 8 aa, Entamoeba histolytica
RKQDEEMT

SEQ ID NO: 2652531 - protein, 9 aa, Entamoeba histolytica
RKQDQLPTK

SEQ ID NO: 2652532 - protein, 4 aa, Entamoeba histolytica
RKQE

SEQ ID NO: 2652533 - protein, 10 aa, Entamoeba histolytica
RKQEEINQQN

SEQ ID NO: 2652534 - protein, 11 aa, Entamoeba histolytica
RKQEERPSPLS

SEQ ID NO: 2652535 - protein, 15 aa, Entamoeba histolytica
RKQKKQVGAEEGRAK

SEQ ID NO: 2652536 - protein, 12 aa, Entamoeba histolytica
RKQLKQSLSNEE

SEQ ID NO: 2652537 - protein, 8 aa, Entamoeba histolytica
RKQNKKNE

SEQ ID NO: 2652538 - protein, 15 aa, Entamoeba histolytica
RKQNKQPSPSVIPPA

SEQ ID NO: 2652539 - protein, 8 aa, Entamoeba histolytica
RKQPGKEQ

SEQ ID NO: 2652540 - protein, 27 aa, Entamoeba histolytica
RKQQAVTRVQTAENNYKQAVEKANAFG

SEQ ID NO: 2652541 - protein, 10 aa, Entamoeba histolytica
RKQQEPNALN

SEQ ID NO: 2652542 - protein, 12 aa, Entamoeba histolytica
RKQQEPNALNEI

SEQ ID NO: 2652543 - protein, 28 aa, Entamoeba histolytica
RKQQNSDAPEEAGKGGPKKQKEKKKCYL

SEQ ID NO: 2652544 - protein, 8 aa, Entamoeba histolytica
RKQQPQET

SEQ ID NO: 2652545 - protein, 4 aa, Entamoeba histolytica
RKQR

SEQ ID NO: 2652546 - protein, 15 aa, Entamoeba histolytica
RKQREVRDKKAECNS

SEQ ID NO: 2652547 - protein, 15 aa, Entamoeba histolytica
RKQRKRPIKTDTGET

SEQ ID NO: 2652548 - protein, 7 aa, Entamoeba histolytica
RKQRRQK

SEQ ID NO: 2652549 - protein, 9 aa, Entamoeba histolytica
RKQSEERNK

SEQ ID NO: 2652550 - protein, 10 aa, Entamoeba histolytica
RKQSISTDKT

SEQ ID NO: 2652551 - protein, 5 aa, Entamoeba histolytica
RKQST

SEQ ID NO: 2652552 - protein, 15 aa, Entamoeba histolytica
RKQTGPHGETHEWKN

SEQ ID NO: 2652553 - protein, 7 aa, Entamoeba histolytica
RKQTTVT

SEQ ID NO: 2652554 - protein, 4 aa, Entamoeba histolytica
RKQY

SEQ ID NO: 2652555 - protein, 9 aa, Entamoeba histolytica
RKRADDRKE

SEQ ID NO: 2652556 - protein, 18 aa, Entamoeba histolytica
RKRDKTKNKLPTESKKSL

SEQ ID NO: 2652557 - protein, 8 aa, Entamoeba histolytica
RKREGKKY

SEQ ID NO: 2652558 - protein, 20 aa, Entamoeba histolytica
RKREKGNKIKSKSSLLENST

SEQ ID NO: 2652559 - protein, 8 aa, Entamoeba histolytica
RKRGNSRG

SEQ ID NO: 2652560 - protein, 11 aa, Entamoeba histolytica
RKRKTKNKEAV

SEQ ID NO: 2652561 - protein, 7 aa, Entamoeba histolytica
RKRKVGT

SEQ ID NO: 2652562 - protein, 6 aa, Entamoeba histolytica
RKRKYT

SEQ ID NO: 2652563 - protein, 5 aa, Entamoeba histolytica
RKRLR

SEQ ID NO: 2652564 - protein, 11 aa, Entamoeba histolytica
RKRMEEEKNDK

SEQ ID NO: 2652565 - protein, 14 aa, Entamoeba histolytica
RKRMEEEKNDKRRY

SEQ ID NO: 2652566 - protein, 9 aa, Entamoeba histolytica
RKRPENRPR

SEQ ID NO: 2652567 - protein, 6 aa, Entamoeba histolytica
RKRRAK

SEQ ID NO: 2652568 - protein, 14 aa, Entamoeba histolytica
RKRREIRIEFNGEI

SEQ ID NO: 2652569 - protein, 16 aa, Entamoeba histolytica
RKRREKISRFLHLTKT

SEQ ID NO: 2652570 - protein, 13 aa, Entamoeba histolytica
RKRRGKDEEINDE

SEQ ID NO: 2652571 - protein, 182 aa, Entamoeba histolytica
RKRRQEEERRKEEEERRQQQEEEERRQQEEEEERRRQEEEEERRQEEEEEERKRQEEEEERKKQEQERKIQEHERKIQEYERKIKEQEEERKKQKEEQERKTQEQERKIQQLENKTQEQEKKIQEQERKIKEQEEERNKQKEEQDRKIQEQKEEQDKKIQEHERKIQEQERKTTEQEKKIQQ

SEQ ID NO: 2652572 - protein, 24 aa, Entamoeba histolytica
RKRRSYNRKNNGKRKKDPNKKEIE

SEQ ID NO: 2652573 - protein, 7 aa, Entamoeba histolytica
RKRSGAI

SEQ ID NO: 2652574 - protein, 16 aa, Entamoeba histolytica
RKRSKQERARLALALL

SEQ ID NO: 2652575 - protein, 66 aa, Entamoeba histolytica
RKRTEEKVNEKKEEIVQEKAPTRKINESPKKEDKIKTSQKEEEVKENLHTGSKEKDDTTRQEDKES

SEQ ID NO: 2652576 - protein, 6 aa, Entamoeba histolytica
RKRTEL

SEQ ID NO: 2652577 - protein, 15 aa, Entamoeba histolytica
RKSDEHHESQSIQDT

SEQ ID NO: 2652578 - protein, 8 aa, Entamoeba histolytica
RKSDGPLS

SEQ ID NO: 2652579 - protein, 16 aa, Entamoeba histolytica
RKSEEQLEEIKKSQNL

SEQ ID NO: 2652580 - protein, 11 aa, Entamoeba histolytica
RKSFKKNIPQE

SEQ ID NO: 2652581 - protein, 7 aa, Entamoeba histolytica
RKSGGDD

SEQ ID NO: 2652582 - protein, 10 aa, Entamoeba histolytica
RKSGIDTEIR

SEQ ID NO: 2652583 - protein, 13 aa, Entamoeba histolytica
RKSGIRDNSDESI

SEQ ID NO: 2652584 - protein, 8 aa, Entamoeba histolytica
RKSHSSRI

SEQ ID NO: 2652585 - protein, 6 aa, Entamoeba histolytica
RKSIAE

SEQ ID NO: 2652586 - protein, 11 aa, Entamoeba histolytica
RKSIEETPEFE

SEQ ID NO: 2652587 - protein, 7 aa, Entamoeba histolytica
RKSISKR

SEQ ID NO: 2652588 - protein, 13 aa, Entamoeba histolytica
RKSISRPGKRMED

SEQ ID NO: 2652589 - protein, 20 aa, Entamoeba histolytica
RKSKGLPPLERKKHDTGKRH

SEQ ID NO: 2652590 - protein, 9 aa, Entamoeba histolytica
RKSKKLSGL

SEQ ID NO: 2652591 - protein, 11 aa, Entamoeba histolytica
RKSLDSKEEVE

SEQ ID NO: 2652592 - protein, 10 aa, Entamoeba histolytica
RKSLEKSREV

SEQ ID NO: 2652593 - protein, 9 aa, Entamoeba histolytica
RKSNDGISI

SEQ ID NO: 2652594 - protein, 8 aa, Entamoeba histolytica
RKSNEEDL

SEQ ID NO: 2652595 - protein, 10 aa, Entamoeba histolytica
RKSNGEVSQT

SEQ ID NO: 2652596 - protein, 8 aa, Entamoeba histolytica
RKSNNKIN

SEQ ID NO: 2652597 - protein, 8 aa, Entamoeba histolytica
RKSPPIDL

SEQ ID NO: 2652598 - protein, 9 aa, Entamoeba histolytica
RKSPTRDPP

SEQ ID NO: 2652599 - protein, 8 aa, Entamoeba histolytica
RKSPVAPD

SEQ ID NO: 2652600 - protein, 4 aa, Entamoeba histolytica
RKSQ

SEQ ID NO: 2652601 - protein, 5 aa, Entamoeba histolytica
RKSRI

SEQ ID NO: 2652602 - protein, 8 aa, Entamoeba histolytica
RKSRRERR

SEQ ID NO: 2652603 - protein, 7 aa, Entamoeba histolytica
RKSSHFQ

SEQ ID NO: 2652604 - protein, 15 aa, Entamoeba histolytica
RKSSKEQNLSQSTDC

SEQ ID NO: 2652605 - protein, 7 aa, Entamoeba histolytica
RKSSKQL

SEQ ID NO: 2652606 - protein, 8 aa, Entamoeba histolytica
RKSSKSTM

SEQ ID NO: 2652607 - protein, 7 aa, Entamoeba histolytica
RKSSPFN

SEQ ID NO: 2652608 - protein, 6 aa, Entamoeba histolytica
RKSSTK

SEQ ID NO: 2652609 - protein, 6 aa, Entamoeba histolytica
RKSSVA

SEQ ID NO: 2652610 - protein, 9 aa, Entamoeba histolytica
RKSSYERDF

SEQ ID NO: 2652611 - protein, 9 aa, Entamoeba histolytica
RKSTDRDCH

SEQ ID NO: 2652612 - protein, 6 aa, Entamoeba histolytica
RKSTQE

SEQ ID NO: 2652613 - protein, 18 aa, Entamoeba histolytica
RKSVTPKDDATEIEIVDT

SEQ ID NO: 2652614 - protein, 4 aa, Entamoeba histolytica
RKSY

SEQ ID NO: 2652615 - protein, 6 aa, Entamoeba histolytica
RKTAEG

SEQ ID NO: 2652616 - protein, 8 aa, Entamoeba histolytica
RKTDALNQ

SEQ ID NO: 2652617 - protein, 6 aa, Entamoeba histolytica
RKTDTF

SEQ ID NO: 2652618 - protein, 5 aa, Entamoeba histolytica
RKTEA

SEQ ID NO: 2652619 - protein, 37 aa, Entamoeba histolytica
RKTEEDQKADEEATIAKTEKAEKKEKKKEKKVTKRKK

SEQ ID NO: 2652620 - protein, 21 aa, Entamoeba histolytica
RKTENGSGDINTSSLSDQGKT

SEQ ID NO: 2652621 - protein, 4 aa, Entamoeba histolytica
RKTF

SEQ ID NO: 2652622 - protein, 7 aa, Entamoeba histolytica
RKTGKPK

SEQ ID NO: 2652623 - protein, 12 aa, Entamoeba histolytica
RKTHETSREKWH

SEQ ID NO: 2652624 - protein, 12 aa, Entamoeba histolytica
RKTHTGTENDPE

SEQ ID NO: 2652625 - protein, 5 aa, Entamoeba histolytica
RKTIK

SEQ ID NO: 2652626 - protein, 5 aa, Entamoeba histolytica
RKTKD

SEQ ID NO: 2652627 - protein, 6 aa, Entamoeba histolytica
RKTKEY

SEQ ID NO: 2652628 - protein, 23 aa, Entamoeba histolytica
RKTKPKSHKDKKKKGGLFGIFKK

SEQ ID NO: 2652629 - protein, 17 aa, Entamoeba histolytica
RKTKVGGKGKKKGGCDL

SEQ ID NO: 2652630 - protein, 7 aa, Entamoeba histolytica
RKTLGKR

SEQ ID NO: 2652631 - protein, 9 aa, Entamoeba histolytica
RKTNDTRVE

SEQ ID NO: 2652632 - protein, 14 aa, Entamoeba histolytica
RKTNINCGGATTKK

SEQ ID NO: 2652633 - protein, 5 aa, Entamoeba histolytica
RKTQE

SEQ ID NO: 2652634 - protein, 8 aa, Entamoeba histolytica
RKTSSSFG

SEQ ID NO: 2652635 - protein, 15 aa, Entamoeba histolytica
RKTSSTKMNSQSSRS

SEQ ID NO: 2652636 - protein, 22 aa, Entamoeba histolytica
RKTVISTKTEVPFTRTTTVENQ

SEQ ID NO: 2652637 - protein, 9 aa, Entamoeba histolytica
RKVAKQSVS

SEQ ID NO: 2652638 - protein, 7 aa, Entamoeba histolytica
RKVDKDT

SEQ ID NO: 2652639 - protein, 8 aa, Entamoeba histolytica
RKVEDKEV

SEQ ID NO: 2652640 - protein, 8 aa, Entamoeba histolytica
RKVREECE

SEQ ID NO: 2652641 - protein, 6 aa, Entamoeba histolytica
RKVRSI

SEQ ID NO: 2652642 - protein, 11 aa, Entamoeba histolytica
RKVSDIPPSVT

SEQ ID NO: 2652643 - protein, 9 aa, Entamoeba histolytica
RKVSDSDIE

SEQ ID NO: 2652644 - protein, 7 aa, Entamoeba histolytica
RKVTPSI

SEQ ID NO: 2652645 - protein, 8 aa, Entamoeba histolytica
RKWGSYGS

SEQ ID NO: 2652646 - protein, 7 aa, Entamoeba histolytica
RKWGYSN

SEQ ID NO: 2652647 - protein, 16 aa, Entamoeba histolytica
RKWSSNNKSVLEGNEK

SEQ ID NO: 2652648 - protein, 7 aa, Entamoeba histolytica
RKYDEDI

SEQ ID NO: 2652649 - protein, 6 aa, Entamoeba histolytica
RKYEDA

SEQ ID NO: 2652650 - protein, 9 aa, Entamoeba histolytica
RKYEEEKKK

SEQ ID NO: 2652651 - protein, 8 aa, Entamoeba histolytica
RKYEPESF

SEQ ID NO: 2652652 - protein, 11 aa, Entamoeba histolytica
RKYGSCPHGGY

SEQ ID NO: 2652653 - protein, 7 aa, Entamoeba histolytica
RKYGTSN

SEQ ID NO: 2652654 - protein, 12 aa, Entamoeba histolytica
RKYKSEPKYSEY

SEQ ID NO: 2652655 - protein, 12 aa, Entamoeba histolytica
RKYKSNKSLPKQ

SEQ ID NO: 2652656 - protein, 17 aa, Entamoeba histolytica
RKYKTEKYKEKINKGTK

SEQ ID NO: 2652657 - protein, 10 aa, Entamoeba histolytica
RKYQKKNSEI

SEQ ID NO: 2652658 - protein, 6 aa, Entamoeba histolytica
RKYQSN

SEQ ID NO: 2652659 - protein, 4 aa, Entamoeba histolytica
RKYR

SEQ ID NO: 2652660 - protein, 9 aa, Entamoeba histolytica
RKYSKPLGN

SEQ ID NO: 2652661 - protein, 9 aa, Entamoeba histolytica
RKYSPTSAK

SEQ ID NO: 2652662 - protein, 8 aa, Entamoeba histolytica
RKYSRQLS

SEQ ID NO: 2652663 - protein, 12 aa, Entamoeba histolytica
RLDDSKFPKLGS

SEQ ID NO: 2652664 - protein, 5 aa, Entamoeba histolytica
RLDGC

SEQ ID NO: 2652665 - protein, 4 aa, Entamoeba histolytica
RLDK

SEQ ID NO: 2652666 - protein, 10 aa, Entamoeba histolytica
RLDPDNNQDL

SEQ ID NO: 2652667 - protein, 7 aa, Entamoeba histolytica
RLDPSTN

SEQ ID NO: 2652668 - protein, 5 aa, Entamoeba histolytica
RLDQK

SEQ ID NO: 2652669 - protein, 9 aa, Entamoeba histolytica
RLDQSSYED

SEQ ID NO: 2652670 - protein, 8 aa, Entamoeba histolytica
RLDRTSPA

SEQ ID NO: 2652671 - protein, 97 aa, Entamoeba histolytica
RLEENERKIKEEEKKKTEEEKKEKDVKEFKSKQVTIEEDNSNNKEITSQQEEEQIKQANISKTKNVSIKQEEKQIEEERQIEEERQIEEEKQTKEKE

SEQ ID NO: 2652672 - protein, 29 aa, Entamoeba histolytica
RLEETKKGEKGYQEKRKELNERLSKQTDI

SEQ ID NO: 2652673 - protein, 9 aa, Entamoeba histolytica
RLEKEAAEV

SEQ ID NO: 2652674 - protein, 7 aa, Entamoeba histolytica
RLEPKKE

SEQ ID NO: 2652675 - protein, 23 aa, Entamoeba histolytica
RLEQEKAKIKDQFNTTKEQLNNI

SEQ ID NO: 2652676 - protein, 10 aa, Entamoeba histolytica
RLESESKEGM

SEQ ID NO: 2652677 - protein, 17 aa, Entamoeba histolytica
RLGDKDEIKKAQLNTQQ

SEQ ID NO: 2652678 - protein, 11 aa, Entamoeba histolytica
RLGNRSEHQDE

SEQ ID NO: 2652679 - protein, 14 aa, Entamoeba histolytica
RLGPAELDKPDLGN

SEQ ID NO: 2652680 - protein, 4 aa, Entamoeba histolytica
RLGS

SEQ ID NO: 2652681 - protein, 21 aa, Entamoeba histolytica
RLGTASQKEPQLTDDDYKKYA

SEQ ID NO: 2652682 - protein, 11 aa, Entamoeba histolytica
RLGTIESSEMM

SEQ ID NO: 2652683 - protein, 14 aa, Entamoeba histolytica
RLGTKDEQKAHLKS

SEQ ID NO: 2652684 - protein, 8 aa, Entamoeba histolytica
RLKKGYEK

SEQ ID NO: 2652685 - protein, 8 aa, Entamoeba histolytica
RLKNNEGQ

SEQ ID NO: 2652686 - protein, 8 aa, Entamoeba histolytica
RLKNNPST

SEQ ID NO: 2652687 - protein, 7 aa, Entamoeba histolytica
RLKPSHL

SEQ ID NO: 2652688 - protein, 20 aa, Entamoeba histolytica
RLNAEQQQIEKRRKEEQERC

SEQ ID NO: 2652689 - protein, 8 aa, Entamoeba histolytica
RLNDPTSE

SEQ ID NO: 2652690 - protein, 4 aa, Entamoeba histolytica
RLNE

SEQ ID NO: 2652691 - protein, 14 aa, Entamoeba histolytica
RLNENEKSLLTTET

SEQ ID NO: 2652692 - protein, 9 aa, Entamoeba histolytica
RLNKEQKKV

SEQ ID NO: 2652693 - protein, 8 aa, Entamoeba histolytica
RLPDPQGL

SEQ ID NO: 2652694 - protein, 14 aa, Entamoeba histolytica
RLPFNNSTNSLTTI

SEQ ID NO: 2652695 - protein, 5 aa, Entamoeba histolytica
RLPGE

SEQ ID NO: 2652696 - protein, 4 aa, Entamoeba histolytica
RLPK

SEQ ID NO: 2652697 - protein, 9 aa, Entamoeba histolytica
RLPKPKECD

SEQ ID NO: 2652698 - protein, 10 aa, Entamoeba histolytica
RLPNPRRVKT

SEQ ID NO: 2652699 - protein, 11 aa, Entamoeba histolytica
RLQDESDEQDI

SEQ ID NO: 2652700 - protein, 8 aa, Entamoeba histolytica
RLQEKHPE

SEQ ID NO: 2652701 - protein, 12 aa, Entamoeba histolytica
RLQKGSKPKIER

SEQ ID NO: 2652702 - protein, 10 aa, Entamoeba histolytica
RLQNETEPFT

SEQ ID NO: 2652703 - protein, 10 aa, Entamoeba histolytica
RLQNGKGIKG

SEQ ID NO: 2652704 - protein, 6 aa, Entamoeba histolytica
RLQRVG

SEQ ID NO: 2652705 - protein, 13 aa, Entamoeba histolytica
RLRKSSIQTKRET

SEQ ID NO: 2652706 - protein, 11 aa, Entamoeba histolytica
RLRNQTKENSP

SEQ ID NO: 2652707 - protein, 6 aa, Entamoeba histolytica
RLSDEA

SEQ ID NO: 2652708 - protein, 4 aa, Entamoeba histolytica
RLSE

SEQ ID NO: 2652709 - protein, 7 aa, Entamoeba histolytica
RLSEDDI

SEQ ID NO: 2652710 - protein, 18 aa, Entamoeba histolytica
RLSEKNPNKCSSKKDENV

SEQ ID NO: 2652711 - protein, 5 aa, Entamoeba histolytica
RLSEQ

SEQ ID NO: 2652712 - protein, 6 aa, Entamoeba histolytica
RLSGDQ

SEQ ID NO: 2652713 - protein, 20 aa, Entamoeba histolytica
RLSIEESKRLYGSKNLARED

SEQ ID NO: 2652714 - protein, 19 aa, Entamoeba histolytica
RLSKKKKQVIQQRAPSFDP

SEQ ID NO: 2652715 - protein, 12 aa, Entamoeba histolytica
RLSKSSTTNDFK

SEQ ID NO: 2652716 - protein, 6 aa, Entamoeba histolytica
RLSNVQ

SEQ ID NO: 2652717 - protein, 14 aa, Entamoeba histolytica
RLSQKYPEQFNSEN

SEQ ID NO: 2652718 - protein, 8 aa, Entamoeba histolytica
RLSQRDLS

SEQ ID NO: 2652719 - protein, 9 aa, Entamoeba histolytica
RLSQTINPF

SEQ ID NO: 2652720 - protein, 6 aa, Entamoeba histolytica
RLSQYE

SEQ ID NO: 2652721 - protein, 11 aa, Entamoeba histolytica
RLSSQNSKESF

SEQ ID NO: 2652722 - protein, 36 aa, Entamoeba histolytica
RLSSQNSTQPQLQTKEISSVTQEKHDEVPKKKRRRK

SEQ ID NO: 2652723 - protein, 6 aa, Entamoeba histolytica
RLSSTN

SEQ ID NO: 2652724 - protein, 10 aa, Entamoeba histolytica
RLSTGRVETS

SEQ ID NO: 2652725 - protein, 6 aa, Entamoeba histolytica
RLSVTK

SEQ ID NO: 2652726 - protein, 11 aa, Entamoeba histolytica
RLTDEETQKIA

SEQ ID NO: 2652727 - protein, 13 aa, Entamoeba histolytica
RLTEGKKDTSKLE

SEQ ID NO: 2652728 - protein, 8 aa, Entamoeba histolytica
RLTEKAEE

SEQ ID NO: 2652729 - protein, 5 aa, Entamoeba histolytica
RLTND

SEQ ID NO: 2652730 - protein, 8 aa, Entamoeba histolytica
RLTNPQTL

SEQ ID NO: 2652731 - protein, 5 aa, Entamoeba histolytica
RLTPS

SEQ ID NO: 2652732 - protein, 6 aa, Entamoeba histolytica
RLTQQQ

SEQ ID NO: 2652733 - protein, 10 aa, Entamoeba histolytica
RLTSGIKNKP

SEQ ID NO: 2652734 - protein, 4 aa, Entamoeba histolytica
RLVQ

SEQ ID NO: 2652735 - protein, 5 aa, Entamoeba histolytica
RMDSL

SEQ ID NO: 2652736 - protein, 7 aa, Entamoeba histolytica
RMKEEEA

SEQ ID NO: 2652737 - protein, 24 aa, Entamoeba histolytica
RMKEETEKKIKEEVSQKEKRINEL

SEQ ID NO: 2652738 - protein, 9 aa, Entamoeba histolytica
RMKENKSID

SEQ ID NO: 2652739 - protein, 12 aa, Entamoeba histolytica
RMKPRRNNQFNK

SEQ ID NO: 2652740 - protein, 8 aa, Entamoeba histolytica
RMKSEYPT

SEQ ID NO: 2652741 - protein, 9 aa, Entamoeba histolytica
RMNDQEKEE

SEQ ID NO: 2652742 - protein, 6 aa, Entamoeba histolytica
RMNEEI

SEQ ID NO: 2652743 - protein, 8 aa, Entamoeba histolytica
RMNEERER

SEQ ID NO: 2652744 - protein, 5 aa, Entamoeba histolytica
RMNEQ

SEQ ID NO: 2652745 - protein, 4 aa, Entamoeba histolytica
RMNN

SEQ ID NO: 2652746 - protein, 6 aa, Entamoeba histolytica
RMNPKS

SEQ ID NO: 2652747 - protein, 6 aa, Entamoeba histolytica
RMNSSK

SEQ ID NO: 2652748 - protein, 23 aa, Entamoeba histolytica
RMPTSPRSILSPRSNSQSKKSPD

SEQ ID NO: 2652749 - protein, 7 aa, Entamoeba histolytica
RMQESTE

SEQ ID NO: 2652750 - protein, 4 aa, Entamoeba histolytica
RMQS

SEQ ID NO: 2652751 - protein, 12 aa, Entamoeba histolytica
RMRGGPLKKGQS

SEQ ID NO: 2652752 - protein, 5 aa, Entamoeba histolytica
RMRNS

SEQ ID NO: 2652753 - protein, 11 aa, Entamoeba histolytica
RMSSQDIKAKE

SEQ ID NO: 2652754 - protein, 4 aa, Entamoeba histolytica
RMSV

SEQ ID NO: 2652755 - protein, 9 aa, Entamoeba histolytica
RMTTGREMT

SEQ ID NO: 2652756 - protein, 6 aa, Entamoeba histolytica
RNAGDC

SEQ ID NO: 2652757 - protein, 10 aa, Entamoeba histolytica
RNAGENKSKW

SEQ ID NO: 2652758 - protein, 14 aa, Entamoeba histolytica
RNAKYKDYNPNSPQ

SEQ ID NO: 2652759 - protein, 23 aa, Entamoeba histolytica
RNAPDRLDTNEASRKTIETIKDA

SEQ ID NO: 2652760 - protein, 7 aa, Entamoeba histolytica
RNAPPSV

SEQ ID NO: 2652761 - protein, 23 aa, Entamoeba histolytica
RNAPVDNKKEKKAKKEKKKGCLL

SEQ ID NO: 2652762 - protein, 7 aa, Entamoeba histolytica
RNATDRE

SEQ ID NO: 2652763 - protein, 11 aa, Entamoeba histolytica
RNCDKVKEESV

SEQ ID NO: 2652764 - protein, 8 aa, Entamoeba histolytica
RNCGKTRG

SEQ ID NO: 2652765 - protein, 5 aa, Entamoeba histolytica
RNCKH

SEQ ID NO: 2652766 - protein, 11 aa, Entamoeba histolytica
RNCKNSTERVG

SEQ ID NO: 2652767 - protein, 9 aa, Entamoeba histolytica
RNCSQEERE

SEQ ID NO: 2652768 - protein, 5 aa, Entamoeba histolytica
RNDAA

SEQ ID NO: 2652769 - protein, 7 aa, Entamoeba histolytica
RNDDDMK

SEQ ID NO: 2652770 - protein, 7 aa, Entamoeba histolytica
RNDDEKI

SEQ ID NO: 2652771 - protein, 7 aa, Entamoeba histolytica
RNDEEVK

SEQ ID NO: 2652772 - protein, 6 aa, Entamoeba histolytica
RNDEIT

SEQ ID NO: 2652773 - protein, 9 aa, Entamoeba histolytica
RNDEQRKNL

SEQ ID NO: 2652774 - protein, 6 aa, Entamoeba histolytica
RNDFED

SEQ ID NO: 2652775 - protein, 19 aa, Entamoeba histolytica
RNDKEKYQEFSDKEYDKTI

SEQ ID NO: 2652776 - protein, 5 aa, Entamoeba histolytica
RNDKV

SEQ ID NO: 2652777 - protein, 9 aa, Entamoeba histolytica
RNDLPSADN

SEQ ID NO: 2652778 - protein, 12 aa, Entamoeba histolytica
RNDMRRSRRREM

SEQ ID NO: 2652779 - protein, 8 aa, Entamoeba histolytica
RNDNAEKI

SEQ ID NO: 2652780 - protein, 13 aa, Entamoeba histolytica
RNDNHLESSGDLS

SEQ ID NO: 2652781 - protein, 19 aa, Entamoeba histolytica
RNDSITKQFKRKNKSQTIY

SEQ ID NO: 2652782 - protein, 10 aa, Entamoeba histolytica
RNDTEGTGEL

SEQ ID NO: 2652783 - protein, 4 aa, Entamoeba histolytica
RNDV

SEQ ID NO: 2652784 - protein, 4 aa, Entamoeba histolytica
RNDY

SEQ ID NO: 2652785 - protein, 8 aa, Entamoeba histolytica
RNDYKQLN

SEQ ID NO: 2652786 - protein, 5 aa, Entamoeba histolytica
RNEAG

SEQ ID NO: 2652787 - protein, 4 aa, Entamoeba histolytica
RNED

SEQ ID NO: 2652788 - protein, 10 aa, Entamoeba histolytica
RNEEEPNGIK

SEQ ID NO: 2652789 - protein, 9 aa, Entamoeba histolytica
RNEEKSTYF

SEQ ID NO: 2652790 - protein, 14 aa, Entamoeba histolytica
RNEEKYGSKYRKTR

SEQ ID NO: 2652791 - protein, 12 aa, Entamoeba histolytica
RNEELEKENTEM

SEQ ID NO: 2652792 - protein, 4 aa, Entamoeba histolytica
RNEF

SEQ ID NO: 2652793 - protein, 4 aa, Entamoeba histolytica
RNEG

SEQ ID NO: 2652794 - protein, 10 aa, Entamoeba histolytica
RNEKEIKEME

SEQ ID NO: 2652795 - protein, 9 aa, Entamoeba histolytica
RNEKRERKT

SEQ ID NO: 2652796 - protein, 5 aa, Entamoeba histolytica
RNELN

SEQ ID NO: 2652797 - protein, 23 aa, Entamoeba histolytica
RNELNRKMATPDFGKQNNDDDLL

SEQ ID NO: 2652798 - protein, 4 aa, Entamoeba histolytica
RNEN

SEQ ID NO: 2652799 - protein, 6 aa, Entamoeba histolytica
RNENCE

SEQ ID NO: 2652800 - protein, 7 aa, Entamoeba histolytica
RNENEKT

SEQ ID NO: 2652801 - protein, 6 aa, Entamoeba histolytica
RNENEL

SEQ ID NO: 2652802 - protein, 9 aa, Entamoeba histolytica
RNENGDQFS

SEQ ID NO: 2652803 - protein, 6 aa, Entamoeba histolytica
RNENIN

SEQ ID NO: 2652804 - protein, 10 aa, Entamoeba histolytica
RNENKERNKE

SEQ ID NO: 2652805 - protein, 13 aa, Entamoeba histolytica
RNENKHPEMNDNN

SEQ ID NO: 2652806 - protein, 25 aa, Entamoeba histolytica
RNENSTEKIKGDSNPVLRKQPKRTS

SEQ ID NO: 2652807 - protein, 7 aa, Entamoeba histolytica
RNENTIK

SEQ ID NO: 2652808 - protein, 21 aa, Entamoeba histolytica
RNEPEQEPGTTEYAPVFIFDD

SEQ ID NO: 2652809 - protein, 4 aa, Entamoeba histolytica
RNEQ

SEQ ID NO: 2652810 - protein, 6 aa, Entamoeba histolytica
RNEQGT

SEQ ID NO: 2652811 - protein, 19 aa, Entamoeba histolytica
RNEQTENTQEKKETNTNQT

SEQ ID NO: 2652812 - protein, 7 aa, Entamoeba histolytica
RNEQTPI

SEQ ID NO: 2652813 - protein, 5 aa, Entamoeba histolytica
RNERR

SEQ ID NO: 2652814 - protein, 8 aa, Entamoeba histolytica
RNERSNTV

SEQ ID NO: 2652815 - protein, 8 aa, Entamoeba histolytica
RNERYGKL

SEQ ID NO: 2652816 - protein, 4 aa, Entamoeba histolytica
RNES

SEQ ID NO: 2652817 - protein, 7 aa, Entamoeba histolytica
RNETARY

SEQ ID NO: 2652818 - protein, 6 aa, Entamoeba histolytica
RNEWKN

SEQ ID NO: 2652819 - protein, 5 aa, Entamoeba histolytica
RNEYE

SEQ ID NO: 2652820 - protein, 7 aa, Entamoeba histolytica
RNEYETI

SEQ ID NO: 2652821 - protein, 6 aa, Entamoeba histolytica
RNGAKR

SEQ ID NO: 2652822 - protein, 4 aa, Entamoeba histolytica
RNGC

SEQ ID NO: 2652823 - protein, 7 aa, Entamoeba histolytica
RNGCGKS

SEQ ID NO: 2652824 - protein, 7 aa, Entamoeba histolytica
RNGCGKT

SEQ ID NO: 2652825 - protein, 16 aa, Entamoeba histolytica
RNGDDLINNRGTVSSY

SEQ ID NO: 2652826 - protein, 9 aa, Entamoeba histolytica
RNGEENERI

SEQ ID NO: 2652827 - protein, 6 aa, Entamoeba histolytica
RNGEIQ

SEQ ID NO: 2652828 - protein, 11 aa, Entamoeba histolytica
RNGEKKSNDDI

SEQ ID NO: 2652829 - protein, 6 aa, Entamoeba histolytica
RNGHGA

SEQ ID NO: 2652830 - protein, 4 aa, Entamoeba histolytica
RNGI

SEQ ID NO: 2652831 - protein, 5 aa, Entamoeba histolytica
RNGIQ

SEQ ID NO: 2652832 - protein, 10 aa, Entamoeba histolytica
RNGKSDNYEM

SEQ ID NO: 2652833 - protein, 7 aa, Entamoeba histolytica
RNGKSEI

SEQ ID NO: 2652834 - protein, 10 aa, Entamoeba histolytica
RNGKTQQKDV

SEQ ID NO: 2652835 - protein, 4 aa, Entamoeba histolytica
RNGL

SEQ ID NO: 2652836 - protein, 8 aa, Entamoeba histolytica
RNGNKVYD

SEQ ID NO: 2652837 - protein, 9 aa, Entamoeba histolytica
RNGSDDTNK

SEQ ID NO: 2652838 - protein, 9 aa, Entamoeba histolytica
RNGSGKSNF

SEQ ID NO: 2652839 - protein, 5 aa, Entamoeba histolytica
RNGSL

SEQ ID NO: 2652840 - protein, 6 aa, Entamoeba histolytica
RNGSLE

SEQ ID NO: 2652841 - protein, 15 aa, Entamoeba histolytica
RNGYRTVEHQRTEKI

SEQ ID NO: 2652842 - protein, 7 aa, Entamoeba histolytica
RNHPSTP

SEQ ID NO: 2652843 - protein, 10 aa, Entamoeba histolytica
RNHRKEKEIN

SEQ ID NO: 2652844 - protein, 5 aa, Entamoeba histolytica
RNHTS

SEQ ID NO: 2652845 - protein, 12 aa, Entamoeba histolytica
RNIDVPSNRDWR

SEQ ID NO: 2652846 - protein, 13 aa, Entamoeba histolytica
RNIEEEAKKYIPK

SEQ ID NO: 2652847 - protein, 16 aa, Entamoeba histolytica
RNIETSENDKEIKKDI

SEQ ID NO: 2652848 - protein, 8 aa, Entamoeba histolytica
RNIGEEKP

SEQ ID NO: 2652849 - protein, 9 aa, Entamoeba histolytica
RNIKGDDYK

SEQ ID NO: 2652850 - protein, 5 aa, Entamoeba histolytica
RNINN

SEQ ID NO: 2652851 - protein, 10 aa, Entamoeba histolytica
RNIQREQETI

SEQ ID NO: 2652852 - protein, 7 aa, Entamoeba histolytica
RNIRTSE

SEQ ID NO: 2652853 - protein, 7 aa, Entamoeba histolytica
RNISKEI

SEQ ID NO: 2652854 - protein, 13 aa, Entamoeba histolytica
RNISNKNKFPQDK

SEQ ID NO: 2652855 - protein, 10 aa, Entamoeba histolytica
RNITTNNEHA

SEQ ID NO: 2652856 - protein, 7 aa, Entamoeba histolytica
RNKDYKK

SEQ ID NO: 2652857 - protein, 5 aa, Entamoeba histolytica
RNKEC

SEQ ID NO: 2652858 - protein, 20 aa, Entamoeba histolytica
RNKEDKKLKKKKEINEDVEE

SEQ ID NO: 2652859 - protein, 50 aa, Entamoeba histolytica
RNKEEKEKEEKEQLEKELKESGAIPMEEEQKSAGYIPSVPKKRSLFDDTS

SEQ ID NO: 2652860 - protein, 15 aa, Entamoeba histolytica
RNKENELKQKNKQYH

SEQ ID NO: 2652861 - protein, 7 aa, Entamoeba histolytica
RNKGDVS

SEQ ID NO: 2652862 - protein, 5 aa, Entamoeba histolytica
RNKGK

SEQ ID NO: 2652863 - protein, 8 aa, Entamoeba histolytica
RNKGSSIN

SEQ ID NO: 2652864 - protein, 9 aa, Entamoeba histolytica
RNKKESRPY

SEQ ID NO: 2652865 - protein, 8 aa, Entamoeba histolytica
RNKKQSVT

SEQ ID NO: 2652866 - protein, 18 aa, Entamoeba histolytica
RNKKRDQLLQTKREPHSL

SEQ ID NO: 2652867 - protein, 9 aa, Entamoeba histolytica
RNKLKNALQ

SEQ ID NO: 2652868 - protein, 7 aa, Entamoeba histolytica
RNKQEFE

SEQ ID NO: 2652869 - protein, 8 aa, Entamoeba histolytica
RNKRITPF

SEQ ID NO: 2652870 - protein, 21 aa, Entamoeba histolytica
RNKRRTQSWSPIQSPKETAIQ

SEQ ID NO: 2652871 - protein, 7 aa, Entamoeba histolytica
RNKSEAS

SEQ ID NO: 2652872 - protein, 7 aa, Entamoeba histolytica
RNKSGKA

SEQ ID NO: 2652873 - protein, 9 aa, Entamoeba histolytica
RNKSLKRRT

SEQ ID NO: 2652874 - protein, 5 aa, Entamoeba histolytica
RNKTE

SEQ ID NO: 2652875 - protein, 9 aa, Entamoeba histolytica
RNLDGKEKS

SEQ ID NO: 2652876 - protein, 22 aa, Entamoeba histolytica
RNLENSRLRNNKQKSNEPTMTQ

SEQ ID NO: 2652877 - protein, 4 aa, Entamoeba histolytica
RNLP

SEQ ID NO: 2652878 - protein, 8 aa, Entamoeba histolytica
RNLPQNKG

SEQ ID NO: 2652879 - protein, 19 aa, Entamoeba histolytica
RNMNDSERAEAAKKDAAYS

SEQ ID NO: 2652880 - protein, 10 aa, Entamoeba histolytica
RNMNGGYKDF

SEQ ID NO: 2652881 - protein, 5 aa, Entamoeba histolytica
RNMNK

SEQ ID NO: 2652882 - protein, 6 aa, Entamoeba histolytica
RNMNKG

SEQ ID NO: 2652883 - protein, 6 aa, Entamoeba histolytica
RNMTNQ

SEQ ID NO: 2652884 - protein, 6 aa, Entamoeba histolytica
RNMTNR

SEQ ID NO: 2652885 - protein, 9 aa, Entamoeba histolytica
RNNAPDEYK

SEQ ID NO: 2652886 - protein, 11 aa, Entamoeba histolytica
RNNCEEKRIEE

SEQ ID NO: 2652887 - protein, 7 aa, Entamoeba histolytica
RNNDTVK

SEQ ID NO: 2652888 - protein, 5 aa, Entamoeba histolytica
RNNEL

SEQ ID NO: 2652889 - protein, 5 aa, Entamoeba histolytica
RNNEN

SEQ ID NO: 2652890 - protein, 20 aa, Entamoeba histolytica
RNNGKSIKDKYENETTIEEQ

SEQ ID NO: 2652891 - protein, 5 aa, Entamoeba histolytica
RNNGQ

SEQ ID NO: 2652892 - protein, 4 aa, Entamoeba histolytica
RNNK

SEQ ID NO: 2652893 - protein, 11 aa, Entamoeba histolytica
RNNKGEEEIVE

SEQ ID NO: 2652894 - protein, 27 aa, Entamoeba histolytica
RNNKQKSNEPTMTHPNNEQEKNTLPSV

SEQ ID NO: 2652895 - protein, 7 aa, Entamoeba histolytica
RNNKRIQ

SEQ ID NO: 2652896 - protein, 5 aa, Entamoeba histolytica
RNNLP

SEQ ID NO: 2652897 - protein, 4 aa, Entamoeba histolytica
RNNN

SEQ ID NO: 2652898 - protein, 7 aa, Entamoeba histolytica
RNNNEIN

SEQ ID NO: 2652899 - protein, 6 aa, Entamoeba histolytica
RNNNHP

SEQ ID NO: 2652900 - protein, 7 aa, Entamoeba histolytica
RNNNVAK

SEQ ID NO: 2652901 - protein, 14 aa, Entamoeba histolytica
RNNPSVAALQGEKT

SEQ ID NO: 2652902 - protein, 7 aa, Entamoeba histolytica
RNNQQYQ

SEQ ID NO: 2652903 - protein, 8 aa, Entamoeba histolytica
RNNSERIQ

SEQ ID NO: 2652904 - protein, 6 aa, Entamoeba histolytica
RNNSIG

SEQ ID NO: 2652905 - protein, 33 aa, Entamoeba histolytica
RNNTITKIDNPNGKFGTFTPGLDSSSPCISSKE

SEQ ID NO: 2652906 - protein, 5 aa, Entamoeba histolytica
RNNTL

SEQ ID NO: 2652907 - protein, 5 aa, Entamoeba histolytica
RNNVR

SEQ ID NO: 2652908 - protein, 8 aa, Entamoeba histolytica
RNNYNTNG

SEQ ID NO: 2652909 - protein, 4 aa, Entamoeba histolytica
RNPE

SEQ ID NO: 2652910 - protein, 7 aa, Entamoeba histolytica
RNPEERI

SEQ ID NO: 2652911 - protein, 8 aa, Entamoeba histolytica
RNPETNKY

SEQ ID NO: 2652912 - protein, 16 aa, Entamoeba histolytica
RNPGAQKYKEKKDIRV

SEQ ID NO: 2652913 - protein, 4 aa, Entamoeba histolytica
RNPH

SEQ ID NO: 2652914 - protein, 7 aa, Entamoeba histolytica
RNPKLAQ

SEQ ID NO: 2652915 - protein, 17 aa, Entamoeba histolytica
RNPLADSPSTNPITPQS

SEQ ID NO: 2652916 - protein, 9 aa, Entamoeba histolytica
RNPLKTTTF

SEQ ID NO: 2652917 - protein, 5 aa, Entamoeba histolytica
RNPNC

SEQ ID NO: 2652918 - protein, 11 aa, Entamoeba histolytica
RNPNQRASSRE

SEQ ID NO: 2652919 - protein, 16 aa, Entamoeba histolytica
RNPPPIPPPPENPFPF

SEQ ID NO: 2652920 - protein, 5 aa, Entamoeba histolytica
RNPQF

SEQ ID NO: 2652921 - protein, 5 aa, Entamoeba histolytica
RNPQR

SEQ ID NO: 2652922 - protein, 7 aa, Entamoeba histolytica
RNPSPEK

SEQ ID NO: 2652923 - protein, 29 aa, Entamoeba histolytica
RNPSSNFDKPKKDKKKSHKKSKKVNQKKT

SEQ ID NO: 2652924 - protein, 7 aa, Entamoeba histolytica
RNPSWNK

SEQ ID NO: 2652925 - protein, 9 aa, Entamoeba histolytica
RNPTKVSKE

SEQ ID NO: 2652926 - protein, 7 aa, Entamoeba histolytica
RNPTQPV

SEQ ID NO: 2652927 - protein, 56 aa, Entamoeba histolytica
RNPTYQAPLSQYPQPQSQPPYKPTDQSKFKTVSEVNKRPDNIQDDNLQIAPKKPPE

SEQ ID NO: 2652928 - protein, 6 aa, Entamoeba histolytica
RNPYEM

SEQ ID NO: 2652929 - protein, 12 aa, Entamoeba histolytica
RNPYTGSSHEPY

SEQ ID NO: 2652930 - protein, 6 aa, Entamoeba histolytica
RNQETK

SEQ ID NO: 2652931 - protein, 12 aa, Entamoeba histolytica
RNQITDKSGYVE

SEQ ID NO: 2652932 - protein, 33 aa, Entamoeba histolytica
RNQKKSISSRSSCDISSCNTENKVHKKEDDFPK

SEQ ID NO: 2652933 - protein, 5 aa, Entamoeba histolytica
RNQLQ

SEQ ID NO: 2652934 - protein, 22 aa, Entamoeba histolytica
RNQQVIATEGERHLGGKDIDRK

SEQ ID NO: 2652935 - protein, 5 aa, Entamoeba histolytica
RNQST

SEQ ID NO: 2652936 - protein, 24 aa, Entamoeba histolytica
RNQTEETYSKEDRDKHNLMTQGKK

SEQ ID NO: 2652937 - protein, 9 aa, Entamoeba histolytica
RNQTGETAL

SEQ ID NO: 2652938 - protein, 5 aa, Entamoeba histolytica
RNQTM

SEQ ID NO: 2652939 - protein, 8 aa, Entamoeba histolytica
RNQTPKTL

SEQ ID NO: 2652940 - protein, 5 aa, Entamoeba histolytica
RNQWS

SEQ ID NO: 2652941 - protein, 4 aa, Entamoeba histolytica
RNRD

SEQ ID NO: 2652942 - protein, 17 aa, Entamoeba histolytica
RNRDEDDDFGSIDGRTA

SEQ ID NO: 2652943 - protein, 5 aa, Entamoeba histolytica
RNRDR

SEQ ID NO: 2652944 - protein, 13 aa, Entamoeba histolytica
RNRGVSDADKKNK

SEQ ID NO: 2652945 - protein, 10 aa, Entamoeba histolytica
RNRISQDVEG

SEQ ID NO: 2652946 - protein, 9 aa, Entamoeba histolytica
RNRKGEEYN

SEQ ID NO: 2652947 - protein, 6 aa, Entamoeba histolytica
RNRKQC

SEQ ID NO: 2652948 - protein, 7 aa, Entamoeba histolytica
RNRLAGP

SEQ ID NO: 2652949 - protein, 10 aa, Entamoeba histolytica
RNRLPNDEMA

SEQ ID NO: 2652950 - protein, 8 aa, Entamoeba histolytica
RNRMDEGY

SEQ ID NO: 2652951 - protein, 11 aa, Entamoeba histolytica
RNRMNGEEKKQ

SEQ ID NO: 2652952 - protein, 41 aa, Entamoeba histolytica
RNRNKGQQQSQQQTFQQQTPQKTEKPAAKVEQPPKPSPSFN

SEQ ID NO: 2652953 - protein, 19 aa, Entamoeba histolytica
RNRPSELIQKEKDDDDTID

SEQ ID NO: 2652954 - protein, 8 aa, Entamoeba histolytica
RNRSGEKM

SEQ ID NO: 2652955 - protein, 9 aa, Entamoeba histolytica
RNRSGTLEP

SEQ ID NO: 2652956 - protein, 18 aa, Entamoeba histolytica
RNRTGRNGVSVAKESGIE

SEQ ID NO: 2652957 - protein, 6 aa, Entamoeba histolytica
RNRTSP

SEQ ID NO: 2652958 - protein, 6 aa, Entamoeba histolytica
RNRYVS

SEQ ID NO: 2652959 - protein, 5 aa, Entamoeba histolytica
RNSFI

SEQ ID NO: 2652960 - protein, 7 aa, Entamoeba histolytica
RNSHLSS

SEQ ID NO: 2652961 - protein, 18 aa, Entamoeba histolytica
RNSIPKELDSFLKKNEII

SEQ ID NO: 2652962 - protein, 13 aa, Entamoeba histolytica
RNSITSSDSDIPA

SEQ ID NO: 2652963 - protein, 7 aa, Entamoeba histolytica
RNSKDTK

SEQ ID NO: 2652964 - protein, 5 aa, Entamoeba histolytica
RNSLS

SEQ ID NO: 2652965 - protein, 6 aa, Entamoeba histolytica
RNSNEK

SEQ ID NO: 2652966 - protein, 6 aa, Entamoeba histolytica
RNSNFR

SEQ ID NO: 2652967 - protein, 4 aa, Entamoeba histolytica
RNSP

SEQ ID NO: 2652968 - protein, 5 aa, Entamoeba histolytica
RNSPE

SEQ ID NO: 2652969 - protein, 10 aa, Entamoeba histolytica
RNSPGPQSLK

SEQ ID NO: 2652970 - protein, 8 aa, Entamoeba histolytica
RNSPVAPD

SEQ ID NO: 2652971 - protein, 8 aa, Entamoeba histolytica
RNSTNPQI

SEQ ID NO: 2652972 - protein, 7 aa, Entamoeba histolytica
RNSTTKQ

SEQ ID NO: 2652973 - protein, 12 aa, Entamoeba histolytica
RNTAKSTEKEKW

SEQ ID NO: 2652974 - protein, 24 aa, Entamoeba histolytica
RNTDISGTTPKYEKKQSKSRSLQC

SEQ ID NO: 2652975 - protein, 8 aa, Entamoeba histolytica
RNTENPMS

SEQ ID NO: 2652976 - protein, 6 aa, Entamoeba histolytica
RNTEQD

SEQ ID NO: 2652977 - protein, 10 aa, Entamoeba histolytica
RNTISGGLSG

SEQ ID NO: 2652978 - protein, 5 aa, Entamoeba histolytica
RNTKN

SEQ ID NO: 2652979 - protein, 4 aa, Entamoeba histolytica
RNTL

SEQ ID NO: 2652980 - protein, 6 aa, Entamoeba histolytica
RNTPTP

SEQ ID NO: 2652981 - protein, 6 aa, Entamoeba histolytica
RNTPYY

SEQ ID NO: 2652982 - protein, 8 aa, Entamoeba histolytica
RNTQNSSY

SEQ ID NO: 2652983 - protein, 8 aa, Entamoeba histolytica
RNTQRDYP

SEQ ID NO: 2652984 - protein, 6 aa, Entamoeba histolytica
RNTSKI

SEQ ID NO: 2652985 - protein, 11 aa, Entamoeba histolytica
RNTSRDSRVND

SEQ ID NO: 2652986 - protein, 7 aa, Entamoeba histolytica
RNTSSSP

SEQ ID NO: 2652987 - protein, 17 aa, Entamoeba histolytica
RNTTPKIQEDNNQEDIQ

SEQ ID NO: 2652988 - protein, 6 aa, Entamoeba histolytica
RNTTSN

SEQ ID NO: 2652989 - protein, 14 aa, Entamoeba histolytica
RNTVASVGGSGSAS

SEQ ID NO: 2652990 - protein, 7 aa, Entamoeba histolytica
RNTYPSL

SEQ ID NO: 2652991 - protein, 5 aa, Entamoeba histolytica
RNVNE

SEQ ID NO: 2652992 - protein, 17 aa, Entamoeba histolytica
RNVPEGIKPKPSKKYIV

SEQ ID NO: 2652993 - protein, 9 aa, Entamoeba histolytica
RNVTDKPTL

SEQ ID NO: 2652994 - protein, 4 aa, Entamoeba histolytica
RNWN

SEQ ID NO: 2652995 - protein, 4 aa, Entamoeba histolytica
RNYE

SEQ ID NO: 2652996 - protein, 13 aa, Entamoeba histolytica
RNYPGDSALSADD

SEQ ID NO: 2652997 - protein, 12 aa, Entamoeba histolytica
RNYPNKQSSEEI

SEQ ID NO: 2652998 - protein, 35 aa, Entamoeba histolytica
RNYQEEKTHNNEEYEKKIEDLEERIKEKNNEISSL

SEQ ID NO: 2652999 - protein, 7 aa, Entamoeba histolytica
RNYQSQQ

SEQ ID NO: 2653000 - protein, 6 aa, Entamoeba histolytica
RNYQVA

SEQ ID NO: 2653001 - protein, 6 aa, Entamoeba histolytica
RNYQVS

SEQ ID NO: 2653002 - protein, 14 aa, Entamoeba histolytica
RPAGLSSASKIDGV

SEQ ID NO: 2653003 - protein, 11 aa, Entamoeba histolytica
RPASDKDRNAY

SEQ ID NO: 2653004 - protein, 25 aa, Entamoeba histolytica
RPATKNAAKAPKYPRSLKANRNKMD

SEQ ID NO: 2653005 - protein, 46 aa, Entamoeba histolytica; identical to SEQ ID NO: 2457882

SEQ ID NO: 2653006 - protein, 7 aa, Entamoeba histolytica
RPDDSPF

SEQ ID NO: 2653007 - protein, 5 aa, Entamoeba histolytica
RPDMP

SEQ ID NO: 2653008 - protein, 9 aa, Entamoeba histolytica
RPDNPATTC

SEQ ID NO: 2653009 - protein, 5 aa, Entamoeba histolytica
RPDRQ

SEQ ID NO: 2653010 - protein, 13 aa, Entamoeba histolytica
RPDRQNDREEAKR

SEQ ID NO: 2653011 - protein, 4 aa, Entamoeba histolytica
RPDV

SEQ ID NO: 2653012 - protein, 27 aa, Entamoeba histolytica
RPEDPIANELTNEENEEESEENNEEQK

SEQ ID NO: 2653013 - protein, 4 aa, Entamoeba histolytica
RPEI

SEQ ID NO: 2653014 - protein, 6 aa, Entamoeba histolytica
RPELTR

SEQ ID NO: 2653015 - protein, 9 aa, Entamoeba histolytica
RPEQIQNNS

SEQ ID NO: 2653016 - protein, 6 aa, Entamoeba histolytica
RPERAA

SEQ ID NO: 2653017 - protein, 6 aa, Entamoeba histolytica
RPERMA

SEQ ID NO: 2653018 - protein, 5 aa, Entamoeba histolytica
RPETA

SEQ ID NO: 2653019 - protein, 6 aa, Entamoeba histolytica
RPETMY

SEQ ID NO: 2653020 - protein, 14 aa, Entamoeba histolytica
RPFDTSDKSKPPVK

SEQ ID NO: 2653021 - protein, 7 aa, Entamoeba histolytica
RPFGDDG

SEQ ID NO: 2653022 - protein, 14 aa, Entamoeba histolytica
RPFGGKNDNMDIIY

SEQ ID NO: 2653023 - protein, 7 aa, Entamoeba histolytica
RPFPPYD

SEQ ID NO: 2653024 - protein, 4 aa, Entamoeba histolytica
RPFT

SEQ ID NO: 2653025 - protein, 15 aa, Entamoeba histolytica
RPGAVDAEKAVAPHG

SEQ ID NO: 2653026 - protein, 9 aa, Entamoeba histolytica
RPGGHEEKK

SEQ ID NO: 2653027 - protein, 4 aa, Entamoeba histolytica
RPGM

SEQ ID NO: 2653028 - protein, 7 aa, Entamoeba histolytica
RPGPSNM

SEQ ID NO: 2653029 - protein, 5 aa, Entamoeba histolytica
RPGRI

SEQ ID NO: 2653030 - protein, 20 aa, Entamoeba histolytica
RPGSSSNPLSRFDGKSEKAL

SEQ ID NO: 2653031 - protein, 4 aa, Entamoeba histolytica
RPHK

SEQ ID NO: 2653032 - protein, 6 aa, Entamoeba histolytica
RPHKSG

SEQ ID NO: 2653033 - protein, 7 aa, Entamoeba histolytica
RPHPVSE

SEQ ID NO: 2653034 - protein, 5 aa, Entamoeba histolytica
RPHQE

SEQ ID NO: 2653035 - protein, 5 aa, Entamoeba histolytica
RPIDD

SEQ ID NO: 2653036 - protein, 5 aa, Entamoeba histolytica
RPIDL

SEQ ID NO: 2653037 - protein, 17 aa, Entamoeba histolytica
RPIGGKPANESDKNCLD

SEQ ID NO: 2653038 - protein, 6 aa, Entamoeba histolytica
RPIGNG

SEQ ID NO: 2653039 - protein, 11 aa, Entamoeba histolytica
RPIISPNTGFE

SEQ ID NO: 2653040 - protein, 14 aa, Entamoeba histolytica
RPINRRKKKKAIHE

SEQ ID NO: 2653041 - protein, 4 aa, Entamoeba histolytica
RPIP

SEQ ID NO: 2653042 - protein, 9 aa, Entamoeba histolytica
RPIQTPSIA

SEQ ID NO: 2653043 - protein, 7 aa, Entamoeba histolytica
RPITGPD

SEQ ID NO: 2653044 - protein, 6 aa, Entamoeba histolytica
RPKEGI

SEQ ID NO: 2653045 - protein, 11 aa, Entamoeba histolytica
RPKEGQSAQEL

SEQ ID NO: 2653046 - protein, 9 aa, Entamoeba histolytica
RPKEIRKTI

SEQ ID NO: 2653047 - protein, 8 aa, Entamoeba histolytica
RPKKAEKA

SEQ ID NO: 2653048 - protein, 9 aa, Entamoeba histolytica
RPKKDEGAV

SEQ ID NO: 2653049 - protein, 13 aa, Entamoeba histolytica
RPKKEWLKPQMIK

SEQ ID NO: 2653050 - protein, 9 aa, Entamoeba histolytica
RPKKRSSLT

SEQ ID NO: 2653051 - protein, 22 aa, Entamoeba histolytica
RPKLNAYTNKAAGGGYEDETTY

SEQ ID NO: 2653052 - protein, 7 aa, Entamoeba histolytica
RPKQLSP

SEQ ID NO: 2653053 - protein, 4 aa, Entamoeba histolytica
RPKR

SEQ ID NO: 2653054 - protein, 78 aa, Entamoeba histolytica
RPKRRFNRRPGYVNRNNRNRRERGKKENTKSEEKKEVAKSEEKKEQPKEERERGSSKNDLRNRARPKGYGGRYYKHYE

SEQ ID NO: 2653055 - protein, 4 aa, Entamoeba histolytica
RPKT

SEQ ID NO: 2653056 - protein, 13 aa, Entamoeba histolytica
RPKTLDDVQGQEE

SEQ ID NO: 2653057 - protein, 7 aa, Entamoeba histolytica
RPLENNN

SEQ ID NO: 2653058 - protein, 8 aa, Entamoeba histolytica
RPLPPPIS

SEQ ID NO: 2653059 - protein, 10 aa, Entamoeba histolytica
RPLSKGEGPI

SEQ ID NO: 2653060 - protein, 14 aa, Entamoeba histolytica
RPLTGSLDSNPERL

SEQ ID NO: 2653061 - protein, 10 aa, Entamoeba histolytica
RPLTQTKIPS

SEQ ID NO: 2653062 - protein, 7 aa, Entamoeba histolytica
RPNCDEQ

SEQ ID NO: 2653063 - protein, 4 aa, Entamoeba histolytica
RPND

SEQ ID NO: 2653064 - protein, 8 aa, Entamoeba histolytica
RPNEDPTI

SEQ ID NO: 2653065 - protein, 7 aa, Entamoeba histolytica
RPNETTA

SEQ ID NO: 2653066 - protein, 4 aa, Entamoeba histolytica
RPNF

SEQ ID NO: 2653067 - protein, 4 aa, Entamoeba histolytica
RPNG

SEQ ID NO: 2653068 - protein, 5 aa, Entamoeba histolytica
RPNKF

SEQ ID NO: 2653069 - protein, 11 aa, Entamoeba histolytica
RPNKSCVSKTA

SEQ ID NO: 2653070 - protein, 15 aa, Entamoeba histolytica
RPNKSKKSTPSTPAK

SEQ ID NO: 2653071 - protein, 8 aa, Entamoeba histolytica
RPNNEFNK

SEQ ID NO: 2653072 - protein, 10 aa, Entamoeba histolytica
RPNQNETKTR

SEQ ID NO: 2653073 - protein, 16 aa, Entamoeba histolytica
RPNVEEQESSKEAPTA

SEQ ID NO: 2653074 - protein, 4 aa, Entamoeba histolytica
RPPI

SEQ ID NO: 2653075 - protein, 5 aa, Entamoeba histolytica
RPPIN

SEQ ID NO: 2653076 - protein, 7 aa, Entamoeba histolytica
RPPKKAW

SEQ ID NO: 2653077 - protein, 20 aa, Entamoeba histolytica
RPPLNAQANRLQGGGVESNT

SEQ ID NO: 2653078 - protein, 5 aa, Entamoeba histolytica
RPPLT

SEQ ID NO: 2653079 - protein, 8 aa, Entamoeba histolytica
RPPPPFPS

SEQ ID NO: 2653080 - protein, 9 aa, Entamoeba histolytica
RPPRENRNT

SEQ ID NO: 2653081 - protein, 68 aa, Entamoeba histolytica
RPPSSVEEKKHETTHNEDTTKVEDKKEEVTKVEDKKEETTKVEGEKEENKTIQKKEKNKKENDDRTKN

SEQ ID NO: 2653082 - protein, 5 aa, Entamoeba histolytica
RPQCE

SEQ ID NO: 2653083 - protein, 5 aa, Entamoeba histolytica
RPQDK

SEQ ID NO: 2653084 - protein, 9 aa, Entamoeba histolytica
RPQEKQKAT

SEQ ID NO: 2653085 - protein, 4 aa, Entamoeba histolytica
RPQF

SEQ ID NO: 2653086 - protein, 5 aa, Entamoeba histolytica
RPQIK

SEQ ID NO: 2653087 - protein, 9 aa, Entamoeba histolytica
RPQKQIKKK

SEQ ID NO: 2653088 - protein, 4 aa, Entamoeba histolytica
RPQQ

SEQ ID NO: 2653089 - protein, 21 aa, Entamoeba histolytica
RPQSRTNGHAQDGQVTTKIPS

SEQ ID NO: 2653090 - protein, 6 aa, Entamoeba histolytica
RPQTND

SEQ ID NO: 2653091 - protein, 4 aa, Entamoeba histolytica
RPQV

SEQ ID NO: 2653092 - protein, 9 aa, Entamoeba histolytica
RPRDSRTSV

SEQ ID NO: 2653093 - protein, 5 aa, Entamoeba histolytica
RPRID

SEQ ID NO: 2653094 - protein, 8 aa, Entamoeba histolytica
RPRIQSSK

SEQ ID NO: 2653095 - protein, 8 aa, Entamoeba histolytica
RPRLSAEF

SEQ ID NO: 2653096 - protein, 8 aa, Entamoeba histolytica
RPRNDIDE

SEQ ID NO: 2653097 - protein, 19 aa, Entamoeba histolytica
RPRSSSTSSDQRKKIDQDA

SEQ ID NO: 2653098 - protein, 7 aa, Entamoeba histolytica
RPRSYNA

SEQ ID NO: 2653099 - protein, 12 aa, Entamoeba histolytica
RPRTTKEGTPDL

SEQ ID NO: 2653100 - protein, 5 aa, Entamoeba histolytica
RPSAE

SEQ ID NO: 2653101 - protein, 36 aa, Entamoeba histolytica
RPSIRRKPTSSAGDLLSPNSGNSPCKSTASTPRSEN

SEQ ID NO: 2653102 - protein, 12 aa, Entamoeba histolytica
RPSLESTQQQEV

SEQ ID NO: 2653103 - protein, 4 aa, Entamoeba histolytica
RPSN

SEQ ID NO: 2653104 - protein, 5 aa, Entamoeba histolytica
RPSNN

SEQ ID NO: 2653105 - protein, 9 aa, Entamoeba histolytica
RPSWSDDGS

SEQ ID NO: 2653106 - protein, 10 aa, Entamoeba histolytica
RPSWTNKGAH

SEQ ID NO: 2653107 - protein, 8 aa, Entamoeba histolytica
RPTDIPEE

SEQ ID NO: 2653108 - protein, 4 aa, Entamoeba histolytica
RPTE

SEQ ID NO: 2653109 - protein, 15 aa, Entamoeba histolytica
RPTETYNDVGGLDKE

SEQ ID NO: 2653110 - protein, 7 aa, Entamoeba histolytica
RPTGTHA

SEQ ID NO: 2653111 - protein, 6 aa, Entamoeba histolytica
RPTIDS

SEQ ID NO: 2653112 - protein, 5 aa, Entamoeba histolytica
RPTPK

SEQ ID NO: 2653113 - protein, 7 aa, Entamoeba histolytica
RPTSISS

SEQ ID NO: 2653114 - protein, 28 aa, Entamoeba histolytica
RPTSPGITLGNKNGDSQVRTEISNTKKI

SEQ ID NO: 2653115 - protein, 5 aa, Entamoeba histolytica
RPTTN

SEQ ID NO: 2653116 - protein, 12 aa, Entamoeba histolytica
RPTYTNEDSNGF

SEQ ID NO: 2653117 - protein, 6 aa, Entamoeba histolytica
RPVAEG

SEQ ID NO: 2653118 - protein, 11 aa, Entamoeba histolytica
RPVAHGNGGLG

SEQ ID NO: 2653119 - protein, 18 aa, Entamoeba histolytica
RPVAHGNGGLGIKRIIIK

SEQ ID NO: 2653120 - protein, 6 aa, Entamoeba histolytica
RPVGYG

SEQ ID NO: 2653121 - protein, 4 aa, Entamoeba histolytica
RPVP

SEQ ID NO: 2653122 - protein, 8 aa, Entamoeba histolytica
RPWKKDPY

SEQ ID NO: 2653123 - protein, 7 aa, Entamoeba histolytica
RPYTLNE

SEQ ID NO: 2653124 - protein, 16 aa, Entamoeba histolytica
RQAANLKREKGVYSKM

SEQ ID NO: 2653125 - protein, 43 aa, Entamoeba histolytica
RQAERQAEREKARKEREEKKKEEMAKKAAQRAAMRKQADEELK

SEQ ID NO: 2653126 - protein, 12 aa, Entamoeba histolytica
RQANDPSVYAED

SEQ ID NO: 2653127 - protein, 16 aa, Entamoeba histolytica
RQAPKRVGAKDEKVIE

SEQ ID NO: 2653128 - protein, 6 aa, Entamoeba histolytica
RQDEFT

SEQ ID NO: 2653129 - protein, 12 aa, Entamoeba histolytica
RQDEPTKQIKPE

SEQ ID NO: 2653130 - protein, 14 aa, Entamoeba histolytica
RQDEQLAETDQEID

SEQ ID NO: 2653131 - protein, 17 aa, Entamoeba histolytica
RQDQPNILTKPSNHLTE

SEQ ID NO: 2653132 - protein, 10 aa, Entamoeba histolytica
RQDTQPRQNL

SEQ ID NO: 2653133 - protein, 5 aa, Entamoeba histolytica
RQEEI

SEQ ID NO: 2653134 - protein, 11 aa, Entamoeba histolytica
RQEEMEKEHQR

SEQ ID NO: 2653135 - protein, 20 aa, Entamoeba histolytica
RQEFPPFKEGDRIPSRSQEL

SEQ ID NO: 2653136 - protein, 31 aa, Entamoeba histolytica
RQEHERENHERMKTPSEKKRIKKEKNDKIIE

SEQ ID NO: 2653137 - protein, 4 aa, Entamoeba histolytica
RQEL

SEQ ID NO: 2653138 - protein, 19 aa, Entamoeba histolytica
RQENEIKKNPNEKTRKEER

SEQ ID NO: 2653139 - protein, 6 aa, Entamoeba histolytica
RQENKY

SEQ ID NO: 2653140 - protein, 13 aa, Entamoeba histolytica
RQEQYKQDEIERE

SEQ ID NO: 2653141 - protein, 11 aa, Entamoeba histolytica
RQETSSKKPEE

SEQ ID NO: 2653142 - protein, 4 aa, Entamoeba histolytica
RQEY

SEQ ID NO: 2653143 - protein, 4 aa, Entamoeba histolytica
RQFP

SEQ ID NO: 2653144 - protein, 24 aa, Entamoeba histolytica
RQGDKTNLPSVPAPISQPKQSKAV

SEQ ID NO: 2653145 - protein, 21 aa, Entamoeba histolytica
RQGEIREEELKDKEKELSKQI

SEQ ID NO: 2653146 - protein, 35 aa, Entamoeba histolytica
RQGKKLKKVETVDKSSPKVGNNSDPKKSTSTGGND

SEQ ID NO: 2653147 - protein, 6 aa, Entamoeba histolytica
RQGKWK

SEQ ID NO: 2653148 - protein, 18 aa, Entamoeba histolytica
RQGMSQLEKTKLSKAINK

SEQ ID NO: 2653149 - protein, 5 aa, Entamoeba histolytica
RQGNG

SEQ ID NO: 2653150 - protein, 8 aa, Entamoeba histolytica
RQGNRAPE

SEQ ID NO: 2653151 - protein, 7 aa, Entamoeba histolytica
RQGRLEN

SEQ ID NO: 2653152 - protein, 9 aa, Entamoeba histolytica
RQGSQKERL

SEQ ID NO: 2653153 - protein, 6 aa, Entamoeba histolytica
RQGSSY

SEQ ID NO: 2653154 - protein, 18 aa, Entamoeba histolytica
RQHISTPVKGVPKEPTLT

SEQ ID NO: 2653155 - protein, 13 aa, Entamoeba histolytica
RQHSKKADAENTE

SEQ ID NO: 2653156 - protein, 10 aa, Entamoeba histolytica
RQIQKQNEEV

SEQ ID NO: 2653157 - protein, 6 aa, Entamoeba histolytica
RQIQQG

SEQ ID NO: 2653158 - protein, 6 aa, Entamoeba histolytica
RQISES

SEQ ID NO: 2653159 - protein, 5 aa, Entamoeba histolytica
RQISG

SEQ ID NO: 2653160 - protein, 19 aa, Entamoeba histolytica
RQKCETKLKETELEEDNDM

SEQ ID NO: 2653161 - protein, 7 aa, Entamoeba histolytica
RQKDPVG

SEQ ID NO: 2653162 - protein, 17 aa, Entamoeba histolytica
RQKESESIDDSKEKIKR

SEQ ID NO: 2653163 - protein, 6 aa, Entamoeba histolytica
RQKETC

SEQ ID NO: 2653164 - protein, 9 aa, Entamoeba histolytica
RQKGADDQM

SEQ ID NO: 2653165 - protein, 7 aa, Entamoeba histolytica
RQKNTSI

SEQ ID NO: 2653166 - protein, 11 aa, Entamoeba histolytica
RQKQETSQSFE

SEQ ID NO: 2653167 - protein, 6 aa, Entamoeba histolytica
RQLADN

SEQ ID NO: 2653168 - protein, 42 aa, Entamoeba histolytica
RQLARDTEIKKKSTAALRDEAALKQQSYQQMQEDAEKAAAER

SEQ ID NO: 2653169 - protein, 26 aa, Entamoeba histolytica
RQLEKEKTTVQRQSDTIEDLNESDKD

SEQ ID NO: 2653170 - protein, 9 aa, Entamoeba histolytica
RQLGDDKTL

SEQ ID NO: 2653171 - protein, 5 aa, Entamoeba histolytica
RQLNQ

SEQ ID NO: 2653172 - protein, 7 aa, Entamoeba histolytica
RQLQEKE

SEQ ID NO: 2653173 - protein, 9 aa, Entamoeba histolytica
RQMKGVSEE

SEQ ID NO: 2653174 - protein, 10 aa, Entamoeba histolytica
RQNDNKVVTK

SEQ ID NO: 2653175 - protein, 5 aa, Entamoeba histolytica
RQNDQ

SEQ ID NO: 2653176 - protein, 9 aa, Entamoeba histolytica
RQNGLKREW

SEQ ID NO: 2653177 - protein, 16 aa, Entamoeba histolytica
RQNGVQRKRSQPLSPI

SEQ ID NO: 2653178 - protein, 7 aa, Entamoeba histolytica
RQNNGEW

SEQ ID NO: 2653179 - protein, 8 aa, Entamoeba histolytica
RQNNTEKF

SEQ ID NO: 2653180 - protein, 5 aa, Entamoeba histolytica
RQNPL

SEQ ID NO: 2653181 - protein, 10 aa, Entamoeba histolytica
RQNQTSKTTE

SEQ ID NO: 2653182 - protein, 7 aa, Entamoeba histolytica
RQNSNGN

SEQ ID NO: 2653183 - protein, 10 aa, Entamoeba histolytica
RQNTEPPESQ

SEQ ID NO: 2653184 - protein, 7 aa, Entamoeba histolytica
RQNTNNT

SEQ ID NO: 2653185 - protein, 6 aa, Entamoeba histolytica
RQNWEQ

SEQ ID NO: 2653186 - protein, 27 aa, Entamoeba histolytica
RQPSTHTSLPGTQVSTRVQQTQNGTRM

SEQ ID NO: 2653187 - protein, 18 aa, Entamoeba histolytica
RQPTKSNTSVKTADTRKM

SEQ ID NO: 2653188 - protein, 10 aa, Entamoeba histolytica
RQPYNGPKAD

SEQ ID NO: 2653189 - protein, 4 aa, Entamoeba histolytica
RQQD

SEQ ID NO: 2653190 - protein, 6 aa, Entamoeba histolytica
RQQDDR

SEQ ID NO: 2653191 - protein, 12 aa, Entamoeba histolytica
RQQEEDETLIVS

SEQ ID NO: 2653192 - protein, 20 aa, Entamoeba histolytica
RQQFEEGFGSNTTLKTAQTR

SEQ ID NO: 2653193 - protein, 28 aa, Entamoeba histolytica
RQQGQHPKEKQKDKTIKEYTKPNKIQRS

SEQ ID NO: 2653194 - protein, 6 aa, Entamoeba histolytica
RQQKTL

SEQ ID NO: 2653195 - protein, 13 aa, Entamoeba histolytica
RQQPKRAEAENAE

SEQ ID NO: 2653196 - protein, 8 aa, Entamoeba histolytica
RQQRKRHE

SEQ ID NO: 2653197 - protein, 18 aa, Entamoeba histolytica
RQQRLKELEDRRKNAKII

SEQ ID NO: 2653198 - protein, 6 aa, Entamoeba histolytica
RQQTVA

SEQ ID NO: 2653199 - protein, 7 aa, Entamoeba histolytica
RQQVQND

SEQ ID NO: 2653200 - protein, 10 aa, Entamoeba histolytica
RQQYKSAEEL

SEQ ID NO: 2653201 - protein, 7 aa, Entamoeba histolytica
RQRAQTS

SEQ ID NO: 2653202 - protein, 9 aa, Entamoeba histolytica
RQRESTKYG

SEQ ID NO: 2653203 - protein, 9 aa, Entamoeba histolytica
RQRGEGGRF

SEQ ID NO: 2653204 - protein, 5 aa, Entamoeba histolytica
RQRKG

SEQ ID NO: 2653205 - protein, 7 aa, Entamoeba histolytica
RQRKNDF

SEQ ID NO: 2653206 - protein, 7 aa, Entamoeba histolytica
RQRQATL

SEQ ID NO: 2653207 - protein, 6 aa, Entamoeba histolytica
RQRRRR

SEQ ID NO: 2653208 - protein, 7 aa, Entamoeba histolytica
RQRRSKE

SEQ ID NO: 2653209 - protein, 7 aa, Entamoeba histolytica
RQRTRAA

SEQ ID NO: 2653210 - protein, 4 aa, Entamoeba histolytica
RQSE

SEQ ID NO: 2653211 - protein, 11 aa, Entamoeba histolytica
RQSETVKSNKV

SEQ ID NO: 2653212 - protein, 5 aa, Entamoeba histolytica
RQSFE

SEQ ID NO: 2653213 - protein, 6 aa, Entamoeba histolytica
RQSFEG

SEQ ID NO: 2653214 - protein, 11 aa, Entamoeba histolytica
RQSGDDNFGDE

SEQ ID NO: 2653215 - protein, 6 aa, Entamoeba histolytica
RQSKID

SEQ ID NO: 2653216 - protein, 18 aa, Entamoeba histolytica
RQSQNSRNEQLSTFTKEK

SEQ ID NO: 2653217 - protein, 19 aa, Entamoeba histolytica
RQSRGWGVTENDLTKTNPY

SEQ ID NO: 2653218 - protein, 6 aa, Entamoeba histolytica
RQSRRE

SEQ ID NO: 2653219 - protein, 16 aa, Entamoeba histolytica
RQSRTGESDRKHDIER

SEQ ID NO: 2653220 - protein, 9 aa, Entamoeba histolytica
RQSSDYPTQ

SEQ ID NO: 2653221 - protein, 11 aa, Entamoeba histolytica
RQTANAATLPG

SEQ ID NO: 2653222 - protein, 8 aa, Entamoeba histolytica
RQTGERTE

SEQ ID NO: 2653223 - protein, 11 aa, Entamoeba histolytica
RQTKKSIDNKM

SEQ ID NO: 2653224 - protein, 6 aa, Entamoeba histolytica
RQTNPT

SEQ ID NO: 2653225 - protein, 6 aa, Entamoeba histolytica
RQTNSL

SEQ ID NO: 2653226 - protein, 10 aa, Entamoeba histolytica
RQTSLTPDMN

SEQ ID NO: 2653227 - protein, 49 aa, Entamoeba histolytica
RQTSSTASCINNDSSASNTESSKQISDTSSVSTNSSSGTSIIGTTKVNN

SEQ ID NO: 2653228 - protein, 12 aa, Entamoeba histolytica
RQTSTELSAYEN

SEQ ID NO: 2653229 - protein, 11 aa, Entamoeba histolytica
RQTTFEGNKSK

SEQ ID NO: 2653230 - protein, 8 aa, Entamoeba histolytica
RQTTSDLY

SEQ ID NO: 2653231 - protein, 18 aa, Entamoeba histolytica
RQVQTTSEQSWKSDTNPY

SEQ ID NO: 2653232 - protein, 8 aa, Entamoeba histolytica
RQVSGEEI

SEQ ID NO: 2653233 - protein, 20 aa, Entamoeba histolytica
RQYDKASPEVDDEQPDQEGE

SEQ ID NO: 2653234 - protein, 19 aa, Entamoeba histolytica
RQYGRGDGGEQKQTQRKRK

SEQ ID NO: 2653235 - protein, 18 aa, Entamoeba histolytica
RRAAQTTDMNERRKLAEE

SEQ ID NO: 2653236 - protein, 13 aa, Entamoeba histolytica
RRAKTLEEGYDET

SEQ ID NO: 2653237 - protein, 18 aa, Entamoeba histolytica
RRAQNLSKRVSKCKGKLS

SEQ ID NO: 2653238 - protein, 5 aa, Entamoeba histolytica
RRASQ

SEQ ID NO: 2653239 - protein, 5 aa, Entamoeba histolytica
RRATE

SEQ ID NO: 2653240 - protein, 7 aa, Entamoeba histolytica
RRATEKD

SEQ ID NO: 2653241 - protein, 9 aa, Entamoeba histolytica
RRCEGNEGL

SEQ ID NO: 2653242 - protein, 213 aa, Entamoeba histolytica
  misc_feature (41)..(74): Xaa can be any naturally occurring amino acid
RRDDDYRKSGYRTSRYERRVDRRDYRNDRFEGRDDYRTTDXXXXXXXXXXXXXXXXXXXXXXXXXXXXXXXXXXSDRRDDYRVNDRRDDYRTTDRRVDYRQSDIRDDYRTNERRDDYRTTDRRDDYRATDRRDDYRPSDGRDNYRPSDRRDDYRANDRREEYRPSDLRDEYRPSDSRDEYRPSDHKDEYRPGERSDRFERRGNGSSSYREERK

SEQ ID NO: 2653243 - protein, 98 aa, Entamoeba histolytica
RRDDDYRKSGYRTSRYERRVDRRDYRNDRFERRDDYRTTDSRDDYRTTDRRDDYRQSDRRDDYRPGDRRDNYRPSDRRDDYRANDRRDDYRATDRRDD

SEQ ID NO: 2653244 - protein, 6 aa, Entamoeba histolytica
RRDDEE

SEQ ID NO: 2653245 - protein, 5 aa, Entamoeba histolytica
RRDDI

SEQ ID NO: 2653246 - protein, 6 aa, Entamoeba histolytica
RRDDLE

SEQ ID NO: 2653247 - protein, 7 aa, Entamoeba histolytica
RRDEAKE

SEQ ID NO: 2653248 - protein, 5 aa, Entamoeba histolytica
RRDEK

SEQ ID NO: 2653249 - protein, 7 aa, Entamoeba histolytica
RRDGVPK

SEQ ID NO: 2653250 - protein, 20 aa, Entamoeba histolytica
RRDLRSNSMGKKNKSSCLSG

SEQ ID NO: 2653251 - protein, 7 aa, Entamoeba histolytica
RRDNGNA

SEQ ID NO: 2653252 - protein, 8 aa, Entamoeba histolytica
RRDPPIAS

SEQ ID NO: 2653253 - protein, 19 aa, Entamoeba histolytica
RRDRRQSVYSEETSHKPVT

SEQ ID NO: 2653254 - protein, 8 aa, Entamoeba histolytica
RRDSLASH

SEQ ID NO: 2653255 - protein, 25 aa, Entamoeba histolytica
RREAQLSAARSKQIAKEKSEEQKNI

SEQ ID NO: 2653256 - protein, 5 aa, Entamoeba histolytica
RREDD

SEQ ID NO: 2653257 - protein, 13 aa, Entamoeba histolytica
RREEARDKTPGRY

SEQ ID NO: 2653258 - protein, 62 aa, Entamoeba histolytica
RREEENKKKEIEENERKKKEEEERQLKEEQKKKELEEQQRKEEEERERKLEEEERERKLEEE

SEQ ID NO: 2653259 - protein, 30 aa, Entamoeba histolytica
RREENNNNTNNDCLTNSVNSKLNERKENSF

SEQ ID NO: 2653260 - protein, 8 aa, Entamoeba histolytica
RREETLQN

SEQ ID NO: 2653261 - protein, 4 aa, Entamoeba histolytica
RREG

SEQ ID NO: 2653262 - protein, 4 aa, Entamoeba histolytica
RREQ

SEQ ID NO: 2653263 - protein, 6 aa, Entamoeba histolytica
RREQER

SEQ ID NO: 2653264 - protein, 7 aa, Entamoeba histolytica
RRERSKT

SEQ ID NO: 2653265 - protein, 6 aa, Entamoeba histolytica
RRESIG

SEQ ID NO: 2653266 - protein, 17 aa, Entamoeba histolytica
RRFGKTDSLNLKAKTQL

SEQ ID NO: 2653267 - protein, 13 aa, Entamoeba histolytica
RRGDYVDKNDTRD

SEQ ID NO: 2653268 - protein, 5 aa, Entamoeba histolytica
RRGGC

SEQ ID NO: 2653269 - protein, 17 aa, Entamoeba histolytica
RRGGKRGGRGRPAAAVR

SEQ ID NO: 2653270 - protein, 7 aa, Entamoeba histolytica
RRGGVKR

SEQ ID NO: 2653271 - protein, 24 aa, Entamoeba histolytica
RRGIGSHNRSHSRPSDKQTQYPER

SEQ ID NO: 2653272 - protein, 5 aa, Entamoeba histolytica
RRGLP

SEQ ID NO: 2653273 - protein, 21 aa, Entamoeba histolytica
RRGTTTTTSKKLGSSFSGRLF

SEQ ID NO: 2653274 - protein, 7 aa, Entamoeba histolytica
RRGYKAK

SEQ ID NO: 2653275 - protein, 6 aa, Entamoeba histolytica
RRHENS

SEQ ID NO: 2653276 - protein, 10 aa, Entamoeba histolytica
RRIDNPSKCR

SEQ ID NO: 2653277 - protein, 11 aa, Entamoeba histolytica
RRIGDGAGGCD

SEQ ID NO: 2653278 - protein, 5 aa, Entamoeba histolytica
RRIPN

SEQ ID NO: 2653279 - protein, 4 aa, Entamoeba histolytica
RRIT

SEQ ID NO: 2653280 - protein, 10 aa, Entamoeba histolytica
RRITSQNSEH

SEQ ID NO: 2653281 - protein, 37 aa, Entamoeba histolytica
RRKAEPQTTPKPEDKQPDVMPPPPSGEAPVPEHRERK

SEQ ID NO: 2653282 - protein, 10 aa, Entamoeba histolytica
RRKDKGGRMS

SEQ ID NO: 2653283 - protein, 8 aa, Entamoeba histolytica
RRKDLNRT

SEQ ID NO: 2653284 - protein, 8 aa, Entamoeba histolytica
RRKDNKNI

SEQ ID NO: 2653285 - protein, 10 aa, Entamoeba histolytica
RRKDNPNRRR

SEQ ID NO: 2653286 - protein, 9 aa, Entamoeba histolytica
RRKDRSTAC

SEQ ID NO: 2653287 - protein, 4 aa, Entamoeba histolytica
RRKE

SEQ ID NO: 2653288 - protein, 9 aa, Entamoeba histolytica
RRKEKEDVA

SEQ ID NO: 2653289 - protein, 22 aa, Entamoeba histolytica
RRKERKAKQLKEKEETAPKKNE

SEQ ID NO: 2653290 - protein, 40 aa, Entamoeba histolytica
RRKESQELEHEEKMRREKNRQLLEEKRKREEIKQRNEEIE

SEQ ID NO: 2653291 - protein, 58 aa, Entamoeba histolytica
RRKGGDEKEGDEKGDKEEFSPKVKEEKKEKKKEEKKEKEREKKERKEEKKKKGSEENI

SEQ ID NO: 2653292 - protein, 6 aa, Entamoeba histolytica
RRKGSN

SEQ ID NO: 2653293 - protein, 9 aa, Entamoeba histolytica
RRKNISPNN

SEQ ID NO: 2653294 - protein, 7 aa, Entamoeba histolytica
RRKPQKE

SEQ ID NO: 2653295 - protein, 11 aa, Entamoeba histolytica
RRKPSDSNSII

SEQ ID NO: 2653296 - protein, 14 aa, Entamoeba histolytica
RRKRRKGTESNQGS

SEQ ID NO: 2653297 - protein, 8 aa, Entamoeba histolytica
RRKSYNPI

SEQ ID NO: 2653298 - protein, 4 aa, Entamoeba histolytica
RRKT

SEQ ID NO: 2653299 - protein, 6 aa, Entamoeba histolytica
RRKTDE

SEQ ID NO: 2653300 - protein, 9 aa, Entamoeba histolytica
RRKTTRFSA

SEQ ID NO: 2653301 - protein, 4 aa, Entamoeba histolytica
RRKV

SEQ ID NO: 2653302 - protein, 4 aa, Entamoeba histolytica
RRKW

SEQ ID NO: 2653303 - protein, 22 aa, Entamoeba histolytica
RRMKEEEKKTRVKTMRLFLGKT

SEQ ID NO: 2653304 - protein, 22 aa, Entamoeba histolytica
RRMKEEEKKTRVKTMRLLLGKT

SEQ ID NO: 2653305 - protein, 27 aa, Entamoeba histolytica
RRMKEEEKTTRVKTGRSWLSAKPNNQK

SEQ ID NO: 2653306 - protein, 20 aa, Entamoeba histolytica
RRMKEEGKSKMNKSGDDCVI

SEQ ID NO: 2653307 - protein, 8 aa, Entamoeba histolytica
RRNELENE

SEQ ID NO: 2653308 - protein, 10 aa, Entamoeba histolytica
RRNGTKSTLS

SEQ ID NO: 2653309 - protein, 4 aa, Entamoeba histolytica
RRNK

SEQ ID NO: 2653310 - protein, 9 aa, Entamoeba histolytica
RRNKKENSI

SEQ ID NO: 2653311 - protein, 7 aa, Entamoeba histolytica
RRNPKTN

SEQ ID NO: 2653312 - protein, 4 aa, Entamoeba histolytica
RRNQ

SEQ ID NO: 2653313 - protein, 10 aa, Entamoeba histolytica
RRNQVPPANN

SEQ ID NO: 2653314 - protein, 6 aa, Entamoeba histolytica
RRNTAP

SEQ ID NO: 2653315 - protein, 12 aa, Entamoeba histolytica
RRNTKGKKGTLK

SEQ ID NO: 2653316 - protein, 6 aa, Entamoeba histolytica
RRPDLL

SEQ ID NO: 2653317 - protein, 6 aa, Entamoeba histolytica
RRPGDI

SEQ ID NO: 2653318 - protein, 23 aa, Entamoeba histolytica
RRPGKRRDKQEEKKEEKEISDSQ

SEQ ID NO: 2653319 - protein, 6 aa, Entamoeba histolytica
RRPSGI

SEQ ID NO: 2653320 - protein, 11 aa, Entamoeba histolytica
RRPSQAPTEEM

SEQ ID NO: 2653321 - protein, 7 aa, Entamoeba histolytica
RRPSTRA

SEQ ID NO: 2653322 - protein, 20 aa, Entamoeba histolytica
RRQDTNISSDEEEEDDDDWS

SEQ ID NO: 2653323 - protein, 11 aa, Entamoeba histolytica
RRQEDTEETFV

SEQ ID NO: 2653324 - protein, 8 aa, Entamoeba histolytica
RRQEIPHE

SEQ ID NO: 2653325 - protein, 9 aa, Entamoeba histolytica
RRQGANPLL

SEQ ID NO: 2653326 - protein, 4 aa, Entamoeba histolytica
RRQI

SEQ ID NO: 2653327 - protein, 8 aa, Entamoeba histolytica
RRQKKEVD

SEQ ID NO: 2653328 - protein, 7 aa, Entamoeba histolytica
RRQLTGD

SEQ ID NO: 2653329 - protein, 16 aa, Entamoeba histolytica
RRQNQSMRYAQPYNYP

SEQ ID NO: 2653330 - protein, 15 aa, Entamoeba histolytica
RRQQEESDIKGAERL

SEQ ID NO: 2653331 - protein, 8 aa, Entamoeba histolytica
RRQQNNES

SEQ ID NO: 2653332 - protein, 10 aa, Entamoeba histolytica
RRQSNIKTEN

SEQ ID NO: 2653333 - protein, 8 aa, Entamoeba histolytica
RRQTRLTA

SEQ ID NO: 2653334 - protein, 8 aa, Entamoeba histolytica
RRRDLPPI

SEQ ID NO: 2653335 - protein, 12 aa, Entamoeba histolytica
RRRFPINSMISI

SEQ ID NO: 2653336 - protein, 9 aa, Entamoeba histolytica
RRRGGGGDC

SEQ ID NO: 2653337 - protein, 13 aa, Entamoeba histolytica
RRRKAKPEVDNTK

SEQ ID NO: 2653338 - protein, 9 aa, Entamoeba histolytica
RRRKDDYSL

SEQ ID NO: 2653339 - protein, 16 aa, Entamoeba histolytica
RRRKGSFSRPHEDGIT

SEQ ID NO: 2653340 - protein, 13 aa, Entamoeba histolytica
RRRNRQIETFNSE

SEQ ID NO: 2653341 - protein, 13 aa, Entamoeba histolytica
RRRQEAEAQASVD

SEQ ID NO: 2653342 - protein, 83 aa, Entamoeba histolytica
RRRQPKKDREEDREPQPSEADTADSWRRKEGEAFVPRKGGEANERNQREPRQPAGPSEADTADSWRRKEGEAFVPRKAPTEFR

SEQ ID NO: 2653343 - protein, 7 aa, Entamoeba histolytica
RRRRAKK

SEQ ID NO: 2653344 - protein, 5 aa, Entamoeba histolytica
RRRRI

SEQ ID NO: 2653345 - protein, 30 aa, Entamoeba histolytica
RRRTERSRSRERYRPTYYSPRRSRSISPRD

SEQ ID NO: 2653346 - protein, 7 aa, Entamoeba histolytica
RRSEARS

SEQ ID NO: 2653347 - protein, 4 aa, Entamoeba histolytica
RRSF

SEQ ID NO: 2653348 - protein, 6 aa, Entamoeba histolytica
RRSFET

SEQ ID NO: 2653349 - protein, 22 aa, Entamoeba histolytica
RRSGLKSHASGVSTSHMNSDDV

SEQ ID NO: 2653350 - protein, 22 aa, Entamoeba histolytica
RRSKEELKSIENSAQKSIQQMN

SEQ ID NO: 2653351 - protein, 12 aa, Entamoeba histolytica
RRSKKKRGVTAP

SEQ ID NO: 2653352 - protein, 19 aa, Entamoeba histolytica
RRSQDNPDAIEDERAFKAE

SEQ ID NO: 2653353 - protein, 5 aa, Entamoeba histolytica
RRSSA

SEQ ID NO: 2653354 - protein, 15 aa, Entamoeba histolytica
RRSSELKRESLTNEL

SEQ ID NO: 2653355 - protein, 10 aa, Entamoeba histolytica
RRSSTHTSNV

SEQ ID NO: 2653356 - protein, 14 aa, Entamoeba histolytica
RRSTNDYLAIQIRM

SEQ ID NO: 2653357 - protein, 14 aa, Entamoeba histolytica
RRSTNENEIRTRQK

SEQ ID NO: 2653358 - protein, 11 aa, Entamoeba histolytica
RRSVSDQDVRR

SEQ ID NO: 2653359 - protein, 13 aa, Entamoeba histolytica
RRTAPLSADMGGT

SEQ ID NO: 2653360 - protein, 29 aa, Entamoeba histolytica
RRTETNQENEIIPPPKRPITNKENKNNLS

SEQ ID NO: 2653361 - protein, 11 aa, Entamoeba histolytica
RRTGGTSNSKE

SEQ ID NO: 2653362 - protein, 8 aa, Entamoeba histolytica
RRTQRRQS

SEQ ID NO: 2653363 - protein, 10 aa, Entamoeba histolytica
RRTRDNEKLK

SEQ ID NO: 2653364 - protein, 17 aa, Entamoeba histolytica
RRTSFGEESEEEVIQGG

SEQ ID NO: 2653365 - protein, 15 aa, Entamoeba histolytica
RRTTQPKPKKQATFQ

SEQ ID NO: 2653366 - protein, 6 aa, Entamoeba histolytica
RRTYAP

SEQ ID NO: 2653367 - protein, 5 aa, Entamoeba histolytica
RRTYQ

SEQ ID NO: 2653368 - protein, 67 aa, Entamoeba histolytica
RRVDPSKEEVKINSTSETGHLEKQSNNPKQEVDDTKKVISKNETESSLEKTQQESQKEAEQNKKIEE

SEQ ID NO: 2653369 - protein, 10 aa, Entamoeba histolytica
RRVNERSKQI

SEQ ID NO: 2653370 - protein, 12 aa, Entamoeba histolytica
RRWEKNEDGELG

SEQ ID NO: 2653371 - protein, 9 aa, Entamoeba histolytica
RRYQNNKKI

SEQ ID NO: 2653372 - protein, 24 aa, Entamoeba histolytica
RRYQPTQYPNSAAQALPDFTQNGN

SEQ ID NO: 2653373 - protein, 6 aa, Entamoeba histolytica
RRYRES

SEQ ID NO: 2653374 - protein, 8 aa, Entamoeba histolytica
RRYTKSSF

SEQ ID NO: 2653375 - protein, 11 aa, Entamoeba histolytica
RSAAANRDDDR

SEQ ID NO: 2653376 - protein, 24 aa, Entamoeba histolytica
RSAADRKLDTAAPVVSDAGKQDLT

SEQ ID NO: 2653377 - protein, 14 aa, Entamoeba histolytica
RSAGTNDITIFHIK

SEQ ID NO: 2653378 - protein, 14 aa, Entamoeba histolytica
RSAHPAKFSPVDPY

SEQ ID NO: 2653379 - protein, 15 aa, Entamoeba histolytica
RSAKAKTKQKGGKHQ

SEQ ID NO: 2653380 - protein, 24 aa, Entamoeba histolytica
RSAKDQNDEETVATEVPHFVHSLL

SEQ ID NO: 2653381 - protein, 5 aa, Entamoeba histolytica
RSAKR

SEQ ID NO: 2653382 - protein, 7 aa, Entamoeba histolytica
RSAQELG

SEQ ID NO: 2653383 - protein, 10 aa, Entamoeba histolytica
RSAQPLPGTF

SEQ ID NO: 2653384 - protein, 5 aa, Entamoeba histolytica
RSAST

SEQ ID NO: 2653385 - protein, 6 aa, Entamoeba histolytica
RSATKR

SEQ ID NO: 2653386 - protein, 34 aa, Entamoeba histolytica
RSCRQRSSYRERSRSDSRERRKNYYEERRYDSRK

SEQ ID NO: 2653387 - protein, 12 aa, Entamoeba histolytica
RSDATKSRHSTS

SEQ ID NO: 2653388 - protein, 6 aa, Entamoeba histolytica
RSDDGL

SEQ ID NO: 2653389 - protein, 10 aa, Entamoeba histolytica
RSDEEDEKLK

SEQ ID NO: 2653390 - protein, 4 aa, Entamoeba histolytica
RSDG

SEQ ID NO: 2653391 - protein, 15 aa, Entamoeba histolytica
RSDIYDENNKFGEDA

SEQ ID NO: 2653392 - protein, 7 aa, Entamoeba histolytica
RSDREEF

SEQ ID NO: 2653393 - protein, 13 aa, Entamoeba histolytica
RSDRENRTTEIPK

SEQ ID NO: 2653394 - protein, 19 aa, Entamoeba histolytica
RSDTSIQNESKVEDLKTEP

SEQ ID NO: 2653395 - protein, 5 aa, Entamoeba histolytica
RSDVD

SEQ ID NO: 2653396 - protein, 7 aa, Entamoeba histolytica
RSDVDTA

SEQ ID NO: 2653397 - protein, 5 aa, Entamoeba histolytica
RSEDI

SEQ ID NO: 2653398 - protein, 5 aa, Entamoeba histolytica
RSEDY

SEQ ID NO: 2653399 - protein, 8 aa, Entamoeba histolytica
RSEEENKE

SEQ ID NO: 2653400 - protein, 15 aa, Entamoeba histolytica
RSEETMTIKTNTSQY

SEQ ID NO: 2653401 - protein, 58 aa, Entamoeba histolytica
RSEEVKQNENNSIQVTSSQVSDGTTTNTKDNQKEESDKIISPRNKKEQNEKGDNEESK

SEQ ID NO: 2653402 - protein, 15 aa, Entamoeba histolytica
RSEIEKAKKKLEEIQ

SEQ ID NO: 2653403 - protein, 10 aa, Entamoeba histolytica
RSEKEGVTSI

SEQ ID NO: 2653404 - protein, 13 aa, Entamoeba histolytica
RSELTNNIEEGEP

SEQ ID NO: 2653405 - protein, 5 aa, Entamoeba histolytica
RSEME

SEQ ID NO: 2653406 - protein, 15 aa, Entamoeba histolytica
RSENETEDGKGGNRE

SEQ ID NO: 2653407 - protein, 9 aa, Entamoeba histolytica
RSENKQIDS

SEQ ID NO: 2653408 - protein, 8 aa, Entamoeba histolytica
RSERKIPT

SEQ ID NO: 2653409 - protein, 9 aa, Entamoeba histolytica
RSESDSGEF

SEQ ID NO: 2653410 - protein, 6 aa, Entamoeba histolytica
RSESHS

SEQ ID NO: 2653411 - protein, 25 aa, Entamoeba histolytica
RSESPITRTQLSPRTITTKKESDLY

SEQ ID NO: 2653412 - protein, 31 aa, Entamoeba histolytica
RSESQSDYSKTETNYESYPVQRESSSRVSPS

SEQ ID NO: 2653413 - protein, 9 aa, Entamoeba histolytica
RSESVNNQL

SEQ ID NO: 2653414 - protein, 7 aa, Entamoeba histolytica
RSESVTV

SEQ ID NO: 2653415 - protein, 8 aa, Entamoeba histolytica
RSETNGEF

SEQ ID NO: 2653416 - protein, 6 aa, Entamoeba histolytica
RSEYMK

SEQ ID NO: 2653417 - protein, 10 aa, Entamoeba histolytica
RSFDGNDERC

SEQ ID NO: 2653418 - protein, 14 aa, Entamoeba histolytica
RSFDSSISGNFRRE

SEQ ID NO: 2653419 - protein, 5 aa, Entamoeba histolytica
RSFED

SEQ ID NO: 2653420 - protein, 14 aa, Entamoeba histolytica
RSFEEQREKQITEV

SEQ ID NO: 2653421 - protein, 5 aa, Entamoeba histolytica
RSFHP

SEQ ID NO: 2653422 - protein, 16 aa, Entamoeba histolytica
RSFPPSQIKTQPMPNI

SEQ ID NO: 2653423 - protein, 44 aa, Entamoeba histolytica
RSFQRGISKNDPELLSSSSSSESPDNTEDELEYSSESDLNNQNN

SEQ ID NO: 2653424 - protein, 4 aa, Entamoeba histolytica
RSFS

SEQ ID NO: 2653425 - protein, 10 aa, Entamoeba histolytica
RSFSDTYGKL

SEQ ID NO: 2653426 - protein, 14 aa, Entamoeba histolytica
RSFSRDRSRSRSSN

SEQ ID NO: 2653427 - protein, 10 aa, Entamoeba histolytica
RSFTKEDKTI

SEQ ID NO: 2653428 - protein, 19 aa, Entamoeba histolytica
RSFTRSKNQSGKPNSSNLK

SEQ ID NO: 2653429 - protein, 8 aa, Entamoeba histolytica
RSGAAPFT

SEQ ID NO: 2653430 - protein, 7 aa, Entamoeba histolytica
RSGDGMN

SEQ ID NO: 2653431 - protein, 7 aa, Entamoeba histolytica
RSGEQAI

SEQ ID NO: 2653432 - protein, 6 aa, Entamoeba histolytica
RSGGCA

SEQ ID NO: 2653433 - protein, 6 aa, Entamoeba histolytica
RSGGLG

SEQ ID NO: 2653434 - protein, 12 aa, Entamoeba histolytica
RSGGTGGDSVRD

SEQ ID NO: 2653435 - protein, 13 aa, Entamoeba histolytica
RSGITPKPTAKNF

SEQ ID NO: 2653436 - protein, 8 aa, Entamoeba histolytica
RSGKDAVK

SEQ ID NO: 2653437 - protein, 9 aa, Entamoeba histolytica
RSGKTINPN

SEQ ID NO: 2653438 - protein, 12 aa, Entamoeba histolytica
RSGLNEDKSPMI

SEQ ID NO: 2653439 - protein, 10 aa, Entamoeba histolytica
RSGNLTEKDN

SEQ ID NO: 2653440 - protein, 5 aa, Entamoeba histolytica
RSGQF

SEQ ID NO: 2653441 - protein, 8 aa, Entamoeba histolytica
RSGRFGRT

SEQ ID NO: 2653442 - protein, 10 aa, Entamoeba histolytica
RSGSAESLNG

SEQ ID NO: 2653443 - protein, 9 aa, Entamoeba histolytica
RSGSGKTSM

SEQ ID NO: 2653444 - protein, 5 aa, Entamoeba histolytica
RSGST

SEQ ID NO: 2653445 - protein, 4 aa, Entamoeba histolytica
RSGT

SEQ ID NO: 2653446 - protein, 10 aa, Entamoeba histolytica
RSGYMTEKSG

SEQ ID NO: 2653447 - protein, 5 aa, Entamoeba histolytica
RSHNE

SEQ ID NO: 2653448 - protein, 8 aa, Entamoeba histolytica
RSIGDEPL

SEQ ID NO: 2653449 - protein, 8 aa, Entamoeba histolytica
RSIGDESM

SEQ ID NO: 2653450 - protein, 5 aa, Entamoeba histolytica
RSIHE

SEQ ID NO: 2653451 - protein, 6 aa, Entamoeba histolytica
RSIQPE

SEQ ID NO: 2653452 - protein, 22 aa, Entamoeba histolytica
RSITKSQEIKETSSQVPSSAIT

SEQ ID NO: 2653453 - protein, 6 aa, Entamoeba histolytica
RSKAAF

SEQ ID NO: 2653454 - protein, 8 aa, Entamoeba histolytica
RSKAEDYS

SEQ ID NO: 2653455 - protein, 6 aa, Entamoeba histolytica
RSKDEE

SEQ ID NO: 2653456 - protein, 7 aa, Entamoeba histolytica
RSKELSN

SEQ ID NO: 2653457 - protein, 5 aa, Entamoeba histolytica
RSKER

SEQ ID NO: 2653458 - protein, 6 aa, Entamoeba histolytica
RSKESE

SEQ ID NO: 2653459 - protein, 6 aa, Entamoeba histolytica
RSKEYD

SEQ ID NO: 2653460 - protein, 10 aa, Entamoeba histolytica
RSKFKRSNGI

SEQ ID NO: 2653461 - protein, 10 aa, Entamoeba histolytica
RSKFSKTVTT

SEQ ID NO: 2653462 - protein, 4 aa, Entamoeba histolytica
RSKG

SEQ ID NO: 2653463 - protein, 13 aa, Entamoeba histolytica
RSKGVNENDLVQF

SEQ ID NO: 2653464 - protein, 14 aa, Entamoeba histolytica
RSKINKGSTSPPQV

SEQ ID NO: 2653465 - protein, 8 aa, Entamoeba histolytica
RSKKEVSQ

SEQ ID NO: 2653466 - protein, 7 aa, Entamoeba histolytica
RSKKEYE

SEQ ID NO: 2653467 - protein, 5 aa, Entamoeba histolytica
RSKLQ

SEQ ID NO: 2653468 - protein, 12 aa, Entamoeba histolytica
RSKNNKTDQIDH

SEQ ID NO: 2653469 - protein, 11 aa, Entamoeba histolytica
RSKNSSEERRD

SEQ ID NO: 2653470 - protein, 5 aa, Entamoeba histolytica
RSKPK

SEQ ID NO: 2653471 - protein, 9 aa, Entamoeba histolytica
RSKPSDELQ

SEQ ID NO: 2653472 - protein, 13 aa, Entamoeba histolytica
RSKPYIDQAFELI

SEQ ID NO: 2653473 - protein, 8 aa, Entamoeba histolytica
RSKQEYPE

SEQ ID NO: 2653474 - protein, 9 aa, Entamoeba histolytica
RSKQNGIGE

SEQ ID NO: 2653475 - protein, 9 aa, Entamoeba histolytica
RSKRSKENN

SEQ ID NO: 2653476 - protein, 10 aa, Entamoeba histolytica
RSKSNKGTSS

SEQ ID NO: 2653477 - protein, 6 aa, Entamoeba histolytica
RSKTIQ

SEQ ID NO: 2653478 - protein, 20 aa, Entamoeba histolytica
RSKTSNDNKSESSESGTKTV

SEQ ID NO: 2653479 - protein, 8 aa, Entamoeba histolytica
RSKVTEMD

SEQ ID NO: 2653480 - protein, 18 aa, Entamoeba histolytica
RSLDDAVSSYYDQGCPEI

SEQ ID NO: 2653481 - protein, 7 aa, Entamoeba histolytica
RSLDKRQ

SEQ ID NO: 2653482 - protein, 5 aa, Entamoeba histolytica
RSLES

SEQ ID NO: 2653483 - protein, 12 aa, Entamoeba histolytica
RSLGDSANQPII

SEQ ID NO: 2653484 - protein, 11 aa, Entamoeba histolytica
RSLPKQDEYFT

SEQ ID NO: 2653485 - protein, 7 aa, Entamoeba histolytica
RSLPPAI

SEQ ID NO: 2653486 - protein, 10 aa, Entamoeba histolytica
RSLPPKPLRS

SEQ ID NO: 2653487 - protein, 9 aa, Entamoeba histolytica
RSLSINSTT

SEQ ID NO: 2653488 - protein, 10 aa, Entamoeba histolytica
RSLTTTDSQF

SEQ ID NO: 2653489 - protein, 4 aa, Entamoeba histolytica
RSLV

SEQ ID NO: 2653490 - protein, 4 aa, Entamoeba histolytica
RSME

SEQ ID NO: 2653491 - protein, 7 aa, Entamoeba histolytica
RSMNEQV

SEQ ID NO: 2653492 - protein, 6 aa, Entamoeba histolytica
RSMSKE

SEQ ID NO: 2653493 - protein, 11 aa, Entamoeba histolytica
RSMYEDTDTFT

SEQ ID NO: 2653494 - protein, 8 aa, Entamoeba histolytica
RSNARQRK

SEQ ID NO: 2653495 - protein, 4 aa, Entamoeba histolytica
RSND

SEQ ID NO: 2653496 - protein, 5 aa, Entamoeba histolytica
RSNDL

SEQ ID NO: 2653497 - protein, 7 aa, Entamoeba histolytica
RSNEEKE

SEQ ID NO: 2653498 - protein, 7 aa, Entamoeba histolytica
RSNEFGD

SEQ ID NO: 2653499 - protein, 10 aa, Entamoeba histolytica
RSNEIQKENE

SEQ ID NO: 2653500 - protein, 6 aa, Entamoeba histolytica
RSNEIS

SEQ ID NO: 2653501 - protein, 5 aa, Entamoeba histolytica
RSNET

SEQ ID NO: 2653502 - protein, 4 aa, Entamoeba histolytica
RSNG

SEQ ID NO: 2653503 - protein, 18 aa, Entamoeba histolytica
RSNLTEKEQDIILQASMH

SEQ ID NO: 2653504 - protein, 7 aa, Entamoeba histolytica
RSNPISQ

SEQ ID NO: 2653505 - protein, 7 aa, Entamoeba histolytica
RSNPSTA

SEQ ID NO: 2653506 - protein, 26 aa, Entamoeba histolytica
RSNPTTPSHKKSRKSSIVDAFKKFSK

SEQ ID NO: 2653507 - protein, 5 aa, Entamoeba histolytica
RSNQI

SEQ ID NO: 2653508 - protein, 4 aa, Entamoeba histolytica
RSNR

SEQ ID NO: 2653509 - protein, 10 aa, Entamoeba histolytica
RSNRRKENPN

SEQ ID NO: 2653510 - protein, 13 aa, Entamoeba histolytica
RSNSGGKKTTRRN

SEQ ID NO: 2653511 - protein, 8 aa, Entamoeba histolytica
RSNSSTPM

SEQ ID NO: 2653512 - protein, 4 aa, Entamoeba histolytica
RSNT

SEQ ID NO: 2653513 - protein, 5 aa, Entamoeba histolytica
RSNTN

SEQ ID NO: 2653514 - protein, 7 aa, Entamoeba histolytica
RSNTTTY

SEQ ID NO: 2653515 - protein, 4 aa, Entamoeba histolytica
RSNV

SEQ ID NO: 2653516 - protein, 11 aa, Entamoeba histolytica
RSNVTDPEGYT

SEQ ID NO: 2653517 - protein, 10 aa, Entamoeba histolytica
RSNYTQLPQQ

SEQ ID NO: 2653518 - protein, 5 aa, Entamoeba histolytica
RSPCE

SEQ ID NO: 2653519 - protein, 15 aa, Entamoeba histolytica
RSPDKNDSPNKFDER

SEQ ID NO: 2653520 - protein, 17 aa, Entamoeba histolytica
RSPDNDMTREMTDTPKL

SEQ ID NO: 2653521 - protein, 7 aa, Entamoeba histolytica
RSPGERP

SEQ ID NO: 2653522 - protein, 9 aa, Entamoeba histolytica
RSPGGDMGI

SEQ ID NO: 2653523 - protein, 10 aa, Entamoeba histolytica
RSPGGITSDD

SEQ ID NO: 2653524 - protein, 6 aa, Entamoeba histolytica
RSPKQE

SEQ ID NO: 2653525 - protein, 5 aa, Entamoeba histolytica
RSPNV

SEQ ID NO: 2653526 - protein, 5 aa, Entamoeba histolytica
RSPPG

SEQ ID NO: 2653527 - protein, 6 aa, Entamoeba histolytica
RSPQIK

SEQ ID NO: 2653528 - protein, 41 aa, Entamoeba histolytica
RSPSPSSSRSSHIRRTSGSHLRNSGDFSSRSPSPSPLQTPR

SEQ ID NO: 2653529 - protein, 8 aa, Entamoeba histolytica
RSPSSSRL

SEQ ID NO: 2653530 - protein, 9 aa, Entamoeba histolytica
RSPTTENIS

SEQ ID NO: 2653531 - protein, 6 aa, Entamoeba histolytica
RSPTVS

SEQ ID NO: 2653532 - protein, 8 aa, Entamoeba histolytica
RSQEEEFS

SEQ ID NO: 2653533 - protein, 10 aa, Entamoeba histolytica
RSQEYSDRAP

SEQ ID NO: 2653534 - protein, 4 aa, Entamoeba histolytica
RSQI

SEQ ID NO: 2653535 - protein, 7 aa, Entamoeba histolytica
RSQNPEI

SEQ ID NO: 2653536 - protein, 4 aa, Entamoeba histolytica
RSQQ

SEQ ID NO: 2653537 - protein, 11 aa, Entamoeba histolytica
RSQQDINNGVD

SEQ ID NO: 2653538 - protein, 10 aa, Entamoeba histolytica
RSQQEHYEER

SEQ ID NO: 2653539 - protein, 11 aa, Entamoeba histolytica
RSQSSKKSTIQ

SEQ ID NO: 2653540 - protein, 8 aa, Entamoeba histolytica
RSQVSNTI

SEQ ID NO: 2653541 - protein, 5 aa, Entamoeba histolytica
RSRFK

SEQ ID NO: 2653542 - protein, 11 aa, Entamoeba histolytica
RSRGTETEEQV

SEQ ID NO: 2653543 - protein, 5 aa, Entamoeba histolytica
RSRIK

SEQ ID NO: 2653544 - protein, 6 aa, Entamoeba histolytica
RSRKAA

SEQ ID NO: 2653545 - protein, 13 aa, Entamoeba histolytica
RSRKRNPINCLVI

SEQ ID NO: 2653546 - protein, 4 aa, Entamoeba histolytica
RSRN

SEQ ID NO: 2653547 - protein, 7 aa, Entamoeba histolytica
RSRNDDS

SEQ ID NO: 2653548 - protein, 7 aa, Entamoeba histolytica
RSRNHTY

SEQ ID NO: 2653549 - protein, 11 aa, Entamoeba histolytica
RSRQKVKDSKK

SEQ ID NO: 2653550 - protein, 38 aa, Entamoeba histolytica
RSRSCSRRRSFSRSSSSSNRNSFRSPYHSPTRRPSPLP

SEQ ID NO: 2653551 - protein, 8 aa, Entamoeba histolytica
RSRSDYNK

SEQ ID NO: 2653552 - protein, 16 aa, Entamoeba histolytica
RSRTKKKFINHETPFQ

SEQ ID NO: 2653553 - protein, 6 aa, Entamoeba histolytica
RSRVEQ

SEQ ID NO: 2653554 - protein, 4 aa, Entamoeba histolytica
RSSA

SEQ ID NO: 2653555 - protein, 9 aa, Entamoeba histolytica
RSSAEDSID

SEQ ID NO: 2653556 - protein, 25 aa, Entamoeba histolytica
RSSAGSKTSVKPEVQNDQQPNGSPF

SEQ ID NO: 2653557 - protein, 6 aa, Entamoeba histolytica
RSSDDE

SEQ ID NO: 2653558 - protein, 5 aa, Entamoeba histolytica
RSSDP

SEQ ID NO: 2653559 - protein, 7 aa, Entamoeba histolytica
RSSDTIP

SEQ ID NO: 2653560 - protein, 8 aa, Entamoeba histolytica
RSSEMKNT

SEQ ID NO: 2653561 - protein, 12 aa, Entamoeba histolytica
RSSGTTSTESEW

SEQ ID NO: 2653562 - protein, 9 aa, Entamoeba histolytica
RSSHLNSSY

SEQ ID NO: 2653563 - protein, 5 aa, Entamoeba histolytica
RSSID

SEQ ID NO: 2653564 - protein, 7 aa, Entamoeba histolytica
RSSKDED

SEQ ID NO: 2653565 - protein, 9 aa, Entamoeba histolytica
RSSKTFEAC

SEQ ID NO: 2653566 - protein, 11 aa, Entamoeba histolytica
RSSLDTNKQEL

SEQ ID NO: 2653567 - protein, 5 aa, Entamoeba histolytica
RSSLK

SEQ ID NO: 2653568 - protein, 4 aa, Entamoeba histolytica
RSSM

SEQ ID NO: 2653569 - protein, 8 aa, Entamoeba histolytica
RSSNNDYL

SEQ ID NO: 2653570 - protein, 7 aa, Entamoeba histolytica
RSSNREI

SEQ ID NO: 2653571 - protein, 8 aa, Entamoeba histolytica
RSSNTKLL

SEQ ID NO: 2653572 - protein, 15 aa, Entamoeba histolytica
RSSPSQDDSPTPNIA

SEQ ID NO: 2653573 - protein, 69 aa, Entamoeba histolytica
RSSRESPRLEQPKSELGTPREGIKSPRVIGKEKRRLSGGSVDFKSETSLEETDRITETKRRSSSLNSEC

SEQ ID NO: 2653574 - protein, 15 aa, Entamoeba histolytica
RSSRSGSISNPKEFR

SEQ ID NO: 2653575 - protein, 6 aa, Entamoeba histolytica
RSSSAP

SEQ ID NO: 2653576 - protein, 27 aa, Entamoeba histolytica
RSSSISSEEQSFEQNYEQQYPNTEGAI

SEQ ID NO: 2653577 - protein, 7 aa, Entamoeba histolytica
RSSSSQF

SEQ ID NO: 2653578 - protein, 9 aa, Entamoeba histolytica
RSSSTEQNL

SEQ ID NO: 2653579 - protein, 6 aa, Entamoeba histolytica
RSSTDI

SEQ ID NO: 2653580 - protein, 7 aa, Entamoeba histolytica
RSSTNTL

SEQ ID NO: 2653581 - protein, 10 aa, Entamoeba histolytica
RSSVAQKDEV

SEQ ID NO: 2653582 - protein, 15 aa, Entamoeba histolytica
RSSYSNTYLQNEGET

SEQ ID NO: 2653583 - protein, 10 aa, Entamoeba histolytica
RSTDEVEKEI

SEQ ID NO: 2653584 - protein, 6 aa, Entamoeba histolytica
RSTDFE

SEQ ID NO: 2653585 - protein, 5 aa, Entamoeba histolytica
RSTGD

SEQ ID NO: 2653586 - protein, 31 aa, Entamoeba histolytica
RSTGSKSNSITEPPPQEEESELQKKLKSRRA

SEQ ID NO: 2653587 - protein, 5 aa, Entamoeba histolytica
RSTHT

SEQ ID NO: 2653588 - protein, 11 aa, Entamoeba histolytica
RSTHTMTGHSN

SEQ ID NO: 2653589 - protein, 4 aa, Entamoeba histolytica
RSTK

SEQ ID NO: 2653590 - protein, 5 aa, Entamoeba histolytica
RSTKK

SEQ ID NO: 2653591 - protein, 9 aa, Entamoeba histolytica
RSTKNKWSE

SEQ ID NO: 2653592 - protein, 6 aa, Entamoeba histolytica
RSTKVD

SEQ ID NO: 2653593 - protein, 12 aa, Entamoeba histolytica
RSTMPENQYKTR

SEQ ID NO: 2653594 - protein, 11 aa, Entamoeba histolytica
RSTNDSSTVSE

SEQ ID NO: 2653595 - protein, 18 aa, Entamoeba histolytica
RSTNELKDNIDDIAQDII

SEQ ID NO: 2653596 - protein, 14 aa, Entamoeba histolytica
RSTNYSTTKKHNEN

SEQ ID NO: 2653597 - protein, 11 aa, Entamoeba histolytica
RSTPQGDIIDG

SEQ ID NO: 2653598 - protein, 9 aa, Entamoeba histolytica
RSTQDFNGA

SEQ ID NO: 2653599 - protein, 11 aa, Entamoeba histolytica
RSTQPQQSQPT

SEQ ID NO: 2653600 - protein, 7 aa, Entamoeba histolytica
RSTRKEY

SEQ ID NO: 2653601 - protein, 11 aa, Entamoeba histolytica
RSTRKGTKEDY

SEQ ID NO: 2653602 - protein, 4 aa, Entamoeba histolytica
RSTS

SEQ ID NO: 2653603 - protein, 12 aa, Entamoeba histolytica
RSTSRRSSPEHH

SEQ ID NO: 2653604 - protein, 7 aa, Entamoeba histolytica
RSTSVPD

SEQ ID NO: 2653605 - protein, 9 aa, Entamoeba histolytica
RSTTGKVDE

SEQ ID NO: 2653606 - protein, 20 aa, Entamoeba histolytica
RSTTKERNEFNEKKKADYEK

SEQ ID NO: 2653607 - protein, 7 aa, Entamoeba histolytica
RSTTTNI

SEQ ID NO: 2653608 - protein, 13 aa, Entamoeba histolytica
RSVADNSSKIQEK

SEQ ID NO: 2653609 - protein, 5 aa, Entamoeba histolytica
RSVGG

SEQ ID NO: 2653610 - protein, 14 aa, Entamoeba histolytica
RSVKHIQSDIRMEE

SEQ ID NO: 2653611 - protein, 8 aa, Entamoeba histolytica
RSVNETCQ

SEQ ID NO: 2653612 - protein, 14 aa, Entamoeba histolytica
RSVNSGRVDDNDDS

SEQ ID NO: 2653613 - protein, 5 aa, Entamoeba histolytica
RSVQL

SEQ ID NO: 2653614 - protein, 29 aa, Entamoeba histolytica
RSYKERIKQHEKEMKEYNENKEKREIDKR

SEQ ID NO: 2653615 - protein, 6 aa, Entamoeba histolytica
RSYNDL

SEQ ID NO: 2653616 - protein, 10 aa, Entamoeba histolytica
RSYNRAPKLK

SEQ ID NO: 2653617 - protein, 8 aa, Entamoeba histolytica
RSYPENAA

SEQ ID NO: 2653618 - protein, 5 aa, Entamoeba histolytica
RSYSG

SEQ ID NO: 2653619 - protein, 13 aa, Entamoeba histolytica
RSYSNSPKRRFSP

SEQ ID NO: 2653620 - protein, 7 aa, Entamoeba histolytica
RSYVETN

SEQ ID NO: 2653621 - protein, 4 aa, Entamoeba histolytica
RTAI

SEQ ID NO: 2653622 - protein, 12 aa, Entamoeba histolytica
RTAKEERKERIK

SEQ ID NO: 2653623 - protein, 6 aa, Entamoeba histolytica
RTAKEF

SEQ ID NO: 2653624 - protein, 10 aa, Entamoeba histolytica
RTARADTKGR

SEQ ID NO: 2653625 - protein, 10 aa, Entamoeba histolytica
RTARAGKSGY

SEQ ID NO: 2653626 - protein, 9 aa, Entamoeba histolytica
RTARANRKG

SEQ ID NO: 2653627 - protein, 7 aa, Entamoeba histolytica
RTASHKE

SEQ ID NO: 2653628 - protein, 5 aa, Entamoeba histolytica
RTASL

SEQ ID NO: 2653629 - protein, 7 aa, Entamoeba histolytica
RTASSIQ

SEQ ID NO: 2653630 - protein, 7 aa, Entamoeba histolytica
RTATSEI

SEQ ID NO: 2653631 - protein, 8 aa, Entamoeba histolytica
RTCGTGID

SEQ ID NO: 2653632 - protein, 4 aa, Entamoeba histolytica
RTDA

SEQ ID NO: 2653633 - protein, 5 aa, Entamoeba histolytica
RTDAL

SEQ ID NO: 2653634 - protein, 8 aa, Entamoeba histolytica
RTDANSKI

SEQ ID NO: 2653635 - protein, 18 aa, Entamoeba histolytica
RTDERERKERKKKIRGDF

SEQ ID NO: 2653636 - protein, 8 aa, Entamoeba histolytica
RTDGVSTT

SEQ ID NO: 2653637 - protein, 6 aa, Entamoeba histolytica
RTDIED

SEQ ID NO: 2653638 - protein, 6 aa, Entamoeba histolytica
RTDMEE

SEQ ID NO: 2653639 - protein, 7 aa, Entamoeba histolytica
RTDPTTL

SEQ ID NO: 2653640 - protein, 7 aa, Entamoeba histolytica
RTDQHSC

SEQ ID NO: 2653641 - protein, 6 aa, Entamoeba histolytica
RTDSGH

SEQ ID NO: 2653642 - protein, 26 aa, Entamoeba histolytica
RTDSLPIPVSEKKRVEEISKEPIATS

SEQ ID NO: 2653643 - protein, 8 aa, Entamoeba histolytica
RTDSSSFK

SEQ ID NO: 2653644 - protein, 6 aa, Entamoeba histolytica
RTDSTP

SEQ ID NO: 2653645 - protein, 18 aa, Entamoeba histolytica
RTDTTKTRSTTTSFSDNA

SEQ ID NO: 2653646 - protein, 10 aa, Entamoeba histolytica
RTEEIEKRRK

SEQ ID NO: 2653647 - protein, 10 aa, Entamoeba histolytica
RTEEKKKITR

SEQ ID NO: 2653648 - protein, 8 aa, Entamoeba histolytica
RTEGVSTT

SEQ ID NO: 2653649 - protein, 5 aa, Entamoeba histolytica
RTEIE

SEQ ID NO: 2653650 - protein, 10 aa, Entamoeba histolytica
RTEISKSQTP

SEQ ID NO: 2653651 - protein, 4 aa, Entamoeba histolytica
RTEM

SEQ ID NO: 2653652 - protein, 4 aa, Entamoeba histolytica
RTEN

SEQ ID NO: 2653653 - protein, 5 aa, Entamoeba histolytica
RTENE

SEQ ID NO: 2653654 - protein, 4 aa, Entamoeba histolytica
RTEP

SEQ ID NO: 2653655 - protein, 6 aa, Entamoeba histolytica
RTESQI

SEQ ID NO: 2653656 - protein, 4 aa, Entamoeba histolytica
RTEV

SEQ ID NO: 2653657 - protein, 7 aa, Entamoeba histolytica
RTEVAES

SEQ ID NO: 2653658 - protein, 4 aa, Entamoeba histolytica
RTGD

SEQ ID NO: 2653659 - protein, 5 aa, Entamoeba histolytica
RTGEK

SEQ ID NO: 2653660 - protein, 13 aa, Entamoeba histolytica
RTGGTAEEEGNID

SEQ ID NO: 2653661 - protein, 6 aa, Entamoeba histolytica
RTGKPI

SEQ ID NO: 2653662 - protein, 10 aa, Entamoeba histolytica
RTGKSSNTIQ

SEQ ID NO: 2653663 - protein, 4 aa, Entamoeba histolytica
RTGN

SEQ ID NO: 2653664 - protein, 7 aa, Entamoeba histolytica
RTGRIGY

SEQ ID NO: 2653665 - protein, 12 aa, Entamoeba histolytica
RTGRMGRSVEGE

SEQ ID NO: 2653666 - protein, 9 aa, Entamoeba histolytica
RTGSGKTAA

SEQ ID NO: 2653667 - protein, 5 aa, Entamoeba histolytica
RTGYG

SEQ ID NO: 2653668 - protein, 9 aa, Entamoeba histolytica
RTHKEYKGL

SEQ ID NO: 2653669 - protein, 5 aa, Entamoeba histolytica
RTHNQ

SEQ ID NO: 2653670 - protein, 7 aa, Entamoeba histolytica
RTHPSAS

SEQ ID NO: 2653671 - protein, 7 aa, Entamoeba histolytica
RTIEDKK

SEQ ID NO: 2653672 - protein, 19 aa, Entamoeba histolytica
RTIEPRVGSDEHRRQQRRR

SEQ ID NO: 2653673 - protein, 5 aa, Entamoeba histolytica
RTIKE

SEQ ID NO: 2653674 - protein, 6 aa, Entamoeba histolytica
RTIKGT

SEQ ID NO: 2653675 - protein, 7 aa, Entamoeba histolytica
RTIPSES

SEQ ID NO: 2653676 - protein, 17 aa, Entamoeba histolytica
RTISRGRSSNHEIEESY

SEQ ID NO: 2653677 - protein, 9 aa, Entamoeba histolytica
RTITEKQSM

SEQ ID NO: 2653678 - protein, 17 aa, Entamoeba histolytica
RTITENKRNTNQSDCVV

SEQ ID NO: 2653679 - protein, 5 aa, Entamoeba histolytica
RTITK

SEQ ID NO: 2653680 - protein, 16 aa, Entamoeba histolytica
RTIYERGKNKNPTSQD

SEQ ID NO: 2653681 - protein, 6 aa, Entamoeba histolytica
RTIYGG

SEQ ID NO: 2653682 - protein, 12 aa, Entamoeba histolytica
RTKDMESPRQTA

SEQ ID NO: 2653683 - protein, 5 aa, Entamoeba histolytica
RTKDQ

SEQ ID NO: 2653684 - protein, 9 aa, Entamoeba histolytica
RTKDVRDQL

SEQ ID NO: 2653685 - protein, 10 aa, Entamoeba histolytica
RTKEAGSFGE

SEQ ID NO: 2653686 - protein, 20 aa, Entamoeba histolytica
RTKEANPSHKPLTSQNNVIQ

SEQ ID NO: 2653687 - protein, 7 aa, Entamoeba histolytica
RTKEDDH

SEQ ID NO: 2653688 - protein, 5 aa, Entamoeba histolytica
RTKEN

SEQ ID NO: 2653689 - protein, 9 aa, Entamoeba histolytica
RTKENERMN

SEQ ID NO: 2653690 - protein, 5 aa, Entamoeba histolytica
RTKGD

SEQ ID NO: 2653691 - protein, 10 aa, Entamoeba histolytica
RTKKPQNRLS

SEQ ID NO: 2653692 - protein, 6 aa, Entamoeba histolytica
RTKKQC

SEQ ID NO: 2653693 - protein, 8 aa, Entamoeba histolytica
RTKKTKNT

SEQ ID NO: 2653694 - protein, 9 aa, Entamoeba histolytica
RTKNEIKTL

SEQ ID NO: 2653695 - protein, 8 aa, Entamoeba histolytica
RTKNSLPN

SEQ ID NO: 2653696 - protein, 5 aa, Entamoeba histolytica
RTKPE

SEQ ID NO: 2653697 - protein, 17 aa, Entamoeba histolytica
RTKPNTFEISNIIILQW

SEQ ID NO: 2653698 - protein, 5 aa, Entamoeba histolytica
RTKQI

SEQ ID NO: 2653699 - protein, 9 aa, Entamoeba histolytica
RTKSEINKN

SEQ ID NO: 2653700 - protein, 10 aa, Entamoeba histolytica
RTKSKGYSIE

SEQ ID NO: 2653701 - protein, 8 aa, Entamoeba histolytica
RTKSTPPI

SEQ ID NO: 2653702 - protein, 11 aa, Entamoeba histolytica
RTKTAKERIER

SEQ ID NO: 2653703 - protein, 8 aa, Entamoeba histolytica
RTKTLGQR

SEQ ID NO: 2653704 - protein, 6 aa, Entamoeba histolytica
RTKTRT

SEQ ID NO: 2653705 - protein, 13 aa, Entamoeba histolytica
RTLADSVPKEEKT

SEQ ID NO: 2653706 - protein, 14 aa, Entamoeba histolytica
RTLNESPKRNTKIQ

SEQ ID NO: 2653707 - protein, 6 aa, Entamoeba histolytica
RTLSEP

SEQ ID NO: 2653708 - protein, 13 aa, Entamoeba histolytica
RTLSTNLKSKKIN

SEQ ID NO: 2653709 - protein, 6 aa, Entamoeba histolytica
RTMDQL

SEQ ID NO: 2653710 - protein, 6 aa, Entamoeba histolytica
RTMGEE

SEQ ID NO: 2653711 - protein, 9 aa, Entamoeba histolytica
RTMSETGMT

SEQ ID NO: 2653712 - protein, 9 aa, Entamoeba histolytica
RTNAGTPAY

SEQ ID NO: 2653713 - protein, 4 aa, Entamoeba histolytica
RTND

SEQ ID NO: 2653714 - protein, 5 aa, Entamoeba histolytica
RTNED

SEQ ID NO: 2653715 - protein, 5 aa, Entamoeba histolytica
RTNEM

SEQ ID NO: 2653716 - protein, 6 aa, Entamoeba histolytica
RTNEVT

SEQ ID NO: 2653717 - protein, 43 aa, Entamoeba histolytica
RTNEYEAKETKRNSKSKSSKKRRESKPRKTSNKKGFVKRMTSK

SEQ ID NO: 2653718 - protein, 10 aa, Entamoeba histolytica
RTNKSKKENY

SEQ ID NO: 2653719 - protein, 7 aa, Entamoeba histolytica
RTNKTTI

SEQ ID NO: 2653720 - protein, 6 aa, Entamoeba histolytica
RTNNDL

SEQ ID NO: 2653721 - protein, 5 aa, Entamoeba histolytica
RTNNE

SEQ ID NO: 2653722 - protein, 10 aa, Entamoeba histolytica
RTNNREISDT

SEQ ID NO: 2653723 - protein, 6 aa, Entamoeba histolytica
RTNPPK

SEQ ID NO: 2653724 - protein, 7 aa, Entamoeba histolytica
RTNPRGN

SEQ ID NO: 2653725 - protein, 8 aa, Entamoeba histolytica
RTNTDYKS

SEQ ID NO: 2653726 - protein, 6 aa, Entamoeba histolytica
RTNTIE

SEQ ID NO: 2653727 - protein, 5 aa, Entamoeba histolytica
RTNTQ

SEQ ID NO: 2653728 - protein, 5 aa, Entamoeba histolytica
RTNTS

SEQ ID NO: 2653729 - protein, 6 aa, Entamoeba histolytica
RTPDTY

SEQ ID NO: 2653730 - protein, 4 aa, Entamoeba histolytica
RTPE

SEQ ID NO: 2653731 - protein, 7 aa, Entamoeba histolytica
RTPEDYA

SEQ ID NO: 2653732 - protein, 6 aa, Entamoeba histolytica
RTPGIK

SEQ ID NO: 2653733 - protein, 8 aa, Entamoeba histolytica
RTPKGEII

SEQ ID NO: 2653734 - protein, 14 aa, Entamoeba histolytica
RTPNSRNVDEYTKS

SEQ ID NO: 2653735 - protein, 6 aa, Entamoeba histolytica
RTPNVE

SEQ ID NO: 2653736 - protein, 4 aa, Entamoeba histolytica
RTPP

SEQ ID NO: 2653737 - protein, 9 aa, Entamoeba histolytica
RTPPIPSKR

SEQ ID NO: 2653738 - protein, 9 aa, Entamoeba histolytica
RTPQGNSRK

SEQ ID NO: 2653739 - protein, 4 aa, Entamoeba histolytica
RTPR

SEQ ID NO: 2653740 - protein, 7 aa, Entamoeba histolytica
RTPSADL

SEQ ID NO: 2653741 - protein, 4 aa, Entamoeba histolytica
RTPT

SEQ ID NO: 2653742 - protein, 5 aa, Entamoeba histolytica
RTPVV

SEQ ID NO: 2653743 - protein, 6 aa, Entamoeba histolytica
RTQAEH

SEQ ID NO: 2653744 - protein, 12 aa, Entamoeba histolytica
RTQDETVGDGTT

SEQ ID NO: 2653745 - protein, 14 aa, Entamoeba histolytica
RTQEINADTVEDAK

SEQ ID NO: 2653746 - protein, 7 aa, Entamoeba histolytica
RTQEKVE

SEQ ID NO: 2653747 - protein, 7 aa, Entamoeba histolytica
RTQIAPN

SEQ ID NO: 2653748 - protein, 22 aa, Entamoeba histolytica
RTQQEESATEGSDNESKTALGD

SEQ ID NO: 2653749 - protein, 9 aa, Entamoeba histolytica
RTQTMNEED

SEQ ID NO: 2653750 - protein, 8 aa, Entamoeba histolytica
RTQTRNTT

SEQ ID NO: 2653751 - protein, 22 aa, Entamoeba histolytica
RTRDRNPRHREYDRYESSYYSR

SEQ ID NO: 2653752 - protein, 14 aa, Entamoeba histolytica
RTRHSSMSSPQQQY

SEQ ID NO: 2653753 - protein, 7 aa, Entamoeba histolytica
RTRKQIK

SEQ ID NO: 2653754 - protein, 40 aa, Entamoeba histolytica
RTRPTPKPEEPKQEETVSRTTPLKPQSSNSSVQDKPHVGA

SEQ ID NO: 2653755 - protein, 7 aa, Entamoeba histolytica
RTRPTTN

SEQ ID NO: 2653756 - protein, 6 aa, Entamoeba histolytica
RTRSEK

SEQ ID NO: 2653757 - protein, 6 aa, Entamoeba histolytica
RTRSEN

SEQ ID NO: 2653758 - protein, 9 aa, Entamoeba histolytica
RTSDGGAEV

SEQ ID NO: 2653759 - protein, 5 aa, Entamoeba histolytica
RTSDP

SEQ ID NO: 2653760 - protein, 4 aa, Entamoeba histolytica
RTSE

SEQ ID NO: 2653761 - protein, 7 aa, Entamoeba histolytica
RTSEDEF

SEQ ID NO: 2653762 - protein, 12 aa, Entamoeba histolytica
RTSEDLNDVRES

SEQ ID NO: 2653763 - protein, 16 aa, Entamoeba histolytica
RTSEEETNKVEEEIKE

SEQ ID NO: 2653764 - protein, 7 aa, Entamoeba histolytica
RTSEYQY

SEQ ID NO: 2653765 - protein, 13 aa, Entamoeba histolytica
RTSFTPKKPRTGF

SEQ ID NO: 2653766 - protein, 13 aa, Entamoeba histolytica
RTSFTYRDKTYNE

SEQ ID NO: 2653767 - protein, 7 aa, Entamoeba histolytica
RTSHSLS

SEQ ID NO: 2653768 - protein, 4 aa, Entamoeba histolytica
RTSK

SEQ ID NO: 2653769 - protein, 6 aa, Entamoeba histolytica
RTSKEL

SEQ ID NO: 2653770 - protein, 10 aa, Entamoeba histolytica
RTSKISSIQQ

SEQ ID NO: 2653771 - protein, 14 aa, Entamoeba histolytica
RTSKRMSKKKHQYP

SEQ ID NO: 2653772 - protein, 9 aa, Entamoeba histolytica
RTSKSHRDY

SEQ ID NO: 2653773 - protein, 13 aa, Entamoeba histolytica
RTSKTDKSEIKKG

SEQ ID NO: 2653774 - protein, 6 aa, Entamoeba histolytica
RTSNNT

SEQ ID NO: 2653775 - protein, 5 aa, Entamoeba histolytica
RTSPH

SEQ ID NO: 2653776 - protein, 21 aa, Entamoeba histolytica
RTSRRPELGDKFSSRHGQKGV

SEQ ID NO: 2653777 - protein, 21 aa, Entamoeba histolytica
RTSSPAPKIPTLSQNKENNLI

SEQ ID NO: 2653778 - protein, 9 aa, Entamoeba histolytica
RTSSTEQVI

SEQ ID NO: 2653779 - protein, 28 aa, Entamoeba histolytica
RTSTPAPSFSTVKQNENVRRKGIRKRGK

SEQ ID NO: 2653780 - protein, 15 aa, Entamoeba histolytica
RTSTPSESEVSESSE

SEQ ID NO: 2653781 - protein, 10 aa, Entamoeba histolytica
RTTAGIDGTV

SEQ ID NO: 2653782 - protein, 9 aa, Entamoeba histolytica
RTTAGVDGS

SEQ ID NO: 2653783 - protein, 5 aa, Entamoeba histolytica
RTTAP

SEQ ID NO: 2653784 - protein, 13 aa, Entamoeba histolytica
RTTASTSKDQLRE

SEQ ID NO: 2653785 - protein, 6 aa, Entamoeba histolytica
RTTDEV

SEQ ID NO: 2653786 - protein, 5 aa, Entamoeba histolytica
RTTEE

SEQ ID NO: 2653787 - protein, 6 aa, Entamoeba histolytica
RTTEWD

SEQ ID NO: 2653788 - protein, 10 aa, Entamoeba histolytica
RTTEYEQKRI

SEQ ID NO: 2653789 - protein, 4 aa, Entamoeba histolytica
RTTF

SEQ ID NO: 2653790 - protein, 5 aa, Entamoeba histolytica
RTTFK

SEQ ID NO: 2653791 - protein, 4 aa, Entamoeba histolytica
RTTG

SEQ ID NO: 2653792 - protein, 5 aa, Entamoeba histolytica
RTTKE

SEQ ID NO: 2653793 - protein, 29 aa, Entamoeba histolytica
RTTKEDRIKRRKALAKKRMSRRKEKAQQS

SEQ ID NO: 2653794 - protein, 11 aa, Entamoeba histolytica
RTTKPAKMTKK

SEQ ID NO: 2653795 - protein, 6 aa, Entamoeba histolytica
RTTKPQ

SEQ ID NO: 2653796 - protein, 4 aa, Entamoeba histolytica
RTTL

SEQ ID NO: 2653797 - protein, 8 aa, Entamoeba histolytica
RTTPEEKS

SEQ ID NO: 2653798 - protein, 6 aa, Entamoeba histolytica
RTTPKP

SEQ ID NO: 2653799 - protein, 15 aa, Entamoeba histolytica
RTTPRKLEGHSQRDY

SEQ ID NO: 2653800 - protein, 7 aa, Entamoeba histolytica
RTTQRNS

SEQ ID NO: 2653801 - protein, 4 aa, Entamoeba histolytica
RTTR

SEQ ID NO: 2653802 - protein, 5 aa, Entamoeba histolytica
RTTST

SEQ ID NO: 2653803 - protein, 12 aa, Entamoeba histolytica
RTTTDDQSLGNS

SEQ ID NO: 2653804 - protein, 8 aa, Entamoeba histolytica
RTTTGKKG

SEQ ID NO: 2653805 - protein, 4 aa, Entamoeba histolytica
RTTV

SEQ ID NO: 2653806 - protein, 32 aa, Entamoeba histolytica
RTVKDSLRKEHNKRKEQRERRKAKKEEEKRKA

SEQ ID NO: 2653807 - protein, 11 aa, Entamoeba histolytica
RTVKNTPKKPL

SEQ ID NO: 2653808 - protein, 10 aa, Entamoeba histolytica
RTVKPRNKGY

SEQ ID NO: 2653809 - protein, 9 aa, Entamoeba histolytica
RTVRRSSGD

SEQ ID NO: 2653810 - protein, 13 aa, Entamoeba histolytica
RTYKKDISGNARA

SEQ ID NO: 2653811 - protein, 8 aa, Entamoeba histolytica
RTYSNEEV

SEQ ID NO: 2653812 - protein, 4 aa, Entamoeba histolytica
RVAE

SEQ ID NO: 2653813 - protein, 6 aa, Entamoeba histolytica
RVAPVN

SEQ ID NO: 2653814 - protein, 5 aa, Entamoeba histolytica
RVAQK

SEQ ID NO: 2653815 - protein, 7 aa, Entamoeba histolytica
RVATKNE

SEQ ID NO: 2653816 - protein, 11 aa, Entamoeba histolytica
RVDDYTKQEMK

SEQ ID NO: 2653817 - protein, 24 aa, Entamoeba histolytica
RVDEELKKDEERIKKEEERAKDRR

SEQ ID NO: 2653818 - protein, 7 aa, Entamoeba histolytica
RVDEETI

SEQ ID NO: 2653819 - protein, 10 aa, Entamoeba histolytica
RVDKNSGVIR

SEQ ID NO: 2653820 - protein, 8 aa, Entamoeba histolytica
RVDSPDFS

SEQ ID NO: 2653821 - protein, 20 aa, Entamoeba histolytica
RVDTKKKNSNRTKSGPSSRF

SEQ ID NO: 2653822 - protein, 11 aa, Entamoeba histolytica
RVEDKTFDGKS

SEQ ID NO: 2653823 - protein, 4 aa, Entamoeba histolytica
RVEE

SEQ ID NO: 2653824 - protein, 39 aa, Entamoeba histolytica
RVEEERRRVREEQEQEYKKALEEAKRQEEREQKKQEELL

SEQ ID NO: 2653825 - protein, 18 aa, Entamoeba histolytica
RVEEEYPSGTINGFSKEG

SEQ ID NO: 2653826 - protein, 85 aa, Entamoeba histolytica
RVEEIEKQKQAMEEEEKRKEEEEKEKAIKELKKKKEEEMKRKSGIGKQQNQRYVRPKKTQSEREEESKEEEKAIELEKKSSSERI

SEQ ID NO: 2653827 - protein, 99 aa, Entamoeba histolytica
RVEEIEKQKQAMEEEKKKEEEEEKRKEEEEKRKEEEEKEKAIKELKKKKEEEMKRKSGIGKQQNQRYVRPKKTQSEREEESKEEEKAIELEKKSSSERI

SEQ ID NO: 2653828 - protein, 8 aa, Entamoeba histolytica
RVEEVEKK

SEQ ID NO: 2653829 - protein, 9 aa, Entamoeba histolytica
RVEGKSNTS

SEQ ID NO: 2653830 - protein, 11 aa, Entamoeba histolytica
RVEGSIEGYYE

SEQ ID NO: 2653831 - protein, 13 aa, Entamoeba histolytica
RVEGWDDETEEIR

SEQ ID NO: 2653832 - protein, 11 aa, Entamoeba histolytica
RVEKGVPNSCS

SEQ ID NO: 2653833 - protein, 13 aa, Entamoeba histolytica
RVENTKKAKKLRY

SEQ ID NO: 2653834 - protein, 14 aa, Entamoeba histolytica
RVEPNKVKIGDSES

SEQ ID NO: 2653835 - protein, 10 aa, Entamoeba histolytica
RVEQYEVGSS

SEQ ID NO: 2653836 - protein, 16 aa, Entamoeba histolytica
RVESSGGDQDLGGNDF

SEQ ID NO: 2653837 - protein, 5 aa, Entamoeba histolytica
RVGED

SEQ ID NO: 2653838 - protein, 6 aa, Entamoeba histolytica
RVGGVT

SEQ ID NO: 2653839 - protein, 4 aa, Entamoeba histolytica
RVGN

SEQ ID NO: 2653840 - protein, 7 aa, Entamoeba histolytica
RVGTTKN

SEQ ID NO: 2653841 - protein, 5 aa, Entamoeba histolytica
RVIGN

SEQ ID NO: 2653842 - protein, 20 aa, Entamoeba histolytica
RVKENAKKIGSTTHADPRCQ

SEQ ID NO: 2653843 - protein, 8 aa, Entamoeba histolytica
RVKGKTNE

SEQ ID NO: 2653844 - protein, 4 aa, Entamoeba histolytica
RVKK

SEQ ID NO: 2653845 - protein, 9 aa, Entamoeba histolytica
RVKKDEDIQ

SEQ ID NO: 2653846 - protein, 6 aa, Entamoeba histolytica
RVKQNN

SEQ ID NO: 2653847 - protein, 7 aa, Entamoeba histolytica
RVKQTLS

SEQ ID NO: 2653848 - protein, 7 aa, Entamoeba histolytica
RVNETET

SEQ ID NO: 2653849 - protein, 9 aa, Entamoeba histolytica
RVNNTDSHQ

SEQ ID NO: 2653850 - protein, 17 aa, Entamoeba histolytica
RVNNTNESEEKENEIQT

SEQ ID NO: 2653851 - protein, 21 aa, Entamoeba histolytica
RVNNTQTRPLPQQQNQPIQTG

SEQ ID NO: 2653852 - protein, 34 aa, Entamoeba histolytica; identical to SEQ ID NO: 2458634

SEQ ID NO: 2653853 - protein, 7 aa, Entamoeba histolytica
RVNQQSL

SEQ ID NO: 2653854 - protein, 9 aa, Entamoeba histolytica
RVPDSKNEL

SEQ ID NO: 2653855 - protein, 43 aa, Entamoeba histolytica
RVPGKGGFKPKSNSQPSQKATYNQQPTQSFNAPPPPPPSYGGH

SEQ ID NO: 2653856 - protein, 7 aa, Entamoeba histolytica
RVPNSLP

SEQ ID NO: 2653857 - protein, 7 aa, Entamoeba histolytica
RVPPLDE

SEQ ID NO: 2653858 - protein, 5 aa, Entamoeba histolytica
RVQQE

SEQ ID NO: 2653859 - protein, 49 aa, Entamoeba histolytica
RVRNRRESGRKTQSPQNVPPIPPMDPPVSPSRSTPMSLPEETPFNSPPI

SEQ ID NO: 2653860 - protein, 18 aa, Entamoeba histolytica
RVSDSGSVEEQSTEEEQT

SEQ ID NO: 2653861 - protein, 9 aa, Entamoeba histolytica
RVSEDEADE

SEQ ID NO: 2653862 - protein, 10 aa, Entamoeba histolytica
RVSEDEADEL

SEQ ID NO: 2653863 - protein, 11 aa, Entamoeba histolytica
RVSEDSLKSRK

SEQ ID NO: 2653864 - protein, 13 aa, Entamoeba histolytica
RVSEEVGSKLGEE

SEQ ID NO: 2653865 - protein, 17 aa, Entamoeba histolytica
RVSKKRRFNSSTKYTNR

SEQ ID NO: 2653866 - protein, 30 aa, Entamoeba histolytica
RVSNRRRREDKEQSDEEKDRKCEDERYEDE

SEQ ID NO: 2653867 - protein, 11 aa, Entamoeba histolytica
RVSQGKRFKNK

SEQ ID NO: 2653868 - protein, 9 aa, Entamoeba histolytica
RVSSEAITS

SEQ ID NO: 2653869 - protein, 30 aa, Entamoeba histolytica
RVSSEPTASIEPTDTKGKKERKPSKSKCEL

SEQ ID NO: 2653870 - protein, 8 aa, Entamoeba histolytica
RVTDEDLD

SEQ ID NO: 2653871 - protein, 54 aa, Entamoeba histolytica
RVTEENKKLQAQREKEAKKAEAAAAKKAGKKKTSLAPIPGEEGNMVKGRRQNPL

SEQ ID NO: 2653872 - protein, 6 aa, Entamoeba histolytica
RVTFGD

SEQ ID NO: 2653873 - protein, 5 aa, Entamoeba histolytica
RVTGR

SEQ ID NO: 2653874 - protein, 6 aa, Entamoeba histolytica
RVTGTT

SEQ ID NO: 2653875 - protein, 5 aa, Entamoeba histolytica
RVTPE

SEQ ID NO: 2653876 - protein, 9 aa, Entamoeba histolytica
RVTRKQGTT

SEQ ID NO: 2653877 - protein, 5 aa, Entamoeba histolytica
RVTTK

SEQ ID NO: 2653878 - protein, 7 aa, Entamoeba histolytica
RWEEEER

SEQ ID NO: 2653879 - protein, 12 aa, Entamoeba histolytica
RWGTSDDRTDYE

SEQ ID NO: 2653880 - protein, 8 aa, Entamoeba histolytica
RWKEQSTK

SEQ ID NO: 2653881 - protein, 20 aa, Entamoeba histolytica
RWNGKQPEEMDEQTKKRYKR

SEQ ID NO: 2653882 - protein, 7 aa, Entamoeba histolytica
RWPSGAK

SEQ ID NO: 2653883 - protein, 4 aa, Entamoeba histolytica
RWSA

SEQ ID NO: 2653884 - protein, 8 aa, Entamoeba histolytica
RYADGEIK

SEQ ID NO: 2653885 - protein, 10 aa, Entamoeba histolytica
RYAKSVSSKI

SEQ ID NO: 2653886 - protein, 13 aa, Entamoeba histolytica
RYDAKEKKEEAFA

SEQ ID NO: 2653887 - protein, 12 aa, Entamoeba histolytica
RYDKKQNKEETF

SEQ ID NO: 2653888 - protein, 5 aa, Entamoeba histolytica
RYDKT

SEQ ID NO: 2653889 - protein, 5 aa, Entamoeba histolytica
RYDNR

SEQ ID NO: 2653890 - protein, 5 aa, Entamoeba histolytica
RYDRI

SEQ ID NO: 2653891 - protein, 34 aa, Entamoeba histolytica
RYDSPRDRYNSYSPSRDYREVRSPPRNSRERRRD

SEQ ID NO: 2653892 - protein, 4 aa, Entamoeba histolytica
RYEA

SEQ ID NO: 2653893 - protein, 13 aa, Entamoeba histolytica
RYEDLRQQLSHLS

SEQ ID NO: 2653894 - protein, 13 aa, Entamoeba histolytica
RYEENNDDELTEL

SEQ ID NO: 2653895 - protein, 13 aa, Entamoeba histolytica
RYEGERSAAPNIK

SEQ ID NO: 2653896 - protein, 5 aa, Entamoeba histolytica
RYEIK

SEQ ID NO: 2653897 - protein, 16 aa, Entamoeba histolytica
RYENKGPFEFEKDDDD

SEQ ID NO: 2653898 - protein, 6 aa, Entamoeba histolytica
RYEQEP

SEQ ID NO: 2653899 - protein, 11 aa, Entamoeba histolytica
RYESNKKYIED

SEQ ID NO: 2653900 - protein, 8 aa, Entamoeba histolytica
RYESSQNA

SEQ ID NO: 2653901 - protein, 8 aa, Entamoeba histolytica
RYGDETKM

SEQ ID NO: 2653902 - protein, 8 aa, Entamoeba histolytica
RYGEGEAT

SEQ ID NO: 2653903 - protein, 12 aa, Entamoeba histolytica
RYGLGSKEFTPA

SEQ ID NO: 2653904 - protein, 68 aa, Entamoeba histolytica
RYGNAKKPIPSSASSARSVPKVPASKTNKVGGYGVSKSTTTTTKPNTTTTKPNTTTTKPSPATPARGG

SEQ ID NO: 2653905 - protein, 9 aa, Entamoeba histolytica
RYGPDKGNV

SEQ ID NO: 2653906 - protein, 7 aa, Entamoeba histolytica
RYGTNES

SEQ ID NO: 2653907 - protein, 7 aa, Entamoeba histolytica
RYGTNNW

SEQ ID NO: 2653908 - protein, 10 aa, Entamoeba histolytica
RYHSKSNQYE

SEQ ID NO: 2653909 - protein, 12 aa, Entamoeba histolytica
RYKDEEQPNWES

SEQ ID NO: 2653910 - protein, 7 aa, Entamoeba histolytica
RYKEDDL

SEQ ID NO: 2653911 - protein, 9 aa, Entamoeba histolytica
RYKNELEKE

SEQ ID NO: 2653912 - protein, 8 aa, Entamoeba histolytica
RYKSEKRK

SEQ ID NO: 2653913 - protein, 66 aa, Entamoeba histolytica
RYKSSRRRTRREYSRNEDREDRHRRVPEEERYNRSIRRRADRSPSLSPLGDKLPSRWDEQPKAIDS

SEQ ID NO: 2653914 - protein, 16 aa, Entamoeba histolytica
RYNAQFGDKTKGVTDK

SEQ ID NO: 2653915 - protein, 13 aa, Entamoeba histolytica
RYNEGKKGMDSAE

SEQ ID NO: 2653916 - protein, 14 aa, Entamoeba histolytica
RYNEGKKGVADAES

SEQ ID NO: 2653917 - protein, 18 aa, Entamoeba histolytica
RYNTENQMKEHELSKKHK

SEQ ID NO: 2653918 - protein, 11 aa, Entamoeba histolytica
RYPRNENGEIV

SEQ ID NO: 2653919 - protein, 4 aa, Entamoeba histolytica
RYRE

SEQ ID NO: 2653920 - protein, 13 aa, Entamoeba histolytica
RYRGEDTKEITSR

SEQ ID NO: 2653921 - protein, 12 aa, Entamoeba histolytica
RYSEGKEGMASA

SEQ ID NO: 2653922 - protein, 6 aa, Entamoeba histolytica
RYSGNV

SEQ ID NO: 2653923 - protein, 5 aa, Entamoeba histolytica
RYSKA

SEQ ID NO: 2653924 - protein, 12 aa, Entamoeba histolytica
RYSNVDDITQGT

SEQ ID NO: 2653925 - protein, 7 aa, Entamoeba histolytica
RYSQNAP

SEQ ID NO: 2653926 - protein, 6 aa, Entamoeba histolytica
RYSRNK

SEQ ID NO: 2653927 - protein, 4 aa, Entamoeba histolytica
RYST

SEQ ID NO: 2653928 - protein, 8 aa, Entamoeba histolytica
RYSTTITN

SEQ ID NO: 2653929 - protein, 9 aa, Entamoeba histolytica
RYTNNKIAE

SEQ ID NO: 2653930 - protein, 8 aa, Entamoeba histolytica
RYTTQSDV

SEQ ID NO: 2653931 - protein, 6 aa, Entamoeba histolytica
RYVTGD

SEQ ID NO: 2653932 - protein, 7 aa, Entamoeba histolytica
SAAAGAN

SEQ ID NO: 2653933 - protein, 11 aa, Entamoeba histolytica
SAAAQAKYSQA

SEQ ID NO: 2653934 - protein, 10 aa, Entamoeba histolytica
SAADKTTMDD

SEQ ID NO: 2653935 - protein, 19 aa, Entamoeba histolytica
SAADTASELYAETNQSERV

SEQ ID NO: 2653936 - protein, 10 aa, Entamoeba histolytica
SAAEGQELAE

SEQ ID NO: 2653937 - protein, 6 aa, Entamoeba histolytica
SAAEQK

SEQ ID NO: 2653938 - protein, 9 aa, Entamoeba histolytica
SAAKGENIQ

SEQ ID NO: 2653939 - protein, 8 aa, Entamoeba histolytica
SAAKNNGY

SEQ ID NO: 2653940 - protein, 8 aa, Entamoeba histolytica
SAAPTLKS

SEQ ID NO: 2653941 - protein, 13 aa, Entamoeba histolytica
SAARSKDFEVTDA

SEQ ID NO: 2653942 - protein, 8 aa, Entamoeba histolytica
SAASNSNV

SEQ ID NO: 2653943 - protein, 6 aa, Entamoeba histolytica
SAATEN

SEQ ID NO: 2653944 - protein, 24 aa, Entamoeba histolytica
SADDKEKEEIKEEIKKKRPKSESM

SEQ ID NO: 2653945 - protein, 7 aa, Entamoeba histolytica
SADEPMT

SEQ ID NO: 2653946 - protein, 14 aa, Entamoeba histolytica
SADFATSHKYDKEL

SEQ ID NO: 2653947 - protein, 8 aa, Entamoeba histolytica
SADFDRNR

SEQ ID NO: 2653948 - protein, 14 aa, Entamoeba histolytica
SADGTTLGSDDGAG

SEQ ID NO: 2653949 - protein, 4 aa, Entamoeba histolytica
SADH

SEQ ID NO: 2653950 - protein, 10 aa, Entamoeba histolytica
SADNDTKKSI

SEQ ID NO: 2653951 - protein, 7 aa, Entamoeba histolytica
SADNKQT

SEQ ID NO: 2653952 - protein, 6 aa, Entamoeba histolytica
SADNKY

SEQ ID NO: 2653953 - protein, 16 aa, Entamoeba histolytica
SADNSDFSTITPASAQ

SEQ ID NO: 2653954 - protein, 10 aa, Entamoeba histolytica
SADPQKKMDS

SEQ ID NO: 2653955 - protein, 13 aa, Entamoeba histolytica
SADRNIKGKITKD

SEQ ID NO: 2653956 - protein, 5 aa, Entamoeba histolytica
SADRT

SEQ ID NO: 2653957 - protein, 7 aa, Entamoeba histolytica
SADSPYH

SEQ ID NO: 2653958 - protein, 18 aa, Entamoeba histolytica
SADTNVPVDPKNPPKERQ

SEQ ID NO: 2653959 - protein, 7 aa, Entamoeba histolytica
SADYNAK

SEQ ID NO: 2653960 - protein, 9 aa, Entamoeba histolytica
SAEARERER

SEQ ID NO: 2653961 - protein, 9 aa, Entamoeba histolytica
SAEEMQSIE

SEQ ID NO: 2653962 - protein, 12 aa, Entamoeba histolytica
SAEETGNSSKPL

SEQ ID NO: 2653963 - protein, 4 aa, Entamoeba histolytica
SAEK

SEQ ID NO: 2653964 - protein, 6 aa, Entamoeba histolytica
SAELGY

SEQ ID NO: 2653965 - protein, 12 aa, Entamoeba histolytica
SAENMADSESGY

SEQ ID NO: 2653966 - protein, 42 aa, Entamoeba histolytica
SAENTQYTQQQQTTPSTPPQFQSPSPKQSKSPLSPPKSSIKT

SEQ ID NO: 2653967 - protein, 42 aa, Entamoeba histolytica
SAENTQYTQQQQTTPSTSPQFQSPSPKQSKSPLSPPKSSIKT

SEQ ID NO: 2653968 - protein, 9 aa, Entamoeba histolytica
SAEQDKTDF

SEQ ID NO: 2653969 - protein, 8 aa, Entamoeba histolytica
SAEQRSDV

SEQ ID NO: 2653970 - protein, 13 aa, Entamoeba histolytica
SAERKKPATIVSR

SEQ ID NO: 2653971 - protein, 29 aa, Entamoeba histolytica
SAESKRDEIISSANQESEKEKNSIIEKEK

SEQ ID NO: 2653972 - protein, 6 aa, Entamoeba histolytica
SAETQG

SEQ ID NO: 2653973 - protein, 6 aa, Entamoeba histolytica
SAFPDT

SEQ ID NO: 2653974 - protein, 5 aa, Entamoeba histolytica
SAFSQ

SEQ ID NO: 2653975 - protein, 8 aa, Entamoeba histolytica
SAFVSDTN

SEQ ID NO: 2653976 - protein, 5 aa, Entamoeba histolytica
SAGAY

SEQ ID NO: 2653977 - protein, 9 aa, Entamoeba histolytica
SAGGDQHLG

SEQ ID NO: 2653978 - protein, 9 aa, Entamoeba histolytica
SAGGITAQL

SEQ ID NO: 2653979 - protein, 10 aa, Entamoeba histolytica
SAGGMKLGQK

SEQ ID NO: 2653980 - protein, 5 aa, Entamoeba histolytica
SAGKG

SEQ ID NO: 2653981 - protein, 10 aa, Entamoeba histolytica
SAGKTATAEY

SEQ ID NO: 2653982 - protein, 6 aa, Entamoeba histolytica
SAGKTT

SEQ ID NO: 2653983 - protein, 6 aa, Entamoeba histolytica
SAGQQK

SEQ ID NO: 2653984 - protein, 7 aa, Entamoeba histolytica
SAGRHKE

SEQ ID NO: 2653985 - protein, 8 aa, Entamoeba histolytica
SAGSPTVI

SEQ ID NO: 2653986 - protein, 5 aa, Entamoeba histolytica
SAGVD

SEQ ID NO: 2653987 - protein, 6 aa, Entamoeba histolytica
SAHKRI

SEQ ID NO: 2653988 - protein, 9 aa, Entamoeba histolytica
SAHPNRNSI

SEQ ID NO: 2653989 - protein, 6 aa, Entamoeba histolytica
SAHQQT

SEQ ID NO: 2653990 - protein, 5 aa, Entamoeba histolytica
SAHRT

SEQ ID NO: 2653991 - protein, 5 aa, Entamoeba histolytica
SAIDS

SEQ ID NO: 2653992 - protein, 8 aa, Entamoeba histolytica
SAIEKQQG

SEQ ID NO: 2653993 - protein, 7 aa, Entamoeba histolytica
SAIGDQQ

SEQ ID NO: 2653994 - protein, 5 aa, Entamoeba histolytica
SAINK

SEQ ID NO: 2653995 - protein, 6 aa, Entamoeba histolytica
SAIPGV

SEQ ID NO: 2653996 - protein, 7 aa, Entamoeba histolytica
SAIPNST

SEQ ID NO: 2653997 - protein, 8 aa, Entamoeba histolytica
SAIPTSTY

SEQ ID NO: 2653998 - protein, 15 aa, Entamoeba histolytica
SAIQKESDKKFSKNI

SEQ ID NO: 2653999 - protein, 8 aa, Entamoeba histolytica
SAIQRNNG

SEQ ID NO: 2654000 - protein, 4 aa, Entamoeba histolytica
SAIS

SEQ ID NO: 2654001 - protein, 6 aa, Entamoeba histolytica
SAISPD

SEQ ID NO: 2654002 - protein, 13 aa, Entamoeba histolytica
SAITQPQAATASQ

SEQ ID NO: 2654003 - protein, 9 aa, Entamoeba histolytica
SAIVGGNDF

SEQ ID NO: 2654004 - protein, 9 aa, Entamoeba histolytica
SAKADVEKL

SEQ ID NO: 2654005 - protein, 8 aa, Entamoeba histolytica
SAKARKGL

SEQ ID NO: 2654006 - protein, 10 aa, Entamoeba histolytica
SAKDEPRKVE

SEQ ID NO: 2654007 - protein, 9 aa, Entamoeba histolytica
SAKDGSGID

SEQ ID NO: 2654008 - protein, 41 aa, Entamoeba histolytica
SAKDQLPKEDINEEQKFDEMEEEKNEDDQNSVSISSATAVT

SEQ ID NO: 2654009 - protein, 6 aa, Entamoeba histolytica
SAKEEH

SEQ ID NO: 2654010 - protein, 9 aa, Entamoeba histolytica
SAKEGTGVN

SEQ ID NO: 2654011 - protein, 15 aa, Entamoeba histolytica
SAKEQFKQPSSEMKL

SEQ ID NO: 2654012 - protein, 9 aa, Entamoeba histolytica
SAKERKERA

SEQ ID NO: 2654013 - protein, 8 aa, Entamoeba histolytica
SAKFPGGL

SEQ ID NO: 2654014 - protein, 8 aa, Entamoeba histolytica
SAKKGIVS

SEQ ID NO: 2654015 - protein, 7 aa, Entamoeba histolytica
SAKKSLN

SEQ ID NO: 2654016 - protein, 8 aa, Entamoeba histolytica
SAKNNTNV

SEQ ID NO: 2654017 - protein, 7 aa, Entamoeba histolytica
SAKNSLK

SEQ ID NO: 2654018 - protein, 12 aa, Entamoeba histolytica
SAKQIKKKTEGW

SEQ ID NO: 2654019 - protein, 8 aa, Entamoeba histolytica
SAKRKADG

SEQ ID NO: 2654020 - protein, 7 aa, Entamoeba histolytica
SAKRNIK

SEQ ID NO: 2654021 - protein, 6 aa, Entamoeba histolytica
SAKRSK

SEQ ID NO: 2654022 - protein, 8 aa, Entamoeba histolytica
SAKSAEIL

SEQ ID NO: 2654023 - protein, 8 aa, Entamoeba histolytica
SAKSNNNV

SEQ ID NO: 2654024 - protein, 11 aa, Entamoeba histolytica
SAKTAAEEREI

SEQ ID NO: 2654025 - protein, 8 aa, Entamoeba histolytica
SAKTGAGV

SEQ ID NO: 2654026 - protein, 8 aa, Entamoeba histolytica
SAKTGENV

SEQ ID NO: 2654027 - protein, 9 aa, Entamoeba histolytica
SAKTGENVE

SEQ ID NO: 2654028 - protein, 8 aa, Entamoeba histolytica
SAKTGNNI

SEQ ID NO: 2654029 - protein, 13 aa, Entamoeba histolytica
SAKTLQDNQKLRG

SEQ ID NO: 2654030 - protein, 8 aa, Entamoeba histolytica
SAKTQKNI

SEQ ID NO: 2654031 - protein, 8 aa, Entamoeba histolytica
SAKTSENL

SEQ ID NO: 2654032 - protein, 9 aa, Entamoeba histolytica
SAKTYTETA

SEQ ID NO: 2654033 - protein, 9 aa, Entamoeba histolytica
SAKYNDGTI

SEQ ID NO: 2654034 - protein, 7 aa, Entamoeba histolytica
SALGDDS

SEQ ID NO: 2654035 - protein, 17 aa, Entamoeba histolytica
SALGNASIDEEIKKELD

SEQ ID NO: 2654036 - protein, 33 aa, Entamoeba histolytica
SALKATQRLGRSAAEKASSISNDLVPPSSQKLI

SEQ ID NO: 2654037 - protein, 9 aa, Entamoeba histolytica
SALKDRGIN

SEQ ID NO: 2654038 - protein, 14 aa, Entamoeba histolytica
SALPNTSLTSDGGW

SEQ ID NO: 2654039 - protein, 8 aa, Entamoeba histolytica
SALPPTNY

SEQ ID NO: 2654040 - protein, 6 aa, Entamoeba histolytica
SALPRA

SEQ ID NO: 2654041 - protein, 5 aa, Entamoeba histolytica
SALQQ

SEQ ID NO: 2654042 - protein, 7 aa, Entamoeba histolytica
SALTGDN

SEQ ID NO: 2654043 - protein, 9 aa, Entamoeba histolytica
SALTSTSAE

SEQ ID NO: 2654044 - protein, 8 aa, Entamoeba histolytica
SAMSNPAQ

SEQ ID NO: 2654045 - protein, 6 aa, Entamoeba histolytica
SAMSRR

SEQ ID NO: 2654046 - protein, 8 aa, Entamoeba histolytica
SANDEEEH

SEQ ID NO: 2654047 - protein, 12 aa, Entamoeba histolytica
SANDNKKDPIRE

SEQ ID NO: 2654048 - protein, 6 aa, Entamoeba histolytica
SANGKQ

SEQ ID NO: 2654049 - protein, 8 aa, Entamoeba histolytica
SANGSEAD

SEQ ID NO: 2654050 - protein, 4 aa, Entamoeba histolytica
SANL

SEQ ID NO: 2654051 - protein, 10 aa, Entamoeba histolytica
SANLKDNKTA

SEQ ID NO: 2654052 - protein, 8 aa, Entamoeba histolytica
SANLTPMD

SEQ ID NO: 2654053 - protein, 15 aa, Entamoeba histolytica
SANMNAKNKIGETPL

SEQ ID NO: 2654054 - protein, 10 aa, Entamoeba histolytica
SANNDEKIGE

SEQ ID NO: 2654055 - protein, 12 aa, Entamoeba histolytica
SANPKESRYNPK

SEQ ID NO: 2654056 - protein, 9 aa, Entamoeba histolytica
SANPKIKQA

SEQ ID NO: 2654057 - protein, 8 aa, Entamoeba histolytica
SANPQIER

SEQ ID NO: 2654058 - protein, 7 aa, Entamoeba histolytica
SANQTTK

SEQ ID NO: 2654059 - protein, 16 aa, Entamoeba histolytica
SANSLLDRNSEGLTSN

SEQ ID NO: 2654060 - protein, 12 aa, Entamoeba histolytica
SANTPSLRSNVH

SEQ ID NO: 2654061 - protein, 17 aa, Entamoeba histolytica
SANYSFSASTGNSPSEH

SEQ ID NO: 2654062 - protein, 6 aa, Entamoeba histolytica
SAPKLQ

SEQ ID NO: 2654063 - protein, 7 aa, Entamoeba histolytica
SAPLTPE

SEQ ID NO: 2654064 - protein, 6 aa, Entamoeba histolytica
SAPLTQ

SEQ ID NO: 2654065 - protein, 10 aa, Entamoeba histolytica
SAPPKKWTDE

SEQ ID NO: 2654066 - protein, 16 aa, Entamoeba histolytica
SAPPLTEEEEEREKEI

SEQ ID NO: 2654067 - protein, 6 aa, Entamoeba histolytica
SAPPVP

SEQ ID NO: 2654068 - protein, 7 aa, Entamoeba histolytica
SAPSEEI

SEQ ID NO: 2654069 - protein, 9 aa, Entamoeba histolytica
SAPSGHDMS

SEQ ID NO: 2654070 - protein, 12 aa, Entamoeba histolytica
SAPSQPSQQQNS

SEQ ID NO: 2654071 - protein, 6 aa, Entamoeba histolytica
SAPTHE

SEQ ID NO: 2654072 - protein, 7 aa, Entamoeba histolytica
SAPTISV

SEQ ID NO: 2654073 - protein, 10 aa, Entamoeba histolytica
SAPTSSGKTL

SEQ ID NO: 2654074 - protein, 14 aa, Entamoeba histolytica
SAPTTSAADGDDIK

SEQ ID NO: 2654075 - protein, 4 aa, Entamoeba histolytica
SAPY

SEQ ID NO: 2654076 - protein, 15 aa, Entamoeba histolytica
SAQGTTLGGDDGTGV

SEQ ID NO: 2654077 - protein, 12 aa, Entamoeba histolytica
SAQKYTETARDE

SEQ ID NO: 2654078 - protein, 4 aa, Entamoeba histolytica
SAQN

SEQ ID NO: 2654079 - protein, 7 aa, Entamoeba histolytica
SAQNNIN

SEQ ID NO: 2654080 - protein, 44 aa, Entamoeba histolytica; identical to SEQ ID NO: 2458892

SEQ ID NO: 2654081 - protein, 14 aa, Entamoeba histolytica
SAQQKKYQTHSKTF

SEQ ID NO: 2654082 - protein, 8 aa, Entamoeba histolytica
SAQQSAIN

SEQ ID NO: 2654083 - protein, 11 aa, Entamoeba histolytica
SAQTSQNGVEQ

SEQ ID NO: 2654084 - protein, 10 aa, Entamoeba histolytica
SARDEPRKVE

SEQ ID NO: 2654085 - protein, 7 aa, Entamoeba histolytica
SARFGRK

SEQ ID NO: 2654086 - protein, 12 aa, Entamoeba histolytica
SARKEEDLDEST

SEQ ID NO: 2654087 - protein, 10 aa, Entamoeba histolytica
SARLEPQPID

SEQ ID NO: 2654088 - protein, 4 aa, Entamoeba histolytica
SARP

SEQ ID NO: 2654089 - protein, 8 aa, Entamoeba histolytica
SARQGINI

SEQ ID NO: 2654090 - protein, 22 aa, Entamoeba histolytica
SARQVQQGKETNQYKTSAKRIK

SEQ ID NO: 2654091 - protein, 14 aa, Entamoeba histolytica
SARSESEHESSRRL

SEQ ID NO: 2654092 - protein, 19 aa, Entamoeba histolytica
SARTGSDNLSGMSQPEEEA

SEQ ID NO: 2654093 - protein, 7 aa, Entamoeba histolytica
SASCSEE

SEQ ID NO: 2654094 - protein, 7 aa, Entamoeba histolytica
SASDGID

SEQ ID NO: 2654095 - protein, 10 aa, Entamoeba histolytica
SASDKKKEID

SEQ ID NO: 2654096 - protein, 8 aa, Entamoeba histolytica
SASDPSQI

SEQ ID NO: 2654097 - protein, 12 aa, Entamoeba histolytica
SASEITSDASYI

SEQ ID NO: 2654098 - protein, 17 aa, Entamoeba histolytica
SASETQRVGRAGRLSSG

SEQ ID NO: 2654099 - protein, 5 aa, Entamoeba histolytica
SASFQ

SEQ ID NO: 2654100 - protein, 16 aa, Entamoeba histolytica
SASGRTGDSDPMKQQS

SEQ ID NO: 2654101 - protein, 12 aa, Entamoeba histolytica
SASKALQAAGSE

SEQ ID NO: 2654102 - protein, 13 aa, Entamoeba histolytica
SASKISGSLASGV

SEQ ID NO: 2654103 - protein, 20 aa, Entamoeba histolytica
SASKSTNPFGEESDEEISDE

SEQ ID NO: 2654104 - protein, 7 aa, Entamoeba histolytica
SASLNLK

SEQ ID NO: 2654105 - protein, 13 aa, Entamoeba histolytica
SASPQDEEDTFGK

SEQ ID NO: 2654106 - protein, 21 aa, Entamoeba histolytica
SASPSNPPTTSPIKQSPTPNK

SEQ ID NO: 2654107 - protein, 5 aa, Entamoeba histolytica
SASQD

SEQ ID NO: 2654108 - protein, 20 aa, Entamoeba histolytica
SASSHIDDIESNQNTEQIQA

SEQ ID NO: 2654109 - protein, 10 aa, Entamoeba histolytica
SASSSKERDE

SEQ ID NO: 2654110 - protein, 7 aa, Entamoeba histolytica
SASVTNN

SEQ ID NO: 2654111 - protein, 4 aa, Entamoeba histolytica
SATA

SEQ ID NO: 2654112 - protein, 7 aa, Entamoeba histolytica
SATDDRR

SEQ ID NO: 2654113 - protein, 5 aa, Entamoeba histolytica
SATDL

SEQ ID NO: 2654114 - protein, 5 aa, Entamoeba histolytica
SATDN

SEQ ID NO: 2654115 - protein, 8 aa, Entamoeba histolytica
SATDPRAN

SEQ ID NO: 2654116 - protein, 7 aa, Entamoeba histolytica
SATDQPL

SEQ ID NO: 2654117 - protein, 22 aa, Entamoeba histolytica
SATEINKKNIQEITSKKRGNKR

SEQ ID NO: 2654118 - protein, 20 aa, Entamoeba histolytica
SATKQQNQNTNPFTDNSSQM

SEQ ID NO: 2654119 - protein, 7 aa, Entamoeba histolytica
SATKSYK

SEQ ID NO: 2654120 - protein, 7 aa, Entamoeba histolytica
SATLQTR

SEQ ID NO: 2654121 - protein, 12 aa, Entamoeba histolytica
SATLSNDRSSRS

SEQ ID NO: 2654122 - protein, 5 aa, Entamoeba histolytica
SATNR

SEQ ID NO: 2654123 - protein, 7 aa, Entamoeba histolytica
SATPLGS

SEQ ID NO: 2654124 - protein, 11 aa, Entamoeba histolytica
SATPPKRSEEV

SEQ ID NO: 2654125 - protein, 7 aa, Entamoeba histolytica
SATQSIN

SEQ ID NO: 2654126 - protein, 6 aa, Entamoeba histolytica
SATRIQ

SEQ ID NO: 2654127 - protein, 5 aa, Entamoeba histolytica
SATSE

SEQ ID NO: 2654128 - protein, 5 aa, Entamoeba histolytica
SATTF

SEQ ID NO: 2654129 - protein, 4 aa, Entamoeba histolytica
SATV

SEQ ID NO: 2654130 - protein, 6 aa, Entamoeba histolytica
SATVRS

SEQ ID NO: 2654131 - protein, 6 aa, Entamoeba histolytica
SAVAGM

SEQ ID NO: 2654132 - protein, 5 aa, Entamoeba histolytica
SAVGK

SEQ ID NO: 2654133 - protein, 16 aa, Entamoeba histolytica
SAVNITEPEDVNRYPT

SEQ ID NO: 2654134 - protein, 15 aa, Entamoeba histolytica
SAVPMKQKTKMDYGG

SEQ ID NO: 2654135 - protein, 40 aa, Entamoeba histolytica
SAVPPPKLAPVTQPETHSTEPIQQPTTQPITTNQPSTQPV

SEQ ID NO: 2654136 - protein, 6 aa, Entamoeba histolytica
SAVPQH

SEQ ID NO: 2654137 - protein, 5 aa, Entamoeba histolytica
SAVPY

SEQ ID NO: 2654138 - protein, 15 aa, Entamoeba histolytica
SAVRQKEKHKKRRDD

SEQ ID NO: 2654139 - protein, 9 aa, Entamoeba histolytica
SAVSPQFAA

SEQ ID NO: 2654140 - protein, 4 aa, Entamoeba histolytica
SAWK

SEQ ID NO: 2654141 - protein, 6 aa, Entamoeba histolytica
SAYEKD

SEQ ID NO: 2654142 - protein, 7 aa, Entamoeba histolytica
SAYEKQD

SEQ ID NO: 2654143 - protein, 8 aa, Entamoeba histolytica
SAYENKED

SEQ ID NO: 2654144 - protein, 13 aa, Entamoeba histolytica
SAYGGGMDGPESV

SEQ ID NO: 2654145 - protein, 4 aa, Entamoeba histolytica
SAYQ

SEQ ID NO: 2654146 - protein, 11 aa, Entamoeba histolytica
SAYSREGNSCA

SEQ ID NO: 2654147 - protein, 8 aa, Entamoeba histolytica
SCATQGNT

SEQ ID NO: 2654148 - protein, 4 aa, Entamoeba histolytica
SCDD

SEQ ID NO: 2654149 - protein, 4 aa, Entamoeba histolytica
SCEE

SEQ ID NO: 2654150 - protein, 7 aa, Entamoeba histolytica
SCEEIDP

SEQ ID NO: 2654151 - protein, 8 aa, Entamoeba histolytica
SCEGGEPL

SEQ ID NO: 2654152 - protein, 15 aa, Entamoeba histolytica
SCEKESEALNISPGN

SEQ ID NO: 2654153 - protein, 4 aa, Entamoeba histolytica
SCEP

SEQ ID NO: 2654154 - protein, 9 aa, Entamoeba histolytica
SCESGFRDN

SEQ ID NO: 2654155 - protein, 30 aa, Entamoeba histolytica
SCETDQSLNKVRSQDSPSGEMVPPKKVPVG

SEQ ID NO: 2654156 - protein, 7 aa, Entamoeba histolytica
SCETKQN

SEQ ID NO: 2654157 - protein, 5 aa, Entamoeba histolytica
SCGEE

SEQ ID NO: 2654158 - protein, 4 aa, Entamoeba histolytica
SCGP

SEQ ID NO: 2654159 - protein, 5 aa, Entamoeba histolytica
SCGPN

SEQ ID NO: 2654160 - protein, 8 aa, Entamoeba histolytica
SCGPRGFY

SEQ ID NO: 2654161 - protein, 52 aa, Entamoeba histolytica
SCGSTSSPKTLSISNTDSFTSTLKTTGGTESPISDIKPTSRPINEKDVRKKK

SEQ ID NO: 2654162 - protein, 13 aa, Entamoeba histolytica
SCGYPDAKMRQYA

SEQ ID NO: 2654163 - protein, 5 aa, Entamoeba histolytica
SCGYT

SEQ ID NO: 2654164 - protein, 25 aa, Entamoeba histolytica
SCHERTLTRSQSEWAASSESVDKNI

SEQ ID NO: 2654165 - protein, 16 aa, Entamoeba histolytica
SCISDSKSHNSSKISE

SEQ ID NO: 2654166 - protein, 10 aa, Entamoeba histolytica
SCISEDEKKQ

SEQ ID NO: 2654167 - protein, 4 aa, Entamoeba histolytica
SCKE

SEQ ID NO: 2654168 - protein, 9 aa, Entamoeba histolytica
SCKEGLSNK

SEQ ID NO: 2654169 - protein, 20 aa, Entamoeba histolytica
SCKLSKDQKYLERDKAQKYL

SEQ ID NO: 2654170 - protein, 9 aa, Entamoeba histolytica
SCKQIKKGK

SEQ ID NO: 2654171 - protein, 5 aa, Entamoeba histolytica
SCLGS

SEQ ID NO: 2654172 - protein, 22 aa, Entamoeba histolytica
SCNEQGKCIQNTKEMYQAKNME

SEQ ID NO: 2654173 - protein, 15 aa, Entamoeba histolytica
SCNGKKGFSLTPNDM

SEQ ID NO: 2654174 - protein, 6 aa, Entamoeba histolytica
SCNKNG

SEQ ID NO: 2654175 - protein, 8 aa, Entamoeba histolytica
SCNNEQTG

SEQ ID NO: 2654176 - protein, 6 aa, Entamoeba histolytica
SCNPRN

SEQ ID NO: 2654177 - protein, 4 aa, Entamoeba histolytica
SCNR

SEQ ID NO: 2654178 - protein, 11 aa, Entamoeba histolytica
SCNSRDQNGSG

SEQ ID NO: 2654179 - protein, 11 aa, Entamoeba histolytica
SCPDANPNTIQ

SEQ ID NO: 2654180 - protein, 5 aa, Entamoeba histolytica
SCPKD

SEQ ID NO: 2654181 - protein, 5 aa, Entamoeba histolytica
SCPNP

SEQ ID NO: 2654182 - protein, 6 aa, Entamoeba histolytica
SCPQNE

SEQ ID NO: 2654183 - protein, 5 aa, Entamoeba histolytica
SCPSC

SEQ ID NO: 2654184 - protein, 9 aa, Entamoeba histolytica
SCPTGSAVS

SEQ ID NO: 2654185 - protein, 10 aa, Entamoeba histolytica
SCQKNEKTNE

SEQ ID NO: 2654186 - protein, 17 aa, Entamoeba histolytica
SCQRMSSSNQLVGKNDE

SEQ ID NO: 2654187 - protein, 11 aa, Entamoeba histolytica
SCSASLDNNDL

SEQ ID NO: 2654188 - protein, 7 aa, Entamoeba histolytica
SCSGSGI

SEQ ID NO: 2654189 - protein, 11 aa, Entamoeba histolytica
SCSHSSSTVTN

SEQ ID NO: 2654190 - protein, 6 aa, Entamoeba histolytica
SCSIPG

SEQ ID NO: 2654191 - protein, 8 aa, Entamoeba histolytica
SCSNPPAI

SEQ ID NO: 2654192 - protein, 5 aa, Entamoeba histolytica
SCSRK

SEQ ID NO: 2654193 - protein, 10 aa, Entamoeba histolytica
SCTEKRTEEI

SEQ ID NO: 2654194 - protein, 7 aa, Entamoeba histolytica
SCTENAD

SEQ ID NO: 2654195 - protein, 11 aa, Entamoeba histolytica
SCVNQSSTPFQ

SEQ ID NO: 2654196 - protein, 6 aa, Entamoeba histolytica
SCWSEG

SEQ ID NO: 2654197 - protein, 7 aa, Entamoeba histolytica
SCYSNYR

SEQ ID NO: 2654198 - protein, 4 aa, Entamoeba histolytica
SDAD

SEQ ID NO: 2654199 - protein, 4 aa, Entamoeba histolytica
SDAN

SEQ ID NO: 2654200 - protein, 8 aa, Entamoeba histolytica
SDANEMAR

SEQ ID NO: 2654201 - protein, 5 aa, Entamoeba histolytica
SDAPI

SEQ ID NO: 2654202 - protein, 13 aa, Entamoeba histolytica
SDAQPKKQQSPII

SEQ ID NO: 2654203 - protein, 11 aa, Entamoeba histolytica
SDAQSQEIQKT

SEQ ID NO: 2654204 - protein, 8 aa, Entamoeba histolytica
SDAQTNPN

SEQ ID NO: 2654205 - protein, 8 aa, Entamoeba histolytica
SDATLIDK

SEQ ID NO: 2654206 - protein, 17 aa, Entamoeba histolytica
SDATSKSTEIHKASTNQ

SEQ ID NO: 2654207 - protein, 6 aa, Entamoeba histolytica
SDCHPQ

SEQ ID NO: 2654208 - protein, 5 aa, Entamoeba histolytica
SDCQN

SEQ ID NO: 2654209 - protein, 12 aa, Entamoeba histolytica
SDCSAPVTPPSF

SEQ ID NO: 2654210 - protein, 10 aa, Entamoeba histolytica
SDCSSSAQGG

SEQ ID NO: 2654211 - protein, 9 aa, Entamoeba histolytica
SDDARGFET

SEQ ID NO: 2654212 - protein, 19 aa, Entamoeba histolytica
SDDDDSEEKKETSNTMEEM

SEQ ID NO: 2654213 - protein, 8 aa, Entamoeba histolytica
SDDDITRA

SEQ ID NO: 2654214 - protein, 69 aa, Entamoeba histolytica
SDDEEIEEEVPEEDAYEEDEEEKERRRIEREKRKLEKQHKKEEAKKKKRKLIKEDDDDDEMESGNEQVM

SEQ ID NO: 2654215 - protein, 4 aa, Entamoeba histolytica
SDDG

SEQ ID NO: 2654216 - protein, 5 aa, Entamoeba histolytica
SDDGP

SEQ ID NO: 2654217 - protein, 4 aa, Entamoeba histolytica
SDDI

SEQ ID NO: 2654218 - protein, 7 aa, Entamoeba histolytica
SDDINEE

SEQ ID NO: 2654219 - protein, 6 aa, Entamoeba histolytica
SDDKNI

SEQ ID NO: 2654220 - protein, 9 aa, Entamoeba histolytica
SDDKNYGFA

SEQ ID NO: 2654221 - protein, 42 aa, Entamoeba histolytica
SDDKQNSNTNAVINENNDKQKTTQNNSFETTSSTTDKSGSNV

SEQ ID NO: 2654222 - protein, 7 aa, Entamoeba histolytica
SDDKTPK

SEQ ID NO: 2654223 - protein, 7 aa, Entamoeba histolytica
SDDKTRK

SEQ ID NO: 2654224 - protein, 5 aa, Entamoeba histolytica
SDDLE

SEQ ID NO: 2654225 - protein, 9 aa, Entamoeba histolytica
SDDNGMNKR

SEQ ID NO: 2654226 - protein, 9 aa, Entamoeba histolytica
SDDNSKNNI

SEQ ID NO: 2654227 - protein, 6 aa, Entamoeba histolytica
SDDPEF

SEQ ID NO: 2654228 - protein, 7 aa, Entamoeba histolytica
SDDPWSS

SEQ ID NO: 2654229 - protein, 7 aa, Entamoeba histolytica
SDDSDVR

SEQ ID NO: 2654230 - protein, 15 aa, Entamoeba histolytica
SDDSLEDMKESTDYD

SEQ ID NO: 2654231 - protein, 8 aa, Entamoeba histolytica
SDDSPSVG

SEQ ID NO: 2654232 - protein, 9 aa, Entamoeba histolytica
SDDSRNSLT

SEQ ID NO: 2654233 - protein, 5 aa, Entamoeba histolytica
SDDST

SEQ ID NO: 2654234 - protein, 8 aa, Entamoeba histolytica
SDDTEQDL

SEQ ID NO: 2654235 - protein, 17 aa, Entamoeba histolytica
SDDTIHEEEPQQQPDLD

SEQ ID NO: 2654236 - protein, 10 aa, Entamoeba histolytica
SDDTNNSTTQ

SEQ ID NO: 2654237 - protein, 10 aa, Entamoeba histolytica
SDDTVEKQSE

SEQ ID NO: 2654238 - protein, 5 aa, Entamoeba histolytica
SDDVA

SEQ ID NO: 2654239 - protein, 8 aa, Entamoeba histolytica
SDDVTGTD

SEQ ID NO: 2654240 - protein, 8 aa, Entamoeba histolytica
SDDYSEVG

SEQ ID NO: 2654241 - protein, 9 aa, Entamoeba histolytica
SDECGEGRY

SEQ ID NO: 2654242 - protein, 8 aa, Entamoeba histolytica
SDEDGNGF

SEQ ID NO: 2654243 - protein, 15 aa, Entamoeba histolytica
SDEDKIADLDSKSIV

SEQ ID NO: 2654244 - protein, 10 aa, Entamoeba histolytica
SDEDNQRKEK

SEQ ID NO: 2654245 - protein, 16 aa, Entamoeba histolytica
SDEDRPIPKRVVASMF

SEQ ID NO: 2654246 - protein, 8 aa, Entamoeba histolytica
SDEEDGCP

SEQ ID NO: 2654247 - protein, 13 aa, Entamoeba histolytica
SDEEEPKTDDEKI

SEQ ID NO: 2654248 - protein, 6 aa, Entamoeba histolytica
SDEEIE

SEQ ID NO: 2654249 - protein, 16 aa, Entamoeba histolytica
SDEEKPIPKRVVASMF

SEQ ID NO: 2654250 - protein, 15 aa, Entamoeba histolytica
SDEENNDVDMTEYSL

SEQ ID NO: 2654251 - protein, 6 aa, Entamoeba histolytica
SDEERR

SEQ ID NO: 2654252 - protein, 9 aa, Entamoeba histolytica
SDEETEIED

SEQ ID NO: 2654253 - protein, 8 aa, Entamoeba histolytica
SDEETKKQ

SEQ ID NO: 2654254 - protein, 5 aa, Entamoeba histolytica
SDEEY

SEQ ID NO: 2654255 - protein, 5 aa, Entamoeba histolytica
SDEFA

SEQ ID NO: 2654256 - protein, 4 aa, Entamoeba histolytica
SDEG

SEQ ID NO: 2654257 - protein, 5 aa, Entamoeba histolytica
SDEIE

SEQ ID NO: 2654258 - protein, 15 aa, Entamoeba histolytica
SDEIQKKESKPEKTS

SEQ ID NO: 2654259 - protein, 35 aa, Entamoeba histolytica
SDEITSKDKNKHKATSSKLVSNNKSIGNNDHHNEK

SEQ ID NO: 2654260 - protein, 25 aa, Entamoeba histolytica
SDEKEQERKQSIYEQQQKQKINDED

SEQ ID NO: 2654261 - protein, 6 aa, Entamoeba histolytica
SDEKSF

SEQ ID NO: 2654262 - protein, 9 aa, Entamoeba histolytica
SDEKSQFET

SEQ ID NO: 2654263 - protein, 22 aa, Entamoeba histolytica
SDEKTFSSNNEGGYFSPRSSRY

SEQ ID NO: 2654264 - protein, 22 aa, Entamoeba histolytica
SDELAKEYDELKARKEKAEEQT

SEQ ID NO: 2654265 - protein, 32 aa, Entamoeba histolytica
SDELEAQEEKEQLEEKEAEEEIETPPIQEDAD

SEQ ID NO: 2654266 - protein, 7 aa, Entamoeba histolytica
SDELKGN

SEQ ID NO: 2654267 - protein, 6 aa, Entamoeba histolytica
SDELTP

SEQ ID NO: 2654268 - protein, 6 aa, Entamoeba histolytica
SDENIQ

SEQ ID NO: 2654269 - protein, 7 aa, Entamoeba histolytica
SDENQPT

SEQ ID NO: 2654270 - protein, 14 aa, Entamoeba histolytica
SDEQTQIEPRKSQP

SEQ ID NO: 2654271 - protein, 7 aa, Entamoeba histolytica
SDESDMK

SEQ ID NO: 2654272 - protein, 14 aa, Entamoeba histolytica
SDESERKKHTEERS

SEQ ID NO: 2654273 - protein, 7 aa, Entamoeba histolytica
SDESGDL

SEQ ID NO: 2654274 - protein, 5 aa, Entamoeba histolytica
SDESL

SEQ ID NO: 2654275 - protein, 6 aa, Entamoeba histolytica
SDESLF

SEQ ID NO: 2654276 - protein, 6 aa, Entamoeba histolytica
SDETDI

SEQ ID NO: 2654277 - protein, 7 aa, Entamoeba histolytica
SDETVQP

SEQ ID NO: 2654278 - protein, 4 aa, Entamoeba histolytica
SDEV

SEQ ID NO: 2654279 - protein, 6 aa, Entamoeba histolytica
SDEVVK

SEQ ID NO: 2654280 - protein, 4 aa, Entamoeba histolytica
SDEY

SEQ ID NO: 2654281 - protein, 8 aa, Entamoeba histolytica
SDEYPNEL

SEQ ID NO: 2654282 - protein, 8 aa, Entamoeba histolytica
SDFAGAKN

SEQ ID NO: 2654283 - protein, 9 aa, Entamoeba histolytica
SDFGGDEEF

SEQ ID NO: 2654284 - protein, 30 aa, Entamoeba histolytica
SDFGSFSSTTLQQPSQQNNGTSVLNGDDWD

SEQ ID NO: 2654285 - protein, 7 aa, Entamoeba histolytica
SDFKAEE

SEQ ID NO: 2654286 - protein, 12 aa, Entamoeba histolytica
SDFKAPKSYENW

SEQ ID NO: 2654287 - protein, 4 aa, Entamoeba histolytica
SDFN

SEQ ID NO: 2654288 - protein, 6 aa, Entamoeba histolytica
SDFQQY

SEQ ID NO: 2654289 - protein, 13 aa, Entamoeba histolytica
SDFYPTNGLPDKE

SEQ ID NO: 2654290 - protein, 4 aa, Entamoeba histolytica
SDGD

SEQ ID NO: 2654291 - protein, 10 aa, Entamoeba histolytica
SDGDARSALN

SEQ ID NO: 2654292 - protein, 4 aa, Entamoeba histolytica
SDGE

SEQ ID NO: 2654293 - protein, 11 aa, Entamoeba histolytica
SDGEENPSEEN

SEQ ID NO: 2654294 - protein, 9 aa, Entamoeba histolytica
SDGEFYSES

SEQ ID NO: 2654295 - protein, 5 aa, Entamoeba histolytica
SDGEK

SEQ ID NO: 2654296 - protein, 9 aa, Entamoeba histolytica
SDGEKKKAC

SEQ ID NO: 2654297 - protein, 39 aa, Entamoeba histolytica
SDGEYSPKEQNNYTKEKKPIVKPMSERKSKQKIERTNEM

SEQ ID NO: 2654298 - protein, 12 aa, Entamoeba histolytica
SDGFQMKNEGEV

SEQ ID NO: 2654299 - protein, 7 aa, Entamoeba histolytica
SDGGELR

SEQ ID NO: 2654300 - protein, 7 aa, Entamoeba histolytica
SDGGKIN

SEQ ID NO: 2654301 - protein, 4 aa, Entamoeba histolytica
SDGI

SEQ ID NO: 2654302 - protein, 8 aa, Entamoeba histolytica
SDGIKKSE

SEQ ID NO: 2654303 - protein, 6 aa, Entamoeba histolytica
SDGIKS

SEQ ID NO: 2654304 - protein, 15 aa, Entamoeba histolytica
SDGKCSNPGSEEKKE

SEQ ID NO: 2654305 - protein, 8 aa, Entamoeba histolytica
SDGKDYTL

SEQ ID NO: 2654306 - protein, 5 aa, Entamoeba histolytica
SDGKY

SEQ ID NO: 2654307 - protein, 7 aa, Entamoeba histolytica
SDGQGGV

SEQ ID NO: 2654308 - protein, 12 aa, Entamoeba histolytica
SDGRISEENMDS

SEQ ID NO: 2654309 - protein, 5 aa, Entamoeba histolytica
SDGRK

SEQ ID NO: 2654310 - protein, 5 aa, Entamoeba histolytica
SDGSE

SEQ ID NO: 2654311 - protein, 6 aa, Entamoeba histolytica
SDGSEY

SEQ ID NO: 2654312 - protein, 7 aa, Entamoeba histolytica
SDGSVKI

SEQ ID NO: 2654313 - protein, 10 aa, Entamoeba histolytica
SDGSYEMGQK

SEQ ID NO: 2654314 - protein, 6 aa, Entamoeba histolytica
SDGSYK

SEQ ID NO: 2654315 - protein, 9 aa, Entamoeba histolytica
SDGTSNAIE

SEQ ID NO: 2654316 - protein, 9 aa, Entamoeba histolytica
SDGTSSAIN

SEQ ID NO: 2654317 - protein, 9 aa, Entamoeba histolytica
SDGTVGANH

SEQ ID NO: 2654318 - protein, 5 aa, Entamoeba histolytica
SDGVI

SEQ ID NO: 2654319 - protein, 5 aa, Entamoeba histolytica
SDGYG

SEQ ID NO: 2654320 - protein, 5 aa, Entamoeba histolytica
SDHDD

SEQ ID NO: 2654321 - protein, 7 aa, Entamoeba histolytica
SDHEAYK

SEQ ID NO: 2654322 - protein, 4 aa, Entamoeba histolytica
SDHF

SEQ ID NO: 2654323 - protein, 6 aa, Entamoeba histolytica
SDHPNF

SEQ ID NO: 2654324 - protein, 7 aa, Entamoeba histolytica
SDHPPHG

SEQ ID NO: 2654325 - protein, 26 aa, Entamoeba histolytica
SDIAKSWSKTTEMRIPDSTNDGNIIN

SEQ ID NO: 2654326 - protein, 14 aa, Entamoeba histolytica
SDIEREGSVNGDSM

SEQ ID NO: 2654327 - protein, 13 aa, Entamoeba histolytica
SDIGGGNSGVPSF

SEQ ID NO: 2654328 - protein, 12 aa, Entamoeba histolytica
SDIGGNGQVPIN

SEQ ID NO: 2654329 - protein, 17 aa, Entamoeba histolytica
SDIGNTIDDQLNETKNR

SEQ ID NO: 2654330 - protein, 17 aa, Entamoeba histolytica
SDIIQPKQSVSTKVSSI

SEQ ID NO: 2654331 - protein, 4 aa, Entamoeba histolytica
SDIK

SEQ ID NO: 2654332 - protein, 7 aa, Entamoeba histolytica
SDINARA

SEQ ID NO: 2654333 - protein, 19 aa, Entamoeba histolytica
SDINENLSRGIKERDEKIK

SEQ ID NO: 2654334 - protein, 6 aa, Entamoeba histolytica
SDINES

SEQ ID NO: 2654335 - protein, 12 aa, Entamoeba histolytica
SDINSDITIKNS

SEQ ID NO: 2654336 - protein, 12 aa, Entamoeba histolytica
SDINSDVTIENS

SEQ ID NO: 2654337 - protein, 7 aa, Entamoeba histolytica
SDIPSIG

SEQ ID NO: 2654338 - protein, 10 aa, Entamoeba histolytica
SDIPTISMDG

SEQ ID NO: 2654339 - protein, 6 aa, Entamoeba histolytica
SDIQTA

SEQ ID NO: 2654340 - protein, 7 aa, Entamoeba histolytica
SDIQTQT

SEQ ID NO: 2654341 - protein, 11 aa, Entamoeba histolytica
SDIRDDYEQQQ

SEQ ID NO: 2654342 - protein, 12 aa, Entamoeba histolytica
SDISDTNDIEST

SEQ ID NO: 2654343 - protein, 8 aa, Entamoeba histolytica
SDISKQPK

SEQ ID NO: 2654344 - protein, 11 aa, Entamoeba histolytica
SDISNKIPNIN

SEQ ID NO: 2654345 - protein, 12 aa, Entamoeba histolytica
SDISSETKGIDS

SEQ ID NO: 2654346 - protein, 4 aa, Entamoeba histolytica
SDKA

SEQ ID NO: 2654347 - protein, 9 aa, Entamoeba histolytica
SDKDHEVKE

SEQ ID NO: 2654348 - protein, 26 aa, Entamoeba histolytica
SDKDKENEKKPTIKSKNKKLKKKEVK

SEQ ID NO: 2654349 - protein, 16 aa, Entamoeba histolytica
SDKEEHSEEENKERTK

SEQ ID NO: 2654350 - protein, 9 aa, Entamoeba histolytica
SDKEKDPSF

SEQ ID NO: 2654351 - protein, 11 aa, Entamoeba histolytica
SDKENKKSILN

SEQ ID NO: 2654352 - protein, 7 aa, Entamoeba histolytica
SDKENYV

SEQ ID NO: 2654353 - protein, 8 aa, Entamoeba histolytica
SDKEREKY

SEQ ID NO: 2654354 - protein, 10 aa, Entamoeba histolytica
SDKETQLSGY

SEQ ID NO: 2654355 - protein, 8 aa, Entamoeba histolytica
SDKEVTDY

SEQ ID NO: 2654356 - protein, 8 aa, Entamoeba histolytica
SDKGGCDA

SEQ ID NO: 2654357 - protein, 6 aa, Entamoeba histolytica
SDKGNE

SEQ ID NO: 2654358 - protein, 23 aa, Entamoeba histolytica
SDKKDMSIKSESFETINDNSFNQ

SEQ ID NO: 2654359 - protein, 9 aa, Entamoeba histolytica
SDKKEIHNN

SEQ ID NO: 2654360 - protein, 8 aa, Entamoeba histolytica
SDKKGYSS

SEQ ID NO: 2654361 - protein, 10 aa, Entamoeba histolytica
SDKKIKQETA

SEQ ID NO: 2654362 - protein, 8 aa, Entamoeba histolytica
SDKKVEVA

SEQ ID NO: 2654363 - protein, 21 aa, Entamoeba histolytica
SDKKYNGPTIDPHHKSDDGRS

SEQ ID NO: 2654364 - protein, 7 aa, Entamoeba histolytica
SDKLDTI

SEQ ID NO: 2654365 - protein, 9 aa, Entamoeba histolytica
SDKLNPPKY

SEQ ID NO: 2654366 - protein, 15 aa, Entamoeba histolytica
SDKLNPRKYEHTTPI

SEQ ID NO: 2654367 - protein, 13 aa, Entamoeba histolytica
SDKLTKDAQNALR

SEQ ID NO: 2654368 - protein, 14 aa, Entamoeba histolytica
SDKMREETKPSKSL

SEQ ID NO: 2654369 - protein, 8 aa, Entamoeba histolytica
SDKMSKAS

SEQ ID NO: 2654370 - protein, 8 aa, Entamoeba histolytica
SDKQHPLT

SEQ ID NO: 2654371 - protein, 7 aa, Entamoeba histolytica
SDKQKLK

SEQ ID NO: 2654372 - protein, 13 aa, Entamoeba histolytica
SDKQLKEKGPSLQ

SEQ ID NO: 2654373 - protein, 6 aa, Entamoeba histolytica
SDKQQQ

SEQ ID NO: 2654374 - protein, 8 aa, Entamoeba histolytica
SDKQRDAT

SEQ ID NO: 2654375 - protein, 8 aa, Entamoeba histolytica
SDKRPNKW

SEQ ID NO: 2654376 - protein, 17 aa, Entamoeba histolytica
SDKRYFNSKSKKESIID

SEQ ID NO: 2654377 - protein, 4 aa, Entamoeba histolytica
SDKS

SEQ ID NO: 2654378 - protein, 14 aa, Entamoeba histolytica
SDKSGLLERDETTK

SEQ ID NO: 2654379 - protein, 9 aa, Entamoeba histolytica
SDKSQIEQL

SEQ ID NO: 2654380 - protein, 11 aa, Entamoeba histolytica
SDKSTGTINER

SEQ ID NO: 2654381 - protein, 20 aa, Entamoeba histolytica
SDKYLTQKSKGEKTEISEEQ

SEQ ID NO: 2654382 - protein, 6 aa, Entamoeba histolytica
SDKYSI

SEQ ID NO: 2654383 - protein, 10 aa, Entamoeba histolytica
SDLDNDSEQI

SEQ ID NO: 2654384 - protein, 21 aa, Entamoeba histolytica
SDLEGNRQITTTEAEQFAQEN

SEQ ID NO: 2654385 - protein, 17 aa, Entamoeba histolytica
SDLEREVTKEEAEEVAK

SEQ ID NO: 2654386 - protein, 18 aa, Entamoeba histolytica
SDLKNSSQELDKSSYPLI

SEQ ID NO: 2654387 - protein, 11 aa, Entamoeba histolytica
SDLKSQTLDTI

SEQ ID NO: 2654388 - protein, 7 aa, Entamoeba histolytica
SDLNEET

SEQ ID NO: 2654389 - protein, 5 aa, Entamoeba histolytica
SDLPN

SEQ ID NO: 2654390 - protein, 12 aa, Entamoeba histolytica
SDLQTNVEETKV

SEQ ID NO: 2654391 - protein, 20 aa, Entamoeba histolytica
SDLRQSQSTIEKLRKEGKAL

SEQ ID NO: 2654392 - protein, 10 aa, Entamoeba histolytica
SDLSRTPTSV

SEQ ID NO: 2654393 - protein, 9 aa, Entamoeba histolytica
SDLTNNKHK

SEQ ID NO: 2654394 - protein, 12 aa, Entamoeba histolytica
SDMDEEDDVEDI

SEQ ID NO: 2654395 - protein, 8 aa, Entamoeba histolytica
SDMNGTVS

SEQ ID NO: 2654396 - protein, 7 aa, Entamoeba histolytica
SDMPSRR

SEQ ID NO: 2654397 - protein, 13 aa, Entamoeba histolytica
SDMQKKELQNAYK

SEQ ID NO: 2654398 - protein, 8 aa, Entamoeba histolytica
SDNAERIG

SEQ ID NO: 2654399 - protein, 20 aa, Entamoeba histolytica
SDNAQVKDVEEKYSKGELLS

SEQ ID NO: 2654400 - protein, 11 aa, Entamoeba histolytica
SDNAQVNTQKY

SEQ ID NO: 2654401 - protein, 12 aa, Entamoeba histolytica
SDNDDAESDNMQ

SEQ ID NO: 2654402 - protein, 10 aa, Entamoeba histolytica
SDNDESYSEI

SEQ ID NO: 2654403 - protein, 17 aa, Entamoeba histolytica
SDNDFEKYKGKTLPELK

SEQ ID NO: 2654404 - protein, 5 aa, Entamoeba histolytica
SDNDK

SEQ ID NO: 2654405 - protein, 8 aa, Entamoeba histolytica
SDNDMDNP

SEQ ID NO: 2654406 - protein, 18 aa, Entamoeba histolytica
SDNESVGSCHHENDDSEV

SEQ ID NO: 2654407 - protein, 14 aa, Entamoeba histolytica
SDNETTINTNQTED

SEQ ID NO: 2654408 - protein, 7 aa, Entamoeba histolytica
SDNEWDK

SEQ ID NO: 2654409 - protein, 4 aa, Entamoeba histolytica
SDNF

SEQ ID NO: 2654410 - protein, 6 aa, Entamoeba histolytica
SDNFKE

SEQ ID NO: 2654411 - protein, 9 aa, Entamoeba histolytica
SDNGLDARK

SEQ ID NO: 2654412 - protein, 9 aa, Entamoeba histolytica
SDNGNQLSS

SEQ ID NO: 2654413 - protein, 8 aa, Entamoeba histolytica
SDNHKTNL

SEQ ID NO: 2654414 - protein, 7 aa, Entamoeba histolytica
SDNHVPP

SEQ ID NO: 2654415 - protein, 12 aa, Entamoeba histolytica
SDNISDDEPFYF

SEQ ID NO: 2654416 - protein, 13 aa, Entamoeba histolytica
SDNKDQKEYNETL

SEQ ID NO: 2654417 - protein, 7 aa, Entamoeba histolytica
SDNKEFE

SEQ ID NO: 2654418 - protein, 7 aa, Entamoeba histolytica
SDNKETI

SEQ ID NO: 2654419 - protein, 8 aa, Entamoeba histolytica
SDNKQRIN

SEQ ID NO: 2654420 - protein, 5 aa, Entamoeba histolytica
SDNKT

SEQ ID NO: 2654421 - protein, 6 aa, Entamoeba histolytica
SDNKTL

SEQ ID NO: 2654422 - protein, 9 aa, Entamoeba histolytica
SDNLEEKSL

SEQ ID NO: 2654423 - protein, 9 aa, Entamoeba histolytica
SDNLNHQSI

SEQ ID NO: 2654424 - protein, 8 aa, Entamoeba histolytica
SDNNEVST

SEQ ID NO: 2654425 - protein, 8 aa, Entamoeba histolytica
SDNNINTT

SEQ ID NO: 2654426 - protein, 9 aa, Entamoeba histolytica
SDNNKSKQL

SEQ ID NO: 2654427 - protein, 7 aa, Entamoeba histolytica
SDNNPDK

SEQ ID NO: 2654428 - protein, 16 aa, Entamoeba histolytica
SDNNPQQLDKKKHIGN

SEQ ID NO: 2654429 - protein, 7 aa, Entamoeba histolytica
SDNPIKN

SEQ ID NO: 2654430 - protein, 6 aa, Entamoeba histolytica
SDNPSI

SEQ ID NO: 2654431 - protein, 7 aa, Entamoeba histolytica
SDNSIDE

SEQ ID NO: 2654432 - protein, 17 aa, Entamoeba histolytica
SDNSKSKYISEVQRKGG

SEQ ID NO: 2654433 - protein, 8 aa, Entamoeba histolytica
SDNSSSIN

SEQ ID NO: 2654434 - protein, 8 aa, Entamoeba histolytica
SDNTIPSG

SEQ ID NO: 2654435 - protein, 10 aa, Entamoeba histolytica
SDNTNINLSS

SEQ ID NO: 2654436 - protein, 36 aa, Entamoeba histolytica
SDNTQNTSKIKPSTSIKKPVRNTFDAEKSKISRKRY

SEQ ID NO: 2654437 - protein, 6 aa, Entamoeba histolytica
SDNVQS

SEQ ID NO: 2654438 - protein, 15 aa, Entamoeba histolytica
SDNYSDDSKKSQLVK

SEQ ID NO: 2654439 - protein, 8 aa, Entamoeba histolytica
SDPAGSVA

SEQ ID NO: 2654440 - protein, 5 aa, Entamoeba histolytica
SDPCA

SEQ ID NO: 2654441 - protein, 9 aa, Entamoeba histolytica
SDPDDSLRR

SEQ ID NO: 2654442 - protein, 8 aa, Entamoeba histolytica
SDPDGIKS

SEQ ID NO: 2654443 - protein, 9 aa, Entamoeba histolytica
SDPEGKPIY

SEQ ID NO: 2654444 - protein, 6 aa, Entamoeba histolytica
SDPEGW

SEQ ID NO: 2654445 - protein, 6 aa, Entamoeba histolytica
SDPFRP

SEQ ID NO: 2654446 - protein, 5 aa, Entamoeba histolytica
SDPHD

SEQ ID NO: 2654447 - protein, 11 aa, Entamoeba histolytica
SDPIKDAEGKS

SEQ ID NO: 2654448 - protein, 26 aa, Entamoeba histolytica
SDPIPSRSQKKVLPKSKMERRKESIE

SEQ ID NO: 2654449 - protein, 5 aa, Entamoeba histolytica
SDPIS

SEQ ID NO: 2654450 - protein, 4 aa, Entamoeba histolytica
SDPK

SEQ ID NO: 2654451 - protein, 6 aa, Entamoeba histolytica
SDPLPL

SEQ ID NO: 2654452 - protein, 6 aa, Entamoeba histolytica
SDPNDL

SEQ ID NO: 2654453 - protein, 5 aa, Entamoeba histolytica
SDPNL

SEQ ID NO: 2654454 - protein, 5 aa, Entamoeba histolytica
SDPNN

SEQ ID NO: 2654455 - protein, 14 aa, Entamoeba histolytica
SDPNNSGAQFGEED

SEQ ID NO: 2654456 - protein, 4 aa, Entamoeba histolytica
SDPQ

SEQ ID NO: 2654457 - protein, 14 aa, Entamoeba histolytica
SDPQLRRDDKGEYT

SEQ ID NO: 2654458 - protein, 9 aa, Entamoeba histolytica
SDPRGKGFR

SEQ ID NO: 2654459 - protein, 5 aa, Entamoeba histolytica
SDPSF

SEQ ID NO: 2654460 - protein, 4 aa, Entamoeba histolytica
SDPT

SEQ ID NO: 2654461 - protein, 7 aa, Entamoeba histolytica
SDPTFRK

SEQ ID NO: 2654462 - protein, 5 aa, Entamoeba histolytica
SDPTQ

SEQ ID NO: 2654463 - protein, 5 aa, Entamoeba histolytica
SDPVA

SEQ ID NO: 2654464 - protein, 7 aa, Entamoeba histolytica
SDPYQNN

SEQ ID NO: 2654465 - protein, 11 aa, Entamoeba histolytica
SDQDGGEGKTG

SEQ ID NO: 2654466 - protein, 5 aa, Entamoeba histolytica
SDQEF

SEQ ID NO: 2654467 - protein, 11 aa, Entamoeba histolytica
SDQEKELDKEV

SEQ ID NO: 2654468 - protein, 8 aa, Entamoeba histolytica
SDQIKEEK

SEQ ID NO: 2654469 - protein, 29 aa, Entamoeba histolytica
SDQKSEESQQSKPIKNDDVTSPKPQINNK

SEQ ID NO: 2654470 - protein, 7 aa, Entamoeba histolytica
SDQNDSI

SEQ ID NO: 2654471 - protein, 11 aa, Entamoeba histolytica
SDQNNSNNNKL

SEQ ID NO: 2654472 - protein, 6 aa, Entamoeba histolytica
SDQSFK

SEQ ID NO: 2654473 - protein, 9 aa, Entamoeba histolytica
SDRCPPGGL

SEQ ID NO: 2654474 - protein, 7 aa, Entamoeba histolytica
SDRCSPN

SEQ ID NO: 2654475 - protein, 7 aa, Entamoeba histolytica
SDRISRI

SEQ ID NO: 2654476 - protein, 14 aa, Entamoeba histolytica
SDRKLTEEGNGKKV

SEQ ID NO: 2654477 - protein, 6 aa, Entamoeba histolytica
SDRKYD

SEQ ID NO: 2654478 - protein, 5 aa, Entamoeba histolytica
SDRLS

SEQ ID NO: 2654479 - protein, 12 aa, Entamoeba histolytica
SDRLSNVNEATR

SEQ ID NO: 2654480 - protein, 16 aa, Entamoeba histolytica
SDRMDPYDEAVEKNEL

SEQ ID NO: 2654481 - protein, 21 aa, Entamoeba histolytica
SDRNMKINEEETKKIKTTIES

SEQ ID NO: 2654482 - protein, 4 aa, Entamoeba histolytica
SDRR

SEQ ID NO: 2654483 - protein, 23 aa, Entamoeba histolytica
SDRRKDMNMEDNEEDSEDDWSDD

SEQ ID NO: 2654484 - protein, 18 aa, Entamoeba histolytica
SDRRQENERNESIKVPTT

SEQ ID NO: 2654485 - protein, 4 aa, Entamoeba histolytica
SDRY

SEQ ID NO: 2654486 - protein, 4 aa, Entamoeba histolytica
SDSC

SEQ ID NO: 2654487 - protein, 24 aa, Entamoeba histolytica
SDSDKREVYDKYGKKGLEEGGMGG

SEQ ID NO: 2654488 - protein, 8 aa, Entamoeba histolytica
SDSEEKPV

SEQ ID NO: 2654489 - protein, 13 aa, Entamoeba histolytica
SDSESGSEYENYF

SEQ ID NO: 2654490 - protein, 4 aa, Entamoeba histolytica
SDSF

SEQ ID NO: 2654491 - protein, 6 aa, Entamoeba histolytica
SDSGSI

SEQ ID NO: 2654492 - protein, 10 aa, Entamoeba histolytica
SDSGSSAMTD

SEQ ID NO: 2654493 - protein, 8 aa, Entamoeba histolytica
SDSGYFES

SEQ ID NO: 2654494 - protein, 8 aa, Entamoeba histolytica
SDSHNSEV

SEQ ID NO: 2654495 - protein, 4 aa, Entamoeba histolytica
SDSI

SEQ ID NO: 2654496 - protein, 7 aa, Entamoeba histolytica
SDSIHSP

SEQ ID NO: 2654497 - protein, 35 aa, Entamoeba histolytica
SDSITEEEKPEHIEEPVTKRTTRRQANHENQRQEL

SEQ ID NO: 2654498 - protein, 5 aa, Entamoeba histolytica
SDSIY

SEQ ID NO: 2654499 - protein, 7 aa, Entamoeba histolytica
SDSKEGA

SEQ ID NO: 2654500 - protein, 6 aa, Entamoeba histolytica
SDSLET

SEQ ID NO: 2654501 - protein, 9 aa, Entamoeba histolytica
SDSLREGGY

SEQ ID NO: 2654502 - protein, 11 aa, Entamoeba histolytica
SDSNSKRSQID

SEQ ID NO: 2654503 - protein, 5 aa, Entamoeba histolytica
SDSNT

SEQ ID NO: 2654504 - protein, 12 aa, Entamoeba histolytica
SDSNTMEEEEPI

SEQ ID NO: 2654505 - protein, 7 aa, Entamoeba histolytica
SDSNVTQ

SEQ ID NO: 2654506 - protein, 8 aa, Entamoeba histolytica
SDSNYQKR

SEQ ID NO: 2654507 - protein, 6 aa, Entamoeba histolytica
SDSPKL

SEQ ID NO: 2654508 - protein, 9 aa, Entamoeba histolytica
SDSQRLATE

SEQ ID NO: 2654509 - protein, 8 aa, Entamoeba histolytica
SDSRESQV

SEQ ID NO: 2654510 - protein, 9 aa, Entamoeba histolytica
SDSRKLPKI

SEQ ID NO: 2654511 - protein, 6 aa, Entamoeba histolytica
SDSRPS

SEQ ID NO: 2654512 - protein, 7 aa, Entamoeba histolytica
SDSRQVL

SEQ ID NO: 2654513 - protein, 5 aa, Entamoeba histolytica
SDSSF

SEQ ID NO: 2654514 - protein, 11 aa, Entamoeba histolytica
SDSSKRDIYDR

SEQ ID NO: 2654515 - protein, 15 aa, Entamoeba histolytica
SDSSSGKVPFAKKSY

SEQ ID NO: 2654516 - protein, 15 aa, Entamoeba histolytica
SDSTASLLNKFTQPQ

SEQ ID NO: 2654517 - protein, 6 aa, Entamoeba histolytica
SDSTET

SEQ ID NO: 2654518 - protein, 6 aa, Entamoeba histolytica
SDSTFK

SEQ ID NO: 2654519 - protein, 23 aa, Entamoeba histolytica
SDSTISETREADVQSGEGERSDV

SEQ ID NO: 2654520 - protein, 7 aa, Entamoeba histolytica
SDSTSFT

SEQ ID NO: 2654521 - protein, 4 aa, Entamoeba histolytica
SDSV

SEQ ID NO: 2654522 - protein, 26 aa, Entamoeba histolytica
SDSVTRHGTQSSYPNKEQIQKIISEL

SEQ ID NO: 2654523 - protein, 6 aa, Entamoeba histolytica
SDSYGI

SEQ ID NO: 2654524 - protein, 9 aa, Entamoeba histolytica
SDTDGEDQD

SEQ ID NO: 2654525 - protein, 19 aa, Entamoeba histolytica
SDTDNISDNNTVKEKETIE

SEQ ID NO: 2654526 - protein, 8 aa, Entamoeba histolytica
SDTDVKRQ

SEQ ID NO: 2654527 - protein, 6 aa, Entamoeba histolytica
SDTEEY

SEQ ID NO: 2654528 - protein, 7 aa, Entamoeba histolytica
SDTEQIN

SEQ ID NO: 2654529 - protein, 15 aa, Entamoeba histolytica
SDTESDSESSYEKHE

SEQ ID NO: 2654530 - protein, 7 aa, Entamoeba histolytica
SDTGEYS

SEQ ID NO: 2654531 - protein, 11 aa, Entamoeba histolytica
SDTHSEPSEVE

SEQ ID NO: 2654532 - protein, 4 aa, Entamoeba histolytica
SDTI

SEQ ID NO: 2654533 - protein, 16 aa, Entamoeba histolytica
SDTIQETVKPSSSNRY

SEQ ID NO: 2654534 - protein, 11 aa, Entamoeba histolytica
SDTISKTLSPA

SEQ ID NO: 2654535 - protein, 7 aa, Entamoeba histolytica
SDTKKDE

SEQ ID NO: 2654536 - protein, 8 aa, Entamoeba histolytica
SDTKPTRS

SEQ ID NO: 2654537 - protein, 4 aa, Entamoeba histolytica
SDTL

SEQ ID NO: 2654538 - protein, 28 aa, Entamoeba histolytica
SDTLDHTSKEDKFISPEPSLTTPSNFTD

SEQ ID NO: 2654539 - protein, 5 aa, Entamoeba histolytica
SDTLP

SEQ ID NO: 2654540 - protein, 6 aa, Entamoeba histolytica
SDTLPS

SEQ ID NO: 2654541 - protein, 14 aa, Entamoeba histolytica
SDTNCYSKNEYKNT

SEQ ID NO: 2654542 - protein, 9 aa, Entamoeba histolytica
SDTPEGESC

SEQ ID NO: 2654543 - protein, 9 aa, Entamoeba histolytica
SDTPGNLIT

SEQ ID NO: 2654544 - protein, 16 aa, Entamoeba histolytica
SDTQQTEDVLKILSSL

SEQ ID NO: 2654545 - protein, 9 aa, Entamoeba histolytica
SDTQSLTLP

SEQ ID NO: 2654546 - protein, 5 aa, Entamoeba histolytica
SDTRY

SEQ ID NO: 2654547 - protein, 8 aa, Entamoeba histolytica
SDTSPLKE

SEQ ID NO: 2654548 - protein, 6 aa, Entamoeba histolytica
SDTSRE

SEQ ID NO: 2654549 - protein, 11 aa, Entamoeba histolytica
SDTTAQPLYEE

SEQ ID NO: 2654550 - protein, 6 aa, Entamoeba histolytica
SDTTCR

SEQ ID NO: 2654551 - protein, 6 aa, Entamoeba histolytica
SDTTKH

SEQ ID NO: 2654552 - protein, 5 aa, Entamoeba histolytica
SDTTV

SEQ ID NO: 2654553 - protein, 6 aa, Entamoeba histolytica
SDTVRR

SEQ ID NO: 2654554 - protein, 11 aa, Entamoeba histolytica
SDTYKGVPAGE

SEQ ID NO: 2654555 - protein, 5 aa, Entamoeba histolytica
SDVDV

SEQ ID NO: 2654556 - protein, 10 aa, Entamoeba histolytica
SDVESSLDPT

SEQ ID NO: 2654557 - protein, 6 aa, Entamoeba histolytica
SDVHPS

SEQ ID NO: 2654558 - protein, 7 aa, Entamoeba histolytica
SDVKKET

SEQ ID NO: 2654559 - protein, 4 aa, Entamoeba histolytica
SDVN

SEQ ID NO: 2654560 - protein, 9 aa, Entamoeba histolytica
SDVNGRDTL

SEQ ID NO: 2654561 - protein, 11 aa, Entamoeba histolytica
SDVNKKNPLST

SEQ ID NO: 2654562 - protein, 6 aa, Entamoeba histolytica
SDVPQE

SEQ ID NO: 2654563 - protein, 38 aa, Entamoeba histolytica; identical to SEQ ID NO: 2459346

SEQ ID NO: 2654564 - protein, 5 aa, Entamoeba histolytica
SDVVS

SEQ ID NO: 2654565 - protein, 8 aa, Entamoeba histolytica
SDVVSEGA

SEQ ID NO: 2654566 - protein, 6 aa, Entamoeba histolytica
SDWEKS

SEQ ID NO: 2654567 - protein, 5 aa, Entamoeba histolytica
SDWKQ

SEQ ID NO: 2654568 - protein, 6 aa, Entamoeba histolytica
SDYDKN

SEQ ID NO: 2654569 - protein, 6 aa, Entamoeba histolytica
SDYEQA

SEQ ID NO: 2654570 - protein, 6 aa, Entamoeba histolytica
SDYESA

SEQ ID NO: 2654571 - protein, 4 aa, Entamoeba histolytica
SDYH

SEQ ID NO: 2654572 - protein, 4 aa, Entamoeba histolytica
SDYK

SEQ ID NO: 2654573 - protein, 9 aa, Entamoeba histolytica
SDYPNPQRD

SEQ ID NO: 2654574 - protein, 8 aa, Entamoeba histolytica
SDYQSGDR

SEQ ID NO: 2654575 - protein, 12 aa, Entamoeba histolytica
SDYSNGFPNVGP

SEQ ID NO: 2654576 - protein, 13 aa, Entamoeba histolytica
SDYSTSISMPTSI

SEQ ID NO: 2654577 - protein, 6 aa, Entamoeba histolytica
SEADSD

SEQ ID NO: 2654578 - protein, 5 aa, Entamoeba histolytica
SEAEE

SEQ ID NO: 2654579 - protein, 11 aa, Entamoeba histolytica
SEAEELANNGM

SEQ ID NO: 2654580 - protein, 6 aa, Entamoeba histolytica
SEAEEV

SEQ ID NO: 2654581 - protein, 8 aa, Entamoeba histolytica
SEAERALR

SEQ ID NO: 2654582 - protein, 7 aa, Entamoeba histolytica
SEAEVPK

SEQ ID NO: 2654583 - protein, 8 aa, Entamoeba histolytica
SEAGEVGE

SEQ ID NO: 2654584 - protein, 4 aa, Entamoeba histolytica
SEAI

SEQ ID NO: 2654585 - protein, 5 aa, Entamoeba histolytica
SEAIE

SEQ ID NO: 2654586 - protein, 9 aa, Entamoeba histolytica
SEAKREMRL

SEQ ID NO: 2654587 - protein, 8 aa, Entamoeba histolytica
SEANKRDI

SEQ ID NO: 2654588 - protein, 5 aa, Entamoeba histolytica
SEANV

SEQ ID NO: 2654589 - protein, 6 aa, Entamoeba histolytica
SEANVR

SEQ ID NO: 2654590 - protein, 13 aa, Entamoeba histolytica
SEAPQAKEKKKGM

SEQ ID NO: 2654591 - protein, 8 aa, Entamoeba histolytica
SEAQPNDN

SEQ ID NO: 2654592 - protein, 6 aa, Entamoeba histolytica
SEAQSR

SEQ ID NO: 2654593 - protein, 5 aa, Entamoeba histolytica
SEARD

SEQ ID NO: 2654594 - protein, 5 aa, Entamoeba histolytica
SEARE

SEQ ID NO: 2654595 - protein, 131 aa, Entamoeba histolytica
SEASTTQNGEEKKEEMKTPKSSKEIKEEKKKAEELKKEEEKKKKEALKEEERKKKEEKKKAEELRKEEEKKKKEEKKEEERKKKEEKKNKKSQKEIKEEPRPTEHLEEGKDEPESNDNDGIKKEDSNTNQE

SEQ ID NO: 2654596 - protein, 15 aa, Entamoeba histolytica
SEATESKRIRRQKAS

SEQ ID NO: 2654597 - protein, 7 aa, Entamoeba histolytica
SEATYGL

SEQ ID NO: 2654598 - protein, 4 aa, Entamoeba histolytica
SEAV

SEQ ID NO: 2654599 - protein, 6 aa, Entamoeba histolytica
SEAVPK

SEQ ID NO: 2654600 - protein, 4 aa, Entamoeba histolytica
SECI

SEQ ID NO: 2654601 - protein, 6 aa, Entamoeba histolytica
SECTGC

SEQ ID NO: 2654602 - protein, 14 aa, Entamoeba histolytica
SEDCTTEKKTDLKQ

SEQ ID NO: 2654603 - protein, 4 aa, Entamoeba histolytica
SEDD

SEQ ID NO: 2654604 - protein, 9 aa, Entamoeba histolytica
SEDDDKTMK

SEQ ID NO: 2654605 - protein, 20 aa, Entamoeba histolytica
SEDERKKYKDLAQHNKDSVK

SEQ ID NO: 2654606 - protein, 63 aa, Entamoeba histolytica
SEDESSGSNSFNPTNSKCERMNKDEISEDGSNRDSSDNEGSEDEELEESIDEDTDEDTSSLFS

SEQ ID NO: 2654607 - protein, 28 aa, Entamoeba histolytica
SEDGESDEYEEAEDSNKDNESSEEDDEL

SEQ ID NO: 2654608 - protein, 7 aa, Entamoeba histolytica
SEDGNFT

SEQ ID NO: 2654609 - protein, 14 aa, Entamoeba histolytica
SEDGTAKTWEPRTC

SEQ ID NO: 2654610 - protein, 5 aa, Entamoeba histolytica
SEDIG

SEQ ID NO: 2654611 - protein, 10 aa, Entamoeba histolytica
SEDIQQKKEL

SEQ ID NO: 2654612 - protein, 9 aa, Entamoeba histolytica
SEDKKNPRG

SEQ ID NO: 2654613 - protein, 4 aa, Entamoeba histolytica
SEDL

SEQ ID NO: 2654614 - protein, 8 aa, Entamoeba histolytica
SEDLDGEK

SEQ ID NO: 2654615 - protein, 5 aa, Entamoeba histolytica
SEDLS

SEQ ID NO: 2654616 - protein, 4 aa, Entamoeba histolytica
SEDN

SEQ ID NO: 2654617 - protein, 10 aa, Entamoeba histolytica
SEDNKENIGP

SEQ ID NO: 2654618 - protein, 9 aa, Entamoeba histolytica
SEDPNDITT

SEQ ID NO: 2654619 - protein, 10 aa, Entamoeba histolytica
SEDPNQPLKT

SEQ ID NO: 2654620 - protein, 7 aa, Entamoeba histolytica
SEDPQYK

SEQ ID NO: 2654621 - protein, 6 aa, Entamoeba histolytica
SEDQRL

SEQ ID NO: 2654622 - protein, 11 aa, Entamoeba histolytica
SEDTNLSRSAE

SEQ ID NO: 2654623 - protein, 4 aa, Entamoeba histolytica
SEDW

SEQ ID NO: 2654624 - protein, 6 aa, Entamoeba histolytica
SEDWGE

SEQ ID NO: 2654625 - protein, 8 aa, Entamoeba histolytica
SEEAGADA

SEQ ID NO: 2654626 - protein, 6 aa, Entamoeba histolytica
SEEDCE

SEQ ID NO: 2654627 - protein, 16 aa, Entamoeba histolytica
SEEDDDNESPQCEEEP

SEQ ID NO: 2654628 - protein, 10 aa, Entamoeba histolytica
SEEDEGDEPI

SEQ ID NO: 2654629 - protein, 9 aa, Entamoeba histolytica
SEEDGRCGK

SEQ ID NO: 2654630 - protein, 34 aa, Entamoeba histolytica
SEEDINPKLPKTPETIKYSEEKRKKTSKRKETKN

SEQ ID NO: 2654631 - protein, 5 aa, Entamoeba histolytica
SEEDK

SEQ ID NO: 2654632 - protein, 6 aa, Entamoeba histolytica
SEEDTV

SEQ ID NO: 2654633 - protein, 5 aa, Entamoeba histolytica
SEEDV

SEQ ID NO: 2654634 - protein, 5 aa, Entamoeba histolytica
SEEED

SEQ ID NO: 2654635 - protein, 11 aa, Entamoeba histolytica
SEEEDGTLGAK

SEQ ID NO: 2654636 - protein, 7 aa, Entamoeba histolytica
SEEEEEV

SEQ ID NO: 2654637 - protein, 20 aa, Entamoeba histolytica
SEEEENEEEKMEESEEEGIN

SEQ ID NO: 2654638 - protein, 6 aa, Entamoeba histolytica
SEEEKK

SEQ ID NO: 2654639 - protein, 5 aa, Entamoeba histolytica
SEEEL

SEQ ID NO: 2654640 - protein, 5 aa, Entamoeba histolytica
SEEEM

SEQ ID NO: 2654641 - protein, 6 aa, Entamoeba histolytica
SEEEME

SEQ ID NO: 2654642 - protein, 9 aa, Entamoeba histolytica
SEEENTRRY

SEQ ID NO: 2654643 - protein, 9 aa, Entamoeba histolytica
SEEEPITPE

SEQ ID NO: 2654644 - protein, 9 aa, Entamoeba histolytica
SEEEQGNEV

SEQ ID NO: 2654645 - protein, 9 aa, Entamoeba histolytica
SEEESKLRQ

SEQ ID NO: 2654646 - protein, 8 aa, Entamoeba histolytica
SEEESLKA

SEQ ID NO: 2654647 - protein, 6 aa, Entamoeba histolytica
SEEETD

SEQ ID NO: 2654648 - protein, 7 aa, Entamoeba histolytica
SEEETSN

SEQ ID NO: 2654649 - protein, 5 aa, Entamoeba histolytica
SEEEY

SEQ ID NO: 2654650 - protein, 4 aa, Entamoeba histolytica
SEEF

SEQ ID NO: 2654651 - protein, 5 aa, Entamoeba histolytica
SEEGE

SEQ ID NO: 2654652 - protein, 7 aa, Entamoeba histolytica
SEEGPGK

SEQ ID NO: 2654653 - protein, 7 aa, Entamoeba histolytica
SEEGYSK

SEQ ID NO: 2654654 - protein, 7 aa, Entamoeba histolytica
SEEHKSF

SEQ ID NO: 2654655 - protein, 14 aa, Entamoeba histolytica
SEEIEDSHENYQKV

SEQ ID NO: 2654656 - protein, 41 aa, Entamoeba histolytica
SEEIKKPKESEGIKELKKSKESKGIKKATNKTKKEKKRTTK

SEQ ID NO: 2654657 - protein, 5 aa, Entamoeba histolytica
SEEIN

SEQ ID NO: 2654658 - protein, 6 aa, Entamoeba histolytica
SEEISN

SEQ ID NO: 2654659 - protein, 4 aa, Entamoeba histolytica
SEEK

SEQ ID NO: 2654660 - protein, 7 aa, Entamoeba histolytica
SEEKEDI

SEQ ID NO: 2654661 - protein, 8 aa, Entamoeba histolytica
SEEKEKEI

SEQ ID NO: 2654662 - protein, 8 aa, Entamoeba histolytica
SEEKIGGV

SEQ ID NO: 2654663 - protein, 6 aa, Entamoeba histolytica
SEEKQK

SEQ ID NO: 2654664 - protein, 21 aa, Entamoeba histolytica
SEEKVSTTKEIKRGAIENNNL

SEQ ID NO: 2654665 - protein, 9 aa, Entamoeba histolytica
SEELEQPLN

SEQ ID NO: 2654666 - protein, 6 aa, Entamoeba histolytica
SEELKN

SEQ ID NO: 2654667 - protein, 29 aa, Entamoeba histolytica
SEELNEKRKEEITRLQKENEDLENKQQQL

SEQ ID NO: 2654668 - protein, 20 aa, Entamoeba histolytica
SEELNKEKQIIESKKSSGKF

SEQ ID NO: 2654669 - protein, 7 aa, Entamoeba histolytica
SEELNPR

SEQ ID NO: 2654670 - protein, 4 aa, Entamoeba histolytica
SEEM

SEQ ID NO: 2654671 - protein, 6 aa, Entamoeba histolytica
SEEMAN

SEQ ID NO: 2654672 - protein, 11 aa, Entamoeba histolytica
SEEMEAENTAL

SEQ ID NO: 2654673 - protein, 11 aa, Entamoeba histolytica
SEENKSFTSQK

SEQ ID NO: 2654674 - protein, 10 aa, Entamoeba histolytica
SEENSYSTED

SEQ ID NO: 2654675 - protein, 7 aa, Entamoeba histolytica
SEEPDRA

SEQ ID NO: 2654676 - protein, 6 aa, Entamoeba histolytica
SEEPKL

SEQ ID NO: 2654677 - protein, 15 aa, Entamoeba histolytica
SEEPQINPDEPPNFN

SEQ ID NO: 2654678 - protein, 4 aa, Entamoeba histolytica
SEEQ

SEQ ID NO: 2654679 - protein, 18 aa, Entamoeba histolytica
SEEQKRINESSSKSFDLS

SEQ ID NO: 2654680 - protein, 6 aa, Entamoeba histolytica
SEESHI

SEQ ID NO: 2654681 - protein, 5 aa, Entamoeba histolytica
SEESI

SEQ ID NO: 2654682 - protein, 6 aa, Entamoeba histolytica
SEESIN

SEQ ID NO: 2654683 - protein, 20 aa, Entamoeba histolytica
SEESSENSDDDREGLQNGEE

SEQ ID NO: 2654684 - protein, 9 aa, Entamoeba histolytica
SEESVVPDI

SEQ ID NO: 2654685 - protein, 9 aa, Entamoeba histolytica
SEETTLDPL

SEQ ID NO: 2654686 - protein, 13 aa, Entamoeba histolytica
SEEVKGTEDPRFP

SEQ ID NO: 2654687 - protein, 11 aa, Entamoeba histolytica
SEEVNSSRQPL

SEQ ID NO: 2654688 - protein, 206 aa, Entamoeba histolytica
SEEVSKGTTEERSDEKKKENVEESKDGVVTEGEKGQSQEGTKEHNDNQKEKGEGAQHDKEEKSQVSGGEEPTQKNKEEGSDKEKTKEQESEEKKEQEEEQKEGKNNNEEKSKEDSTKEKKEVEDEKSKEDSEKEKAEKEKAEKEEKEKITDDTKNGKEKDNQNDKQGDEEKKQEGDGNKEKEDITESKSDEKENDTSNDNNNLNGT

SEQ ID NO: 2654689 - protein, 8 aa, Entamoeba histolytica
SEFAPGTY

SEQ ID NO: 2654690 - protein, 5 aa, Entamoeba histolytica
SEFAT

SEQ ID NO: 2654691 - protein, 7 aa, Entamoeba histolytica
SEFETNE

SEQ ID NO: 2654692 - protein, 13 aa, Entamoeba histolytica
SEFETNKEEPIKL

SEQ ID NO: 2654693 - protein, 31 aa, Entamoeba histolytica
SEFNSPINPSSPFNEPVNTQRHNQYFHPIYT

SEQ ID NO: 2654694 - protein, 4 aa, Entamoeba histolytica
SEFP

SEQ ID NO: 2654695 - protein, 8 aa, Entamoeba histolytica
SEFRTNGR

SEQ ID NO: 2654696 - protein, 21 aa, Entamoeba histolytica
SEFTQNQRNSNYIEIDSEEQL

SEQ ID NO: 2654697 - protein, 11 aa, Entamoeba histolytica
SEGAKESKDDL

SEQ ID NO: 2654698 - protein, 5 aa, Entamoeba histolytica
SEGAY

SEQ ID NO: 2654699 - protein, 7 aa, Entamoeba histolytica
SEGDESV

SEQ ID NO: 2654700 - protein, 8 aa, Entamoeba histolytica
SEGDNTFS

SEQ ID NO: 2654701 - protein, 13 aa, Entamoeba histolytica
SEGDSAQENYSVS

SEQ ID NO: 2654702 - protein, 4 aa, Entamoeba histolytica
SEGE

SEQ ID NO: 2654703 - protein, 5 aa, Entamoeba histolytica
SEGED

SEQ ID NO: 2654704 - protein, 11 aa, Entamoeba histolytica
SEGEEAKMEQI

SEQ ID NO: 2654705 - protein, 9 aa, Entamoeba histolytica
SEGENGQYA

SEQ ID NO: 2654706 - protein, 6 aa, Entamoeba histolytica
SEGEPI

SEQ ID NO: 2654707 - protein, 7 aa, Entamoeba histolytica
SEGFDDD

SEQ ID NO: 2654708 - protein, 15 aa, Entamoeba histolytica
SEGFEQYDSSKTEQV

SEQ ID NO: 2654709 - protein, 19 aa, Entamoeba histolytica
SEGGISSLSKLNDEQLNNT

SEQ ID NO: 2654710 - protein, 5 aa, Entamoeba histolytica
SEGGL

SEQ ID NO: 2654711 - protein, 6 aa, Entamoeba histolytica
SEGIDF

SEQ ID NO: 2654712 - protein, 5 aa, Entamoeba histolytica
SEGIT

SEQ ID NO: 2654713 - protein, 12 aa, Entamoeba histolytica
SEGKATPHNIVL

SEQ ID NO: 2654714 - protein, 14 aa, Entamoeba histolytica
SEGKGAGKFEQGIE

SEQ ID NO: 2654715 - protein, 7 aa, Entamoeba histolytica
SEGKQMK

SEQ ID NO: 2654716 - protein, 15 aa, Entamoeba histolytica
SEGKQNDTQSTGRFG

SEQ ID NO: 2654717 - protein, 5 aa, Entamoeba histolytica
SEGKS

SEQ ID NO: 2654718 - protein, 8 aa, Entamoeba histolytica
SEGKSGAD

SEQ ID NO: 2654719 - protein, 12 aa, Entamoeba histolytica
SEGKTKSSFELQ

SEQ ID NO: 2654720 - protein, 5 aa, Entamoeba histolytica
SEGPF

SEQ ID NO: 2654721 - protein, 8 aa, Entamoeba histolytica
SEGPVQSR

SEQ ID NO: 2654722 - protein, 5 aa, Entamoeba histolytica
SEGQH

SEQ ID NO: 2654723 - protein, 10 aa, Entamoeba histolytica
SEGRNISNNM

SEQ ID NO: 2654724 - protein, 26 aa, Entamoeba histolytica
SEGSTPDITKKGTDIEKEEIDNKQPK

SEQ ID NO: 2654725 - protein, 8 aa, Entamoeba histolytica
SEGSVSPA

SEQ ID NO: 2654726 - protein, 14 aa, Entamoeba histolytica
SEGTEIKEEEELKE

SEQ ID NO: 2654727 - protein, 5 aa, Entamoeba histolytica
SEGTV

SEQ ID NO: 2654728 - protein, 5 aa, Entamoeba histolytica
SEGVN

SEQ ID NO: 2654729 - protein, 12 aa, Entamoeba histolytica
SEHEKRENALKE

SEQ ID NO: 2654730 - protein, 5 aa, Entamoeba histolytica
SEHGD

SEQ ID NO: 2654731 - protein, 6 aa, Entamoeba histolytica
SEHPGV

SEQ ID NO: 2654732 - protein, 7 aa, Entamoeba histolytica
SEHSTSI

SEQ ID NO: 2654733 - protein, 6 aa, Entamoeba histolytica
SEIANE

SEQ ID NO: 2654734 - protein, 4 aa, Entamoeba histolytica
SEIE

SEQ ID NO: 2654735 - protein, 6 aa, Entamoeba histolytica
SEIEER

SEQ ID NO: 2654736 - protein, 10 aa, Entamoeba histolytica
SEIEGQPEAI

SEQ ID NO: 2654737 - protein, 13 aa, Entamoeba histolytica
SEIERKNTDPLPD

SEQ ID NO: 2654738 - protein, 8 aa, Entamoeba histolytica
SEIGTEVA

SEQ ID NO: 2654739 - protein, 9 aa, Entamoeba histolytica
SEIKKKKKY

SEQ ID NO: 2654740 - protein, 9 aa, Entamoeba histolytica
SEIKPNSIS

SEQ ID NO: 2654741 - protein, 12 aa, Entamoeba histolytica
SEIKSETQRKSI

SEQ ID NO: 2654742 - protein, 8 aa, Entamoeba histolytica
SEIKTNKN

SEQ ID NO: 2654743 - protein, 7 aa, Entamoeba histolytica
SEINTSP

SEQ ID NO: 2654744 - protein, 10 aa, Entamoeba histolytica
SEIPGISRSD

SEQ ID NO: 2654745 - protein, 13 aa, Entamoeba histolytica
SEIPNDITKTASK

SEQ ID NO: 2654746 - protein, 5 aa, Entamoeba histolytica
SEIPP

SEQ ID NO: 2654747 - protein, 6 aa, Entamoeba histolytica
SEIPVD

SEQ ID NO: 2654748 - protein, 4 aa, Entamoeba histolytica
SEIQ

SEQ ID NO: 2654749 - protein, 7 aa, Entamoeba histolytica
SEIQDTS

SEQ ID NO: 2654750 - protein, 21 aa, Entamoeba histolytica
SEIQNALSQNDSTSKSGGIER

SEQ ID NO: 2654751 - protein, 8 aa, Entamoeba histolytica
SEIREDEY

SEQ ID NO: 2654752 - protein, 14 aa, Entamoeba histolytica
SEIREEKERPLKEV

SEQ ID NO: 2654753 - protein, 9 aa, Entamoeba histolytica
SEISEEDLE

SEQ ID NO: 2654754 - protein, 12 aa, Entamoeba histolytica
SEISEGQDLKMK

SEQ ID NO: 2654755 - protein, 18 aa, Entamoeba histolytica
SEISKVRKTSKKPSLVTE

SEQ ID NO: 2654756 - protein, 4 aa, Entamoeba histolytica
SEIT

SEQ ID NO: 2654757 - protein, 5 aa, Entamoeba histolytica
SEITA

SEQ ID NO: 2654758 - protein, 5 aa, Entamoeba histolytica
SEITG

SEQ ID NO: 2654759 - protein, 5 aa, Entamoeba histolytica
SEITN

SEQ ID NO: 2654760 - protein, 13 aa, Entamoeba histolytica
SEITTSTKDRGTY

SEQ ID NO: 2654761 - protein, 9 aa, Entamoeba histolytica
SEKAKQVSD

SEQ ID NO: 2654762 - protein, 5 aa, Entamoeba histolytica
SEKDI

SEQ ID NO: 2654763 - protein, 8 aa, Entamoeba histolytica
SEKDPTNA

SEQ ID NO: 2654764 - protein, 10 aa, Entamoeba histolytica
SEKEAETQIS

SEQ ID NO: 2654765 - protein, 21 aa, Entamoeba histolytica
SEKECPDCRGRGEHVDEKDRC

SEQ ID NO: 2654766 - protein, 8 aa, Entamoeba histolytica
SEKEDQIL

SEQ ID NO: 2654767 - protein, 8 aa, Entamoeba histolytica
SEKEEENI

SEQ ID NO: 2654768 - protein, 20 aa, Entamoeba histolytica
SEKELKNPQEEKEEINENTN

SEQ ID NO: 2654769 - protein, 5 aa, Entamoeba histolytica
SEKEP

SEQ ID NO: 2654770 - protein, 17 aa, Entamoeba histolytica
SEKERKEKKGGGDLTGK

SEQ ID NO: 2654771 - protein, 8 aa, Entamoeba histolytica
SEKESDEN

SEQ ID NO: 2654772 - protein, 12 aa, Entamoeba histolytica
SEKEVDEKEQEV

SEQ ID NO: 2654773 - protein, 9 aa, Entamoeba histolytica
SEKFPDSAI

SEQ ID NO: 2654774 - protein, 16 aa, Entamoeba histolytica
SEKFTEDKDHGFVNVE

SEQ ID NO: 2654775 - protein, 8 aa, Entamoeba histolytica
SEKGCKEG

SEQ ID NO: 2654776 - protein, 6 aa, Entamoeba histolytica
SEKGEL

SEQ ID NO: 2654777 - protein, 22 aa, Entamoeba histolytica
SEKGKTKSDEMISENEQENEGL

SEQ ID NO: 2654778 - protein, 9 aa, Entamoeba histolytica
SEKGKVGEE

SEQ ID NO: 2654779 - protein, 7 aa, Entamoeba histolytica
SEKGVSR

SEQ ID NO: 2654780 - protein, 8 aa, Entamoeba histolytica
SEKGVSSI

SEQ ID NO: 2654781 - protein, 8 aa, Entamoeba histolytica
SEKIEGEY

SEQ ID NO: 2654782 - protein, 5 aa, Entamoeba histolytica
SEKIK

SEQ ID NO: 2654783 - protein, 7 aa, Entamoeba histolytica
SEKIPST

SEQ ID NO: 2654784 - protein, 12 aa, Entamoeba histolytica
SEKKDRPRKIPQ

SEQ ID NO: 2654785 - protein, 62 aa, Entamoeba histolytica
SEKKENKVQNNDKEVKKPKMPSSKTSKKKINKQIKSVTKEQETNEQLDSIEEQYDTKTETKI

SEQ ID NO: 2654786 - protein, 24 aa, Entamoeba histolytica
SEKKKDHDKHQNNEEEEEQNPCNG

SEQ ID NO: 2654787 - protein, 12 aa, Entamoeba histolytica
SEKKPDSRFKKD

SEQ ID NO: 2654788 - protein, 9 aa, Entamoeba histolytica
SEKKQNQRC

SEQ ID NO: 2654789 - protein, 12 aa, Entamoeba histolytica
SEKKRTKEEYNQ

SEQ ID NO: 2654790 - protein, 23 aa, Entamoeba histolytica
SEKKSEKNVIDNEVQEKQPQINK

SEQ ID NO: 2654791 - protein, 6 aa, Entamoeba histolytica
SEKKYN

SEQ ID NO: 2654792 - protein, 4 aa, Entamoeba histolytica
SEKL

SEQ ID NO: 2654793 - protein, 9 aa, Entamoeba histolytica
SEKLKSENK

SEQ ID NO: 2654794 - protein, 5 aa, Entamoeba histolytica
SEKLS

SEQ ID NO: 2654795 - protein, 4 aa, Entamoeba histolytica
SEKN

SEQ ID NO: 2654796 - protein, 8 aa, Entamoeba histolytica
SEKNTQRA

SEQ ID NO: 2654797 - protein, 8 aa, Entamoeba histolytica
SEKPRPPF

SEQ ID NO: 2654798 - protein, 8 aa, Entamoeba histolytica
SEKPTIYE

SEQ ID NO: 2654799 - protein, 13 aa, Entamoeba histolytica
SEKPTKRTENDPL

SEQ ID NO: 2654800 - protein, 5 aa, Entamoeba histolytica
SEKQS

SEQ ID NO: 2654801 - protein, 10 aa, Entamoeba histolytica
SEKRETVEQN

SEQ ID NO: 2654802 - protein, 5 aa, Entamoeba histolytica
SEKRG

SEQ ID NO: 2654803 - protein, 9 aa, Entamoeba histolytica
SEKRKGRRE

SEQ ID NO: 2654804 - protein, 29 aa, Entamoeba histolytica
SEKRNEIKTIQNQTRKIPNDDGENSIDEW

SEQ ID NO: 2654805 - protein, 8 aa, Entamoeba histolytica
SEKRNSRM

SEQ ID NO: 2654806 - protein, 4 aa, Entamoeba histolytica
SEKS

SEQ ID NO: 2654807 - protein, 6 aa, Entamoeba histolytica
SEKSIS

SEQ ID NO: 2654808 - protein, 11 aa, Entamoeba histolytica
SEKSKFERPWN

SEQ ID NO: 2654809 - protein, 5 aa, Entamoeba histolytica
SEKTD

SEQ ID NO: 2654810 - protein, 7 aa, Entamoeba histolytica
SEKTDGL

SEQ ID NO: 2654811 - protein, 7 aa, Entamoeba histolytica
SEKTDGV

SEQ ID NO: 2654812 - protein, 77 aa, Entamoeba histolytica
SEKTKTKENDETNKRNESERSHSSSKKKNNSKGKKKGSKKKGGSKKQNVSPSINEPKKSDVLEPSSKPPSRPIPNNK

SEQ ID NO: 2654813 - protein, 5 aa, Entamoeba histolytica
SEKVK

SEQ ID NO: 2654814 - protein, 5 aa, Entamoeba histolytica
SEKYE

SEQ ID NO: 2654815 - protein, 7 aa, Entamoeba histolytica
SEKYKKM

SEQ ID NO: 2654816 - protein, 15 aa, Entamoeba histolytica
SEKYTSKVDENYKLS

SEQ ID NO: 2654817 - protein, 5 aa, Entamoeba histolytica
SELAT

SEQ ID NO: 2654818 - protein, 8 aa, Entamoeba histolytica
SELDPSDF

SEQ ID NO: 2654819 - protein, 6 aa, Entamoeba histolytica
SELEDS

SEQ ID NO: 2654820 - protein, 6 aa, Entamoeba histolytica
SELEEK

SEQ ID NO: 2654821 - protein, 15 aa, Entamoeba histolytica
SELERQTPFKPNEPL

SEQ ID NO: 2654822 - protein, 5 aa, Entamoeba histolytica
SELGL

SEQ ID NO: 2654823 - protein, 14 aa, Entamoeba histolytica
SELGSEEAKEILSK

SEQ ID NO: 2654824 - protein, 10 aa, Entamoeba histolytica
SELGSRYYRP

SEQ ID NO: 2654825 - protein, 4 aa, Entamoeba histolytica
SELK

SEQ ID NO: 2654826 - protein, 13 aa, Entamoeba histolytica
SELKEAQSKKVLL

SEQ ID NO: 2654827 - protein, 14 aa, Entamoeba histolytica
SELKERYEKKMNDA

SEQ ID NO: 2654828 - protein, 7 aa, Entamoeba histolytica
SELKGDI

SEQ ID NO: 2654829 - protein, 5 aa, Entamoeba histolytica
SELLE

SEQ ID NO: 2654830 - protein, 5 aa, Entamoeba histolytica
SELNE

SEQ ID NO: 2654831 - protein, 17 aa, Entamoeba histolytica
SELNENNSLSITEKGKT

SEQ ID NO: 2654832 - protein, 50 aa, Entamoeba histolytica
SELNNKGSSTPSPMPPSSPLPPQSSPLPPTATPPVSTSQPHTASGRRPRY

SEQ ID NO: 2654833 - protein, 10 aa, Entamoeba histolytica
SELNRDGVKK

SEQ ID NO: 2654834 - protein, 11 aa, Entamoeba histolytica
SELQPYGLTQR

SEQ ID NO: 2654835 - protein, 5 aa, Entamoeba histolytica
SELRS

SEQ ID NO: 2654836 - protein, 16 aa, Entamoeba histolytica
SELSKEKELNNNSEID

SEQ ID NO: 2654837 - protein, 5 aa, Entamoeba histolytica
SELSL

SEQ ID NO: 2654838 - protein, 7 aa, Entamoeba histolytica
SELSSKN

SEQ ID NO: 2654839 - protein, 6 aa, Entamoeba histolytica
SELVPG

SEQ ID NO: 2654840 - protein, 4 aa, Entamoeba histolytica
SEMA

SEQ ID NO: 2654841 - protein, 10 aa, Entamoeba histolytica
SEMEEEKKEL

SEQ ID NO: 2654842 - protein, 7 aa, Entamoeba histolytica
SEMPKKG

SEQ ID NO: 2654843 - protein, 9 aa, Entamoeba histolytica
SEMSKSTRK

SEQ ID NO: 2654844 - protein, 9 aa, Entamoeba histolytica
SENDEQKPT

SEQ ID NO: 2654845 - protein, 11 aa, Entamoeba histolytica
SENDKKKLRDI

SEQ ID NO: 2654846 - protein, 6 aa, Entamoeba histolytica
SENDKR

SEQ ID NO: 2654847 - protein, 5 aa, Entamoeba histolytica
SENEC

SEQ ID NO: 2654848 - protein, 8 aa, Entamoeba histolytica
SENEKNPI

SEQ ID NO: 2654849 - protein, 5 aa, Entamoeba histolytica
SENEM

SEQ ID NO: 2654850 - protein, 20 aa, Entamoeba histolytica
SENEMPAAPSEVEEAKEEGV

SEQ ID NO: 2654851 - protein, 10 aa, Entamoeba histolytica
SENEQMNNEM

SEQ ID NO: 2654852 - protein, 11 aa, Entamoeba histolytica
SENETIKAERD

SEQ ID NO: 2654853 - protein, 8 aa, Entamoeba histolytica
SENETNPI

SEQ ID NO: 2654854 - protein, 5 aa, Entamoeba histolytica
SENGN

SEQ ID NO: 2654855 - protein, 9 aa, Entamoeba histolytica
SENGNTQTW

SEQ ID NO: 2654856 - protein, 19 aa, Entamoeba histolytica
SENHPKSFGKSMSRSGSVA

SEQ ID NO: 2654857 - protein, 12 aa, Entamoeba histolytica
SENIGEKLTINW

SEQ ID NO: 2654858 - protein, 5 aa, Entamoeba histolytica
SENIS

SEQ ID NO: 2654859 - protein, 4 aa, Entamoeba histolytica
SENK

SEQ ID NO: 2654860 - protein, 11 aa, Entamoeba histolytica
SENLAKNEDND

SEQ ID NO: 2654861 - protein, 15 aa, Entamoeba histolytica
SENLPKQSQFEVSTS

SEQ ID NO: 2654862 - protein, 9 aa, Entamoeba histolytica
SENNDITEN

SEQ ID NO: 2654863 - protein, 6 aa, Entamoeba histolytica
SENNLQ

SEQ ID NO: 2654864 - protein, 6 aa, Entamoeba histolytica
SENNSY

SEQ ID NO: 2654865 - protein, 5 aa, Entamoeba histolytica
SENPF

SEQ ID NO: 2654866 - protein, 7 aa, Entamoeba histolytica
SENPVCE

SEQ ID NO: 2654867 - protein, 9 aa, Entamoeba histolytica
SENPYEAPG

SEQ ID NO: 2654868 - protein, 11 aa, Entamoeba histolytica
SENQNKDSSDL

SEQ ID NO: 2654869 - protein, 8 aa, Entamoeba histolytica
SENQPTSP

SEQ ID NO: 2654870 - protein, 9 aa, Entamoeba histolytica
SENSDNRKI

SEQ ID NO: 2654871 - protein, 10 aa, Entamoeba histolytica
SENSNSSVIE

SEQ ID NO: 2654872 - protein, 8 aa, Entamoeba histolytica
SENSQLES

SEQ ID NO: 2654873 - protein, 6 aa, Entamoeba histolytica
SENSSL

SEQ ID NO: 2654874 - protein, 8 aa, Entamoeba histolytica
SENSTCSL

SEQ ID NO: 2654875 - protein, 9 aa, Entamoeba histolytica
SENSTTAKG

SEQ ID NO: 2654876 - protein, 7 aa, Entamoeba histolytica
SENSYYR

SEQ ID NO: 2654877 - protein, 5 aa, Entamoeba histolytica
SENVK

SEQ ID NO: 2654878 - protein, 19 aa, Entamoeba histolytica
SEPDERCDNIRSENEIERL

SEQ ID NO: 2654879 - protein, 10 aa, Entamoeba histolytica
SEPDHSGSLS

SEQ ID NO: 2654880 - protein, 5 aa, Entamoeba histolytica
SEPHV

SEQ ID NO: 2654881 - protein, 13 aa, Entamoeba histolytica
SEPITPSISTPRV

SEQ ID NO: 2654882 - protein, 5 aa, Entamoeba histolytica
SEPKE

SEQ ID NO: 2654883 - protein, 6 aa, Entamoeba histolytica
SEPKEI

SEQ ID NO: 2654884 - protein, 6 aa, Entamoeba histolytica
SEPKSP

SEQ ID NO: 2654885 - protein, 4 aa, Entamoeba histolytica
SEPN

SEQ ID NO: 2654886 - protein, 9 aa, Entamoeba histolytica
SEPNGNGFE

SEQ ID NO: 2654887 - protein, 5 aa, Entamoeba histolytica
SEPNK

SEQ ID NO: 2654888 - protein, 9 aa, Entamoeba histolytica
SEPNTLPYE

SEQ ID NO: 2654889 - protein, 7 aa, Entamoeba histolytica
SEPPIPT

SEQ ID NO: 2654890 - protein, 7 aa, Entamoeba histolytica
SEPPITE

SEQ ID NO: 2654891 - protein, 8 aa, Entamoeba histolytica
SEPPPSNC

SEQ ID NO: 2654892 - protein, 21 aa, Entamoeba histolytica
SEPPQVSPSNIKYGYSQPHPM

SEQ ID NO: 2654893 - protein, 6 aa, Entamoeba histolytica
SEPPTD

SEQ ID NO: 2654894 - protein, 6 aa, Entamoeba histolytica
SEPQIQ

SEQ ID NO: 2654895 - protein, 7 aa, Entamoeba histolytica
SEPSRTV

SEQ ID NO: 2654896 - protein, 7 aa, Entamoeba histolytica
SEPSVAD

SEQ ID NO: 2654897 - protein, 8 aa, Entamoeba histolytica
SEPTNNFG

SEQ ID NO: 2654898 - protein, 14 aa, Entamoeba histolytica
SEPTSTVISRSGDE

SEQ ID NO: 2654899 - protein, 5 aa, Entamoeba histolytica
SEPVS

SEQ ID NO: 2654900 - protein, 8 aa, Entamoeba histolytica
SEPVSSIS

SEQ ID NO: 2654901 - protein, 13 aa, Entamoeba histolytica
SEQAEKENDVETQ

SEQ ID NO: 2654902 - protein, 4 aa, Entamoeba histolytica
SEQD

SEQ ID NO: 2654903 - protein, 4 aa, Entamoeba histolytica
SEQF

SEQ ID NO: 2654904 - protein, 13 aa, Entamoeba histolytica
SEQGLKKQKTADL

SEQ ID NO: 2654905 - protein, 8 aa, Entamoeba histolytica
SEQGTPTL

SEQ ID NO: 2654906 - protein, 4 aa, Entamoeba histolytica
SEQI

SEQ ID NO: 2654907 - protein, 7 aa, Entamoeba histolytica
SEQIEQK

SEQ ID NO: 2654908 - protein, 11 aa, Entamoeba histolytica
SEQISLEEPNK

SEQ ID NO: 2654909 - protein, 8 aa, Entamoeba histolytica
SEQISTYK

SEQ ID NO: 2654910 - protein, 11 aa, Entamoeba histolytica
SEQKEKQDQWK

SEQ ID NO: 2654911 - protein, 6 aa, Entamoeba histolytica
SEQKNI

SEQ ID NO: 2654912 - protein, 5 aa, Entamoeba histolytica
SEQKY

SEQ ID NO: 2654913 - protein, 14 aa, Entamoeba histolytica
SEQLETLRKEILTI

SEQ ID NO: 2654914 - protein, 11 aa, Entamoeba histolytica
SEQLKKRSSRI

SEQ ID NO: 2654915 - protein, 4 aa, Entamoeba histolytica
SEQN

SEQ ID NO: 2654916 - protein, 7 aa, Entamoeba histolytica
SEQPQKL

SEQ ID NO: 2654917 - protein, 6 aa, Entamoeba histolytica
SEQQEK

SEQ ID NO: 2654918 - protein, 10 aa, Entamoeba histolytica
SEQQENNKIG

SEQ ID NO: 2654919 - protein, 7 aa, Entamoeba histolytica
SEQQSKL

SEQ ID NO: 2654920 - protein, 8 aa, Entamoeba histolytica
SEQRTTRL

SEQ ID NO: 2654921 - protein, 27 aa, Entamoeba histolytica
SEQSSQLKKYSQTTSSSSALSSNGSWS

SEQ ID NO: 2654922 - protein, 4 aa, Entamoeba histolytica
SEQV

SEQ ID NO: 2654923 - protein, 5 aa, Entamoeba histolytica
SEQYE

SEQ ID NO: 2654924 - protein, 4 aa, Entamoeba histolytica
SERA

SEQ ID NO: 2654925 - protein, 6 aa, Entamoeba histolytica
SERASD

SEQ ID NO: 2654926 - protein, 13 aa, Entamoeba histolytica
SERCGNEIEKGRS

SEQ ID NO: 2654927 - protein, 7 aa, Entamoeba histolytica
SERDPLE

SEQ ID NO: 2654928 - protein, 4 aa, Entamoeba histolytica
SERE

SEQ ID NO: 2654929 - protein, 6 aa, Entamoeba histolytica
SERFNE

SEQ ID NO: 2654930 - protein, 25 aa, Entamoeba histolytica
SERHESPDRSNCQPHSQPNHTTRPE

SEQ ID NO: 2654931 - protein, 22 aa, Entamoeba histolytica
SERHQKGEEIRTRQKHIKQAKR

SEQ ID NO: 2654932 - protein, 29 aa, Entamoeba histolytica
SERIKKEEERNEERRKEIEEIKQQRKENV

SEQ ID NO: 2654933 - protein, 11 aa, Entamoeba histolytica
SERKEENNTEI

SEQ ID NO: 2654934 - protein, 40 aa, Entamoeba histolytica
SERKERREKKRQQIEKEKEKLRKMEESRKERTMKKEELKR

SEQ ID NO: 2654935 - protein, 10 aa, Entamoeba histolytica
SERKGNGTQF

SEQ ID NO: 2654936 - protein, 12 aa, Entamoeba histolytica
SERKKASLSLET

SEQ ID NO: 2654937 - protein, 6 aa, Entamoeba histolytica
SERLDD

SEQ ID NO: 2654938 - protein, 7 aa, Entamoeba histolytica
SERMKEK

SEQ ID NO: 2654939 - protein, 7 aa, Entamoeba histolytica
SERNEWE

SEQ ID NO: 2654940 - protein, 6 aa, Entamoeba histolytica
SERNNK

SEQ ID NO: 2654941 - protein, 6 aa, Entamoeba histolytica
SERPRM

SEQ ID NO: 2654942 - protein, 13 aa, Entamoeba histolytica
SERRKEKDERLNE

SEQ ID NO: 2654943 - protein, 4 aa, Entamoeba histolytica
SERS

SEQ ID NO: 2654944 - protein, 15 aa, Entamoeba histolytica
SERSINKEETGKSFG

SEQ ID NO: 2654945 - protein, 7 aa, Entamoeba histolytica
SERSSPK

SEQ ID NO: 2654946 - protein, 6 aa, Entamoeba histolytica
SERVKT

SEQ ID NO: 2654947 - protein, 5 aa, Entamoeba histolytica
SERVQ

SEQ ID NO: 2654948 - protein, 5 aa, Entamoeba histolytica
SERVR

SEQ ID NO: 2654949 - protein, 8 aa, Entamoeba histolytica
SERVSTQK

SEQ ID NO: 2654950 - protein, 11 aa, Entamoeba histolytica
SESAEEPKRTI

SEQ ID NO: 2654951 - protein, 5 aa, Entamoeba histolytica
SESDI

SEQ ID NO: 2654952 - protein, 7 aa, Entamoeba histolytica
SESEINR

SEQ ID NO: 2654953 - protein, 4 aa, Entamoeba histolytica
SESF

SEQ ID NO: 2654954 - protein, 14 aa, Entamoeba histolytica
SESFRNGPKLSNEK

SEQ ID NO: 2654955 - protein, 10 aa, Entamoeba histolytica
SESFSSGRLT

SEQ ID NO: 2654956 - protein, 11 aa, Entamoeba histolytica
SESFSSSELNA

SEQ ID NO: 2654957 - protein, 9 aa, Entamoeba histolytica
SESGEANEI

SEQ ID NO: 2654958 - protein, 9 aa, Entamoeba histolytica
SESGTEGEV

SEQ ID NO: 2654959 - protein, 8 aa, Entamoeba histolytica
SESHKPQF

SEQ ID NO: 2654960 - protein, 8 aa, Entamoeba histolytica
SESIDDQN

SEQ ID NO: 2654961 - protein, 23 aa, Entamoeba histolytica
SESIKELEKSKETEDPTEDKGIK

SEQ ID NO: 2654962 - protein, 22 aa, Entamoeba histolytica
SESIKGARVTHGTNKPPKEKME

SEQ ID NO: 2654963 - protein, 13 aa, Entamoeba histolytica
SESIKSGRITAST

SEQ ID NO: 2654964 - protein, 4 aa, Entamoeba histolytica
SESK

SEQ ID NO: 2654965 - protein, 7 aa, Entamoeba histolytica
SESKTSF

SEQ ID NO: 2654966 - protein, 4 aa, Entamoeba histolytica
SESL

SEQ ID NO: 2654967 - protein, 7 aa, Entamoeba histolytica
SESMQHG

SEQ ID NO: 2654968 - protein, 13 aa, Entamoeba histolytica
SESNAQNKERPRK

SEQ ID NO: 2654969 - protein, 10 aa, Entamoeba histolytica
SESNENNQQN

SEQ ID NO: 2654970 - protein, 5 aa, Entamoeba histolytica
SESNG

SEQ ID NO: 2654971 - protein, 8 aa, Entamoeba histolytica
SESNYDSF

SEQ ID NO: 2654972 - protein, 10 aa, Entamoeba histolytica
SESPDLDNVN

SEQ ID NO: 2654973 - protein, 5 aa, Entamoeba histolytica
SESPF

SEQ ID NO: 2654974 - protein, 15 aa, Entamoeba histolytica
SESPFNSNSQKKDDI

SEQ ID NO: 2654975 - protein, 7 aa, Entamoeba histolytica
SESPGEC

SEQ ID NO: 2654976 - protein, 51 aa, Entamoeba histolytica
SESPSSSSSASSSYSEERYSRDKKEKKKSEKKPKKEGARELKRRKKEEIAT

SEQ ID NO: 2654977 - protein, 6 aa, Entamoeba histolytica
SESQKD

SEQ ID NO: 2654978 - protein, 13 aa, Entamoeba histolytica
SESRGSFSTPQSI

SEQ ID NO: 2654979 - protein, 7 aa, Entamoeba histolytica
SESRKLN

SEQ ID NO: 2654980 - protein, 9 aa, Entamoeba histolytica
SESSDDLKQ

SEQ ID NO: 2654981 - protein, 10 aa, Entamoeba histolytica
SESSTKRYVP

SEQ ID NO: 2654982 - protein, 7 aa, Entamoeba histolytica
SESTDEN

SEQ ID NO: 2654983 - protein, 8 aa, Entamoeba histolytica
SESTFSSR

SEQ ID NO: 2654984 - protein, 6 aa, Entamoeba histolytica
SESTMN

SEQ ID NO: 2654985 - protein, 22 aa, Entamoeba histolytica
SESTNEKRSVDQSNANISKPRN

SEQ ID NO: 2654986 - protein, 4 aa, Entamoeba histolytica
SESV

SEQ ID NO: 2654987 - protein, 13 aa, Entamoeba histolytica
SESVASCKPAEGE

SEQ ID NO: 2654988 - protein, 7 aa, Entamoeba histolytica
SESVIDN

SEQ ID NO: 2654989 - protein, 6 aa, Entamoeba histolytica
SESYDE

SEQ ID NO: 2654990 - protein, 4 aa, Entamoeba histolytica
SETA

SEQ ID NO: 2654991 - protein, 11 aa, Entamoeba histolytica
SETCQGDEQET

SEQ ID NO: 2654992 - protein, 10 aa, Entamoeba histolytica
SETDQNESHQ

SEQ ID NO: 2654993 - protein, 7 aa, Entamoeba histolytica
SETEEEI

SEQ ID NO: 2654994 - protein, 13 aa, Entamoeba histolytica
SETEIGESHDKAD

SEQ ID NO: 2654995 - protein, 7 aa, Entamoeba histolytica
SETEQNY

SEQ ID NO: 2654996 - protein, 7 aa, Entamoeba histolytica
SETFDKD

SEQ ID NO: 2654997 - protein, 9 aa, Entamoeba histolytica
SETGEPSTI

SEQ ID NO: 2654998 - protein, 21 aa, Entamoeba histolytica
SETGPHPKQDEEEEKGTPSIQ

SEQ ID NO: 2654999 - protein, 4 aa, Entamoeba histolytica
SETK

SEQ ID NO: 2655000 - protein, 22 aa, Entamoeba histolytica
SETKATTVAADVSKDPTYPKTT

SEQ ID NO: 2655001 - protein, 68 aa, Entamoeba histolytica
SETKMPEEVEEEDSDDSHTKETQTTETDTQQDESDELEKKVKKTKKARKTVKRNGLKYDSSTYASFHF

SEQ ID NO: 2655002 - protein, 9 aa, Entamoeba histolytica
SETKMSEQE

SEQ ID NO: 2655003 - protein, 5 aa, Entamoeba histolytica
SETKP

SEQ ID NO: 2655004 - protein, 4 aa, Entamoeba histolytica
SETN

SEQ ID NO: 2655005 - protein, 12 aa, Entamoeba histolytica
SETNGKDEITQL

SEQ ID NO: 2655006 - protein, 8 aa, Entamoeba histolytica
SETNPTDC

SEQ ID NO: 2655007 - protein, 10 aa, Entamoeba histolytica
SETPKGEYKE

SEQ ID NO: 2655008 - protein, 4 aa, Entamoeba histolytica
SETQ

SEQ ID NO: 2655009 - protein, 18 aa, Entamoeba histolytica
SETQSIKISTNDHLSTRS

SEQ ID NO: 2655010 - protein, 10 aa, Entamoeba histolytica
SETSQTQNDI

SEQ ID NO: 2655011 - protein, 9 aa, Entamoeba histolytica
SETTGYNKD

SEQ ID NO: 2655012 - protein, 6 aa, Entamoeba histolytica
SETTKE

SEQ ID NO: 2655013 - protein, 5 aa, Entamoeba histolytica
SETTN

SEQ ID NO: 2655014 - protein, 6 aa, Entamoeba histolytica
SETTQQ

SEQ ID NO: 2655015 - protein, 13 aa, Entamoeba histolytica
SETTYSNASRRQG

SEQ ID NO: 2655016 - protein, 6 aa, Entamoeba histolytica
SETVDT

SEQ ID NO: 2655017 - protein, 6 aa, Entamoeba histolytica
SETVSQ

SEQ ID NO: 2655018 - protein, 12 aa, Entamoeba histolytica
SETYEQKSKRKQ

SEQ ID NO: 2655019 - protein, 10 aa, Entamoeba histolytica
SEVDEGMNKE

SEQ ID NO: 2655020 - protein, 5 aa, Entamoeba histolytica
SEVEN

SEQ ID NO: 2655021 - protein, 41 aa, Entamoeba histolytica
SEVERERNKREERAERRRAERKEERKERNKQEEENENIKEK

SEQ ID NO: 2655022 - protein, 6 aa, Entamoeba histolytica
SEVESK

SEQ ID NO: 2655023 - protein, 13 aa, Entamoeba histolytica
SEVGRDNARTPMQ

SEQ ID NO: 2655024 - protein, 8 aa, Entamoeba histolytica
SEVGSVRR

SEQ ID NO: 2655025 - protein, 22 aa, Entamoeba histolytica
SEVKPEEPKEEKRQAKTKSSKV

SEQ ID NO: 2655026 - protein, 5 aa, Entamoeba histolytica
SEVND

SEQ ID NO: 2655027 - protein, 4 aa, Entamoeba histolytica
SEVP

SEQ ID NO: 2655028 - protein, 12 aa, Entamoeba histolytica
SEVPSSPKEELN

SEQ ID NO: 2655029 - protein, 4 aa, Entamoeba histolytica
SEVQ

SEQ ID NO: 2655030 - protein, 8 aa, Entamoeba histolytica
SEVQENTD

SEQ ID NO: 2655031 - protein, 4 aa, Entamoeba histolytica
SEVT

SEQ ID NO: 2655032 - protein, 9 aa, Entamoeba histolytica
SEVTGNRKE

SEQ ID NO: 2655033 - protein, 20 aa, Entamoeba histolytica
SEVTSNAPKDVFNEAKKATE

SEQ ID NO: 2655034 - protein, 9 aa, Entamoeba histolytica
SEWDPDSPE

SEQ ID NO: 2655035 - protein, 9 aa, Entamoeba histolytica
SEWEGQKRI

SEQ ID NO: 2655036 - protein, 12 aa, Entamoeba histolytica
SEWGKGKEEFET

SEQ ID NO: 2655037 - protein, 9 aa, Entamoeba histolytica
SEWSNSTSF

SEQ ID NO: 2655038 - protein, 8 aa, Entamoeba histolytica
SEWTPKED

SEQ ID NO: 2655039 - protein, 4 aa, Entamoeba histolytica
SEYE

SEQ ID NO: 2655040 - protein, 12 aa, Entamoeba histolytica
SEYEEKKKNRLS

SEQ ID NO: 2655041 - protein, 5 aa, Entamoeba histolytica
SEYEY

SEQ ID NO: 2655042 - protein, 7 aa, Entamoeba histolytica
SEYGTDP

SEQ ID NO: 2655043 - protein, 7 aa, Entamoeba histolytica
SEYPDGI

SEQ ID NO: 2655044 - protein, 5 aa, Entamoeba histolytica
SEYPE

SEQ ID NO: 2655045 - protein, 5 aa, Entamoeba histolytica
SEYPT

SEQ ID NO: 2655046 - protein, 7 aa, Entamoeba histolytica
SEYQEIR

SEQ ID NO: 2655047 - protein, 8 aa, Entamoeba histolytica
SEYQKKTP

SEQ ID NO: 2655048 - protein, 5 aa, Entamoeba histolytica
SEYQN

SEQ ID NO: 2655049 - protein, 6 aa, Entamoeba histolytica
SEYSQK

SEQ ID NO: 2655050 - protein, 34 aa, Entamoeba histolytica
SEYTSEAGGSRGSSYRTPTLGSAPDSPRKTHTDK

SEQ ID NO: 2655051 - protein, 8 aa, Entamoeba histolytica
SEYYDKRP

SEQ ID NO: 2655052 - protein, 11 aa, Entamoeba histolytica
SEYYNQGRKSF

SEQ ID NO: 2655053 - protein, 6 aa, Entamoeba histolytica
SFADSN

SEQ ID NO: 2655054 - protein, 12 aa, Entamoeba histolytica
SFAEVKEGDDSF

SEQ ID NO: 2655055 - protein, 4 aa, Entamoeba histolytica
SFAK

SEQ ID NO: 2655056 - protein, 19 aa, Entamoeba histolytica
SFAKQPQWKQKNAKARVGL

SEQ ID NO: 2655057 - protein, 5 aa, Entamoeba histolytica
SFANN

SEQ ID NO: 2655058 - protein, 16 aa, Entamoeba histolytica
SFASAGGYIASDKNTI

SEQ ID NO: 2655059 - protein, 23 aa, Entamoeba histolytica
SFATRKKYSAIETKGSGNAGYNS

SEQ ID NO: 2655060 - protein, 11 aa, Entamoeba histolytica
SFDDEDDVNEI

SEQ ID NO: 2655061 - protein, 23 aa, Entamoeba histolytica
SFDEADQDKKQLHTNHDSHQQSL

SEQ ID NO: 2655062 - protein, 5 aa, Entamoeba histolytica
SFDKN

SEQ ID NO: 2655063 - protein, 10 aa, Entamoeba histolytica
SFDNQRRTEL

SEQ ID NO: 2655064 - protein, 10 aa, Entamoeba histolytica
SFDNSDLKKK

SEQ ID NO: 2655065 - protein, 7 aa, Entamoeba histolytica
SFDPPEL

SEQ ID NO: 2655066 - protein, 6 aa, Entamoeba histolytica
SFDPTG

SEQ ID NO: 2655067 - protein, 4 aa, Entamoeba histolytica
SFDS

SEQ ID NO: 2655068 - protein, 17 aa, Entamoeba histolytica
SFDSEAANSYKSAITAG

SEQ ID NO: 2655069 - protein, 9 aa, Entamoeba histolytica
SFDSNTVGT

SEQ ID NO: 2655070 - protein, 7 aa, Entamoeba histolytica
SFDSSQY

SEQ ID NO: 2655071 - protein, 5 aa, Entamoeba histolytica
SFDTN

SEQ ID NO: 2655072 - protein, 7 aa, Entamoeba histolytica
SFEDQHN

SEQ ID NO: 2655073 - protein, 16 aa, Entamoeba histolytica
SFEDSDEEKEQTKTIK

SEQ ID NO: 2655074 - protein, 21 aa, Entamoeba histolytica
SFEEEGLKEFKGKTIQLPFIL

SEQ ID NO: 2655075 - protein, 23 aa, Entamoeba histolytica
SFEEENNETDNPTDTKQDAKSDH

SEQ ID NO: 2655076 - protein, 21 aa, Entamoeba histolytica
SFENIDNKENSNKEKKPKKNL

SEQ ID NO: 2655077 - protein, 5 aa, Entamoeba histolytica
SFENN

SEQ ID NO: 2655078 - protein, 6 aa, Entamoeba histolytica
SFENTD

SEQ ID NO: 2655079 - protein, 4 aa, Entamoeba histolytica
SFEP

SEQ ID NO: 2655080 - protein, 26 aa, Entamoeba histolytica
SFEPKEKNKVEQKMNGETDSDDEQDI

SEQ ID NO: 2655081 - protein, 6 aa, Entamoeba histolytica
SFEPYS

SEQ ID NO: 2655082 - protein, 4 aa, Entamoeba histolytica
SFEQ

SEQ ID NO: 2655083 - protein, 10 aa, Entamoeba histolytica
SFETNNTSAI

SEQ ID NO: 2655084 - protein, 24 aa, Entamoeba histolytica
SFGDFEAPSVDSSQSKNDESKKSF

SEQ ID NO: 2655085 - protein, 10 aa, Entamoeba histolytica
SFGGEDAPEP

SEQ ID NO: 2655086 - protein, 9 aa, Entamoeba histolytica
SFGGKGDTY

SEQ ID NO: 2655087 - protein, 5 aa, Entamoeba histolytica
SFGGN

SEQ ID NO: 2655088 - protein, 4 aa, Entamoeba histolytica
SFGN

SEQ ID NO: 2655089 - protein, 16 aa, Entamoeba histolytica
SFGPKTNTENKPTNVT

SEQ ID NO: 2655090 - protein, 5 aa, Entamoeba histolytica
SFGPV

SEQ ID NO: 2655091 - protein, 17 aa, Entamoeba histolytica
SFGQSWSKNHPMIMPQD

SEQ ID NO: 2655092 - protein, 28 aa, Entamoeba histolytica
SFGQTNQQQNGFGSFGQTNQQQNGFGGF

SEQ ID NO: 2655093 - protein, 49 aa, Entamoeba histolytica
SFGRYPPVRQAQNSHLTTPQGYPITASTSSIQPNPHNNFRNSSCSLTSS

SEQ ID NO: 2655094 - protein, 10 aa, Entamoeba histolytica
SFGSSTSKTR

SEQ ID NO: 2655095 - protein, 4 aa, Entamoeba histolytica
SFHP

SEQ ID NO: 2655096 - protein, 4 aa, Entamoeba histolytica
SFIS

SEQ ID NO: 2655097 - protein, 9 aa, Entamoeba histolytica
SFKEKYKEH

SEQ ID NO: 2655098 - protein, 4 aa, Entamoeba histolytica
SFKG

SEQ ID NO: 2655099 - protein, 9 aa, Entamoeba histolytica
SFKKRAPKA

SEQ ID NO: 2655100 - protein, 9 aa, Entamoeba histolytica
SFKKRSTEW

SEQ ID NO: 2655101 - protein, 6 aa, Entamoeba histolytica
SFKPPV

SEQ ID NO: 2655102 - protein, 5 aa, Entamoeba histolytica
SFKRY

SEQ ID NO: 2655103 - protein, 9 aa, Entamoeba histolytica
SFKSSEMTD

SEQ ID NO: 2655104 - protein, 4 aa, Entamoeba histolytica
SFKT

SEQ ID NO: 2655105 - protein, 9 aa, Entamoeba histolytica
SFNESTSSF

SEQ ID NO: 2655106 - protein, 5 aa, Entamoeba histolytica
SFNPY

SEQ ID NO: 2655107 - protein, 14 aa, Entamoeba histolytica
SFNQDTTIKPNADI

SEQ ID NO: 2655108 - protein, 5 aa, Entamoeba histolytica
SFNSF

SEQ ID NO: 2655109 - protein, 10 aa, Entamoeba histolytica
SFNSQNSCSF

SEQ ID NO: 2655110 - protein, 14 aa, Entamoeba histolytica
SFNTESQKEHNTTI

SEQ ID NO: 2655111 - protein, 9 aa, Entamoeba histolytica
SFPEGDYSE

SEQ ID NO: 2655112 - protein, 6 aa, Entamoeba histolytica
SFPGET

SEQ ID NO: 2655113 - protein, 7 aa, Entamoeba histolytica
SFPKQSS

SEQ ID NO: 2655114 - protein, 6 aa, Entamoeba histolytica
SFPLTD

SEQ ID NO: 2655115 - protein, 18 aa, Entamoeba histolytica
SFPNQEFSSPPTSPRNNK

SEQ ID NO: 2655116 - protein, 4 aa, Entamoeba histolytica
SFPP

SEQ ID NO: 2655117 - protein, 7 aa, Entamoeba histolytica
SFPPSRS

SEQ ID NO: 2655118 - protein, 7 aa, Entamoeba histolytica
SFPPTDP

SEQ ID NO: 2655119 - protein, 4 aa, Entamoeba histolytica
SFPQ

SEQ ID NO: 2655120 - protein, 5 aa, Entamoeba histolytica
SFPQY

SEQ ID NO: 2655121 - protein, 6 aa, Entamoeba histolytica
SFPRDT

SEQ ID NO: 2655122 - protein, 6 aa, Entamoeba histolytica
SFPSGE

SEQ ID NO: 2655123 - protein, 13 aa, Entamoeba histolytica
SFPSKDDQSTISL

SEQ ID NO: 2655124 - protein, 5 aa, Entamoeba histolytica
SFPSS

SEQ ID NO: 2655125 - protein, 4 aa, Entamoeba histolytica
SFPT

SEQ ID NO: 2655126 - protein, 5 aa, Entamoeba histolytica
SFPTL

SEQ ID NO: 2655127 - protein, 5 aa, Entamoeba histolytica
SFPYS

SEQ ID NO: 2655128 - protein, 6 aa, Entamoeba histolytica
SFQGRE

SEQ ID NO: 2655129 - protein, 11 aa, Entamoeba histolytica
SFQGRTPNSLK

SEQ ID NO: 2655130 - protein, 12 aa, Entamoeba histolytica
SFQKEIGKEEYK

SEQ ID NO: 2655131 - protein, 8 aa, Entamoeba histolytica
SFQNGQNG

SEQ ID NO: 2655132 - protein, 12 aa, Entamoeba histolytica
SFQPQPTTTSFQ

SEQ ID NO: 2655133 - protein, 5 aa, Entamoeba histolytica
SFQPT

SEQ ID NO: 2655134 - protein, 5 aa, Entamoeba histolytica
SFQQK

SEQ ID NO: 2655135 - protein, 9 aa, Entamoeba histolytica
SFQQKTPDH

SEQ ID NO: 2655136 - protein, 4 aa, Entamoeba histolytica
SFQR

SEQ ID NO: 2655137 - protein, 7 aa, Entamoeba histolytica
SFQSSES

SEQ ID NO: 2655138 - protein, 15 aa, Entamoeba histolytica
SFQSSKHSYGSHDSD

SEQ ID NO: 2655139 - protein, 9 aa, Entamoeba histolytica
SFQTSTDPK

SEQ ID NO: 2655140 - protein, 7 aa, Entamoeba histolytica
SFRDSKQ

SEQ ID NO: 2655141 - protein, 44 aa, Entamoeba histolytica
SFREGNPSLFKSTNSNEQKIVKPDQPISEDKSQPQLSKKEQMSI

SEQ ID NO: 2655142 - protein, 17 aa, Entamoeba histolytica
SFREKKKEGIENEKRAQ

SEQ ID NO: 2655143 - protein, 11 aa, Entamoeba histolytica
SFRGKDEKKDK

SEQ ID NO: 2655144 - protein, 13 aa, Entamoeba histolytica
SFRKTRNVQANQQ

SEQ ID NO: 2655145 - protein, 10 aa, Entamoeba histolytica
SFRSKKNWKY

SEQ ID NO: 2655146 - protein, 4 aa, Entamoeba histolytica
SFSD

SEQ ID NO: 2655147 - protein, 15 aa, Entamoeba histolytica
SFSDSDDDLWSGEQT

SEQ ID NO: 2655148 - protein, 15 aa, Entamoeba histolytica
SFSEVGKGQEVYSET

SEQ ID NO: 2655149 - protein, 13 aa, Entamoeba histolytica
SFSGESDQAPGII

SEQ ID NO: 2655150 - protein, 21 aa, Entamoeba histolytica
SFSIPQSPREYEKKISRTSSK

SEQ ID NO: 2655151 - protein, 6 aa, Entamoeba histolytica
SFSKKD

SEQ ID NO: 2655152 - protein, 6 aa, Entamoeba histolytica
SFSKPT

SEQ ID NO: 2655153 - protein, 37 aa, Entamoeba histolytica
SFSKRNSTENTGHSSSEHSATSSLASETTAEEVNRSV

SEQ ID NO: 2655154 - protein, 28 aa, Entamoeba histolytica
SFSKTTDANSLKSAVQSFQQAAGAFQKA

SEQ ID NO: 2655155 - protein, 6 aa, Entamoeba histolytica
SFSNEY

SEQ ID NO: 2655156 - protein, 5 aa, Entamoeba histolytica
SFSNS

SEQ ID NO: 2655157 - protein, 18 aa, Entamoeba histolytica
SFSPATTNVAAASDAVDE

SEQ ID NO: 2655158 - protein, 7 aa, Entamoeba histolytica
SFSPDGQ

SEQ ID NO: 2655159 - protein, 12 aa, Entamoeba histolytica
SFSPSRRAFTPR

SEQ ID NO: 2655160 - protein, 6 aa, Entamoeba histolytica
SFSQTE

SEQ ID NO: 2655161 - protein, 12 aa, Entamoeba histolytica
SFSSSDYSSPKT

SEQ ID NO: 2655162 - protein, 7 aa, Entamoeba histolytica
SFSTSTL

SEQ ID NO: 2655163 - protein, 5 aa, Entamoeba histolytica
SFTAG

SEQ ID NO: 2655164 - protein, 20 aa, Entamoeba histolytica
SFTDKNGSFYSGASLNEKEN

SEQ ID NO: 2655165 - protein, 11 aa, Entamoeba histolytica
SFTEEDYQETT

SEQ ID NO: 2655166 - protein, 10 aa, Entamoeba histolytica
SFTEGTGIEN

SEQ ID NO: 2655167 - protein, 7 aa, Entamoeba histolytica
SFTGKTS

SEQ ID NO: 2655168 - protein, 8 aa, Entamoeba histolytica
SFTNGNNH

SEQ ID NO: 2655169 - protein, 7 aa, Entamoeba histolytica
SFTPARD

SEQ ID NO: 2655170 - protein, 22 aa, Entamoeba histolytica
SFTPRTPRVESPQIPEQKDDFE

SEQ ID NO: 2655171 - protein, 8 aa, Entamoeba histolytica
SFTPSPKL

SEQ ID NO: 2655172 - protein, 4 aa, Entamoeba histolytica
SFTT

SEQ ID NO: 2655173 - protein, 4 aa, Entamoeba histolytica
SFVG

SEQ ID NO: 2655174 - protein, 12 aa, Entamoeba histolytica
SFYTPDGPTPEE

SEQ ID NO: 2655175 - protein, 4 aa, Entamoeba histolytica
SGAA

SEQ ID NO: 2655176 - protein, 10 aa, Entamoeba histolytica
SGADHASEFK

SEQ ID NO: 2655177 - protein, 11 aa, Entamoeba histolytica
SGAKKIKELTG

SEQ ID NO: 2655178 - protein, 9 aa, Entamoeba histolytica
SGAKLKGDM

SEQ ID NO: 2655179 - protein, 8 aa, Entamoeba histolytica
SGAKLTTA

SEQ ID NO: 2655180 - protein, 10 aa, Entamoeba histolytica
SGANPTNATN

SEQ ID NO: 2655181 - protein, 6 aa, Entamoeba histolytica
SGAQSN

SEQ ID NO: 2655182 - protein, 11 aa, Entamoeba histolytica
SGARKGGNVGG

SEQ ID NO: 2655183 - protein, 4 aa, Entamoeba histolytica
SGAT

SEQ ID NO: 2655184 - protein, 8 aa, Entamoeba histolytica
SGATSLNS

SEQ ID NO: 2655185 - protein, 13 aa, Entamoeba histolytica
SGATTNNGFKGTK

SEQ ID NO: 2655186 - protein, 11 aa, Entamoeba histolytica
SGAYTDKQCKN

SEQ ID NO: 2655187 - protein, 9 aa, Entamoeba histolytica
SGCADELKR

SEQ ID NO: 2655188 - protein, 5 aa, Entamoeba histolytica
SGCDG

SEQ ID NO: 2655189 - protein, 8 aa, Entamoeba histolytica
SGCGKTSL

SEQ ID NO: 2655190 - protein, 17 aa, Entamoeba histolytica
SGCGNEESLKKDPPDIV

SEQ ID NO: 2655191 - protein, 18 aa, Entamoeba histolytica
SGCLTDEEKIQKEEESEE

SEQ ID NO: 2655192 - protein, 4 aa, Entamoeba histolytica
SGCS

SEQ ID NO: 2655193 - protein, 7 aa, Entamoeba histolytica
SGCTLSP

SEQ ID NO: 2655194 - protein, 15 aa, Entamoeba histolytica
SGCYRDKDRTSQYQI

SEQ ID NO: 2655195 - protein, 6 aa, Entamoeba histolytica
SGDALS

SEQ ID NO: 2655196 - protein, 6 aa, Entamoeba histolytica
SGDANG

SEQ ID NO: 2655197 - protein, 16 aa, Entamoeba histolytica
SGDDDKRKRKNDLSNE

SEQ ID NO: 2655198 - protein, 5 aa, Entamoeba histolytica
SGDDK

SEQ ID NO: 2655199 - protein, 6 aa, Entamoeba histolytica
SGDDVG

SEQ ID NO: 2655200 - protein, 10 aa, Entamoeba histolytica
SGDENGHTQF

SEQ ID NO: 2655201 - protein, 6 aa, Entamoeba histolytica
SGDERY

SEQ ID NO: 2655202 - protein, 6 aa, Entamoeba histolytica
SGDFIT

SEQ ID NO: 2655203 - protein, 4 aa, Entamoeba histolytica
SGDI

SEQ ID NO: 2655204 - protein, 10 aa, Entamoeba histolytica
SGDIGSNSED

SEQ ID NO: 2655205 - protein, 7 aa, Entamoeba histolytica
SGDIRTA

SEQ ID NO: 2655206 - protein, 13 aa, Entamoeba histolytica
SGDKKKINEHSQY

SEQ ID NO: 2655207 - protein, 19 aa, Entamoeba histolytica
SGDKNVKVTKSKSERKGNA

SEQ ID NO: 2655208 - protein, 8 aa, Entamoeba histolytica
SGDKTELN

SEQ ID NO: 2655209 - protein, 7 aa, Entamoeba histolytica
SGDKTPA

SEQ ID NO: 2655210 - protein, 6 aa, Entamoeba histolytica
SGDKYR

SEQ ID NO: 2655211 - protein, 7 aa, Entamoeba histolytica
SGDNHRF

SEQ ID NO: 2655212 - protein, 7 aa, Entamoeba histolytica
SGDNYAS

SEQ ID NO: 2655213 - protein, 6 aa, Entamoeba histolytica
SGDQEV

SEQ ID NO: 2655214 - protein, 10 aa, Entamoeba histolytica
SGDQNQINNL

SEQ ID NO: 2655215 - protein, 9 aa, Entamoeba histolytica
SGDQRKAAS

SEQ ID NO: 2655216 - protein, 5 aa, Entamoeba histolytica
SGDQS

SEQ ID NO: 2655217 - protein, 9 aa, Entamoeba histolytica
SGDSDTVQV

SEQ ID NO: 2655218 - protein, 5 aa, Entamoeba histolytica
SGDYI

SEQ ID NO: 2655219 - protein, 9 aa, Entamoeba histolytica
SGDYNPHTI

SEQ ID NO: 2655220 - protein, 6 aa, Entamoeba histolytica
SGEAGR

SEQ ID NO: 2655221 - protein, 6 aa, Entamoeba histolytica
SGEAIQ

SEQ ID NO: 2655222 - protein, 11 aa, Entamoeba histolytica
SGEDGCPFDST

SEQ ID NO: 2655223 - protein, 5 aa, Entamoeba histolytica
SGEEY

SEQ ID NO: 2655224 - protein, 4 aa, Entamoeba histolytica
SGEF

SEQ ID NO: 2655225 - protein, 12 aa, Entamoeba histolytica
SGEFNPNTASSI

SEQ ID NO: 2655226 - protein, 9 aa, Entamoeba histolytica
SGEGGNPTI

SEQ ID NO: 2655227 - protein, 5 aa, Entamoeba histolytica
SGEGH

SEQ ID NO: 2655228 - protein, 7 aa, Entamoeba histolytica
SGEGSVE

SEQ ID NO: 2655229 - protein, 15 aa, Entamoeba histolytica
SGEIKEIEDTITDKY

SEQ ID NO: 2655230 - protein, 5 aa, Entamoeba histolytica
SGEIP

SEQ ID NO: 2655231 - protein, 7 aa, Entamoeba histolytica
SGEISRQ

SEQ ID NO: 2655232 - protein, 5 aa, Entamoeba histolytica
SGEKK

SEQ ID NO: 2655233 - protein, 13 aa, Entamoeba histolytica
SGEKSKAKEESER

SEQ ID NO: 2655234 - protein, 5 aa, Entamoeba histolytica
SGEKV

SEQ ID NO: 2655235 - protein, 6 aa, Entamoeba histolytica
SGELTE

SEQ ID NO: 2655236 - protein, 17 aa, Entamoeba histolytica
SGENQSLETKENSNQFL

SEQ ID NO: 2655237 - protein, 6 aa, Entamoeba histolytica
SGEPKL

SEQ ID NO: 2655238 - protein, 8 aa, Entamoeba histolytica
SGEPSLAD

SEQ ID NO: 2655239 - protein, 9 aa, Entamoeba histolytica
SGERGPSLA

SEQ ID NO: 2655240 - protein, 5 aa, Entamoeba histolytica
SGERL

SEQ ID NO: 2655241 - protein, 8 aa, Entamoeba histolytica
SGESAVGN

SEQ ID NO: 2655242 - protein, 10 aa, Entamoeba histolytica
SGESCDTDNG

SEQ ID NO: 2655243 - protein, 10 aa, Entamoeba histolytica
SGESGKSTIA

SEQ ID NO: 2655244 - protein, 8 aa, Entamoeba histolytica
SGESYGKR

SEQ ID NO: 2655245 - protein, 9 aa, Entamoeba histolytica
SGETCGNIA

SEQ ID NO: 2655246 - protein, 5 aa, Entamoeba histolytica
SGETI

SEQ ID NO: 2655247 - protein, 8 aa, Entamoeba histolytica
SGETIGDY

SEQ ID NO: 2655248 - protein, 7 aa, Entamoeba histolytica
SGETKQQ

SEQ ID NO: 2655249 - protein, 19 aa, Entamoeba histolytica
SGETRTVSKDKAQETRKKK

SEQ ID NO: 2655250 - protein, 6 aa, Entamoeba histolytica
SGETVP

SEQ ID NO: 2655251 - protein, 6 aa, Entamoeba histolytica
SGETYK

SEQ ID NO: 2655252 - protein, 7 aa, Entamoeba histolytica
SGEVKEL

SEQ ID NO: 2655253 - protein, 5 aa, Entamoeba histolytica
SGEVS

SEQ ID NO: 2655254 - protein, 4 aa, Entamoeba histolytica
SGEY

SEQ ID NO: 2655255 - protein, 4 aa, Entamoeba histolytica
SGFE

SEQ ID NO: 2655256 - protein, 7 aa, Entamoeba histolytica
SGFERSI

SEQ ID NO: 2655257 - protein, 12 aa, Entamoeba histolytica
SGFESVGTPSIV

SEQ ID NO: 2655258 - protein, 6 aa, Entamoeba histolytica
SGFGDK

SEQ ID NO: 2655259 - protein, 16 aa, Entamoeba histolytica
SGFGSSQTQNNGFGQQ

SEQ ID NO: 2655260 - protein, 6 aa, Entamoeba histolytica
SGFGTS

SEQ ID NO: 2655261 - protein, 14 aa, Entamoeba histolytica
SGFNGEVNKPLRKT

SEQ ID NO: 2655262 - protein, 5 aa, Entamoeba histolytica
SGFPN

SEQ ID NO: 2655263 - protein, 9 aa, Entamoeba histolytica
SGGARMQEG

SEQ ID NO: 2655264 - protein, 5 aa, Entamoeba histolytica
SGGDD

SEQ ID NO: 2655265 - protein, 8 aa, Entamoeba histolytica
SGGDDGTA

SEQ ID NO: 2655266 - protein, 15 aa, Entamoeba histolytica
SGGDINDSEQNDDWQ

SEQ ID NO: 2655267 - protein, 5 aa, Entamoeba histolytica
SGGDQ

SEQ ID NO: 2655268 - protein, 6 aa, Entamoeba histolytica
SGGERN

SEQ ID NO: 2655269 - protein, 6 aa, Entamoeba histolytica
SGGFQS

SEQ ID NO: 2655270 - protein, 10 aa, Entamoeba histolytica
SGGIDGDQTV

SEQ ID NO: 2655271 - protein, 6 aa, Entamoeba histolytica
SGGIEE

SEQ ID NO: 2655272 - protein, 8 aa, Entamoeba histolytica
SGGIPKDI

SEQ ID NO: 2655273 - protein, 9 aa, Entamoeba histolytica
SGGIPPQIE

SEQ ID NO: 2655274 - protein, 7 aa, Entamoeba histolytica
SGGKDKQ

SEQ ID NO: 2655275 - protein, 9 aa, Entamoeba histolytica
SGGKDSTAL

SEQ ID NO: 2655276 - protein, 5 aa, Entamoeba histolytica
SGGKL

SEQ ID NO: 2655277 - protein, 8 aa, Entamoeba histolytica
SGGKRSKE

SEQ ID NO: 2655278 - protein, 6 aa, Entamoeba histolytica
SGGLAT

SEQ ID NO: 2655279 - protein, 11 aa, Entamoeba histolytica
SGGNPSDPESF

SEQ ID NO: 2655280 - protein, 5 aa, Entamoeba histolytica
SGGNV

SEQ ID NO: 2655281 - protein, 4 aa, Entamoeba histolytica
SGGP

SEQ ID NO: 2655282 - protein, 6 aa, Entamoeba histolytica
SGGRDG

SEQ ID NO: 2655283 - protein, 12 aa, Entamoeba histolytica
SGGREQNSDQQY

SEQ ID NO: 2655284 - protein, 7 aa, Entamoeba histolytica
SGGSASN

SEQ ID NO: 2655285 - protein, 7 aa, Entamoeba histolytica
SGGSDEV

SEQ ID NO: 2655286 - protein, 13 aa, Entamoeba histolytica
SGGSNIFGKTGGV

SEQ ID NO: 2655287 - protein, 7 aa, Entamoeba histolytica
SGGSSSV

SEQ ID NO: 2655288 - protein, 5 aa, Entamoeba histolytica
SGGTN

SEQ ID NO: 2655289 - protein, 7 aa, Entamoeba histolytica
SGGTYKS

SEQ ID NO: 2655290 - protein, 5 aa, Entamoeba histolytica
SGGVP

SEQ ID NO: 2655291 - protein, 5 aa, Entamoeba histolytica
SGGYR

SEQ ID NO: 2655292 - protein, 7 aa, Entamoeba histolytica
SGHEQTV

SEQ ID NO: 2655293 - protein, 8 aa, Entamoeba histolytica
SGHNEKAD

SEQ ID NO: 2655294 - protein, 5 aa, Entamoeba histolytica
SGHQR

SEQ ID NO: 2655295 - protein, 6 aa, Entamoeba histolytica
SGHTAK

SEQ ID NO: 2655296 - protein, 4 aa, Entamoeba histolytica
SGID

SEQ ID NO: 2655297 - protein, 10 aa, Entamoeba histolytica
SGIDDDAERE

SEQ ID NO: 2655298 - protein, 11 aa, Entamoeba histolytica
SGIDNKSLSQL

SEQ ID NO: 2655299 - protein, 5 aa, Entamoeba histolytica
SGIEA

SEQ ID NO: 2655300 - protein, 6 aa, Entamoeba histolytica
SGIEEL

SEQ ID NO: 2655301 - protein, 12 aa, Entamoeba histolytica
SGIEESSINQEE

SEQ ID NO: 2655302 - protein, 11 aa, Entamoeba histolytica
SGIEPSQSNQN

SEQ ID NO: 2655303 - protein, 7 aa, Entamoeba histolytica
SGIGEPI

SEQ ID NO: 2655304 - protein, 15 aa, Entamoeba histolytica
SGIGKTKKVIELFLT

SEQ ID NO: 2655305 - protein, 6 aa, Entamoeba histolytica
SGIGNE

SEQ ID NO: 2655306 - protein, 4 aa, Entamoeba histolytica
SGII

SEQ ID NO: 2655307 - protein, 11 aa, Entamoeba histolytica
SGIKRSKQTFK

SEQ ID NO: 2655308 - protein, 8 aa, Entamoeba histolytica
SGINDPNR

SEQ ID NO: 2655309 - protein, 14 aa, Entamoeba histolytica
SGINTKKRNELKSP

SEQ ID NO: 2655310 - protein, 5 aa, Entamoeba histolytica
SGIPG

SEQ ID NO: 2655311 - protein, 6 aa, Entamoeba histolytica
SGIPNS

SEQ ID NO: 2655312 - protein, 7 aa, Entamoeba histolytica
SGIPPEH

SEQ ID NO: 2655313 - protein, 21 aa, Entamoeba histolytica
SGIPQGDVSTISNSASNNHLT

SEQ ID NO: 2655314 - protein, 7 aa, Entamoeba histolytica
SGIPTTI

SEQ ID NO: 2655315 - protein, 19 aa, Entamoeba histolytica
SGIQNNTQLNTNSNSYFQN

SEQ ID NO: 2655316 - protein, 5 aa, Entamoeba histolytica
SGISK

SEQ ID NO: 2655317 - protein, 16 aa, Entamoeba histolytica
SGISNTKSKHKKPEID

SEQ ID NO: 2655318 - protein, 5 aa, Entamoeba histolytica
SGITP

SEQ ID NO: 2655319 - protein, 26 aa, Entamoeba histolytica
SGITQTPTISYETNNIPVQLKDLNIH

SEQ ID NO: 2655320 - protein, 6 aa, Entamoeba histolytica
SGKAEV

SEQ ID NO: 2655321 - protein, 12 aa, Entamoeba histolytica
SGKALPDGTHLR

SEQ ID NO: 2655322 - protein, 11 aa, Entamoeba histolytica
SGKASSAAGLT

SEQ ID NO: 2655323 - protein, 26 aa, Entamoeba histolytica
SGKEDPIDFPEPTFSKKNLKNGQHSF

SEQ ID NO: 2655324 - protein, 8 aa, Entamoeba histolytica
SGKEEEMN

SEQ ID NO: 2655325 - protein, 6 aa, Entamoeba histolytica
SGKEEQ

SEQ ID NO: 2655326 - protein, 7 aa, Entamoeba histolytica
SGKEGGI

SEQ ID NO: 2655327 - protein, 8 aa, Entamoeba histolytica
SGKEHLNE

SEQ ID NO: 2655328 - protein, 8 aa, Entamoeba histolytica
SGKGEINE

SEQ ID NO: 2655329 - protein, 5 aa, Entamoeba histolytica
SGKGK

SEQ ID NO: 2655330 - protein, 9 aa, Entamoeba histolytica
SGKGNTYNA

SEQ ID NO: 2655331 - protein, 5 aa, Entamoeba histolytica
SGKGR

SEQ ID NO: 2655332 - protein, 7 aa, Entamoeba histolytica
SGKINKD

SEQ ID NO: 2655333 - protein, 9 aa, Entamoeba histolytica
SGKKAYPHK

SEQ ID NO: 2655334 - protein, 9 aa, Entamoeba histolytica
SGKKEKAEE

SEQ ID NO: 2655335 - protein, 8 aa, Entamoeba histolytica
SGKKGSVM

SEQ ID NO: 2655336 - protein, 11 aa, Entamoeba histolytica
SGKKKQQSPEY

SEQ ID NO: 2655337 - protein, 9 aa, Entamoeba histolytica
SGKKLDSKN

SEQ ID NO: 2655338 - protein, 25 aa, Entamoeba histolytica
SGKKMSEFSGADKNKLNDMVMWAAF

SEQ ID NO: 2655339 - protein, 8 aa, Entamoeba histolytica
SGKKPFPS

SEQ ID NO: 2655340 - protein, 4 aa, Entamoeba histolytica
SGKL

SEQ ID NO: 2655341 - protein, 6 aa, Entamoeba histolytica
SGKLAN

SEQ ID NO: 2655342 - protein, 10 aa, Entamoeba histolytica
SGKLGYPHRG

SEQ ID NO: 2655343 - protein, 5 aa, Entamoeba histolytica
SGKLI

SEQ ID NO: 2655344 - protein, 7 aa, Entamoeba histolytica
SGKLTIP

SEQ ID NO: 2655345 - protein, 7 aa, Entamoeba histolytica
SGKMKEI

SEQ ID NO: 2655346 - protein, 4 aa, Entamoeba histolytica
SGKN

SEQ ID NO: 2655347 - protein, 10 aa, Entamoeba histolytica
SGKNKQHPDF

SEQ ID NO: 2655348 - protein, 10 aa, Entamoeba histolytica
SGKNYNEKTD

SEQ ID NO: 2655349 - protein, 7 aa, Entamoeba histolytica
SGKPGNE

SEQ ID NO: 2655350 - protein, 17 aa, Entamoeba histolytica
SGKPRDEVVSMWIKLLP

SEQ ID NO: 2655351 - protein, 9 aa, Entamoeba histolytica
SGKPYNGSK

SEQ ID NO: 2655352 - protein, 8 aa, Entamoeba histolytica
SGKQTTDI

SEQ ID NO: 2655353 - protein, 6 aa, Entamoeba histolytica
SGKRDD

SEQ ID NO: 2655354 - protein, 4 aa, Entamoeba histolytica
SGKS

SEQ ID NO: 2655355 - protein, 10 aa, Entamoeba histolytica
SGKSAISPKI

SEQ ID NO: 2655356 - protein, 15 aa, Entamoeba histolytica
SGKSNRVNVTGTEKP

SEQ ID NO: 2655357 - protein, 9 aa, Entamoeba histolytica
SGKSTLSKT

SEQ ID NO: 2655358 - protein, 9 aa, Entamoeba histolytica
SGKSTMNKT

SEQ ID NO: 2655359 - protein, 9 aa, Entamoeba histolytica
SGKSTVNKT

SEQ ID NO: 2655360 - protein, 4 aa, Entamoeba histolytica
SGKT

SEQ ID NO: 2655361 - protein, 9 aa, Entamoeba histolytica
SGKTAIAAA

SEQ ID NO: 2655362 - protein, 12 aa, Entamoeba histolytica
SGKTATEPAIGK

SEQ ID NO: 2655363 - protein, 9 aa, Entamoeba histolytica
SGKTEGLAE

SEQ ID NO: 2655364 - protein, 11 aa, Entamoeba histolytica
SGKTKAVDPIA

SEQ ID NO: 2655365 - protein, 7 aa, Entamoeba histolytica
SGKTTFA

SEQ ID NO: 2655366 - protein, 5 aa, Entamoeba histolytica
SGKVK

SEQ ID NO: 2655367 - protein, 8 aa, Entamoeba histolytica
SGKVNQYR

SEQ ID NO: 2655368 - protein, 82 aa, Entamoeba histolytica
SGLAKGTKSAVKGDASAKDVWKESTKDIPDLDEDQKKDLKQRGKEASKTAKTSYEKASQTEEWKQAKEQTKTISKEVYESEQ

SEQ ID NO: 2655369 - protein, 8 aa, Entamoeba histolytica
SGLDLEEQ

SEQ ID NO: 2655370 - protein, 11 aa, Entamoeba histolytica
SGLEKSQVSDD

SEQ ID NO: 2655371 - protein, 12 aa, Entamoeba histolytica
SGLKGKQEGLSD

SEQ ID NO: 2655372 - protein, 4 aa, Entamoeba histolytica
SGLL

SEQ ID NO: 2655373 - protein, 10 aa, Entamoeba histolytica
SGLNEEQNKQ

SEQ ID NO: 2655374 - protein, 16 aa, Entamoeba histolytica
SGLNNPGPLQNSPHKR

SEQ ID NO: 2655375 - protein, 14 aa, Entamoeba histolytica
SGLQNSANISDSQN

SEQ ID NO: 2655376 - protein, 23 aa, Entamoeba histolytica
SGLQSSESVSKSATQPQTPCNPA

SEQ ID NO: 2655377 - protein, 4 aa, Entamoeba histolytica
SGLS

SEQ ID NO: 2655378 - protein, 8 aa, Entamoeba histolytica
SGLSQRDN

SEQ ID NO: 2655379 - protein, 6 aa, Entamoeba histolytica
SGLSRE

SEQ ID NO: 2655380 - protein, 4 aa, Entamoeba histolytica
SGME

SEQ ID NO: 2655381 - protein, 7 aa, Entamoeba histolytica
SGMEEEV

SEQ ID NO: 2655382 - protein, 7 aa, Entamoeba histolytica
SGMESKK

SEQ ID NO: 2655383 - protein, 10 aa, Entamoeba histolytica
SGMGGSEDGI

SEQ ID NO: 2655384 - protein, 6 aa, Entamoeba histolytica
SGMGNI

SEQ ID NO: 2655385 - protein, 7 aa, Entamoeba histolytica
SGMGPDA

SEQ ID NO: 2655386 - protein, 16 aa, Entamoeba histolytica
SGMTASQFKQDPITRR

SEQ ID NO: 2655387 - protein, 4 aa, Entamoeba histolytica
SGND

SEQ ID NO: 2655388 - protein, 13 aa, Entamoeba histolytica
SGNDDLLSQTEEI

SEQ ID NO: 2655389 - protein, 7 aa, Entamoeba histolytica
SGNDGMG

SEQ ID NO: 2655390 - protein, 5 aa, Entamoeba histolytica
SGNDI

SEQ ID NO: 2655391 - protein, 10 aa, Entamoeba histolytica
SGNDIATNSI

SEQ ID NO: 2655392 - protein, 9 aa, Entamoeba histolytica
SGNDPNWNK

SEQ ID NO: 2655393 - protein, 5 aa, Entamoeba histolytica
SGNDT

SEQ ID NO: 2655394 - protein, 4 aa, Entamoeba histolytica
SGNE

SEQ ID NO: 2655395 - protein, 17 aa, Entamoeba histolytica
SGNENDIIEAKKDKEAY

SEQ ID NO: 2655396 - protein, 5 aa, Entamoeba histolytica
SGNEQ

SEQ ID NO: 2655397 - protein, 4 aa, Entamoeba histolytica
SGNF

SEQ ID NO: 2655398 - protein, 5 aa, Entamoeba histolytica
SGNGE

SEQ ID NO: 2655399 - protein, 8 aa, Entamoeba histolytica
SGNGNTTD

SEQ ID NO: 2655400 - protein, 10 aa, Entamoeba histolytica
SGNGSKEDTM

SEQ ID NO: 2655401 - protein, 4 aa, Entamoeba histolytica
SGNI

SEQ ID NO: 2655402 - protein, 5 aa, Entamoeba histolytica
SGNIQ

SEQ ID NO: 2655403 - protein, 8 aa, Entamoeba histolytica
SGNISKMP

SEQ ID NO: 2655404 - protein, 8 aa, Entamoeba histolytica
SGNKGATM

SEQ ID NO: 2655405 - protein, 19 aa, Entamoeba histolytica
SGNKKPGVLTHSGGNPVLN

SEQ ID NO: 2655406 - protein, 5 aa, Entamoeba histolytica
SGNKN

SEQ ID NO: 2655407 - protein, 5 aa, Entamoeba histolytica
SGNLL

SEQ ID NO: 2655408 - protein, 6 aa, Entamoeba histolytica
SGNNIK

SEQ ID NO: 2655409 - protein, 8 aa, Entamoeba histolytica
SGNNKNYK

SEQ ID NO: 2655410 - protein, 7 aa, Entamoeba histolytica
SGNNNQG

SEQ ID NO: 2655411 - protein, 8 aa, Entamoeba histolytica
SGNPFKGT

SEQ ID NO: 2655412 - protein, 6 aa, Entamoeba histolytica
SGNPIN

SEQ ID NO: 2655413 - protein, 8 aa, Entamoeba histolytica
SGNPKCDE

SEQ ID NO: 2655414 - protein, 9 aa, Entamoeba histolytica
SGNPNGSSF

SEQ ID NO: 2655415 - protein, 7 aa, Entamoeba histolytica
SGNPSAE

SEQ ID NO: 2655416 - protein, 5 aa, Entamoeba histolytica
SGNQC

SEQ ID NO: 2655417 - protein, 7 aa, Entamoeba histolytica
SGNQQWP

SEQ ID NO: 2655418 - protein, 7 aa, Entamoeba histolytica
SGNRTVH

SEQ ID NO: 2655419 - protein, 9 aa, Entamoeba histolytica
SGNSPNNGQ

SEQ ID NO: 2655420 - protein, 9 aa, Entamoeba histolytica
SGNSSPTYL

SEQ ID NO: 2655421 - protein, 4 aa, Entamoeba histolytica
SGNT

SEQ ID NO: 2655422 - protein, 6 aa, Entamoeba histolytica
SGNTHE

SEQ ID NO: 2655423 - protein, 8 aa, Entamoeba histolytica
SGNVGDST

SEQ ID NO: 2655424 - protein, 7 aa, Entamoeba histolytica
SGPAAHT

SEQ ID NO: 2655425 - protein, 7 aa, Entamoeba histolytica
SGPAKTF

SEQ ID NO: 2655426 - protein, 10 aa, Entamoeba histolytica
SGPCEECPTP

SEQ ID NO: 2655427 - protein, 8 aa, Entamoeba histolytica
SGPEEATG

SEQ ID NO: 2655428 - protein, 6 aa, Entamoeba histolytica
SGPFNT

SEQ ID NO: 2655429 - protein, 15 aa, Entamoeba histolytica
SGPGVDGGEDLDDCN

SEQ ID NO: 2655430 - protein, 11 aa, Entamoeba histolytica
SGPINKEAKQE

SEQ ID NO: 2655431 - protein, 5 aa, Entamoeba histolytica
SGPIP

SEQ ID NO: 2655432 - protein, 5 aa, Entamoeba histolytica
SGPQL

SEQ ID NO: 2655433 - protein, 6 aa, Entamoeba histolytica
SGPRCG

SEQ ID NO: 2655434 - protein, 25 aa, Entamoeba histolytica
SGPRIPPTVTPNRENVTQPNDDKTR

SEQ ID NO: 2655435 - protein, 7 aa, Entamoeba histolytica
SGPSDPW

SEQ ID NO: 2655436 - protein, 26 aa, Entamoeba histolytica
SGPSIGGKPFKGNTSENAWKVNKIEI

SEQ ID NO: 2655437 - protein, 7 aa, Entamoeba histolytica
SGPTNIS

SEQ ID NO: 2655438 - protein, 12 aa, Entamoeba histolytica
SGQFESGPTKKR

SEQ ID NO: 2655439 - protein, 7 aa, Entamoeba histolytica
SGQFTPI

SEQ ID NO: 2655440 - protein, 4 aa, Entamoeba histolytica
SGQG

SEQ ID NO: 2655441 - protein, 11 aa, Entamoeba histolytica
SGQGSGIAENN

SEQ ID NO: 2655442 - protein, 7 aa, Entamoeba histolytica
SGQQQQK

SEQ ID NO: 2655443 - protein, 5 aa, Entamoeba histolytica
SGQRL

SEQ ID NO: 2655444 - protein, 9 aa, Entamoeba histolytica
SGQSNEDQM

SEQ ID NO: 2655445 - protein, 12 aa, Entamoeba histolytica
SGQTNPSGRLPT

SEQ ID NO: 2655446 - protein, 11 aa, Entamoeba histolytica
SGQYKKPKKGF

SEQ ID NO: 2655447 - protein, 10 aa, Entamoeba histolytica
SGRDPTSPTF

SEQ ID NO: 2655448 - protein, 6 aa, Entamoeba histolytica
SGRETM

SEQ ID NO: 2655449 - protein, 13 aa, Entamoeba histolytica
SGRGELSERQQKL

SEQ ID NO: 2655450 - protein, 6 aa, Entamoeba histolytica
SGRIGD

SEQ ID NO: 2655451 - protein, 7 aa, Entamoeba histolytica
SGRKEHI

SEQ ID NO: 2655452 - protein, 6 aa, Entamoeba histolytica
SGRLNQ

SEQ ID NO: 2655453 - protein, 6 aa, Entamoeba histolytica
SGRLQY

SEQ ID NO: 2655454 - protein, 5 aa, Entamoeba histolytica
SGRMN

SEQ ID NO: 2655455 - protein, 9 aa, Entamoeba histolytica
SGRSQHKEN

SEQ ID NO: 2655456 - protein, 5 aa, Entamoeba histolytica
SGRTH

SEQ ID NO: 2655457 - protein, 4 aa, Entamoeba histolytica
SGSA

SEQ ID NO: 2655458 - protein, 18 aa, Entamoeba histolytica
SGSAEGVSIKTTKNNGNI

SEQ ID NO: 2655459 - protein, 11 aa, Entamoeba histolytica
SGSDHYTTKEP

SEQ ID NO: 2655460 - protein, 5 aa, Entamoeba histolytica
SGSED

SEQ ID NO: 2655461 - protein, 8 aa, Entamoeba histolytica
SGSEDGTI

SEQ ID NO: 2655462 - protein, 6 aa, Entamoeba histolytica
SGSEIT

SEQ ID NO: 2655463 - protein, 12 aa, Entamoeba histolytica
SGSGNSSLENTK

SEQ ID NO: 2655464 - protein, 8 aa, Entamoeba histolytica
SGSGTEVT

SEQ ID NO: 2655465 - protein, 5 aa, Entamoeba histolytica
SGSHA

SEQ ID NO: 2655466 - protein, 7 aa, Entamoeba histolytica
SGSHPDV

SEQ ID NO: 2655467 - protein, 19 aa, Entamoeba histolytica
SGSHTGKLKRRSTEPMKSS

SEQ ID NO: 2655468 - protein, 7 aa, Entamoeba histolytica
SGSKDAS

SEQ ID NO: 2655469 - protein, 9 aa, Entamoeba histolytica
SGSKGSTTN

SEQ ID NO: 2655470 - protein, 4 aa, Entamoeba histolytica
SGSL

SEQ ID NO: 2655471 - protein, 12 aa, Entamoeba histolytica
SGSLDAQQPTNQ

SEQ ID NO: 2655472 - protein, 6 aa, Entamoeba histolytica
SGSLEG

SEQ ID NO: 2655473 - protein, 8 aa, Entamoeba histolytica
SGSNSKEV

SEQ ID NO: 2655474 - protein, 15 aa, Entamoeba histolytica
SGSNSYNTANKTKAL

SEQ ID NO: 2655475 - protein, 10 aa, Entamoeba histolytica
SGSNTKVTTN

SEQ ID NO: 2655476 - protein, 8 aa, Entamoeba histolytica
SGSNVERH

SEQ ID NO: 2655477 - protein, 11 aa, Entamoeba histolytica
SGSPDSETNKP

SEQ ID NO: 2655478 - protein, 35 aa, Entamoeba histolytica
SGSPEDSVYSGYSSPNPIRQENSFSAGTSQYPTYQ

SEQ ID NO: 2655479 - protein, 8 aa, Entamoeba histolytica
SGSPIEQK

SEQ ID NO: 2655480 - protein, 10 aa, Entamoeba histolytica
SGSREKRDQG

SEQ ID NO: 2655481 - protein, 15 aa, Entamoeba histolytica
SGSRQSKYMNEKGDI

SEQ ID NO: 2655482 - protein, 7 aa, Entamoeba histolytica
SGSSDRK

SEQ ID NO: 2655483 - protein, 11 aa, Entamoeba histolytica
SGSSSEDAKQF

SEQ ID NO: 2655484 - protein, 14 aa, Entamoeba histolytica
SGSSSEVDGPEEEK

SEQ ID NO: 2655485 - protein, 10 aa, Entamoeba histolytica
SGSSTTKTGL

SEQ ID NO: 2655486 - protein, 14 aa, Entamoeba histolytica
SGSTDNICVLVCKL

SEQ ID NO: 2655487 - protein, 18 aa, Entamoeba histolytica
SGSTLQTTEKRSRSNVKT

SEQ ID NO: 2655488 - protein, 11 aa, Entamoeba histolytica
SGSVGKSAIAT

SEQ ID NO: 2655489 - protein, 6 aa, Entamoeba histolytica
SGSYDD

SEQ ID NO: 2655490 - protein, 6 aa, Entamoeba histolytica
SGSYGK

SEQ ID NO: 2655491 - protein, 10 aa, Entamoeba histolytica
SGTAEDTAVT

SEQ ID NO: 2655492 - protein, 6 aa, Entamoeba histolytica
SGTCPQ

SEQ ID NO: 2655493 - protein, 6 aa, Entamoeba histolytica
SGTDEF

SEQ ID NO: 2655494 - protein, 5 aa, Entamoeba histolytica
SGTEF

SEQ ID NO: 2655495 - protein, 10 aa, Entamoeba histolytica
SGTEIGLPEE

SEQ ID NO: 2655496 - protein, 5 aa, Entamoeba histolytica
SGTEM

SEQ ID NO: 2655497 - protein, 4 aa, Entamoeba histolytica
SGTG

SEQ ID NO: 2655498 - protein, 11 aa, Entamoeba histolytica
SGTGASKPIRI

SEQ ID NO: 2655499 - protein, 8 aa, Entamoeba histolytica
SGTHTRYE

SEQ ID NO: 2655500 - protein, 6 aa, Entamoeba histolytica
SGTIYK

SEQ ID NO: 2655501 - protein, 6 aa, Entamoeba histolytica
SGTKCP

SEQ ID NO: 2655502 - protein, 5 aa, Entamoeba histolytica
SGTLQ

SEQ ID NO: 2655503 - protein, 16 aa, Entamoeba histolytica
SGTNAANGTGAYKQKS

SEQ ID NO: 2655504 - protein, 6 aa, Entamoeba histolytica
SGTNQM

SEQ ID NO: 2655505 - protein, 12 aa, Entamoeba histolytica
SGTNSSIPSLST

SEQ ID NO: 2655506 - protein, 5 aa, Entamoeba histolytica
SGTPL

SEQ ID NO: 2655507 - protein, 9 aa, Entamoeba histolytica
SGTSGLPKG

SEQ ID NO: 2655508 - protein, 10 aa, Entamoeba histolytica
SGTSGTPKGA

SEQ ID NO: 2655509 - protein, 5 aa, Entamoeba histolytica
SGTSL

SEQ ID NO: 2655510 - protein, 9 aa, Entamoeba histolytica
SGTSSISSK

SEQ ID NO: 2655511 - protein, 10 aa, Entamoeba histolytica
SGTSSSPKGV

SEQ ID NO: 2655512 - protein, 9 aa, Entamoeba histolytica
SGTTGFPKG

SEQ ID NO: 2655513 - protein, 8 aa, Entamoeba histolytica
SGTTRQQY

SEQ ID NO: 2655514 - protein, 4 aa, Entamoeba histolytica
SGTV

SEQ ID NO: 2655515 - protein, 11 aa, Entamoeba histolytica
SGVDGGNKKEF

SEQ ID NO: 2655516 - protein, 11 aa, Entamoeba histolytica
SGVDSSSISQS

SEQ ID NO: 2655517 - protein, 6 aa, Entamoeba histolytica
SGVDTD

SEQ ID NO: 2655518 - protein, 4 aa, Entamoeba histolytica
SGVE

SEQ ID NO: 2655519 - protein, 5 aa, Entamoeba histolytica
SGVEG

SEQ ID NO: 2655520 - protein, 5 aa, Entamoeba histolytica
SGVGK

SEQ ID NO: 2655521 - protein, 18 aa, Entamoeba histolytica
SGVGKTELAKALAAELFD

SEQ ID NO: 2655522 - protein, 10 aa, Entamoeba histolytica
SGVGNDVKGD

SEQ ID NO: 2655523 - protein, 13 aa, Entamoeba histolytica
SGVIQGDWRDGKN

SEQ ID NO: 2655524 - protein, 7 aa, Entamoeba histolytica
SGVKDEK

SEQ ID NO: 2655525 - protein, 8 aa, Entamoeba histolytica
SGVQPKTV

SEQ ID NO: 2655526 - protein, 4 aa, Entamoeba histolytica
SGVS

SEQ ID NO: 2655527 - protein, 5 aa, Entamoeba histolytica
SGVTE

SEQ ID NO: 2655528 - protein, 19 aa, Entamoeba histolytica
SGVTGEGLKEGMEWIASHC

SEQ ID NO: 2655529 - protein, 15 aa, Entamoeba histolytica
SGWDPSCRPQGKKQK

SEQ ID NO: 2655530 - protein, 7 aa, Entamoeba histolytica
SGWGEQS

SEQ ID NO: 2655531 - protein, 4 aa, Entamoeba histolytica
SGWR

SEQ ID NO: 2655532 - protein, 6 aa, Entamoeba histolytica
SGYEDA

SEQ ID NO: 2655533 - protein, 7 aa, Entamoeba histolytica
SGYEKTK

SEQ ID NO: 2655534 - protein, 6 aa, Entamoeba histolytica
SGYGMT

SEQ ID NO: 2655535 - protein, 7 aa, Entamoeba histolytica
SGYISSS

SEQ ID NO: 2655536 - protein, 6 aa, Entamoeba histolytica
SGYKAK

SEQ ID NO: 2655537 - protein, 9 aa, Entamoeba histolytica
SGYNGNKYQ

SEQ ID NO: 2655538 - protein, 4 aa, Entamoeba histolytica
SGYP

SEQ ID NO: 2655539 - protein, 6 aa, Entamoeba histolytica
SGYPNT

SEQ ID NO: 2655540 - protein, 6 aa, Entamoeba histolytica
SGYPTV

SEQ ID NO: 2655541 - protein, 10 aa, Entamoeba histolytica
SGYQKANTLQ

SEQ ID NO: 2655542 - protein, 7 aa, Entamoeba histolytica
SGYQNEA

SEQ ID NO: 2655543 - protein, 9 aa, Entamoeba histolytica
SGYQQHDSQ

SEQ ID NO: 2655544 - protein, 17 aa, Entamoeba histolytica
SGYRGGLDVKTGTTGVN

SEQ ID NO: 2655545 - protein, 6 aa, Entamoeba histolytica
SGYSVY

SEQ ID NO: 2655546 - protein, 4 aa, Entamoeba histolytica
SGYV

SEQ ID NO: 2655547 - protein, 7 aa, Entamoeba histolytica
SHADGSK

SEQ ID NO: 2655548 - protein, 10 aa, Entamoeba histolytica
SHAPATYDSE

SEQ ID NO: 2655549 - protein, 9 aa, Entamoeba histolytica
SHAPSPQEK

SEQ ID NO: 2655550 - protein, 7 aa, Entamoeba histolytica
SHCGKTS

SEQ ID NO: 2655551 - protein, 4 aa, Entamoeba histolytica
SHDA

SEQ ID NO: 2655552 - protein, 114 aa, Entamoeba histolytica
SHEEHRHENNERQHKGFKEREPPQPSEADTADSWRRKDSDVPIPKKTYERRHENTEKPHRDFGERRTDDRGKRTFGPRDGQHQNTKKSTQHIKQGKKTPKQSSKPVVDEEGWMT

SEQ ID NO: 2655553 - protein, 5 aa, Entamoeba histolytica
SHEEK

SEQ ID NO: 2655554 - protein, 5 aa, Entamoeba histolytica
SHEGD

SEQ ID NO: 2655555 - protein, 19 aa, Entamoeba histolytica
SHENNISKEVTDEVSDSQI

SEQ ID NO: 2655556 - protein, 4 aa, Entamoeba histolytica
SHEQ

SEQ ID NO: 2655557 - protein, 6 aa, Entamoeba histolytica
SHERVD

SEQ ID NO: 2655558 - protein, 4 aa, Entamoeba histolytica
SHEV

SEQ ID NO: 2655559 - protein, 4 aa, Entamoeba histolytica
SHGN

SEQ ID NO: 2655560 - protein, 8 aa, Entamoeba histolytica
SHHKGQDE

SEQ ID NO: 2655561 - protein, 11 aa, Entamoeba histolytica
SHINKQRREID

SEQ ID NO: 2655562 - protein, 4 aa, Entamoeba histolytica
SHIP

SEQ ID NO: 2655563 - protein, 10 aa, Entamoeba histolytica
SHISTGGGAS

SEQ ID NO: 2655564 - protein, 10 aa, Entamoeba histolytica
SHKARQFTTK

SEQ ID NO: 2655565 - protein, 6 aa, Entamoeba histolytica
SHKEIT

SEQ ID NO: 2655566 - protein, 6 aa, Entamoeba histolytica
SHKNPG

SEQ ID NO: 2655567 - protein, 7 aa, Entamoeba histolytica
SHKPKKF

SEQ ID NO: 2655568 - protein, 10 aa, Entamoeba histolytica
SHLKGGNGKV

SEQ ID NO: 2655569 - protein, 8 aa, Entamoeba histolytica
SHLPKGDI

SEQ ID NO: 2655570 - protein, 24 aa, Entamoeba histolytica
SHLPSNNYSFPDPISSNVNATVSN

SEQ ID NO: 2655571 - protein, 12 aa, Entamoeba histolytica
SHNDNKCNEYGK

SEQ ID NO: 2655572 - protein, 35 aa, Entamoeba histolytica
SHNEEITSIKDQKEKKPKKNKTSNTLKKSKEKEVI

SEQ ID NO: 2655573 - protein, 7 aa, Entamoeba histolytica
SHNKPEE

SEQ ID NO: 2655574 - protein, 10 aa, Entamoeba histolytica
SHNPKADNGY

SEQ ID NO: 2655575 - protein, 8 aa, Entamoeba histolytica
SHNPKPWN

SEQ ID NO: 2655576 - protein, 7 aa, Entamoeba histolytica
SHNPVGI

SEQ ID NO: 2655577 - protein, 7 aa, Entamoeba histolytica
SHNQQRV

SEQ ID NO: 2655578 - protein, 18 aa, Entamoeba histolytica
SHNSAQNVLQTSSTTLPE

SEQ ID NO: 2655579 - protein, 11 aa, Entamoeba histolytica
SHNSDQSGATV

SEQ ID NO: 2655580 - protein, 13 aa, Entamoeba histolytica
SHNTSKASRATQT

SEQ ID NO: 2655581 - protein, 9 aa, Entamoeba histolytica
SHPCSTGKV

SEQ ID NO: 2655582 - protein, 15 aa, Entamoeba histolytica
SHPDEGCDNSRSEME

SEQ ID NO: 2655583 - protein, 4 aa, Entamoeba histolytica
SHPE

SEQ ID NO: 2655584 - protein, 24 aa, Entamoeba histolytica
SHPIERKNDRYKSALRNPSSQINL

SEQ ID NO: 2655585 - protein, 6 aa, Entamoeba histolytica
SHPKEL

SEQ ID NO: 2655586 - protein, 13 aa, Entamoeba histolytica
SHPKPNLKIGSET

SEQ ID NO: 2655587 - protein, 5 aa, Entamoeba histolytica
SHPKT

SEQ ID NO: 2655588 - protein, 15 aa, Entamoeba histolytica
SHPLPSRPKSLSRSV

SEQ ID NO: 2655589 - protein, 14 aa, Entamoeba histolytica
SHPPPVPPRRGNLK

SEQ ID NO: 2655590 - protein, 16 aa, Entamoeba histolytica
SHPTEASLSAPNLPPL

SEQ ID NO: 2655591 - protein, 4 aa, Entamoeba histolytica
SHQH

SEQ ID NO: 2655592 - protein, 7 aa, Entamoeba histolytica
SHQKDLS

SEQ ID NO: 2655593 - protein, 7 aa, Entamoeba histolytica
SHQKKGE

SEQ ID NO: 2655594 - protein, 15 aa, Entamoeba histolytica
SHQQNTPIPPSKPSN

SEQ ID NO: 2655595 - protein, 7 aa, Entamoeba histolytica
SHQQPNK

SEQ ID NO: 2655596 - protein, 7 aa, Entamoeba histolytica
SHQQTIE

SEQ ID NO: 2655597 - protein, 18 aa, Entamoeba histolytica
SHQTTPTLIPSASASSSV

SEQ ID NO: 2655598 - protein, 8 aa, Entamoeba histolytica
SHRDEDTA

SEQ ID NO: 2655599 - protein, 8 aa, Entamoeba histolytica
SHRPKELS

SEQ ID NO: 2655600 - protein, 23 aa, Entamoeba histolytica
SHRRGKSSIDQSTRKNEAKSEFK

SEQ ID NO: 2655601 - protein, 5 aa, Entamoeba histolytica
SHRSA

SEQ ID NO: 2655602 - protein, 6 aa, Entamoeba histolytica
SHSATA

SEQ ID NO: 2655603 - protein, 9 aa, Entamoeba histolytica
SHSETQTPR

SEQ ID NO: 2655604 - protein, 4 aa, Entamoeba histolytica
SHSF

SEQ ID NO: 2655605 - protein, 9 aa, Entamoeba histolytica
SHSGSGKTV

SEQ ID NO: 2655606 - protein, 9 aa, Entamoeba histolytica
SHSKPSWED

SEQ ID NO: 2655607 - protein, 11 aa, Entamoeba histolytica
SHSPRSSQSPA

SEQ ID NO: 2655608 - protein, 6 aa, Entamoeba histolytica
SHSPYS

SEQ ID NO: 2655609 - protein, 11 aa, Entamoeba histolytica
SHSQDPSYGYP

SEQ ID NO: 2655610 - protein, 7 aa, Entamoeba histolytica
SHSSPLL

SEQ ID NO: 2655611 - protein, 9 aa, Entamoeba histolytica
SHSSVDKTS

SEQ ID NO: 2655612 - protein, 21 aa, Entamoeba histolytica
SHSTTPDELNKEIDEENEHQS

SEQ ID NO: 2655613 - protein, 13 aa, Entamoeba histolytica
SHTDQSRSKTITE

SEQ ID NO: 2655614 - protein, 6 aa, Entamoeba histolytica
SHTDRV

SEQ ID NO: 2655615 - protein, 5 aa, Entamoeba histolytica
SHTEM

SEQ ID NO: 2655616 - protein, 13 aa, Entamoeba histolytica
SHTETGPRKRNED

SEQ ID NO: 2655617 - protein, 8 aa, Entamoeba histolytica
SHTMSKQA

SEQ ID NO: 2655618 - protein, 4 aa, Entamoeba histolytica
SHTN

SEQ ID NO: 2655619 - protein, 16 aa, Entamoeba histolytica
SHTTEIASQEDSTKEQ

SEQ ID NO: 2655620 - protein, 8 aa, Entamoeba histolytica
SHVQEEET

SEQ ID NO: 2655621 - protein, 11 aa, Entamoeba histolytica
SHVSGGPTHIE

SEQ ID NO: 2655622 - protein, 15 aa, Entamoeba histolytica
SHYHSQKKKECSKNN

SEQ ID NO: 2655623 - protein, 6 aa, Entamoeba histolytica
SHYNNT

SEQ ID NO: 2655624 - protein, 6 aa, Entamoeba histolytica
SHYNTS

SEQ ID NO: 2655625 - protein, 11 aa, Entamoeba histolytica
SHYRSNNYQDY

SEQ ID NO: 2655626 - protein, 9 aa, Entamoeba histolytica
SIADEERRR

SEQ ID NO: 2655627 - protein, 6 aa, Entamoeba histolytica
SIAENA

SEQ ID NO: 2655628 - protein, 7 aa, Entamoeba histolytica
SIAENNE

SEQ ID NO: 2655629 - protein, 5 aa, Entamoeba histolytica
SIANG

SEQ ID NO: 2655630 - protein, 14 aa, Entamoeba histolytica
SIANTTAPSGFSSP

SEQ ID NO: 2655631 - protein, 15 aa, Entamoeba histolytica
SIAPKRDKAQGEVER

SEQ ID NO: 2655632 - protein, 15 aa, Entamoeba histolytica
SIAPKRDKSGGEVER

SEQ ID NO: 2655633 - protein, 6 aa, Entamoeba histolytica
SIAPSL

SEQ ID NO: 2655634 - protein, 7 aa, Entamoeba histolytica
SIAPTPK

SEQ ID NO: 2655635 - protein, 5 aa, Entamoeba histolytica
SIASD

SEQ ID NO: 2655636 - protein, 8 aa, Entamoeba histolytica
SIATQSSC

SEQ ID NO: 2655637 - protein, 7 aa, Entamoeba histolytica
SIDDEDD

SEQ ID NO: 2655638 - protein, 11 aa, Entamoeba histolytica
SIDDISKDIEN

SEQ ID NO: 2655639 - protein, 10 aa, Entamoeba histolytica
SIDDKKKEEL

SEQ ID NO: 2655640 - protein, 7 aa, Entamoeba histolytica
SIDDKTT

SEQ ID NO: 2655641 - protein, 4 aa, Entamoeba histolytica
SIDE

SEQ ID NO: 2655642 - protein, 5 aa, Entamoeba histolytica
SIDEA

SEQ ID NO: 2655643 - protein, 5 aa, Entamoeba histolytica
SIDEN

SEQ ID NO: 2655644 - protein, 5 aa, Entamoeba histolytica
SIDEQ

SEQ ID NO: 2655645 - protein, 7 aa, Entamoeba histolytica
SIDETKR

SEQ ID NO: 2655646 - protein, 8 aa, Entamoeba histolytica
SIDEVGDY

SEQ ID NO: 2655647 - protein, 10 aa, Entamoeba histolytica
SIDGSKNKKP

SEQ ID NO: 2655648 - protein, 7 aa, Entamoeba histolytica
SIDGTGE

SEQ ID NO: 2655649 - protein, 6 aa, Entamoeba histolytica
SIDGTI

SEQ ID NO: 2655650 - protein, 5 aa, Entamoeba histolytica
SIDGY

SEQ ID NO: 2655651 - protein, 8 aa, Entamoeba histolytica
SIDKNSLN

SEQ ID NO: 2655652 - protein, 5 aa, Entamoeba histolytica
SIDPQ

SEQ ID NO: 2655653 - protein, 9 aa, Entamoeba histolytica
SIDPSSTDC

SEQ ID NO: 2655654 - protein, 5 aa, Entamoeba histolytica
SIDPV

SEQ ID NO: 2655655 - protein, 6 aa, Entamoeba histolytica
SIDRGY

SEQ ID NO: 2655656 - protein, 10 aa, Entamoeba histolytica
SIDSETPDQM

SEQ ID NO: 2655657 - protein, 14 aa, Entamoeba histolytica
SIDSFNEKRDSSIK

SEQ ID NO: 2655658 - protein, 13 aa, Entamoeba histolytica
SIDSHTKEVQVNG

SEQ ID NO: 2655659 - protein, 5 aa, Entamoeba histolytica
SIDSK

SEQ ID NO: 2655660 - protein, 11 aa, Entamoeba histolytica
SIDSTQTNNSG

SEQ ID NO: 2655661 - protein, 26 aa, Entamoeba histolytica
SIEAETRKKEKEKQQSNINRKSRESI

SEQ ID NO: 2655662 - protein, 19 aa, Entamoeba histolytica
SIEDDEELASRWPRYGDEI

SEQ ID NO: 2655663 - protein, 5 aa, Entamoeba histolytica
SIEDP

SEQ ID NO: 2655664 - protein, 6 aa, Entamoeba histolytica
SIEDSS

SEQ ID NO: 2655665 - protein, 9 aa, Entamoeba histolytica
SIEDTDDAI

SEQ ID NO: 2655666 - protein, 32 aa, Entamoeba histolytica; identical to SEQ ID NO: 2460437

SEQ ID NO: 2655667 - protein, 6 aa, Entamoeba histolytica
SIEEKP

SEQ ID NO: 2655668 - protein, 8 aa, Entamoeba histolytica
SIEEKSNK

SEQ ID NO: 2655669 - protein, 26 aa, Entamoeba histolytica
SIEEKYASIDRTEYEKEFKEATKLGD

SEQ ID NO: 2655670 - protein, 10 aa, Entamoeba histolytica
SIEEQKERIQ

SEQ ID NO: 2655671 - protein, 9 aa, Entamoeba histolytica
SIEERQKNL

SEQ ID NO: 2655672 - protein, 7 aa, Entamoeba histolytica
SIEESKI

SEQ ID NO: 2655673 - protein, 27 aa, Entamoeba histolytica
SIEESKNHDQKDTERAKQQKEEKIKTI

SEQ ID NO: 2655674 - protein, 5 aa, Entamoeba histolytica
SIEGA

SEQ ID NO: 2655675 - protein, 27 aa, Entamoeba histolytica
SIEGGTEISTRLDPDEIKEEKKIGEGS

SEQ ID NO: 2655676 - protein, 5 aa, Entamoeba histolytica
SIEGT

SEQ ID NO: 2655677 - protein, 4 aa, Entamoeba histolytica
SIEK

SEQ ID NO: 2655678 - protein, 8 aa, Entamoeba histolytica
SIEKGCKK

SEQ ID NO: 2655679 - protein, 13 aa, Entamoeba histolytica
SIEKSYKTNEGKL

SEQ ID NO: 2655680 - protein, 6 aa, Entamoeba histolytica
SIEKTD

SEQ ID NO: 2655681 - protein, 6 aa, Entamoeba histolytica
SIEKTK

SEQ ID NO: 2655682 - protein, 9 aa, Entamoeba histolytica
SIEKTTEKT

SEQ ID NO: 2655683 - protein, 11 aa, Entamoeba histolytica
SIENNNSSLQK

SEQ ID NO: 2655684 - protein, 8 aa, Entamoeba histolytica
SIENSQNT

SEQ ID NO: 2655685 - protein, 5 aa, Entamoeba histolytica
SIENT

SEQ ID NO: 2655686 - protein, 4 aa, Entamoeba histolytica
SIEP

SEQ ID NO: 2655687 - protein, 10 aa, Entamoeba histolytica
SIEPENQNYL

SEQ ID NO: 2655688 - protein, 5 aa, Entamoeba histolytica
SIEPL

SEQ ID NO: 2655689 - protein, 6 aa, Entamoeba histolytica
SIEPSF

SEQ ID NO: 2655690 - protein, 8 aa, Entamoeba histolytica
SIEPSNEN

SEQ ID NO: 2655691 - protein, 4 aa, Entamoeba histolytica
SIEQ

SEQ ID NO: 2655692 - protein, 5 aa, Entamoeba histolytica
SIERK

SEQ ID NO: 2655693 - protein, 9 aa, Entamoeba histolytica
SIERTGNGY

SEQ ID NO: 2655694 - protein, 4 aa, Entamoeba histolytica
SIES

SEQ ID NO: 2655695 - protein, 5 aa, Entamoeba histolytica
SIESD

SEQ ID NO: 2655696 - protein, 8 aa, Entamoeba histolytica
SIESECNE

SEQ ID NO: 2655697 - protein, 11 aa, Entamoeba histolytica
SIESNKERALS

SEQ ID NO: 2655698 - protein, 5 aa, Entamoeba histolytica
SIESQ

SEQ ID NO: 2655699 - protein, 8 aa, Entamoeba histolytica
SIETQDPQ

SEQ ID NO: 2655700 - protein, 5 aa, Entamoeba histolytica
SIEVE

SEQ ID NO: 2655701 - protein, 13 aa, Entamoeba histolytica
SIGATGKSTFYGE

SEQ ID NO: 2655702 - protein, 14 aa, Entamoeba histolytica
SIGDDDDKPKEIEG

SEQ ID NO: 2655703 - protein, 9 aa, Entamoeba histolytica
SIGDDKMKD

SEQ ID NO: 2655704 - protein, 10 aa, Entamoeba histolytica
SIGDETPSTI

SEQ ID NO: 2655705 - protein, 7 aa, Entamoeba histolytica
SIGDSVQ

SEQ ID NO: 2655706 - protein, 4 aa, Entamoeba histolytica
SIGE

SEQ ID NO: 2655707 - protein, 11 aa, Entamoeba histolytica
SIGEERRGRFD

SEQ ID NO: 2655708 - protein, 25 aa, Entamoeba histolytica
SIGENNNKAKSDMKEAYKQQEKQEI

SEQ ID NO: 2655709 - protein, 6 aa, Entamoeba histolytica
SIGHGS

SEQ ID NO: 2655710 - protein, 10 aa, Entamoeba histolytica
SIGKERKRSG

SEQ ID NO: 2655711 - protein, 10 aa, Entamoeba histolytica
SIGKKTETGL

SEQ ID NO: 2655712 - protein, 15 aa, Entamoeba histolytica
SIGKNAGDKGNGNSA

SEQ ID NO: 2655713 - protein, 11 aa, Entamoeba histolytica
SIGKPLAGLTP

SEQ ID NO: 2655714 - protein, 5 aa, Entamoeba histolytica
SIGKY

SEQ ID NO: 2655715 - protein, 4 aa, Entamoeba histolytica
SIGM

SEQ ID NO: 2655716 - protein, 20 aa, Entamoeba histolytica
SIGNKGKEENKDGNRKEVNG

SEQ ID NO: 2655717 - protein, 5 aa, Entamoeba histolytica
SIGNS

SEQ ID NO: 2655718 - protein, 6 aa, Entamoeba histolytica
SIGPQA

SEQ ID NO: 2655719 - protein, 5 aa, Entamoeba histolytica
SIGPT

SEQ ID NO: 2655720 - protein, 5 aa, Entamoeba histolytica
SIGRQ

SEQ ID NO: 2655721 - protein, 16 aa, Entamoeba histolytica
SIGSQLESTLSKTDIT

SEQ ID NO: 2655722 - protein, 18 aa, Entamoeba histolytica
SIGSSRIEGKSGGDSEVQ

SEQ ID NO: 2655723 - protein, 7 aa, Entamoeba histolytica
SIGTGDS

SEQ ID NO: 2655724 - protein, 6 aa, Entamoeba histolytica
SIGVNT

SEQ ID NO: 2655725 - protein, 6 aa, Entamoeba histolytica
SIHEEN

SEQ ID NO: 2655726 - protein, 12 aa, Entamoeba histolytica
SIHGDRSQADRD

SEQ ID NO: 2655727 - protein, 7 aa, Entamoeba histolytica
SIHNTQD

SEQ ID NO: 2655728 - protein, 14 aa, Entamoeba histolytica
SIHPESTKKSYLDS

SEQ ID NO: 2655729 - protein, 6 aa, Entamoeba histolytica
SIHTDR

SEQ ID NO: 2655730 - protein, 8 aa, Entamoeba histolytica
SIHTEQEE

SEQ ID NO: 2655731 - protein, 4 aa, Entamoeba histolytica
SIIP

SEQ ID NO: 2655732 - protein, 20 aa, Entamoeba histolytica
SIISGDNAIKEKEQTQTKEL

SEQ ID NO: 2655733 - protein, 11 aa, Entamoeba histolytica
SIITQTKTLSS

SEQ ID NO: 2655734 - protein, 11 aa, Entamoeba histolytica
SIKADNSTKEL

SEQ ID NO: 2655735 - protein, 16 aa, Entamoeba histolytica
SIKADPQYFGYSDSKA

SEQ ID NO: 2655736 - protein, 13 aa, Entamoeba histolytica
SIKAGTAEDEAPS

SEQ ID NO: 2655737 - protein, 5 aa, Entamoeba histolytica
SIKDK

SEQ ID NO: 2655738 - protein, 10 aa, Entamoeba histolytica
SIKDNEMTKE

SEQ ID NO: 2655739 - protein, 23 aa, Entamoeba histolytica
SIKEDNDQMKKENQNENERKGCI

SEQ ID NO: 2655740 - protein, 23 aa, Entamoeba histolytica
SIKEEKKEVNKPIKIEGNNQRYV

SEQ ID NO: 2655741 - protein, 17 aa, Entamoeba histolytica
SIKENFNANKTLSKRGR

SEQ ID NO: 2655742 - protein, 8 aa, Entamoeba histolytica
SIKENKIE

SEQ ID NO: 2655743 - protein, 7 aa, Entamoeba histolytica
SIKEQGK

SEQ ID NO: 2655744 - protein, 10 aa, Entamoeba histolytica
SIKGKNKIND

SEQ ID NO: 2655745 - protein, 8 aa, Entamoeba histolytica
SIKGPNGL

SEQ ID NO: 2655746 - protein, 8 aa, Entamoeba histolytica
SIKGYDKH

SEQ ID NO: 2655747 - protein, 4 aa, Entamoeba histolytica
SIKI

SEQ ID NO: 2655748 - protein, 29 aa, Entamoeba histolytica
SIKKESIKENSSSSSISNEEGKGYEFTGD

SEQ ID NO: 2655749 - protein, 10 aa, Entamoeba histolytica
SIKKGKKVIG

SEQ ID NO: 2655750 - protein, 28 aa, Entamoeba histolytica
SIKKRNREESKEIKREIKEKEIKQEELE

SEQ ID NO: 2655751 - protein, 8 aa, Entamoeba histolytica
SIKNDQGI

SEQ ID NO: 2655752 - protein, 7 aa, Entamoeba histolytica
SIKNHRY

SEQ ID NO: 2655753 - protein, 5 aa, Entamoeba histolytica
SIKNS

SEQ ID NO: 2655754 - protein, 10 aa, Entamoeba histolytica
SIKPKKSPYI

SEQ ID NO: 2655755 - protein, 5 aa, Entamoeba histolytica
SIKPN

SEQ ID NO: 2655756 - protein, 7 aa, Entamoeba histolytica
SIKQSGF

SEQ ID NO: 2655757 - protein, 8 aa, Entamoeba histolytica
SIKQYPKY

SEQ ID NO: 2655758 - protein, 11 aa, Entamoeba histolytica
SIKRGNEEVDK

SEQ ID NO: 2655759 - protein, 5 aa, Entamoeba histolytica
SIKRT

SEQ ID NO: 2655760 - protein, 16 aa, Entamoeba histolytica
SIKSESYKSNKLEPRE

SEQ ID NO: 2655761 - protein, 5 aa, Entamoeba histolytica
SIKSV

SEQ ID NO: 2655762 - protein, 6 aa, Entamoeba histolytica
SIKTDK

SEQ ID NO: 2655763 - protein, 19 aa, Entamoeba histolytica
SIKTPDEKLIPGEPVMTSF

SEQ ID NO: 2655764 - protein, 7 aa, Entamoeba histolytica
SIKTSSD

SEQ ID NO: 2655765 - protein, 5 aa, Entamoeba histolytica
SILSS

SEQ ID NO: 2655766 - protein, 5 aa, Entamoeba histolytica
SINDE

SEQ ID NO: 2655767 - protein, 4 aa, Entamoeba histolytica
SINE

SEQ ID NO: 2655768 - protein, 13 aa, Entamoeba histolytica
SINEHQKSISSSE

SEQ ID NO: 2655769 - protein, 10 aa, Entamoeba histolytica
SINEKTTDEE

SEQ ID NO: 2655770 - protein, 13 aa, Entamoeba histolytica
SINETMSPSSPVG

SEQ ID NO: 2655771 - protein, 5 aa, Entamoeba histolytica
SINEY

SEQ ID NO: 2655772 - protein, 10 aa, Entamoeba histolytica
SINGGSPIKE

SEQ ID NO: 2655773 - protein, 4 aa, Entamoeba histolytica
SINK

SEQ ID NO: 2655774 - protein, 10 aa, Entamoeba histolytica
SINKRTKQQI

SEQ ID NO: 2655775 - protein, 4 aa, Entamoeba histolytica
SINL

SEQ ID NO: 2655776 - protein, 14 aa, Entamoeba histolytica
SINNEGVISDPSGV

SEQ ID NO: 2655777 - protein, 13 aa, Entamoeba histolytica
SINNKEGNHQTTD

SEQ ID NO: 2655778 - protein, 18 aa, Entamoeba histolytica
SINNNEHKHSSENEDKNL

SEQ ID NO: 2655779 - protein, 5 aa, Entamoeba histolytica
SINNS

SEQ ID NO: 2655780 - protein, 5 aa, Entamoeba histolytica
SINNY

SEQ ID NO: 2655781 - protein, 8 aa, Entamoeba histolytica
SINPDKPV

SEQ ID NO: 2655782 - protein, 8 aa, Entamoeba histolytica
SINPEPYH

SEQ ID NO: 2655783 - protein, 5 aa, Entamoeba histolytica
SINPK

SEQ ID NO: 2655784 - protein, 13 aa, Entamoeba histolytica
SINPSAQPQYQPF

SEQ ID NO: 2655785 - protein, 12 aa, Entamoeba histolytica
SINQKDDLGNTA

SEQ ID NO: 2655786 - protein, 10 aa, Entamoeba histolytica
SINQKEIKPI

SEQ ID NO: 2655787 - protein, 7 aa, Entamoeba histolytica
SINQKSD

SEQ ID NO: 2655788 - protein, 8 aa, Entamoeba histolytica
SINQPKGK

SEQ ID NO: 2655789 - protein, 13 aa, Entamoeba histolytica
SINQQREMIENFE

SEQ ID NO: 2655790 - protein, 5 aa, Entamoeba histolytica
SINQR

SEQ ID NO: 2655791 - protein, 8 aa, Entamoeba histolytica
SINRGQNT

SEQ ID NO: 2655792 - protein, 7 aa, Entamoeba histolytica
SINSKED

SEQ ID NO: 2655793 - protein, 10 aa, Entamoeba histolytica
SINSNGDVNS

SEQ ID NO: 2655794 - protein, 11 aa, Entamoeba histolytica
SINTNGRTASI

SEQ ID NO: 2655795 - protein, 5 aa, Entamoeba histolytica
SINTT

SEQ ID NO: 2655796 - protein, 18 aa, Entamoeba histolytica
SINTTTNEIDLELDDSID

SEQ ID NO: 2655797 - protein, 7 aa, Entamoeba histolytica
SIPDDNK

SEQ ID NO: 2655798 - protein, 5 aa, Entamoeba histolytica
SIPDG

SEQ ID NO: 2655799 - protein, 7 aa, Entamoeba histolytica
SIPDGDE

SEQ ID NO: 2655800 - protein, 5 aa, Entamoeba histolytica
SIPDI

SEQ ID NO: 2655801 - protein, 4 aa, Entamoeba histolytica
SIPE

SEQ ID NO: 2655802 - protein, 13 aa, Entamoeba histolytica
SIPEDAKKPPVEE

SEQ ID NO: 2655803 - protein, 5 aa, Entamoeba histolytica
SIPEP

SEQ ID NO: 2655804 - protein, 11 aa, Entamoeba histolytica
SIPESYRYSTG

SEQ ID NO: 2655805 - protein, 5 aa, Entamoeba histolytica
SIPEV

SEQ ID NO: 2655806 - protein, 6 aa, Entamoeba histolytica
SIPGND

SEQ ID NO: 2655807 - protein, 7 aa, Entamoeba histolytica
SIPINDP

SEQ ID NO: 2655808 - protein, 10 aa, Entamoeba histolytica
SIPKDEPEQC

SEQ ID NO: 2655809 - protein, 9 aa, Entamoeba histolytica
SIPKEVKKI

SEQ ID NO: 2655810 - protein, 9 aa, Entamoeba histolytica
SIPKSSDLS

SEQ ID NO: 2655811 - protein, 6 aa, Entamoeba histolytica
SIPLAG

SEQ ID NO: 2655812 - protein, 5 aa, Entamoeba histolytica
SIPLQ

SEQ ID NO: 2655813 - protein, 6 aa, Entamoeba histolytica
SIPMSQ

SEQ ID NO: 2655814 - protein, 4 aa, Entamoeba histolytica
SIPN

SEQ ID NO: 2655815 - protein, 5 aa, Entamoeba histolytica
SIPNA

SEQ ID NO: 2655816 - protein, 8 aa, Entamoeba histolytica
SIPNLDRN

SEQ ID NO: 2655817 - protein, 8 aa, Entamoeba histolytica
SIPNNVSS

SEQ ID NO: 2655818 - protein, 23 aa, Entamoeba histolytica
SIPNQTNNQKQQPTNVDENTTVI

SEQ ID NO: 2655819 - protein, 7 aa, Entamoeba histolytica
SIPNRKR

SEQ ID NO: 2655820 - protein, 8 aa, Entamoeba histolytica
SIPNRSQC

SEQ ID NO: 2655821 - protein, 4 aa, Entamoeba histolytica
SIPP

SEQ ID NO: 2655822 - protein, 6 aa, Entamoeba histolytica
SIPPEI

SEQ ID NO: 2655823 - protein, 6 aa, Entamoeba histolytica
SIPPRC

SEQ ID NO: 2655824 - protein, 5 aa, Entamoeba histolytica
SIPPT

SEQ ID NO: 2655825 - protein, 19 aa, Entamoeba histolytica
SIPPTPRTKTTKNNDFDSI

SEQ ID NO: 2655826 - protein, 23 aa, Entamoeba histolytica
SIPQEQPNQRNSSTSQQPNTAQN

SEQ ID NO: 2655827 - protein, 13 aa, Entamoeba histolytica
SIPRHNSNYDNEN

SEQ ID NO: 2655828 - protein, 5 aa, Entamoeba histolytica
SIPRN

SEQ ID NO: 2655829 - protein, 7 aa, Entamoeba histolytica
SIPSISA

SEQ ID NO: 2655830 - protein, 5 aa, Entamoeba histolytica
SIPSK

SEQ ID NO: 2655831 - protein, 7 aa, Entamoeba histolytica
SIPSLNG

SEQ ID NO: 2655832 - protein, 12 aa, Entamoeba histolytica
SIPSRASPASLS

SEQ ID NO: 2655833 - protein, 6 aa, Entamoeba histolytica
SIPSTS

SEQ ID NO: 2655834 - protein, 4 aa, Entamoeba histolytica
SIPT

SEQ ID NO: 2655835 - protein, 7 aa, Entamoeba histolytica
SIPTPKT

SEQ ID NO: 2655836 - protein, 5 aa, Entamoeba histolytica
SIPTV

SEQ ID NO: 2655837 - protein, 11 aa, Entamoeba histolytica
SIPVDGTVSQL

SEQ ID NO: 2655838 - protein, 5 aa, Entamoeba histolytica
SIPVE

SEQ ID NO: 2655839 - protein, 6 aa, Entamoeba histolytica
SIPVEE

SEQ ID NO: 2655840 - protein, 5 aa, Entamoeba histolytica
SIPVG

SEQ ID NO: 2655841 - protein, 30 aa, Entamoeba histolytica
SIQASTEKEKYYKEANEKLEKTLKEKEETF

SEQ ID NO: 2655842 - protein, 21 aa, Entamoeba histolytica
SIQDTRKQQPTSQQKQTLGQF

SEQ ID NO: 2655843 - protein, 5 aa, Entamoeba histolytica
SIQES

SEQ ID NO: 2655844 - protein, 5 aa, Entamoeba histolytica
SIQFQ

SEQ ID NO: 2655845 - protein, 9 aa, Entamoeba histolytica
SIQGDEAIE

SEQ ID NO: 2655846 - protein, 13 aa, Entamoeba histolytica
SIQGETSEDISPR

SEQ ID NO: 2655847 - protein, 8 aa, Entamoeba histolytica
SIQGPDTM

SEQ ID NO: 2655848 - protein, 6 aa, Entamoeba histolytica
SIQHEG

SEQ ID NO: 2655849 - protein, 10 aa, Entamoeba histolytica
SIQKPKEETQ

SEQ ID NO: 2655850 - protein, 11 aa, Entamoeba histolytica
SIQKTQNDQNK

SEQ ID NO: 2655851 - protein, 16 aa, Entamoeba histolytica
SIQNEIGNATTSAQEL

SEQ ID NO: 2655852 - protein, 10 aa, Entamoeba histolytica
SIQNKTDKLQ

SEQ ID NO: 2655853 - protein, 7 aa, Entamoeba histolytica
SIQNNLQ

SEQ ID NO: 2655854 - protein, 4 aa, Entamoeba histolytica
SIQP

SEQ ID NO: 2655855 - protein, 8 aa, Entamoeba histolytica
SIQPSSEK

SEQ ID NO: 2655856 - protein, 6 aa, Entamoeba histolytica
SIQPTT

SEQ ID NO: 2655857 - protein, 7 aa, Entamoeba histolytica
SIQPYEQ

SEQ ID NO: 2655858 - protein, 17 aa, Entamoeba histolytica
SIQRPKSLSNQIDTTPH

SEQ ID NO: 2655859 - protein, 12 aa, Entamoeba histolytica
SIQSEEELKSNE

SEQ ID NO: 2655860 - protein, 5 aa, Entamoeba histolytica
SIQSF

SEQ ID NO: 2655861 - protein, 5 aa, Entamoeba histolytica
SIQSI

SEQ ID NO: 2655862 - protein, 13 aa, Entamoeba histolytica
SIQTDDISQQRQA

SEQ ID NO: 2655863 - protein, 6 aa, Entamoeba histolytica
SIQTSQ

SEQ ID NO: 2655864 - protein, 12 aa, Entamoeba histolytica
SIRASSKLSKIG

SEQ ID NO: 2655865 - protein, 12 aa, Entamoeba histolytica
SIRDTTNNYGED

SEQ ID NO: 2655866 - protein, 16 aa, Entamoeba histolytica
SIREEQKQKENLEKNL

SEQ ID NO: 2655867 - protein, 10 aa, Entamoeba histolytica
SIRGSDEDAS

SEQ ID NO: 2655868 - protein, 12 aa, Entamoeba histolytica
SIRIDKNKAVTK

SEQ ID NO: 2655869 - protein, 6 aa, Entamoeba histolytica
SIRKDI

SEQ ID NO: 2655870 - protein, 10 aa, Entamoeba histolytica
SIRNKKKEEL

SEQ ID NO: 2655871 - protein, 5 aa, Entamoeba histolytica
SIRPE

SEQ ID NO: 2655872 - protein, 8 aa, Entamoeba histolytica
SIRRTDDG

SEQ ID NO: 2655873 - protein, 6 aa, Entamoeba histolytica
SIRSNK

SEQ ID NO: 2655874 - protein, 9 aa, Entamoeba histolytica
SIRSPKEIE

SEQ ID NO: 2655875 - protein, 6 aa, Entamoeba histolytica
SIRTVR

SEQ ID NO: 2655876 - protein, 15 aa, Entamoeba histolytica
SIRTYGDKYPTNEQV

SEQ ID NO: 2655877 - protein, 5 aa, Entamoeba histolytica
SIRYN

SEQ ID NO: 2655878 - protein, 9 aa, Entamoeba histolytica
SISDDISSH

SEQ ID NO: 2655879 - protein, 8 aa, Entamoeba histolytica
SISDPKNA

SEQ ID NO: 2655880 - protein, 4 aa, Entamoeba histolytica
SISE

SEQ ID NO: 2655881 - protein, 7 aa, Entamoeba histolytica
SISEDET

SEQ ID NO: 2655882 - protein, 13 aa, Entamoeba histolytica
SISEYTNSEVEQI

SEQ ID NO: 2655883 - protein, 7 aa, Entamoeba histolytica
SISGTEF

SEQ ID NO: 2655884 - protein, 6 aa, Entamoeba histolytica
SISHSS

SEQ ID NO: 2655885 - protein, 7 aa, Entamoeba histolytica
SISIPTS

SEQ ID NO: 2655886 - protein, 4 aa, Entamoeba histolytica
SISK

SEQ ID NO: 2655887 - protein, 5 aa, Entamoeba histolytica
SISKE

SEQ ID NO: 2655888 - protein, 9 aa, Entamoeba histolytica
SISKEDRTL

SEQ ID NO: 2655889 - protein, 35 aa, Entamoeba histolytica
SISKNQPSKDVFETTNEPIKPKPETKALSKEDYRE

SEQ ID NO: 2655890 - protein, 5 aa, Entamoeba histolytica
SISKT

SEQ ID NO: 2655891 - protein, 5 aa, Entamoeba histolytica
SISNE

SEQ ID NO: 2655892 - protein, 20 aa, Entamoeba histolytica
SISNNSSPENRQLRKKSSFC

SEQ ID NO: 2655893 - protein, 9 aa, Entamoeba histolytica
SISNPRISK

SEQ ID NO: 2655894 - protein, 5 aa, Entamoeba histolytica
SISPE

SEQ ID NO: 2655895 - protein, 5 aa, Entamoeba histolytica
SISPT

SEQ ID NO: 2655896 - protein, 8 aa, Entamoeba histolytica
SISQTEIP

SEQ ID NO: 2655897 - protein, 9 aa, Entamoeba histolytica
SISQTNELT

SEQ ID NO: 2655898 - protein, 20 aa, Entamoeba histolytica
SISRGNSTCNMNQKGEAFQS

SEQ ID NO: 2655899 - protein, 14 aa, Entamoeba histolytica
SISSDSSFDDCFIF

SEQ ID NO: 2655900 - protein, 22 aa, Entamoeba histolytica
SISSEDIENYQRDTNTEASQKV

SEQ ID NO: 2655901 - protein, 28 aa, Entamoeba histolytica
SISSHPPSETPKEESRPKLTRTKSGDPL

SEQ ID NO: 2655902 - protein, 5 aa, Entamoeba histolytica
SISSK

SEQ ID NO: 2655903 - protein, 6 aa, Entamoeba histolytica
SISSPP

SEQ ID NO: 2655904 - protein, 11 aa, Entamoeba histolytica
SISSQSDKTIS

SEQ ID NO: 2655905 - protein, 13 aa, Entamoeba histolytica
SISSSQDSTTSSI

SEQ ID NO: 2655906 - protein, 4 aa, Entamoeba histolytica
SIST

SEQ ID NO: 2655907 - protein, 12 aa, Entamoeba histolytica
SISTASSDKDTM

SEQ ID NO: 2655908 - protein, 16 aa, Entamoeba histolytica
SISTDSQMSKVDNNQK

SEQ ID NO: 2655909 - protein, 6 aa, Entamoeba histolytica
SISTGK

SEQ ID NO: 2655910 - protein, 5 aa, Entamoeba histolytica
SISTP

SEQ ID NO: 2655911 - protein, 5 aa, Entamoeba histolytica
SISTT

SEQ ID NO: 2655912 - protein, 4 aa, Entamoeba histolytica
SITD

SEQ ID NO: 2655913 - protein, 12 aa, Entamoeba histolytica
SITDDFDEQTKI

SEQ ID NO: 2655914 - protein, 6 aa, Entamoeba histolytica
SITDPL

SEQ ID NO: 2655915 - protein, 6 aa, Entamoeba histolytica
SITDTT

SEQ ID NO: 2655916 - protein, 6 aa, Entamoeba histolytica
SITERN

SEQ ID NO: 2655917 - protein, 11 aa, Entamoeba histolytica
SITETTTPKFQ

SEQ ID NO: 2655918 - protein, 6 aa, Entamoeba histolytica
SITIQR

SEQ ID NO: 2655919 - protein, 6 aa, Entamoeba histolytica
SITNTG

SEQ ID NO: 2655920 - protein, 17 aa, Entamoeba histolytica
SITNTQRINNKISEQNQ

SEQ ID NO: 2655921 - protein, 6 aa, Entamoeba histolytica
SITPQP

SEQ ID NO: 2655922 - protein, 10 aa, Entamoeba histolytica
SITPSEDNVE

SEQ ID NO: 2655923 - protein, 18 aa, Entamoeba histolytica
SITPSSPIIQTQSDTLDS

SEQ ID NO: 2655924 - protein, 9 aa, Entamoeba histolytica
SITRGEEQK

SEQ ID NO: 2655925 - protein, 5 aa, Entamoeba histolytica
SITSG

SEQ ID NO: 2655926 - protein, 6 aa, Entamoeba histolytica
SITSHT

SEQ ID NO: 2655927 - protein, 15 aa, Entamoeba histolytica
SITSQSSDTPGTEIK

SEQ ID NO: 2655928 - protein, 16 aa, Entamoeba histolytica
SITSTDEYGVTTTKTE

SEQ ID NO: 2655929 - protein, 33 aa, Entamoeba histolytica
SITSTQSVSKNEATETSSTKSIETTKSTKEELK

SEQ ID NO: 2655930 - protein, 21 aa, Entamoeba histolytica
SITSTSDLISEDKKTLKQKEL

SEQ ID NO: 2655931 - protein, 4 aa, Entamoeba histolytica
SITT

SEQ ID NO: 2655932 - protein, 6 aa, Entamoeba histolytica
SITTES

SEQ ID NO: 2655933 - protein, 5 aa, Entamoeba histolytica
SITTN

SEQ ID NO: 2655934 - protein, 6 aa, Entamoeba histolytica
SITTNP

SEQ ID NO: 2655935 - protein, 7 aa, Entamoeba histolytica
SITTPEA

SEQ ID NO: 2655936 - protein, 9 aa, Entamoeba histolytica
SITTPRGWK

SEQ ID NO: 2655937 - protein, 8 aa, Entamoeba histolytica
SITTSNQA

SEQ ID NO: 2655938 - protein, 12 aa, Entamoeba histolytica
SITVPKSVTKLG

SEQ ID NO: 2655939 - protein, 4 aa, Entamoeba histolytica
SIVN

SEQ ID NO: 2655940 - protein, 8 aa, Entamoeba histolytica
SIVPNQNT

SEQ ID NO: 2655941 - protein, 21 aa, Entamoeba histolytica
SIVSDEKKENTQINNNENDDF

SEQ ID NO: 2655942 - protein, 6 aa, Entamoeba histolytica
SIYDGT

SEQ ID NO: 2655943 - protein, 11 aa, Entamoeba histolytica
SIYSTDGDSII

SEQ ID NO: 2655944 - protein, 6 aa, Entamoeba histolytica
SKAANQ

SEQ ID NO: 2655945 - protein, 7 aa, Entamoeba histolytica
SKADKDE

SEQ ID NO: 2655946 - protein, 6 aa, Entamoeba histolytica
SKADLG

SEQ ID NO: 2655947 - protein, 14 aa, Entamoeba histolytica
SKADLNTATKSTED

SEQ ID NO: 2655948 - protein, 10 aa, Entamoeba histolytica
SKADNGNPYA

SEQ ID NO: 2655949 - protein, 9 aa, Entamoeba histolytica
SKAEEEVKR

SEQ ID NO: 2655950 - protein, 209 aa, Entamoeba histolytica
SKAEYNDKLKEYDAQTLSTEDKKEKKSKKVTKKEDEKATEEKKPKKVEIKKEDEKPKKVESKKEEKTKKVEIKKEDDEKTKKVEIKKEDEKKEKKHSKKEDKKKEEMKKNEGKKESDKKEDTKKDKKVKKSEKKDEIKKEDEKKHEKKEEKTEEKKPKKPESEKEESKKEKKHSKKEDKKKDEEKSKKVEDKKSKKQKKDESSSSDEDM

SEQ ID NO: 2655951 - protein, 18 aa, Entamoeba histolytica
SKAGEPSWESQWGPGRPG

SEQ ID NO: 2655952 - protein, 9 aa, Entamoeba histolytica
SKAGKVTPQ

SEQ ID NO: 2655953 - protein, 7 aa, Entamoeba histolytica
SKAIEEE

SEQ ID NO: 2655954 - protein, 4 aa, Entamoeba histolytica
SKAK

SEQ ID NO: 2655955 - protein, 9 aa, Entamoeba histolytica
SKAKENEDR

SEQ ID NO: 2655956 - protein, 8 aa, Entamoeba histolytica
SKAKEYSE

SEQ ID NO: 2655957 - protein, 28 aa, Entamoeba histolytica
SKAKQKPFKTREDERDKIYREKQRFGDP

SEQ ID NO: 2655958 - protein, 9 aa, Entamoeba histolytica
SKAKRRYQQ

SEQ ID NO: 2655959 - protein, 7 aa, Entamoeba histolytica
SKALESY

SEQ ID NO: 2655960 - protein, 7 aa, Entamoeba histolytica
SKALQSV

SEQ ID NO: 2655961 - protein, 19 aa, Entamoeba histolytica
SKANAQQRTGRVGRVSSGE

SEQ ID NO: 2655962 - protein, 8 aa, Entamoeba histolytica
SKANEDLH

SEQ ID NO: 2655963 - protein, 11 aa, Entamoeba histolytica
SKANETKASSS

SEQ ID NO: 2655964 - protein, 19 aa, Entamoeba histolytica
SKANSSVEEENVKEAKEKM

SEQ ID NO: 2655965 - protein, 9 aa, Entamoeba histolytica
SKAPDNSIE

SEQ ID NO: 2655966 - protein, 10 aa, Entamoeba histolytica
SKAPTSGEGY

SEQ ID NO: 2655967 - protein, 4 aa, Entamoeba histolytica
SKAR

SEQ ID NO: 2655968 - protein, 9 aa, Entamoeba histolytica
SKARESDGM

SEQ ID NO: 2655969 - protein, 15 aa, Entamoeba histolytica
SKARKALYTANASQR

SEQ ID NO: 2655970 - protein, 15 aa, Entamoeba histolytica
SKARKALYTAPASQR

SEQ ID NO: 2655971 - protein, 18 aa, Entamoeba histolytica
SKASADQRAGRAGRVSPG

SEQ ID NO: 2655972 - protein, 9 aa, Entamoeba histolytica
SKASEINPK

SEQ ID NO: 2655973 - protein, 9 aa, Entamoeba histolytica
SKASNSSLK

SEQ ID NO: 2655974 - protein, 9 aa, Entamoeba histolytica
SKATHIPAG

SEQ ID NO: 2655975 - protein, 13 aa, Entamoeba histolytica
SKATKDQQKDLNN

SEQ ID NO: 2655976 - protein, 4 aa, Entamoeba histolytica
SKAY

SEQ ID NO: 2655977 - protein, 8 aa, Entamoeba histolytica
SKAYSQQL

SEQ ID NO: 2655978 - protein, 8 aa, Entamoeba histolytica
SKCKENCT

SEQ ID NO: 2655979 - protein, 5 aa, Entamoeba histolytica
SKCKG

SEQ ID NO: 2655980 - protein, 6 aa, Entamoeba histolytica
SKCKGG

SEQ ID NO: 2655981 - protein, 5 aa, Entamoeba histolytica
SKCND

SEQ ID NO: 2655982 - protein, 5 aa, Entamoeba histolytica
SKCNE

SEQ ID NO: 2655983 - protein, 10 aa, Entamoeba histolytica
SKCNTKKNVQ

SEQ ID NO: 2655984 - protein, 9 aa, Entamoeba histolytica
SKDARGNTP

SEQ ID NO: 2655985 - protein, 11 aa, Entamoeba histolytica
SKDATSTYDFQ

SEQ ID NO: 2655986 - protein, 4 aa, Entamoeba histolytica
SKDE

SEQ ID NO: 2655987 - protein, 7 aa, Entamoeba histolytica
SKDEEFN

SEQ ID NO: 2655988 - protein, 6 aa, Entamoeba histolytica
SKDELL

SEQ ID NO: 2655989 - protein, 12 aa, Entamoeba histolytica
SKDENDPSSTNA

SEQ ID NO: 2655990 - protein, 17 aa, Entamoeba histolytica
SKDEQRLVNDASGGNHF

SEQ ID NO: 2655991 - protein, 6 aa, Entamoeba histolytica
SKDESI

SEQ ID NO: 2655992 - protein, 8 aa, Entamoeba histolytica
SKDETRVD

SEQ ID NO: 2655993 - protein, 7 aa, Entamoeba histolytica
SKDEVSR

SEQ ID NO: 2655994 - protein, 6 aa, Entamoeba histolytica
SKDEYT

SEQ ID NO: 2655995 - protein, 7 aa, Entamoeba histolytica
SKDGKII

SEQ ID NO: 2655996 - protein, 8 aa, Entamoeba histolytica
SKDGSGLG

SEQ ID NO: 2655997 - protein, 8 aa, Entamoeba histolytica
SKDGSLAS

SEQ ID NO: 2655998 - protein, 6 aa, Entamoeba histolytica
SKDGYE

SEQ ID NO: 2655999 - protein, 6 aa, Entamoeba histolytica
SKDHSV

SEQ ID NO: 2656000 - protein, 7 aa, Entamoeba histolytica
SKDIDID

SEQ ID NO: 2656001 - protein, 4 aa, Entamoeba histolytica
SKDK

SEQ ID NO: 2656002 - protein, 9 aa, Entamoeba histolytica
SKDKKGDRR

SEQ ID NO: 2656003 - protein, 7 aa, Entamoeba histolytica
SKDKLEE

SEQ ID NO: 2656004 - protein, 8 aa, Entamoeba histolytica
SKDKTVQE

SEQ ID NO: 2656005 - protein, 8 aa, Entamoeba histolytica
SKDLSDKI

SEQ ID NO: 2656006 - protein, 5 aa, Entamoeba histolytica
SKDMQ

SEQ ID NO: 2656007 - protein, 7 aa, Entamoeba histolytica
SKDNMEK

SEQ ID NO: 2656008 - protein, 6 aa, Entamoeba histolytica
SKDNPN

SEQ ID NO: 2656009 - protein, 7 aa, Entamoeba histolytica
SKDPKEV

SEQ ID NO: 2656010 - protein, 8 aa, Entamoeba histolytica
SKDPQLNQ

SEQ ID NO: 2656011 - protein, 9 aa, Entamoeba histolytica
SKDPTNKYN

SEQ ID NO: 2656012 - protein, 15 aa, Entamoeba histolytica
SKDQINHQNKKGETA

SEQ ID NO: 2656013 - protein, 5 aa, Entamoeba histolytica
SKDQK

SEQ ID NO: 2656014 - protein, 6 aa, Entamoeba histolytica
SKDQYG

SEQ ID NO: 2656015 - protein, 14 aa, Entamoeba histolytica
SKDSEMTEKQKEVQ

SEQ ID NO: 2656016 - protein, 6 aa, Entamoeba histolytica
SKDSFD

SEQ ID NO: 2656017 - protein, 9 aa, Entamoeba histolytica
SKDSKMTAQ

SEQ ID NO: 2656018 - protein, 6 aa, Entamoeba histolytica
SKDTRE

SEQ ID NO: 2656019 - protein, 7 aa, Entamoeba histolytica
SKDTTPV

SEQ ID NO: 2656020 - protein, 6 aa, Entamoeba histolytica
SKDTTW

SEQ ID NO: 2656021 - protein, 10 aa, Entamoeba histolytica
SKDYKADQTK

SEQ ID NO: 2656022 - protein, 7 aa, Entamoeba histolytica
SKEAERT

SEQ ID NO: 2656023 - protein, 11 aa, Entamoeba histolytica
SKECTKKKTVA

SEQ ID NO: 2656024 - protein, 6 aa, Entamoeba histolytica
SKEDDF

SEQ ID NO: 2656025 - protein, 8 aa, Entamoeba histolytica
SKEDEYSI

SEQ ID NO: 2656026 - protein, 8 aa, Entamoeba histolytica
SKEDISEK

SEQ ID NO: 2656027 - protein, 11 aa, Entamoeba histolytica
SKEEAEEKAKE

SEQ ID NO: 2656028 - protein, 11 aa, Entamoeba histolytica
SKEEAEFNTTA

SEQ ID NO: 2656029 - protein, 6 aa, Entamoeba histolytica
SKEEAL

SEQ ID NO: 2656030 - protein, 8 aa, Entamoeba histolytica
SKEEAYTT

SEQ ID NO: 2656031 - protein, 6 aa, Entamoeba histolytica
SKEEDI

SEQ ID NO: 2656032 - protein, 6 aa, Entamoeba histolytica
SKEEDQ

SEQ ID NO: 2656033 - protein, 7 aa, Entamoeba histolytica
SKEEEKQ

SEQ ID NO: 2656034 - protein, 6 aa, Entamoeba histolytica
SKEEEY

SEQ ID NO: 2656035 - protein, 9 aa, Entamoeba histolytica
SKEEINKNI

SEQ ID NO: 2656036 - protein, 5 aa, Entamoeba histolytica
SKEEK

SEQ ID NO: 2656037 - protein, 6 aa, Entamoeba histolytica
SKEEKE

SEQ ID NO: 2656038 - protein, 8 aa, Entamoeba histolytica
SKEEKQPF

SEQ ID NO: 2656039 - protein, 7 aa, Entamoeba histolytica
SKEEKYT

SEQ ID NO: 2656040 - protein, 9 aa, Entamoeba histolytica
SKEEQDKIN

SEQ ID NO: 2656041 - protein, 7 aa, Entamoeba histolytica
SKEERAY

SEQ ID NO: 2656042 - protein, 6 aa, Entamoeba histolytica
SKEESL

SEQ ID NO: 2656043 - protein, 9 aa, Entamoeba histolytica
SKEETIEEA

SEQ ID NO: 2656044 - protein, 9 aa, Entamoeba histolytica
SKEETRNSD

SEQ ID NO: 2656045 - protein, 6 aa, Entamoeba histolytica
SKEFNE

SEQ ID NO: 2656046 - protein, 7 aa, Entamoeba histolytica
SKEGAEK

SEQ ID NO: 2656047 - protein, 17 aa, Entamoeba histolytica
SKEGKYGTNEDDCLLPA

SEQ ID NO: 2656048 - protein, 5 aa, Entamoeba histolytica
SKEGR

SEQ ID NO: 2656049 - protein, 7 aa, Entamoeba histolytica
SKEGSPD

SEQ ID NO: 2656050 - protein, 5 aa, Entamoeba histolytica
SKEGV

SEQ ID NO: 2656051 - protein, 24 aa, Entamoeba histolytica
SKEHNGSRTVQQSIEKGSEDERQK

SEQ ID NO: 2656052 - protein, 9 aa, Entamoeba histolytica
SKEIDDREG

SEQ ID NO: 2656053 - protein, 30 aa, Entamoeba histolytica; identical to SEQ ID NO: 2460844

SEQ ID NO: 2656054 - protein, 7 aa, Entamoeba histolytica
SKEIQNQ

SEQ ID NO: 2656055 - protein, 7 aa, Entamoeba histolytica
SKEKDNH

SEQ ID NO: 2656056 - protein, 7 aa, Entamoeba histolytica
SKEKEGN

SEQ ID NO: 2656057 - protein, 9 aa, Entamoeba histolytica
SKEKEGYYE

SEQ ID NO: 2656058 - protein, 8 aa, Entamoeba histolytica
SKEKISVK

SEQ ID NO: 2656059 - protein, 7 aa, Entamoeba histolytica
SKEKNNF

SEQ ID NO: 2656060 - protein, 8 aa, Entamoeba histolytica
SKELKEDY

SEQ ID NO: 2656061 - protein, 6 aa, Entamoeba histolytica
SKELNS

SEQ ID NO: 2656062 - protein, 5 aa, Entamoeba histolytica
SKELP

SEQ ID NO: 2656063 - protein, 6 aa, Entamoeba histolytica
SKELPG

SEQ ID NO: 2656064 - protein, 7 aa, Entamoeba histolytica
SKELPNK

SEQ ID NO: 2656065 - protein, 10 aa, Entamoeba histolytica
SKELPVTTDI

SEQ ID NO: 2656066 - protein, 6 aa, Entamoeba histolytica
SKELQN

SEQ ID NO: 2656067 - protein, 6 aa, Entamoeba histolytica
SKELTD

SEQ ID NO: 2656068 - protein, 7 aa, Entamoeba histolytica
SKELVKN

SEQ ID NO: 2656069 - protein, 6 aa, Entamoeba histolytica
SKENAQ

SEQ ID NO: 2656070 - protein, 10 aa, Entamoeba histolytica
SKENDKEENE

SEQ ID NO: 2656071 - protein, 5 aa, Entamoeba histolytica
SKENF

SEQ ID NO: 2656072 - protein, 9 aa, Entamoeba histolytica
SKENNKKIY

SEQ ID NO: 2656073 - protein, 5 aa, Entamoeba histolytica
SKENQ

SEQ ID NO: 2656074 - protein, 20 aa, Entamoeba histolytica
SKENTSNDKLNGWNTLSSEK

SEQ ID NO: 2656075 - protein, 16 aa, Entamoeba histolytica
SKENVEENVEENQPIK

SEQ ID NO: 2656076 - protein, 13 aa, Entamoeba histolytica
SKENVSGNETTAT

SEQ ID NO: 2656077 - protein, 4 aa, Entamoeba histolytica
SKEP

SEQ ID NO: 2656078 - protein, 9 aa, Entamoeba histolytica
SKEPKEIED

SEQ ID NO: 2656079 - protein, 12 aa, Entamoeba histolytica
SKEPKGTTEEIR

SEQ ID NO: 2656080 - protein, 11 aa, Entamoeba histolytica
SKEPYSKPGWD

SEQ ID NO: 2656081 - protein, 7 aa, Entamoeba histolytica
SKEQAEE

SEQ ID NO: 2656082 - protein, 11 aa, Entamoeba histolytica
SKEQATKPKIT

SEQ ID NO: 2656083 - protein, 6 aa, Entamoeba histolytica
SKEQEI

SEQ ID NO: 2656084 - protein, 15 aa, Entamoeba histolytica
SKEQEKEKLNNIEKK

SEQ ID NO: 2656085 - protein, 8 aa, Entamoeba histolytica
SKEQKVAR

SEQ ID NO: 2656086 - protein, 14 aa, Entamoeba histolytica
SKEQRPSDKKYEEY

SEQ ID NO: 2656087 - protein, 8 aa, Entamoeba histolytica
SKEQTKES

SEQ ID NO: 2656088 - protein, 5 aa, Entamoeba histolytica
SKERL

SEQ ID NO: 2656089 - protein, 9 aa, Entamoeba histolytica
SKERYGPEA

SEQ ID NO: 2656090 - protein, 8 aa, Entamoeba histolytica
SKESEEEQ

SEQ ID NO: 2656091 - protein, 6 aa, Entamoeba histolytica
SKESLE

SEQ ID NO: 2656092 - protein, 11 aa, Entamoeba histolytica
SKESNNFDPEA

SEQ ID NO: 2656093 - protein, 5 aa, Entamoeba histolytica
SKESS

SEQ ID NO: 2656094 - protein, 13 aa, Entamoeba histolytica
SKESVHKKEKELK

SEQ ID NO: 2656095 - protein, 8 aa, Entamoeba histolytica
SKETCSLQ

SEQ ID NO: 2656096 - protein, 9 aa, Entamoeba histolytica
SKETGDYRN

SEQ ID NO: 2656097 - protein, 5 aa, Entamoeba histolytica
SKETM

SEQ ID NO: 2656098 - protein, 6 aa, Entamoeba histolytica
SKETPL

SEQ ID NO: 2656099 - protein, 12 aa, Entamoeba histolytica
SKETQQGIPGIG

SEQ ID NO: 2656100 - protein, 11 aa, Entamoeba histolytica
SKETRESLSEE

SEQ ID NO: 2656101 - protein, 9 aa, Entamoeba histolytica
SKETRHEKT

SEQ ID NO: 2656102 - protein, 9 aa, Entamoeba histolytica
SKETTAGCT

SEQ ID NO: 2656103 - protein, 19 aa, Entamoeba histolytica
SKETTKEEKEKEIEKIGKS

SEQ ID NO: 2656104 - protein, 6 aa, Entamoeba histolytica
SKETTV

SEQ ID NO: 2656105 - protein, 24 aa, Entamoeba histolytica
SKEVAEATRIQYGGSVNPANCNEL

SEQ ID NO: 2656106 - protein, 5 aa, Entamoeba histolytica
SKEVE

SEQ ID NO: 2656107 - protein, 5 aa, Entamoeba histolytica
SKEVG

SEQ ID NO: 2656108 - protein, 12 aa, Entamoeba histolytica
SKEVYDSDFDET

SEQ ID NO: 2656109 - protein, 4 aa, Entamoeba histolytica
SKEW

SEQ ID NO: 2656110 - protein, 5 aa, Entamoeba histolytica
SKEYD

SEQ ID NO: 2656111 - protein, 5 aa, Entamoeba histolytica
SKEYQ

SEQ ID NO: 2656112 - protein, 29 aa, Entamoeba histolytica
SKEYTDLTSKMRDSNDQLTKNCAQSQTNA

SEQ ID NO: 2656113 - protein, 6 aa, Entamoeba histolytica
SKFDSQ

SEQ ID NO: 2656114 - protein, 7 aa, Entamoeba histolytica
SKFEDQK

SEQ ID NO: 2656115 - protein, 17 aa, Entamoeba histolytica
SKFEEQQIRINQQHFET

SEQ ID NO: 2656116 - protein, 7 aa, Entamoeba histolytica
SKFEGEE

SEQ ID NO: 2656117 - protein, 8 aa, Entamoeba histolytica
SKFGNNKL

SEQ ID NO: 2656118 - protein, 14 aa, Entamoeba histolytica
SKFKSQNGSTKDIS

SEQ ID NO: 2656119 - protein, 7 aa, Entamoeba histolytica
SKFPQDY

SEQ ID NO: 2656120 - protein, 6 aa, Entamoeba histolytica
SKFSDG

SEQ ID NO: 2656121 - protein, 13 aa, Entamoeba histolytica
SKFSESTTQNDKV

SEQ ID NO: 2656122 - protein, 5 aa, Entamoeba histolytica
SKFTS

SEQ ID NO: 2656123 - protein, 6 aa, Entamoeba histolytica
SKFTTL

SEQ ID NO: 2656124 - protein, 8 aa, Entamoeba histolytica
SKGAQGEV

SEQ ID NO: 2656125 - protein, 8 aa, Entamoeba histolytica
SKGDARSI

SEQ ID NO: 2656126 - protein, 8 aa, Entamoeba histolytica
SKGEFEKQ

SEQ ID NO: 2656127 - protein, 11 aa, Entamoeba histolytica
SKGEKKARKAL

SEQ ID NO: 2656128 - protein, 6 aa, Entamoeba histolytica
SKGEPM

SEQ ID NO: 2656129 - protein, 9 aa, Entamoeba histolytica
SKGEYDNTN

SEQ ID NO: 2656130 - protein, 9 aa, Entamoeba histolytica
SKGFEDKPS

SEQ ID NO: 2656131 - protein, 22 aa, Entamoeba histolytica
SKGFKTSLSHTYPNSIKTNASA

SEQ ID NO: 2656132 - protein, 5 aa, Entamoeba histolytica
SKGFQ

SEQ ID NO: 2656133 - protein, 7 aa, Entamoeba histolytica
SKGGDSH

SEQ ID NO: 2656134 - protein, 6 aa, Entamoeba histolytica
SKGGHV

SEQ ID NO: 2656135 - protein, 5 aa, Entamoeba histolytica
SKGIP

SEQ ID NO: 2656136 - protein, 8 aa, Entamoeba histolytica
SKGKEVEG

SEQ ID NO: 2656137 - protein, 6 aa, Entamoeba histolytica
SKGKIH

SEQ ID NO: 2656138 - protein, 9 aa, Entamoeba histolytica
SKGKILNDE

SEQ ID NO: 2656139 - protein, 6 aa, Entamoeba histolytica
SKGKIS

SEQ ID NO: 2656140 - protein, 16 aa, Entamoeba histolytica
SKGKKKENKKKDDGFG

SEQ ID NO: 2656141 - protein, 6 aa, Entamoeba histolytica
SKGKLE

SEQ ID NO: 2656142 - protein, 5 aa, Entamoeba histolytica
SKGLN

SEQ ID NO: 2656143 - protein, 10 aa, Entamoeba histolytica
SKGLNSGNRE

SEQ ID NO: 2656144 - protein, 9 aa, Entamoeba histolytica
SKGNEDTYL

SEQ ID NO: 2656145 - protein, 8 aa, Entamoeba histolytica
SKGNHIGG

SEQ ID NO: 2656146 - protein, 5 aa, Entamoeba histolytica
SKGNI

SEQ ID NO: 2656147 - protein, 5 aa, Entamoeba histolytica
SKGNL

SEQ ID NO: 2656148 - protein, 10 aa, Entamoeba histolytica
SKGNNARESL

SEQ ID NO: 2656149 - protein, 19 aa, Entamoeba histolytica
SKGNRPDPNKLSGGDLDGD

SEQ ID NO: 2656150 - protein, 6 aa, Entamoeba histolytica
SKGNRQ

SEQ ID NO: 2656151 - protein, 6 aa, Entamoeba histolytica
SKGNVF

SEQ ID NO: 2656152 - protein, 6 aa, Entamoeba histolytica
SKGNYK

SEQ ID NO: 2656153 - protein, 6 aa, Entamoeba histolytica
SKGPFS

SEQ ID NO: 2656154 - protein, 16 aa, Entamoeba histolytica
SKGQIPPIPSHYPTHS

SEQ ID NO: 2656155 - protein, 7 aa, Entamoeba histolytica
SKGRMKG

SEQ ID NO: 2656156 - protein, 8 aa, Entamoeba histolytica
SKGSPISD

SEQ ID NO: 2656157 - protein, 8 aa, Entamoeba histolytica
SKGSPISE

SEQ ID NO: 2656158 - protein, 6 aa, Entamoeba histolytica
SKGSQW

SEQ ID NO: 2656159 - protein, 4 aa, Entamoeba histolytica
SKGT

SEQ ID NO: 2656160 - protein, 6 aa, Entamoeba histolytica
SKGVST

SEQ ID NO: 2656161 - protein, 12 aa, Entamoeba histolytica
SKGVYKKANTIQ

SEQ ID NO: 2656162 - protein, 11 aa, Entamoeba histolytica
SKGYSKKEKYE

SEQ ID NO: 2656163 - protein, 6 aa, Entamoeba histolytica
SKGYSS

SEQ ID NO: 2656164 - protein, 6 aa, Entamoeba histolytica
SKGYTC

SEQ ID NO: 2656165 - protein, 5 aa, Entamoeba histolytica
SKHDG

SEQ ID NO: 2656166 - protein, 11 aa, Entamoeba histolytica
SKHDSVAAPPG

SEQ ID NO: 2656167 - protein, 6 aa, Entamoeba histolytica
SKHFTP

SEQ ID NO: 2656168 - protein, 10 aa, Entamoeba histolytica
SKHGGNNDLT

SEQ ID NO: 2656169 - protein, 4 aa, Entamoeba histolytica
SKHP

SEQ ID NO: 2656170 - protein, 6 aa, Entamoeba histolytica
SKHQKT

SEQ ID NO: 2656171 - protein, 8 aa, Entamoeba histolytica
SKHSKTNY

SEQ ID NO: 2656172 - protein, 5 aa, Entamoeba histolytica
SKHTT

SEQ ID NO: 2656173 - protein, 14 aa, Entamoeba histolytica
SKIAEEEVKYEKER

SEQ ID NO: 2656174 - protein, 10 aa, Entamoeba histolytica
SKIAKQEEVD

SEQ ID NO: 2656175 - protein, 4 aa, Entamoeba histolytica
SKID

SEQ ID NO: 2656176 - protein, 14 aa, Entamoeba histolytica
SKIDEDQNSYQTKL

SEQ ID NO: 2656177 - protein, 8 aa, Entamoeba histolytica
SKIDGSTA

SEQ ID NO: 2656178 - protein, 12 aa, Entamoeba histolytica
SKIDGTKKSRQI

SEQ ID NO: 2656179 - protein, 6 aa, Entamoeba histolytica
SKIDPV

SEQ ID NO: 2656180 - protein, 5 aa, Entamoeba histolytica
SKIDS

SEQ ID NO: 2656181 - protein, 16 aa, Entamoeba histolytica
SKIDTSAKSGSVNNPT

SEQ ID NO: 2656182 - protein, 8 aa, Entamoeba histolytica
SKIEANYA

SEQ ID NO: 2656183 - protein, 8 aa, Entamoeba histolytica
SKIEEKED

SEQ ID NO: 2656184 - protein, 9 aa, Entamoeba histolytica
SKIEESARN

SEQ ID NO: 2656185 - protein, 7 aa, Entamoeba histolytica
SKIENKI

SEQ ID NO: 2656186 - protein, 8 aa, Entamoeba histolytica
SKIENPPL

SEQ ID NO: 2656187 - protein, 8 aa, Entamoeba histolytica
SKIEREEM

SEQ ID NO: 2656188 - protein, 8 aa, Entamoeba histolytica
SKIESSTA

SEQ ID NO: 2656189 - protein, 5 aa, Entamoeba histolytica
SKIGN

SEQ ID NO: 2656190 - protein, 8 aa, Entamoeba histolytica
SKIGPKEI

SEQ ID NO: 2656191 - protein, 12 aa, Entamoeba histolytica
SKIGSNSHDSAE

SEQ ID NO: 2656192 - protein, 6 aa, Entamoeba histolytica
SKIGTF

SEQ ID NO: 2656193 - protein, 8 aa, Entamoeba histolytica
SKIISQSN

SEQ ID NO: 2656194 - protein, 10 aa, Entamoeba histolytica
SKIKGEDEKQ

SEQ ID NO: 2656195 - protein, 18 aa, Entamoeba histolytica
SKIKIGYEDGKIEVKITD

SEQ ID NO: 2656196 - protein, 7 aa, Entamoeba histolytica
SKIKLQG

SEQ ID NO: 2656197 - protein, 9 aa, Entamoeba histolytica
SKIKTTKNI

SEQ ID NO: 2656198 - protein, 13 aa, Entamoeba histolytica
SKIMKGATSPPQI

SEQ ID NO: 2656199 - protein, 8 aa, Entamoeba histolytica
SKINENDS

SEQ ID NO: 2656200 - protein, 6 aa, Entamoeba histolytica
SKININ

SEQ ID NO: 2656201 - protein, 5 aa, Entamoeba histolytica
SKIPE

SEQ ID NO: 2656202 - protein, 14 aa, Entamoeba histolytica
SKIPHSTSLNEEKV

SEQ ID NO: 2656203 - protein, 8 aa, Entamoeba histolytica
SKIPINET

SEQ ID NO: 2656204 - protein, 5 aa, Entamoeba histolytica
SKIQP

SEQ ID NO: 2656205 - protein, 8 aa, Entamoeba histolytica
SKISEDEI

SEQ ID NO: 2656206 - protein, 12 aa, Entamoeba histolytica
SKISEIEQESLN

SEQ ID NO: 2656207 - protein, 8 aa, Entamoeba histolytica
SKISEKNG

SEQ ID NO: 2656208 - protein, 6 aa, Entamoeba histolytica
SKISGK

SEQ ID NO: 2656209 - protein, 9 aa, Entamoeba histolytica
SKISQELKD

SEQ ID NO: 2656210 - protein, 6 aa, Entamoeba histolytica
SKISSK

SEQ ID NO: 2656211 - protein, 7 aa, Entamoeba histolytica
SKISTSK

SEQ ID NO: 2656212 - protein, 8 aa, Entamoeba histolytica
SKITSEGY

SEQ ID NO: 2656213 - protein, 11 aa, Entamoeba histolytica
SKITSSDENDF

SEQ ID NO: 2656214 - protein, 5 aa, Entamoeba histolytica
SKIYP

SEQ ID NO: 2656215 - protein, 18 aa, Entamoeba histolytica
SKKAMEEDEKGNSKEALE

SEQ ID NO: 2656216 - protein, 10 aa, Entamoeba histolytica
SKKASSNAVS

SEQ ID NO: 2656217 - protein, 8 aa, Entamoeba histolytica
SKKATYKT

SEQ ID NO: 2656218 - protein, 22 aa, Entamoeba histolytica
SKKDNINDKYKKDNITNEQIDE

SEQ ID NO: 2656219 - protein, 9 aa, Entamoeba histolytica
SKKDPQFPF

SEQ ID NO: 2656220 - protein, 12 aa, Entamoeba histolytica
SKKDRGRPDQQH

SEQ ID NO: 2656221 - protein, 15 aa, Entamoeba histolytica
SKKDYKSEKNKTYYD

SEQ ID NO: 2656222 - protein, 18 aa, Entamoeba histolytica
SKKEEEVEKILKHFNSFF

SEQ ID NO: 2656223 - protein, 7 aa, Entamoeba histolytica
SKKEEGE

SEQ ID NO: 2656224 - protein, 10 aa, Entamoeba histolytica
SKKEEKSDEQ

SEQ ID NO: 2656225 - protein, 9 aa, Entamoeba histolytica
SKKEGIEKQ

SEQ ID NO: 2656226 - protein, 14 aa, Entamoeba histolytica
SKKEKAQEKEENLT

SEQ ID NO: 2656227 - protein, 11 aa, Entamoeba histolytica
SKKEKKNDTRL

SEQ ID NO: 2656228 - protein, 14 aa, Entamoeba histolytica
SKKEQIAKAFSTIL

SEQ ID NO: 2656229 - protein, 8 aa, Entamoeba histolytica
SKKEQLGD

SEQ ID NO: 2656230 - protein, 7 aa, Entamoeba histolytica
SKKETII

SEQ ID NO: 2656231 - protein, 15 aa, Entamoeba histolytica
SKKEVDDIGGEELNE

SEQ ID NO: 2656232 - protein, 8 aa, Entamoeba histolytica
SKKEYADQ

SEQ ID NO: 2656233 - protein, 4 aa, Entamoeba histolytica
SKKG

SEQ ID NO: 2656234 - protein, 9 aa, Entamoeba histolytica
SKKGCVDDA

SEQ ID NO: 2656235 - protein, 7 aa, Entamoeba histolytica
SKKGERT

SEQ ID NO: 2656236 - protein, 8 aa, Entamoeba histolytica
SKKGFVQK

SEQ ID NO: 2656237 - protein, 8 aa, Entamoeba histolytica
SKKGKNPY

SEQ ID NO: 2656238 - protein, 7 aa, Entamoeba histolytica
SKKGTIE

SEQ ID NO: 2656239 - protein, 18 aa, Entamoeba histolytica
SKKGTKKTTYPRNENKTF

SEQ ID NO: 2656240 - protein, 9 aa, Entamoeba histolytica
SKKGYLDKD

SEQ ID NO: 2656241 - protein, 6 aa, Entamoeba histolytica
SKKIPT

SEQ ID NO: 2656242 - protein, 37 aa, Entamoeba histolytica
SKKIPVSNQPVSSSSHQQSNLSQMKRQSSKTFKPHQK

SEQ ID NO: 2656243 - protein, 8 aa, Entamoeba histolytica
SKKIQTPI

SEQ ID NO: 2656244 - protein, 13 aa, Entamoeba histolytica
SKKISTNINELST

SEQ ID NO: 2656245 - protein, 24 aa, Entamoeba histolytica
SKKKELKKGFNETKSQETKEQENI

SEQ ID NO: 2656246 - protein, 17 aa, Entamoeba histolytica
SKKKGASTIRVPQGEEP

SEQ ID NO: 2656247 - protein, 21 aa, Entamoeba histolytica
SKKKGTKKGSSKGKKGKVTGE

SEQ ID NO: 2656248 - protein, 7 aa, Entamoeba histolytica
SKKKPSF

SEQ ID NO: 2656249 - protein, 8 aa, Entamoeba histolytica
SKKKSFKN

SEQ ID NO: 2656250 - protein, 9 aa, Entamoeba histolytica
SKKKYQKEE

SEQ ID NO: 2656251 - protein, 9 aa, Entamoeba histolytica
SKKLADATK

SEQ ID NO: 2656252 - protein, 6 aa, Entamoeba histolytica
SKKLET

SEQ ID NO: 2656253 - protein, 11 aa, Entamoeba histolytica
SKKLKQKEIEE

SEQ ID NO: 2656254 - protein, 7 aa, Entamoeba histolytica
SKKLTQL

SEQ ID NO: 2656255 - protein, 10 aa, Entamoeba histolytica
SKKMEPEKQK

SEQ ID NO: 2656256 - protein, 5 aa, Entamoeba histolytica
SKKMN

SEQ ID NO: 2656257 - protein, 6 aa, Entamoeba histolytica
SKKNAV

SEQ ID NO: 2656258 - protein, 7 aa, Entamoeba histolytica
SKKNKKL

SEQ ID NO: 2656259 - protein, 9 aa, Entamoeba histolytica
SKKNPKTFQ

SEQ ID NO: 2656260 - protein, 17 aa, Entamoeba histolytica
SKKNPSVTAETIRMELQ

SEQ ID NO: 2656261 - protein, 7 aa, Entamoeba histolytica
SKKPCKD

SEQ ID NO: 2656262 - protein, 20 aa, Entamoeba histolytica
SKKPPGKQSGLGEAQNKYNV

SEQ ID NO: 2656263 - protein, 6 aa, Entamoeba histolytica
SKKPTS

SEQ ID NO: 2656264 - protein, 7 aa, Entamoeba histolytica
SKKPYQF

SEQ ID NO: 2656265 - protein, 13 aa, Entamoeba histolytica
SKKQANQKTIESK

SEQ ID NO: 2656266 - protein, 8 aa, Entamoeba histolytica
SKKQAVGS

SEQ ID NO: 2656267 - protein, 42 aa, Entamoeba histolytica
SKKQEEDEKEEELEEKQRKQKEIAEREEAERQKKLQEQQQIR

SEQ ID NO: 2656268 - protein, 7 aa, Entamoeba histolytica
SKKQETV

SEQ ID NO: 2656269 - protein, 6 aa, Entamoeba histolytica
SKKQEV

SEQ ID NO: 2656270 - protein, 7 aa, Entamoeba histolytica
SKKQMDM

SEQ ID NO: 2656271 - protein, 9 aa, Entamoeba histolytica
SKKQTHTSF

SEQ ID NO: 2656272 - protein, 17 aa, Entamoeba histolytica
SKKRKDEDADEDEEHGA

SEQ ID NO: 2656273 - protein, 7 aa, Entamoeba histolytica
SKKRNEM

SEQ ID NO: 2656274 - protein, 7 aa, Entamoeba histolytica
SKKSDKI

SEQ ID NO: 2656275 - protein, 9 aa, Entamoeba histolytica
SKKSDMKRK

SEQ ID NO: 2656276 - protein, 12 aa, Entamoeba histolytica
SKKSHNNYGTLE

SEQ ID NO: 2656277 - protein, 7 aa, Entamoeba histolytica
SKKSKCA

SEQ ID NO: 2656278 - protein, 7 aa, Entamoeba histolytica
SKKSKKC

SEQ ID NO: 2656279 - protein, 8 aa, Entamoeba histolytica
SKKSNCFE

SEQ ID NO: 2656280 - protein, 17 aa, Entamoeba histolytica
SKKSSDVMDGTYEPSEF

SEQ ID NO: 2656281 - protein, 18 aa, Entamoeba histolytica
SKKSSTSSSMTRSSKQRK

SEQ ID NO: 2656282 - protein, 5 aa, Entamoeba histolytica
SKKST

SEQ ID NO: 2656283 - protein, 4 aa, Entamoeba histolytica
SKKT

SEQ ID NO: 2656284 - protein, 8 aa, Entamoeba histolytica
SKKTANKK

SEQ ID NO: 2656285 - protein, 10 aa, Entamoeba histolytica
SKKTEDNEVN

SEQ ID NO: 2656286 - protein, 7 aa, Entamoeba histolytica
SKKTEKA

SEQ ID NO: 2656287 - protein, 20 aa, Entamoeba histolytica
SKKTKRKRKLSTTEKIKSLF

SEQ ID NO: 2656288 - protein, 8 aa, Entamoeba histolytica
SKKTLEGV

SEQ ID NO: 2656289 - protein, 9 aa, Entamoeba histolytica
SKKTLSEEE

SEQ ID NO: 2656290 - protein, 16 aa, Entamoeba histolytica
SKKVEEEIEINPSKNE

SEQ ID NO: 2656291 - protein, 19 aa, Entamoeba histolytica
SKKVEKKPESEPKKEKKTF

SEQ ID NO: 2656292 - protein, 14 aa, Entamoeba histolytica
SKKVNENYFNSTQE

SEQ ID NO: 2656293 - protein, 5 aa, Entamoeba histolytica
SKKYA

SEQ ID NO: 2656294 - protein, 10 aa, Entamoeba histolytica
SKKYGNKINT

SEQ ID NO: 2656295 - protein, 6 aa, Entamoeba histolytica
SKLAKT

SEQ ID NO: 2656296 - protein, 12 aa, Entamoeba histolytica
SKLDNETKSKYD

SEQ ID NO: 2656297 - protein, 5 aa, Entamoeba histolytica
SKLDQ

SEQ ID NO: 2656298 - protein, 8 aa, Entamoeba histolytica
SKLEGNIK

SEQ ID NO: 2656299 - protein, 9 aa, Entamoeba histolytica
SKLESDKEK

SEQ ID NO: 2656300 - protein, 12 aa, Entamoeba histolytica
SKLGDKGKSDEQ

SEQ ID NO: 2656301 - protein, 9 aa, Entamoeba histolytica
SKLKGMGTR

SEQ ID NO: 2656302 - protein, 9 aa, Entamoeba histolytica
SKLKQDMST

SEQ ID NO: 2656303 - protein, 7 aa, Entamoeba histolytica
SKLKSTG

SEQ ID NO: 2656304 - protein, 10 aa, Entamoeba histolytica
SKLKTKGSQI

SEQ ID NO: 2656305 - protein, 6 aa, Entamoeba histolytica
SKLNLS

SEQ ID NO: 2656306 - protein, 8 aa, Entamoeba histolytica
SKLNNTMT

SEQ ID NO: 2656307 - protein, 26 aa, Entamoeba histolytica
SKLNSGLYKKPKTTLLSRSQSAQPDD

SEQ ID NO: 2656308 - protein, 5 aa, Entamoeba histolytica
SKLNT

SEQ ID NO: 2656309 - protein, 6 aa, Entamoeba histolytica
SKLPDS

SEQ ID NO: 2656310 - protein, 6 aa, Entamoeba histolytica
SKLPEI

SEQ ID NO: 2656311 - protein, 20 aa, Entamoeba histolytica
SKLPGTMGSSIARSTFSGMS

SEQ ID NO: 2656312 - protein, 6 aa, Entamoeba histolytica
SKLPNG

SEQ ID NO: 2656313 - protein, 8 aa, Entamoeba histolytica
SKLSDEMN

SEQ ID NO: 2656314 - protein, 15 aa, Entamoeba histolytica
SKLSDQFDNLSSGPD

SEQ ID NO: 2656315 - protein, 8 aa, Entamoeba histolytica
SKLSEEHL

SEQ ID NO: 2656316 - protein, 8 aa, Entamoeba histolytica
SKLSEQDL

SEQ ID NO: 2656317 - protein, 8 aa, Entamoeba histolytica
SKLSHKPL

SEQ ID NO: 2656318 - protein, 5 aa, Entamoeba histolytica
SKLSK

SEQ ID NO: 2656319 - protein, 7 aa, Entamoeba histolytica
SKLSKND

SEQ ID NO: 2656320 - protein, 35 aa, Entamoeba histolytica
SKLSKSEKYDKKIDAKEDKKQQEKNKTAESGCCYI

SEQ ID NO: 2656321 - protein, 8 aa, Entamoeba histolytica
SKLSYQKG

SEQ ID NO: 2656322 - protein, 11 aa, Entamoeba histolytica
SKLTKPSPSSL

SEQ ID NO: 2656323 - protein, 14 aa, Entamoeba histolytica
SKLTNGKSTTVKNE

SEQ ID NO: 2656324 - protein, 7 aa, Entamoeba histolytica
SKLTQQQ

SEQ ID NO: 2656325 - protein, 7 aa, Entamoeba histolytica
SKLYQPT

SEQ ID NO: 2656326 - protein, 8 aa, Entamoeba histolytica
SKMDTNGN

SEQ ID NO: 2656327 - protein, 6 aa, Entamoeba histolytica
SKMEKE

SEQ ID NO: 2656328 - protein, 9 aa, Entamoeba histolytica
SKMGGEIST

SEQ ID NO: 2656329 - protein, 7 aa, Entamoeba histolytica
SKMKSDK

SEQ ID NO: 2656330 - protein, 16 aa, Entamoeba histolytica
SKMPRIKQEVGKNCNW

SEQ ID NO: 2656331 - protein, 8 aa, Entamoeba histolytica
SKMQTSNK

SEQ ID NO: 2656332 - protein, 8 aa, Entamoeba histolytica
SKMSNQPH

SEQ ID NO: 2656333 - protein, 8 aa, Entamoeba histolytica
SKMTADPR

SEQ ID NO: 2656334 - protein, 8 aa, Entamoeba histolytica
SKNDELGK

SEQ ID NO: 2656335 - protein, 8 aa, Entamoeba histolytica
SKNDKSTL

SEQ ID NO: 2656336 - protein, 27 aa, Entamoeba histolytica
SKNEAAQEIQQSGMKDDEQNNKKFGEE

SEQ ID NO: 2656337 - protein, 8 aa, Entamoeba histolytica
SKNEEELK

SEQ ID NO: 2656338 - protein, 6 aa, Entamoeba histolytica
SKNEGE

SEQ ID NO: 2656339 - protein, 9 aa, Entamoeba histolytica
SKNEMRPKR

SEQ ID NO: 2656340 - protein, 9 aa, Entamoeba histolytica
SKNENADNV

SEQ ID NO: 2656341 - protein, 9 aa, Entamoeba histolytica
SKNENLKSM

SEQ ID NO: 2656342 - protein, 38 aa, Entamoeba histolytica
SKNETNDEQQKDEIKDEKSKDENKNEVKDETKQESVKE

SEQ ID NO: 2656343 - protein, 8 aa, Entamoeba histolytica
SKNGATIR

SEQ ID NO: 2656344 - protein, 6 aa, Entamoeba histolytica
SKNGEC

SEQ ID NO: 2656345 - protein, 5 aa, Entamoeba histolytica
SKNGF

SEQ ID NO: 2656346 - protein, 6 aa, Entamoeba histolytica
SKNGGC

SEQ ID NO: 2656347 - protein, 8 aa, Entamoeba histolytica
SKNGKASY

SEQ ID NO: 2656348 - protein, 9 aa, Entamoeba histolytica
SKNGKPKVS

SEQ ID NO: 2656349 - protein, 11 aa, Entamoeba histolytica
SKNGQNDPERD

SEQ ID NO: 2656350 - protein, 12 aa, Entamoeba histolytica
SKNGSTSARKQF

SEQ ID NO: 2656351 - protein, 5 aa, Entamoeba histolytica
SKNIP

SEQ ID NO: 2656352 - protein, 7 aa, Entamoeba histolytica
SKNKEDI

SEQ ID NO: 2656353 - protein, 5 aa, Entamoeba histolytica
SKNKN

SEQ ID NO: 2656354 - protein, 10 aa, Entamoeba histolytica
SKNKNTLIDS

SEQ ID NO: 2656355 - protein, 40 aa, Entamoeba histolytica
SKNLKVKRSDTSKYFTKTSKANSKKLKRLEKETGVDSNGL

SEQ ID NO: 2656356 - protein, 33 aa, Entamoeba histolytica
SKNNEKKNDVKREEEKEMKEKRKEQSKRHEKEE

SEQ ID NO: 2656357 - protein, 9 aa, Entamoeba histolytica
SKNNGELDT

SEQ ID NO: 2656358 - protein, 8 aa, Entamoeba histolytica
SKNNHHEP

SEQ ID NO: 2656359 - protein, 11 aa, Entamoeba histolytica
SKNNLKESEEV

SEQ ID NO: 2656360 - protein, 9 aa, Entamoeba histolytica
SKNNTGIKE

SEQ ID NO: 2656361 - protein, 8 aa, Entamoeba histolytica
SKNPELKT

SEQ ID NO: 2656362 - protein, 16 aa, Entamoeba histolytica
SKNPLKNSVKYPQPPP

SEQ ID NO: 2656363 - protein, 7 aa, Entamoeba histolytica
SKNPLTF

SEQ ID NO: 2656364 - protein, 7 aa, Entamoeba histolytica
SKNPRYC

SEQ ID NO: 2656365 - protein, 8 aa, Entamoeba histolytica
SKNPSLVG

SEQ ID NO: 2656366 - protein, 20 aa, Entamoeba histolytica
SKNPSQPPPNFESPMKKRVL

SEQ ID NO: 2656367 - protein, 7 aa, Entamoeba histolytica
SKNPVNG

SEQ ID NO: 2656368 - protein, 4 aa, Entamoeba histolytica
SKNQ

SEQ ID NO: 2656369 - protein, 5 aa, Entamoeba histolytica
SKNQC

SEQ ID NO: 2656370 - protein, 5 aa, Entamoeba histolytica
SKNQI

SEQ ID NO: 2656371 - protein, 8 aa, Entamoeba histolytica
SKNQPEEV

SEQ ID NO: 2656372 - protein, 16 aa, Entamoeba histolytica
SKNRIQKKSSNSNTFH

SEQ ID NO: 2656373 - protein, 8 aa, Entamoeba histolytica
SKNRRVKD

SEQ ID NO: 2656374 - protein, 6 aa, Entamoeba histolytica
SKNSNL

SEQ ID NO: 2656375 - protein, 6 aa, Entamoeba histolytica
SKNSYA

SEQ ID NO: 2656376 - protein, 22 aa, Entamoeba histolytica
SKNYLPDNVKSQIRQAGEKKQN

SEQ ID NO: 2656377 - protein, 7 aa, Entamoeba histolytica
SKNYSSD

SEQ ID NO: 2656378 - protein, 7 aa, Entamoeba histolytica
SKPAYNA

SEQ ID NO: 2656379 - protein, 5 aa, Entamoeba histolytica
SKPDL

SEQ ID NO: 2656380 - protein, 5 aa, Entamoeba histolytica
SKPED

SEQ ID NO: 2656381 - protein, 8 aa, Entamoeba histolytica
SKPENKAL

SEQ ID NO: 2656382 - protein, 8 aa, Entamoeba histolytica
SKPESVSQ

SEQ ID NO: 2656383 - protein, 5 aa, Entamoeba histolytica
SKPFI

SEQ ID NO: 2656384 - protein, 5 aa, Entamoeba histolytica
SKPIE

SEQ ID NO: 2656385 - protein, 7 aa, Entamoeba histolytica
SKPIGAL

SEQ ID NO: 2656386 - protein, 5 aa, Entamoeba histolytica
SKPII

SEQ ID NO: 2656387 - protein, 5 aa, Entamoeba histolytica
SKPIN

SEQ ID NO: 2656388 - protein, 6 aa, Entamoeba histolytica
SKPISA

SEQ ID NO: 2656389 - protein, 9 aa, Entamoeba histolytica
SKPISKTPH

SEQ ID NO: 2656390 - protein, 17 aa, Entamoeba histolytica
SKPKEETKKSKTKTTQV

SEQ ID NO: 2656391 - protein, 7 aa, Entamoeba histolytica
SKPKFSD

SEQ ID NO: 2656392 - protein, 12 aa, Entamoeba histolytica
SKPLASGEGISK

SEQ ID NO: 2656393 - protein, 5 aa, Entamoeba histolytica
SKPLR

SEQ ID NO: 2656394 - protein, 5 aa, Entamoeba histolytica
SKPNI

SEQ ID NO: 2656395 - protein, 36 aa, Entamoeba histolytica
SKPNSVEISKSPQSDSSPSLVTSTSPLSQNSDSSEL

SEQ ID NO: 2656396 - protein, 7 aa, Entamoeba histolytica
SKPPQQG

SEQ ID NO: 2656397 - protein, 7 aa, Entamoeba histolytica
SKPPSLY

SEQ ID NO: 2656398 - protein, 4 aa, Entamoeba histolytica
SKPQ

SEQ ID NO: 2656399 - protein, 5 aa, Entamoeba histolytica
SKPQQ

SEQ ID NO: 2656400 - protein, 8 aa, Entamoeba histolytica
SKPSEKKN

SEQ ID NO: 2656401 - protein, 14 aa, Entamoeba histolytica
SKPSIPKVSTDVPR

SEQ ID NO: 2656402 - protein, 7 aa, Entamoeba histolytica
SKPSKPF

SEQ ID NO: 2656403 - protein, 7 aa, Entamoeba histolytica
SKPSNQF

SEQ ID NO: 2656404 - protein, 13 aa, Entamoeba histolytica
SKPSNRAGSKAYM

SEQ ID NO: 2656405 - protein, 14 aa, Entamoeba histolytica
SKPSRKSKKSHQME

SEQ ID NO: 2656406 - protein, 6 aa, Entamoeba histolytica
SKPTEV

SEQ ID NO: 2656407 - protein, 6 aa, Entamoeba histolytica
SKPTPL

SEQ ID NO: 2656408 - protein, 5 aa, Entamoeba histolytica
SKPTQ

SEQ ID NO: 2656409 - protein, 9 aa, Entamoeba histolytica
SKPTSPRRL

SEQ ID NO: 2656410 - protein, 6 aa, Entamoeba histolytica
SKPTTN

SEQ ID NO: 2656411 - protein, 8 aa, Entamoeba histolytica
SKPVRTAS

SEQ ID NO: 2656412 - protein, 13 aa, Entamoeba histolytica
SKPVVQEKADGHR

SEQ ID NO: 2656413 - protein, 4 aa, Entamoeba histolytica
SKQA

SEQ ID NO: 2656414 - protein, 14 aa, Entamoeba histolytica
SKQDKQKKPVTKLT

SEQ ID NO: 2656415 - protein, 18 aa, Entamoeba histolytica
SKQEEPKKEEKSNKKKEI

SEQ ID NO: 2656416 - protein, 14 aa, Entamoeba histolytica
SKQEMKKAEHERKV

SEQ ID NO: 2656417 - protein, 6 aa, Entamoeba histolytica
SKQENK

SEQ ID NO: 2656418 - protein, 10 aa, Entamoeba histolytica
SKQHNSQNHI

SEQ ID NO: 2656419 - protein, 4 aa, Entamoeba histolytica
SKQI

SEQ ID NO: 2656420 - protein, 19 aa, Entamoeba histolytica
SKQIGTTVTENANKITDKS

SEQ ID NO: 2656421 - protein, 4 aa, Entamoeba histolytica
SKQK

SEQ ID NO: 2656422 - protein, 8 aa, Entamoeba histolytica
SKQKLRGT

SEQ ID NO: 2656423 - protein, 6 aa, Entamoeba histolytica
SKQKQA

SEQ ID NO: 2656424 - protein, 6 aa, Entamoeba histolytica
SKQKRV

SEQ ID NO: 2656425 - protein, 16 aa, Entamoeba histolytica
SKQKSEAEKGWNEDDS

SEQ ID NO: 2656426 - protein, 7 aa, Entamoeba histolytica
SKQKYYD

SEQ ID NO: 2656427 - protein, 4 aa, Entamoeba histolytica
SKQL

SEQ ID NO: 2656428 - protein, 11 aa, Entamoeba histolytica
SKQNKEKFENE

SEQ ID NO: 2656429 - protein, 10 aa, Entamoeba histolytica
SKQNQYEKSE

SEQ ID NO: 2656430 - protein, 4 aa, Entamoeba histolytica
SKQP

SEQ ID NO: 2656431 - protein, 6 aa, Entamoeba histolytica
SKQPHG

SEQ ID NO: 2656432 - protein, 15 aa, Entamoeba histolytica
SKQPLQSNSGLTKMT

SEQ ID NO: 2656433 - protein, 7 aa, Entamoeba histolytica
SKQPPIF

SEQ ID NO: 2656434 - protein, 10 aa, Entamoeba histolytica
SKQPSPPVQP

SEQ ID NO: 2656435 - protein, 7 aa, Entamoeba histolytica
SKQQDIG

SEQ ID NO: 2656436 - protein, 6 aa, Entamoeba histolytica
SKQQEI

SEQ ID NO: 2656437 - protein, 6 aa, Entamoeba histolytica
SKQRIE

SEQ ID NO: 2656438 - protein, 5 aa, Entamoeba histolytica
SKQRS

SEQ ID NO: 2656439 - protein, 9 aa, Entamoeba histolytica
SKQSGNETS

SEQ ID NO: 2656440 - protein, 6 aa, Entamoeba histolytica
SKQSKM

SEQ ID NO: 2656441 - protein, 18 aa, Entamoeba histolytica
SKQSKSSHKSSSKMDSSI

SEQ ID NO: 2656442 - protein, 8 aa, Entamoeba histolytica
SKQSNHTG

SEQ ID NO: 2656443 - protein, 6 aa, Entamoeba histolytica
SKQSQF

SEQ ID NO: 2656444 - protein, 4 aa, Entamoeba histolytica
SKQT

SEQ ID NO: 2656445 - protein, 7 aa, Entamoeba histolytica
SKQTELI

SEQ ID NO: 2656446 - protein, 6 aa, Entamoeba histolytica
SKQTKH

SEQ ID NO: 2656447 - protein, 5 aa, Entamoeba histolytica
SKQTM

SEQ ID NO: 2656448 - protein, 17 aa, Entamoeba histolytica
SKQTNQEKKQSKEEEVL

SEQ ID NO: 2656449 - protein, 8 aa, Entamoeba histolytica
SKQTTESP

SEQ ID NO: 2656450 - protein, 5 aa, Entamoeba histolytica
SKQVG

SEQ ID NO: 2656451 - protein, 14 aa, Entamoeba histolytica
SKQYNESITSIQKE

SEQ ID NO: 2656452 - protein, 15 aa, Entamoeba histolytica
SKRDEKKEVSIQEES

SEQ ID NO: 2656453 - protein, 7 aa, Entamoeba histolytica
SKREEFK

SEQ ID NO: 2656454 - protein, 10 aa, Entamoeba histolytica
SKREIQKQIG

SEQ ID NO: 2656455 - protein, 7 aa, Entamoeba histolytica
SKREPLE

SEQ ID NO: 2656456 - protein, 5 aa, Entamoeba histolytica
SKREQ

SEQ ID NO: 2656457 - protein, 18 aa, Entamoeba histolytica
SKRESSRFDNRRGEYNGY

SEQ ID NO: 2656458 - protein, 8 aa, Entamoeba histolytica
SKRFGDNE

SEQ ID NO: 2656459 - protein, 7 aa, Entamoeba histolytica
SKRFNEK

SEQ ID NO: 2656460 - protein, 6 aa, Entamoeba histolytica
SKRFSA

SEQ ID NO: 2656461 - protein, 4 aa, Entamoeba histolytica
SKRG

SEQ ID NO: 2656462 - protein, 8 aa, Entamoeba histolytica
SKRGFGEE

SEQ ID NO: 2656463 - protein, 9 aa, Entamoeba histolytica
SKRITPDNQ

SEQ ID NO: 2656464 - protein, 6 aa, Entamoeba histolytica
SKRKEL

SEQ ID NO: 2656465 - protein, 5 aa, Entamoeba histolytica
SKRKY

SEQ ID NO: 2656466 - protein, 7 aa, Entamoeba histolytica
SKRLADQ

SEQ ID NO: 2656467 - protein, 7 aa, Entamoeba histolytica
SKRNDNN

SEQ ID NO: 2656468 - protein, 6 aa, Entamoeba histolytica
SKRNST

SEQ ID NO: 2656469 - protein, 6 aa, Entamoeba histolytica
SKRNYD

SEQ ID NO: 2656470 - protein, 4 aa, Entamoeba histolytica
SKRP

SEQ ID NO: 2656471 - protein, 6 aa, Entamoeba histolytica
SKRPEI

SEQ ID NO: 2656472 - protein, 12 aa, Entamoeba histolytica
SKRPETTKEDEG

SEQ ID NO: 2656473 - protein, 8 aa, Entamoeba histolytica
SKRPIKNE

SEQ ID NO: 2656474 - protein, 4 aa, Entamoeba histolytica
SKRQ

SEQ ID NO: 2656475 - protein, 6 aa, Entamoeba histolytica
SKRQHK

SEQ ID NO: 2656476 - protein, 7 aa, Entamoeba histolytica
SKRSGGD

SEQ ID NO: 2656477 - protein, 7 aa, Entamoeba histolytica
SKRSSQR

SEQ ID NO: 2656478 - protein, 8 aa, Entamoeba histolytica
SKRSSSSA

SEQ ID NO: 2656479 - protein, 4 aa, Entamoeba histolytica
SKRT

SEQ ID NO: 2656480 - protein, 5 aa, Entamoeba histolytica
SKRTL

SEQ ID NO: 2656481 - protein, 12 aa, Entamoeba histolytica
SKRTSGKKRCSN

SEQ ID NO: 2656482 - protein, 10 aa, Entamoeba histolytica
SKRTVTRAYG

SEQ ID NO: 2656483 - protein, 7 aa, Entamoeba histolytica
SKRVRSL

SEQ ID NO: 2656484 - protein, 14 aa, Entamoeba histolytica
SKRVTVEQKEEKTP

SEQ ID NO: 2656485 - protein, 7 aa, Entamoeba histolytica
SKSASPF

SEQ ID NO: 2656486 - protein, 7 aa, Entamoeba histolytica
SKSAVED

SEQ ID NO: 2656487 - protein, 23 aa, Entamoeba histolytica
SKSCSSPADNLKKVKTESTTLNP

SEQ ID NO: 2656488 - protein, 8 aa, Entamoeba histolytica
SKSDDVSV

SEQ ID NO: 2656489 - protein, 5 aa, Entamoeba histolytica
SKSDK

SEQ ID NO: 2656490 - protein, 13 aa, Entamoeba histolytica
SKSDLPSVVPEST

SEQ ID NO: 2656491 - protein, 7 aa, Entamoeba histolytica
SKSDYNS

SEQ ID NO: 2656492 - protein, 4 aa, Entamoeba histolytica
SKSE

SEQ ID NO: 2656493 - protein, 8 aa, Entamoeba histolytica
SKSEAEKR

SEQ ID NO: 2656494 - protein, 7 aa, Entamoeba histolytica
SKSEKYE

SEQ ID NO: 2656495 - protein, 8 aa, Entamoeba histolytica
SKSENGTM

SEQ ID NO: 2656496 - protein, 9 aa, Entamoeba histolytica
SKSEPDIKI

SEQ ID NO: 2656497 - protein, 8 aa, Entamoeba histolytica
SKSEVRPG

SEQ ID NO: 2656498 - protein, 7 aa, Entamoeba histolytica
SKSFSSE

SEQ ID NO: 2656499 - protein, 5 aa, Entamoeba histolytica
SKSFV

SEQ ID NO: 2656500 - protein, 9 aa, Entamoeba histolytica
SKSGKTLYN

SEQ ID NO: 2656501 - protein, 8 aa, Entamoeba histolytica
SKSGSNAS

SEQ ID NO: 2656502 - protein, 9 aa, Entamoeba histolytica
SKSGTPSTI

SEQ ID NO: 2656503 - protein, 9 aa, Entamoeba histolytica
SKSISTNER

SEQ ID NO: 2656504 - protein, 10 aa, Entamoeba histolytica
SKSKAGQLTK

SEQ ID NO: 2656505 - protein, 6 aa, Entamoeba histolytica
SKSKDL

SEQ ID NO: 2656506 - protein, 6 aa, Entamoeba histolytica
SKSKEM

SEQ ID NO: 2656507 - protein, 45 aa, Entamoeba histolytica
SKSKKSGSKANKKPATSSVKPNTPAAPVDPSVIPPEIKEPTETLS

SEQ ID NO: 2656508 - protein, 10 aa, Entamoeba histolytica
SKSKNQSFQN

SEQ ID NO: 2656509 - protein, 10 aa, Entamoeba histolytica
SKSKSNIPRE

SEQ ID NO: 2656510 - protein, 7 aa, Entamoeba histolytica
SKSKVAD

SEQ ID NO: 2656511 - protein, 7 aa, Entamoeba histolytica
SKSLSIG

SEQ ID NO: 2656512 - protein, 14 aa, Entamoeba histolytica
SKSLSQTDVKSKIT

SEQ ID NO: 2656513 - protein, 28 aa, Entamoeba histolytica
SKSLTKPKKVEKNPTISSRPTSESSSIV

SEQ ID NO: 2656514 - protein, 34 aa, Entamoeba histolytica
SKSNDLLTSSTKDEKKKEKKEKKVKRKGDENCGY

SEQ ID NO: 2656515 - protein, 59 aa, Entamoeba histolytica
SKSNEESEEDNSMSEEDAENSEENKESNEEDNSMSEEDEEESNENKESNEEGEEDEADK

SEQ ID NO: 2656516 - protein, 8 aa, Entamoeba histolytica
SKSNKKRK

SEQ ID NO: 2656517 - protein, 9 aa, Entamoeba histolytica
SKSNSYGMT

SEQ ID NO: 2656518 - protein, 12 aa, Entamoeba histolytica
SKSPSYDRRKTA

SEQ ID NO: 2656519 - protein, 10 aa, Entamoeba histolytica
SKSQSESRNK

SEQ ID NO: 2656520 - protein, 10 aa, Entamoeba histolytica
SKSREENKSI

SEQ ID NO: 2656521 - protein, 6 aa, Entamoeba histolytica
SKSRIL

SEQ ID NO: 2656522 - protein, 9 aa, Entamoeba histolytica
SKSRPLTTN

SEQ ID NO: 2656523 - protein, 4 aa, Entamoeba histolytica
SKSS

SEQ ID NO: 2656524 - protein, 6 aa, Entamoeba histolytica
SKSSAL

SEQ ID NO: 2656525 - protein, 8 aa, Entamoeba histolytica
SKSSINES

SEQ ID NO: 2656526 - protein, 18 aa, Entamoeba histolytica
SKSSKITSSKKQEKKNFR

SEQ ID NO: 2656527 - protein, 8 aa, Entamoeba histolytica
SKSSNTSK

SEQ ID NO: 2656528 - protein, 8 aa, Entamoeba histolytica
SKSSSSYE

SEQ ID NO: 2656529 - protein, 10 aa, Entamoeba histolytica
SKSSYPNTSQ

SEQ ID NO: 2656530 - protein, 6 aa, Entamoeba histolytica
SKSTLF

SEQ ID NO: 2656531 - protein, 6 aa, Entamoeba histolytica
SKSTSL

SEQ ID NO: 2656532 - protein, 8 aa, Entamoeba histolytica
SKSTTNKD

SEQ ID NO: 2656533 - protein, 8 aa, Entamoeba histolytica
SKSTTSND

SEQ ID NO: 2656534 - protein, 23 aa, Entamoeba histolytica
SKSTTSTSGDKSVSPRSTSPSTP

SEQ ID NO: 2656535 - protein, 27 aa, Entamoeba histolytica
SKSTVGDKQQTPITKSRVSTTSSGNKS

SEQ ID NO: 2656536 - protein, 5 aa, Entamoeba histolytica
SKSVS

SEQ ID NO: 2656537 - protein, 7 aa, Entamoeba histolytica
SKSVSLN

SEQ ID NO: 2656538 - protein, 4 aa, Entamoeba histolytica
SKSY

SEQ ID NO: 2656539 - protein, 9 aa, Entamoeba histolytica
SKTANENEI

SEQ ID NO: 2656540 - protein, 7 aa, Entamoeba histolytica
SKTANEQ

SEQ ID NO: 2656541 - protein, 10 aa, Entamoeba histolytica
SKTASSRMSA

SEQ ID NO: 2656542 - protein, 7 aa, Entamoeba histolytica
SKTEAGC

SEQ ID NO: 2656543 - protein, 5 aa, Entamoeba histolytica
SKTEI

SEQ ID NO: 2656544 - protein, 8 aa, Entamoeba histolytica
SKTEPKID

SEQ ID NO: 2656545 - protein, 37 aa, Entamoeba histolytica
SKTFNKKNEENSLKITSEKTIHKTKPLPPPKKSTEIT

SEQ ID NO: 2656546 - protein, 6 aa, Entamoeba histolytica
SKTFQA

SEQ ID NO: 2656547 - protein, 4 aa, Entamoeba histolytica
SKTG

SEQ ID NO: 2656548 - protein, 12 aa, Entamoeba histolytica
SKTGPSKGSTMS

SEQ ID NO: 2656549 - protein, 7 aa, Entamoeba histolytica
SKTGQHG

SEQ ID NO: 2656550 - protein, 4 aa, Entamoeba histolytica
SKTH

SEQ ID NO: 2656551 - protein, 6 aa, Entamoeba histolytica
SKTHSD

SEQ ID NO: 2656552 - protein, 4 aa, Entamoeba histolytica
SKTI

SEQ ID NO: 2656553 - protein, 5 aa, Entamoeba histolytica
SKTID

SEQ ID NO: 2656554 - protein, 22 aa, Entamoeba histolytica
SKTIERNNLNNSCNTRKNGRSL

SEQ ID NO: 2656555 - protein, 53 aa, Entamoeba histolytica
SKTKAPDYSNSSSCKTPTATNTKSVNHPLNESGTITQTQKTNGNSDKPGSVEI

SEQ ID NO: 2656556 - protein, 7 aa, Entamoeba histolytica
SKTKCHQ

SEQ ID NO: 2656557 - protein, 13 aa, Entamoeba histolytica
SKTKDKKVEKNSG

SEQ ID NO: 2656558 - protein, 8 aa, Entamoeba histolytica
SKTKEANC

SEQ ID NO: 2656559 - protein, 7 aa, Entamoeba histolytica
SKTKEEM

SEQ ID NO: 2656560 - protein, 6 aa, Entamoeba histolytica
SKTKEI

SEQ ID NO: 2656561 - protein, 7 aa, Entamoeba histolytica
SKTKEIE

SEQ ID NO: 2656562 - protein, 7 aa, Entamoeba histolytica
SKTKKCG

SEQ ID NO: 2656563 - protein, 12 aa, Entamoeba histolytica
SKTKKSLTISKG

SEQ ID NO: 2656564 - protein, 9 aa, Entamoeba histolytica
SKTKLFQRN

SEQ ID NO: 2656565 - protein, 8 aa, Entamoeba histolytica
SKTKNLND

SEQ ID NO: 2656566 - protein, 6 aa, Entamoeba histolytica
SKTKQE

SEQ ID NO: 2656567 - protein, 25 aa, Entamoeba histolytica
SKTKQETEEEKEESEQLKRKQIDDE

SEQ ID NO: 2656568 - protein, 11 aa, Entamoeba histolytica
SKTKQKQITTL

SEQ ID NO: 2656569 - protein, 6 aa, Entamoeba histolytica
SKTKYF

SEQ ID NO: 2656570 - protein, 8 aa, Entamoeba histolytica
SKTLPDKL

SEQ ID NO: 2656571 - protein, 6 aa, Entamoeba histolytica
SKTLPK

SEQ ID NO: 2656572 - protein, 10 aa, Entamoeba histolytica
SKTLSVSDET

SEQ ID NO: 2656573 - protein, 14 aa, Entamoeba histolytica
SKTMEKDKEEIEKL

SEQ ID NO: 2656574 - protein, 8 aa, Entamoeba histolytica
SKTMKSKG

SEQ ID NO: 2656575 - protein, 10 aa, Entamoeba histolytica
SKTMPAIPKN

SEQ ID NO: 2656576 - protein, 7 aa, Entamoeba histolytica
SKTNDSL

SEQ ID NO: 2656577 - protein, 16 aa, Entamoeba histolytica
SKTNESPRIEDKEKTC

SEQ ID NO: 2656578 - protein, 13 aa, Entamoeba histolytica
SKTNSSLKALGGS

SEQ ID NO: 2656579 - protein, 9 aa, Entamoeba histolytica
SKTPKTPSM

SEQ ID NO: 2656580 - protein, 7 aa, Entamoeba histolytica
SKTPLSL

SEQ ID NO: 2656581 - protein, 40 aa, Entamoeba histolytica
SKTPNPSSTNPFGDEPPKLTSSTSKQGLTKSFKDQPPRIS

SEQ ID NO: 2656582 - protein, 7 aa, Entamoeba histolytica
SKTPPEK

SEQ ID NO: 2656583 - protein, 5 aa, Entamoeba histolytica
SKTPQ

SEQ ID NO: 2656584 - protein, 15 aa, Entamoeba histolytica
SKTPSFNNDSKPFYQ

SEQ ID NO: 2656585 - protein, 8 aa, Entamoeba histolytica
SKTPTPKK

SEQ ID NO: 2656586 - protein, 4 aa, Entamoeba histolytica
SKTQ

SEQ ID NO: 2656587 - protein, 8 aa, Entamoeba histolytica
SKTQGVSP

SEQ ID NO: 2656588 - protein, 7 aa, Entamoeba histolytica
SKTRDPQ

SEQ ID NO: 2656589 - protein, 9 aa, Entamoeba histolytica
SKTRTPEEI

SEQ ID NO: 2656590 - protein, 5 aa, Entamoeba histolytica
SKTSF

SEQ ID NO: 2656591 - protein, 20 aa, Entamoeba histolytica
SKTSLKKKNKSNSKDEYKKR

SEQ ID NO: 2656592 - protein, 9 aa, Entamoeba histolytica
SKTSQNHQF

SEQ ID NO: 2656593 - protein, 7 aa, Entamoeba histolytica
SKTSQNR

SEQ ID NO: 2656594 - protein, 11 aa, Entamoeba histolytica
SKTSRGKCKSC

SEQ ID NO: 2656595 - protein, 6 aa, Entamoeba histolytica
SKTSYP

SEQ ID NO: 2656596 - protein, 15 aa, Entamoeba histolytica
SKTTDEEVGDGTTSV

SEQ ID NO: 2656597 - protein, 4 aa, Entamoeba histolytica
SKTV

SEQ ID NO: 2656598 - protein, 7 aa, Entamoeba histolytica
SKTVTYN

SEQ ID NO: 2656599 - protein, 8 aa, Entamoeba histolytica
SKTYNIPG

SEQ ID NO: 2656600 - protein, 15 aa, Entamoeba histolytica
SKVGALKGEYQDATP

SEQ ID NO: 2656601 - protein, 9 aa, Entamoeba histolytica
SKVGDEQSE

SEQ ID NO: 2656602 - protein, 4 aa, Entamoeba histolytica
SKVI

SEQ ID NO: 2656603 - protein, 8 aa, Entamoeba histolytica
SKVKEQKR

SEQ ID NO: 2656604 - protein, 22 aa, Entamoeba histolytica
SKVKGKKKQNQTTPNQINEELN

SEQ ID NO: 2656605 - protein, 6 aa, Entamoeba histolytica
SKVMNE

SEQ ID NO: 2656606 - protein, 9 aa, Entamoeba histolytica
SKVNDKENI

SEQ ID NO: 2656607 - protein, 11 aa, Entamoeba histolytica
SKVNQKYLPPK

SEQ ID NO: 2656608 - protein, 15 aa, Entamoeba histolytica
SKVPGAQFESEIGGL

SEQ ID NO: 2656609 - protein, 6 aa, Entamoeba histolytica
SKVPHS

SEQ ID NO: 2656610 - protein, 13 aa, Entamoeba histolytica
SKVPKEKHKKRGK

SEQ ID NO: 2656611 - protein, 7 aa, Entamoeba histolytica
SKVPSKS

SEQ ID NO: 2656612 - protein, 5 aa, Entamoeba histolytica
SKVPT

SEQ ID NO: 2656613 - protein, 4 aa, Entamoeba histolytica
SKVS

SEQ ID NO: 2656614 - protein, 24 aa, Entamoeba histolytica
SKVSHPNEEISTEDVTSNNGNENI

SEQ ID NO: 2656615 - protein, 9 aa, Entamoeba histolytica
SKVSPKARR

SEQ ID NO: 2656616 - protein, 5 aa, Entamoeba histolytica
SKVTS

SEQ ID NO: 2656617 - protein, 16 aa, Entamoeba histolytica
SKYAEGKAGINKQESI

SEQ ID NO: 2656618 - protein, 6 aa, Entamoeba histolytica
SKYDAT

SEQ ID NO: 2656619 - protein, 10 aa, Entamoeba histolytica
SKYDGESQKD

SEQ ID NO: 2656620 - protein, 8 aa, Entamoeba histolytica
SKYDQLKS

SEQ ID NO: 2656621 - protein, 14 aa, Entamoeba histolytica
SKYEDDSLSSKETI

SEQ ID NO: 2656622 - protein, 9 aa, Entamoeba histolytica
SKYGEEGGK

SEQ ID NO: 2656623 - protein, 6 aa, Entamoeba histolytica
SKYGSI

SEQ ID NO: 2656624 - protein, 8 aa, Entamoeba histolytica
SKYGSNEK

SEQ ID NO: 2656625 - protein, 9 aa, Entamoeba histolytica
SKYKDVSKY

SEQ ID NO: 2656626 - protein, 7 aa, Entamoeba histolytica
SKYKKTT

SEQ ID NO: 2656627 - protein, 6 aa, Entamoeba histolytica
SKYNSS

SEQ ID NO: 2656628 - protein, 8 aa, Entamoeba histolytica
SKYPEPQN

SEQ ID NO: 2656629 - protein, 11 aa, Entamoeba histolytica
SKYPVDAQPHP

SEQ ID NO: 2656630 - protein, 8 aa, Entamoeba histolytica
SKYQDERQ

SEQ ID NO: 2656631 - protein, 25 aa, Entamoeba histolytica
SKYQSLNQQTQSDSIQSDLSDPLTQ

SEQ ID NO: 2656632 - protein, 8 aa, Entamoeba histolytica
SKYSGLSS

SEQ ID NO: 2656633 - protein, 11 aa, Entamoeba histolytica
SKYSKPTSKTL

SEQ ID NO: 2656634 - protein, 5 aa, Entamoeba histolytica
SKYSN

SEQ ID NO: 2656635 - protein, 6 aa, Entamoeba histolytica
SKYSNS

SEQ ID NO: 2656636 - protein, 11 aa, Entamoeba histolytica
SKYSPSRNAEL

SEQ ID NO: 2656637 - protein, 8 aa, Entamoeba histolytica
SKYSPYST

SEQ ID NO: 2656638 - protein, 8 aa, Entamoeba histolytica
SKYSSNKL

SEQ ID NO: 2656639 - protein, 5 aa, Entamoeba histolytica
SKYTP

SEQ ID NO: 2656640 - protein, 6 aa, Entamoeba histolytica
SKYYNH

SEQ ID NO: 2656641 - protein, 13 aa, Entamoeba histolytica
SLAANENDKEAKE

SEQ ID NO: 2656642 - protein, 4 aa, Entamoeba histolytica
SLAD

SEQ ID NO: 2656643 - protein, 9 aa, Entamoeba histolytica
SLADRINSD

SEQ ID NO: 2656644 - protein, 11 aa, Entamoeba histolytica
SLAEMKKTKTF

SEQ ID NO: 2656645 - protein, 5 aa, Entamoeba histolytica
SLANE

SEQ ID NO: 2656646 - protein, 9 aa, Entamoeba histolytica
SLASPDDDK

SEQ ID NO: 2656647 - protein, 5 aa, Entamoeba histolytica
SLASS

SEQ ID NO: 2656648 - protein, 9 aa, Entamoeba histolytica
SLDATRDDA

SEQ ID NO: 2656649 - protein, 8 aa, Entamoeba histolytica
SLDDIDDD

SEQ ID NO: 2656650 - protein, 5 aa, Entamoeba histolytica
SLDDN

SEQ ID NO: 2656651 - protein, 13 aa, Entamoeba histolytica
SLDDTLGSSAPEI

SEQ ID NO: 2656652 - protein, 10 aa, Entamoeba histolytica
SLDEQEKTRN

SEQ ID NO: 2656653 - protein, 16 aa, Entamoeba histolytica
SLDETARKYLSSDTHS

SEQ ID NO: 2656654 - protein, 13 aa, Entamoeba histolytica
SLDGKSRSKNNTF

SEQ ID NO: 2656655 - protein, 5 aa, Entamoeba histolytica
SLDGY

SEQ ID NO: 2656656 - protein, 11 aa, Entamoeba histolytica
SLDKAKEISQL

SEQ ID NO: 2656657 - protein, 13 aa, Entamoeba histolytica
SLDLSETQQSLDN

SEQ ID NO: 2656658 - protein, 9 aa, Entamoeba histolytica
SLDNTQVAE

SEQ ID NO: 2656659 - protein, 8 aa, Entamoeba histolytica
SLDPKEQP

SEQ ID NO: 2656660 - protein, 16 aa, Entamoeba histolytica
SLDPKEYEEQINALSL

SEQ ID NO: 2656661 - protein, 5 aa, Entamoeba histolytica
SLDPN

SEQ ID NO: 2656662 - protein, 6 aa, Entamoeba histolytica
SLDQGT

SEQ ID NO: 2656663 - protein, 14 aa, Entamoeba histolytica
SLDSKDDNYTKSIT

SEQ ID NO: 2656664 - protein, 13 aa, Entamoeba histolytica
SLDSKNHNNYTRV

SEQ ID NO: 2656665 - protein, 11 aa, Entamoeba histolytica
SLDSSLDTFED

SEQ ID NO: 2656666 - protein, 6 aa, Entamoeba histolytica
SLDSSN

SEQ ID NO: 2656667 - protein, 25 aa, Entamoeba histolytica
SLDTKKETNTSTVQRLDEKKKTPED

SEQ ID NO: 2656668 - protein, 7 aa, Entamoeba histolytica
SLDTTAK

SEQ ID NO: 2656669 - protein, 21 aa, Entamoeba histolytica
SLEDKSQTPELSEEDENTLNQ

SEQ ID NO: 2656670 - protein, 25 aa, Entamoeba histolytica
SLEEEKESNDVDELKRGLNNSVSSL

SEQ ID NO: 2656671 - protein, 13 aa, Entamoeba histolytica
SLEEGDKKNGRLP

SEQ ID NO: 2656672 - protein, 6 aa, Entamoeba histolytica
SLEEKN

SEQ ID NO: 2656673 - protein, 27 aa, Entamoeba histolytica
SLEEKYSQDMNVSKQKIKELEERKPAL

SEQ ID NO: 2656674 - protein, 12 aa, Entamoeba histolytica
SLEEQNNDKQIQ

SEQ ID NO: 2656675 - protein, 13 aa, Entamoeba histolytica
SLEEQRETQRKEY

SEQ ID NO: 2656676 - protein, 72 aa, Entamoeba histolytica
SLEERRRKREEERKAREERRAKRAAESNGESKSENTTTETKQESSEERRKRREEREAQREKERAERRARLSN

SEQ ID NO: 2656677 - protein, 17 aa, Entamoeba histolytica
SLEGKYKEVKKQITNHN

SEQ ID NO: 2656678 - protein, 7 aa, Entamoeba histolytica
SLEGPEC

SEQ ID NO: 2656679 - protein, 8 aa, Entamoeba histolytica
SLEGQTYT

SEQ ID NO: 2656680 - protein, 5 aa, Entamoeba histolytica
SLEIT

SEQ ID NO: 2656681 - protein, 4 aa, Entamoeba histolytica
SLEK

SEQ ID NO: 2656682 - protein, 10 aa, Entamoeba histolytica
SLEKENTQNN

SEQ ID NO: 2656683 - protein, 8 aa, Entamoeba histolytica
SLEKITKE

SEQ ID NO: 2656684 - protein, 27 aa, Entamoeba histolytica
SLEKKIESQTNQKPKKEPNQKPKKEID

SEQ ID NO: 2656685 - protein, 19 aa, Entamoeba histolytica
SLEKNSQENDTSKQEINNQ

SEQ ID NO: 2656686 - protein, 8 aa, Entamoeba histolytica
SLENETLT

SEQ ID NO: 2656687 - protein, 9 aa, Entamoeba histolytica
SLENGLNKR

SEQ ID NO: 2656688 - protein, 10 aa, Entamoeba histolytica
SLENSQNEEL

SEQ ID NO: 2656689 - protein, 14 aa, Entamoeba histolytica
SLEPEKNGLIPPKA

SEQ ID NO: 2656690 - protein, 8 aa, Entamoeba histolytica
SLEPMKEK

SEQ ID NO: 2656691 - protein, 5 aa, Entamoeba histolytica
SLERI

SEQ ID NO: 2656692 - protein, 5 aa, Entamoeba histolytica
SLERQ

SEQ ID NO: 2656693 - protein, 6 aa, Entamoeba histolytica
SLERSA

SEQ ID NO: 2656694 - protein, 7 aa, Entamoeba histolytica
SLESQEI

SEQ ID NO: 2656695 - protein, 6 aa, Entamoeba histolytica
SLETEG

SEQ ID NO: 2656696 - protein, 14 aa, Entamoeba histolytica
SLETKTITTYPNTE

SEQ ID NO: 2656697 - protein, 33 aa, Entamoeba histolytica
SLETPPTSTPPMSPQQNQSKSRLSARDARLDKR

SEQ ID NO: 2656698 - protein, 4 aa, Entamoeba histolytica
SLGD

SEQ ID NO: 2656699 - protein, 10 aa, Entamoeba histolytica
SLGDKELHPP

SEQ ID NO: 2656700 - protein, 11 aa, Entamoeba histolytica
SLGDKTYKGKG

SEQ ID NO: 2656701 - protein, 10 aa, Entamoeba histolytica
SLGDRTLHPP

SEQ ID NO: 2656702 - protein, 7 aa, Entamoeba histolytica
SLGDTSI

SEQ ID NO: 2656703 - protein, 12 aa, Entamoeba histolytica
SLGDYSKKCNAY

SEQ ID NO: 2656704 - protein, 21 aa, Entamoeba histolytica
SLGEGRNLPISPKPSSKTWSQ

SEQ ID NO: 2656705 - protein, 5 aa, Entamoeba histolytica
SLGEL

SEQ ID NO: 2656706 - protein, 8 aa, Entamoeba histolytica
SLGIEGSK

SEQ ID NO: 2656707 - protein, 6 aa, Entamoeba histolytica
SLGKMK

SEQ ID NO: 2656708 - protein, 5 aa, Entamoeba histolytica
SLGKN

SEQ ID NO: 2656709 - protein, 20 aa, Entamoeba histolytica
SLGNNDKIITKKQRKKEPLF

SEQ ID NO: 2656710 - protein, 8 aa, Entamoeba histolytica
SLGNNGDI

SEQ ID NO: 2656711 - protein, 8 aa, Entamoeba histolytica
SLGNNGEL

SEQ ID NO: 2656712 - protein, 7 aa, Entamoeba histolytica
SLGPKGM

SEQ ID NO: 2656713 - protein, 9 aa, Entamoeba histolytica
SLGPSSTSL

SEQ ID NO: 2656714 - protein, 8 aa, Entamoeba histolytica
SLGQSGLR

SEQ ID NO: 2656715 - protein, 4 aa, Entamoeba histolytica
SLGS

SEQ ID NO: 2656716 - protein, 5 aa, Entamoeba histolytica
SLGSL

SEQ ID NO: 2656717 - protein, 4 aa, Entamoeba histolytica
SLGW

SEQ ID NO: 2656718 - protein, 14 aa, Entamoeba histolytica
SLHQKEKRLIQIIR

SEQ ID NO: 2656719 - protein, 10 aa, Entamoeba histolytica
SLHQQNSKKI

SEQ ID NO: 2656720 - protein, 8 aa, Entamoeba histolytica
SLIGGESI

SEQ ID NO: 2656721 - protein, 5 aa, Entamoeba histolytica
SLIGN

SEQ ID NO: 2656722 - protein, 5 aa, Entamoeba histolytica
SLIRN

SEQ ID NO: 2656723 - protein, 18 aa, Entamoeba histolytica
SLKDEKTIDELRKENQRL

SEQ ID NO: 2656724 - protein, 7 aa, Entamoeba histolytica
SLKDTFG

SEQ ID NO: 2656725 - protein, 4 aa, Entamoeba histolytica
SLKE

SEQ ID NO: 2656726 - protein, 14 aa, Entamoeba histolytica
SLKEEDGSMKASEH

SEQ ID NO: 2656727 - protein, 8 aa, Entamoeba histolytica
SLKEGDSI

SEQ ID NO: 2656728 - protein, 5 aa, Entamoeba histolytica
SLKEN

SEQ ID NO: 2656729 - protein, 8 aa, Entamoeba histolytica
SLKEQNKK

SEQ ID NO: 2656730 - protein, 5 aa, Entamoeba histolytica
SLKER

SEQ ID NO: 2656731 - protein, 6 aa, Entamoeba histolytica
SLKGDK

SEQ ID NO: 2656732 - protein, 12 aa, Entamoeba histolytica
SLKKKSGREKYG

SEQ ID NO: 2656733 - protein, 5 aa, Entamoeba histolytica
SLKNG

SEQ ID NO: 2656734 - protein, 7 aa, Entamoeba histolytica
SLKNGQV

SEQ ID NO: 2656735 - protein, 7 aa, Entamoeba histolytica
SLKNSQI

SEQ ID NO: 2656736 - protein, 9 aa, Entamoeba histolytica
SLKPKSKKM

SEQ ID NO: 2656737 - protein, 13 aa, Entamoeba histolytica
SLKQAQSKCDKIT

SEQ ID NO: 2656738 - protein, 8 aa, Entamoeba histolytica
SLKQGQNP

SEQ ID NO: 2656739 - protein, 19 aa, Entamoeba histolytica
SLKRMTETLKKEKTLTPIG

SEQ ID NO: 2656740 - protein, 22 aa, Entamoeba histolytica
SLKSKEPEQCFSDKKQKNKCVV

SEQ ID NO: 2656741 - protein, 11 aa, Entamoeba histolytica
SLKSKTSDGIE

SEQ ID NO: 2656742 - protein, 7 aa, Entamoeba histolytica
SLKSNKD

SEQ ID NO: 2656743 - protein, 5 aa, Entamoeba histolytica
SLKSR

SEQ ID NO: 2656744 - protein, 12 aa, Entamoeba histolytica
SLLKERQSDEEI

SEQ ID NO: 2656745 - protein, 18 aa, Entamoeba histolytica
SLLSPKTQITKSKTEPTV

SEQ ID NO: 2656746 - protein, 13 aa, Entamoeba histolytica
SLLSSEKSLPKVN

SEQ ID NO: 2656747 - protein, 7 aa, Entamoeba histolytica
SLNDGDI

SEQ ID NO: 2656748 - protein, 9 aa, Entamoeba histolytica
SLNDNDLEK

SEQ ID NO: 2656749 - protein, 12 aa, Entamoeba histolytica
SLNDNSFSSPPE

SEQ ID NO: 2656750 - protein, 9 aa, Entamoeba histolytica
SLNDSPQQI

SEQ ID NO: 2656751 - protein, 11 aa, Entamoeba histolytica
SLNEDHKPNVP

SEQ ID NO: 2656752 - protein, 27 aa, Entamoeba histolytica
SLNEKQKKQKRISESPSKILQSPSQRI

SEQ ID NO: 2656753 - protein, 9 aa, Entamoeba histolytica
SLNENDEKC

SEQ ID NO: 2656754 - protein, 10 aa, Entamoeba histolytica
SLNENQTSIS

SEQ ID NO: 2656755 - protein, 9 aa, Entamoeba histolytica
SLNENSQID

SEQ ID NO: 2656756 - protein, 11 aa, Entamoeba histolytica
SLNEQNEKINE

SEQ ID NO: 2656757 - protein, 11 aa, Entamoeba histolytica
SLNESSFPEGI

SEQ ID NO: 2656758 - protein, 4 aa, Entamoeba histolytica
SLNG

SEQ ID NO: 2656759 - protein, 17 aa, Entamoeba histolytica
SLNNENNDMTSKIPQLR

SEQ ID NO: 2656760 - protein, 5 aa, Entamoeba histolytica
SLNNP

SEQ ID NO: 2656761 - protein, 5 aa, Entamoeba histolytica
SLNNS

SEQ ID NO: 2656762 - protein, 7 aa, Entamoeba histolytica
SLNPNKS

SEQ ID NO: 2656763 - protein, 10 aa, Entamoeba histolytica
SLNQEIKNKR

SEQ ID NO: 2656764 - protein, 6 aa, Entamoeba histolytica
SLNRKK

SEQ ID NO: 2656765 - protein, 12 aa, Entamoeba histolytica
SLNSDQCKQYRS

SEQ ID NO: 2656766 - protein, 5 aa, Entamoeba histolytica
SLNSG

SEQ ID NO: 2656767 - protein, 6 aa, Entamoeba histolytica
SLNSGL

SEQ ID NO: 2656768 - protein, 11 aa, Entamoeba histolytica
SLNSITKTNGA

SEQ ID NO: 2656769 - protein, 5 aa, Entamoeba histolytica
SLNSP

SEQ ID NO: 2656770 - protein, 12 aa, Entamoeba histolytica
SLNTKTGNNSYQ

SEQ ID NO: 2656771 - protein, 5 aa, Entamoeba histolytica
SLNTN

SEQ ID NO: 2656772 - protein, 33 aa, Entamoeba histolytica
SLNTQRDADKKAADEEKKKKEEQKRAERKARLL

SEQ ID NO: 2656773 - protein, 5 aa, Entamoeba histolytica
SLNTS

SEQ ID NO: 2656774 - protein, 20 aa, Entamoeba histolytica
SLPDDDGIMSEEENEMRGYI

SEQ ID NO: 2656775 - protein, 7 aa, Entamoeba histolytica
SLPDTNK

SEQ ID NO: 2656776 - protein, 7 aa, Entamoeba histolytica
SLPEETK

SEQ ID NO: 2656777 - protein, 5 aa, Entamoeba histolytica
SLPEK

SEQ ID NO: 2656778 - protein, 4 aa, Entamoeba histolytica
SLPF

SEQ ID NO: 2656779 - protein, 5 aa, Entamoeba histolytica
SLPKE

SEQ ID NO: 2656780 - protein, 8 aa, Entamoeba histolytica
SLPKEQRK

SEQ ID NO: 2656781 - protein, 6 aa, Entamoeba histolytica
SLPKGE

SEQ ID NO: 2656782 - protein, 7 aa, Entamoeba histolytica
SLPKKNY

SEQ ID NO: 2656783 - protein, 6 aa, Entamoeba histolytica
SLPKNA

SEQ ID NO: 2656784 - protein, 9 aa, Entamoeba histolytica
SLPKNNGSI

SEQ ID NO: 2656785 - protein, 21 aa, Entamoeba histolytica
SLPKSWRGKENEELEEACGEK

SEQ ID NO: 2656786 - protein, 8 aa, Entamoeba histolytica
SLPNDELK

SEQ ID NO: 2656787 - protein, 14 aa, Entamoeba histolytica
SLPNDLTESHPEMK

SEQ ID NO: 2656788 - protein, 20 aa, Entamoeba histolytica
SLPNEKIEEKEEEKEIKKPL

SEQ ID NO: 2656789 - protein, 6 aa, Entamoeba histolytica
SLPNEN

SEQ ID NO: 2656790 - protein, 12 aa, Entamoeba histolytica
SLPNGNSNETFA

SEQ ID NO: 2656791 - protein, 18 aa, Entamoeba histolytica
SLPNPANKTPECKIGSSN

SEQ ID NO: 2656792 - protein, 5 aa, Entamoeba histolytica
SLPNS

SEQ ID NO: 2656793 - protein, 4 aa, Entamoeba histolytica
SLPP

SEQ ID NO: 2656794 - protein, 9 aa, Entamoeba histolytica
SLPPQKPKR

SEQ ID NO: 2656795 - protein, 12 aa, Entamoeba histolytica
SLPPQPKSIDDT

SEQ ID NO: 2656796 - protein, 26 aa, Entamoeba histolytica
SLPPSTNGETEKKEIKKSEEDSQREI

SEQ ID NO: 2656797 - protein, 8 aa, Entamoeba histolytica
SLPQNEDL

SEQ ID NO: 2656798 - protein, 6 aa, Entamoeba histolytica
SLPQTL

SEQ ID NO: 2656799 - protein, 7 aa, Entamoeba histolytica
SLPRDVD

SEQ ID NO: 2656800 - protein, 39 aa, Entamoeba histolytica
SLPRSGSLSPKPGSRKIKKVPKTSKEEKPQNSPSVEYDI

SEQ ID NO: 2656801 - protein, 8 aa, Entamoeba histolytica
SLPSPQSI

SEQ ID NO: 2656802 - protein, 7 aa, Entamoeba histolytica
SLPSSSQ

SEQ ID NO: 2656803 - protein, 9 aa, Entamoeba histolytica
SLPSSTTLQ

SEQ ID NO: 2656804 - protein, 7 aa, Entamoeba histolytica
SLPSSYS

SEQ ID NO: 2656805 - protein, 12 aa, Entamoeba histolytica
SLPTNTDMEAGE

SEQ ID NO: 2656806 - protein, 13 aa, Entamoeba histolytica
SLPTSKSPKINNY

SEQ ID NO: 2656807 - protein, 10 aa, Entamoeba histolytica
SLPTSNEEST

SEQ ID NO: 2656808 - protein, 20 aa, Entamoeba histolytica
SLPTTKKNERFTVKVKHFIH

SEQ ID NO: 2656809 - protein, 7 aa, Entamoeba histolytica
SLPVPAK

SEQ ID NO: 2656810 - protein, 7 aa, Entamoeba histolytica
SLPYKDS

SEQ ID NO: 2656811 - protein, 11 aa, Entamoeba histolytica
SLQEENTTHEI

SEQ ID NO: 2656812 - protein, 6 aa, Entamoeba histolytica
SLQKEM

SEQ ID NO: 2656813 - protein, 13 aa, Entamoeba histolytica
SLQNEREDQSTVQ

SEQ ID NO: 2656814 - protein, 9 aa, Entamoeba histolytica
SLQNIPQKL

SEQ ID NO: 2656815 - protein, 11 aa, Entamoeba histolytica
SLQPEVKNQTV

SEQ ID NO: 2656816 - protein, 21 aa, Entamoeba histolytica
SLQPKSSCSSSQTSPRTLTSQ

SEQ ID NO: 2656817 - protein, 15 aa, Entamoeba histolytica
SLQPSETSQYQNSSF

SEQ ID NO: 2656818 - protein, 15 aa, Entamoeba histolytica
SLQQERYSNLPKDNE

SEQ ID NO: 2656819 - protein, 8 aa, Entamoeba histolytica
SLQRDKTN

SEQ ID NO: 2656820 - protein, 5 aa, Entamoeba histolytica
SLQRR

SEQ ID NO: 2656821 - protein, 6 aa, Entamoeba histolytica
SLQSTQ

SEQ ID NO: 2656822 - protein, 8 aa, Entamoeba histolytica
SLQSTVDA

SEQ ID NO: 2656823 - protein, 14 aa, Entamoeba histolytica
SLQTQKGTKDYPEQ

SEQ ID NO: 2656824 - protein, 9 aa, Entamoeba histolytica
SLRDEKGVP

SEQ ID NO: 2656825 - protein, 8 aa, Entamoeba histolytica
SLREDTGF

SEQ ID NO: 2656826 - protein, 6 aa, Entamoeba histolytica
SLRETS

SEQ ID NO: 2656827 - protein, 11 aa, Entamoeba histolytica
SLRKERKEEYN

SEQ ID NO: 2656828 - protein, 9 aa, Entamoeba histolytica
SLRKVESKV

SEQ ID NO: 2656829 - protein, 12 aa, Entamoeba histolytica
SLRNNKENIDET

SEQ ID NO: 2656830 - protein, 9 aa, Entamoeba histolytica
SLRQQKPKA

SEQ ID NO: 2656831 - protein, 7 aa, Entamoeba histolytica
SLRSDGY

SEQ ID NO: 2656832 - protein, 9 aa, Entamoeba histolytica
SLRTQTREE

SEQ ID NO: 2656833 - protein, 4 aa, Entamoeba histolytica
SLSD

SEQ ID NO: 2656834 - protein, 5 aa, Entamoeba histolytica
SLSDL

SEQ ID NO: 2656835 - protein, 8 aa, Entamoeba histolytica
SLSETTQI

SEQ ID NO: 2656836 - protein, 10 aa, Entamoeba histolytica
SLSGGRSCQN

SEQ ID NO: 2656837 - protein, 6 aa, Entamoeba histolytica
SLSGQA

SEQ ID NO: 2656838 - protein, 8 aa, Entamoeba histolytica
SLSKAPKE

SEQ ID NO: 2656839 - protein, 33 aa, Entamoeba histolytica
SLSLNEKAAKFKPIKDEIKNENIHQTPSKENAI

SEQ ID NO: 2656840 - protein, 9 aa, Entamoeba histolytica
SLSNDGEIQ

SEQ ID NO: 2656841 - protein, 6 aa, Entamoeba histolytica
SLSNPT

SEQ ID NO: 2656842 - protein, 7 aa, Entamoeba histolytica
SLSPEIT

SEQ ID NO: 2656843 - protein, 7 aa, Entamoeba histolytica
SLSPGSF

SEQ ID NO: 2656844 - protein, 8 aa, Entamoeba histolytica
SLSPKDLG

SEQ ID NO: 2656845 - protein, 17 aa, Entamoeba histolytica
SLSPKKIEKDRINKEQF

SEQ ID NO: 2656846 - protein, 7 aa, Entamoeba histolytica
SLSPQQI

SEQ ID NO: 2656847 - protein, 24 aa, Entamoeba histolytica
SLSPRLDPSHNSHSPRMKKERSWR

SEQ ID NO: 2656848 - protein, 29 aa, Entamoeba histolytica
SLSPTSGSPFSRSPRGSRIEVTDKKQTLP

SEQ ID NO: 2656849 - protein, 11 aa, Entamoeba histolytica
SLSQELKDELQ

SEQ ID NO: 2656850 - protein, 19 aa, Entamoeba histolytica
SLSRSTQKQSLTKKLDNNT

SEQ ID NO: 2656851 - protein, 5 aa, Entamoeba histolytica
SLSSE

SEQ ID NO: 2656852 - protein, 8 aa, Entamoeba histolytica
SLSSKVEG

SEQ ID NO: 2656853 - protein, 7 aa, Entamoeba histolytica
SLSSLGR

SEQ ID NO: 2656854 - protein, 8 aa, Entamoeba histolytica
SLSSREGI

SEQ ID NO: 2656855 - protein, 10 aa, Entamoeba histolytica
SLSSSSKKTT

SEQ ID NO: 2656856 - protein, 10 aa, Entamoeba histolytica
SLSSTPSMSP

SEQ ID NO: 2656857 - protein, 5 aa, Entamoeba histolytica
SLSTP

SEQ ID NO: 2656858 - protein, 7 aa, Entamoeba histolytica
SLSTQKA

SEQ ID NO: 2656859 - protein, 16 aa, Entamoeba histolytica
SLSTSTTNLRDNNSEI

SEQ ID NO: 2656860 - protein, 5 aa, Entamoeba histolytica
SLSVT

SEQ ID NO: 2656861 - protein, 13 aa, Entamoeba histolytica
SLSYNKSLYEFLS

SEQ ID NO: 2656862 - protein, 7 aa, Entamoeba histolytica
SLTAGTE

SEQ ID NO: 2656863 - protein, 5 aa, Entamoeba histolytica
SLTAT

SEQ ID NO: 2656864 - protein, 5 aa, Entamoeba histolytica
SLTDG

SEQ ID NO: 2656865 - protein, 6 aa, Entamoeba histolytica
SLTDNL

SEQ ID NO: 2656866 - protein, 9 aa, Entamoeba histolytica
SLTDQAQTI

SEQ ID NO: 2656867 - protein, 5 aa, Entamoeba histolytica
SLTGN

SEQ ID NO: 2656868 - protein, 5 aa, Entamoeba histolytica
SLTGR

SEQ ID NO: 2656869 - protein, 9 aa, Entamoeba histolytica
SLTGSNRES

SEQ ID NO: 2656870 - protein, 12 aa, Entamoeba histolytica
SLTKQQSSSDFI

SEQ ID NO: 2656871 - protein, 6 aa, Entamoeba histolytica
SLTNKE

SEQ ID NO: 2656872 - protein, 7 aa, Entamoeba histolytica
SLTNNRK

SEQ ID NO: 2656873 - protein, 7 aa, Entamoeba histolytica
SLTPPKG

SEQ ID NO: 2656874 - protein, 7 aa, Entamoeba histolytica
SLTPTNK

SEQ ID NO: 2656875 - protein, 8 aa, Entamoeba histolytica
SLTPTSSD

SEQ ID NO: 2656876 - protein, 4 aa, Entamoeba histolytica
SLTQ

SEQ ID NO: 2656877 - protein, 24 aa, Entamoeba histolytica
SLTQPEKGLAETTSDNSNNPSGGL

SEQ ID NO: 2656878 - protein, 18 aa, Entamoeba histolytica
SLTQQPITTHEKTIETNP

SEQ ID NO: 2656879 - protein, 8 aa, Entamoeba histolytica
SLTSNSYK

SEQ ID NO: 2656880 - protein, 7 aa, Entamoeba histolytica
SLTSSKQ

SEQ ID NO: 2656881 - protein, 5 aa, Entamoeba histolytica
SLTSV

SEQ ID NO: 2656882 - protein, 21 aa, Entamoeba histolytica
SLTTEGKDEEEEGINDNFPST

SEQ ID NO: 2656883 - protein, 12 aa, Entamoeba histolytica
SLTTGPRVEEAM

SEQ ID NO: 2656884 - protein, 6 aa, Entamoeba histolytica
SLTTPK

SEQ ID NO: 2656885 - protein, 8 aa, Entamoeba histolytica
SLTTQTIE

SEQ ID NO: 2656886 - protein, 9 aa, Entamoeba histolytica
SLTTSKEEI

SEQ ID NO: 2656887 - protein, 8 aa, Entamoeba histolytica
SLTTTNDK

SEQ ID NO: 2656888 - protein, 8 aa, Entamoeba histolytica
SLTYATVS

SEQ ID NO: 2656889 - protein, 11 aa, Entamoeba histolytica
SLVKGKDDISE

SEQ ID NO: 2656890 - protein, 4 aa, Entamoeba histolytica
SLYG

SEQ ID NO: 2656891 - protein, 16 aa, Entamoeba histolytica
SLYPKSPIKQEKEIDI

SEQ ID NO: 2656892 - protein, 6 aa, Entamoeba histolytica
SMADDV

SEQ ID NO: 2656893 - protein, 5 aa, Entamoeba histolytica
SMDEG

SEQ ID NO: 2656894 - protein, 4 aa, Entamoeba histolytica
SMDF

SEQ ID NO: 2656895 - protein, 17 aa, Entamoeba histolytica
SMDNESNEEYQEKRDIK

SEQ ID NO: 2656896 - protein, 5 aa, Entamoeba histolytica
SMDNP

SEQ ID NO: 2656897 - protein, 4 aa, Entamoeba histolytica
SMDP

SEQ ID NO: 2656898 - protein, 4 aa, Entamoeba histolytica
SMED

SEQ ID NO: 2656899 - protein, 9 aa, Entamoeba histolytica
SMEDKSKYM

SEQ ID NO: 2656900 - protein, 8 aa, Entamoeba histolytica
SMEDQSPL

SEQ ID NO: 2656901 - protein, 6 aa, Entamoeba histolytica
SMEGYY

SEQ ID NO: 2656902 - protein, 8 aa, Entamoeba histolytica
SMEKENNK

SEQ ID NO: 2656903 - protein, 11 aa, Entamoeba histolytica
SMEKRLPPSTF

SEQ ID NO: 2656904 - protein, 18 aa, Entamoeba histolytica
SMGKSEYGSLDITPRGEY

SEQ ID NO: 2656905 - protein, 5 aa, Entamoeba histolytica
SMGQK

SEQ ID NO: 2656906 - protein, 9 aa, Entamoeba histolytica
SMINKKDGL

SEQ ID NO: 2656907 - protein, 4 aa, Entamoeba histolytica
SMKE

SEQ ID NO: 2656908 - protein, 9 aa, Entamoeba histolytica
SMKKEEEHE

SEQ ID NO: 2656909 - protein, 5 aa, Entamoeba histolytica
SMKKT

SEQ ID NO: 2656910 - protein, 13 aa, Entamoeba histolytica
SMKQKLERKKQGI

SEQ ID NO: 2656911 - protein, 9 aa, Entamoeba histolytica
SMKQKSDPM

SEQ ID NO: 2656912 - protein, 5 aa, Entamoeba histolytica
SMKTN

SEQ ID NO: 2656913 - protein, 8 aa, Entamoeba histolytica
SMNERNKE

SEQ ID NO: 2656914 - protein, 5 aa, Entamoeba histolytica
SMNGQ

SEQ ID NO: 2656915 - protein, 7 aa, Entamoeba histolytica
SMNPKRS

SEQ ID NO: 2656916 - protein, 227 aa, Entamoeba histolytica
SMNSQQPVSTGTTPATGAQPYPAYNAQQPTLNLPNNNQYYGQAGTFNPQQQPNPMQQPTNPIQQPTNPIQQPTNPIQQPTNPIQQPTNNTTNQQRVDGSSNTCTSQQTTTPSQQKGCQQQEYNTQQQYSGYGVQGKDGQQPIQQQYPGYNIEQPNEQQQKQTDKHNSQPTATSSSIPYTQQQTATIPQQGNNDPSSVGISPLPPAGMSGQQQNGQVSGGYNAYPNMP

SEQ ID NO: 2656917 - protein, 25 aa, Entamoeba histolytica
SMPNLPTTFPKTTRNSTSPQMSLAK

SEQ ID NO: 2656918 - protein, 17 aa, Entamoeba histolytica
SMPPTPLPQTPSLQTPG

SEQ ID NO: 2656919 - protein, 13 aa, Entamoeba histolytica
SMQKSSSSEGVSH

SEQ ID NO: 2656920 - protein, 9 aa, Entamoeba histolytica
SMRGGDENA

SEQ ID NO: 2656921 - protein, 14 aa, Entamoeba histolytica
SMRKENKNISENAS

SEQ ID NO: 2656922 - protein, 6 aa, Entamoeba histolytica
SMRPNN

SEQ ID NO: 2656923 - protein, 18 aa, Entamoeba histolytica
SMRSGYYKELEKDLLLIQ

SEQ ID NO: 2656924 - protein, 8 aa, Entamoeba histolytica
SMSDSEKL

SEQ ID NO: 2656925 - protein, 8 aa, Entamoeba histolytica
SMSNGTNL

SEQ ID NO: 2656926 - protein, 17 aa, Entamoeba histolytica
SMSPKGTPRQPANITVV

SEQ ID NO: 2656927 - protein, 6 aa, Entamoeba histolytica
SMSSNN

SEQ ID NO: 2656928 - protein, 4 aa, Entamoeba histolytica
SMTE

SEQ ID NO: 2656929 - protein, 11 aa, Entamoeba histolytica
SMTEHQKTKKV

SEQ ID NO: 2656930 - protein, 13 aa, Entamoeba histolytica
SMTGQSLNEDEEI

SEQ ID NO: 2656931 - protein, 8 aa, Entamoeba histolytica
SMTNDGKN

SEQ ID NO: 2656932 - protein, 19 aa, Entamoeba histolytica
SMTNTDELPVSSSFVGKYQ

SEQ ID NO: 2656933 - protein, 4 aa, Entamoeba histolytica
SMTP

SEQ ID NO: 2656934 - protein, 6 aa, Entamoeba histolytica
SMTPVD

SEQ ID NO: 2656935 - protein, 7 aa, Entamoeba histolytica
SMTSEEL

SEQ ID NO: 2656936 - protein, 18 aa, Entamoeba histolytica
SMYGRKANEKERNKKSPC

SEQ ID NO: 2656937 - protein, 7 aa, Entamoeba histolytica
SMYRNKN

SEQ ID NO: 2656938 - protein, 7 aa, Entamoeba histolytica
SNAAKSV

SEQ ID NO: 2656939 - protein, 5 aa, Entamoeba histolytica
SNAAV

SEQ ID NO: 2656940 - protein, 15 aa, Entamoeba histolytica
SNAEQMKDKEKNIEE

SEQ ID NO: 2656941 - protein, 4 aa, Entamoeba histolytica
SNAF

SEQ ID NO: 2656942 - protein, 8 aa, Entamoeba histolytica
SNAFKETR

SEQ ID NO: 2656943 - protein, 4 aa, Entamoeba histolytica
SNAI

SEQ ID NO: 2656944 - protein, 5 aa, Entamoeba histolytica
SNAKS

SEQ ID NO: 2656945 - protein, 10 aa, Entamoeba histolytica
SNALSETEDL

SEQ ID NO: 2656946 - protein, 8 aa, Entamoeba histolytica
SNANEKKQ

SEQ ID NO: 2656947 - protein, 16 aa, Entamoeba histolytica
SNAPHKLESSQYNERV

SEQ ID NO: 2656948 - protein, 7 aa, Entamoeba histolytica
SNAPLGP

SEQ ID NO: 2656949 - protein, 8 aa, Entamoeba histolytica
SNAPSDQF

SEQ ID NO: 2656950 - protein, 4 aa, Entamoeba histolytica
SNAT

SEQ ID NO: 2656951 - protein, 22 aa, Entamoeba histolytica
SNATEETTKELEQTEEKKITKQ

SEQ ID NO: 2656952 - protein, 8 aa, Entamoeba histolytica
SNATESDK

SEQ ID NO: 2656953 - protein, 9 aa, Entamoeba histolytica
SNATSDKNK

SEQ ID NO: 2656954 - protein, 11 aa, Entamoeba histolytica
SNATTNSPIRR

SEQ ID NO: 2656955 - protein, 4 aa, Entamoeba histolytica
SNAV

SEQ ID NO: 2656956 - protein, 4 aa, Entamoeba histolytica
SNAY

SEQ ID NO: 2656957 - protein, 13 aa, Entamoeba histolytica
SNCDNTKKLHSIS

SEQ ID NO: 2656958 - protein, 11 aa, Entamoeba histolytica
SNCHPESKTRN

SEQ ID NO: 2656959 - protein, 5 aa, Entamoeba histolytica
SNCSP

SEQ ID NO: 2656960 - protein, 11 aa, Entamoeba histolytica
SNCSSSRNHHK

SEQ ID NO: 2656961 - protein, 7 aa, Entamoeba histolytica
SNDDEQY

SEQ ID NO: 2656962 - protein, 5 aa, Entamoeba histolytica
SNDDL

SEQ ID NO: 2656963 - protein, 8 aa, Entamoeba histolytica
SNDDLNAN

SEQ ID NO: 2656964 - protein, 16 aa, Entamoeba histolytica
SNDDNNDDNTNTNEKI

SEQ ID NO: 2656965 - protein, 16 aa, Entamoeba histolytica
SNDDNNDDTDNTNEKI

SEQ ID NO: 2656966 - protein, 10 aa, Entamoeba histolytica
SNDDSERLDE

SEQ ID NO: 2656967 - protein, 17 aa, Entamoeba histolytica
SNDDSNNDDDTNSNEKI

SEQ ID NO: 2656968 - protein, 8 aa, Entamoeba histolytica
SNDECVSP

SEQ ID NO: 2656969 - protein, 10 aa, Entamoeba histolytica
SNDERDKKAT

SEQ ID NO: 2656970 - protein, 7 aa, Entamoeba histolytica
SNDERTT

SEQ ID NO: 2656971 - protein, 5 aa, Entamoeba histolytica
SNDES

SEQ ID NO: 2656972 - protein, 5 aa, Entamoeba histolytica
SNDFI

SEQ ID NO: 2656973 - protein, 6 aa, Entamoeba histolytica
SNDFQS

SEQ ID NO: 2656974 - protein, 4 aa, Entamoeba histolytica
SNDG

SEQ ID NO: 2656975 - protein, 8 aa, Entamoeba histolytica
SNDGNEIP

SEQ ID NO: 2656976 - protein, 8 aa, Entamoeba histolytica
SNDITKPL

SEQ ID NO: 2656977 - protein, 6 aa, Entamoeba histolytica
SNDKKA

SEQ ID NO: 2656978 - protein, 10 aa, Entamoeba histolytica
SNDKKSICDA

SEQ ID NO: 2656979 - protein, 6 aa, Entamoeba histolytica
SNDKPF

SEQ ID NO: 2656980 - protein, 10 aa, Entamoeba histolytica
SNDKRKEKID

SEQ ID NO: 2656981 - protein, 5 aa, Entamoeba histolytica
SNDKT

SEQ ID NO: 2656982 - protein, 5 aa, Entamoeba histolytica
SNDLN

SEQ ID NO: 2656983 - protein, 5 aa, Entamoeba histolytica
SNDND

SEQ ID NO: 2656984 - protein, 7 aa, Entamoeba histolytica
SNDNDSV

SEQ ID NO: 2656985 - protein, 9 aa, Entamoeba histolytica
SNDNTLTPI

SEQ ID NO: 2656986 - protein, 65 aa, Entamoeba histolytica
SNDNYNEEEEHNKGTISNEKDESHSSIKSPKKPQIESQDTSIKKEIRKKENPTDVSTIKKDTDKL

SEQ ID NO: 2656987 - protein, 8 aa, Entamoeba histolytica
SNDPIITS

SEQ ID NO: 2656988 - protein, 6 aa, Entamoeba histolytica
SNDPVP

SEQ ID NO: 2656989 - protein, 7 aa, Entamoeba histolytica
SNDQENQ

SEQ ID NO: 2656990 - protein, 9 aa, Entamoeba histolytica
SNDQNKEAI

SEQ ID NO: 2656991 - protein, 14 aa, Entamoeba histolytica
SNDQVEKAGKRAGN

SEQ ID NO: 2656992 - protein, 74 aa, Entamoeba histolytica
  misc_feature (19)..(52): Xaa can be any naturally occurring amino acid
SNDQVEKAGKRAGNFLDFXXXXXXXXXXXXXXXXXXXXXXXXXXXXXXXXXXQTFKYSKDNLYITFGISFFTSM

SEQ ID NO: 2656993 - protein, 9 aa, Entamoeba histolytica
SNDSEETSL

SEQ ID NO: 2656994 - protein, 7 aa, Entamoeba histolytica
SNDSNNT

SEQ ID NO: 2656995 - protein, 7 aa, Entamoeba histolytica
SNDSSFE

SEQ ID NO: 2656996 - protein, 8 aa, Entamoeba histolytica
SNDSSNYY

SEQ ID NO: 2656997 - protein, 13 aa, Entamoeba histolytica
SNDSYKVEEGNVN

SEQ ID NO: 2656998 - protein, 4 aa, Entamoeba histolytica
SNDT

SEQ ID NO: 2656999 - protein, 5 aa, Entamoeba histolytica
SNDTD

SEQ ID NO: 2657000 - protein, 7 aa, Entamoeba histolytica
SNDVGSP

SEQ ID NO: 2657001 - protein, 7 aa, Entamoeba histolytica
SNDWGNE

SEQ ID NO: 2657002 - protein, 9 aa, Entamoeba histolytica
SNEAKNSIH

SEQ ID NO: 2657003 - protein, 4 aa, Entamoeba histolytica
SNED

SEQ ID NO: 2657004 - protein, 5 aa, Entamoeba histolytica
SNEDI

SEQ ID NO: 2657005 - protein, 8 aa, Entamoeba histolytica
SNEDIEHD

SEQ ID NO: 2657006 - protein, 10 aa, Entamoeba histolytica
SNEEDKDSNG

SEQ ID NO: 2657007 - protein, 13 aa, Entamoeba histolytica
SNEEEGLHSPNKK

SEQ ID NO: 2657008 - protein, 23 aa, Entamoeba histolytica
SNEEEPKEEPSLVTTKEKLEQDN

SEQ ID NO: 2657009 - protein, 7 aa, Entamoeba histolytica
SNEEEPL

SEQ ID NO: 2657010 - protein, 7 aa, Entamoeba histolytica
SNEENEE

SEQ ID NO: 2657011 - protein, 55 aa, Entamoeba histolytica
SNEENTNEEQEEEEEEEDDSEEEEDESDVVEEKKEKKPESEEKKPIQSKEAYGFS

SEQ ID NO: 2657012 - protein, 5 aa, Entamoeba histolytica
SNEET

SEQ ID NO: 2657013 - protein, 6 aa, Entamoeba histolytica
SNEEVT

SEQ ID NO: 2657014 - protein, 6 aa, Entamoeba histolytica
SNEGFT

SEQ ID NO: 2657015 - protein, 7 aa, Entamoeba histolytica
SNEGNYP

SEQ ID NO: 2657016 - protein, 28 aa, Entamoeba histolytica
SNEGSNEKEQRKHSCSEDSEYEEKRTLI

SEQ ID NO: 2657017 - protein, 12 aa, Entamoeba histolytica
SNEHNSIKTGTR

SEQ ID NO: 2657018 - protein, 8 aa, Entamoeba histolytica
SNEHNSPF

SEQ ID NO: 2657019 - protein, 4 aa, Entamoeba histolytica
SNEI

SEQ ID NO: 2657020 - protein, 5 aa, Entamoeba histolytica
SNEIS

SEQ ID NO: 2657021 - protein, 5 aa, Entamoeba histolytica
SNEKE

SEQ ID NO: 2657022 - protein, 7 aa, Entamoeba histolytica
SNEKELS

SEQ ID NO: 2657023 - protein, 31 aa, Entamoeba histolytica
SNEKPKSNSTQDSSTEKLKESNTNVETPLAN

SEQ ID NO: 2657024 - protein, 4 aa, Entamoeba histolytica
SNEL

SEQ ID NO: 2657025 - protein, 15 aa, Entamoeba histolytica
SNELEDLTVEGVSLS

SEQ ID NO: 2657026 - protein, 8 aa, Entamoeba histolytica
SNELKTIT

SEQ ID NO: 2657027 - protein, 4 aa, Entamoeba histolytica
SNEM

SEQ ID NO: 2657028 - protein, 5 aa, Entamoeba histolytica
SNEND

SEQ ID NO: 2657029 - protein, 7 aa, Entamoeba histolytica
SNENEEL

SEQ ID NO: 2657030 - protein, 12 aa, Entamoeba histolytica
SNENESNKTKEG

SEQ ID NO: 2657031 - protein, 9 aa, Entamoeba histolytica
SNENESTVE

SEQ ID NO: 2657032 - protein, 7 aa, Entamoeba histolytica
SNENLEL

SEQ ID NO: 2657033 - protein, 7 aa, Entamoeba histolytica
SNENLTR

SEQ ID NO: 2657034 - protein, 7 aa, Entamoeba histolytica
SNENTLY

SEQ ID NO: 2657035 - protein, 10 aa, Entamoeba histolytica
SNEPENISPI

SEQ ID NO: 2657036 - protein, 9 aa, Entamoeba histolytica
SNEPSEDDI

SEQ ID NO: 2657037 - protein, 7 aa, Entamoeba histolytica
SNEQCSI

SEQ ID NO: 2657038 - protein, 6 aa, Entamoeba histolytica
SNEQEE

SEQ ID NO: 2657039 - protein, 8 aa, Entamoeba histolytica
SNEQRLNE

SEQ ID NO: 2657040 - protein, 7 aa, Entamoeba histolytica
SNEQVAE

SEQ ID NO: 2657041 - protein, 6 aa, Entamoeba histolytica
SNEQVK

SEQ ID NO: 2657042 - protein, 5 aa, Entamoeba histolytica
SNERK

SEQ ID NO: 2657043 - protein, 16 aa, Entamoeba histolytica
SNERLQSKKRKKRLED

SEQ ID NO: 2657044 - protein, 7 aa, Entamoeba histolytica
SNERNQD

SEQ ID NO: 2657045 - protein, 15 aa, Entamoeba histolytica
SNERRYNDHYPNNPP

SEQ ID NO: 2657046 - protein, 17 aa, Entamoeba histolytica
SNESEEEYLDDSLFDSV

SEQ ID NO: 2657047 - protein, 9 aa, Entamoeba histolytica
SNESKTPSL

SEQ ID NO: 2657048 - protein, 7 aa, Entamoeba histolytica
SNESLGS

SEQ ID NO: 2657049 - protein, 6 aa, Entamoeba histolytica
SNESLQ

SEQ ID NO: 2657050 - protein, 10 aa, Entamoeba histolytica
SNETKIDDKE

SEQ ID NO: 2657051 - protein, 5 aa, Entamoeba histolytica
SNETL

SEQ ID NO: 2657052 - protein, 6 aa, Entamoeba histolytica
SNETMN

SEQ ID NO: 2657053 - protein, 10 aa, Entamoeba histolytica
SNETPENKVG

SEQ ID NO: 2657054 - protein, 7 aa, Entamoeba histolytica
SNETTSF

SEQ ID NO: 2657055 - protein, 14 aa, Entamoeba histolytica
SNEVNKKEFNDGTT

SEQ ID NO: 2657056 - protein, 6 aa, Entamoeba histolytica
SNEWRE

SEQ ID NO: 2657057 - protein, 8 aa, Entamoeba histolytica
SNEYRDSV

SEQ ID NO: 2657058 - protein, 4 aa, Entamoeba histolytica
SNFD

SEQ ID NO: 2657059 - protein, 8 aa, Entamoeba histolytica
SNGATETT

SEQ ID NO: 2657060 - protein, 7 aa, Entamoeba histolytica
SNGDIDK

SEQ ID NO: 2657061 - protein, 7 aa, Entamoeba histolytica
SNGEIES

SEQ ID NO: 2657062 - protein, 7 aa, Entamoeba histolytica
SNGEITT

SEQ ID NO: 2657063 - protein, 7 aa, Entamoeba histolytica
SNGENID

SEQ ID NO: 2657064 - protein, 6 aa, Entamoeba histolytica
SNGEQV

SEQ ID NO: 2657065 - protein, 7 aa, Entamoeba histolytica
SNGESHE

SEQ ID NO: 2657066 - protein, 5 aa, Entamoeba histolytica
SNGEV

SEQ ID NO: 2657067 - protein, 7 aa, Entamoeba histolytica
SNGEVEN

SEQ ID NO: 2657068 - protein, 12 aa, Entamoeba histolytica
SNGEVVNQEEDI

SEQ ID NO: 2657069 - protein, 10 aa, Entamoeba histolytica
SNGGFGSSTN

SEQ ID NO: 2657070 - protein, 12 aa, Entamoeba histolytica
SNGGSKLDSTGY

SEQ ID NO: 2657071 - protein, 8 aa, Entamoeba histolytica
SNGIDEYT

SEQ ID NO: 2657072 - protein, 6 aa, Entamoeba histolytica
SNGIGE

SEQ ID NO: 2657073 - protein, 19 aa, Entamoeba histolytica
SNGIPEKTARRRYDTNKIT

SEQ ID NO: 2657074 - protein, 12 aa, Entamoeba histolytica
SNGKESTGIPVK

SEQ ID NO: 2657075 - protein, 6 aa, Entamoeba histolytica
SNGKKR

SEQ ID NO: 2657076 - protein, 4 aa, Entamoeba histolytica
SNGL

SEQ ID NO: 2657077 - protein, 7 aa, Entamoeba histolytica
SNGLSDK

SEQ ID NO: 2657078 - protein, 8 aa, Entamoeba histolytica
SNGNQKIY

SEQ ID NO: 2657079 - protein, 5 aa, Entamoeba histolytica
SNGNY

SEQ ID NO: 2657080 - protein, 10 aa, Entamoeba histolytica
SNGQDTTLGE

SEQ ID NO: 2657081 - protein, 7 aa, Entamoeba histolytica
SNGQQRV

SEQ ID NO: 2657082 - protein, 8 aa, Entamoeba histolytica
SNGQTSIE

SEQ ID NO: 2657083 - protein, 5 aa, Entamoeba histolytica
SNGSQ

SEQ ID NO: 2657084 - protein, 5 aa, Entamoeba histolytica
SNGTF

SEQ ID NO: 2657085 - protein, 7 aa, Entamoeba histolytica
SNGTFGG

SEQ ID NO: 2657086 - protein, 14 aa, Entamoeba histolytica
SNGTINKDIETGAK

SEQ ID NO: 2657087 - protein, 8 aa, Entamoeba histolytica
SNGTKSGL

SEQ ID NO: 2657088 - protein, 12 aa, Entamoeba histolytica
SNGTTTSPINYP

SEQ ID NO: 2657089 - protein, 15 aa, Entamoeba histolytica
SNGTVLASASADKTV

SEQ ID NO: 2657090 - protein, 7 aa, Entamoeba histolytica
SNGWEKK

SEQ ID NO: 2657091 - protein, 19 aa, Entamoeba histolytica
SNGYQAKESTGYISTTAEY

SEQ ID NO: 2657092 - protein, 21 aa, Entamoeba histolytica
SNHESGQASPRVTSVSPNIGS

SEQ ID NO: 2657093 - protein, 7 aa, Entamoeba histolytica
SNHKAQL

SEQ ID NO: 2657094 - protein, 7 aa, Entamoeba histolytica
SNHKGSL

SEQ ID NO: 2657095 - protein, 5 aa, Entamoeba histolytica
SNHPN

SEQ ID NO: 2657096 - protein, 11 aa, Entamoeba histolytica
SNHPRRTNQTL

SEQ ID NO: 2657097 - protein, 11 aa, Entamoeba histolytica
SNHPSNHATEE

SEQ ID NO: 2657098 - protein, 8 aa, Entamoeba histolytica
SNHQSNEI

SEQ ID NO: 2657099 - protein, 11 aa, Entamoeba histolytica
SNHQSTASQPK

SEQ ID NO: 2657100 - protein, 7 aa, Entamoeba histolytica
SNIDTSD

SEQ ID NO: 2657101 - protein, 15 aa, Entamoeba histolytica
SNIGSEGIAQDVASE

SEQ ID NO: 2657102 - protein, 6 aa, Entamoeba histolytica
SNIGVD

SEQ ID NO: 2657103 - protein, 8 aa, Entamoeba histolytica
SNIKSGDI

SEQ ID NO: 2657104 - protein, 4 aa, Entamoeba histolytica
SNIN

SEQ ID NO: 2657105 - protein, 5 aa, Entamoeba histolytica
SNINK

SEQ ID NO: 2657106 - protein, 8 aa, Entamoeba histolytica
SNIPDNGI

SEQ ID NO: 2657107 - protein, 9 aa, Entamoeba histolytica
SNIPSNIPR

SEQ ID NO: 2657108 - protein, 5 aa, Entamoeba histolytica
SNIQY

SEQ ID NO: 2657109 - protein, 8 aa, Entamoeba histolytica
SNIRKGKT

SEQ ID NO: 2657110 - protein, 14 aa, Entamoeba histolytica
SNIRKVEQEDGGSL

SEQ ID NO: 2657111 - protein, 9 aa, Entamoeba histolytica
SNISDVPES

SEQ ID NO: 2657112 - protein, 22 aa, Entamoeba histolytica
SNISEQSATVSSRQSLSYEDEV

SEQ ID NO: 2657113 - protein, 5 aa, Entamoeba histolytica
SNITE

SEQ ID NO: 2657114 - protein, 14 aa, Entamoeba histolytica
SNITKSSKTTYSIN

SEQ ID NO: 2657115 - protein, 8 aa, Entamoeba histolytica
SNKALTEV

SEQ ID NO: 2657116 - protein, 17 aa, Entamoeba histolytica
SNKARKYKEQINNKQSG

SEQ ID NO: 2657117 - protein, 8 aa, Entamoeba histolytica
SNKASQTL

SEQ ID NO: 2657118 - protein, 7 aa, Entamoeba histolytica
SNKDESM

SEQ ID NO: 2657119 - protein, 7 aa, Entamoeba histolytica
SNKDPLI

SEQ ID NO: 2657120 - protein, 10 aa, Entamoeba histolytica
SNKEEKKEEQ

SEQ ID NO: 2657121 - protein, 8 aa, Entamoeba histolytica
SNKEENEA

SEQ ID NO: 2657122 - protein, 12 aa, Entamoeba histolytica
SNKEKERKEEIE

SEQ ID NO: 2657123 - protein, 9 aa, Entamoeba histolytica
SNKEKRTDY

SEQ ID NO: 2657124 - protein, 8 aa, Entamoeba histolytica
SNKEPSPL

SEQ ID NO: 2657125 - protein, 7 aa, Entamoeba histolytica
SNKGSTI

SEQ ID NO: 2657126 - protein, 8 aa, Entamoeba histolytica
SNKHSIQS

SEQ ID NO: 2657127 - protein, 4 aa, Entamoeba histolytica
SNKI

SEQ ID NO: 2657128 - protein, 17 aa, Entamoeba histolytica
SNKIKREKKKQEVTTPT

SEQ ID NO: 2657129 - protein, 20 aa, Entamoeba histolytica
SNKIKSSKISPSPKLPESKI

SEQ ID NO: 2657130 - protein, 17 aa, Entamoeba histolytica
SNKKKKETEEDSSQLRK

SEQ ID NO: 2657131 - protein, 8 aa, Entamoeba histolytica
SNKKPTNI

SEQ ID NO: 2657132 - protein, 11 aa, Entamoeba histolytica
SNKKPTTENVE

SEQ ID NO: 2657133 - protein, 6 aa, Entamoeba histolytica
SNKNGE

SEQ ID NO: 2657134 - protein, 7 aa, Entamoeba histolytica
SNKNKGS

SEQ ID NO: 2657135 - protein, 9 aa, Entamoeba histolytica
SNKNKMNAT

SEQ ID NO: 2657136 - protein, 11 aa, Entamoeba histolytica
SNKNKRGETKE

SEQ ID NO: 2657137 - protein, 6 aa, Entamoeba histolytica
SNKNLV

SEQ ID NO: 2657138 - protein, 8 aa, Entamoeba histolytica
SNKNNGMG

SEQ ID NO: 2657139 - protein, 7 aa, Entamoeba histolytica
SNKNQEL

SEQ ID NO: 2657140 - protein, 84 aa, Entamoeba histolytica
SNKPFKDSSSTIEDSTNPFGDSSTLDNIKTEATQTQESHSSKTASFTNTQFEDQPPKMTSSTTRLSSGNPFGESASTYSNPFES

SEQ ID NO: 2657141 - protein, 8 aa, Entamoeba histolytica
SNKPGKKE

SEQ ID NO: 2657142 - protein, 7 aa, Entamoeba histolytica
SNKPISK

SEQ ID NO: 2657143 - protein, 32 aa, Entamoeba histolytica
SNKPTEGMNGQLQNTSQTNNTNPFGNTNFGNQ

SEQ ID NO: 2657144 - protein, 8 aa, Entamoeba histolytica
SNKPVDSQ

SEQ ID NO: 2657145 - protein, 7 aa, Entamoeba histolytica
SNKRPGL

SEQ ID NO: 2657146 - protein, 9 aa, Entamoeba histolytica
SNKSAKAVK

SEQ ID NO: 2657147 - protein, 11 aa, Entamoeba histolytica
SNKSDAQLEKD

SEQ ID NO: 2657148 - protein, 7 aa, Entamoeba histolytica
SNKSNGK

SEQ ID NO: 2657149 - protein, 6 aa, Entamoeba histolytica
SNKSSC

SEQ ID NO: 2657150 - protein, 10 aa, Entamoeba histolytica
SNKSTETYGS

SEQ ID NO: 2657151 - protein, 4 aa, Entamoeba histolytica
SNKT

SEQ ID NO: 2657152 - protein, 10 aa, Entamoeba histolytica
SNKTGEGCTE

SEQ ID NO: 2657153 - protein, 5 aa, Entamoeba histolytica
SNKTI

SEQ ID NO: 2657154 - protein, 10 aa, Entamoeba histolytica
SNKTINSTKD

SEQ ID NO: 2657155 - protein, 6 aa, Entamoeba histolytica
SNKTIQ

SEQ ID NO: 2657156 - protein, 9 aa, Entamoeba histolytica
SNKTNDAER

SEQ ID NO: 2657157 - protein, 8 aa, Entamoeba histolytica
SNKTPNCE

SEQ ID NO: 2657158 - protein, 9 aa, Entamoeba histolytica
SNKTSDDVQ

SEQ ID NO: 2657159 - protein, 14 aa, Entamoeba histolytica
SNKTSGFKNPISTK

SEQ ID NO: 2657160 - protein, 9 aa, Entamoeba histolytica
SNKTSGYVV

SEQ ID NO: 2657161 - protein, 7 aa, Entamoeba histolytica
SNKTSVN

SEQ ID NO: 2657162 - protein, 6 aa, Entamoeba histolytica
SNKTSY

SEQ ID NO: 2657163 - protein, 8 aa, Entamoeba histolytica
SNKVEPDK

SEQ ID NO: 2657164 - protein, 11 aa, Entamoeba histolytica
SNKWKDDIDAD

SEQ ID NO: 2657165 - protein, 7 aa, Entamoeba histolytica
SNKWPDE

SEQ ID NO: 2657166 - protein, 7 aa, Entamoeba histolytica
SNKYNFG

SEQ ID NO: 2657167 - protein, 8 aa, Entamoeba histolytica
SNKYRSDT

SEQ ID NO: 2657168 - protein, 7 aa, Entamoeba histolytica
SNKYSYA

SEQ ID NO: 2657169 - protein, 31 aa, Entamoeba histolytica
SNKYVKQGECEPEIQENHTGQEEKKEEKEGK

SEQ ID NO: 2657170 - protein, 10 aa, Entamoeba histolytica
SNLKSKTEDC

SEQ ID NO: 2657171 - protein, 32 aa, Entamoeba histolytica
SNLNESEEIKSNDDSDEDLSEESKRKIEEELE

SEQ ID NO: 2657172 - protein, 14 aa, Entamoeba histolytica
SNLNKSGGNDKITI

SEQ ID NO: 2657173 - protein, 8 aa, Entamoeba histolytica
SNLNTDDN

SEQ ID NO: 2657174 - protein, 5 aa, Entamoeba histolytica
SNLPN

SEQ ID NO: 2657175 - protein, 6 aa, Entamoeba histolytica
SNLPQQ

SEQ ID NO: 2657176 - protein, 6 aa, Entamoeba histolytica
SNLPRS

SEQ ID NO: 2657177 - protein, 8 aa, Entamoeba histolytica
SNLPTPQI

SEQ ID NO: 2657178 - protein, 7 aa, Entamoeba histolytica
SNLQKPG

SEQ ID NO: 2657179 - protein, 6 aa, Entamoeba histolytica
SNLQLS

SEQ ID NO: 2657180 - protein, 5 aa, Entamoeba histolytica
SNLSE

SEQ ID NO: 2657181 - protein, 16 aa, Entamoeba histolytica
SNLSSSNDDVEEALTT

SEQ ID NO: 2657182 - protein, 10 aa, Entamoeba histolytica
SNLSTSKELS

SEQ ID NO: 2657183 - protein, 5 aa, Entamoeba histolytica
SNLTE

SEQ ID NO: 2657184 - protein, 12 aa, Entamoeba histolytica
SNNASDKKAIKT

SEQ ID NO: 2657185 - protein, 6 aa, Entamoeba histolytica
SNNDPL

SEQ ID NO: 2657186 - protein, 6 aa, Entamoeba histolytica
SNNDYQ

SEQ ID NO: 2657187 - protein, 11 aa, Entamoeba histolytica
SNNEEHDISKL

SEQ ID NO: 2657188 - protein, 7 aa, Entamoeba histolytica
SNNEKMK

SEQ ID NO: 2657189 - protein, 8 aa, Entamoeba histolytica
SNNEKVDE

SEQ ID NO: 2657190 - protein, 17 aa, Entamoeba histolytica
SNNEYNKGKEKTSKVGC

SEQ ID NO: 2657191 - protein, 5 aa, Entamoeba histolytica
SNNGM

SEQ ID NO: 2657192 - protein, 13 aa, Entamoeba histolytica
SNNGTDEILTSTM

SEQ ID NO: 2657193 - protein, 8 aa, Entamoeba histolytica
SNNIPTQA

SEQ ID NO: 2657194 - protein, 7 aa, Entamoeba histolytica
SNNKATL

SEQ ID NO: 2657195 - protein, 16 aa, Entamoeba histolytica
SNNKEEEKEEKVEINQ

SEQ ID NO: 2657196 - protein, 8 aa, Entamoeba histolytica
SNNKEFTS

SEQ ID NO: 2657197 - protein, 7 aa, Entamoeba histolytica
SNNKISE

SEQ ID NO: 2657198 - protein, 11 aa, Entamoeba histolytica
SNNKNNEGIKF

SEQ ID NO: 2657199 - protein, 7 aa, Entamoeba histolytica
SNNKRLG

SEQ ID NO: 2657200 - protein, 9 aa, Entamoeba histolytica
SNNKWEPTT

SEQ ID NO: 2657201 - protein, 4 aa, Entamoeba histolytica
SNNL

SEQ ID NO: 2657202 - protein, 19 aa, Entamoeba histolytica
SNNLKPTEIEERQKEEDEV

SEQ ID NO: 2657203 - protein, 5 aa, Entamoeba histolytica
SNNLT

SEQ ID NO: 2657204 - protein, 4 aa, Entamoeba histolytica
SNNN

SEQ ID NO: 2657205 - protein, 15 aa, Entamoeba histolytica
SNNNDPKPPEPFEWN

SEQ ID NO: 2657206 - protein, 7 aa, Entamoeba histolytica
SNNNEEI

SEQ ID NO: 2657207 - protein, 17 aa, Entamoeba histolytica
SNNNEGKLTTTEKSIKE

SEQ ID NO: 2657208 - protein, 9 aa, Entamoeba histolytica
SNNNEQTLD

SEQ ID NO: 2657209 - protein, 8 aa, Entamoeba histolytica
SNNPNATD

SEQ ID NO: 2657210 - protein, 8 aa, Entamoeba histolytica
SNNPSDTF

SEQ ID NO: 2657211 - protein, 4 aa, Entamoeba histolytica
SNNQ

SEQ ID NO: 2657212 - protein, 18 aa, Entamoeba histolytica
SNNQEPSNEQELTTQEKN

SEQ ID NO: 2657213 - protein, 5 aa, Entamoeba histolytica
SNNQI

SEQ ID NO: 2657214 - protein, 5 aa, Entamoeba histolytica
SNNQL

SEQ ID NO: 2657215 - protein, 9 aa, Entamoeba histolytica
SNNQSIKQS

SEQ ID NO: 2657216 - protein, 29 aa, Entamoeba histolytica
SNNQSPSNKNTERVVSARGNRQNLVRSTS

SEQ ID NO: 2657217 - protein, 6 aa, Entamoeba histolytica
SNNQTD

SEQ ID NO: 2657218 - protein, 4 aa, Entamoeba histolytica
SNNS

SEQ ID NO: 2657219 - protein, 12 aa, Entamoeba histolytica
SNNSGKVNKKEL

SEQ ID NO: 2657220 - protein, 8 aa, Entamoeba histolytica
SNNSGTKS

SEQ ID NO: 2657221 - protein, 6 aa, Entamoeba histolytica
SNNSIP

SEQ ID NO: 2657222 - protein, 9 aa, Entamoeba histolytica
SNNSSDRFS

SEQ ID NO: 2657223 - protein, 9 aa, Entamoeba histolytica
SNNSSLSST

SEQ ID NO: 2657224 - protein, 7 aa, Entamoeba histolytica
SNNSSNE

SEQ ID NO: 2657225 - protein, 5 aa, Entamoeba histolytica
SNNST

SEQ ID NO: 2657226 - protein, 8 aa, Entamoeba histolytica
SNNSTEIK

SEQ ID NO: 2657227 - protein, 148 aa, Entamoeba histolytica
SNNTFGKTTNTTGGFGTGFGSTTGFGNTNNTGFGSTTGGFGNGNNTGFGSGFGSTIGGFGNNNNTKTAGGFGSTPSGFGNNNTFGNTGFGSTTTGFGNTTNTGFGSTSGAFGNTTGLGGFGSTLGNGIGSGFGNNNTGLGSGFGNNNM

SEQ ID NO: 2657228 - protein, 8 aa, Entamoeba histolytica
SNNTGKPL

SEQ ID NO: 2657229 - protein, 8 aa, Entamoeba histolytica
SNNTNNKN

SEQ ID NO: 2657230 - protein, 5 aa, Entamoeba histolytica
SNNTR

SEQ ID NO: 2657231 - protein, 6 aa, Entamoeba histolytica
SNNYPS

SEQ ID NO: 2657232 - protein, 5 aa, Entamoeba histolytica
SNPAV

SEQ ID NO: 2657233 - protein, 16 aa, Entamoeba histolytica
SNPDEGCDNSRSEKEI

SEQ ID NO: 2657234 - protein, 4 aa, Entamoeba histolytica
SNPE

SEQ ID NO: 2657235 - protein, 7 aa, Entamoeba histolytica
SNPEEKA

SEQ ID NO: 2657236 - protein, 28 aa, Entamoeba histolytica
SNPEKRKQYDSSDNTDDKLPQDRQYEEN

SEQ ID NO: 2657237 - protein, 9 aa, Entamoeba histolytica
SNPEKYNSP

SEQ ID NO: 2657238 - protein, 6 aa, Entamoeba histolytica
SNPETI

SEQ ID NO: 2657239 - protein, 27 aa, Entamoeba histolytica
SNPFEELPDRDDIQKFDKSAVDKSLKT

SEQ ID NO: 2657240 - protein, 7 aa, Entamoeba histolytica
SNPGINI

SEQ ID NO: 2657241 - protein, 59 aa, Entamoeba histolytica
SNPHPKLNSENTSKRRSKDNKGDLDSSETSSEPQKDHDKQLTSSHKKDKSEQKSDNENI

SEQ ID NO: 2657242 - protein, 7 aa, Entamoeba histolytica
SNPIKTL

SEQ ID NO: 2657243 - protein, 7 aa, Entamoeba histolytica
SNPIPQP

SEQ ID NO: 2657244 - protein, 10 aa, Entamoeba histolytica
SNPKDKNEHE

SEQ ID NO: 2657245 - protein, 8 aa, Entamoeba histolytica
SNPKDSSL

SEQ ID NO: 2657246 - protein, 5 aa, Entamoeba histolytica
SNPKE

SEQ ID NO: 2657247 - protein, 8 aa, Entamoeba histolytica
SNPKEPTI

SEQ ID NO: 2657248 - protein, 8 aa, Entamoeba histolytica
SNPKFSPK

SEQ ID NO: 2657249 - protein, 6 aa, Entamoeba histolytica
SNPKNY

SEQ ID NO: 2657250 - protein, 7 aa, Entamoeba histolytica
SNPKPFY

SEQ ID NO: 2657251 - protein, 6 aa, Entamoeba histolytica
SNPKYN

SEQ ID NO: 2657252 - protein, 4 aa, Entamoeba histolytica
SNPL

SEQ ID NO: 2657253 - protein, 11 aa, Entamoeba histolytica
SNPLDSYSNEA

SEQ ID NO: 2657254 - protein, 6 aa, Entamoeba histolytica
SNPLTL

SEQ ID NO: 2657255 - protein, 6 aa, Entamoeba histolytica
SNPNCQ

SEQ ID NO: 2657256 - protein, 9 aa, Entamoeba histolytica
SNPNIQKQI

SEQ ID NO: 2657257 - protein, 4 aa, Entamoeba histolytica
SNPQ

SEQ ID NO: 2657258 - protein, 6 aa, Entamoeba histolytica
SNPQFQ

SEQ ID NO: 2657259 - protein, 6 aa, Entamoeba histolytica
SNPQID

SEQ ID NO: 2657260 - protein, 115 aa, Entamoeba histolytica
SNPQPQPITKKSFTTPSSSTLKQTTPSQPQSSSMNSFNKSSVVKQTTTASVNTSKPLTPKSPTSSLNENKVSTGSHINSTISSPIKQTQPTTSQTLQTRKQSLTPSHQISAEQMK

SEQ ID NO: 2657261 - protein, 5 aa, Entamoeba histolytica
SNPQR

SEQ ID NO: 2657262 - protein, 7 aa, Entamoeba histolytica
SNPQSKV

SEQ ID NO: 2657263 - protein, 6 aa, Entamoeba histolytica
SNPQTT

SEQ ID NO: 2657264 - protein, 4 aa, Entamoeba histolytica
SNPS

SEQ ID NO: 2657265 - protein, 10 aa, Entamoeba histolytica
SNPSQLSAPA

SEQ ID NO: 2657266 - protein, 137 aa, Entamoeba histolytica
SNPSSAKQSAGSYPQQQPGAYPPQQGYPQQQQGGYPPQQGYGQPGAYPGYPPQGGYPPQQPGAYPGYPPQQGYGQPGAYPPQQGGYPPQQPGAYPGYPPQQGYGQPGAYPGYPPQQPGYPQPGAYPGYPPQQGAPQK

SEQ ID NO: 2657267 - protein, 7 aa, Entamoeba histolytica
SNPSYGH

SEQ ID NO: 2657268 - protein, 7 aa, Entamoeba histolytica
SNPTERK

SEQ ID NO: 2657269 - protein, 7 aa, Entamoeba histolytica
SNPTYTL

SEQ ID NO: 2657270 - protein, 6 aa, Entamoeba histolytica
SNPVRQ

SEQ ID NO: 2657271 - protein, 10 aa, Entamoeba histolytica
SNPVTEELPQ

SEQ ID NO: 2657272 - protein, 9 aa, Entamoeba histolytica
SNQDGLDNR

SEQ ID NO: 2657273 - protein, 8 aa, Entamoeba histolytica
SNQEEEDV

SEQ ID NO: 2657274 - protein, 5 aa, Entamoeba histolytica
SNQFQ

SEQ ID NO: 2657275 - protein, 7 aa, Entamoeba histolytica
SNQIAPH

SEQ ID NO: 2657276 - protein, 8 aa, Entamoeba histolytica
SNQIGENT

SEQ ID NO: 2657277 - protein, 7 aa, Entamoeba histolytica
SNQIGGF

SEQ ID NO: 2657278 - protein, 5 aa, Entamoeba histolytica
SNQKE

SEQ ID NO: 2657279 - protein, 7 aa, Entamoeba histolytica
SNQKKVI

SEQ ID NO: 2657280 - protein, 14 aa, Entamoeba histolytica
SNQLKNEEKYPKTY

SEQ ID NO: 2657281 - protein, 6 aa, Entamoeba histolytica
SNQLNE

SEQ ID NO: 2657282 - protein, 10 aa, Entamoeba histolytica
SNQNGQPTTR

SEQ ID NO: 2657283 - protein, 6 aa, Entamoeba histolytica
SNQNTN

SEQ ID NO: 2657284 - protein, 5 aa, Entamoeba histolytica
SNQPF

SEQ ID NO: 2657285 - protein, 15 aa, Entamoeba histolytica
SNQPIPSVNSQGPSC

SEQ ID NO: 2657286 - protein, 10 aa, Entamoeba histolytica
SNQPYDSKTH

SEQ ID NO: 2657287 - protein, 14 aa, Entamoeba histolytica
SNQQEFEAAGEAAK

SEQ ID NO: 2657288 - protein, 14 aa, Entamoeba histolytica
SNQQHLQFVSIHQL

SEQ ID NO: 2657289 - protein, 10 aa, Entamoeba histolytica
SNQQKRGDEK

SEQ ID NO: 2657290 - protein, 8 aa, Entamoeba histolytica
SNQQTQYR

SEQ ID NO: 2657291 - protein, 7 aa, Entamoeba histolytica
SNQRISP

SEQ ID NO: 2657292 - protein, 7 aa, Entamoeba histolytica
SNQRYNG

SEQ ID NO: 2657293 - protein, 19 aa, Entamoeba histolytica
SNQSLTPIQPTSLTTTKGL

SEQ ID NO: 2657294 - protein, 7 aa, Entamoeba histolytica
SNQSNKP

SEQ ID NO: 2657295 - protein, 17 aa, Entamoeba histolytica
SNQSTPSKQEEKKQEEI

SEQ ID NO: 2657296 - protein, 8 aa, Entamoeba histolytica
SNQTETPI

SEQ ID NO: 2657297 - protein, 5 aa, Entamoeba histolytica
SNQTQ

SEQ ID NO: 2657298 - protein, 5 aa, Entamoeba histolytica
SNQTV

SEQ ID NO: 2657299 - protein, 9 aa, Entamoeba histolytica
SNRAAAYQK

SEQ ID NO: 2657300 - protein, 5 aa, Entamoeba histolytica
SNRAD

SEQ ID NO: 2657301 - protein, 4 aa, Entamoeba histolytica
SNRE

SEQ ID NO: 2657302 - protein, 5 aa, Entamoeba histolytica
SNREI

SEQ ID NO: 2657303 - protein, 7 aa, Entamoeba histolytica
SNREQRM

SEQ ID NO: 2657304 - protein, 9 aa, Entamoeba histolytica
SNRGEQQAI

SEQ ID NO: 2657305 - protein, 10 aa, Entamoeba histolytica
SNRKDKPLRI

SEQ ID NO: 2657306 - protein, 6 aa, Entamoeba histolytica
SNRKED

SEQ ID NO: 2657307 - protein, 9 aa, Entamoeba histolytica
SNRNDKPRR

SEQ ID NO: 2657308 - protein, 14 aa, Entamoeba histolytica
SNRRDNFNKMGETE

SEQ ID NO: 2657309 - protein, 13 aa, Entamoeba histolytica
SNRSAAYSSIEEN

SEQ ID NO: 2657310 - protein, 10 aa, Entamoeba histolytica
SNRSTQSSGI

SEQ ID NO: 2657311 - protein, 4 aa, Entamoeba histolytica
SNRT

SEQ ID NO: 2657312 - protein, 7 aa, Entamoeba histolytica
SNRTESD

SEQ ID NO: 2657313 - protein, 9 aa, Entamoeba histolytica
SNSAKDIDS

SEQ ID NO: 2657314 - protein, 7 aa, Entamoeba histolytica
SNSAQKI

SEQ ID NO: 2657315 - protein, 9 aa, Entamoeba histolytica
SNSAQLRGR

SEQ ID NO: 2657316 - protein, 9 aa, Entamoeba histolytica
SNSCPPSPQ

SEQ ID NO: 2657317 - protein, 11 aa, Entamoeba histolytica
SNSDELSSREL

SEQ ID NO: 2657318 - protein, 7 aa, Entamoeba histolytica
SNSDGLT

SEQ ID NO: 2657319 - protein, 11 aa, Entamoeba histolytica
SNSDLSSKFTE

SEQ ID NO: 2657320 - protein, 14 aa, Entamoeba histolytica
SNSDTQRCEQQQTL

SEQ ID NO: 2657321 - protein, 10 aa, Entamoeba histolytica
SNSEEGNNHI

SEQ ID NO: 2657322 - protein, 15 aa, Entamoeba histolytica
SNSEPKQCLKEKQTK

SEQ ID NO: 2657323 - protein, 15 aa, Entamoeba histolytica
SNSESESISDFVLSP

SEQ ID NO: 2657324 - protein, 11 aa, Entamoeba histolytica
SNSFEENQINN

SEQ ID NO: 2657325 - protein, 7 aa, Entamoeba histolytica
SNSFNDC

SEQ ID NO: 2657326 - protein, 6 aa, Entamoeba histolytica
SNSFNR

SEQ ID NO: 2657327 - protein, 13 aa, Entamoeba histolytica
SNSFTPNPTTSYQ

SEQ ID NO: 2657328 - protein, 7 aa, Entamoeba histolytica
SNSGATH

SEQ ID NO: 2657329 - protein, 17 aa, Entamoeba histolytica
SNSGSSTPSRSVSRSDL

SEQ ID NO: 2657330 - protein, 24 aa, Entamoeba histolytica
SNSGSTHLSDEDSEISNNEVKTNN

SEQ ID NO: 2657331 - protein, 6 aa, Entamoeba histolytica
SNSHLS

SEQ ID NO: 2657332 - protein, 7 aa, Entamoeba histolytica
SNSIDHS

SEQ ID NO: 2657333 - protein, 12 aa, Entamoeba histolytica
SNSIRYAKDGCS

SEQ ID NO: 2657334 - protein, 5 aa, Entamoeba histolytica
SNSIS

SEQ ID NO: 2657335 - protein, 7 aa, Entamoeba histolytica
SNSITGR

SEQ ID NO: 2657336 - protein, 8 aa, Entamoeba histolytica
SNSITGRK

SEQ ID NO: 2657337 - protein, 6 aa, Entamoeba histolytica
SNSITS

SEQ ID NO: 2657338 - protein, 11 aa, Entamoeba histolytica
SNSKEAGGRYK

SEQ ID NO: 2657339 - protein, 8 aa, Entamoeba histolytica
SNSKEKKV

SEQ ID NO: 2657340 - protein, 7 aa, Entamoeba histolytica
SNSKLNE

SEQ ID NO: 2657341 - protein, 10 aa, Entamoeba histolytica
SNSKSLKGVS

SEQ ID NO: 2657342 - protein, 4 aa, Entamoeba histolytica
SNSL

SEQ ID NO: 2657343 - protein, 16 aa, Entamoeba histolytica
SNSMEKSYSLQSSSQI

SEQ ID NO: 2657344 - protein, 6 aa, Entamoeba histolytica
SNSNIK

SEQ ID NO: 2657345 - protein, 8 aa, Entamoeba histolytica
SNSNNVKE

SEQ ID NO: 2657346 - protein, 22 aa, Entamoeba histolytica
SNSPEELKNSGDIENDNGQKVV

SEQ ID NO: 2657347 - protein, 6 aa, Entamoeba histolytica
SNSPHF

SEQ ID NO: 2657348 - protein, 41 aa, Entamoeba histolytica
SNSPNSSSNQLPPVPPVNPGRKALSQKTNPLVEENREKQQA

SEQ ID NO: 2657349 - protein, 11 aa, Entamoeba histolytica
SNSPQKDVDTS

SEQ ID NO: 2657350 - protein, 9 aa, Entamoeba histolytica
SNSPTRLNS

SEQ ID NO: 2657351 - protein, 6 aa, Entamoeba histolytica
SNSPVQ

SEQ ID NO: 2657352 - protein, 6 aa, Entamoeba histolytica
SNSQNG

SEQ ID NO: 2657353 - protein, 14 aa, Entamoeba histolytica
SNSQPKHRTTEEYQ

SEQ ID NO: 2657354 - protein, 10 aa, Entamoeba histolytica
SNSQVSLSPE

SEQ ID NO: 2657355 - protein, 6 aa, Entamoeba histolytica
SNSQYK

SEQ ID NO: 2657356 - protein, 33 aa, Entamoeba histolytica
SNSRRYRNNDQRTNGDSMPPRRTKNDKEVSAPQ

SEQ ID NO: 2657357 - protein, 21 aa, Entamoeba histolytica
SNSRTRESSSLSSSPQRSSPL

SEQ ID NO: 2657358 - protein, 6 aa, Entamoeba histolytica
SNSRYK

SEQ ID NO: 2657359 - protein, 7 aa, Entamoeba histolytica
SNSSEQQ

SEQ ID NO: 2657360 - protein, 5 aa, Entamoeba histolytica
SNSSL

SEQ ID NO: 2657361 - protein, 14 aa, Entamoeba histolytica
SNSSNTHSPQPKSQ

SEQ ID NO: 2657362 - protein, 5 aa, Entamoeba histolytica
SNSSS

SEQ ID NO: 2657363 - protein, 6 aa, Entamoeba histolytica
SNSTAI

SEQ ID NO: 2657364 - protein, 10 aa, Entamoeba histolytica
SNSTHPNQSC

SEQ ID NO: 2657365 - protein, 7 aa, Entamoeba histolytica
SNSTLGI

SEQ ID NO: 2657366 - protein, 7 aa, Entamoeba histolytica
SNSTLPE

SEQ ID NO: 2657367 - protein, 7 aa, Entamoeba histolytica
SNSTNEE

SEQ ID NO: 2657368 - protein, 29 aa, Entamoeba histolytica
SNSTPISGIQSKTTSPKGKSIKPTTLSSL

SEQ ID NO: 2657369 - protein, 35 aa, Entamoeba histolytica
SNSTRKGRHYNTSKSRGGYTSHSKNNSRKHSSRTG

SEQ ID NO: 2657370 - protein, 4 aa, Entamoeba histolytica
SNTA

SEQ ID NO: 2657371 - protein, 10 aa, Entamoeba histolytica
SNTAAVREPR

SEQ ID NO: 2657372 - protein, 7 aa, Entamoeba histolytica
SNTAQSL

SEQ ID NO: 2657373 - protein, 6 aa, Entamoeba histolytica
SNTAVE

SEQ ID NO: 2657374 - protein, 6 aa, Entamoeba histolytica
SNTDAT

SEQ ID NO: 2657375 - protein, 9 aa, Entamoeba histolytica
SNTDDLTSY

SEQ ID NO: 2657376 - protein, 7 aa, Entamoeba histolytica
SNTDSDT

SEQ ID NO: 2657377 - protein, 5 aa, Entamoeba histolytica
SNTEG

SEQ ID NO: 2657378 - protein, 9 aa, Entamoeba histolytica
SNTELQNAD

SEQ ID NO: 2657379 - protein, 5 aa, Entamoeba histolytica
SNTEP

SEQ ID NO: 2657380 - protein, 5 aa, Entamoeba histolytica
SNTEQ

SEQ ID NO: 2657381 - protein, 14 aa, Entamoeba histolytica
SNTFTGNDAALDLS

SEQ ID NO: 2657382 - protein, 4 aa, Entamoeba histolytica
SNTG

SEQ ID NO: 2657383 - protein, 11 aa, Entamoeba histolytica
SNTGINDLDQG

SEQ ID NO: 2657384 - protein, 8 aa, Entamoeba histolytica
SNTISRTC

SEQ ID NO: 2657385 - protein, 6 aa, Entamoeba histolytica
SNTKEN

SEQ ID NO: 2657386 - protein, 5 aa, Entamoeba histolytica
SNTLK

SEQ ID NO: 2657387 - protein, 6 aa, Entamoeba histolytica
SNTLTI

SEQ ID NO: 2657388 - protein, 7 aa, Entamoeba histolytica
SNTMQPD

SEQ ID NO: 2657389 - protein, 4 aa, Entamoeba histolytica
SNTN

SEQ ID NO: 2657390 - protein, 5 aa, Entamoeba histolytica
SNTNA

SEQ ID NO: 2657391 - protein, 7 aa, Entamoeba histolytica
SNTNEEL

SEQ ID NO: 2657392 - protein, 5 aa, Entamoeba histolytica
SNTNI

SEQ ID NO: 2657393 - protein, 9 aa, Entamoeba histolytica
SNTNITQSL

SEQ ID NO: 2657394 - protein, 9 aa, Entamoeba histolytica
SNTNKPKPV

SEQ ID NO: 2657395 - protein, 11 aa, Entamoeba histolytica
SNTNVSSNEHN

SEQ ID NO: 2657396 - protein, 28 aa, Entamoeba histolytica
SNTPGTISPIDEGSSSNSQGKSITLSPA

SEQ ID NO: 2657397 - protein, 6 aa, Entamoeba histolytica
SNTPIS

SEQ ID NO: 2657398 - protein, 7 aa, Entamoeba histolytica
SNTPISQ

SEQ ID NO: 2657399 - protein, 6 aa, Entamoeba histolytica
SNTQLK

SEQ ID NO: 2657400 - protein, 6 aa, Entamoeba histolytica
SNTQSN

SEQ ID NO: 2657401 - protein, 4 aa, Entamoeba histolytica
SNTR

SEQ ID NO: 2657402 - protein, 20 aa, Entamoeba histolytica
SNTRIEKKKKPISNKPSVSS

SEQ ID NO: 2657403 - protein, 6 aa, Entamoeba histolytica
SNTRNG

SEQ ID NO: 2657404 - protein, 18 aa, Entamoeba histolytica
SNTRNKESLTNEIRPGFT

SEQ ID NO: 2657405 - protein, 9 aa, Entamoeba histolytica
SNTRSETKR

SEQ ID NO: 2657406 - protein, 8 aa, Entamoeba histolytica
SNTRSNGE

SEQ ID NO: 2657407 - protein, 13 aa, Entamoeba histolytica
SNTRTVVTDRPKE

SEQ ID NO: 2657408 - protein, 18 aa, Entamoeba histolytica
SNTSNNDEKRDEPPKSFL

SEQ ID NO: 2657409 - protein, 7 aa, Entamoeba histolytica
SNTSRSE

SEQ ID NO: 2657410 - protein, 5 aa, Entamoeba histolytica
SNTTI

SEQ ID NO: 2657411 - protein, 7 aa, Entamoeba histolytica
SNTTPVG

SEQ ID NO: 2657412 - protein, 25 aa, Entamoeba histolytica
SNTTSNSKSCNESSKKEKKGKKCVM

SEQ ID NO: 2657413 - protein, 8 aa, Entamoeba histolytica
SNTTTSPL

SEQ ID NO: 2657414 - protein, 8 aa, Entamoeba histolytica
SNTYDQSE

SEQ ID NO: 2657415 - protein, 5 aa, Entamoeba histolytica
SNVDS

SEQ ID NO: 2657416 - protein, 8 aa, Entamoeba histolytica
SNVEKNTL

SEQ ID NO: 2657417 - protein, 7 aa, Entamoeba histolytica
SNVGGPD

SEQ ID NO: 2657418 - protein, 5 aa, Entamoeba histolytica
SNVKI

SEQ ID NO: 2657419 - protein, 5 aa, Entamoeba histolytica
SNVKL

SEQ ID NO: 2657420 - protein, 7 aa, Entamoeba histolytica
SNVLDKN

SEQ ID NO: 2657421 - protein, 5 aa, Entamoeba histolytica
SNVNF

SEQ ID NO: 2657422 - protein, 5 aa, Entamoeba histolytica
SNVNS

SEQ ID NO: 2657423 - protein, 4 aa, Entamoeba histolytica
SNVP

SEQ ID NO: 2657424 - protein, 38 aa, Entamoeba histolytica
SNVPKANESIKEEKKEEKKEEKKEEKKEINKGEDGRKE

SEQ ID NO: 2657425 - protein, 12 aa, Entamoeba histolytica
SNVQQKKQLTVG

SEQ ID NO: 2657426 - protein, 30 aa, Entamoeba histolytica
SNVQQPTTTTSVGSSKTQNIQESFNTKPDS

SEQ ID NO: 2657427 - protein, 7 aa, Entamoeba histolytica
SNVRLTA

SEQ ID NO: 2657428 - protein, 10 aa, Entamoeba histolytica
SNVRTATRRI

SEQ ID NO: 2657429 - protein, 4 aa, Entamoeba histolytica
SNVT

SEQ ID NO: 2657430 - protein, 6 aa, Entamoeba histolytica
SNVTDN

SEQ ID NO: 2657431 - protein, 8 aa, Entamoeba histolytica
SNVTNKQI

SEQ ID NO: 2657432 - protein, 5 aa, Entamoeba histolytica
SNWDD

SEQ ID NO: 2657433 - protein, 7 aa, Entamoeba histolytica
SNWNPAE

SEQ ID NO: 2657434 - protein, 5 aa, Entamoeba histolytica
SNYEE

SEQ ID NO: 2657435 - protein, 11 aa, Entamoeba histolytica
SNYEENNPSQL

SEQ ID NO: 2657436 - protein, 7 aa, Entamoeba histolytica
SNYEPTI

SEQ ID NO: 2657437 - protein, 6 aa, Entamoeba histolytica
SNYIGT

SEQ ID NO: 2657438 - protein, 7 aa, Entamoeba histolytica
SNYKESS

SEQ ID NO: 2657439 - protein, 6 aa, Entamoeba histolytica
SNYKNE

SEQ ID NO: 2657440 - protein, 6 aa, Entamoeba histolytica
SNYKNY

SEQ ID NO: 2657441 - protein, 6 aa, Entamoeba histolytica
SNYKTV

SEQ ID NO: 2657442 - protein, 4 aa, Entamoeba histolytica
SNYN

SEQ ID NO: 2657443 - protein, 6 aa, Entamoeba histolytica
SNYPGT

SEQ ID NO: 2657444 - protein, 5 aa, Entamoeba histolytica
SNYPS

SEQ ID NO: 2657445 - protein, 5 aa, Entamoeba histolytica
SNYRQ

SEQ ID NO: 2657446 - protein, 4 aa, Entamoeba histolytica
SNYV

SEQ ID NO: 2657447 - protein, 4 aa, Entamoeba histolytica
SNYY

SEQ ID NO: 2657448 - protein, 7 aa, Entamoeba histolytica
SPAESES

SEQ ID NO: 2657449 - protein, 17 aa, Entamoeba histolytica
SPAGGAKKDKKKGGCML

SEQ ID NO: 2657450 - protein, 18 aa, Entamoeba histolytica
SPAGGAKKDKKNNRGCLL

SEQ ID NO: 2657451 - protein, 4 aa, Entamoeba histolytica
SPAN

SEQ ID NO: 2657452 - protein, 11 aa, Entamoeba histolytica
SPAQEDLEETL

SEQ ID NO: 2657453 - protein, 9 aa, Entamoeba histolytica
SPASGKTSF

SEQ ID NO: 2657454 - protein, 6 aa, Entamoeba histolytica
SPASPR

SEQ ID NO: 2657455 - protein, 6 aa, Entamoeba histolytica
SPASVK

SEQ ID NO: 2657456 - protein, 16 aa, Entamoeba histolytica
SPATQHDIEKNKPQKY

SEQ ID NO: 2657457 - protein, 16 aa, Entamoeba histolytica
SPCESPRYKKPISQRA

SEQ ID NO: 2657458 - protein, 7 aa, Entamoeba histolytica
SPCTEEK

SEQ ID NO: 2657459 - protein, 26 aa, Entamoeba histolytica
SPCVEDKQTYYNVPSDSCEKQNEINQ

SEQ ID NO: 2657460 - protein, 9 aa, Entamoeba histolytica
SPDAKRLSD

SEQ ID NO: 2657461 - protein, 8 aa, Entamoeba histolytica
SPDAQPLD

SEQ ID NO: 2657462 - protein, 11 aa, Entamoeba histolytica
SPDDMADEAVK

SEQ ID NO: 2657463 - protein, 16 aa, Entamoeba histolytica
SPDENIRKQAEGTFEQ

SEQ ID NO: 2657464 - protein, 8 aa, Entamoeba histolytica
SPDESNFE

SEQ ID NO: 2657465 - protein, 8 aa, Entamoeba histolytica
SPDETRTF

SEQ ID NO: 2657466 - protein, 9 aa, Entamoeba histolytica
SPDFDPEEL

SEQ ID NO: 2657467 - protein, 5 aa, Entamoeba histolytica
SPDGS

SEQ ID NO: 2657468 - protein, 4 aa, Entamoeba histolytica
SPDI

SEQ ID NO: 2657469 - protein, 4 aa, Entamoeba histolytica
SPDK

SEQ ID NO: 2657470 - protein, 10 aa, Entamoeba histolytica
SPDKCPHRKE

SEQ ID NO: 2657471 - protein, 6 aa, Entamoeba histolytica
SPDLEK

SEQ ID NO: 2657472 - protein, 7 aa, Entamoeba histolytica
SPDLKNI

SEQ ID NO: 2657473 - protein, 5 aa, Entamoeba histolytica
SPDMT

SEQ ID NO: 2657474 - protein, 4 aa, Entamoeba histolytica
SPDN

SEQ ID NO: 2657475 - protein, 5 aa, Entamoeba histolytica
SPDPD

SEQ ID NO: 2657476 - protein, 7 aa, Entamoeba histolytica
SPDQNTF

SEQ ID NO: 2657477 - protein, 12 aa, Entamoeba histolytica
SPDRIEEEMPLS

SEQ ID NO: 2657478 - protein, 23 aa, Entamoeba histolytica
SPDRSFKRSQSPAVWNYHLEQMF

SEQ ID NO: 2657479 - protein, 5 aa, Entamoeba histolytica
SPDSP

SEQ ID NO: 2657480 - protein, 8 aa, Entamoeba histolytica
SPDSSNLK

SEQ ID NO: 2657481 - protein, 5 aa, Entamoeba histolytica
SPDYR

SEQ ID NO: 2657482 - protein, 13 aa, Entamoeba histolytica
SPEEERDNTYSNT

SEQ ID NO: 2657483 - protein, 7 aa, Entamoeba histolytica
SPEEKQL

SEQ ID NO: 2657484 - protein, 6 aa, Entamoeba histolytica
SPEEKR

SEQ ID NO: 2657485 - protein, 5 aa, Entamoeba histolytica
SPEEP

SEQ ID NO: 2657486 - protein, 4 aa, Entamoeba histolytica
SPEF

SEQ ID NO: 2657487 - protein, 5 aa, Entamoeba histolytica
SPEGN

SEQ ID NO: 2657488 - protein, 4 aa, Entamoeba histolytica
SPEK

SEQ ID NO: 2657489 - protein, 10 aa, Entamoeba histolytica
SPEKGQQMAD

SEQ ID NO: 2657490 - protein, 6 aa, Entamoeba histolytica
SPEKIN

SEQ ID NO: 2657491 - protein, 5 aa, Entamoeba histolytica
SPELK

SEQ ID NO: 2657492 - protein, 4 aa, Entamoeba histolytica
SPEN

SEQ ID NO: 2657493 - protein, 13 aa, Entamoeba histolytica
SPENHEPSTTNTY

SEQ ID NO: 2657494 - protein, 5 aa, Entamoeba histolytica
SPENI

SEQ ID NO: 2657495 - protein, 4 aa, Entamoeba histolytica
SPEQ

SEQ ID NO: 2657496 - protein, 5 aa, Entamoeba histolytica
SPEQG

SEQ ID NO: 2657497 - protein, 5 aa, Entamoeba histolytica
SPEQI

SEQ ID NO: 2657498 - protein, 30 aa, Entamoeba histolytica
SPEQNKIEKTPKQPEDSIPTSDYPDELNDN

SEQ ID NO: 2657499 - protein, 22 aa, Entamoeba histolytica
SPESSIDPQIDKSNNVQYRSPN

SEQ ID NO: 2657500 - protein, 7 aa, Entamoeba histolytica
SPETIGG

SEQ ID NO: 2657501 - protein, 6 aa, Entamoeba histolytica
SPEYRE

SEQ ID NO: 2657502 - protein, 11 aa, Entamoeba histolytica
SPFDGDIPTKI

SEQ ID NO: 2657503 - protein, 7 aa, Entamoeba histolytica
SPFDTSN

SEQ ID NO: 2657504 - protein, 15 aa, Entamoeba histolytica
SPFESTEEQESFISS

SEQ ID NO: 2657505 - protein, 5 aa, Entamoeba histolytica
SPFKM

SEQ ID NO: 2657506 - protein, 29 aa, Entamoeba histolytica
SPFNQTNTSPFNQTNTNPFNQTNTNPFNQ

SEQ ID NO: 2657507 - protein, 7 aa, Entamoeba histolytica
SPFPTKT

SEQ ID NO: 2657508 - protein, 7 aa, Entamoeba histolytica
SPFPVND

SEQ ID NO: 2657509 - protein, 5 aa, Entamoeba histolytica
SPFRS

SEQ ID NO: 2657510 - protein, 9 aa, Entamoeba histolytica
SPFSPEPLK

SEQ ID NO: 2657511 - protein, 4 aa, Entamoeba histolytica
SPFT

SEQ ID NO: 2657512 - protein, 14 aa, Entamoeba histolytica
SPFTSQNNNPMKST

SEQ ID NO: 2657513 - protein, 6 aa, Entamoeba histolytica
SPFTTS

SEQ ID NO: 2657514 - protein, 5 aa, Entamoeba histolytica
SPGAY

SEQ ID NO: 2657515 - protein, 15 aa, Entamoeba histolytica
SPGGKTMIDPSRRAF

SEQ ID NO: 2657516 - protein, 9 aa, Entamoeba histolytica
SPGHKTMTY

SEQ ID NO: 2657517 - protein, 5 aa, Entamoeba histolytica
SPGHV

SEQ ID NO: 2657518 - protein, 10 aa, Entamoeba histolytica
SPGYDGENRG

SEQ ID NO: 2657519 - protein, 14 aa, Entamoeba histolytica
SPHAGVKKSQTGIK

SEQ ID NO: 2657520 - protein, 7 aa, Entamoeba histolytica
SPHEAEE

SEQ ID NO: 2657521 - protein, 5 aa, Entamoeba histolytica
SPHPE

SEQ ID NO: 2657522 - protein, 6 aa, Entamoeba histolytica
SPHPLK

SEQ ID NO: 2657523 - protein, 6 aa, Entamoeba histolytica
SPHPQE

SEQ ID NO: 2657524 - protein, 4 aa, Entamoeba histolytica
SPHQ

SEQ ID NO: 2657525 - protein, 5 aa, Entamoeba histolytica
SPHQP

SEQ ID NO: 2657526 - protein, 13 aa, Entamoeba histolytica
SPHSALDSVNGGI

SEQ ID NO: 2657527 - protein, 9 aa, Entamoeba histolytica
SPHSKSLST

SEQ ID NO: 2657528 - protein, 13 aa, Entamoeba histolytica
SPHSPRSTRPGFL

SEQ ID NO: 2657529 - protein, 8 aa, Entamoeba histolytica
SPHSTHPK

SEQ ID NO: 2657530 - protein, 8 aa, Entamoeba histolytica
SPHYTAPE

SEQ ID NO: 2657531 - protein, 9 aa, Entamoeba histolytica
SPIGANHQP

SEQ ID NO: 2657532 - protein, 11 aa, Entamoeba histolytica
SPIHTPKGRPI

SEQ ID NO: 2657533 - protein, 11 aa, Entamoeba histolytica
SPIKNEEKTGK

SEQ ID NO: 2657534 - protein, 9 aa, Entamoeba histolytica
SPIKNGTIE

SEQ ID NO: 2657535 - protein, 5 aa, Entamoeba histolytica
SPIKP

SEQ ID NO: 2657536 - protein, 5 aa, Entamoeba histolytica
SPIND

SEQ ID NO: 2657537 - protein, 5 aa, Entamoeba histolytica
SPIPA

SEQ ID NO: 2657538 - protein, 7 aa, Entamoeba histolytica
SPIPDDE

SEQ ID NO: 2657539 - protein, 8 aa, Entamoeba histolytica
SPIPGSGA

SEQ ID NO: 2657540 - protein, 13 aa, Entamoeba histolytica
SPIQQSPKSVRKI

SEQ ID NO: 2657541 - protein, 4 aa, Entamoeba histolytica
SPIR

SEQ ID NO: 2657542 - protein, 5 aa, Entamoeba histolytica
SPIRN

SEQ ID NO: 2657543 - protein, 4 aa, Entamoeba histolytica
SPIS

SEQ ID NO: 2657544 - protein, 4 aa, Entamoeba histolytica
SPIT

SEQ ID NO: 2657545 - protein, 10 aa, Entamoeba histolytica
SPITEEENLK

SEQ ID NO: 2657546 - protein, 5 aa, Entamoeba histolytica
SPIVT

SEQ ID NO: 2657547 - protein, 8 aa, Entamoeba histolytica
SPKAIKKA

SEQ ID NO: 2657548 - protein, 21 aa, Entamoeba histolytica
SPKDQQHKTKSKSSLSSKPTI

SEQ ID NO: 2657549 - protein, 4 aa, Entamoeba histolytica
SPKE

SEQ ID NO: 2657550 - protein, 5 aa, Entamoeba histolytica
SPKEE

SEQ ID NO: 2657551 - protein, 7 aa, Entamoeba histolytica
SPKEEFT

SEQ ID NO: 2657552 - protein, 5 aa, Entamoeba histolytica
SPKEI

SEQ ID NO: 2657553 - protein, 27 aa, Entamoeba histolytica
SPKEINNLQPKSITDYQQQSSIPERRL

SEQ ID NO: 2657554 - protein, 5 aa, Entamoeba histolytica
SPKGE

SEQ ID NO: 2657555 - protein, 5 aa, Entamoeba histolytica
SPKGH

SEQ ID NO: 2657556 - protein, 9 aa, Entamoeba histolytica
SPKHTSKEL

SEQ ID NO: 2657557 - protein, 7 aa, Entamoeba histolytica
SPKISEY

SEQ ID NO: 2657558 - protein, 6 aa, Entamoeba histolytica
SPKISS

SEQ ID NO: 2657559 - protein, 4 aa, Entamoeba histolytica
SPKK

SEQ ID NO: 2657560 - protein, 17 aa, Entamoeba histolytica
SPKLNKNEQEKKRKYNS

SEQ ID NO: 2657561 - protein, 11 aa, Entamoeba histolytica
SPKLSKPTKFG

SEQ ID NO: 2657562 - protein, 4 aa, Entamoeba histolytica
SPKM

SEQ ID NO: 2657563 - protein, 4 aa, Entamoeba histolytica
SPKN

SEQ ID NO: 2657564 - protein, 6 aa, Entamoeba histolytica
SPKNLS

SEQ ID NO: 2657565 - protein, 6 aa, Entamoeba histolytica
SPKNSI

SEQ ID NO: 2657566 - protein, 13 aa, Entamoeba histolytica
SPKNSLSDRSNIK

SEQ ID NO: 2657567 - protein, 18 aa, Entamoeba histolytica
SPKQNYQSISQQSRKNSY

SEQ ID NO: 2657568 - protein, 14 aa, Entamoeba histolytica
SPKQPGLSSSRVTS

SEQ ID NO: 2657569 - protein, 6 aa, Entamoeba histolytica
SPKQTF

SEQ ID NO: 2657570 - protein, 6 aa, Entamoeba histolytica
SPKRIG

SEQ ID NO: 2657571 - protein, 7 aa, Entamoeba histolytica
SPKRLPK

SEQ ID NO: 2657572 - protein, 17 aa, Entamoeba histolytica
SPKSIQKTTPNDKIKQQ

SEQ ID NO: 2657573 - protein, 9 aa, Entamoeba histolytica
SPKTSCEEA

SEQ ID NO: 2657574 - protein, 4 aa, Entamoeba histolytica
SPKV

SEQ ID NO: 2657575 - protein, 11 aa, Entamoeba histolytica
SPKYDQQVNGN

SEQ ID NO: 2657576 - protein, 9 aa, Entamoeba histolytica
SPLDRPQIT

SEQ ID NO: 2657577 - protein, 10 aa, Entamoeba histolytica
SPLEAQPKRI

SEQ ID NO: 2657578 - protein, 19 aa, Entamoeba histolytica
SPLIKTTSNQQPPIQNTST

SEQ ID NO: 2657579 - protein, 13 aa, Entamoeba histolytica
SPLKKKKSQEDSL

SEQ ID NO: 2657580 - protein, 12 aa, Entamoeba histolytica
SPLKSSSEITSI

SEQ ID NO: 2657581 - protein, 4 aa, Entamoeba histolytica
SPLN

SEQ ID NO: 2657582 - protein, 6 aa, Entamoeba histolytica
SPLNSY

SEQ ID NO: 2657583 - protein, 5 aa, Entamoeba histolytica
SPLPS

SEQ ID NO: 2657584 - protein, 4 aa, Entamoeba histolytica
SPLQ

SEQ ID NO: 2657585 - protein, 5 aa, Entamoeba histolytica
SPLQG

SEQ ID NO: 2657586 - protein, 5 aa, Entamoeba histolytica
SPLQK

SEQ ID NO: 2657587 - protein, 5 aa, Entamoeba histolytica
SPLRE

SEQ ID NO: 2657588 - protein, 13 aa, Entamoeba histolytica
SPLSKNSTPPLDS

SEQ ID NO: 2657589 - protein, 9 aa, Entamoeba histolytica
SPLSPNDEK

SEQ ID NO: 2657590 - protein, 10 aa, Entamoeba histolytica
SPLSSEHKEI

SEQ ID NO: 2657591 - protein, 10 aa, Entamoeba histolytica
SPLSSTPNDV

SEQ ID NO: 2657592 - protein, 34 aa, Entamoeba histolytica
SPLTNTSSQPLPKQNPFVPPQQKTPTKPSPQQLG

SEQ ID NO: 2657593 - protein, 7 aa, Entamoeba histolytica
SPMKQKA

SEQ ID NO: 2657594 - protein, 17 aa, Entamoeba histolytica
SPMNEEHSTTIFHPIYT

SEQ ID NO: 2657595 - protein, 4 aa, Entamoeba histolytica
SPMS

SEQ ID NO: 2657596 - protein, 13 aa, Entamoeba histolytica
SPMSSVSGSIHIS

SEQ ID NO: 2657597 - protein, 6 aa, Entamoeba histolytica
SPNDDT

SEQ ID NO: 2657598 - protein, 5 aa, Entamoeba histolytica
SPNDK

SEQ ID NO: 2657599 - protein, 12 aa, Entamoeba histolytica
SPNDLKTKQTNI

SEQ ID NO: 2657600 - protein, 9 aa, Entamoeba histolytica
SPNEDNSIE

SEQ ID NO: 2657601 - protein, 5 aa, Entamoeba histolytica
SPNEI

SEQ ID NO: 2657602 - protein, 12 aa, Entamoeba histolytica
SPNEKNKNSQQF

SEQ ID NO: 2657603 - protein, 8 aa, Entamoeba histolytica
SPNELPSS

SEQ ID NO: 2657604 - protein, 10 aa, Entamoeba histolytica
SPNESNELSY

SEQ ID NO: 2657605 - protein, 5 aa, Entamoeba histolytica
SPNGT

SEQ ID NO: 2657606 - protein, 4 aa, Entamoeba histolytica
SPNH

SEQ ID NO: 2657607 - protein, 7 aa, Entamoeba histolytica
SPNIYTS

SEQ ID NO: 2657608 - protein, 9 aa, Entamoeba histolytica
SPNKAIRPN

SEQ ID NO: 2657609 - protein, 9 aa, Entamoeba histolytica
SPNLPEAEA

SEQ ID NO: 2657610 - protein, 5 aa, Entamoeba histolytica
SPNME

SEQ ID NO: 2657611 - protein, 13 aa, Entamoeba histolytica
SPNNEVRKQAEQL

SEQ ID NO: 2657612 - protein, 7 aa, Entamoeba histolytica
SPNNGLE

SEQ ID NO: 2657613 - protein, 13 aa, Entamoeba histolytica
SPNNPTGISYTQE

SEQ ID NO: 2657614 - protein, 5 aa, Entamoeba histolytica
SPNNR

SEQ ID NO: 2657615 - protein, 11 aa, Entamoeba histolytica
SPNNTLGNGTE

SEQ ID NO: 2657616 - protein, 6 aa, Entamoeba histolytica
SPNPNE

SEQ ID NO: 2657617 - protein, 7 aa, Entamoeba histolytica
SPNQTLT

SEQ ID NO: 2657618 - protein, 4 aa, Entamoeba histolytica
SPNS

SEQ ID NO: 2657619 - protein, 5 aa, Entamoeba histolytica
SPNSI

SEQ ID NO: 2657620 - protein, 13 aa, Entamoeba histolytica
SPNSISSENNTTT

SEQ ID NO: 2657621 - protein, 6 aa, Entamoeba histolytica
SPNSNQ

SEQ ID NO: 2657622 - protein, 8 aa, Entamoeba histolytica
SPNSPDVI

SEQ ID NO: 2657623 - protein, 8 aa, Entamoeba histolytica
SPNSTTPL

SEQ ID NO: 2657624 - protein, 9 aa, Entamoeba histolytica
SPNTINPFT

SEQ ID NO: 2657625 - protein, 15 aa, Entamoeba histolytica
SPPDSSRSSLRSSLE

SEQ ID NO: 2657626 - protein, 7 aa, Entamoeba histolytica
SPPGTYL

SEQ ID NO: 2657627 - protein, 12 aa, Entamoeba histolytica
SPPHTVANDSIQ

SEQ ID NO: 2657628 - protein, 6 aa, Entamoeba histolytica
SPPLND

SEQ ID NO: 2657629 - protein, 6 aa, Entamoeba histolytica
SPPLPS

SEQ ID NO: 2657630 - protein, 4 aa, Entamoeba histolytica
SPPN

SEQ ID NO: 2657631 - protein, 15 aa, Entamoeba histolytica
SPPPADSISPINSPL

SEQ ID NO: 2657632 - protein, 11 aa, Entamoeba histolytica
SPPPKRKQQTF

SEQ ID NO: 2657633 - protein, 6 aa, Entamoeba histolytica
SPPPLE

SEQ ID NO: 2657634 - protein, 6 aa, Entamoeba histolytica
SPPPPI

SEQ ID NO: 2657635 - protein, 8 aa, Entamoeba histolytica
SPPSSLKN

SEQ ID NO: 2657636 - protein, 6 aa, Entamoeba histolytica
SPPSTF

SEQ ID NO: 2657637 - protein, 9 aa, Entamoeba histolytica
SPPTGELER

SEQ ID NO: 2657638 - protein, 6 aa, Entamoeba histolytica
SPPTTC

SEQ ID NO: 2657639 - protein, 15 aa, Entamoeba histolytica
SPPVIPTNPPIATPS

SEQ ID NO: 2657640 - protein, 7 aa, Entamoeba histolytica
SPPYIKN

SEQ ID NO: 2657641 - protein, 7 aa, Entamoeba histolytica
SPQEREV

SEQ ID NO: 2657642 - protein, 18 aa, Entamoeba histolytica
SPQIGTTENITNSSVNDQ

SEQ ID NO: 2657643 - protein, 7 aa, Entamoeba histolytica
SPQKDDI

SEQ ID NO: 2657644 - protein, 10 aa, Entamoeba histolytica
SPQKENEKTP

SEQ ID NO: 2657645 - protein, 9 aa, Entamoeba histolytica
SPQKHSESI

SEQ ID NO: 2657646 - protein, 5 aa, Entamoeba histolytica
SPQKI

SEQ ID NO: 2657647 - protein, 5 aa, Entamoeba histolytica
SPQLN

SEQ ID NO: 2657648 - protein, 6 aa, Entamoeba histolytica
SPQLPL

SEQ ID NO: 2657649 - protein, 8 aa, Entamoeba histolytica
SPQNQKRR

SEQ ID NO: 2657650 - protein, 5 aa, Entamoeba histolytica
SPQNS

SEQ ID NO: 2657651 - protein, 14 aa, Entamoeba histolytica
SPQQLEREQKKGGK

SEQ ID NO: 2657652 - protein, 8 aa, Entamoeba histolytica
SPQRNQAE

SEQ ID NO: 2657653 - protein, 16 aa, Entamoeba histolytica
SPQRSNAVTPQQNPED

SEQ ID NO: 2657654 - protein, 21 aa, Entamoeba histolytica
SPQSIDNQYQQQYQQYPQYQN

SEQ ID NO: 2657655 - protein, 6 aa, Entamoeba histolytica
SPQSNS

SEQ ID NO: 2657656 - protein, 5 aa, Entamoeba histolytica
SPQTD

SEQ ID NO: 2657657 - protein, 6 aa, Entamoeba histolytica
SPQTNQ

SEQ ID NO: 2657658 - protein, 6 aa, Entamoeba histolytica
SPQTPS

SEQ ID NO: 2657659 - protein, 7 aa, Entamoeba histolytica
SPQTRDQ

SEQ ID NO: 2657660 - protein, 14 aa, Entamoeba histolytica
SPQTRSRSRSSSFA

SEQ ID NO: 2657661 - protein, 8 aa, Entamoeba histolytica
SPQTSSKF

SEQ ID NO: 2657662 - protein, 6 aa, Entamoeba histolytica
SPRALE

SEQ ID NO: 2657663 - protein, 4 aa, Entamoeba histolytica
SPRD

SEQ ID NO: 2657664 - protein, 11 aa, Entamoeba histolytica
SPREEEQTEVD

SEQ ID NO: 2657665 - protein, 32 aa, Entamoeba histolytica
SPRFEEAKTKDAENEKRPAELEDLKKQWGIDD

SEQ ID NO: 2657666 - protein, 8 aa, Entamoeba histolytica
SPRGDNDR

SEQ ID NO: 2657667 - protein, 9 aa, Entamoeba histolytica
SPRHSQRST

SEQ ID NO: 2657668 - protein, 10 aa, Entamoeba histolytica
SPRKREQQQL

SEQ ID NO: 2657669 - protein, 9 aa, Entamoeba histolytica
SPRKSSDTC

SEQ ID NO: 2657670 - protein, 6 aa, Entamoeba histolytica
SPRLNG

SEQ ID NO: 2657671 - protein, 15 aa, Entamoeba histolytica
SPRLPSKGLNTLTQK

SEQ ID NO: 2657672 - protein, 14 aa, Entamoeba histolytica
SPRQNDPHKYKKKK

SEQ ID NO: 2657673 - protein, 8 aa, Entamoeba histolytica
SPRSRSEM

SEQ ID NO: 2657674 - protein, 22 aa, Entamoeba histolytica
SPRSSSTSPRNTSPQFKKTGEL

SEQ ID NO: 2657675 - protein, 5 aa, Entamoeba histolytica
SPRTL

SEQ ID NO: 2657676 - protein, 31 aa, Entamoeba histolytica
SPRVSQKPLPVEESNGPSNELAALLAKRRQK

SEQ ID NO: 2657677 - protein, 14 aa, Entamoeba histolytica
SPSDNQLNSSRATD

SEQ ID NO: 2657678 - protein, 9 aa, Entamoeba histolytica
SPSDQQPKC

SEQ ID NO: 2657679 - protein, 8 aa, Entamoeba histolytica
SPSDRRAA

SEQ ID NO: 2657680 - protein, 27 aa, Entamoeba histolytica
SPSDSSSQSSDQTSPSIQSPLTNSPYS

SEQ ID NO: 2657681 - protein, 10 aa, Entamoeba histolytica
SPSEEKTPEE

SEQ ID NO: 2657682 - protein, 8 aa, Entamoeba histolytica
SPSEKDIR

SEQ ID NO: 2657683 - protein, 13 aa, Entamoeba histolytica
SPSFKYDKNKIKR

SEQ ID NO: 2657684 - protein, 8 aa, Entamoeba histolytica
SPSIQNSI

SEQ ID NO: 2657685 - protein, 6 aa, Entamoeba histolytica
SPSISR

SEQ ID NO: 2657686 - protein, 5 aa, Entamoeba histolytica
SPSKI

SEQ ID NO: 2657687 - protein, 8 aa, Entamoeba histolytica
SPSKLSQV

SEQ ID NO: 2657688 - protein, 9 aa, Entamoeba histolytica
SPSKNQKNE

SEQ ID NO: 2657689 - protein, 7 aa, Entamoeba histolytica
SPSLLTP

SEQ ID NO: 2657690 - protein, 5 aa, Entamoeba histolytica
SPSLN

SEQ ID NO: 2657691 - protein, 12 aa, Entamoeba histolytica
SPSLNSTKHSNC

SEQ ID NO: 2657692 - protein, 13 aa, Entamoeba histolytica
SPSLSSIKETSST

SEQ ID NO: 2657693 - protein, 7 aa, Entamoeba histolytica
SPSLTSS

SEQ ID NO: 2657694 - protein, 4 aa, Entamoeba histolytica
SPSN

SEQ ID NO: 2657695 - protein, 5 aa, Entamoeba histolytica
SPSNE

SEQ ID NO: 2657696 - protein, 5 aa, Entamoeba histolytica
SPSNL

SEQ ID NO: 2657697 - protein, 7 aa, Entamoeba histolytica
SPSPESL

SEQ ID NO: 2657698 - protein, 5 aa, Entamoeba histolytica
SPSPI

SEQ ID NO: 2657699 - protein, 7 aa, Entamoeba histolytica
SPSPMDF

SEQ ID NO: 2657700 - protein, 7 aa, Entamoeba histolytica
SPSPSLK

SEQ ID NO: 2657701 - protein, 22 aa, Entamoeba histolytica
SPSPTFSRSPSPRSQKINSPRS

SEQ ID NO: 2657702 - protein, 7 aa, Entamoeba histolytica
SPSPYRS

SEQ ID NO: 2657703 - protein, 9 aa, Entamoeba histolytica
SPSQDDPDS

SEQ ID NO: 2657704 - protein, 12 aa, Entamoeba histolytica
SPSQEEEYLDKE

SEQ ID NO: 2657705 - protein, 7 aa, Entamoeba histolytica
SPSQKQT

SEQ ID NO: 2657706 - protein, 6 aa, Entamoeba histolytica
SPSQNG

SEQ ID NO: 2657707 - protein, 8 aa, Entamoeba histolytica
SPSQNRTF

SEQ ID NO: 2657708 - protein, 11 aa, Entamoeba histolytica
SPSQQQQQQQY

SEQ ID NO: 2657709 - protein, 6 aa, Entamoeba histolytica
SPSRDE

SEQ ID NO: 2657710 - protein, 5 aa, Entamoeba histolytica
SPSRI

SEQ ID NO: 2657711 - protein, 7 aa, Entamoeba histolytica
SPSSCTS

SEQ ID NO: 2657712 - protein, 6 aa, Entamoeba histolytica
SPSSIQ

SEQ ID NO: 2657713 - protein, 14 aa, Entamoeba histolytica
SPSSKSPAHAPETV

SEQ ID NO: 2657714 - protein, 8 aa, Entamoeba histolytica
SPSSLEQA

SEQ ID NO: 2657715 - protein, 8 aa, Entamoeba histolytica
SPSSSLFS

SEQ ID NO: 2657716 - protein, 4 aa, Entamoeba histolytica
SPST

SEQ ID NO: 2657717 - protein, 30 aa, Entamoeba histolytica
SPSTLSQGIEYSTTDFSTNTIEDSTWTQSN

SEQ ID NO: 2657718 - protein, 6 aa, Entamoeba histolytica
SPSTYL

SEQ ID NO: 2657719 - protein, 14 aa, Entamoeba histolytica
SPSVSDTSLIPPSR

SEQ ID NO: 2657720 - protein, 9 aa, Entamoeba histolytica
SPTDDNVDN

SEQ ID NO: 2657721 - protein, 4 aa, Entamoeba histolytica
SPTE

SEQ ID NO: 2657722 - protein, 5 aa, Entamoeba histolytica
SPTEF

SEQ ID NO: 2657723 - protein, 12 aa, Entamoeba histolytica
SPTEHDEINPRP

SEQ ID NO: 2657724 - protein, 13 aa, Entamoeba histolytica
SPTEIDEVNPKPH

SEQ ID NO: 2657725 - protein, 5 aa, Entamoeba histolytica
SPTEY

SEQ ID NO: 2657726 - protein, 4 aa, Entamoeba histolytica
SPTF

SEQ ID NO: 2657727 - protein, 7 aa, Entamoeba histolytica
SPTGINP

SEQ ID NO: 2657728 - protein, 7 aa, Entamoeba histolytica
SPTGTGK

SEQ ID NO: 2657729 - protein, 4 aa, Entamoeba histolytica
SPTI

SEQ ID NO: 2657730 - protein, 11 aa, Entamoeba histolytica
SPTIEDTYNKT

SEQ ID NO: 2657731 - protein, 6 aa, Entamoeba histolytica
SPTKAY

SEQ ID NO: 2657732 - protein, 8 aa, Entamoeba histolytica
SPTKDLDG

SEQ ID NO: 2657733 - protein, 13 aa, Entamoeba histolytica
SPTKKSPSPSSQS

SEQ ID NO: 2657734 - protein, 7 aa, Entamoeba histolytica
SPTKNTP

SEQ ID NO: 2657735 - protein, 5 aa, Entamoeba histolytica
SPTKV

SEQ ID NO: 2657736 - protein, 8 aa, Entamoeba histolytica
SPTKYEPL

SEQ ID NO: 2657737 - protein, 28 aa, Entamoeba histolytica
SPTLGNVEELSKERIQSLPTPIKTGQRL

SEQ ID NO: 2657738 - protein, 9 aa, Entamoeba histolytica
SPTLSSSMK

SEQ ID NO: 2657739 - protein, 7 aa, Entamoeba histolytica
SPTMKTV

SEQ ID NO: 2657740 - protein, 5 aa, Entamoeba histolytica
SPTND

SEQ ID NO: 2657741 - protein, 9 aa, Entamoeba histolytica
SPTNDNEFE

SEQ ID NO: 2657742 - protein, 13 aa, Entamoeba histolytica
SPTNIISQSKNIT

SEQ ID NO: 2657743 - protein, 43 aa, Entamoeba histolytica; identical to SEQ ID NO: 2462554

SEQ ID NO: 2657744 - protein, 6 aa, Entamoeba histolytica
SPTPEV

SEQ ID NO: 2657745 - protein, 8 aa, Entamoeba histolytica
SPTPGNLI

SEQ ID NO: 2657746 - protein, 9 aa, Entamoeba histolytica
SPTPPTTYD

SEQ ID NO: 2657747 - protein, 4 aa, Entamoeba histolytica
SPTQ

SEQ ID NO: 2657748 - protein, 23 aa, Entamoeba histolytica
SPTQIESNDFSEEFSDDNTFNYQ

SEQ ID NO: 2657749 - protein, 7 aa, Entamoeba histolytica
SPTQTQI

SEQ ID NO: 2657750 - protein, 8 aa, Entamoeba histolytica
SPTSESIK

SEQ ID NO: 2657751 - protein, 6 aa, Entamoeba histolytica
SPTSHY

SEQ ID NO: 2657752 - protein, 9 aa, Entamoeba histolytica
SPTSNTLQP

SEQ ID NO: 2657753 - protein, 7 aa, Entamoeba histolytica
SPTSQTI

SEQ ID NO: 2657754 - protein, 9 aa, Entamoeba histolytica
SPTTKENRL

SEQ ID NO: 2657755 - protein, 5 aa, Entamoeba histolytica
SPTTN

SEQ ID NO: 2657756 - protein, 8 aa, Entamoeba histolytica
SPTTPNRD

SEQ ID NO: 2657757 - protein, 6 aa, Entamoeba histolytica
SPTTTV

SEQ ID NO: 2657758 - protein, 4 aa, Entamoeba histolytica
SPTV

SEQ ID NO: 2657759 - protein, 6 aa, Entamoeba histolytica
SPTVDE

SEQ ID NO: 2657760 - protein, 8 aa, Entamoeba histolytica
SPTVSPAV

SEQ ID NO: 2657761 - protein, 6 aa, Entamoeba histolytica
SPTVVT

SEQ ID NO: 2657762 - protein, 6 aa, Entamoeba histolytica
SPVDAT

SEQ ID NO: 2657763 - protein, 5 aa, Entamoeba histolytica
SPVGD

SEQ ID NO: 2657764 - protein, 8 aa, Entamoeba histolytica
SPVGRTGM

SEQ ID NO: 2657765 - protein, 5 aa, Entamoeba histolytica
SPVQL

SEQ ID NO: 2657766 - protein, 7 aa, Entamoeba histolytica
SPVQNYK

SEQ ID NO: 2657767 - protein, 22 aa, Entamoeba histolytica
SPVQTNKHLGTTRKQTLTHKDD

SEQ ID NO: 2657768 - protein, 88 aa, Entamoeba histolytica
SPYANTYSSAQQRQNQPTYQPPTMPNISQQPSFGVKSTSSYPTQQSTSSYPTQQSTYTAPQNPNYPPQQTYQGTYSTTQQYPSSQKEQ

SEQ ID NO: 2657769 - protein, 6 aa, Entamoeba histolytica
SPYDEE

SEQ ID NO: 2657770 - protein, 8 aa, Entamoeba histolytica
SPYDTEIE

SEQ ID NO: 2657771 - protein, 5 aa, Entamoeba histolytica
SPYFQ

SEQ ID NO: 2657772 - protein, 6 aa, Entamoeba histolytica
SPYKQS

SEQ ID NO: 2657773 - protein, 6 aa, Entamoeba histolytica
SPYKYH

SEQ ID NO: 2657774 - protein, 4 aa, Entamoeba histolytica
SPYL

SEQ ID NO: 2657775 - protein, 4 aa, Entamoeba histolytica
SPYS

SEQ ID NO: 2657776 - protein, 15 aa, Entamoeba histolytica
SPYSEQAPSSPVKVT

SEQ ID NO: 2657777 - protein, 12 aa, Entamoeba histolytica
SPYYNPNYAAKN

SEQ ID NO: 2657778 - protein, 5 aa, Entamoeba histolytica
SPYYQ

SEQ ID NO: 2657779 - protein, 19 aa, Entamoeba histolytica
SQAAAQQRAGRAGRTRPGQ

SEQ ID NO: 2657780 - protein, 6 aa, Entamoeba histolytica
SQAALD

SEQ ID NO: 2657781 - protein, 8 aa, Entamoeba histolytica
SQAEKYES

SEQ ID NO: 2657782 - protein, 7 aa, Entamoeba histolytica
SQAGTEE

SEQ ID NO: 2657783 - protein, 17 aa, Entamoeba histolytica
SQAKYKSYLTQKEAEDV

SEQ ID NO: 2657784 - protein, 7 aa, Entamoeba histolytica
SQANNQP

SEQ ID NO: 2657785 - protein, 8 aa, Entamoeba histolytica
SQAPTIET

SEQ ID NO: 2657786 - protein, 7 aa, Entamoeba histolytica
SQAPTLE

SEQ ID NO: 2657787 - protein, 6 aa, Entamoeba histolytica
SQAPTS

SEQ ID NO: 2657788 - protein, 9 aa, Entamoeba histolytica
SQAQQSYKT

SEQ ID NO: 2657789 - protein, 6 aa, Entamoeba histolytica
SQAQTD

SEQ ID NO: 2657790 - protein, 6 aa, Entamoeba histolytica
SQASKT

SEQ ID NO: 2657791 - protein, 5 aa, Entamoeba histolytica
SQATQ

SEQ ID NO: 2657792 - protein, 7 aa, Entamoeba histolytica
SQCPPLE

SEQ ID NO: 2657793 - protein, 5 aa, Entamoeba histolytica
SQCSA

SEQ ID NO: 2657794 - protein, 6 aa, Entamoeba histolytica
SQDCTV

SEQ ID NO: 2657795 - protein, 7 aa, Entamoeba histolytica
SQDDRLR

SEQ ID NO: 2657796 - protein, 8 aa, Entamoeba histolytica
SQDDSYKN

SEQ ID NO: 2657797 - protein, 9 aa, Entamoeba histolytica
SQDESVLSG

SEQ ID NO: 2657798 - protein, 4 aa, Entamoeba histolytica
SQDG

SEQ ID NO: 2657799 - protein, 8 aa, Entamoeba histolytica
SQDNNIRS

SEQ ID NO: 2657800 - protein, 10 aa, Entamoeba histolytica
SQDNQTTEKE

SEQ ID NO: 2657801 - protein, 9 aa, Entamoeba histolytica
SQDPKNRWG

SEQ ID NO: 2657802 - protein, 6 aa, Entamoeba histolytica
SQDPQT

SEQ ID NO: 2657803 - protein, 10 aa, Entamoeba histolytica
SQDQTGSRTV

SEQ ID NO: 2657804 - protein, 14 aa, Entamoeba histolytica
SQDSSKLGSCSGDH

SEQ ID NO: 2657805 - protein, 6 aa, Entamoeba histolytica
SQDVPQ

SEQ ID NO: 2657806 - protein, 5 aa, Entamoeba histolytica
SQDVS

SEQ ID NO: 2657807 - protein, 19 aa, Entamoeba histolytica
SQEDYEKSIQREEEETRKS

SEQ ID NO: 2657808 - protein, 5 aa, Entamoeba histolytica
SQEEA

SEQ ID NO: 2657809 - protein, 8 aa, Entamoeba histolytica
SQEEAAEI

SEQ ID NO: 2657810 - protein, 9 aa, Entamoeba histolytica
SQEEDCKVP

SEQ ID NO: 2657811 - protein, 5 aa, Entamoeba histolytica
SQEEE

SEQ ID NO: 2657812 - protein, 5 aa, Entamoeba histolytica
SQEEI

SEQ ID NO: 2657813 - protein, 8 aa, Entamoeba histolytica
SQEEINET

SEQ ID NO: 2657814 - protein, 9 aa, Entamoeba histolytica
SQEETHGLS

SEQ ID NO: 2657815 - protein, 5 aa, Entamoeba histolytica
SQEEV

SEQ ID NO: 2657816 - protein, 4 aa, Entamoeba histolytica
SQEF

SEQ ID NO: 2657817 - protein, 6 aa, Entamoeba histolytica
SQEFNE

SEQ ID NO: 2657818 - protein, 5 aa, Entamoeba histolytica
SQEFT

SEQ ID NO: 2657819 - protein, 5 aa, Entamoeba histolytica
SQEGR

SEQ ID NO: 2657820 - protein, 5 aa, Entamoeba histolytica
SQEKG

SEQ ID NO: 2657821 - protein, 7 aa, Entamoeba histolytica
SQEKRIQ

SEQ ID NO: 2657822 - protein, 7 aa, Entamoeba histolytica
SQELSES

SEQ ID NO: 2657823 - protein, 9 aa, Entamoeba histolytica
SQENAGETI

SEQ ID NO: 2657824 - protein, 15 aa, Entamoeba histolytica
SQENISNSISYSSLP

SEQ ID NO: 2657825 - protein, 9 aa, Entamoeba histolytica
SQEPQIRSS

SEQ ID NO: 2657826 - protein, 4 aa, Entamoeba histolytica
SQEQ

SEQ ID NO: 2657827 - protein, 6 aa, Entamoeba histolytica
SQEQID

SEQ ID NO: 2657828 - protein, 6 aa, Entamoeba histolytica
SQERKN

SEQ ID NO: 2657829 - protein, 7 aa, Entamoeba histolytica
SQESDRF

SEQ ID NO: 2657830 - protein, 8 aa, Entamoeba histolytica
SQESINKY

SEQ ID NO: 2657831 - protein, 8 aa, Entamoeba histolytica
SQETAGKT

SEQ ID NO: 2657832 - protein, 9 aa, Entamoeba histolytica
SQETEAQTE

SEQ ID NO: 2657833 - protein, 8 aa, Entamoeba histolytica
SQETTQTG

SEQ ID NO: 2657834 - protein, 15 aa, Entamoeba histolytica
SQEYSNSSLKSLQEE

SEQ ID NO: 2657835 - protein, 8 aa, Entamoeba histolytica
SQEYWKQS

SEQ ID NO: 2657836 - protein, 5 aa, Entamoeba histolytica
SQFHS

SEQ ID NO: 2657837 - protein, 15 aa, Entamoeba histolytica
SQFKEKEDNWEKEKN

SEQ ID NO: 2657838 - protein, 9 aa, Entamoeba histolytica
SQFNKSHGF

SEQ ID NO: 2657839 - protein, 11 aa, Entamoeba histolytica
SQFPENKINKT

SEQ ID NO: 2657840 - protein, 7 aa, Entamoeba histolytica
SQFPQNS

SEQ ID NO: 2657841 - protein, 6 aa, Entamoeba histolytica
SQFQPR

SEQ ID NO: 2657842 - protein, 8 aa, Entamoeba histolytica
SQGDPTKV

SEQ ID NO: 2657843 - protein, 6 aa, Entamoeba histolytica
SQGDSI

SEQ ID NO: 2657844 - protein, 5 aa, Entamoeba histolytica
SQGIN

SEQ ID NO: 2657845 - protein, 6 aa, Entamoeba histolytica
SQGKLS

SEQ ID NO: 2657846 - protein, 7 aa, Entamoeba histolytica
SQGLDSL

SEQ ID NO: 2657847 - protein, 58 aa, Entamoeba histolytica
SQGLNDNKQNNEQTSSDSEKNNKINNNKLNEESTSIKNEKNEEGTSQLTNKKSDVIEI

SEQ ID NO: 2657848 - protein, 6 aa, Entamoeba histolytica
SQGLTL

SEQ ID NO: 2657849 - protein, 9 aa, Entamoeba histolytica
SQGMGNKGA

SEQ ID NO: 2657850 - protein, 12 aa, Entamoeba histolytica
SQGMKTSEAARQ

SEQ ID NO: 2657851 - protein, 5 aa, Entamoeba histolytica
SQGMT

SEQ ID NO: 2657852 - protein, 9 aa, Entamoeba histolytica
SQGNIYESQ

SEQ ID NO: 2657853 - protein, 5 aa, Entamoeba histolytica
SQGNK

SEQ ID NO: 2657854 - protein, 40 aa, Entamoeba histolytica; identical to SEQ ID NO: 2462652

SEQ ID NO: 2657855 - protein, 5 aa, Entamoeba histolytica
SQGQF

SEQ ID NO: 2657856 - protein, 5 aa, Entamoeba histolytica
SQGRN

SEQ ID NO: 2657857 - protein, 8 aa, Entamoeba histolytica
SQHDIDTN

SEQ ID NO: 2657858 - protein, 6 aa, Entamoeba histolytica
SQHGST

SEQ ID NO: 2657859 - protein, 6 aa, Entamoeba histolytica
SQHPDK

SEQ ID NO: 2657860 - protein, 6 aa, Entamoeba histolytica
SQHPNI

SEQ ID NO: 2657861 - protein, 9 aa, Entamoeba histolytica
SQHSQQLQQ

SEQ ID NO: 2657862 - protein, 7 aa, Entamoeba histolytica
SQHVNES

SEQ ID NO: 2657863 - protein, 9 aa, Entamoeba histolytica
SQIDPEKIT

SEQ ID NO: 2657864 - protein, 9 aa, Entamoeba histolytica
SQIDQATSS

SEQ ID NO: 2657865 - protein, 12 aa, Entamoeba histolytica
SQIERENEQLKE

SEQ ID NO: 2657866 - protein, 5 aa, Entamoeba histolytica
SQIEY

SEQ ID NO: 2657867 - protein, 4 aa, Entamoeba histolytica
SQIK

SEQ ID NO: 2657868 - protein, 20 aa, Entamoeba histolytica
SQIKGLNEKETSERKVKKPK

SEQ ID NO: 2657869 - protein, 15 aa, Entamoeba histolytica
SQIKKAQQTDEEQTK

SEQ ID NO: 2657870 - protein, 5 aa, Entamoeba histolytica
SQIKN

SEQ ID NO: 2657871 - protein, 6 aa, Entamoeba histolytica
SQIKPS

SEQ ID NO: 2657872 - protein, 12 aa, Entamoeba histolytica
SQINEPKTPSFA

SEQ ID NO: 2657873 - protein, 12 aa, Entamoeba histolytica
SQINTSKNLPTQ

SEQ ID NO: 2657874 - protein, 4 aa, Entamoeba histolytica
SQIP

SEQ ID NO: 2657875 - protein, 10 aa, Entamoeba histolytica
SQIPEEKYQE

SEQ ID NO: 2657876 - protein, 6 aa, Entamoeba histolytica
SQIPGR

SEQ ID NO: 2657877 - protein, 9 aa, Entamoeba histolytica
SQISPKGMN

SEQ ID NO: 2657878 - protein, 10 aa, Entamoeba histolytica
SQISQTQEQT

SEQ ID NO: 2657879 - protein, 6 aa, Entamoeba histolytica
SQISSS

SEQ ID NO: 2657880 - protein, 4 aa, Entamoeba histolytica
SQIT

SEQ ID NO: 2657881 - protein, 20 aa, Entamoeba histolytica
SQITDNTITNQEDNSNQINE

SEQ ID NO: 2657882 - protein, 5 aa, Entamoeba histolytica
SQITN

SEQ ID NO: 2657883 - protein, 9 aa, Entamoeba histolytica
SQKDRDNTE

SEQ ID NO: 2657884 - protein, 6 aa, Entamoeba histolytica
SQKDSD

SEQ ID NO: 2657885 - protein, 7 aa, Entamoeba histolytica
SQKEEYE

SEQ ID NO: 2657886 - protein, 10 aa, Entamoeba histolytica
SQKEGTYKEK

SEQ ID NO: 2657887 - protein, 8 aa, Entamoeba histolytica
SQKEMNPK

SEQ ID NO: 2657888 - protein, 9 aa, Entamoeba histolytica
SQKESWESA

SEQ ID NO: 2657889 - protein, 13 aa, Entamoeba histolytica
SQKFIGTKDYLIR

SEQ ID NO: 2657890 - protein, 6 aa, Entamoeba histolytica
SQKGDL

SEQ ID NO: 2657891 - protein, 9 aa, Entamoeba histolytica
SQKGQSKNL

SEQ ID NO: 2657892 - protein, 20 aa, Entamoeba histolytica
SQKIRTASQKLQIVNNKIIE

SEQ ID NO: 2657893 - protein, 19 aa, Entamoeba histolytica
SQKKSPVSHNIGTDETEKA

SEQ ID NO: 2657894 - protein, 4 aa, Entamoeba histolytica
SQKL

SEQ ID NO: 2657895 - protein, 10 aa, Entamoeba histolytica
SQKLKEETRT

SEQ ID NO: 2657896 - protein, 7 aa, Entamoeba histolytica
SQKPELT

SEQ ID NO: 2657897 - protein, 17 aa, Entamoeba histolytica
SQKPLSNGLKWQRKKAN

SEQ ID NO: 2657898 - protein, 8 aa, Entamoeba histolytica
SQKQKEEV

SEQ ID NO: 2657899 - protein, 13 aa, Entamoeba histolytica
SQKRKGTKEQEAA

SEQ ID NO: 2657900 - protein, 7 aa, Entamoeba histolytica
SQKRPEI

SEQ ID NO: 2657901 - protein, 11 aa, Entamoeba histolytica
SQKSEGTTLSE

SEQ ID NO: 2657902 - protein, 11 aa, Entamoeba histolytica
SQKSKSQTSVE

SEQ ID NO: 2657903 - protein, 36 aa, Entamoeba histolytica
SQKSKSSKNVASTPTSNSQHATPSITPRYDNTDTKS

SEQ ID NO: 2657904 - protein, 9 aa, Entamoeba histolytica
SQKTSGEKN

SEQ ID NO: 2657905 - protein, 14 aa, Entamoeba histolytica
SQKTVEQLPSTTQL

SEQ ID NO: 2657906 - protein, 8 aa, Entamoeba histolytica
SQKVTSKT

SEQ ID NO: 2657907 - protein, 9 aa, Entamoeba histolytica
SQLDEPSLE

SEQ ID NO: 2657908 - protein, 15 aa, Entamoeba histolytica
SQLKGTPQGGPLEED

SEQ ID NO: 2657909 - protein, 10 aa, Entamoeba histolytica
SQLKKVESGE

SEQ ID NO: 2657910 - protein, 4 aa, Entamoeba histolytica
SQLN

SEQ ID NO: 2657911 - protein, 12 aa, Entamoeba histolytica
SQLNEEENDSFP

SEQ ID NO: 2657912 - protein, 8 aa, Entamoeba histolytica
SQLNSKKK

SEQ ID NO: 2657913 - protein, 6 aa, Entamoeba histolytica
SQLRDT

SEQ ID NO: 2657914 - protein, 27 aa, Entamoeba histolytica
SQLRGDGIKRRRSKKQIENDLPPIGYP

SEQ ID NO: 2657915 - protein, 7 aa, Entamoeba histolytica
SQLSIEG

SEQ ID NO: 2657916 - protein, 4 aa, Entamoeba histolytica
SQLT

SEQ ID NO: 2657917 - protein, 9 aa, Entamoeba histolytica
SQMTTQQDS

SEQ ID NO: 2657918 - protein, 7 aa, Entamoeba histolytica
SQNDRCS

SEQ ID NO: 2657919 - protein, 4 aa, Entamoeba histolytica
SQNE

SEQ ID NO: 2657920 - protein, 7 aa, Entamoeba histolytica
SQNEAYP

SEQ ID NO: 2657921 - protein, 8 aa, Entamoeba histolytica
SQNEEVTK

SEQ ID NO: 2657922 - protein, 5 aa, Entamoeba histolytica
SQNEH

SEQ ID NO: 2657923 - protein, 9 aa, Entamoeba histolytica
SQNEKSEIG

SEQ ID NO: 2657924 - protein, 6 aa, Entamoeba histolytica
SQNENI

SEQ ID NO: 2657925 - protein, 5 aa, Entamoeba histolytica
SQNEQ

SEQ ID NO: 2657926 - protein, 9 aa, Entamoeba histolytica
SQNESSDCA

SEQ ID NO: 2657927 - protein, 8 aa, Entamoeba histolytica
SQNEYGDI

SEQ ID NO: 2657928 - protein, 5 aa, Entamoeba histolytica
SQNGE

SEQ ID NO: 2657929 - protein, 7 aa, Entamoeba histolytica
SQNGNPP

SEQ ID NO: 2657930 - protein, 7 aa, Entamoeba histolytica
SQNIPER

SEQ ID NO: 2657931 - protein, 8 aa, Entamoeba histolytica
SQNKEEVE

SEQ ID NO: 2657932 - protein, 10 aa, Entamoeba histolytica
SQNKKEFNKE

SEQ ID NO: 2657933 - protein, 5 aa, Entamoeba histolytica
SQNLS

SEQ ID NO: 2657934 - protein, 8 aa, Entamoeba histolytica
SQNLSRTQ

SEQ ID NO: 2657935 - protein, 42 aa, Entamoeba histolytica
SQNNGLTRPTTEAPKPSYLPPKPNRLQHNSNELIGGNSASGV

SEQ ID NO: 2657936 - protein, 10 aa, Entamoeba histolytica
SQNNQNSTIP

SEQ ID NO: 2657937 - protein, 8 aa, Entamoeba histolytica
SQNPQNNE

SEQ ID NO: 2657938 - protein, 4 aa, Entamoeba histolytica
SQNQ

SEQ ID NO: 2657939 - protein, 9 aa, Entamoeba histolytica
SQNQEDIET

SEQ ID NO: 2657940 - protein, 7 aa, Entamoeba histolytica
SQNQSMK

SEQ ID NO: 2657941 - protein, 16 aa, Entamoeba histolytica
SQNQSTFQPYENEETI

SEQ ID NO: 2657942 - protein, 7 aa, Entamoeba histolytica
SQNRGPN

SEQ ID NO: 2657943 - protein, 37 aa, Entamoeba histolytica
SQNRNLRNRTSTSSRSRSRDRSRYSGMSESDSQFQND

SEQ ID NO: 2657944 - protein, 25 aa, Entamoeba histolytica
SQNSIAKEEEEKVMKNDDDKIENNN

SEQ ID NO: 2657945 - protein, 7 aa, Entamoeba histolytica
SQNSKLT

SEQ ID NO: 2657946 - protein, 9 aa, Entamoeba histolytica
SQNSLNLPT

SEQ ID NO: 2657947 - protein, 11 aa, Entamoeba histolytica
SQNSTKSLAEG

SEQ ID NO: 2657948 - protein, 9 aa, Entamoeba histolytica
SQNTEENLT

SEQ ID NO: 2657949 - protein, 20 aa, Entamoeba histolytica
SQNTENPKNEKKSEIEQKQV

SEQ ID NO: 2657950 - protein, 9 aa, Entamoeba histolytica
SQNTSPSIS

SEQ ID NO: 2657951 - protein, 8 aa, Entamoeba histolytica
SQNTSPVS

SEQ ID NO: 2657952 - protein, 10 aa, Entamoeba histolytica
SQNTSSQNTI

SEQ ID NO: 2657953 - protein, 4 aa, Entamoeba histolytica
SQNV

SEQ ID NO: 2657954 - protein, 7 aa, Entamoeba histolytica
SQNYDTK

SEQ ID NO: 2657955 - protein, 16 aa, Entamoeba histolytica
SQPDEDYDNKRSEKEI

SEQ ID NO: 2657956 - protein, 15 aa, Entamoeba histolytica
SQPDEDYDNRISEKE

SEQ ID NO: 2657957 - protein, 14 aa, Entamoeba histolytica
SQPDEDYDNRRSEI

SEQ ID NO: 2657958 - protein, 16 aa, Entamoeba histolytica
SQPDEESDNSRSENEI

SEQ ID NO: 2657959 - protein, 16 aa, Entamoeba histolytica
SQPDEEYDNSRSENEI

SEQ ID NO: 2657960 - protein, 16 aa, Entamoeba histolytica
SQPDEGGDNSRTDKEI

SEQ ID NO: 2657961 - protein, 23 aa, Entamoeba histolytica
SQPEDSNPNEKKYDQTREDEWDD

SEQ ID NO: 2657962 - protein, 6 aa, Entamoeba histolytica
SQPHFP

SEQ ID NO: 2657963 - protein, 4 aa, Entamoeba histolytica
SQPI

SEQ ID NO: 2657964 - protein, 6 aa, Entamoeba histolytica
SQPISP

SEQ ID NO: 2657965 - protein, 6 aa, Entamoeba histolytica
SQPIYA

SEQ ID NO: 2657966 - protein, 20 aa, Entamoeba histolytica
SQPKVKDEDHKERKEIEEHK

SEQ ID NO: 2657967 - protein, 12 aa, Entamoeba histolytica
SQPLNETTNVDP

SEQ ID NO: 2657968 - protein, 6 aa, Entamoeba histolytica
SQPMTK

SEQ ID NO: 2657969 - protein, 21 aa, Entamoeba histolytica
SQPMTSIPSPMPKQRISSTFV

SEQ ID NO: 2657970 - protein, 12 aa, Entamoeba histolytica
SQPNKEEQDQCI

SEQ ID NO: 2657971 - protein, 16 aa, Entamoeba histolytica
SQPPSTRTSFLKRRKQ

SEQ ID NO: 2657972 - protein, 5 aa, Entamoeba histolytica
SQPQQ

SEQ ID NO: 2657973 - protein, 6 aa, Entamoeba histolytica
SQPQYL

SEQ ID NO: 2657974 - protein, 5 aa, Entamoeba histolytica
SQPRL

SEQ ID NO: 2657975 - protein, 14 aa, Entamoeba histolytica
SQPRTSLSKLSPYD

SEQ ID NO: 2657976 - protein, 7 aa, Entamoeba histolytica
SQPSEKD

SEQ ID NO: 2657977 - protein, 8 aa, Entamoeba histolytica
SQPSTPVI

SEQ ID NO: 2657978 - protein, 6 aa, Entamoeba histolytica
SQPTEE

SEQ ID NO: 2657979 - protein, 28 aa, Entamoeba histolytica
SQPTGKLQNSVNGITPTPSKKVAPPIPH

SEQ ID NO: 2657980 - protein, 6 aa, Entamoeba histolytica
SQPTHD

SEQ ID NO: 2657981 - protein, 6 aa, Entamoeba histolytica
SQPTMK

SEQ ID NO: 2657982 - protein, 9 aa, Entamoeba histolytica
SQPTQPPLI

SEQ ID NO: 2657983 - protein, 5 aa, Entamoeba histolytica
SQQCP

SEQ ID NO: 2657984 - protein, 8 aa, Entamoeba histolytica
SQQDERTI

SEQ ID NO: 2657985 - protein, 8 aa, Entamoeba histolytica
SQQDGNNV

SEQ ID NO: 2657986 - protein, 18 aa, Entamoeba histolytica
SQQEQKIDKEIKKTQEKN

SEQ ID NO: 2657987 - protein, 7 aa, Entamoeba histolytica
SQQGGMD

SEQ ID NO: 2657988 - protein, 9 aa, Entamoeba histolytica
SQQGQTIES

SEQ ID NO: 2657989 - protein, 6 aa, Entamoeba histolytica
SQQKKI

SEQ ID NO: 2657990 - protein, 6 aa, Entamoeba histolytica
SQQKNR

SEQ ID NO: 2657991 - protein, 6 aa, Entamoeba histolytica
SQQKTS

SEQ ID NO: 2657992 - protein, 9 aa, Entamoeba histolytica
SQQKYDDEQ

SEQ ID NO: 2657993 - protein, 7 aa, Entamoeba histolytica
SQQKYDG

SEQ ID NO: 2657994 - protein, 4 aa, Entamoeba histolytica
SQQL

SEQ ID NO: 2657995 - protein, 5 aa, Entamoeba histolytica
SQQLN

SEQ ID NO: 2657996 - protein, 7 aa, Entamoeba histolytica
SQQNDQQ

SEQ ID NO: 2657997 - protein, 6 aa, Entamoeba histolytica
SQQNSA

SEQ ID NO: 2657998 - protein, 6 aa, Entamoeba histolytica
SQQPIR

SEQ ID NO: 2657999 - protein, 7 aa, Entamoeba histolytica
SQQPLEQ

SEQ ID NO: 2658000 - protein, 33 aa, Entamoeba histolytica
SQQPNQKGKNESDKEGNDSTTEDITQSYDYSSV

SEQ ID NO: 2658001 - protein, 8 aa, Entamoeba histolytica
SQQPQRYN

SEQ ID NO: 2658002 - protein, 7 aa, Entamoeba histolytica
SQQQNIG

SEQ ID NO: 2658003 - protein, 10 aa, Entamoeba histolytica
SQQQNINNNY

SEQ ID NO: 2658004 - protein, 6 aa, Entamoeba histolytica
SQQQQL

SEQ ID NO: 2658005 - protein, 6 aa, Entamoeba histolytica
SQQQYH

SEQ ID NO: 2658006 - protein, 4 aa, Entamoeba histolytica
SQQR

SEQ ID NO: 2658007 - protein, 10 aa, Entamoeba histolytica
SQQRGPKCAR

SEQ ID NO: 2658008 - protein, 5 aa, Entamoeba histolytica
SQQRP

SEQ ID NO: 2658009 - protein, 15 aa, Entamoeba histolytica
SQQRQTVNVEPTEEN

SEQ ID NO: 2658010 - protein, 7 aa, Entamoeba histolytica
SQQRSPK

SEQ ID NO: 2658011 - protein, 4 aa, Entamoeba histolytica
SQQS

SEQ ID NO: 2658012 - protein, 6 aa, Entamoeba histolytica
SQQSNG

SEQ ID NO: 2658013 - protein, 5 aa, Entamoeba histolytica
SQQSR

SEQ ID NO: 2658014 - protein, 6 aa, Entamoeba histolytica
SQQTLK

SEQ ID NO: 2658015 - protein, 6 aa, Entamoeba histolytica
SQQVEQ

SEQ ID NO: 2658016 - protein, 4 aa, Entamoeba histolytica
SQRA

SEQ ID NO: 2658017 - protein, 8 aa, Entamoeba histolytica
SQRDPEVN

SEQ ID NO: 2658018 - protein, 13 aa, Entamoeba histolytica
SQRENEKKVSEKK

SEQ ID NO: 2658019 - protein, 10 aa, Entamoeba histolytica
SQRGDVNGEY

SEQ ID NO: 2658020 - protein, 8 aa, Entamoeba histolytica
SQRGQKVD

SEQ ID NO: 2658021 - protein, 4 aa, Entamoeba histolytica
SQRI

SEQ ID NO: 2658022 - protein, 11 aa, Entamoeba histolytica
SQRKSTEKNPI

SEQ ID NO: 2658023 - protein, 6 aa, Entamoeba histolytica
SQRKYK

SEQ ID NO: 2658024 - protein, 6 aa, Entamoeba histolytica
SQRLAE

SEQ ID NO: 2658025 - protein, 8 aa, Entamoeba histolytica
SQRLNNPS

SEQ ID NO: 2658026 - protein, 7 aa, Entamoeba histolytica
SQRPDSK

SEQ ID NO: 2658027 - protein, 7 aa, Entamoeba histolytica
SQRPFNK

SEQ ID NO: 2658028 - protein, 7 aa, Entamoeba histolytica
SQRVGSS

SEQ ID NO: 2658029 - protein, 6 aa, Entamoeba histolytica
SQRYDE

SEQ ID NO: 2658030 - protein, 9 aa, Entamoeba histolytica
SQSAGKSSV

SEQ ID NO: 2658031 - protein, 8 aa, Entamoeba histolytica
SQSDDDLA

SEQ ID NO: 2658032 - protein, 5 aa, Entamoeba histolytica
SQSDT

SEQ ID NO: 2658033 - protein, 8 aa, Entamoeba histolytica
SQSDTQEQ

SEQ ID NO: 2658034 - protein, 15 aa, Entamoeba histolytica
SQSDYSYSTPQKYID

SEQ ID NO: 2658035 - protein, 4 aa, Entamoeba histolytica
SQSE

SEQ ID NO: 2658036 - protein, 8 aa, Entamoeba histolytica
SQSEESLK

SEQ ID NO: 2658037 - protein, 8 aa, Entamoeba histolytica
SQSEKQKD

SEQ ID NO: 2658038 - protein, 9 aa, Entamoeba histolytica
SQSEKRNGA

SEQ ID NO: 2658039 - protein, 5 aa, Entamoeba histolytica
SQSEM

SEQ ID NO: 2658040 - protein, 27 aa, Entamoeba histolytica
SQSFDSRNSRNRSRERSYSRSGSRDKN

SEQ ID NO: 2658041 - protein, 8 aa, Entamoeba histolytica
SQSGRQVN

SEQ ID NO: 2658042 - protein, 6 aa, Entamoeba histolytica
SQSKEE

SEQ ID NO: 2658043 - protein, 10 aa, Entamoeba histolytica
SQSLDEQNIG

SEQ ID NO: 2658044 - protein, 5 aa, Entamoeba histolytica
SQSME

SEQ ID NO: 2658045 - protein, 4 aa, Entamoeba histolytica
SQSN

SEQ ID NO: 2658046 - protein, 6 aa, Entamoeba histolytica
SQSNIQ

SEQ ID NO: 2658047 - protein, 11 aa, Entamoeba histolytica
SQSNPSKDKDN

SEQ ID NO: 2658048 - protein, 8 aa, Entamoeba histolytica
SQSNTEFE

SEQ ID NO: 2658049 - protein, 16 aa, Entamoeba histolytica
SQSNYTISRGLNLLKI

SEQ ID NO: 2658050 - protein, 5 aa, Entamoeba histolytica
SQSPI

SEQ ID NO: 2658051 - protein, 10 aa, Entamoeba histolytica
SQSPQEIQQE

SEQ ID NO: 2658052 - protein, 13 aa, Entamoeba histolytica
SQSQDSEIGDGTT

SEQ ID NO: 2658053 - protein, 6 aa, Entamoeba histolytica
SQSQGS

SEQ ID NO: 2658054 - protein, 27 aa, Entamoeba histolytica
SQSQNFSDISSTDEDSNRLPVFEQLSH

SEQ ID NO: 2658055 - protein, 5 aa, Entamoeba histolytica
SQSRG

SEQ ID NO: 2658056 - protein, 8 aa, Entamoeba histolytica
SQSSEPFQ

SEQ ID NO: 2658057 - protein, 9 aa, Entamoeba histolytica
SQSSGKSSV

SEQ ID NO: 2658058 - protein, 9 aa, Entamoeba histolytica
SQSSINKEC

SEQ ID NO: 2658059 - protein, 10 aa, Entamoeba histolytica
SQSSPERKKH

SEQ ID NO: 2658060 - protein, 14 aa, Entamoeba histolytica
SQSSTSRQSHLETQ

SEQ ID NO: 2658061 - protein, 5 aa, Entamoeba histolytica
SQSTI

SEQ ID NO: 2658062 - protein, 13 aa, Entamoeba histolytica
SQSTISTSSKLEQ

SEQ ID NO: 2658063 - protein, 39 aa, Entamoeba histolytica
SQSTKSSMSSSSTVSSNEKENQQQVETPVSQEPTPSPRP

SEQ ID NO: 2658064 - protein, 8 aa, Entamoeba histolytica
SQSTSESQ

SEQ ID NO: 2658065 - protein, 5 aa, Entamoeba histolytica
SQSTT

SEQ ID NO: 2658066 - protein, 15 aa, Entamoeba histolytica
SQSVESNDIYQANKT

SEQ ID NO: 2658067 - protein, 4 aa, Entamoeba histolytica
SQSY

SEQ ID NO: 2658068 - protein, 6 aa, Entamoeba histolytica
SQSYNE

SEQ ID NO: 2658069 - protein, 6 aa, Entamoeba histolytica
SQTDGW

SEQ ID NO: 2658070 - protein, 4 aa, Entamoeba histolytica
SQTE

SEQ ID NO: 2658071 - protein, 12 aa, Entamoeba histolytica
SQTGFERAEPSY

SEQ ID NO: 2658072 - protein, 10 aa, Entamoeba histolytica
SQTGKPLSKN

SEQ ID NO: 2658073 - protein, 11 aa, Entamoeba histolytica
SQTGSACKDIE

SEQ ID NO: 2658074 - protein, 7 aa, Entamoeba histolytica
SQTGVGV

SEQ ID NO: 2658075 - protein, 5 aa, Entamoeba histolytica
SQTIP

SEQ ID NO: 2658076 - protein, 8 aa, Entamoeba histolytica
SQTIREKG

SEQ ID NO: 2658077 - protein, 7 aa, Entamoeba histolytica
SQTIRNS

SEQ ID NO: 2658078 - protein, 5 aa, Entamoeba histolytica
SQTIS

SEQ ID NO: 2658079 - protein, 6 aa, Entamoeba histolytica
SQTIYG

SEQ ID NO: 2658080 - protein, 4 aa, Entamoeba histolytica
SQTK

SEQ ID NO: 2658081 - protein, 12 aa, Entamoeba histolytica
SQTKEDKWNTNV

SEQ ID NO: 2658082 - protein, 7 aa, Entamoeba histolytica
SQTKKQY

SEQ ID NO: 2658083 - protein, 23 aa, Entamoeba histolytica
SQTKKRYATVTEKRQLQQKIEHP

SEQ ID NO: 2658084 - protein, 7 aa, Entamoeba histolytica
SQTKRLE

SEQ ID NO: 2658085 - protein, 8 aa, Entamoeba histolytica
SQTLSSPN

SEQ ID NO: 2658086 - protein, 35 aa, Entamoeba histolytica
SQTNDNRVPSEPQHTQPQPNHAPSQPQLSPEDNAA

SEQ ID NO: 2658087 - protein, 7 aa, Entamoeba histolytica
SQTNHSD

SEQ ID NO: 2658088 - protein, 8 aa, Entamoeba histolytica
SQTPGRYN

SEQ ID NO: 2658089 - protein, 9 aa, Entamoeba histolytica
SQTPSLEPQ

SEQ ID NO: 2658090 - protein, 4 aa, Entamoeba histolytica
SQTQ

SEQ ID NO: 2658091 - protein, 7 aa, Entamoeba histolytica
SQTQNID

SEQ ID NO: 2658092 - protein, 17 aa, Entamoeba histolytica
SQTQQEQIKKDDNDEDE

SEQ ID NO: 2658093 - protein, 9 aa, Entamoeba histolytica
SQTQSSQMP

SEQ ID NO: 2658094 - protein, 13 aa, Entamoeba histolytica
SQTSDPVQRTRDS

SEQ ID NO: 2658095 - protein, 8 aa, Entamoeba histolytica
SQTSKEFT

SEQ ID NO: 2658096 - protein, 5 aa, Entamoeba histolytica
SQTSP

SEQ ID NO: 2658097 - protein, 6 aa, Entamoeba histolytica
SQTSTQ

SEQ ID NO: 2658098 - protein, 8 aa, Entamoeba histolytica
SQTTARKY

SEQ ID NO: 2658099 - protein, 28 aa, Entamoeba histolytica
SQTTECTEDSEDKIISSSRTNSQTDSNF

SEQ ID NO: 2658100 - protein, 11 aa, Entamoeba histolytica
SQTTSEQSYYD

SEQ ID NO: 2658101 - protein, 11 aa, Entamoeba histolytica
SQTVGRSLTQS

SEQ ID NO: 2658102 - protein, 17 aa, Entamoeba histolytica
SQVGRNVKKPEEGVEQV

SEQ ID NO: 2658103 - protein, 4 aa, Entamoeba histolytica
SQVN

SEQ ID NO: 2658104 - protein, 7 aa, Entamoeba histolytica
SQVNENT

SEQ ID NO: 2658105 - protein, 7 aa, Entamoeba histolytica
SQVNQNQ

SEQ ID NO: 2658106 - protein, 8 aa, Entamoeba histolytica
SQVNSKSS

SEQ ID NO: 2658107 - protein, 9 aa, Entamoeba histolytica
SQVPPDERK

SEQ ID NO: 2658108 - protein, 4 aa, Entamoeba histolytica
SQVQ

SEQ ID NO: 2658109 - protein, 6 aa, Entamoeba histolytica
SQVSKH

SEQ ID NO: 2658110 - protein, 10 aa, Entamoeba histolytica
SQVSPENEEE

SEQ ID NO: 2658111 - protein, 5 aa, Entamoeba histolytica
SQVTK

SEQ ID NO: 2658112 - protein, 6 aa, Entamoeba histolytica
SQWSSN

SEQ ID NO: 2658113 - protein, 5 aa, Entamoeba histolytica
SQYGA

SEQ ID NO: 2658114 - protein, 11 aa, Entamoeba histolytica
SQYKEGCTTDV

SEQ ID NO: 2658115 - protein, 4 aa, Entamoeba histolytica
SQYN

SEQ ID NO: 2658116 - protein, 13 aa, Entamoeba histolytica
SQYNSALKTYKTS

SEQ ID NO: 2658117 - protein, 7 aa, Entamoeba histolytica
SQYSSLS

SEQ ID NO: 2658118 - protein, 8 aa, Entamoeba histolytica
SQYYRETQ

SEQ ID NO: 2658119 - protein, 8 aa, Entamoeba histolytica
SRAEENQY

SEQ ID NO: 2658120 - protein, 8 aa, Entamoeba histolytica
SRAPSQDV

SEQ ID NO: 2658121 - protein, 21 aa, Entamoeba histolytica
SRAQTNSKNSKHHTKHGSEAI

SEQ ID NO: 2658122 - protein, 6 aa, Entamoeba histolytica
SRASRY

SEQ ID NO: 2658123 - protein, 7 aa, Entamoeba histolytica
SRASSII

SEQ ID NO: 2658124 - protein, 7 aa, Entamoeba histolytica
SRATDDN

SEQ ID NO: 2658125 - protein, 7 aa, Entamoeba histolytica
SRATGTL

SEQ ID NO: 2658126 - protein, 7 aa, Entamoeba histolytica
SRATRGA

SEQ ID NO: 2658127 - protein, 7 aa, Entamoeba histolytica
SRATVGP

SEQ ID NO: 2658128 - protein, 7 aa, Entamoeba histolytica
SRCGKTS

SEQ ID NO: 2658129 - protein, 4 aa, Entamoeba histolytica
SRCK

SEQ ID NO: 2658130 - protein, 6 aa, Entamoeba histolytica
SRCKQH

SEQ ID NO: 2658131 - protein, 10 aa, Entamoeba histolytica
SRDALSNYST

SEQ ID NO: 2658132 - protein, 14 aa, Entamoeba histolytica
SRDDKEVNDITTNK

SEQ ID NO: 2658133 - protein, 5 aa, Entamoeba histolytica
SRDEE

SEQ ID NO: 2658134 - protein, 12 aa, Entamoeba histolytica
SRDELSSGVPTR

SEQ ID NO: 2658135 - protein, 5 aa, Entamoeba histolytica
SRDGL

SEQ ID NO: 2658136 - protein, 11 aa, Entamoeba histolytica
SRDGRAKSNKI

SEQ ID NO: 2658137 - protein, 14 aa, Entamoeba histolytica
SRDIPYSRDRYDPH

SEQ ID NO: 2658138 - protein, 10 aa, Entamoeba histolytica
SRDKKSVYSV

SEQ ID NO: 2658139 - protein, 34 aa, Entamoeba histolytica
SRDPEKQIKHKESKTPKSSIINSSPTPRRSSSVS

SEQ ID NO: 2658140 - protein, 6 aa, Entamoeba histolytica
SRDPQN

SEQ ID NO: 2658141 - protein, 6 aa, Entamoeba histolytica
SRDPSL

SEQ ID NO: 2658142 - protein, 5 aa, Entamoeba histolytica
SRDSN

SEQ ID NO: 2658143 - protein, 7 aa, Entamoeba histolytica
SRDTYKN

SEQ ID NO: 2658144 - protein, 7 aa, Entamoeba histolytica
SRDYPPK

SEQ ID NO: 2658145 - protein, 17 aa, Entamoeba histolytica
SREDEKELIGEKPQKAR

SEQ ID NO: 2658146 - protein, 6 aa, Entamoeba histolytica
SREDKL

SEQ ID NO: 2658147 - protein, 5 aa, Entamoeba histolytica
SREED

SEQ ID NO: 2658148 - protein, 6 aa, Entamoeba histolytica
SREGTL

SEQ ID NO: 2658149 - protein, 9 aa, Entamoeba histolytica
SREKKEVDI

SEQ ID NO: 2658150 - protein, 6 aa, Entamoeba histolytica
SRENEK

SEQ ID NO: 2658151 - protein, 22 aa, Entamoeba histolytica
SRENKISSNDNETTNKKRKCLL

SEQ ID NO: 2658152 - protein, 12 aa, Entamoeba histolytica
SRENPKNERANI

SEQ ID NO: 2658153 - protein, 8 aa, Entamoeba histolytica
SRENSNKN

SEQ ID NO: 2658154 - protein, 9 aa, Entamoeba histolytica
SREQEEGIY

SEQ ID NO: 2658155 - protein, 13 aa, Entamoeba histolytica
SRERDSYDDDDSD

SEQ ID NO: 2658156 - protein, 9 aa, Entamoeba histolytica
SRERETEEV

SEQ ID NO: 2658157 - protein, 5 aa, Entamoeba histolytica
SRERL

SEQ ID NO: 2658158 - protein, 6 aa, Entamoeba histolytica
SRESAR

SEQ ID NO: 2658159 - protein, 5 aa, Entamoeba histolytica
SRESF

SEQ ID NO: 2658160 - protein, 6 aa, Entamoeba histolytica
SRESIQ

SEQ ID NO: 2658161 - protein, 8 aa, Entamoeba histolytica
SRESSTGS

SEQ ID NO: 2658162 - protein, 9 aa, Entamoeba histolytica
SRESVQSSI

SEQ ID NO: 2658163 - protein, 7 aa, Entamoeba histolytica
SRETRNF

SEQ ID NO: 2658164 - protein, 6 aa, Entamoeba histolytica
SREVNP

SEQ ID NO: 2658165 - protein, 8 aa, Entamoeba histolytica
SRFDEDNE

SEQ ID NO: 2658166 - protein, 4 aa, Entamoeba histolytica
SRFE

SEQ ID NO: 2658167 - protein, 6 aa, Entamoeba histolytica
SRGELP

SEQ ID NO: 2658168 - protein, 7 aa, Entamoeba histolytica
SRGIKTC

SEQ ID NO: 2658169 - protein, 8 aa, Entamoeba histolytica
SRGKSDAM

SEQ ID NO: 2658170 - protein, 11 aa, Entamoeba histolytica
SRGLEKKQRFT

SEQ ID NO: 2658171 - protein, 6 aa, Entamoeba histolytica
SRGLYE

SEQ ID NO: 2658172 - protein, 4 aa, Entamoeba histolytica
SRGN

SEQ ID NO: 2658173 - protein, 8 aa, Entamoeba histolytica
SRGNEKYM

SEQ ID NO: 2658174 - protein, 9 aa, Entamoeba histolytica
SRGQPNTNN

SEQ ID NO: 2658175 - protein, 6 aa, Entamoeba histolytica
SRGRAG

SEQ ID NO: 2658176 - protein, 5 aa, Entamoeba histolytica
SRGRW

SEQ ID NO: 2658177 - protein, 13 aa, Entamoeba histolytica
SRGTCKKTPGLSK

SEQ ID NO: 2658178 - protein, 6 aa, Entamoeba histolytica
SRGVKG

SEQ ID NO: 2658179 - protein, 7 aa, Entamoeba histolytica
SRGVKGE

SEQ ID NO: 2658180 - protein, 6 aa, Entamoeba histolytica
SRGWLD

SEQ ID NO: 2658181 - protein, 20 aa, Entamoeba histolytica
SRHDSKSRGSSKDREVDPEA

SEQ ID NO: 2658182 - protein, 16 aa, Entamoeba histolytica
SRIDDKPPESTMSNEE

SEQ ID NO: 2658183 - protein, 6 aa, Entamoeba histolytica
SRIDHK

SEQ ID NO: 2658184 - protein, 7 aa, Entamoeba histolytica
SRIEQYN

SEQ ID NO: 2658185 - protein, 6 aa, Entamoeba histolytica
SRIGSA

SEQ ID NO: 2658186 - protein, 7 aa, Entamoeba histolytica
SRIKKEP

SEQ ID NO: 2658187 - protein, 5 aa, Entamoeba histolytica
SRISG

SEQ ID NO: 2658188 - protein, 5 aa, Entamoeba histolytica
SRITP

SEQ ID NO: 2658189 - protein, 13 aa, Entamoeba histolytica
SRKDNNPANARLT

SEQ ID NO: 2658190 - protein, 6 aa, Entamoeba histolytica
SRKEID

SEQ ID NO: 2658191 - protein, 8 aa, Entamoeba histolytica
SRKEKTSK

SEQ ID NO: 2658192 - protein, 8 aa, Entamoeba histolytica
SRKENVVS

SEQ ID NO: 2658193 - protein, 10 aa, Entamoeba histolytica
SRKEVNSQTI

SEQ ID NO: 2658194 - protein, 8 aa, Entamoeba histolytica
SRKGISSN

SEQ ID NO: 2658195 - protein, 10 aa, Entamoeba histolytica
SRKGKKAGGF

SEQ ID NO: 2658196 - protein, 8 aa, Entamoeba histolytica
SRKKASER

SEQ ID NO: 2658197 - protein, 9 aa, Entamoeba histolytica
SRKKDDKSF

SEQ ID NO: 2658198 - protein, 5 aa, Entamoeba histolytica
SRKKR

SEQ ID NO: 2658199 - protein, 7 aa, Entamoeba histolytica
SRKNGTA

SEQ ID NO: 2658200 - protein, 5 aa, Entamoeba histolytica
SRKNL

SEQ ID NO: 2658201 - protein, 7 aa, Entamoeba histolytica
SRKNSDM

SEQ ID NO: 2658202 - protein, 8 aa, Entamoeba histolytica
SRKNTKGL

SEQ ID NO: 2658203 - protein, 6 aa, Entamoeba histolytica
SRKPDW

SEQ ID NO: 2658204 - protein, 18 aa, Entamoeba histolytica
SRKPKVEDKEEDKKPINV

SEQ ID NO: 2658205 - protein, 11 aa, Entamoeba histolytica
SRKPPSSKISD

SEQ ID NO: 2658206 - protein, 12 aa, Entamoeba histolytica
SRKQKSSFEIDP

SEQ ID NO: 2658207 - protein, 8 aa, Entamoeba histolytica
SRKQPKGV

SEQ ID NO: 2658208 - protein, 18 aa, Entamoeba histolytica
SRKRYKQTRLTRVGKEEV

SEQ ID NO: 2658209 - protein, 8 aa, Entamoeba histolytica
SRKSIEQI

SEQ ID NO: 2658210 - protein, 6 aa, Entamoeba histolytica
SRKSNF

SEQ ID NO: 2658211 - protein, 5 aa, Entamoeba histolytica
SRKTA

SEQ ID NO: 2658212 - protein, 6 aa, Entamoeba histolytica
SRKTVN

SEQ ID NO: 2658213 - protein, 9 aa, Entamoeba histolytica
SRKYYTNTR

SEQ ID NO: 2658214 - protein, 5 aa, Entamoeba histolytica
SRLEN

SEQ ID NO: 2658215 - protein, 4 aa, Entamoeba histolytica
SRLG

SEQ ID NO: 2658216 - protein, 4 aa, Entamoeba histolytica
SRLN

SEQ ID NO: 2658217 - protein, 6 aa, Entamoeba histolytica
SRLNDA

SEQ ID NO: 2658218 - protein, 10 aa, Entamoeba histolytica
SRLNDQQKID

SEQ ID NO: 2658219 - protein, 7 aa, Entamoeba histolytica
SRLNEGN

SEQ ID NO: 2658220 - protein, 7 aa, Entamoeba histolytica
SRLNEKS

SEQ ID NO: 2658221 - protein, 34 aa, Entamoeba histolytica
SRLPPTTIQPSLQPSLQSSIPRTIAPPAPSGSMS

SEQ ID NO: 2658222 - protein, 5 aa, Entamoeba histolytica
SRLSE

SEQ ID NO: 2658223 - protein, 5 aa, Entamoeba histolytica
SRLSN

SEQ ID NO: 2658224 - protein, 26 aa, Entamoeba histolytica
SRLSRSNSCSSKLTPRTRFANDNNAW

SEQ ID NO: 2658225 - protein, 18 aa, Entamoeba histolytica
SRLSTDSNNSEGSETSET

SEQ ID NO: 2658226 - protein, 6 aa, Entamoeba histolytica
SRNAER

SEQ ID NO: 2658227 - protein, 9 aa, Entamoeba histolytica
SRNEKGEID

SEQ ID NO: 2658228 - protein, 6 aa, Entamoeba histolytica
SRNEKR

SEQ ID NO: 2658229 - protein, 8 aa, Entamoeba histolytica
SRNENSRK

SEQ ID NO: 2658230 - protein, 4 aa, Entamoeba histolytica
SRNG

SEQ ID NO: 2658231 - protein, 7 aa, Entamoeba histolytica
SRNGNSE

SEQ ID NO: 2658232 - protein, 9 aa, Entamoeba histolytica
SRNGPSVSG

SEQ ID NO: 2658233 - protein, 10 aa, Entamoeba histolytica
SRNHQTDEHL

SEQ ID NO: 2658234 - protein, 9 aa, Entamoeba histolytica
SRNISSQQL

SEQ ID NO: 2658235 - protein, 12 aa, Entamoeba histolytica
SRNKKTACEQTE

SEQ ID NO: 2658236 - protein, 13 aa, Entamoeba histolytica
SRNKVKNGNSYER

SEQ ID NO: 2658237 - protein, 4 aa, Entamoeba histolytica
SRNL

SEQ ID NO: 2658238 - protein, 8 aa, Entamoeba histolytica
SRNNNEIA

SEQ ID NO: 2658239 - protein, 8 aa, Entamoeba histolytica
SRNQKGTR

SEQ ID NO: 2658240 - protein, 7 aa, Entamoeba histolytica
SRNSGSL

SEQ ID NO: 2658241 - protein, 7 aa, Entamoeba histolytica
SRNTKGS

SEQ ID NO: 2658242 - protein, 8 aa, Entamoeba histolytica
SRPKANAV

SEQ ID NO: 2658243 - protein, 16 aa, Entamoeba histolytica
SRPQDRKRRDHYRSSY

SEQ ID NO: 2658244 - protein, 4 aa, Entamoeba histolytica
SRPT

SEQ ID NO: 2658245 - protein, 12 aa, Entamoeba histolytica
SRPTMKQYNGDM

SEQ ID NO: 2658246 - protein, 11 aa, Entamoeba histolytica
SRPTTGQNSYV

SEQ ID NO: 2658247 - protein, 27 aa, Entamoeba histolytica
SRQLSPKLSPVQSPNHLKTPTLSPNSL

SEQ ID NO: 2658248 - protein, 6 aa, Entamoeba histolytica
SRQNSI

SEQ ID NO: 2658249 - protein, 12 aa, Entamoeba histolytica
SRQPNKQKQMDV

SEQ ID NO: 2658250 - protein, 4 aa, Entamoeba histolytica
SRQR

SEQ ID NO: 2658251 - protein, 8 aa, Entamoeba histolytica
SRQRATIT

SEQ ID NO: 2658252 - protein, 4 aa, Entamoeba histolytica
SRQS

SEQ ID NO: 2658253 - protein, 5 aa, Entamoeba histolytica
SRQSD

SEQ ID NO: 2658254 - protein, 10 aa, Entamoeba histolytica
SRQSTLTTQR

SEQ ID NO: 2658255 - protein, 4 aa, Entamoeba histolytica
SRQT

SEQ ID NO: 2658256 - protein, 6 aa, Entamoeba histolytica
SRQTDV

SEQ ID NO: 2658257 - protein, 5 aa, Entamoeba histolytica
SRQYP

SEQ ID NO: 2658258 - protein, 9 aa, Entamoeba histolytica
SRRDENTLE

SEQ ID NO: 2658259 - protein, 4 aa, Entamoeba histolytica
SRRE

SEQ ID NO: 2658260 - protein, 18 aa, Entamoeba histolytica
SRREKKIGYRGEVSYSDW

SEQ ID NO: 2658261 - protein, 6 aa, Entamoeba histolytica
SRRERI

SEQ ID NO: 2658262 - protein, 6 aa, Entamoeba histolytica
SRRKKV

SEQ ID NO: 2658263 - protein, 7 aa, Entamoeba histolytica
SRRNWSN

SEQ ID NO: 2658264 - protein, 17 aa, Entamoeba histolytica
SRRPTRSSKNRKPATKK

SEQ ID NO: 2658265 - protein, 4 aa, Entamoeba histolytica
SRRS

SEQ ID NO: 2658266 - protein, 48 aa, Entamoeba histolytica
SRRSETQSQTNELVSTPPHEKSGDEAKNEQKQSSSQTSESTEKETHKK

SEQ ID NO: 2658267 - protein, 9 aa, Entamoeba histolytica
SRRSISTQT

SEQ ID NO: 2658268 - protein, 31 aa, Entamoeba histolytica
SRRSNYTPQSTPSPHSDDTPTPVSSARIRGR

SEQ ID NO: 2658269 - protein, 5 aa, Entamoeba histolytica
SRSAE

SEQ ID NO: 2658270 - protein, 5 aa, Entamoeba histolytica
SRSAS

SEQ ID NO: 2658271 - protein, 5 aa, Entamoeba histolytica
SRSAT

SEQ ID NO: 2658272 - protein, 6 aa, Entamoeba histolytica
SRSATY

SEQ ID NO: 2658273 - protein, 13 aa, Entamoeba histolytica
SRSDVRKDEYIYI

SEQ ID NO: 2658274 - protein, 5 aa, Entamoeba histolytica
SRSFQ

SEQ ID NO: 2658275 - protein, 6 aa, Entamoeba histolytica
SRSFQR

SEQ ID NO: 2658276 - protein, 4 aa, Entamoeba histolytica
SRSI

SEQ ID NO: 2658277 - protein, 16 aa, Entamoeba histolytica
SRSIGSIHNDSKIPGV

SEQ ID NO: 2658278 - protein, 5 aa, Entamoeba histolytica
SRSKE

SEQ ID NO: 2658279 - protein, 16 aa, Entamoeba histolytica
SRSLGDKQYKGGRGAV

SEQ ID NO: 2658280 - protein, 4 aa, Entamoeba histolytica
SRSM

SEQ ID NO: 2658281 - protein, 11 aa, Entamoeba histolytica
SRSMKDGVADM

SEQ ID NO: 2658282 - protein, 4 aa, Entamoeba histolytica
SRSN

SEQ ID NO: 2658283 - protein, 13 aa, Entamoeba histolytica
SRSNDVDKINTSQ

SEQ ID NO: 2658284 - protein, 6 aa, Entamoeba histolytica
SRSPNY

SEQ ID NO: 2658285 - protein, 40 aa, Entamoeba histolytica
SRSPTSVPSQPTPNSQPTPNSQPTQPIFQPNEQNTFQQPQ

SEQ ID NO: 2658286 - protein, 7 aa, Entamoeba histolytica
SRSQPER

SEQ ID NO: 2658287 - protein, 9 aa, Entamoeba histolytica
SRSREEAEQ

SEQ ID NO: 2658288 - protein, 7 aa, Entamoeba histolytica
SRSSDVA

SEQ ID NO: 2658289 - protein, 5 aa, Entamoeba histolytica
SRSSF

SEQ ID NO: 2658290 - protein, 7 aa, Entamoeba histolytica
SRSSFES

SEQ ID NO: 2658291 - protein, 7 aa, Entamoeba histolytica
SRSSFGN

SEQ ID NO: 2658292 - protein, 10 aa, Entamoeba histolytica
SRSSQKEKVP

SEQ ID NO: 2658293 - protein, 13 aa, Entamoeba histolytica
SRSSTYKEEEGKV

SEQ ID NO: 2658294 - protein, 11 aa, Entamoeba histolytica
SRSTPESSTTY

SEQ ID NO: 2658295 - protein, 10 aa, Entamoeba histolytica
SRSYEKIKDN

SEQ ID NO: 2658296 - protein, 9 aa, Entamoeba histolytica
SRTDDPGWT

SEQ ID NO: 2658297 - protein, 5 aa, Entamoeba histolytica
SRTDK

SEQ ID NO: 2658298 - protein, 7 aa, Entamoeba histolytica
SRTELNQ

SEQ ID NO: 2658299 - protein, 6 aa, Entamoeba histolytica
SRTGAY

SEQ ID NO: 2658300 - protein, 5 aa, Entamoeba histolytica
SRTIS

SEQ ID NO: 2658301 - protein, 9 aa, Entamoeba histolytica
SRTKGATKT

SEQ ID NO: 2658302 - protein, 4 aa, Entamoeba histolytica
SRTM

SEQ ID NO: 2658303 - protein, 7 aa, Entamoeba histolytica
SRTNQSW

SEQ ID NO: 2658304 - protein, 6 aa, Entamoeba histolytica
SRTNQY

SEQ ID NO: 2658305 - protein, 6 aa, Entamoeba histolytica
SRTPDE

SEQ ID NO: 2658306 - protein, 7 aa, Entamoeba histolytica
SRTPEQL

SEQ ID NO: 2658307 - protein, 20 aa, Entamoeba histolytica
SRTPIDNPKPEQGDYEPDDK

SEQ ID NO: 2658308 - protein, 8 aa, Entamoeba histolytica
SRTPQAKG

SEQ ID NO: 2658309 - protein, 7 aa, Entamoeba histolytica
SRTPSEA

SEQ ID NO: 2658310 - protein, 46 aa, Entamoeba histolytica
SRTRSTDTCDDFKSNTNNLENKVPSRDSPSSTPRRARRGNEDDRMK

SEQ ID NO: 2658311 - protein, 17 aa, Entamoeba histolytica
SRTSDPQKSHNKTPLTL

SEQ ID NO: 2658312 - protein, 10 aa, Entamoeba histolytica
SRTSTKSGSV

SEQ ID NO: 2658313 - protein, 25 aa, Entamoeba histolytica
SRVADTSNWNEDEFNEQEKEIPIES

SEQ ID NO: 2658314 - protein, 22 aa, Entamoeba histolytica
SRVKEEKKQQKLAKEERKQKRS

SEQ ID NO: 2658315 - protein, 12 aa, Entamoeba histolytica
SRVKRQHSHRKT

SEQ ID NO: 2658316 - protein, 4 aa, Entamoeba histolytica
SRVN

SEQ ID NO: 2658317 - protein, 5 aa, Entamoeba histolytica
SRVPT

SEQ ID NO: 2658318 - protein, 16 aa, Entamoeba histolytica
SRVREMKKKKNQKGID

SEQ ID NO: 2658319 - protein, 7 aa, Entamoeba histolytica
SRVSGPW

SEQ ID NO: 2658320 - protein, 12 aa, Entamoeba histolytica
SRVSSEITTPKK

SEQ ID NO: 2658321 - protein, 6 aa, Entamoeba histolytica
SRYPDA

SEQ ID NO: 2658322 - protein, 8 aa, Entamoeba histolytica
SRYPENDY

SEQ ID NO: 2658323 - protein, 19 aa, Entamoeba histolytica
SRYPNYTNSGSIDAREKSN

SEQ ID NO: 2658324 - protein, 10 aa, Entamoeba histolytica
SSAAKSFGTR

SEQ ID NO: 2658325 - protein, 42 aa, Entamoeba histolytica; identical to SEQ ID NO: 2552059

SEQ ID NO: 2658326 - protein, 6 aa, Entamoeba histolytica
SSAASQ

SEQ ID NO: 2658327 - protein, 7 aa, Entamoeba histolytica
SSAATEQ

SEQ ID NO: 2658328 - protein, 4 aa, Entamoeba histolytica
SSAD

SEQ ID NO: 2658329 - protein, 30 aa, Entamoeba histolytica
SSADDYNEEMEEDYTDEEYKEENFPREQPP

SEQ ID NO: 2658330 - protein, 8 aa, Entamoeba histolytica
SSADEPHK

SEQ ID NO: 2658331 - protein, 14 aa, Entamoeba histolytica
SSAESCSAGRITSN

SEQ ID NO: 2658332 - protein, 19 aa, Entamoeba histolytica
SSAKDGSVSRKRAFTTRKD

SEQ ID NO: 2658333 - protein, 10 aa, Entamoeba histolytica
SSAKTGQNVE

SEQ ID NO: 2658334 - protein, 17 aa, Entamoeba histolytica
SSAKTRGKDQEVESKDQ

SEQ ID NO: 2658335 - protein, 74 aa, Entamoeba histolytica
SSAMSTPHTETNPFDDSSDDEPKGITTDSIKSSQSKNPFSESDSTGSDGGEETNNPFSSTNSNISTAKVDGVTK

SEQ ID NO: 2658336 - protein, 7 aa, Entamoeba histolytica
SSAMTPK

SEQ ID NO: 2658337 - protein, 8 aa, Entamoeba histolytica
SSANKCGV

SEQ ID NO: 2658338 - protein, 9 aa, Entamoeba histolytica
SSAPESSLS

SEQ ID NO: 2658339 - protein, 8 aa, Entamoeba histolytica
SSAPESTP

SEQ ID NO: 2658340 - protein, 8 aa, Entamoeba histolytica
SSAPPTPD

SEQ ID NO: 2658341 - protein, 9 aa, Entamoeba histolytica
SSAPVSGTY

SEQ ID NO: 2658342 - protein, 9 aa, Entamoeba histolytica
SSAQGLPAT

SEQ ID NO: 2658343 - protein, 8 aa, Entamoeba histolytica
SSAQKNNA

SEQ ID NO: 2658344 - protein, 14 aa, Entamoeba histolytica
SSAQPQETKQSDWR

SEQ ID NO: 2658345 - protein, 10 aa, Entamoeba histolytica
SSASVTEGVP

SEQ ID NO: 2658346 - protein, 8 aa, Entamoeba histolytica
SSASYRIG

SEQ ID NO: 2658347 - protein, 8 aa, Entamoeba histolytica
SSATEQQL

SEQ ID NO: 2658348 - protein, 4 aa, Entamoeba histolytica
SSAV

SEQ ID NO: 2658349 - protein, 9 aa, Entamoeba histolytica
SSCDSFEGI

SEQ ID NO: 2658350 - protein, 13 aa, Entamoeba histolytica
SSCGSRKEANELE

SEQ ID NO: 2658351 - protein, 10 aa, Entamoeba histolytica
SSCSRERSNA

SEQ ID NO: 2658352 - protein, 7 aa, Entamoeba histolytica
SSCTPST

SEQ ID NO: 2658353 - protein, 8 aa, Entamoeba histolytica
SSCTSSQV

SEQ ID NO: 2658354 - protein, 7 aa, Entamoeba histolytica
SSDAYKA

SEQ ID NO: 2658355 - protein, 6 aa, Entamoeba histolytica
SSDDRT

SEQ ID NO: 2658356 - protein, 16 aa, Entamoeba histolytica
SSDDSSDIHNNLDETS

SEQ ID NO: 2658357 - protein, 4 aa, Entamoeba histolytica
SSDE

SEQ ID NO: 2658358 - protein, 9 aa, Entamoeba histolytica
SSDEDKANR

SEQ ID NO: 2658359 - protein, 10 aa, Entamoeba histolytica
SSDEEEEEKN

SEQ ID NO: 2658360 - protein, 8 aa, Entamoeba histolytica
SSDEFENI

SEQ ID NO: 2658361 - protein, 5 aa, Entamoeba histolytica
SSDEH

SEQ ID NO: 2658362 - protein, 9 aa, Entamoeba histolytica
SSDEHGYSN

SEQ ID NO: 2658363 - protein, 6 aa, Entamoeba histolytica
SSDEIS

SEQ ID NO: 2658364 - protein, 8 aa, Entamoeba histolytica
SSDENPIE

SEQ ID NO: 2658365 - protein, 7 aa, Entamoeba histolytica
SSDESNE

SEQ ID NO: 2658366 - protein, 8 aa, Entamoeba histolytica
SSDETVEK

SEQ ID NO: 2658367 - protein, 4 aa, Entamoeba histolytica
SSDG

SEQ ID NO: 2658368 - protein, 7 aa, Entamoeba histolytica
SSDGEVN

SEQ ID NO: 2658369 - protein, 10 aa, Entamoeba histolytica
SSDGKEVGNS

SEQ ID NO: 2658370 - protein, 8 aa, Entamoeba histolytica
SSDGQSTC

SEQ ID NO: 2658371 - protein, 5 aa, Entamoeba histolytica
SSDHP

SEQ ID NO: 2658372 - protein, 15 aa, Entamoeba histolytica
SSDHWTNNTTGCKQF

SEQ ID NO: 2658373 - protein, 6 aa, Entamoeba histolytica
SSDITS

SEQ ID NO: 2658374 - protein, 12 aa, Entamoeba histolytica
SSDKERIEESGD

SEQ ID NO: 2658375 - protein, 14 aa, Entamoeba histolytica
SSDKQHNNKEEEKG

SEQ ID NO: 2658376 - protein, 6 aa, Entamoeba histolytica
SSDKRF

SEQ ID NO: 2658377 - protein, 6 aa, Entamoeba histolytica
SSDKTP

SEQ ID NO: 2658378 - protein, 6 aa, Entamoeba histolytica
SSDLDT

SEQ ID NO: 2658379 - protein, 10 aa, Entamoeba histolytica
SSDLQTKYSA

SEQ ID NO: 2658380 - protein, 9 aa, Entamoeba histolytica
SSDNFPREE

SEQ ID NO: 2658381 - protein, 8 aa, Entamoeba histolytica
SSDNKSIK

SEQ ID NO: 2658382 - protein, 7 aa, Entamoeba histolytica
SSDNSDI

SEQ ID NO: 2658383 - protein, 8 aa, Entamoeba histolytica
SSDNVEEY

SEQ ID NO: 2658384 - protein, 6 aa, Entamoeba histolytica
SSDPDL

SEQ ID NO: 2658385 - protein, 5 aa, Entamoeba histolytica
SSDPI

SEQ ID NO: 2658386 - protein, 6 aa, Entamoeba histolytica
SSDPLD

SEQ ID NO: 2658387 - protein, 13 aa, Entamoeba histolytica
SSDQSNEESQSIK

SEQ ID NO: 2658388 - protein, 6 aa, Entamoeba histolytica
SSDREI

SEQ ID NO: 2658389 - protein, 12 aa, Entamoeba histolytica
SSDSAESGARET

SEQ ID NO: 2658390 - protein, 37 aa, Entamoeba histolytica
SSDSEEVKPKLTRSKERKRKEEKELKKYKEQASSNKL

SEQ ID NO: 2658391 - protein, 10 aa, Entamoeba histolytica
SSDSENEYDF

SEQ ID NO: 2658392 - protein, 7 aa, Entamoeba histolytica
SSDSFDD

SEQ ID NO: 2658393 - protein, 8 aa, Entamoeba histolytica
SSDSQTLS

SEQ ID NO: 2658394 - protein, 10 aa, Entamoeba histolytica
SSDSSSEDNS

SEQ ID NO: 2658395 - protein, 29 aa, Entamoeba histolytica
SSDSSSNDISKSDTEIEEEIKNNKTKKEK

SEQ ID NO: 2658396 - protein, 11 aa, Entamoeba histolytica
SSDTKPQDSNA

SEQ ID NO: 2658397 - protein, 11 aa, Entamoeba histolytica
SSDTPSLDQTG

SEQ ID NO: 2658398 - protein, 4 aa, Entamoeba histolytica
SSDV

SEQ ID NO: 2658399 - protein, 5 aa, Entamoeba histolytica
SSDVG

SEQ ID NO: 2658400 - protein, 23 aa, Entamoeba histolytica
SSDVIDNKEHSKKSTGTSETKTC

SEQ ID NO: 2658401 - protein, 5 aa, Entamoeba histolytica
SSDVN

SEQ ID NO: 2658402 - protein, 19 aa, Entamoeba histolytica
SSDYEDEEHPKEESDKIRQ

SEQ ID NO: 2658403 - protein, 21 aa, Entamoeba histolytica
SSDYERPTDYPNFTGLRQFCH

SEQ ID NO: 2658404 - protein, 9 aa, Entamoeba histolytica
SSDYKGPVN

SEQ ID NO: 2658405 - protein, 6 aa, Entamoeba histolytica
SSEAAV

SEQ ID NO: 2658406 - protein, 6 aa, Entamoeba histolytica
SSEDEC

SEQ ID NO: 2658407 - protein, 9 aa, Entamoeba histolytica
SSEDKGKDI

SEQ ID NO: 2658408 - protein, 6 aa, Entamoeba histolytica
SSEDPC

SEQ ID NO: 2658409 - protein, 11 aa, Entamoeba histolytica
SSEDRRKYGNK

SEQ ID NO: 2658410 - protein, 6 aa, Entamoeba histolytica
SSEDRV

SEQ ID NO: 2658411 - protein, 13 aa, Entamoeba histolytica
SSEEDFSKHHSSN

SEQ ID NO: 2658412 - protein, 7 aa, Entamoeba histolytica
SSEEGKI

SEQ ID NO: 2658413 - protein, 9 aa, Entamoeba histolytica
SSEEIKKEE

SEQ ID NO: 2658414 - protein, 8 aa, Entamoeba histolytica
SSEELKRK

SEQ ID NO: 2658415 - protein, 9 aa, Entamoeba histolytica
SSEEQQVSQ

SEQ ID NO: 2658416 - protein, 7 aa, Entamoeba histolytica
SSEEVCS

SEQ ID NO: 2658417 - protein, 8 aa, Entamoeba histolytica
SSEEVPKF

SEQ ID NO: 2658418 - protein, 7 aa, Entamoeba histolytica
SSEFFTS

SEQ ID NO: 2658419 - protein, 5 aa, Entamoeba histolytica
SSEFG

SEQ ID NO: 2658420 - protein, 5 aa, Entamoeba histolytica
SSEFP

SEQ ID NO: 2658421 - protein, 14 aa, Entamoeba histolytica
SSEGEESNETIVRT

SEQ ID NO: 2658422 - protein, 6 aa, Entamoeba histolytica
SSEGIE

SEQ ID NO: 2658423 - protein, 7 aa, Entamoeba histolytica
SSEGLNR

SEQ ID NO: 2658424 - protein, 5 aa, Entamoeba histolytica
SSEGN

SEQ ID NO: 2658425 - protein, 33 aa, Entamoeba histolytica
SSEHTKSSDETTNSYDATGPNALPTKKGYKEKE

SEQ ID NO: 2658426 - protein, 7 aa, Entamoeba histolytica
SSEIEQM

SEQ ID NO: 2658427 - protein, 5 aa, Entamoeba histolytica
SSEIR

SEQ ID NO: 2658428 - protein, 5 aa, Entamoeba histolytica
SSEIY

SEQ ID NO: 2658429 - protein, 7 aa, Entamoeba histolytica
SSEKEHE

SEQ ID NO: 2658430 - protein, 19 aa, Entamoeba histolytica
SSEKEQLPDNLEFPDIILN

SEQ ID NO: 2658431 - protein, 8 aa, Entamoeba histolytica
SSEKEVVE

SEQ ID NO: 2658432 - protein, 8 aa, Entamoeba histolytica
SSEKIDED

SEQ ID NO: 2658433 - protein, 9 aa, Entamoeba histolytica
SSEKNAEKV

SEQ ID NO: 2658434 - protein, 9 aa, Entamoeba histolytica
SSEKSSKEL

SEQ ID NO: 2658435 - protein, 9 aa, Entamoeba histolytica
SSELQQKDF

SEQ ID NO: 2658436 - protein, 7 aa, Entamoeba histolytica
SSELTNI

SEQ ID NO: 2658437 - protein, 5 aa, Entamoeba histolytica
SSEMG

SEQ ID NO: 2658438 - protein, 4 aa, Entamoeba histolytica
SSEN

SEQ ID NO: 2658439 - protein, 6 aa, Entamoeba histolytica
SSENDK

SEQ ID NO: 2658440 - protein, 8 aa, Entamoeba histolytica
SSENNKSS

SEQ ID NO: 2658441 - protein, 13 aa, Entamoeba histolytica
SSENPITSSATID

SEQ ID NO: 2658442 - protein, 7 aa, Entamoeba histolytica
SSEPIPK

SEQ ID NO: 2658443 - protein, 10 aa, Entamoeba histolytica
SSEPTNPSLS

SEQ ID NO: 2658444 - protein, 14 aa, Entamoeba histolytica
SSEQQSSSLFSLKT

SEQ ID NO: 2658445 - protein, 6 aa, Entamoeba histolytica
SSERIV

SEQ ID NO: 2658446 - protein, 12 aa, Entamoeba histolytica
SSERKDKEIEMD

SEQ ID NO: 2658447 - protein, 5 aa, Entamoeba histolytica
SSERT

SEQ ID NO: 2658448 - protein, 4 aa, Entamoeba histolytica
SSES

SEQ ID NO: 2658449 - protein, 9 aa, Entamoeba histolytica
SSESDDESC

SEQ ID NO: 2658450 - protein, 7 aa, Entamoeba histolytica
SSESEIL

SEQ ID NO: 2658451 - protein, 6 aa, Entamoeba histolytica
SSESFD

SEQ ID NO: 2658452 - protein, 32 aa, Entamoeba histolytica
SSESNDENNDNDKKEESTEDDESSEEDDGDEE

SEQ ID NO: 2658453 - protein, 10 aa, Entamoeba histolytica
SSESQEDNDR

SEQ ID NO: 2658454 - protein, 8 aa, Entamoeba histolytica
SSESSAIS

SEQ ID NO: 2658455 - protein, 11 aa, Entamoeba histolytica
SSETKIRKESQ

SEQ ID NO: 2658456 - protein, 11 aa, Entamoeba histolytica
SSETMARKTTV

SEQ ID NO: 2658457 - protein, 6 aa, Entamoeba histolytica
SSETNK

SEQ ID NO: 2658458 - protein, 6 aa, Entamoeba histolytica
SSETTY

SEQ ID NO: 2658459 - protein, 7 aa, Entamoeba histolytica
SSEVTAD

SEQ ID NO: 2658460 - protein, 8 aa, Entamoeba histolytica
SSEYKEKG

SEQ ID NO: 2658461 - protein, 8 aa, Entamoeba histolytica
SSEYLTEG

SEQ ID NO: 2658462 - protein, 5 aa, Entamoeba histolytica
SSFAD

SEQ ID NO: 2658463 - protein, 12 aa, Entamoeba histolytica
SSFDDKLTAKEQ

SEQ ID NO: 2658464 - protein, 34 aa, Entamoeba histolytica
SSFDETPEKPEDDATQSSQQTQKKGRTKKTRTNI

SEQ ID NO: 2658465 - protein, 19 aa, Entamoeba histolytica
SSFEGKDKDGGKNSYYKRE

SEQ ID NO: 2658466 - protein, 14 aa, Entamoeba histolytica
SSFGGKKRGGMPKG

SEQ ID NO: 2658467 - protein, 7 aa, Entamoeba histolytica
SSFKPTK

SEQ ID NO: 2658468 - protein, 8 aa, Entamoeba histolytica
SSFKSSFG

SEQ ID NO: 2658469 - protein, 4 aa, Entamoeba histolytica
SSFL

SEQ ID NO: 2658470 - protein, 5 aa, Entamoeba histolytica
SSFPE

SEQ ID NO: 2658471 - protein, 7 aa, Entamoeba histolytica
SSFPKDK

SEQ ID NO: 2658472 - protein, 5 aa, Entamoeba histolytica
SSFQE

SEQ ID NO: 2658473 - protein, 10 aa, Entamoeba histolytica
SSFRSPRSVR

SEQ ID NO: 2658474 - protein, 8 aa, Entamoeba histolytica
SSFSPSKI

SEQ ID NO: 2658475 - protein, 18 aa, Entamoeba histolytica
SSFSPVERPQQPVTQEEI

SEQ ID NO: 2658476 - protein, 4 aa, Entamoeba histolytica
SSFV

SEQ ID NO: 2658477 - protein, 5 aa, Entamoeba histolytica
SSGAY

SEQ ID NO: 2658478 - protein, 11 aa, Entamoeba histolytica
SSGCKRPKKDL

SEQ ID NO: 2658479 - protein, 4 aa, Entamoeba histolytica
SSGD

SEQ ID NO: 2658480 - protein, 23 aa, Entamoeba histolytica
SSGDSEIQYQEPIKKEPSFITNT

SEQ ID NO: 2658481 - protein, 10 aa, Entamoeba histolytica
SSGEVSAYSK

SEQ ID NO: 2658482 - protein, 6 aa, Entamoeba histolytica
SSGFED

SEQ ID NO: 2658483 - protein, 7 aa, Entamoeba histolytica
SSGFEES

SEQ ID NO: 2658484 - protein, 6 aa, Entamoeba histolytica
SSGFTP

SEQ ID NO: 2658485 - protein, 7 aa, Entamoeba histolytica
SSGIIND

SEQ ID NO: 2658486 - protein, 5 aa, Entamoeba histolytica
SSGIK

SEQ ID NO: 2658487 - protein, 9 aa, Entamoeba histolytica
SSGIKGNPI

SEQ ID NO: 2658488 - protein, 7 aa, Entamoeba histolytica
SSGKEET

SEQ ID NO: 2658489 - protein, 7 aa, Entamoeba histolytica
SSGKEYV

SEQ ID NO: 2658490 - protein, 8 aa, Entamoeba histolytica
SSGKTSSI

SEQ ID NO: 2658491 - protein, 6 aa, Entamoeba histolytica
SSGKYQ

SEQ ID NO: 2658492 - protein, 7 aa, Entamoeba histolytica
SSGLEQD

SEQ ID NO: 2658493 - protein, 11 aa, Entamoeba histolytica
SSGLNSKSQWT

SEQ ID NO: 2658494 - protein, 5 aa, Entamoeba histolytica
SSGMV

SEQ ID NO: 2658495 - protein, 7 aa, Entamoeba histolytica
SSGNEVM

SEQ ID NO: 2658496 - protein, 6 aa, Entamoeba histolytica
SSGNLD

SEQ ID NO: 2658497 - protein, 7 aa, Entamoeba histolytica
SSGNTQQ

SEQ ID NO: 2658498 - protein, 20 aa, Entamoeba histolytica
SSGPQQNTPIPERNVQGQPL

SEQ ID NO: 2658499 - protein, 7 aa, Entamoeba histolytica
SSGPVKT

SEQ ID NO: 2658500 - protein, 8 aa, Entamoeba histolytica
SSGRPPIN

SEQ ID NO: 2658501 - protein, 8 aa, Entamoeba histolytica
SSGRPPVN

SEQ ID NO: 2658502 - protein, 7 aa, Entamoeba histolytica
SSGRVES

SEQ ID NO: 2658503 - protein, 5 aa, Entamoeba histolytica
SSGSC

SEQ ID NO: 2658504 - protein, 8 aa, Entamoeba histolytica
SSGSFNDI

SEQ ID NO: 2658505 - protein, 5 aa, Entamoeba histolytica
SSGSV

SEQ ID NO: 2658506 - protein, 6 aa, Entamoeba histolytica
SSGSVD

SEQ ID NO: 2658507 - protein, 5 aa, Entamoeba histolytica
SSGSW

SEQ ID NO: 2658508 - protein, 8 aa, Entamoeba histolytica
SSGSYQSL

SEQ ID NO: 2658509 - protein, 6 aa, Entamoeba histolytica
SSGTTQ

SEQ ID NO: 2658510 - protein, 23 aa, Entamoeba histolytica
SSGVEGIGKSVNKEIEEMKEEAK

SEQ ID NO: 2658511 - protein, 4 aa, Entamoeba histolytica
SSGY

SEQ ID NO: 2658512 - protein, 7 aa, Entamoeba histolytica
SSHASTN

SEQ ID NO: 2658513 - protein, 7 aa, Entamoeba histolytica
SSHDKTI

SEQ ID NO: 2658514 - protein, 16 aa, Entamoeba histolytica
SSHEGITRINKNKKRV

SEQ ID NO: 2658515 - protein, 6 aa, Entamoeba histolytica
SSHEKY

SEQ ID NO: 2658516 - protein, 12 aa, Entamoeba histolytica
SSHFKNGKCKQY

SEQ ID NO: 2658517 - protein, 8 aa, Entamoeba histolytica
SSHHANES

SEQ ID NO: 2658518 - protein, 17 aa, Entamoeba histolytica
SSHPSQPFSSTNETSIN

SEQ ID NO: 2658519 - protein, 4 aa, Entamoeba histolytica
SSHQ

SEQ ID NO: 2658520 - protein, 15 aa, Entamoeba histolytica
SSHRGNSKKSQEEEM

SEQ ID NO: 2658521 - protein, 4 aa, Entamoeba histolytica
SSHS

SEQ ID NO: 2658522 - protein, 6 aa, Entamoeba histolytica
SSHSNQ

SEQ ID NO: 2658523 - protein, 5 aa, Entamoeba histolytica
SSHTN

SEQ ID NO: 2658524 - protein, 18 aa, Entamoeba histolytica
SSIAHSSRRLLSRRLLDL

SEQ ID NO: 2658525 - protein, 4 aa, Entamoeba histolytica
SSID

SEQ ID NO: 2658526 - protein, 6 aa, Entamoeba histolytica
SSIDIP

SEQ ID NO: 2658527 - protein, 11 aa, Entamoeba histolytica
SSIDSFQGNET

SEQ ID NO: 2658528 - protein, 7 aa, Entamoeba histolytica
SSIDTDY

SEQ ID NO: 2658529 - protein, 7 aa, Entamoeba histolytica
SSIEEQT

SEQ ID NO: 2658530 - protein, 16 aa, Entamoeba histolytica
SSIEISGKNLSEFPKQ

SEQ ID NO: 2658531 - protein, 10 aa, Entamoeba histolytica
SSIEKETSCN

SEQ ID NO: 2658532 - protein, 5 aa, Entamoeba histolytica
SSIEP

SEQ ID NO: 2658533 - protein, 7 aa, Entamoeba histolytica
SSIESGK

SEQ ID NO: 2658534 - protein, 9 aa, Entamoeba histolytica
SSIETTEED

SEQ ID NO: 2658535 - protein, 13 aa, Entamoeba histolytica
SSIGEKRMNGGRK

SEQ ID NO: 2658536 - protein, 11 aa, Entamoeba histolytica
SSIGSPSLESQ

SEQ ID NO: 2658537 - protein, 6 aa, Entamoeba histolytica
SSIKGS

SEQ ID NO: 2658538 - protein, 14 aa, Entamoeba histolytica
SSIKKDKINLNKPQ

SEQ ID NO: 2658539 - protein, 5 aa, Entamoeba histolytica
SSILK

SEQ ID NO: 2658540 - protein, 23 aa, Entamoeba histolytica
SSINDNSLPSGRRYRQSELTQQI

SEQ ID NO: 2658541 - protein, 12 aa, Entamoeba histolytica
SSINESGSGTFI

SEQ ID NO: 2658542 - protein, 7 aa, Entamoeba histolytica
SSINESQ

SEQ ID NO: 2658543 - protein, 6 aa, Entamoeba histolytica
SSINIP

SEQ ID NO: 2658544 - protein, 10 aa, Entamoeba histolytica
SSINNKYNTL

SEQ ID NO: 2658545 - protein, 9 aa, Entamoeba histolytica
SSINQQPIS

SEQ ID NO: 2658546 - protein, 7 aa, Entamoeba histolytica
SSINTSK

SEQ ID NO: 2658547 - protein, 12 aa, Entamoeba histolytica
SSIPDMKDEPLM

SEQ ID NO: 2658548 - protein, 8 aa, Entamoeba histolytica
SSIPEDTR

SEQ ID NO: 2658549 - protein, 16 aa, Entamoeba histolytica
SSIPPPEHSFISSYDN

SEQ ID NO: 2658550 - protein, 37 aa, Entamoeba histolytica
SSIPVKDTNFQKEEESHLKKPALPTSEETSHRNSQIK

SEQ ID NO: 2658551 - protein, 12 aa, Entamoeba histolytica
SSIPYDKSSTYR

SEQ ID NO: 2658552 - protein, 6 aa, Entamoeba histolytica
SSIQNN

SEQ ID NO: 2658553 - protein, 8 aa, Entamoeba histolytica
SSIQTEYD

SEQ ID NO: 2658554 - protein, 12 aa, Entamoeba histolytica
SSISGKKYDNGE

SEQ ID NO: 2658555 - protein, 13 aa, Entamoeba histolytica
SSISKEDRIAAKN

SEQ ID NO: 2658556 - protein, 7 aa, Entamoeba histolytica
SSISNAV

SEQ ID NO: 2658557 - protein, 7 aa, Entamoeba histolytica
SSISSAI

SEQ ID NO: 2658558 - protein, 11 aa, Entamoeba histolytica
SSISTHEKNCK

SEQ ID NO: 2658559 - protein, 9 aa, Entamoeba histolytica
SSITPSLNN

SEQ ID NO: 2658560 - protein, 8 aa, Entamoeba histolytica
SSITQESL

SEQ ID NO: 2658561 - protein, 11 aa, Entamoeba histolytica
SSITTESEKDS

SEQ ID NO: 2658562 - protein, 5 aa, Entamoeba histolytica
SSIYE

SEQ ID NO: 2658563 - protein, 6 aa, Entamoeba histolytica
SSIYTD

SEQ ID NO: 2658564 - protein, 6 aa, Entamoeba histolytica
SSKADH

SEQ ID NO: 2658565 - protein, 10 aa, Entamoeba histolytica
SSKAKEDEDR

SEQ ID NO: 2658566 - protein, 13 aa, Entamoeba histolytica
SSKCSREKKKDKF

SEQ ID NO: 2658567 - protein, 12 aa, Entamoeba histolytica
SSKCSVAVKKAN

SEQ ID NO: 2658568 - protein, 11 aa, Entamoeba histolytica
SSKDELGKATG

SEQ ID NO: 2658569 - protein, 10 aa, Entamoeba histolytica
SSKDGLSARS

SEQ ID NO: 2658570 - protein, 45 aa, Entamoeba histolytica
SSKDNSGASTPTQELNKTSVSPSEDKISTLSTSRSKAQSKRGTMT

SEQ ID NO: 2658571 - protein, 18 aa, Entamoeba histolytica
SSKDREEDNKQKPNTNSM

SEQ ID NO: 2658572 - protein, 9 aa, Entamoeba histolytica
SSKDRWTLP

SEQ ID NO: 2658573 - protein, 9 aa, Entamoeba histolytica
SSKDTLQRI

SEQ ID NO: 2658574 - protein, 15 aa, Entamoeba histolytica
SSKEENEKYSIRTNP

SEQ ID NO: 2658575 - protein, 5 aa, Entamoeba histolytica
SSKEF

SEQ ID NO: 2658576 - protein, 12 aa, Entamoeba histolytica
SSKEFEKKRDEV

SEQ ID NO: 2658577 - protein, 18 aa, Entamoeba histolytica
SSKEKKPRKKTPKKKNVR

SEQ ID NO: 2658578 - protein, 15 aa, Entamoeba histolytica
SSKEPLEKADKGGRV

SEQ ID NO: 2658579 - protein, 13 aa, Entamoeba histolytica
SSKESYNDMKPPI

SEQ ID NO: 2658580 - protein, 16 aa, Entamoeba histolytica
SSKFGKEKEEFYQPNG

SEQ ID NO: 2658581 - protein, 8 aa, Entamoeba histolytica
SSKGDKQI

SEQ ID NO: 2658582 - protein, 7 aa, Entamoeba histolytica
SSKGELG

SEQ ID NO: 2658583 - protein, 8 aa, Entamoeba histolytica
SSKGNKQE

SEQ ID NO: 2658584 - protein, 9 aa, Entamoeba histolytica
SSKGSSIAR

SEQ ID NO: 2658585 - protein, 6 aa, Entamoeba histolytica
SSKGYL

SEQ ID NO: 2658586 - protein, 6 aa, Entamoeba histolytica
SSKHGD

SEQ ID NO: 2658587 - protein, 5 aa, Entamoeba histolytica
SSKIS

SEQ ID NO: 2658588 - protein, 14 aa, Entamoeba histolytica
SSKISKSSKRKKLV

SEQ ID NO: 2658589 - protein, 20 aa, Entamoeba histolytica
SSKKESSAIDISTPATNIDD

SEQ ID NO: 2658590 - protein, 15 aa, Entamoeba histolytica
SSKKFDKTTRSPLEV

SEQ ID NO: 2658591 - protein, 10 aa, Entamoeba histolytica
SSKKKKKEVP

SEQ ID NO: 2658592 - protein, 17 aa, Entamoeba histolytica
SSKKQQLEEELKETQNI

SEQ ID NO: 2658593 - protein, 4 aa, Entamoeba histolytica
SSKL

SEQ ID NO: 2658594 - protein, 44 aa, Entamoeba histolytica
SSKLESQISELRKEKEEIQNQYNSYKETRDQEVNNLNKKNTTIM

SEQ ID NO: 2658595 - protein, 11 aa, Entamoeba histolytica
SSKLKESQRIN

SEQ ID NO: 2658596 - protein, 7 aa, Entamoeba histolytica
SSKMSHH

SEQ ID NO: 2658597 - protein, 9 aa, Entamoeba histolytica
SSKNAIGYS

SEQ ID NO: 2658598 - protein, 6 aa, Entamoeba histolytica
SSKNKQ

SEQ ID NO: 2658599 - protein, 14 aa, Entamoeba histolytica
SSKNMSLPQPDGPV

SEQ ID NO: 2658600 - protein, 26 aa, Entamoeba histolytica
SSKNPRGYKDEDKKSKETKETKRANA

SEQ ID NO: 2658601 - protein, 9 aa, Entamoeba histolytica
SSKNYSNID

SEQ ID NO: 2658602 - protein, 8 aa, Entamoeba histolytica
SSKPEECQ

SEQ ID NO: 2658603 - protein, 6 aa, Entamoeba histolytica
SSKPIL

SEQ ID NO: 2658604 - protein, 11 aa, Entamoeba histolytica
SSKPQQRRSIN

SEQ ID NO: 2658605 - protein, 9 aa, Entamoeba histolytica
SSKPSDSSL

SEQ ID NO: 2658606 - protein, 6 aa, Entamoeba histolytica
SSKQDF

SEQ ID NO: 2658607 - protein, 14 aa, Entamoeba histolytica
SSKQFNEAETSFTQ

SEQ ID NO: 2658608 - protein, 7 aa, Entamoeba histolytica
SSKQSNA

SEQ ID NO: 2658609 - protein, 5 aa, Entamoeba histolytica
SSKQT

SEQ ID NO: 2658610 - protein, 7 aa, Entamoeba histolytica
SSKRKGI

SEQ ID NO: 2658611 - protein, 5 aa, Entamoeba histolytica
SSKSA

SEQ ID NO: 2658612 - protein, 8 aa, Entamoeba histolytica
SSKSEDKD

SEQ ID NO: 2658613 - protein, 8 aa, Entamoeba histolytica
SSKSGYNV

SEQ ID NO: 2658614 - protein, 6 aa, Entamoeba histolytica
SSKSIT

SEQ ID NO: 2658615 - protein, 5 aa, Entamoeba histolytica
SSKSP

SEQ ID NO: 2658616 - protein, 10 aa, Entamoeba histolytica
SSKTGDGISK

SEQ ID NO: 2658617 - protein, 9 aa, Entamoeba histolytica
SSKTGDNVN

SEQ ID NO: 2658618 - protein, 9 aa, Entamoeba histolytica
SSKTGEGVD

SEQ ID NO: 2658619 - protein, 10 aa, Entamoeba histolytica
SSKTGEGVKE

SEQ ID NO: 2658620 - protein, 12 aa, Entamoeba histolytica
SSKTGGNTTYNT

SEQ ID NO: 2658621 - protein, 14 aa, Entamoeba histolytica
SSKTGKTVGGSSGR

SEQ ID NO: 2658622 - protein, 6 aa, Entamoeba histolytica
SSKTMQ

SEQ ID NO: 2658623 - protein, 6 aa, Entamoeba histolytica
SSKTNA

SEQ ID NO: 2658624 - protein, 19 aa, Entamoeba histolytica
SSKTPDGKPLELEPGLSTY

SEQ ID NO: 2658625 - protein, 10 aa, Entamoeba histolytica
SSKTQIESKT

SEQ ID NO: 2658626 - protein, 8 aa, Entamoeba histolytica
SSKTRSSN

SEQ ID NO: 2658627 - protein, 5 aa, Entamoeba histolytica
SSKTS

SEQ ID NO: 2658628 - protein, 12 aa, Entamoeba histolytica
SSKVQKDERIGQ

SEQ ID NO: 2658629 - protein, 12 aa, Entamoeba histolytica
SSKYEVEVKINH

SEQ ID NO: 2658630 - protein, 16 aa, Entamoeba histolytica
SSKYSNNKLKETTQRL

SEQ ID NO: 2658631 - protein, 4 aa, Entamoeba histolytica
SSLD

SEQ ID NO: 2658632 - protein, 19 aa, Entamoeba histolytica
SSLDEKNKDVDPPKQQELS

SEQ ID NO: 2658633 - protein, 5 aa, Entamoeba histolytica
SSLDG

SEQ ID NO: 2658634 - protein, 22 aa, Entamoeba histolytica
SSLDPKKHSPPSLDLPLEKKKL

SEQ ID NO: 2658635 - protein, 4 aa, Entamoeba histolytica
SSLE

SEQ ID NO: 2658636 - protein, 8 aa, Entamoeba histolytica
SSLEDQNE

SEQ ID NO: 2658637 - protein, 8 aa, Entamoeba histolytica
SSLEGLTT

SEQ ID NO: 2658638 - protein, 22 aa, Entamoeba histolytica
SSLEKSDDLLQQKEQEINENND

SEQ ID NO: 2658639 - protein, 6 aa, Entamoeba histolytica
SSLEST

SEQ ID NO: 2658640 - protein, 87 aa, Entamoeba histolytica
SSLGQTEEEKKEERQTQQEKEKESNDITHKPEHTEKKEQNPFDSSSSESDDISTEKEENKTLESSESSQEEDKLHSTSSENTDESSE

SEQ ID NO: 2658641 - protein, 8 aa, Entamoeba histolytica
SSLKDQID

SEQ ID NO: 2658642 - protein, 13 aa, Entamoeba histolytica
SSLKGEDGKELNP

SEQ ID NO: 2658643 - protein, 8 aa, Entamoeba histolytica
SSLKGNGI

SEQ ID NO: 2658644 - protein, 22 aa, Entamoeba histolytica
SSLKKRTKREIPQDKKIKPNKR

SEQ ID NO: 2658645 - protein, 9 aa, Entamoeba histolytica
SSLLETGTT

SEQ ID NO: 2658646 - protein, 4 aa, Entamoeba histolytica
SSLN

SEQ ID NO: 2658647 - protein, 12 aa, Entamoeba histolytica
SSLNEQDKQEME

SEQ ID NO: 2658648 - protein, 5 aa, Entamoeba histolytica
SSLNP

SEQ ID NO: 2658649 - protein, 9 aa, Entamoeba histolytica
SSLPAQGSD

SEQ ID NO: 2658650 - protein, 7 aa, Entamoeba histolytica
SSLPKDY

SEQ ID NO: 2658651 - protein, 6 aa, Entamoeba histolytica
SSLPNV

SEQ ID NO: 2658652 - protein, 27 aa, Entamoeba histolytica
SSLPPSTDPAYKETLHPTTSPSVSTSV

SEQ ID NO: 2658653 - protein, 10 aa, Entamoeba histolytica
SSLPSEVSVE

SEQ ID NO: 2658654 - protein, 17 aa, Entamoeba histolytica
SSLPSFQESSTDSQDKK

SEQ ID NO: 2658655 - protein, 14 aa, Entamoeba histolytica
SSLQFSSSQTTVTK

SEQ ID NO: 2658656 - protein, 4 aa, Entamoeba histolytica
SSLS

SEQ ID NO: 2658657 - protein, 9 aa, Entamoeba histolytica
SSLSATPAI

SEQ ID NO: 2658658 - protein, 7 aa, Entamoeba histolytica
SSLSEES

SEQ ID NO: 2658659 - protein, 5 aa, Entamoeba histolytica
SSLSG

SEQ ID NO: 2658660 - protein, 10 aa, Entamoeba histolytica
SSLSINPETT

SEQ ID NO: 2658661 - protein, 8 aa, Entamoeba histolytica
SSLSPRSS

SEQ ID NO: 2658662 - protein, 9 aa, Entamoeba histolytica
SSLSPSTQR

SEQ ID NO: 2658663 - protein, 14 aa, Entamoeba histolytica
SSLSQKKTDQTNQL

SEQ ID NO: 2658664 - protein, 9 aa, Entamoeba histolytica
SSLSQLSQT

SEQ ID NO: 2658665 - protein, 12 aa, Entamoeba histolytica
SSLSQSQEPLPL

SEQ ID NO: 2658666 - protein, 12 aa, Entamoeba histolytica
SSLSTPNSCNSP

SEQ ID NO: 2658667 - protein, 9 aa, Entamoeba histolytica
SSLSTTSPL

SEQ ID NO: 2658668 - protein, 12 aa, Entamoeba histolytica
SSLTDDEGQPFK

SEQ ID NO: 2658669 - protein, 7 aa, Entamoeba histolytica
SSLTESI

SEQ ID NO: 2658670 - protein, 9 aa, Entamoeba histolytica
SSLTKEENE

SEQ ID NO: 2658671 - protein, 15 aa, Entamoeba histolytica
SSLTNTQNVTPQEVK

SEQ ID NO: 2658672 - protein, 5 aa, Entamoeba histolytica
SSLTP

SEQ ID NO: 2658673 - protein, 4 aa, Entamoeba histolytica
SSME

SEQ ID NO: 2658674 - protein, 8 aa, Entamoeba histolytica
SSMKKDYG

SEQ ID NO: 2658675 - protein, 4 aa, Entamoeba histolytica
SSMN

SEQ ID NO: 2658676 - protein, 16 aa, Entamoeba histolytica
SSMNGSEKKNGAEVSR

SEQ ID NO: 2658677 - protein, 6 aa, Entamoeba histolytica
SSMSQK

SEQ ID NO: 2658678 - protein, 16 aa, Entamoeba histolytica
SSMTSQMQRQAEEVTH

SEQ ID NO: 2658679 - protein, 4 aa, Entamoeba histolytica
SSNA

SEQ ID NO: 2658680 - protein, 7 aa, Entamoeba histolytica
SSNAKDI

SEQ ID NO: 2658681 - protein, 5 aa, Entamoeba histolytica
SSNCI

SEQ ID NO: 2658682 - protein, 6 aa, Entamoeba histolytica
SSNCRE

SEQ ID NO: 2658683 - protein, 6 aa, Entamoeba histolytica
SSNDAD

SEQ ID NO: 2658684 - protein, 7 aa, Entamoeba histolytica
SSNDETV

SEQ ID NO: 2658685 - protein, 6 aa, Entamoeba histolytica
SSNDFP

SEQ ID NO: 2658686 - protein, 6 aa, Entamoeba histolytica
SSNDIN

SEQ ID NO: 2658687 - protein, 18 aa, Entamoeba histolytica
SSNDPNAQKVLAQCEKLL

SEQ ID NO: 2658688 - protein, 4 aa, Entamoeba histolytica
SSNE

SEQ ID NO: 2658689 - protein, 14 aa, Entamoeba histolytica
SSNEFSSQSSNNFP

SEQ ID NO: 2658690 - protein, 5 aa, Entamoeba histolytica
SSNEI

SEQ ID NO: 2658691 - protein, 7 aa, Entamoeba histolytica
SSNEKYT

SEQ ID NO: 2658692 - protein, 9 aa, Entamoeba histolytica
SSNENKDLN

SEQ ID NO: 2658693 - protein, 6 aa, Entamoeba histolytica
SSNENY

SEQ ID NO: 2658694 - protein, 5 aa, Entamoeba histolytica
SSNEP

SEQ ID NO: 2658695 - protein, 6 aa, Entamoeba histolytica
SSNESI

SEQ ID NO: 2658696 - protein, 7 aa, Entamoeba histolytica
SSNETKL

SEQ ID NO: 2658697 - protein, 6 aa, Entamoeba histolytica
SSNEVA

SEQ ID NO: 2658698 - protein, 7 aa, Entamoeba histolytica
SSNEYNT

SEQ ID NO: 2658699 - protein, 4 aa, Entamoeba histolytica
SSNF

SEQ ID NO: 2658700 - protein, 4 aa, Entamoeba histolytica
SSNG

SEQ ID NO: 2658701 - protein, 5 aa, Entamoeba histolytica
SSNGF

SEQ ID NO: 2658702 - protein, 7 aa, Entamoeba histolytica
SSNGFEG

SEQ ID NO: 2658703 - protein, 10 aa, Entamoeba histolytica
SSNGGKELAD

SEQ ID NO: 2658704 - protein, 5 aa, Entamoeba histolytica
SSNGQ

SEQ ID NO: 2658705 - protein, 7 aa, Entamoeba histolytica
SSNGSID

SEQ ID NO: 2658706 - protein, 8 aa, Entamoeba histolytica
SSNGSYTL

SEQ ID NO: 2658707 - protein, 6 aa, Entamoeba histolytica
SSNGTW

SEQ ID NO: 2658708 - protein, 20 aa, Entamoeba histolytica
SSNGWNEEKTKKEKKPRNNQ

SEQ ID NO: 2658709 - protein, 5 aa, Entamoeba histolytica
SSNHF

SEQ ID NO: 2658710 - protein, 4 aa, Entamoeba histolytica
SSNI

SEQ ID NO: 2658711 - protein, 8 aa, Entamoeba histolytica
SSNIAATT

SEQ ID NO: 2658712 - protein, 5 aa, Entamoeba histolytica
SSNIN

SEQ ID NO: 2658713 - protein, 16 aa, Entamoeba histolytica
SSNIPKGESDDGKDYI

SEQ ID NO: 2658714 - protein, 18 aa, Entamoeba histolytica
SSNISGAAWGKPTNSSLE

SEQ ID NO: 2658715 - protein, 9 aa, Entamoeba histolytica
SSNITKEDI

SEQ ID NO: 2658716 - protein, 4 aa, Entamoeba histolytica
SSNK

SEQ ID NO: 2658717 - protein, 8 aa, Entamoeba histolytica
SSNKDQVI

SEQ ID NO: 2658718 - protein, 7 aa, Entamoeba histolytica
SSNKEYT

SEQ ID NO: 2658719 - protein, 11 aa, Entamoeba histolytica
SSNKMEKGKAM

SEQ ID NO: 2658720 - protein, 9 aa, Entamoeba histolytica
SSNKRPEYI

SEQ ID NO: 2658721 - protein, 9 aa, Entamoeba histolytica
SSNKSPPYL

SEQ ID NO: 2658722 - protein, 4 aa, Entamoeba histolytica
SSNL

SEQ ID NO: 2658723 - protein, 5 aa, Entamoeba histolytica
SSNLK

SEQ ID NO: 2658724 - protein, 8 aa, Entamoeba histolytica
SSNLNSAP

SEQ ID NO: 2658725 - protein, 6 aa, Entamoeba histolytica
SSNLPR

SEQ ID NO: 2658726 - protein, 10 aa, Entamoeba histolytica
SSNNESAYDM

SEQ ID NO: 2658727 - protein, 7 aa, Entamoeba histolytica
SSNNKSY

SEQ ID NO: 2658728 - protein, 35 aa, Entamoeba histolytica
SSNNPFSENSSDNSEQQPTTVSQTNPFSDDVSDEA

SEQ ID NO: 2658729 - protein, 10 aa, Entamoeba histolytica
SSNNQEPKEV

SEQ ID NO: 2658730 - protein, 10 aa, Entamoeba histolytica
SSNNQEPKKV

SEQ ID NO: 2658731 - protein, 5 aa, Entamoeba histolytica
SSNNS

SEQ ID NO: 2658732 - protein, 7 aa, Entamoeba histolytica
SSNNSCS

SEQ ID NO: 2658733 - protein, 6 aa, Entamoeba histolytica
SSNNYN

SEQ ID NO: 2658734 - protein, 5 aa, Entamoeba histolytica
SSNPE

SEQ ID NO: 2658735 - protein, 12 aa, Entamoeba histolytica
SSNPKTLKETGY

SEQ ID NO: 2658736 - protein, 6 aa, Entamoeba histolytica
SSNPRI

SEQ ID NO: 2658737 - protein, 15 aa, Entamoeba histolytica
SSNPSNRAGSKSYMA

SEQ ID NO: 2658738 - protein, 6 aa, Entamoeba histolytica
SSNQKF

SEQ ID NO: 2658739 - protein, 6 aa, Entamoeba histolytica
SSNQLK

SEQ ID NO: 2658740 - protein, 10 aa, Entamoeba histolytica
SSNQMDSKGI

SEQ ID NO: 2658741 - protein, 21 aa, Entamoeba histolytica
SSNQSQELSSQESKSSSEEFG

SEQ ID NO: 2658742 - protein, 6 aa, Entamoeba histolytica
SSNRLE

SEQ ID NO: 2658743 - protein, 12 aa, Entamoeba histolytica
SSNRQNSEDEDL

SEQ ID NO: 2658744 - protein, 6 aa, Entamoeba histolytica
SSNRST

SEQ ID NO: 2658745 - protein, 4 aa, Entamoeba histolytica
SSNS

SEQ ID NO: 2658746 - protein, 8 aa, Entamoeba histolytica
SSNSEIPK

SEQ ID NO: 2658747 - protein, 5 aa, Entamoeba histolytica
SSNSF

SEQ ID NO: 2658748 - protein, 9 aa, Entamoeba histolytica
SSNSPLSNS

SEQ ID NO: 2658749 - protein, 9 aa, Entamoeba histolytica
SSNSPTSKI

SEQ ID NO: 2658750 - protein, 5 aa, Entamoeba histolytica
SSNSW

SEQ ID NO: 2658751 - protein, 4 aa, Entamoeba histolytica
SSNT

SEQ ID NO: 2658752 - protein, 12 aa, Entamoeba histolytica
SSNTISSSQHKP

SEQ ID NO: 2658753 - protein, 6 aa, Entamoeba histolytica
SSNTNT

SEQ ID NO: 2658754 - protein, 7 aa, Entamoeba histolytica
SSNTPYL

SEQ ID NO: 2658755 - protein, 6 aa, Entamoeba histolytica
SSNTQM

SEQ ID NO: 2658756 - protein, 5 aa, Entamoeba histolytica
SSNVF

SEQ ID NO: 2658757 - protein, 7 aa, Entamoeba histolytica
SSNVGKT

SEQ ID NO: 2658758 - protein, 8 aa, Entamoeba histolytica
SSNYKATV

SEQ ID NO: 2658759 - protein, 9 aa, Entamoeba histolytica
SSNYKDANL

SEQ ID NO: 2658760 - protein, 20 aa, Entamoeba histolytica
SSNYKDDDKKVTGGRNGYGA

SEQ ID NO: 2658761 - protein, 10 aa, Entamoeba histolytica
SSNYKSTTDP

SEQ ID NO: 2658762 - protein, 19 aa, Entamoeba histolytica
SSNYNRAVNGINDDQLGRS

SEQ ID NO: 2658763 - protein, 4 aa, Entamoeba histolytica
SSPA

SEQ ID NO: 2658764 - protein, 9 aa, Entamoeba histolytica
SSPASPGLE

SEQ ID NO: 2658765 - protein, 5 aa, Entamoeba histolytica
SSPDI

SEQ ID NO: 2658766 - protein, 23 aa, Entamoeba histolytica
SSPDLTSSYNSLTKSTQLSVNTK

SEQ ID NO: 2658767 - protein, 8 aa, Entamoeba histolytica
SSPDPMTH

SEQ ID NO: 2658768 - protein, 8 aa, Entamoeba histolytica
SSPDTIQG

SEQ ID NO: 2658769 - protein, 8 aa, Entamoeba histolytica
SSPEDKEK

SEQ ID NO: 2658770 - protein, 6 aa, Entamoeba histolytica
SSPEEM

SEQ ID NO: 2658771 - protein, 8 aa, Entamoeba histolytica
SSPENSRN

SEQ ID NO: 2658772 - protein, 5 aa, Entamoeba histolytica
SSPFK

SEQ ID NO: 2658773 - protein, 7 aa, Entamoeba histolytica
SSPFQGK

SEQ ID NO: 2658774 - protein, 18 aa, Entamoeba histolytica
SSPFSSVSSSSVSSSQIL

SEQ ID NO: 2658775 - protein, 7 aa, Entamoeba histolytica
SSPGYTS

SEQ ID NO: 2658776 - protein, 4 aa, Entamoeba histolytica
SSPI

SEQ ID NO: 2658777 - protein, 5 aa, Entamoeba histolytica
SSPIE

SEQ ID NO: 2658778 - protein, 5 aa, Entamoeba histolytica
SSPIK

SEQ ID NO: 2658779 - protein, 10 aa, Entamoeba histolytica
SSPISSSKTA

SEQ ID NO: 2658780 - protein, 4 aa, Entamoeba histolytica
SSPK

SEQ ID NO: 2658781 - protein, 6 aa, Entamoeba histolytica
SSPKHF

SEQ ID NO: 2658782 - protein, 15 aa, Entamoeba histolytica
SSPKMRDLPTTEEIT

SEQ ID NO: 2658783 - protein, 9 aa, Entamoeba histolytica
SSPKQTKEI

SEQ ID NO: 2658784 - protein, 6 aa, Entamoeba histolytica
SSPLLQ

SEQ ID NO: 2658785 - protein, 9 aa, Entamoeba histolytica
SSPLYAGRN

SEQ ID NO: 2658786 - protein, 4 aa, Entamoeba histolytica
SSPM

SEQ ID NO: 2658787 - protein, 13 aa, Entamoeba histolytica
SSPNDDETAPKTA

SEQ ID NO: 2658788 - protein, 12 aa, Entamoeba histolytica
SSPNESEEEEMI

SEQ ID NO: 2658789 - protein, 7 aa, Entamoeba histolytica
SSPNGIE

SEQ ID NO: 2658790 - protein, 7 aa, Entamoeba histolytica
SSPNNTC

SEQ ID NO: 2658791 - protein, 6 aa, Entamoeba histolytica
SSPNRM

SEQ ID NO: 2658792 - protein, 16 aa, Entamoeba histolytica
SSPNSPYLKSSPKKTS

SEQ ID NO: 2658793 - protein, 5 aa, Entamoeba histolytica
SSPRS

SEQ ID NO: 2658794 - protein, 9 aa, Entamoeba histolytica
SSPSLPSSL

SEQ ID NO: 2658795 - protein, 9 aa, Entamoeba histolytica
SSPSPREKD

SEQ ID NO: 2658796 - protein, 20 aa, Entamoeba histolytica
SSPSTQNKSSTQNALDILLF

SEQ ID NO: 2658797 - protein, 6 aa, Entamoeba histolytica
SSPSVV

SEQ ID NO: 2658798 - protein, 17 aa, Entamoeba histolytica
SSPSYQSNHGPLDQQSL

SEQ ID NO: 2658799 - protein, 6 aa, Entamoeba histolytica
SSPTLE

SEQ ID NO: 2658800 - protein, 5 aa, Entamoeba histolytica
SSPTQ

SEQ ID NO: 2658801 - protein, 9 aa, Entamoeba histolytica
SSPTSRPVT

SEQ ID NO: 2658802 - protein, 17 aa, Entamoeba histolytica
SSPVEGKRKTQKPRQLH

SEQ ID NO: 2658803 - protein, 14 aa, Entamoeba histolytica
SSPVLGKRKEMTGI

SEQ ID NO: 2658804 - protein, 4 aa, Entamoeba histolytica
SSPY

SEQ ID NO: 2658805 - protein, 5 aa, Entamoeba histolytica
SSPYR

SEQ ID NO: 2658806 - protein, 6 aa, Entamoeba histolytica
SSQAEE

SEQ ID NO: 2658807 - protein, 11 aa, Entamoeba histolytica
SSQANRSSGIG

SEQ ID NO: 2658808 - protein, 15 aa, Entamoeba histolytica
SSQCPQGFSTSKRER

SEQ ID NO: 2658809 - protein, 4 aa, Entamoeba histolytica
SSQD

SEQ ID NO: 2658810 - protein, 5 aa, Entamoeba histolytica
SSQDI

SEQ ID NO: 2658811 - protein, 4 aa, Entamoeba histolytica
SSQE

SEQ ID NO: 2658812 - protein, 8 aa, Entamoeba histolytica
SSQENTES

SEQ ID NO: 2658813 - protein, 9 aa, Entamoeba histolytica
SSQESIRKN

SEQ ID NO: 2658814 - protein, 6 aa, Entamoeba histolytica
SSQFDY

SEQ ID NO: 2658815 - protein, 5 aa, Entamoeba histolytica
SSQGY

SEQ ID NO: 2658816 - protein, 12 aa, Entamoeba histolytica
SSQIKESDLDKT

SEQ ID NO: 2658817 - protein, 6 aa, Entamoeba histolytica
SSQIPK

SEQ ID NO: 2658818 - protein, 5 aa, Entamoeba histolytica
SSQIQ

SEQ ID NO: 2658819 - protein, 4 aa, Entamoeba histolytica
SSQK

SEQ ID NO: 2658820 - protein, 16 aa, Entamoeba histolytica
SSQKQQYNWCDAFSNL

SEQ ID NO: 2658821 - protein, 5 aa, Entamoeba histolytica
SSQLK

SEQ ID NO: 2658822 - protein, 6 aa, Entamoeba histolytica
SSQLNS

SEQ ID NO: 2658823 - protein, 8 aa, Entamoeba histolytica
SSQNEQTN

SEQ ID NO: 2658824 - protein, 18 aa, Entamoeba histolytica
SSQPATGITSSRSKVDEQ

SEQ ID NO: 2658825 - protein, 9 aa, Entamoeba histolytica
SSQPESKKN

SEQ ID NO: 2658826 - protein, 7 aa, Entamoeba histolytica
SSQPFKE

SEQ ID NO: 2658827 - protein, 7 aa, Entamoeba histolytica
SSQPGVQ

SEQ ID NO: 2658828 - protein, 16 aa, Entamoeba histolytica
SSQPKTGFTGKSDEDV

SEQ ID NO: 2658829 - protein, 7 aa, Entamoeba histolytica
SSQPLET

SEQ ID NO: 2658830 - protein, 15 aa, Entamoeba histolytica
SSQPSFEVSGGSQVF

SEQ ID NO: 2658831 - protein, 16 aa, Entamoeba histolytica
SSQPTPSTQQEKKGDF

SEQ ID NO: 2658832 - protein, 8 aa, Entamoeba histolytica
SSQQTPVP

SEQ ID NO: 2658833 - protein, 9 aa, Entamoeba histolytica
SSQSGKTKF

SEQ ID NO: 2658834 - protein, 12 aa, Entamoeba histolytica
SSQSIPSQSPIY

SEQ ID NO: 2658835 - protein, 13 aa, Entamoeba histolytica
SSQSLEKKEGIVR

SEQ ID NO: 2658836 - protein, 8 aa, Entamoeba histolytica
SSQSLNQS

SEQ ID NO: 2658837 - protein, 10 aa, Entamoeba histolytica
SSQSNEKTDQ

SEQ ID NO: 2658838 - protein, 15 aa, Entamoeba histolytica
SSQSPSDSITTTYSS

SEQ ID NO: 2658839 - protein, 6 aa, Entamoeba histolytica
SSQSTM

SEQ ID NO: 2658840 - protein, 8 aa, Entamoeba histolytica
SSQTGSGH

SEQ ID NO: 2658841 - protein, 4 aa, Entamoeba histolytica
SSQV

SEQ ID NO: 2658842 - protein, 8 aa, Entamoeba histolytica
SSQYENSI

SEQ ID NO: 2658843 - protein, 5 aa, Entamoeba histolytica
SSQYS

SEQ ID NO: 2658844 - protein, 6 aa, Entamoeba histolytica
SSQYST

SEQ ID NO: 2658845 - protein, 4 aa, Entamoeba histolytica
SSRD

SEQ ID NO: 2658846 - protein, 20 aa, Entamoeba histolytica
SSRDGLSKKGVQNSIKNKSN

SEQ ID NO: 2658847 - protein, 4 aa, Entamoeba histolytica
SSRE

SEQ ID NO: 2658848 - protein, 11 aa, Entamoeba histolytica
SSREITAASDE

SEQ ID NO: 2658849 - protein, 6 aa, Entamoeba histolytica
SSREKE

SEQ ID NO: 2658850 - protein, 7 aa, Entamoeba histolytica
SSRELKQ

SEQ ID NO: 2658851 - protein, 7 aa, Entamoeba histolytica
SSRESLG

SEQ ID NO: 2658852 - protein, 8 aa, Entamoeba histolytica
SSREVAKA

SEQ ID NO: 2658853 - protein, 13 aa, Entamoeba histolytica
SSRGADSSGNVSN

SEQ ID NO: 2658854 - protein, 5 aa, Entamoeba histolytica
SSRIT

SEQ ID NO: 2658855 - protein, 5 aa, Entamoeba histolytica
SSRKT

SEQ ID NO: 2658856 - protein, 4 aa, Entamoeba histolytica
SSRN

SEQ ID NO: 2658857 - protein, 19 aa, Entamoeba histolytica
SSRNKTENKSNEGSSFCVV

SEQ ID NO: 2658858 - protein, 10 aa, Entamoeba histolytica
SSRRKELSEK

SEQ ID NO: 2658859 - protein, 6 aa, Entamoeba histolytica
SSRSYH

SEQ ID NO: 2658860 - protein, 4 aa, Entamoeba histolytica
SSRT

SEQ ID NO: 2658861 - protein, 6 aa, Entamoeba histolytica
SSRTEF

SEQ ID NO: 2658862 - protein, 6 aa, Entamoeba histolytica
SSRYHE

SEQ ID NO: 2658863 - protein, 21 aa, Entamoeba histolytica
SSSAFSSSISTKTQNDSELKQ

SEQ ID NO: 2658864 - protein, 16 aa, Entamoeba histolytica
SSSANTSETTPTNQDN

SEQ ID NO: 2658865 - protein, 9 aa, Entamoeba histolytica
SSSAPPGRF

SEQ ID NO: 2658866 - protein, 8 aa, Entamoeba histolytica
SSSAPTYF

SEQ ID NO: 2658867 - protein, 9 aa, Entamoeba histolytica
SSSAQKGGD

SEQ ID NO: 2658868 - protein, 9 aa, Entamoeba histolytica
SSSDDYKSA

SEQ ID NO: 2658869 - protein, 8 aa, Entamoeba histolytica
SSSDPTRI

SEQ ID NO: 2658870 - protein, 11 aa, Entamoeba histolytica
SSSDSSLSSLS

SEQ ID NO: 2658871 - protein, 10 aa, Entamoeba histolytica
SSSEERATHF

SEQ ID NO: 2658872 - protein, 8 aa, Entamoeba histolytica
SSSEGSGL

SEQ ID NO: 2658873 - protein, 9 aa, Entamoeba histolytica
SSSEHEAIK

SEQ ID NO: 2658874 - protein, 8 aa, Entamoeba histolytica
SSSELTKR

SEQ ID NO: 2658875 - protein, 9 aa, Entamoeba histolytica
SSSEPTIST

SEQ ID NO: 2658876 - protein, 11 aa, Entamoeba histolytica
SSSEVSNKKIE

SEQ ID NO: 2658877 - protein, 5 aa, Entamoeba histolytica
SSSFG

SEQ ID NO: 2658878 - protein, 8 aa, Entamoeba histolytica
SSSFGKSQ

SEQ ID NO: 2658879 - protein, 17 aa, Entamoeba histolytica
SSSFSEPLLSNKNKFNS

SEQ ID NO: 2658880 - protein, 9 aa, Entamoeba histolytica
SSSGRKNAY

SEQ ID NO: 2658881 - protein, 7 aa, Entamoeba histolytica
SSSHEDE

SEQ ID NO: 2658882 - protein, 8 aa, Entamoeba histolytica
SSSHHTPH

SEQ ID NO: 2658883 - protein, 5 aa, Entamoeba histolytica
SSSIG

SEQ ID NO: 2658884 - protein, 9 aa, Entamoeba histolytica
SSSIGDGSR

SEQ ID NO: 2658885 - protein, 9 aa, Entamoeba histolytica
SSSIKPTIQ

SEQ ID NO: 2658886 - protein, 15 aa, Entamoeba histolytica
SSSISHLSNDQPLSP

SEQ ID NO: 2658887 - protein, 7 aa, Entamoeba histolytica
SSSISQE

SEQ ID NO: 2658888 - protein, 9 aa, Entamoeba histolytica
SSSIVQTKN

SEQ ID NO: 2658889 - protein, 7 aa, Entamoeba histolytica
SSSIVTS

SEQ ID NO: 2658890 - protein, 7 aa, Entamoeba histolytica
SSSKGKV

SEQ ID NO: 2658891 - protein, 5 aa, Entamoeba histolytica
SSSKH

SEQ ID NO: 2658892 - protein, 8 aa, Entamoeba histolytica
SSSKKDLS

SEQ ID NO: 2658893 - protein, 6 aa, Entamoeba histolytica
SSSKLL

SEQ ID NO: 2658894 - protein, 36 aa, Entamoeba histolytica
SSSKLSGDSVSINGGNGTEAITETLKKAKEQGLNKE

SEQ ID NO: 2658895 - protein, 9 aa, Entamoeba histolytica
SSSKPVTVE

SEQ ID NO: 2658896 - protein, 8 aa, Entamoeba histolytica
SSSKTDGI

SEQ ID NO: 2658897 - protein, 4 aa, Entamoeba histolytica
SSSL

SEQ ID NO: 2658898 - protein, 6 aa, Entamoeba histolytica
SSSLDG

SEQ ID NO: 2658899 - protein, 5 aa, Entamoeba histolytica
SSSLI

SEQ ID NO: 2658900 - protein, 8 aa, Entamoeba histolytica
SSSLKQTI

SEQ ID NO: 2658901 - protein, 17 aa, Entamoeba histolytica
SSSLNKKIEDLERSEKL

SEQ ID NO: 2658902 - protein, 6 aa, Entamoeba histolytica
SSSLPE

SEQ ID NO: 2658903 - protein, 12 aa, Entamoeba histolytica
SSSLSETGHIKT

SEQ ID NO: 2658904 - protein, 16 aa, Entamoeba histolytica
SSSLSQGISSIPKQET

SEQ ID NO: 2658905 - protein, 9 aa, Entamoeba histolytica
SSSLTRDSK

SEQ ID NO: 2658906 - protein, 38 aa, Entamoeba histolytica
SSSMQTLPSSHLPEPKRKPPLPPNKPIPTPQPKQQLSH

SEQ ID NO: 2658907 - protein, 4 aa, Entamoeba histolytica
SSSN

SEQ ID NO: 2658908 - protein, 8 aa, Entamoeba histolytica
SSSNNNYQ

SEQ ID NO: 2658909 - protein, 8 aa, Entamoeba histolytica
SSSNNPSI

SEQ ID NO: 2658910 - protein, 7 aa, Entamoeba histolytica
SSSNPFQ

SEQ ID NO: 2658911 - protein, 8 aa, Entamoeba histolytica
SSSNPMPK

SEQ ID NO: 2658912 - protein, 9 aa, Entamoeba histolytica
SSSNQEELT

SEQ ID NO: 2658913 - protein, 27 aa, Entamoeba histolytica
SSSNSHSDSFNSHSDSFNSHSDSFNSL

SEQ ID NO: 2658914 - protein, 8 aa, Entamoeba histolytica
SSSNSSVP

SEQ ID NO: 2658915 - protein, 11 aa, Entamoeba histolytica
SSSNTSAATNV

SEQ ID NO: 2658916 - protein, 6 aa, Entamoeba histolytica
SSSPDI

SEQ ID NO: 2658917 - protein, 5 aa, Entamoeba histolytica
SSSPE

SEQ ID NO: 2658918 - protein, 6 aa, Entamoeba histolytica
SSSPID

SEQ ID NO: 2658919 - protein, 7 aa, Entamoeba histolytica
SSSPIQQ

SEQ ID NO: 2658920 - protein, 9 aa, Entamoeba histolytica
SSSPLSSPV

SEQ ID NO: 2658921 - protein, 8 aa, Entamoeba histolytica
SSSPNEAI

SEQ ID NO: 2658922 - protein, 6 aa, Entamoeba histolytica
SSSPPT

SEQ ID NO: 2658923 - protein, 28 aa, Entamoeba histolytica
SSSPRMAYSASPRSRKPAIYRGTPPTFT

SEQ ID NO: 2658924 - protein, 9 aa, Entamoeba histolytica
SSSPSNDLS

SEQ ID NO: 2658925 - protein, 6 aa, Entamoeba histolytica
SSSPSY

SEQ ID NO: 2658926 - protein, 8 aa, Entamoeba histolytica
SSSPVDLR

SEQ ID NO: 2658927 - protein, 10 aa, Entamoeba histolytica
SSSQEITPIT

SEQ ID NO: 2658928 - protein, 23 aa, Entamoeba histolytica
SSSQPDSKTESIGELKTKELTTE

SEQ ID NO: 2658929 - protein, 9 aa, Entamoeba histolytica
SSSSEEEEL

SEQ ID NO: 2658930 - protein, 8 aa, Entamoeba histolytica
SSSSESWI

SEQ ID NO: 2658931 - protein, 6 aa, Entamoeba histolytica
SSSSGY

SEQ ID NO: 2658932 - protein, 17 aa, Entamoeba histolytica
SSSSIGSEISSTSNRGI

SEQ ID NO: 2658933 - protein, 6 aa, Entamoeba histolytica
SSSSIR

SEQ ID NO: 2658934 - protein, 7 aa, Entamoeba histolytica
SSSSKNI

SEQ ID NO: 2658935 - protein, 7 aa, Entamoeba histolytica
SSSSKYP

SEQ ID NO: 2658936 - protein, 6 aa, Entamoeba histolytica
SSSSNQ

SEQ ID NO: 2658937 - protein, 52 aa, Entamoeba histolytica
SSSSSEQSEGDEEFDEEDEDEDEYEQECPTTGMKHPPQLNSYGDALKPGKDA

SEQ ID NO: 2658938 - protein, 9 aa, Entamoeba histolytica
SSSSSNYSS

SEQ ID NO: 2658939 - protein, 22 aa, Entamoeba histolytica
SSSSSSESHQIDNNSKDSTIED

SEQ ID NO: 2658940 - protein, 249 aa, Entamoeba histolytica
SSSSSTKTSQQCGTKPTQQQQYPSYPQQGAQQGYGAYPPGYPQQQPGAPAQQQYPGYPQQPQGQQQYPGYPQQGGYPQQPGVPAQQQYPGYPQQGAQQGYGAYPGYPQQQSASGKQAPQPGAPAQQQYPGYPQQGGYPQQPQGQQQYPGYPQQPQGQQQYPGYPQQPGVPAQQQSASGKQSTQPGAPAQQQYPGYPQQGGYPQQQYPGYPPQQGYGAYPGYPQQGAQGQQPGYPQQGYGAYPGYPQQPP

SEQ ID NO: 2658941 - protein, 16 aa, Entamoeba histolytica
SSSSSVPTPEVTNGVQ

SEQ ID NO: 2658942 - protein, 4 aa, Entamoeba histolytica
SSST

SEQ ID NO: 2658943 - protein, 7 aa, Entamoeba histolytica
SSSTNQF

SEQ ID NO: 2658944 - protein, 9 aa, Entamoeba histolytica
SSSTPNSPH

SEQ ID NO: 2658945 - protein, 9 aa, Entamoeba histolytica
SSSTQKDKM

SEQ ID NO: 2658946 - protein, 11 aa, Entamoeba histolytica
SSSTSSSISKP

SEQ ID NO: 2658947 - protein, 6 aa, Entamoeba histolytica
SSSTTK

SEQ ID NO: 2658948 - protein, 8 aa, Entamoeba histolytica
SSSTVPTI

SEQ ID NO: 2658949 - protein, 8 aa, Entamoeba histolytica
SSSTYSIK

SEQ ID NO: 2658950 - protein, 6 aa, Entamoeba histolytica
SSSVET

SEQ ID NO: 2658951 - protein, 14 aa, Entamoeba histolytica
SSSVGATRNDKKTA

SEQ ID NO: 2658952 - protein, 6 aa, Entamoeba histolytica
SSSVPQ

SEQ ID NO: 2658953 - protein, 37 aa, Entamoeba histolytica; identical to SEQ ID NO: 2463747

SEQ ID NO: 2658954 - protein, 37 aa, Entamoeba histolytica
SSSYFSSNTIEKTRENSSDENETSDTSYESEQQPLTP

SEQ ID NO: 2658955 - protein, 8 aa, Entamoeba histolytica
SSSYIGNN

SEQ ID NO: 2658956 - protein, 6 aa, Entamoeba histolytica
SSSYQT

SEQ ID NO: 2658957 - protein, 6 aa, Entamoeba histolytica
SSSYSA

SEQ ID NO: 2658958 - protein, 4 aa, Entamoeba histolytica
SSTA

SEQ ID NO: 2658959 - protein, 11 aa, Entamoeba histolytica
SSTAASISNTF

SEQ ID NO: 2658960 - protein, 5 aa, Entamoeba histolytica
SSTDG

SEQ ID NO: 2658961 - protein, 17 aa, Entamoeba histolytica
SSTDGVSTNQRYNLTES

SEQ ID NO: 2658962 - protein, 5 aa, Entamoeba histolytica
SSTDL

SEQ ID NO: 2658963 - protein, 12 aa, Entamoeba histolytica
SSTDSSITLFGF

SEQ ID NO: 2658964 - protein, 10 aa, Entamoeba histolytica
SSTDVKCSEI

SEQ ID NO: 2658965 - protein, 4 aa, Entamoeba histolytica
SSTE

SEQ ID NO: 2658966 - protein, 11 aa, Entamoeba histolytica
SSTEDKKNEYV

SEQ ID NO: 2658967 - protein, 9 aa, Entamoeba histolytica
SSTEEERNQ

SEQ ID NO: 2658968 - protein, 11 aa, Entamoeba histolytica
SSTENSKSQGI

SEQ ID NO: 2658969 - protein, 10 aa, Entamoeba histolytica
SSTESQPKVI

SEQ ID NO: 2658970 - protein, 5 aa, Entamoeba histolytica
SSTFT

SEQ ID NO: 2658971 - protein, 6 aa, Entamoeba histolytica
SSTGTV

SEQ ID NO: 2658972 - protein, 7 aa, Entamoeba histolytica
SSTHPLT

SEQ ID NO: 2658973 - protein, 4 aa, Entamoeba histolytica
SSTI

SEQ ID NO: 2658974 - protein, 6 aa, Entamoeba histolytica
SSTIED

SEQ ID NO: 2658975 - protein, 13 aa, Entamoeba histolytica
SSTIQESLGNIDS

SEQ ID NO: 2658976 - protein, 14 aa, Entamoeba histolytica
SSTKKEVVGENSRV

SEQ ID NO: 2658977 - protein, 5 aa, Entamoeba histolytica
SSTKT

SEQ ID NO: 2658978 - protein, 5 aa, Entamoeba histolytica
SSTKY

SEQ ID NO: 2658979 - protein, 4 aa, Entamoeba histolytica
SSTL

SEQ ID NO: 2658980 - protein, 5 aa, Entamoeba histolytica
SSTLP

SEQ ID NO: 2658981 - protein, 10 aa, Entamoeba histolytica
SSTLRTSPQT

SEQ ID NO: 2658982 - protein, 20 aa, Entamoeba histolytica
SSTLSESTSLSRKHSRRGSI

SEQ ID NO: 2658983 - protein, 9 aa, Entamoeba histolytica
SSTNDINGL

SEQ ID NO: 2658984 - protein, 7 aa, Entamoeba histolytica
SSTNDLA

SEQ ID NO: 2658985 - protein, 7 aa, Entamoeba histolytica
SSTNGTF

SEQ ID NO: 2658986 - protein, 5 aa, Entamoeba histolytica
SSTNM

SEQ ID NO: 2658987 - protein, 9 aa, Entamoeba histolytica
SSTNTFTET

SEQ ID NO: 2658988 - protein, 7 aa, Entamoeba histolytica
SSTPDKL

SEQ ID NO: 2658989 - protein, 7 aa, Entamoeba histolytica
SSTPTKI

SEQ ID NO: 2658990 - protein, 10 aa, Entamoeba histolytica
SSTPTNGDSI

SEQ ID NO: 2658991 - protein, 14 aa, Entamoeba histolytica
SSTQITETSTPIEE

SEQ ID NO: 2658992 - protein, 10 aa, Entamoeba histolytica
SSTQNETPFS

SEQ ID NO: 2658993 - protein, 5 aa, Entamoeba histolytica
SSTSR

SEQ ID NO: 2658994 - protein, 6 aa, Entamoeba histolytica
SSTSSF

SEQ ID NO: 2658995 - protein, 23 aa, Entamoeba histolytica
SSTSSLGNKNLSHPRRPTAGSFD

SEQ ID NO: 2658996 - protein, 25 aa, Entamoeba histolytica
SSTSSVKKNERFTNPLRTTGTSSSF

SEQ ID NO: 2658997 - protein, 11 aa, Entamoeba histolytica
SSTSTTPLNPN

SEQ ID NO: 2658998 - protein, 36 aa, Entamoeba histolytica
SSTSYSTNGRITTTSEITETTEIQQNETIVFNGFWL

SEQ ID NO: 2658999 - protein, 4 aa, Entamoeba histolytica
SSTT

SEQ ID NO: 2659000 - protein, 9 aa, Entamoeba histolytica
SSTTAEPYD

SEQ ID NO: 2659001 - protein, 7 aa, Entamoeba histolytica
SSTTELS

SEQ ID NO: 2659002 - protein, 5 aa, Entamoeba histolytica
SSTTH

SEQ ID NO: 2659003 - protein, 22 aa, Entamoeba histolytica
SSTTQGIAETINGDEVEERKRD

SEQ ID NO: 2659004 - protein, 6 aa, Entamoeba histolytica
SSTTQI

SEQ ID NO: 2659005 - protein, 7 aa, Entamoeba histolytica
SSTTSIK

SEQ ID NO: 2659006 - protein, 7 aa, Entamoeba histolytica
SSTTSSI

SEQ ID NO: 2659007 - protein, 5 aa, Entamoeba histolytica
SSTTT

SEQ ID NO: 2659008 - protein, 18 aa, Entamoeba histolytica
SSTVEDKKKRRQRKRNMD

SEQ ID NO: 2659009 - protein, 7 aa, Entamoeba histolytica
SSTVSTE

SEQ ID NO: 2659010 - protein, 5 aa, Entamoeba histolytica
SSTYA

SEQ ID NO: 2659011 - protein, 11 aa, Entamoeba histolytica
SSVAQKTVDTV

SEQ ID NO: 2659012 - protein, 10 aa, Entamoeba histolytica
SSVDEDSANN

SEQ ID NO: 2659013 - protein, 13 aa, Entamoeba histolytica
SSVESQKSKEIEV

SEQ ID NO: 2659014 - protein, 5 aa, Entamoeba histolytica
SSVEY

SEQ ID NO: 2659015 - protein, 6 aa, Entamoeba histolytica
SSVEYH

SEQ ID NO: 2659016 - protein, 10 aa, Entamoeba histolytica
SSVGKTSITQ

SEQ ID NO: 2659017 - protein, 4 aa, Entamoeba histolytica
SSVI

SEQ ID NO: 2659018 - protein, 25 aa, Entamoeba histolytica
SSVKPTTTPSENNSQKITNDGNQIT

SEQ ID NO: 2659019 - protein, 13 aa, Entamoeba histolytica
SSVNYSRNEGNNE

SEQ ID NO: 2659020 - protein, 9 aa, Entamoeba histolytica
SSVPGEGEH

SEQ ID NO: 2659021 - protein, 7 aa, Entamoeba histolytica
SSVPNHV

SEQ ID NO: 2659022 - protein, 7 aa, Entamoeba histolytica
SSVQTKE

SEQ ID NO: 2659023 - protein, 12 aa, Entamoeba histolytica
SSVRDMKEKIEP

SEQ ID NO: 2659024 - protein, 10 aa, Entamoeba histolytica
SSVSASDIAG

SEQ ID NO: 2659025 - protein, 9 aa, Entamoeba histolytica
SSVSESSPY

SEQ ID NO: 2659026 - protein, 9 aa, Entamoeba histolytica
SSVSKIGRA

SEQ ID NO: 2659027 - protein, 42 aa, Entamoeba histolytica
SSVSPQNITNNITPNDSLETSKKPKKILTQSNSENSSELLEQ

SEQ ID NO: 2659028 - protein, 7 aa, Entamoeba histolytica
SSVTTSV

SEQ ID NO: 2659029 - protein, 11 aa, Entamoeba histolytica
SSVVEKKGLHT

SEQ ID NO: 2659030 - protein, 16 aa, Entamoeba histolytica
SSVVSNISNEKNKFNN

SEQ ID NO: 2659031 - protein, 9 aa, Entamoeba histolytica
SSWKTKEDV

SEQ ID NO: 2659032 - protein, 8 aa, Entamoeba histolytica
SSYDVPKM

SEQ ID NO: 2659033 - protein, 5 aa, Entamoeba histolytica
SSYEI

SEQ ID NO: 2659034 - protein, 7 aa, Entamoeba histolytica
SSYENNE

SEQ ID NO: 2659035 - protein, 4 aa, Entamoeba histolytica
SSYG

SEQ ID NO: 2659036 - protein, 8 aa, Entamoeba histolytica
SSYGKRKI

SEQ ID NO: 2659037 - protein, 14 aa, Entamoeba histolytica
SSYGKTIQKPIKEE

SEQ ID NO: 2659038 - protein, 4 aa, Entamoeba histolytica
SSYK

SEQ ID NO: 2659039 - protein, 10 aa, Entamoeba histolytica
SSYKNLKSDS

SEQ ID NO: 2659040 - protein, 7 aa, Entamoeba histolytica
SSYNNNN

SEQ ID NO: 2659041 - protein, 7 aa, Entamoeba histolytica
SSYPGVS

SEQ ID NO: 2659042 - protein, 9 aa, Entamoeba histolytica
SSYPPTKGW

SEQ ID NO: 2659043 - protein, 8 aa, Entamoeba histolytica
SSYPSSAA

SEQ ID NO: 2659044 - protein, 5 aa, Entamoeba histolytica
SSYPT

SEQ ID NO: 2659045 - protein, 30 aa, Entamoeba histolytica
SSYQPALTSTKVDPRKSLDTFADEKQATQL

SEQ ID NO: 2659046 - protein, 10 aa, Entamoeba histolytica
SSYRAEADPI

SEQ ID NO: 2659047 - protein, 5 aa, Entamoeba histolytica
SSYTI

SEQ ID NO: 2659048 - protein, 12 aa, Entamoeba histolytica
SSYTQGNSTVTP

SEQ ID NO: 2659049 - protein, 20 aa, Entamoeba histolytica
SSYTSNYQQHSFESNDTNVF

SEQ ID NO: 2659050 - protein, 8 aa, Entamoeba histolytica
SSYTYPSP

SEQ ID NO: 2659051 - protein, 6 aa, Entamoeba histolytica
SSYVES

SEQ ID NO: 2659052 - protein, 8 aa, Entamoeba histolytica
SSYYKGTQ

SEQ ID NO: 2659053 - protein, 9 aa, Entamoeba histolytica
STAGPEITS

SEQ ID NO: 2659054 - protein, 7 aa, Entamoeba histolytica
STAHPGC

SEQ ID NO: 2659055 - protein, 11 aa, Entamoeba histolytica
STAKKGYAGTA

SEQ ID NO: 2659056 - protein, 5 aa, Entamoeba histolytica
STANE

SEQ ID NO: 2659057 - protein, 7 aa, Entamoeba histolytica
STAPEEA

SEQ ID NO: 2659058 - protein, 10 aa, Entamoeba histolytica
STAPGIPSDT

SEQ ID NO: 2659059 - protein, 10 aa, Entamoeba histolytica
STAPKSVAEL

SEQ ID NO: 2659060 - protein, 4 aa, Entamoeba histolytica
STAQ

SEQ ID NO: 2659061 - protein, 6 aa, Entamoeba histolytica
STARSP

SEQ ID NO: 2659062 - protein, 6 aa, Entamoeba histolytica
STASIQ

SEQ ID NO: 2659063 - protein, 5 aa, Entamoeba histolytica
STASN

SEQ ID NO: 2659064 - protein, 12 aa, Entamoeba histolytica
STATEPELCSDT

SEQ ID NO: 2659065 - protein, 5 aa, Entamoeba histolytica
STATR

SEQ ID NO: 2659066 - protein, 8 aa, Entamoeba histolytica
STATTAQA

SEQ ID NO: 2659067 - protein, 5 aa, Entamoeba histolytica
STAVL

SEQ ID NO: 2659068 - protein, 5 aa, Entamoeba histolytica
STAVS

SEQ ID NO: 2659069 - protein, 5 aa, Entamoeba histolytica
STCNT

SEQ ID NO: 2659070 - protein, 10 aa, Entamoeba histolytica
STCNTETTSV

SEQ ID NO: 2659071 - protein, 19 aa, Entamoeba histolytica
STDAINEHEEKLRKTNKQF

SEQ ID NO: 2659072 - protein, 7 aa, Entamoeba histolytica
STDATLE

SEQ ID NO: 2659073 - protein, 5 aa, Entamoeba histolytica
STDDP

SEQ ID NO: 2659074 - protein, 8 aa, Entamoeba histolytica
STDENGKR

SEQ ID NO: 2659075 - protein, 13 aa, Entamoeba histolytica
STDESGSQEEYDS

SEQ ID NO: 2659076 - protein, 14 aa, Entamoeba histolytica
STDETIKSKSIETI

SEQ ID NO: 2659077 - protein, 6 aa, Entamoeba histolytica
STDFTN

SEQ ID NO: 2659078 - protein, 8 aa, Entamoeba histolytica
STDGPSRT

SEQ ID NO: 2659079 - protein, 7 aa, Entamoeba histolytica
STDMKPN

SEQ ID NO: 2659080 - protein, 4 aa, Entamoeba histolytica
STDN

SEQ ID NO: 2659081 - protein, 5 aa, Entamoeba histolytica
STDNE

SEQ ID NO: 2659082 - protein, 6 aa, Entamoeba histolytica
STDPGV

SEQ ID NO: 2659083 - protein, 6 aa, Entamoeba histolytica
STDPTT

SEQ ID NO: 2659084 - protein, 7 aa, Entamoeba histolytica
STDSDKY

SEQ ID NO: 2659085 - protein, 8 aa, Entamoeba histolytica
STDSKENP

SEQ ID NO: 2659086 - protein, 7 aa, Entamoeba histolytica
STDSQWN

SEQ ID NO: 2659087 - protein, 10 aa, Entamoeba histolytica
STDSSINKYK

SEQ ID NO: 2659088 - protein, 4 aa, Entamoeba histolytica
STDT

SEQ ID NO: 2659089 - protein, 12 aa, Entamoeba histolytica
STECEKGKYEID

SEQ ID NO: 2659090 - protein, 5 aa, Entamoeba histolytica
STECS

SEQ ID NO: 2659091 - protein, 4 aa, Entamoeba histolytica
STED

SEQ ID NO: 2659092 - protein, 9 aa, Entamoeba histolytica
STEDINKRP

SEQ ID NO: 2659093 - protein, 9 aa, Entamoeba histolytica
STEDKETSF

SEQ ID NO: 2659094 - protein, 14 aa, Entamoeba histolytica
STEDNDKLIGIIEK

SEQ ID NO: 2659095 - protein, 7 aa, Entamoeba histolytica
STEDQSF

SEQ ID NO: 2659096 - protein, 8 aa, Entamoeba histolytica
STEEDPSV

SEQ ID NO: 2659097 - protein, 50 aa, Entamoeba histolytica
  misc_feature (18)..(50): Xaa can be any naturally occurring amino acid
STEEDSKPAKVNAPLMTXXXXXXXXXXXXXXXXXXXXXXXXXXXXXXXXX

SEQ ID NO: 2659098 - protein, 20 aa, Entamoeba histolytica
STEEEENIGWDGKEYKTKEE

SEQ ID NO: 2659099 - protein, 5 aa, Entamoeba histolytica
STEEF

SEQ ID NO: 2659100 - protein, 13 aa, Entamoeba histolytica
STEEGQKFSNEGN

SEQ ID NO: 2659101 - protein, 5 aa, Entamoeba histolytica
STEEH

SEQ ID NO: 2659102 - protein, 7 aa, Entamoeba histolytica
STEELDR

SEQ ID NO: 2659103 - protein, 10 aa, Entamoeba histolytica
STEERGENSC

SEQ ID NO: 2659104 - protein, 8 aa, Entamoeba histolytica
STEESYAR

SEQ ID NO: 2659105 - protein, 5 aa, Entamoeba histolytica
STEFI

SEQ ID NO: 2659106 - protein, 6 aa, Entamoeba histolytica
STEFKP

SEQ ID NO: 2659107 - protein, 6 aa, Entamoeba histolytica
STEFPM

SEQ ID NO: 2659108 - protein, 6 aa, Entamoeba histolytica
STEFTQ

SEQ ID NO: 2659109 - protein, 5 aa, Entamoeba histolytica
STEGI

SEQ ID NO: 2659110 - protein, 5 aa, Entamoeba histolytica
STEGN

SEQ ID NO: 2659111 - protein, 15 aa, Entamoeba histolytica
STEGVVTGQSENTEN

SEQ ID NO: 2659112 - protein, 7 aa, Entamoeba histolytica
STEGYAT

SEQ ID NO: 2659113 - protein, 4 aa, Entamoeba histolytica
STEI

SEQ ID NO: 2659114 - protein, 8 aa, Entamoeba histolytica
STEIDKEN

SEQ ID NO: 2659115 - protein, 4 aa, Entamoeba histolytica
STEK

SEQ ID NO: 2659116 - protein, 5 aa, Entamoeba histolytica
STEKS

SEQ ID NO: 2659117 - protein, 4 aa, Entamoeba histolytica
STEL

SEQ ID NO: 2659118 - protein, 4 aa, Entamoeba histolytica
STEN

SEQ ID NO: 2659119 - protein, 12 aa, Entamoeba histolytica
STENEQQEDKNI

SEQ ID NO: 2659120 - protein, 7 aa, Entamoeba histolytica
STENHSN

SEQ ID NO: 2659121 - protein, 6 aa, Entamoeba histolytica
STEPKT

SEQ ID NO: 2659122 - protein, 8 aa, Entamoeba histolytica
STEPSQLE

SEQ ID NO: 2659123 - protein, 19 aa, Entamoeba histolytica
STEPTTNESQHHKKNYYEQ

SEQ ID NO: 2659124 - protein, 10 aa, Entamoeba histolytica
STEQNIPPAQ

SEQ ID NO: 2659125 - protein, 10 aa, Entamoeba histolytica
STERKSDVAQ

SEQ ID NO: 2659126 - protein, 5 aa, Entamoeba histolytica
STERL

SEQ ID NO: 2659127 - protein, 7 aa, Entamoeba histolytica
STESARQ

SEQ ID NO: 2659128 - protein, 8 aa, Entamoeba histolytica
STESGTTA

SEQ ID NO: 2659129 - protein, 5 aa, Entamoeba histolytica
STESH

SEQ ID NO: 2659130 - protein, 8 aa, Entamoeba histolytica
STETNTHT

SEQ ID NO: 2659131 - protein, 8 aa, Entamoeba histolytica
STETPVNE

SEQ ID NO: 2659132 - protein, 5 aa, Entamoeba histolytica
STETT

SEQ ID NO: 2659133 - protein, 7 aa, Entamoeba histolytica
STEVPVS

SEQ ID NO: 2659134 - protein, 7 aa, Entamoeba histolytica
STEVSNQ

SEQ ID NO: 2659135 - protein, 14 aa, Entamoeba histolytica
STFDTGSSRTLNGN

SEQ ID NO: 2659136 - protein, 5 aa, Entamoeba histolytica
STFER

SEQ ID NO: 2659137 - protein, 4 aa, Entamoeba histolytica
STFP

SEQ ID NO: 2659138 - protein, 6 aa, Entamoeba histolytica
STFRDG

SEQ ID NO: 2659139 - protein, 4 aa, Entamoeba histolytica
STFS

SEQ ID NO: 2659140 - protein, 20 aa, Entamoeba histolytica
STFSQNSPKIDESSQGEKKE

SEQ ID NO: 2659141 - protein, 10 aa, Entamoeba histolytica
STFTQEEKEA

SEQ ID NO: 2659142 - protein, 19 aa, Entamoeba histolytica
STFTSQQQDMLPPPTGNFS

SEQ ID NO: 2659143 - protein, 12 aa, Entamoeba histolytica
STFTTTGNARQA

SEQ ID NO: 2659144 - protein, 6 aa, Entamoeba histolytica
STGALV

SEQ ID NO: 2659145 - protein, 13 aa, Entamoeba histolytica
STGDEDMRTSRDA

SEQ ID NO: 2659146 - protein, 14 aa, Entamoeba histolytica
STGDSTCMKTKAGE

SEQ ID NO: 2659147 - protein, 6 aa, Entamoeba histolytica
STGEDG

SEQ ID NO: 2659148 - protein, 15 aa, Entamoeba histolytica
STGFSEEKKETKDEK

SEQ ID NO: 2659149 - protein, 10 aa, Entamoeba histolytica
STGHGQEKEV

SEQ ID NO: 2659150 - protein, 4 aa, Entamoeba histolytica
STGI

SEQ ID NO: 2659151 - protein, 5 aa, Entamoeba histolytica
STGIN

SEQ ID NO: 2659152 - protein, 5 aa, Entamoeba histolytica
STGIR

SEQ ID NO: 2659153 - protein, 7 aa, Entamoeba histolytica
STGISSS

SEQ ID NO: 2659154 - protein, 4 aa, Entamoeba histolytica
STGK

SEQ ID NO: 2659155 - protein, 8 aa, Entamoeba histolytica
STGKLDTS

SEQ ID NO: 2659156 - protein, 5 aa, Entamoeba histolytica
STGKY

SEQ ID NO: 2659157 - protein, 5 aa, Entamoeba histolytica
STGNR

SEQ ID NO: 2659158 - protein, 9 aa, Entamoeba histolytica
STGPEQKPV

SEQ ID NO: 2659159 - protein, 6 aa, Entamoeba histolytica
STGRDA

SEQ ID NO: 2659160 - protein, 20 aa, Entamoeba histolytica
STGRNSTTYLTEQSSSSTLP

SEQ ID NO: 2659161 - protein, 8 aa, Entamoeba histolytica
STGRVESN

SEQ ID NO: 2659162 - protein, 5 aa, Entamoeba histolytica
STGTI

SEQ ID NO: 2659163 - protein, 6 aa, Entamoeba histolytica
STGTKN

SEQ ID NO: 2659164 - protein, 9 aa, Entamoeba histolytica
STGTKRYGE

SEQ ID NO: 2659165 - protein, 5 aa, Entamoeba histolytica
STGTM

SEQ ID NO: 2659166 - protein, 7 aa, Entamoeba histolytica
STHCPDC

SEQ ID NO: 2659167 - protein, 5 aa, Entamoeba histolytica
STHDV

SEQ ID NO: 2659168 - protein, 6 aa, Entamoeba histolytica
STHDVE

SEQ ID NO: 2659169 - protein, 6 aa, Entamoeba histolytica
STHKHL

SEQ ID NO: 2659170 - protein, 5 aa, Entamoeba histolytica
STHPD

SEQ ID NO: 2659171 - protein, 6 aa, Entamoeba histolytica
STHQPS

SEQ ID NO: 2659172 - protein, 4 aa, Entamoeba histolytica
STHS

SEQ ID NO: 2659173 - protein, 6 aa, Entamoeba histolytica
STHSEP

SEQ ID NO: 2659174 - protein, 5 aa, Entamoeba histolytica
STHTG

SEQ ID NO: 2659175 - protein, 13 aa, Entamoeba histolytica
STIDPGSVDGKTF

SEQ ID NO: 2659176 - protein, 13 aa, Entamoeba histolytica
STIEDDIKTHEKY

SEQ ID NO: 2659177 - protein, 7 aa, Entamoeba histolytica
STIEDPS

SEQ ID NO: 2659178 - protein, 5 aa, Entamoeba histolytica
STIEE

SEQ ID NO: 2659179 - protein, 6 aa, Entamoeba histolytica
STIEEG

SEQ ID NO: 2659180 - protein, 7 aa, Entamoeba histolytica
STIEERL

SEQ ID NO: 2659181 - protein, 5 aa, Entamoeba histolytica
STIEI

SEQ ID NO: 2659182 - protein, 28 aa, Entamoeba histolytica
STIESSDSEESETPSKPMSIEQNDHDSI

SEQ ID NO: 2659183 - protein, 7 aa, Entamoeba histolytica
STIGTNK

SEQ ID NO: 2659184 - protein, 16 aa, Entamoeba histolytica
STIHENQPKTSNVNNI

SEQ ID NO: 2659185 - protein, 5 aa, Entamoeba histolytica
STIKE

SEQ ID NO: 2659186 - protein, 20 aa, Entamoeba histolytica
STIKGKKKTQKKLRNQKKTF

SEQ ID NO: 2659187 - protein, 7 aa, Entamoeba histolytica
STIKNST

SEQ ID NO: 2659188 - protein, 13 aa, Entamoeba histolytica
STIKSQEIKTERK

SEQ ID NO: 2659189 - protein, 11 aa, Entamoeba histolytica
STINENDVKPK

SEQ ID NO: 2659190 - protein, 5 aa, Entamoeba histolytica
STINK

SEQ ID NO: 2659191 - protein, 6 aa, Entamoeba histolytica
STIPDV

SEQ ID NO: 2659192 - protein, 10 aa, Entamoeba histolytica
STIPKQSESL

SEQ ID NO: 2659193 - protein, 6 aa, Entamoeba histolytica
STIPND

SEQ ID NO: 2659194 - protein, 10 aa, Entamoeba histolytica
STIQPNPNVR

SEQ ID NO: 2659195 - protein, 14 aa, Entamoeba histolytica
STIQPPKSVNPKEV

SEQ ID NO: 2659196 - protein, 10 aa, Entamoeba histolytica
STIRKTAPIG

SEQ ID NO: 2659197 - protein, 6 aa, Entamoeba histolytica
STISPK

SEQ ID NO: 2659198 - protein, 10 aa, Entamoeba histolytica
STISRSGSLN

SEQ ID NO: 2659199 - protein, 20 aa, Entamoeba histolytica
STISTMTSSDFTRIDTTQHE

SEQ ID NO: 2659200 - protein, 8 aa, Entamoeba histolytica
STITAPSD

SEQ ID NO: 2659201 - protein, 26 aa, Entamoeba histolytica
STITKPQNNTKHSSLKLSSSKPIPTF

SEQ ID NO: 2659202 - protein, 6 aa, Entamoeba histolytica
STITRD

SEQ ID NO: 2659203 - protein, 14 aa, Entamoeba histolytica
STITTIKRNDNKSK

SEQ ID NO: 2659204 - protein, 10 aa, Entamoeba histolytica
STKAISSARS

SEQ ID NO: 2659205 - protein, 7 aa, Entamoeba histolytica
STKARCP

SEQ ID NO: 2659206 - protein, 8 aa, Entamoeba histolytica
STKDVDNP

SEQ ID NO: 2659207 - protein, 12 aa, Entamoeba histolytica
STKEDITNFSSQ

SEQ ID NO: 2659208 - protein, 30 aa, Entamoeba histolytica
STKEEPKKKPVSDNEIKAEKMTKTQTKTKL

SEQ ID NO: 2659209 - protein, 7 aa, Entamoeba histolytica
STKEEQN

SEQ ID NO: 2659210 - protein, 8 aa, Entamoeba histolytica
STKENSII

SEQ ID NO: 2659211 - protein, 14 aa, Entamoeba histolytica
STKESNIEVLTATK

SEQ ID NO: 2659212 - protein, 5 aa, Entamoeba histolytica
STKEV

SEQ ID NO: 2659213 - protein, 20 aa, Entamoeba histolytica
STKFETSEKEYNKERKVYDT

SEQ ID NO: 2659214 - protein, 6 aa, Entamoeba histolytica
STKFNR

SEQ ID NO: 2659215 - protein, 6 aa, Entamoeba histolytica
STKGKG

SEQ ID NO: 2659216 - protein, 21 aa, Entamoeba histolytica
STKGKHVKGNIEGYSKIKATS

SEQ ID NO: 2659217 - protein, 12 aa, Entamoeba histolytica
STKGKSLLFNTI

SEQ ID NO: 2659218 - protein, 9 aa, Entamoeba histolytica
STKGNVVTQ

SEQ ID NO: 2659219 - protein, 15 aa, Entamoeba histolytica
STKHEKLPNNTITQT

SEQ ID NO: 2659220 - protein, 4 aa, Entamoeba histolytica
STKI

SEQ ID NO: 2659221 - protein, 10 aa, Entamoeba histolytica
STKIKGVGST

SEQ ID NO: 2659222 - protein, 5 aa, Entamoeba histolytica
STKKD

SEQ ID NO: 2659223 - protein, 7 aa, Entamoeba histolytica
STKKVID

SEQ ID NO: 2659224 - protein, 6 aa, Entamoeba histolytica
STKLPI

SEQ ID NO: 2659225 - protein, 10 aa, Entamoeba histolytica
STKMGGTNKL

SEQ ID NO: 2659226 - protein, 9 aa, Entamoeba histolytica
STKNKEAKI

SEQ ID NO: 2659227 - protein, 8 aa, Entamoeba histolytica
STKNNDIT

SEQ ID NO: 2659228 - protein, 23 aa, Entamoeba histolytica
STKPEKKGSNQNIKTNHKVATKN

SEQ ID NO: 2659229 - protein, 9 aa, Entamoeba histolytica
STKPKRNAI

SEQ ID NO: 2659230 - protein, 9 aa, Entamoeba histolytica
STKPLNRDE

SEQ ID NO: 2659231 - protein, 5 aa, Entamoeba histolytica
STKPT

SEQ ID NO: 2659232 - protein, 9 aa, Entamoeba histolytica
STKQFPEKK

SEQ ID NO: 2659233 - protein, 5 aa, Entamoeba histolytica
STKQG

SEQ ID NO: 2659234 - protein, 5 aa, Entamoeba histolytica
STKQT

SEQ ID NO: 2659235 - protein, 19 aa, Entamoeba histolytica
STKRDNLDLNQPAIKREYD

SEQ ID NO: 2659236 - protein, 10 aa, Entamoeba histolytica
STKRFTGAYR

SEQ ID NO: 2659237 - protein, 10 aa, Entamoeba histolytica
STKRNNPTTT

SEQ ID NO: 2659238 - protein, 6 aa, Entamoeba histolytica
STKSER

SEQ ID NO: 2659239 - protein, 5 aa, Entamoeba histolytica
STKSI

SEQ ID NO: 2659240 - protein, 17 aa, Entamoeba histolytica
STKSWKTTSFNAHPAGV

SEQ ID NO: 2659241 - protein, 40 aa, Entamoeba histolytica
STKTEPKTVVTSQNKNTGQEPEWKRKQREAEEKKKEMQDK

SEQ ID NO: 2659242 - protein, 8 aa, Entamoeba histolytica
STKTKEKY

SEQ ID NO: 2659243 - protein, 9 aa, Entamoeba histolytica
STKTNISEN

SEQ ID NO: 2659244 - protein, 15 aa, Entamoeba histolytica
STKTPLQYPYPYPGF

SEQ ID NO: 2659245 - protein, 6 aa, Entamoeba histolytica
STKTSF

SEQ ID NO: 2659246 - protein, 8 aa, Entamoeba histolytica
STKTSLLS

SEQ ID NO: 2659247 - protein, 4 aa, Entamoeba histolytica
STKV

SEQ ID NO: 2659248 - protein, 13 aa, Entamoeba histolytica
STLAKKKDKQVVG

SEQ ID NO: 2659249 - protein, 4 aa, Entamoeba histolytica
STLE

SEQ ID NO: 2659250 - protein, 6 aa, Entamoeba histolytica
STLEIN

SEQ ID NO: 2659251 - protein, 8 aa, Entamoeba histolytica
STLEKRTQ

SEQ ID NO: 2659252 - protein, 5 aa, Entamoeba histolytica
STLEQ

SEQ ID NO: 2659253 - protein, 5 aa, Entamoeba histolytica
STLHQ

SEQ ID NO: 2659254 - protein, 8 aa, Entamoeba histolytica
STLNDEKI

SEQ ID NO: 2659255 - protein, 6 aa, Entamoeba histolytica
STLPAQ

SEQ ID NO: 2659256 - protein, 7 aa, Entamoeba histolytica
STLPHKE

SEQ ID NO: 2659257 - protein, 15 aa, Entamoeba histolytica
STLPSEDKPVEFSTT

SEQ ID NO: 2659258 - protein, 5 aa, Entamoeba histolytica
STLPV

SEQ ID NO: 2659259 - protein, 4 aa, Entamoeba histolytica
STLR

SEQ ID NO: 2659260 - protein, 6 aa, Entamoeba histolytica
STLRES

SEQ ID NO: 2659261 - protein, 9 aa, Entamoeba histolytica
STLSEKEKS

SEQ ID NO: 2659262 - protein, 49 aa, Entamoeba histolytica
STLSFSEKKEGDKEKKDSNTRQTVSGKPTDGTSKEVDKKSRFSLFKKTK

SEQ ID NO: 2659263 - protein, 7 aa, Entamoeba histolytica
STLSPQE

SEQ ID NO: 2659264 - protein, 10 aa, Entamoeba histolytica
STLSQEQRAV

SEQ ID NO: 2659265 - protein, 14 aa, Entamoeba histolytica
STLTESKQESPCGS

SEQ ID NO: 2659266 - protein, 14 aa, Entamoeba histolytica
STMEPKELKSKVVY

SEQ ID NO: 2659267 - protein, 18 aa, Entamoeba histolytica
STMEQSTSFNNTSEPYQI

SEQ ID NO: 2659268 - protein, 9 aa, Entamoeba histolytica
STMNCDEEE

SEQ ID NO: 2659269 - protein, 6 aa, Entamoeba histolytica
STMNEE

SEQ ID NO: 2659270 - protein, 5 aa, Entamoeba histolytica
STNDG

SEQ ID NO: 2659271 - protein, 6 aa, Entamoeba histolytica
STNDGA

SEQ ID NO: 2659272 - protein, 8 aa, Entamoeba histolytica
STNDNDEL

SEQ ID NO: 2659273 - protein, 6 aa, Entamoeba histolytica
STNGGW

SEQ ID NO: 2659274 - protein, 10 aa, Entamoeba histolytica
STNGKIENDP

SEQ ID NO: 2659275 - protein, 8 aa, Entamoeba histolytica
STNGLGGI

SEQ ID NO: 2659276 - protein, 6 aa, Entamoeba histolytica
STNGYP

SEQ ID NO: 2659277 - protein, 6 aa, Entamoeba histolytica
STNHPN

SEQ ID NO: 2659278 - protein, 5 aa, Entamoeba histolytica
STNHT

SEQ ID NO: 2659279 - protein, 8 aa, Entamoeba histolytica
STNITGTD

SEQ ID NO: 2659280 - protein, 4 aa, Entamoeba histolytica
STNK

SEQ ID NO: 2659281 - protein, 6 aa, Entamoeba histolytica
STNKDI

SEQ ID NO: 2659282 - protein, 5 aa, Entamoeba histolytica
STNKE

SEQ ID NO: 2659283 - protein, 5 aa, Entamoeba histolytica
STNKV

SEQ ID NO: 2659284 - protein, 10 aa, Entamoeba histolytica
STNKVATRNN

SEQ ID NO: 2659285 - protein, 4 aa, Entamoeba histolytica
STNL

SEQ ID NO: 2659286 - protein, 8 aa, Entamoeba histolytica
STNLPSRV

SEQ ID NO: 2659287 - protein, 12 aa, Entamoeba histolytica
STNLQNNNSSLN

SEQ ID NO: 2659288 - protein, 4 aa, Entamoeba histolytica
STNM

SEQ ID NO: 2659289 - protein, 4 aa, Entamoeba histolytica
STNN

SEQ ID NO: 2659290 - protein, 6 aa, Entamoeba histolytica
STNNEI

SEQ ID NO: 2659291 - protein, 7 aa, Entamoeba histolytica
STNNPRG

SEQ ID NO: 2659292 - protein, 20 aa, Entamoeba histolytica
STNNPTYQQQMSSTTQYYPY

SEQ ID NO: 2659293 - protein, 7 aa, Entamoeba histolytica
STNNQLE

SEQ ID NO: 2659294 - protein, 7 aa, Entamoeba histolytica
STNNSPD

SEQ ID NO: 2659295 - protein, 5 aa, Entamoeba histolytica
STNPD

SEQ ID NO: 2659296 - protein, 9 aa, Entamoeba histolytica
STNPETPDT

SEQ ID NO: 2659297 - protein, 10 aa, Entamoeba histolytica
STNPKATPQL

SEQ ID NO: 2659298 - protein, 10 aa, Entamoeba histolytica
STNPNCQIDP

SEQ ID NO: 2659299 - protein, 13 aa, Entamoeba histolytica
STNPQMKNCNSRN

SEQ ID NO: 2659300 - protein, 10 aa, Entamoeba histolytica
STNPYYSEKK

SEQ ID NO: 2659301 - protein, 6 aa, Entamoeba histolytica
STNQDK

SEQ ID NO: 2659302 - protein, 7 aa, Entamoeba histolytica
STNQLQT

SEQ ID NO: 2659303 - protein, 4 aa, Entamoeba histolytica
STNS

SEQ ID NO: 2659304 - protein, 15 aa, Entamoeba histolytica
STNSKQQSFPEKKEN

SEQ ID NO: 2659305 - protein, 19 aa, Entamoeba histolytica
STNSQIDKDVRRTDRNDSK

SEQ ID NO: 2659306 - protein, 10 aa, Entamoeba histolytica
STNSVKKDVA

SEQ ID NO: 2659307 - protein, 7 aa, Entamoeba histolytica
STNTDSK

SEQ ID NO: 2659308 - protein, 8 aa, Entamoeba histolytica
STNTKDQL

SEQ ID NO: 2659309 - protein, 9 aa, Entamoeba histolytica
STNTNNSKD

SEQ ID NO: 2659310 - protein, 5 aa, Entamoeba histolytica
STNTS

SEQ ID NO: 2659311 - protein, 7 aa, Entamoeba histolytica
STNTYNQ

SEQ ID NO: 2659312 - protein, 4 aa, Entamoeba histolytica
STNW

SEQ ID NO: 2659313 - protein, 13 aa, Entamoeba histolytica
STPDYSNSPSQSK

SEQ ID NO: 2659314 - protein, 14 aa, Entamoeba histolytica
STPEDLFDHLIQSM

SEQ ID NO: 2659315 - protein, 7 aa, Entamoeba histolytica
STPEEAI

SEQ ID NO: 2659316 - protein, 8 aa, Entamoeba histolytica
STPEGYNR

SEQ ID NO: 2659317 - protein, 6 aa, Entamoeba histolytica
STPEIV

SEQ ID NO: 2659318 - protein, 6 aa, Entamoeba histolytica
STPESH

SEQ ID NO: 2659319 - protein, 6 aa, Entamoeba histolytica
STPFNF

SEQ ID NO: 2659320 - protein, 13 aa, Entamoeba histolytica
STPFTSTSFSLSF

SEQ ID NO: 2659321 - protein, 6 aa, Entamoeba histolytica
STPGFY

SEQ ID NO: 2659322 - protein, 4 aa, Entamoeba histolytica
STPI

SEQ ID NO: 2659323 - protein, 17 aa, Entamoeba histolytica
STPIKSTPSSSSQQSTN

SEQ ID NO: 2659324 - protein, 7 aa, Entamoeba histolytica
STPIQQK

SEQ ID NO: 2659325 - protein, 19 aa, Entamoeba histolytica
STPIQSTKENKTVTPRRST

SEQ ID NO: 2659326 - protein, 7 aa, Entamoeba histolytica
STPKKQI

SEQ ID NO: 2659327 - protein, 6 aa, Entamoeba histolytica
STPLHP

SEQ ID NO: 2659328 - protein, 25 aa, Entamoeba histolytica
STPMPQTPSLTSSATPLGNPTDNSM

SEQ ID NO: 2659329 - protein, 8 aa, Entamoeba histolytica
STPNEDEL

SEQ ID NO: 2659330 - protein, 8 aa, Entamoeba histolytica
STPNEITE

SEQ ID NO: 2659331 - protein, 9 aa, Entamoeba histolytica
STPNYPTEH

SEQ ID NO: 2659332 - protein, 6 aa, Entamoeba histolytica
STPPFN

SEQ ID NO: 2659333 - protein, 7 aa, Entamoeba histolytica
STPPLET

SEQ ID NO: 2659334 - protein, 6 aa, Entamoeba histolytica
STPPPI

SEQ ID NO: 2659335 - protein, 6 aa, Entamoeba histolytica
STPQFK

SEQ ID NO: 2659336 - protein, 6 aa, Entamoeba histolytica
STPRMN

SEQ ID NO: 2659337 - protein, 4 aa, Entamoeba histolytica
STPS

SEQ ID NO: 2659338 - protein, 8 aa, Entamoeba histolytica
STPSETMS

SEQ ID NO: 2659339 - protein, 7 aa, Entamoeba histolytica
STPSKIP

SEQ ID NO: 2659340 - protein, 6 aa, Entamoeba histolytica
STPSLL

SEQ ID NO: 2659341 - protein, 7 aa, Entamoeba histolytica
STPSLQP

SEQ ID NO: 2659342 - protein, 8 aa, Entamoeba histolytica
STPSPDEC

SEQ ID NO: 2659343 - protein, 7 aa, Entamoeba histolytica
STPSPLV

SEQ ID NO: 2659344 - protein, 11 aa, Entamoeba histolytica
STPSTSISERR

SEQ ID NO: 2659345 - protein, 4 aa, Entamoeba histolytica
STPT

SEQ ID NO: 2659346 - protein, 9 aa, Entamoeba histolytica
STPTISKQN

SEQ ID NO: 2659347 - protein, 5 aa, Entamoeba histolytica
STPTL

SEQ ID NO: 2659348 - protein, 21 aa, Entamoeba histolytica
STPTMEPTIKREEKERTFNGM

SEQ ID NO: 2659349 - protein, 8 aa, Entamoeba histolytica
STPTTIDN

SEQ ID NO: 2659350 - protein, 11 aa, Entamoeba histolytica
STPVLEDNEPY

SEQ ID NO: 2659351 - protein, 4 aa, Entamoeba histolytica
STQE

SEQ ID NO: 2659352 - protein, 7 aa, Entamoeba histolytica
STQFEDT

SEQ ID NO: 2659353 - protein, 7 aa, Entamoeba histolytica
STQFKER

SEQ ID NO: 2659354 - protein, 14 aa, Entamoeba histolytica
STQGVSTGNSENTE

SEQ ID NO: 2659355 - protein, 7 aa, Entamoeba histolytica
STQIEMQ

SEQ ID NO: 2659356 - protein, 6 aa, Entamoeba histolytica
STQIKE

SEQ ID NO: 2659357 - protein, 12 aa, Entamoeba histolytica
STQIRDSDLDKK

SEQ ID NO: 2659358 - protein, 20 aa, Entamoeba histolytica
STQISNQLPQQQENKPKEFE

SEQ ID NO: 2659359 - protein, 5 aa, Entamoeba histolytica
STQKD

SEQ ID NO: 2659360 - protein, 21 aa, Entamoeba histolytica
STQLQNKQQEEKIEKKDNKIE

SEQ ID NO: 2659361 - protein, 15 aa, Entamoeba histolytica
STQNETKLKQHVSQA

SEQ ID NO: 2659362 - protein, 8 aa, Entamoeba histolytica
STQNPDSV

SEQ ID NO: 2659363 - protein, 6 aa, Entamoeba histolytica
STQPGV

SEQ ID NO: 2659364 - protein, 5 aa, Entamoeba histolytica
STQPI

SEQ ID NO: 2659365 - protein, 7 aa, Entamoeba histolytica
STQPPKV

SEQ ID NO: 2659366 - protein, 6 aa, Entamoeba histolytica
STQQLE

SEQ ID NO: 2659367 - protein, 7 aa, Entamoeba histolytica
STQQVQG

SEQ ID NO: 2659368 - protein, 5 aa, Entamoeba histolytica
STQRE

SEQ ID NO: 2659369 - protein, 7 aa, Entamoeba histolytica
STQSIEM

SEQ ID NO: 2659370 - protein, 5 aa, Entamoeba histolytica
STQTK

SEQ ID NO: 2659371 - protein, 7 aa, Entamoeba histolytica
STQYKSP

SEQ ID NO: 2659372 - protein, 7 aa, Entamoeba histolytica
STRGEKV

SEQ ID NO: 2659373 - protein, 6 aa, Entamoeba histolytica
STRGES

SEQ ID NO: 2659374 - protein, 7 aa, Entamoeba histolytica
STRGETI

SEQ ID NO: 2659375 - protein, 16 aa, Entamoeba histolytica
STRIKDRSDRATNDQV

SEQ ID NO: 2659376 - protein, 5 aa, Entamoeba histolytica
STRIP

SEQ ID NO: 2659377 - protein, 9 aa, Entamoeba histolytica
STRKPEEKR

SEQ ID NO: 2659378 - protein, 7 aa, Entamoeba histolytica
STRKVGD

SEQ ID NO: 2659379 - protein, 5 aa, Entamoeba histolytica
STRLR

SEQ ID NO: 2659380 - protein, 6 aa, Entamoeba histolytica
STRNGK

SEQ ID NO: 2659381 - protein, 5 aa, Entamoeba histolytica
STRPT

SEQ ID NO: 2659382 - protein, 31 aa, Entamoeba histolytica
STRQPHMKSPNTTPQHQTQSSSVTSTKTTQA

SEQ ID NO: 2659383 - protein, 4 aa, Entamoeba histolytica
STRR

SEQ ID NO: 2659384 - protein, 8 aa, Entamoeba histolytica
STRRNTVA

SEQ ID NO: 2659385 - protein, 6 aa, Entamoeba histolytica
STRSSD

SEQ ID NO: 2659386 - protein, 5 aa, Entamoeba histolytica
STRYG

SEQ ID NO: 2659387 - protein, 6 aa, Entamoeba histolytica
STSADE

SEQ ID NO: 2659388 - protein, 32 aa, Entamoeba histolytica
STSASTTLSSSTQSCDEETKKKTQRDKISHES

SEQ ID NO: 2659389 - protein, 10 aa, Entamoeba histolytica
STSDADNGYD

SEQ ID NO: 2659390 - protein, 7 aa, Entamoeba histolytica
STSDITK

SEQ ID NO: 2659391 - protein, 19 aa, Entamoeba histolytica
STSDKSSDKFTQQNNDVPQ

SEQ ID NO: 2659392 - protein, 8 aa, Entamoeba histolytica
STSEGKAI

SEQ ID NO: 2659393 - protein, 7 aa, Entamoeba histolytica
STSFGSE

SEQ ID NO: 2659394 - protein, 11 aa, Entamoeba histolytica
STSFGSEETDV

SEQ ID NO: 2659395 - protein, 5 aa, Entamoeba histolytica
STSFI

SEQ ID NO: 2659396 - protein, 7 aa, Entamoeba histolytica
STSFPSA

SEQ ID NO: 2659397 - protein, 15 aa, Entamoeba histolytica
STSGDLDGQDNSSRF

SEQ ID NO: 2659398 - protein, 21 aa, Entamoeba histolytica
STSGGRSNLCSSKSHKQVHYS

SEQ ID NO: 2659399 - protein, 8 aa, Entamoeba histolytica
STSGPLPR

SEQ ID NO: 2659400 - protein, 20 aa, Entamoeba histolytica
STSGSKLPRAFAGSSQNHSL

SEQ ID NO: 2659401 - protein, 4 aa, Entamoeba histolytica
STSH

SEQ ID NO: 2659402 - protein, 8 aa, Entamoeba histolytica
STSHKGGV

SEQ ID NO: 2659403 - protein, 5 aa, Entamoeba histolytica
STSIE

SEQ ID NO: 2659404 - protein, 9 aa, Entamoeba histolytica
STSISASTL

SEQ ID NO: 2659405 - protein, 9 aa, Entamoeba histolytica
STSKGAVES

SEQ ID NO: 2659406 - protein, 8 aa, Entamoeba histolytica
STSKGFVQ

SEQ ID NO: 2659407 - protein, 17 aa, Entamoeba histolytica
STSKKDSKKQENNSQTV

SEQ ID NO: 2659408 - protein, 14 aa, Entamoeba histolytica
STSKKNGKQNQSEI

SEQ ID NO: 2659409 - protein, 11 aa, Entamoeba histolytica
STSKTGKHGHA

SEQ ID NO: 2659410 - protein, 12 aa, Entamoeba histolytica
STSKTGKHGHAK

SEQ ID NO: 2659411 - protein, 13 aa, Entamoeba histolytica
STSKTLSDQSIKE

SEQ ID NO: 2659412 - protein, 11 aa, Entamoeba histolytica
STSKVYTSDGY

SEQ ID NO: 2659413 - protein, 5 aa, Entamoeba histolytica
STSLN

SEQ ID NO: 2659414 - protein, 9 aa, Entamoeba histolytica
STSLTPQKE

SEQ ID NO: 2659415 - protein, 17 aa, Entamoeba histolytica
STSMDYSKTIDKSSTEI

SEQ ID NO: 2659416 - protein, 5 aa, Entamoeba histolytica
STSNA

SEQ ID NO: 2659417 - protein, 12 aa, Entamoeba histolytica
STSNDDISDEEL

SEQ ID NO: 2659418 - protein, 6 aa, Entamoeba histolytica
STSNNN

SEQ ID NO: 2659419 - protein, 8 aa, Entamoeba histolytica
STSNNPKT

SEQ ID NO: 2659420 - protein, 17 aa, Entamoeba histolytica
STSNVSLEERKKNIDSK

SEQ ID NO: 2659421 - protein, 6 aa, Entamoeba histolytica
STSPNL

SEQ ID NO: 2659422 - protein, 6 aa, Entamoeba histolytica
STSPTI

SEQ ID NO: 2659423 - protein, 9 aa, Entamoeba histolytica
STSQEARKN

SEQ ID NO: 2659424 - protein, 10 aa, Entamoeba histolytica
STSQNKLEMA

SEQ ID NO: 2659425 - protein, 4 aa, Entamoeba histolytica
STSR

SEQ ID NO: 2659426 - protein, 11 aa, Entamoeba histolytica
STSRARAESTT

SEQ ID NO: 2659427 - protein, 8 aa, Entamoeba histolytica
STSRSQHS

SEQ ID NO: 2659428 - protein, 6 aa, Entamoeba histolytica
STSRWA

SEQ ID NO: 2659429 - protein, 6 aa, Entamoeba histolytica
STSSAN

SEQ ID NO: 2659430 - protein, 8 aa, Entamoeba histolytica
STSSDKTV

SEQ ID NO: 2659431 - protein, 7 aa, Entamoeba histolytica
STSSDRS

SEQ ID NO: 2659432 - protein, 10 aa, Entamoeba histolytica
STSSEPLTCS

SEQ ID NO: 2659433 - protein, 9 aa, Entamoeba histolytica
STSSGYSKS

SEQ ID NO: 2659434 - protein, 9 aa, Entamoeba histolytica
STSSPLSSF

SEQ ID NO: 2659435 - protein, 9 aa, Entamoeba histolytica
STSSSLKQL

SEQ ID NO: 2659436 - protein, 10 aa, Entamoeba histolytica
STSSSLTGKN

SEQ ID NO: 2659437 - protein, 4 aa, Entamoeba histolytica
STST

SEQ ID NO: 2659438 - protein, 9 aa, Entamoeba histolytica
STSTDELEN

SEQ ID NO: 2659439 - protein, 8 aa, Entamoeba histolytica
STSTFDTE

SEQ ID NO: 2659440 - protein, 5 aa, Entamoeba histolytica
STSTQ

SEQ ID NO: 2659441 - protein, 14 aa, Entamoeba histolytica
STSTQNPDEMTTTY

SEQ ID NO: 2659442 - protein, 5 aa, Entamoeba histolytica
STSTT

SEQ ID NO: 2659443 - protein, 6 aa, Entamoeba histolytica
STSTTS

SEQ ID NO: 2659444 - protein, 8 aa, Entamoeba histolytica
STSTTTSL

SEQ ID NO: 2659445 - protein, 10 aa, Entamoeba histolytica
STSVETQRNS

SEQ ID NO: 2659446 - protein, 33 aa, Entamoeba histolytica
STSVSRKPPPSSISEQQHKEVQSSSHIVSNGNK

SEQ ID NO: 2659447 - protein, 13 aa, Entamoeba histolytica
STSVSVNAKNDTF

SEQ ID NO: 2659448 - protein, 4 aa, Entamoeba histolytica
STTA

SEQ ID NO: 2659449 - protein, 19 aa, Entamoeba histolytica
STTAAPDTLRDGSSYNPTQ

SEQ ID NO: 2659450 - protein, 5 aa, Entamoeba histolytica
STTCA

SEQ ID NO: 2659451 - protein, 4 aa, Entamoeba histolytica
STTD

SEQ ID NO: 2659452 - protein, 5 aa, Entamoeba histolytica
STTDG

SEQ ID NO: 2659453 - protein, 6 aa, Entamoeba histolytica
STTDVA

SEQ ID NO: 2659454 - protein, 11 aa, Entamoeba histolytica
STTEGHSSGTA

SEQ ID NO: 2659455 - protein, 6 aa, Entamoeba histolytica
STTEKT

SEQ ID NO: 2659456 - protein, 8 aa, Entamoeba histolytica
STTELGPQ

SEQ ID NO: 2659457 - protein, 20 aa, Entamoeba histolytica
STTENQSSKTLKPQSKRKLK

SEQ ID NO: 2659458 - protein, 9 aa, Entamoeba histolytica
STTEPPQFL

SEQ ID NO: 2659459 - protein, 8 aa, Entamoeba histolytica
STTEWANS

SEQ ID NO: 2659460 - protein, 11 aa, Entamoeba histolytica
STTGAEPQEIK

SEQ ID NO: 2659461 - protein, 11 aa, Entamoeba histolytica
STTGKHEDPEI

SEQ ID NO: 2659462 - protein, 10 aa, Entamoeba histolytica
STTGSQISDY

SEQ ID NO: 2659463 - protein, 4 aa, Entamoeba histolytica
STTI

SEQ ID NO: 2659464 - protein, 5 aa, Entamoeba histolytica
STTIK

SEQ ID NO: 2659465 - protein, 7 aa, Entamoeba histolytica
STTIKDP

SEQ ID NO: 2659466 - protein, 11 aa, Entamoeba histolytica
STTIPPPSQND

SEQ ID NO: 2659467 - protein, 25 aa, Entamoeba histolytica
STTISSQTKSLKKKKLSSSNSEVFT

SEQ ID NO: 2659468 - protein, 9 aa, Entamoeba histolytica
STTKEFREA

SEQ ID NO: 2659469 - protein, 9 aa, Entamoeba histolytica
STTKEPEMK

SEQ ID NO: 2659470 - protein, 12 aa, Entamoeba histolytica
STTKKRYATMTE

SEQ ID NO: 2659471 - protein, 10 aa, Entamoeba histolytica
STTKKSKRQI

SEQ ID NO: 2659472 - protein, 8 aa, Entamoeba histolytica
STTKSKEI

SEQ ID NO: 2659473 - protein, 4 aa, Entamoeba histolytica
STTL

SEQ ID NO: 2659474 - protein, 12 aa, Entamoeba histolytica
STTMKRATETKR

SEQ ID NO: 2659475 - protein, 5 aa, Entamoeba histolytica
STTNK

SEQ ID NO: 2659476 - protein, 7 aa, Entamoeba histolytica
STTNSDT

SEQ ID NO: 2659477 - protein, 8 aa, Entamoeba histolytica
STTPKTRQ

SEQ ID NO: 2659478 - protein, 9 aa, Entamoeba histolytica
STTPLPNGN

SEQ ID NO: 2659479 - protein, 5 aa, Entamoeba histolytica
STTPN

SEQ ID NO: 2659480 - protein, 8 aa, Entamoeba histolytica
STTPSYIP

SEQ ID NO: 2659481 - protein, 48 aa, Entamoeba histolytica
STTPVVSSHTPVASTYTPTNSKQSSSKYRPNRSTEKISRPKATKIFSM

SEQ ID NO: 2659482 - protein, 4 aa, Entamoeba histolytica
STTQ

SEQ ID NO: 2659483 - protein, 14 aa, Entamoeba histolytica
STTQKHQKEECCSS

SEQ ID NO: 2659484 - protein, 7 aa, Entamoeba histolytica
STTQLPT

SEQ ID NO: 2659485 - protein, 12 aa, Entamoeba histolytica
STTQNVSEKTRM

SEQ ID NO: 2659486 - protein, 8 aa, Entamoeba histolytica
STTQSEKI

SEQ ID NO: 2659487 - protein, 8 aa, Entamoeba histolytica
STTSALDQ

SEQ ID NO: 2659488 - protein, 40 aa, Entamoeba histolytica
STTSAPSTPGLSHSPRRSTLSTSTTCEGGGPNTNGTINTS

SEQ ID NO: 2659489 - protein, 10 aa, Entamoeba histolytica
STTSEELRSR

SEQ ID NO: 2659490 - protein, 7 aa, Entamoeba histolytica
STTSGAL

SEQ ID NO: 2659491 - protein, 10 aa, Entamoeba histolytica
STTSKSDDKL

SEQ ID NO: 2659492 - protein, 10 aa, Entamoeba histolytica
STTSNSSSRE

SEQ ID NO: 2659493 - protein, 7 aa, Entamoeba histolytica
STTSQQV

SEQ ID NO: 2659494 - protein, 10 aa, Entamoeba histolytica
STTSSSLSRC

SEQ ID NO: 2659495 - protein, 8 aa, Entamoeba histolytica
STTSTVPH

SEQ ID NO: 2659496 - protein, 5 aa, Entamoeba histolytica
STTSV

SEQ ID NO: 2659497 - protein, 4 aa, Entamoeba histolytica
STTT

SEQ ID NO: 2659498 - protein, 6 aa, Entamoeba histolytica
STTTGD

SEQ ID NO: 2659499 - protein, 6 aa, Entamoeba histolytica
STTTND

SEQ ID NO: 2659500 - protein, 20 aa, Entamoeba histolytica
STTTNNPRRAPHPQGYYTQP

SEQ ID NO: 2659501 - protein, 6 aa, Entamoeba histolytica
STTTSL

SEQ ID NO: 2659502 - protein, 6 aa, Entamoeba histolytica
STTVTL

SEQ ID NO: 2659503 - protein, 17 aa, Entamoeba histolytica
STVDPKLKKNEDGTTGI

SEQ ID NO: 2659504 - protein, 5 aa, Entamoeba histolytica
STVDW

SEQ ID NO: 2659505 - protein, 4 aa, Entamoeba histolytica
STVE

SEQ ID NO: 2659506 - protein, 10 aa, Entamoeba histolytica
STVGKTSLAN

SEQ ID NO: 2659507 - protein, 7 aa, Entamoeba histolytica
STVGKTT

SEQ ID NO: 2659508 - protein, 5 aa, Entamoeba histolytica
STVKK

SEQ ID NO: 2659509 - protein, 36 aa, Entamoeba histolytica
STVPSGPSLAEQLQAKRNDLNSAPVEDNVPVQQDDD

SEQ ID NO: 2659510 - protein, 8 aa, Entamoeba histolytica
STVPYSNP

SEQ ID NO: 2659511 - protein, 19 aa, Entamoeba histolytica
STVSNDDSDRSLLQGEPGV

SEQ ID NO: 2659512 - protein, 5 aa, Entamoeba histolytica
STVSP

SEQ ID NO: 2659513 - protein, 17 aa, Entamoeba histolytica
STVSTTPNKNHSDLSSE

SEQ ID NO: 2659514 - protein, 11 aa, Entamoeba histolytica
STVTKIGDSSF

SEQ ID NO: 2659515 - protein, 10 aa, Entamoeba histolytica
STVTNARTKF

SEQ ID NO: 2659516 - protein, 6 aa, Entamoeba histolytica
STVTSL

SEQ ID NO: 2659517 - protein, 8 aa, Entamoeba histolytica
STYNEDEG

SEQ ID NO: 2659518 - protein, 4 aa, Entamoeba histolytica
STYP

SEQ ID NO: 2659519 - protein, 19 aa, Entamoeba histolytica
STYQADDNSNIFEQPDSPE

SEQ ID NO: 2659520 - protein, 6 aa, Entamoeba histolytica
STYQAH

SEQ ID NO: 2659521 - protein, 8 aa, Entamoeba histolytica
STYQSNRL

SEQ ID NO: 2659522 - protein, 10 aa, Entamoeba histolytica
STYRDTSGKG

SEQ ID NO: 2659523 - protein, 11 aa, Entamoeba histolytica
STYSSENTSPR

SEQ ID NO: 2659524 - protein, 6 aa, Entamoeba histolytica
STYTEK

SEQ ID NO: 2659525 - protein, 6 aa, Entamoeba histolytica
STYYKT

SEQ ID NO: 2659526 - protein, 9 aa, Entamoeba histolytica
SVAATKRTQ

SEQ ID NO: 2659527 - protein, 12 aa, Entamoeba histolytica
SVAKNSNSSLYG

SEQ ID NO: 2659528 - protein, 12 aa, Entamoeba histolytica
SVALRGKEYEIS

SEQ ID NO: 2659529 - protein, 4 aa, Entamoeba histolytica
SVAS

SEQ ID NO: 2659530 - protein, 11 aa, Entamoeba histolytica
SVCSSTPCKSI

SEQ ID NO: 2659531 - protein, 30 aa, Entamoeba histolytica
SVDCPENTEGGFKRKSNDNTEDTGKHIRFD

SEQ ID NO: 2659532 - protein, 7 aa, Entamoeba histolytica
SVDENNI

SEQ ID NO: 2659533 - protein, 6 aa, Entamoeba histolytica
SVDGDS

SEQ ID NO: 2659534 - protein, 11 aa, Entamoeba histolytica
SVDGSVTSKQG

SEQ ID NO: 2659535 - protein, 7 aa, Entamoeba histolytica
SVDGTDY

SEQ ID NO: 2659536 - protein, 21 aa, Entamoeba histolytica
SVDKELETELKDDEKEGGPNA

SEQ ID NO: 2659537 - protein, 4 aa, Entamoeba histolytica
SVDS

SEQ ID NO: 2659538 - protein, 12 aa, Entamoeba histolytica
SVDSGRSDDNEV

SEQ ID NO: 2659539 - protein, 11 aa, Entamoeba histolytica
SVDTTNKGDDV

SEQ ID NO: 2659540 - protein, 10 aa, Entamoeba histolytica
SVEDENDGYD

SEQ ID NO: 2659541 - protein, 8 aa, Entamoeba histolytica
SVEDNGIQ

SEQ ID NO: 2659542 - protein, 19 aa, Entamoeba histolytica
SVEEENSEDEFESVSDPQW

SEQ ID NO: 2659543 - protein, 8 aa, Entamoeba histolytica
SVEERDKE

SEQ ID NO: 2659544 - protein, 9 aa, Entamoeba histolytica
SVEERSEKM

SEQ ID NO: 2659545 - protein, 9 aa, Entamoeba histolytica
SVEGDSVDK

SEQ ID NO: 2659546 - protein, 10 aa, Entamoeba histolytica
SVEIKGKDDT

SEQ ID NO: 2659547 - protein, 5 aa, Entamoeba histolytica
SVEIN

SEQ ID NO: 2659548 - protein, 6 aa, Entamoeba histolytica
SVEKPY

SEQ ID NO: 2659549 - protein, 30 aa, Entamoeba histolytica
SVEKTSQKENEKKDNDKPTEQTNTASNPFT

SEQ ID NO: 2659550 - protein, 12 aa, Entamoeba histolytica
SVELDEKEEYDK

SEQ ID NO: 2659551 - protein, 11 aa, Entamoeba histolytica
SVEMEGADPTL

SEQ ID NO: 2659552 - protein, 4 aa, Entamoeba histolytica
SVEP

SEQ ID NO: 2659553 - protein, 6 aa, Entamoeba histolytica
SVEPLK

SEQ ID NO: 2659554 - protein, 4 aa, Entamoeba histolytica
SVEQ

SEQ ID NO: 2659555 - protein, 5 aa, Entamoeba histolytica
SVEQK

SEQ ID NO: 2659556 - protein, 7 aa, Entamoeba histolytica
SVEQSEQ

SEQ ID NO: 2659557 - protein, 7 aa, Entamoeba histolytica
SVERNDE

SEQ ID NO: 2659558 - protein, 12 aa, Entamoeba histolytica
SVESQSSTDQQE

SEQ ID NO: 2659559 - protein, 16 aa, Entamoeba histolytica
SVESSDGIKNRNTREW

SEQ ID NO: 2659560 - protein, 9 aa, Entamoeba histolytica
SVESSNNQA

SEQ ID NO: 2659561 - protein, 5 aa, Entamoeba histolytica
SVETH

SEQ ID NO: 2659562 - protein, 15 aa, Entamoeba histolytica
SVETHKRLCERKEKK

SEQ ID NO: 2659563 - protein, 4 aa, Entamoeba histolytica
SVFG

SEQ ID NO: 2659564 - protein, 7 aa, Entamoeba histolytica
SVFSNTP

SEQ ID NO: 2659565 - protein, 6 aa, Entamoeba histolytica
SVGAEE

SEQ ID NO: 2659566 - protein, 7 aa, Entamoeba histolytica
SVGDNTF

SEQ ID NO: 2659567 - protein, 10 aa, Entamoeba histolytica
SVGDTSLDIP

SEQ ID NO: 2659568 - protein, 5 aa, Entamoeba histolytica
SVGEK

SEQ ID NO: 2659569 - protein, 12 aa, Entamoeba histolytica
SVGINKSTEYNY

SEQ ID NO: 2659570 - protein, 7 aa, Entamoeba histolytica
SVGKDIT

SEQ ID NO: 2659571 - protein, 8 aa, Entamoeba histolytica
SVGKGGFG

SEQ ID NO: 2659572 - protein, 8 aa, Entamoeba histolytica
SVGKIQTK

SEQ ID NO: 2659573 - protein, 5 aa, Entamoeba histolytica
SVGKS

SEQ ID NO: 2659574 - protein, 6 aa, Entamoeba histolytica
SVGPDE

SEQ ID NO: 2659575 - protein, 14 aa, Entamoeba histolytica
SVGPKTSSPFVFAL

SEQ ID NO: 2659576 - protein, 15 aa, Entamoeba histolytica
SVGSNSSFRLSNEGL

SEQ ID NO: 2659577 - protein, 12 aa, Entamoeba histolytica
SVGSNYKENKQM

SEQ ID NO: 2659578 - protein, 12 aa, Entamoeba histolytica
SVGSQEKDISNQ

SEQ ID NO: 2659579 - protein, 6 aa, Entamoeba histolytica
SVGSSL

SEQ ID NO: 2659580 - protein, 5 aa, Entamoeba histolytica
SVGVE

SEQ ID NO: 2659581 - protein, 4 aa, Entamoeba histolytica
SVGY

SEQ ID NO: 2659582 - protein, 9 aa, Entamoeba histolytica
SVHSNGSQR

SEQ ID NO: 2659583 - protein, 14 aa, Entamoeba histolytica
SVHSTNTPYTPENK

SEQ ID NO: 2659584 - protein, 26 aa, Entamoeba histolytica
SVHTPQQSYEGYQQSYEGYQQSYEGQ

SEQ ID NO: 2659585 - protein, 7 aa, Entamoeba histolytica
SVINPTQ

SEQ ID NO: 2659586 - protein, 6 aa, Entamoeba histolytica
SVISND

SEQ ID NO: 2659587 - protein, 10 aa, Entamoeba histolytica
SVITGGADGK

SEQ ID NO: 2659588 - protein, 12 aa, Entamoeba histolytica
SVKCKKRGQTAW

SEQ ID NO: 2659589 - protein, 10 aa, Entamoeba histolytica
SVKDGSTEEI

SEQ ID NO: 2659590 - protein, 5 aa, Entamoeba histolytica
SVKEL

SEQ ID NO: 2659591 - protein, 6 aa, Entamoeba histolytica
SVKGPV

SEQ ID NO: 2659592 - protein, 21 aa, Entamoeba histolytica
SVKKQMKTSGSQKGKMARKTV

SEQ ID NO: 2659593 - protein, 17 aa, Entamoeba histolytica
SVKPELKKIDPKSKLTS

SEQ ID NO: 2659594 - protein, 8 aa, Entamoeba histolytica
SVKPQKEI

SEQ ID NO: 2659595 - protein, 18 aa, Entamoeba histolytica
SVKRQSTTNKMARTPRQS

SEQ ID NO: 2659596 - protein, 4 aa, Entamoeba histolytica
SVKS

SEQ ID NO: 2659597 - protein, 25 aa, Entamoeba histolytica
SVKSESYSPTRDRSTSKTSSSSQNQ

SEQ ID NO: 2659598 - protein, 10 aa, Entamoeba histolytica
SVKSNDPNIK

SEQ ID NO: 2659599 - protein, 4 aa, Entamoeba histolytica
SVKT

SEQ ID NO: 2659600 - protein, 23 aa, Entamoeba histolytica
SVKTPEITPIKGKPTSKLTTNSQ

SEQ ID NO: 2659601 - protein, 6 aa, Entamoeba histolytica
SVKTPF

SEQ ID NO: 2659602 - protein, 6 aa, Entamoeba histolytica
SVLEQE

SEQ ID NO: 2659603 - protein, 8 aa, Entamoeba histolytica
SVLTGGEK

SEQ ID NO: 2659604 - protein, 9 aa, Entamoeba histolytica
SVMQTGSAA

SEQ ID NO: 2659605 - protein, 5 aa, Entamoeba histolytica
SVNDA

SEQ ID NO: 2659606 - protein, 5 aa, Entamoeba histolytica
SVNDR

SEQ ID NO: 2659607 - protein, 12 aa, Entamoeba histolytica
SVNDTIAESAEQ

SEQ ID NO: 2659608 - protein, 4 aa, Entamoeba histolytica
SVNE

SEQ ID NO: 2659609 - protein, 7 aa, Entamoeba histolytica
SVNEHQT

SEQ ID NO: 2659610 - protein, 21 aa, Entamoeba histolytica
SVNESSVDSEEDRKDQQNQTI

SEQ ID NO: 2659611 - protein, 5 aa, Entamoeba histolytica
SVNGQ

SEQ ID NO: 2659612 - protein, 13 aa, Entamoeba histolytica
SVNIEDGESLKKA

SEQ ID NO: 2659613 - protein, 11 aa, Entamoeba histolytica
SVNKENEETVN

SEQ ID NO: 2659614 - protein, 18 aa, Entamoeba histolytica
SVNKESKVDQKVSNNDHV

SEQ ID NO: 2659615 - protein, 5 aa, Entamoeba histolytica
SVNLD

SEQ ID NO: 2659616 - protein, 16 aa, Entamoeba histolytica
SVNNDGKRVKVTSLPK

SEQ ID NO: 2659617 - protein, 8 aa, Entamoeba histolytica
SVNNEENE

SEQ ID NO: 2659618 - protein, 8 aa, Entamoeba histolytica
SVNNPKNV

SEQ ID NO: 2659619 - protein, 14 aa, Entamoeba histolytica
SVNNQKLQKPQITP

SEQ ID NO: 2659620 - protein, 14 aa, Entamoeba histolytica
SVNPQQIDQYGNSP

SEQ ID NO: 2659621 - protein, 13 aa, Entamoeba histolytica
SVNPSKYSTNNCG

SEQ ID NO: 2659622 - protein, 7 aa, Entamoeba histolytica
SVNQETI

SEQ ID NO: 2659623 - protein, 5 aa, Entamoeba histolytica
SVNQS

SEQ ID NO: 2659624 - protein, 4 aa, Entamoeba histolytica
SVNY

SEQ ID NO: 2659625 - protein, 60 aa, Entamoeba histolytica
SVPAQTNQQENTKQEETKVQPINDTNQPIPQQLNSTEQKATENKQKDTFEDEFSDFFVSS

SEQ ID NO: 2659626 - protein, 5 aa, Entamoeba histolytica
SVPGH

SEQ ID NO: 2659627 - protein, 8 aa, Entamoeba histolytica
SVPKESTV

SEQ ID NO: 2659628 - protein, 10 aa, Entamoeba histolytica
SVPKSTPRNR

SEQ ID NO: 2659629 - protein, 13 aa, Entamoeba histolytica
SVPLTSQEDLNQT

SEQ ID NO: 2659630 - protein, 15 aa, Entamoeba histolytica
SVPNPFLRKSSLEQQ

SEQ ID NO: 2659631 - protein, 5 aa, Entamoeba histolytica
SVPPK

SEQ ID NO: 2659632 - protein, 16 aa, Entamoeba histolytica
SVPPPPVSSDTTYIEK

SEQ ID NO: 2659633 - protein, 4 aa, Entamoeba histolytica
SVPQ

SEQ ID NO: 2659634 - protein, 8 aa, Entamoeba histolytica
SVPSASPH

SEQ ID NO: 2659635 - protein, 10 aa, Entamoeba histolytica
SVPSDSPDDY

SEQ ID NO: 2659636 - protein, 5 aa, Entamoeba histolytica
SVPSG

SEQ ID NO: 2659637 - protein, 10 aa, Entamoeba histolytica
SVPTKRGTPS

SEQ ID NO: 2659638 - protein, 8 aa, Entamoeba histolytica
SVPVTQKD

SEQ ID NO: 2659639 - protein, 4 aa, Entamoeba histolytica
SVQE

SEQ ID NO: 2659640 - protein, 10 aa, Entamoeba histolytica
SVQNNTSITL

SEQ ID NO: 2659641 - protein, 9 aa, Entamoeba histolytica
SVQPEERYQ

SEQ ID NO: 2659642 - protein, 11 aa, Entamoeba histolytica
SVQPTKYNGSE

SEQ ID NO: 2659643 - protein, 6 aa, Entamoeba histolytica
SVQPTR

SEQ ID NO: 2659644 - protein, 10 aa, Entamoeba histolytica
SVQQKQQPDI

SEQ ID NO: 2659645 - protein, 8 aa, Entamoeba histolytica
SVQQNQKI

SEQ ID NO: 2659646 - protein, 11 aa, Entamoeba histolytica
SVQQPDHSGAI

SEQ ID NO: 2659647 - protein, 16 aa, Entamoeba histolytica
SVQQSIRTNNSSITLQ

SEQ ID NO: 2659648 - protein, 7 aa, Entamoeba histolytica
SVQTTLN

SEQ ID NO: 2659649 - protein, 6 aa, Entamoeba histolytica
SVRDPI

SEQ ID NO: 2659650 - protein, 8 aa, Entamoeba histolytica
SVREKESI

SEQ ID NO: 2659651 - protein, 11 aa, Entamoeba histolytica
SVRGGADSYVS

SEQ ID NO: 2659652 - protein, 7 aa, Entamoeba histolytica
SVRNSSY

SEQ ID NO: 2659653 - protein, 7 aa, Entamoeba histolytica
SVRTAQD

SEQ ID NO: 2659654 - protein, 4 aa, Entamoeba histolytica
SVSA

SEQ ID NO: 2659655 - protein, 10 aa, Entamoeba histolytica
SVSAAEGETW

SEQ ID NO: 2659656 - protein, 9 aa, Entamoeba histolytica
SVSADPEDM

SEQ ID NO: 2659657 - protein, 6 aa, Entamoeba histolytica
SVSADV

SEQ ID NO: 2659658 - protein, 49 aa, Entamoeba histolytica
SVSDSSSSTLPSSSVTTSAPISAQPKEEEPVTLTKPQSSNNEPQEAGGC

SEQ ID NO: 2659659 - protein, 5 aa, Entamoeba histolytica
SVSEI

SEQ ID NO: 2659660 - protein, 4 aa, Entamoeba histolytica
SVSI

SEQ ID NO: 2659661 - protein, 8 aa, Entamoeba histolytica
SVSKEDQE

SEQ ID NO: 2659662 - protein, 7 aa, Entamoeba histolytica
SVSKGWK

SEQ ID NO: 2659663 - protein, 7 aa, Entamoeba histolytica
SVSKTDL

SEQ ID NO: 2659664 - protein, 9 aa, Entamoeba histolytica
SVSLKGSET

SEQ ID NO: 2659665 - protein, 14 aa, Entamoeba histolytica
SVSNSKTQETPKKK

SEQ ID NO: 2659666 - protein, 6 aa, Entamoeba histolytica
SVSPFP

SEQ ID NO: 2659667 - protein, 7 aa, Entamoeba histolytica
SVSQTSQ

SEQ ID NO: 2659668 - protein, 11 aa, Entamoeba histolytica
SVSSEKVSGKE

SEQ ID NO: 2659669 - protein, 10 aa, Entamoeba histolytica
SVSSSTTNSL

SEQ ID NO: 2659670 - protein, 9 aa, Entamoeba histolytica
SVSTDSDGN

SEQ ID NO: 2659671 - protein, 7 aa, Entamoeba histolytica
SVSTLPA

SEQ ID NO: 2659672 - protein, 22 aa, Entamoeba histolytica
SVSTPIPERSIKPLPKNITSHS

SEQ ID NO: 2659673 - protein, 8 aa, Entamoeba histolytica
SVSTPVKG

SEQ ID NO: 2659674 - protein, 4 aa, Entamoeba histolytica
SVSY

SEQ ID NO: 2659675 - protein, 8 aa, Entamoeba histolytica
SVTEKGER

SEQ ID NO: 2659676 - protein, 5 aa, Entamoeba histolytica
SVTEM

SEQ ID NO: 2659677 - protein, 13 aa, Entamoeba histolytica
SVTFRKSKRTKQT

SEQ ID NO: 2659678 - protein, 5 aa, Entamoeba histolytica
SVTGK

SEQ ID NO: 2659679 - protein, 6 aa, Entamoeba histolytica
SVTGKK

SEQ ID NO: 2659680 - protein, 15 aa, Entamoeba histolytica
SVTKPFKDHSYTPSI

SEQ ID NO: 2659681 - protein, 11 aa, Entamoeba histolytica
SVTKVESGEVV

SEQ ID NO: 2659682 - protein, 15 aa, Entamoeba histolytica
SVTPGYVSGDVRGKK

SEQ ID NO: 2659683 - protein, 20 aa, Entamoeba histolytica
SVTPKKSKPFIPPKNNEERI

SEQ ID NO: 2659684 - protein, 8 aa, Entamoeba histolytica
SVTPKLKY

SEQ ID NO: 2659685 - protein, 27 aa, Entamoeba histolytica
SVTPPLDSYEDQMKDSEEDEQKKQKKA

SEQ ID NO: 2659686 - protein, 6 aa, Entamoeba histolytica
SVTQQK

SEQ ID NO: 2659687 - protein, 10 aa, Entamoeba histolytica
SVTSKTNHLS

SEQ ID NO: 2659688 - protein, 15 aa, Entamoeba histolytica
SVTSRDKKSDLVEKA

SEQ ID NO: 2659689 - protein, 10 aa, Entamoeba histolytica
SVTTQSSSGS

SEQ ID NO: 2659690 - protein, 10 aa, Entamoeba histolytica
SVVGSDVKRE

SEQ ID NO: 2659691 - protein, 12 aa, Entamoeba histolytica
SVYEEKSEQDGC

SEQ ID NO: 2659692 - protein, 9 aa, Entamoeba histolytica
SVYPQSEDT

SEQ ID NO: 2659693 - protein, 20 aa, Entamoeba histolytica
SVYPQTNKNNDQDIKHLPDG

SEQ ID NO: 2659694 - protein, 5 aa, Entamoeba histolytica
SVYQQ

SEQ ID NO: 2659695 - protein, 7 aa, Entamoeba histolytica
SVYTATG

SEQ ID NO: 2659696 - protein, 12 aa, Entamoeba histolytica
SWGTKEGGGYKN

SEQ ID NO: 2659697 - protein, 8 aa, Entamoeba histolytica
SWKNEESL

SEQ ID NO: 2659698 - protein, 9 aa, Entamoeba histolytica
SWKNKNNCP

SEQ ID NO: 2659699 - protein, 5 aa, Entamoeba histolytica
SWNRV

SEQ ID NO: 2659700 - protein, 4 aa, Entamoeba histolytica
SWPA

SEQ ID NO: 2659701 - protein, 4 aa, Entamoeba histolytica
SWQQ

SEQ ID NO: 2659702 - protein, 9 aa, Entamoeba histolytica
SWQQEPKER

SEQ ID NO: 2659703 - protein, 10 aa, Entamoeba histolytica
SWQQEPKERI

SEQ ID NO: 2659704 - protein, 8 aa, Entamoeba histolytica
SWSENDES

SEQ ID NO: 2659705 - protein, 6 aa, Entamoeba histolytica
SWSPDG

SEQ ID NO: 2659706 - protein, 5 aa, Entamoeba histolytica
SWSPK

SEQ ID NO: 2659707 - protein, 7 aa, Entamoeba histolytica
SWTGKRD

SEQ ID NO: 2659708 - protein, 9 aa, Entamoeba histolytica
SYANHTDSV

SEQ ID NO: 2659709 - protein, 14 aa, Entamoeba histolytica
SYATDKYDGKTGEC

SEQ ID NO: 2659710 - protein, 5 aa, Entamoeba histolytica
SYCQP

SEQ ID NO: 2659711 - protein, 10 aa, Entamoeba histolytica
SYCSSSRSHH

SEQ ID NO: 2659712 - protein, 9 aa, Entamoeba histolytica
SYCSSTKEL

SEQ ID NO: 2659713 - protein, 11 aa, Entamoeba histolytica
SYDDSKPKQKK

SEQ ID NO: 2659714 - protein, 7 aa, Entamoeba histolytica
SYDETNA

SEQ ID NO: 2659715 - protein, 5 aa, Entamoeba histolytica
SYDGK

SEQ ID NO: 2659716 - protein, 6 aa, Entamoeba histolytica
SYDKTA

SEQ ID NO: 2659717 - protein, 8 aa, Entamoeba histolytica
SYDNKKTI

SEQ ID NO: 2659718 - protein, 10 aa, Entamoeba histolytica
SYDRSSTSNF

SEQ ID NO: 2659719 - protein, 5 aa, Entamoeba histolytica
SYDTT

SEQ ID NO: 2659720 - protein, 12 aa, Entamoeba histolytica
SYDYSLDSKEVS

SEQ ID NO: 2659721 - protein, 8 aa, Entamoeba histolytica
SYEDPFTQ

SEQ ID NO: 2659722 - protein, 5 aa, Entamoeba histolytica
SYEKK

SEQ ID NO: 2659723 - protein, 5 aa, Entamoeba histolytica
SYEKN

SEQ ID NO: 2659724 - protein, 9 aa, Entamoeba histolytica
SYEKSSQCQ

SEQ ID NO: 2659725 - protein, 6 aa, Entamoeba histolytica
SYENPT

SEQ ID NO: 2659726 - protein, 22 aa, Entamoeba histolytica
SYENSTKMKTQQQESVQGLTEE

SEQ ID NO: 2659727 - protein, 10 aa, Entamoeba histolytica
SYERKTTSPL

SEQ ID NO: 2659728 - protein, 5 aa, Entamoeba histolytica
SYERP

SEQ ID NO: 2659729 - protein, 6 aa, Entamoeba histolytica
SYESAS

SEQ ID NO: 2659730 - protein, 9 aa, Entamoeba histolytica
SYESVNGKL

SEQ ID NO: 2659731 - protein, 7 aa, Entamoeba histolytica
SYESYRS

SEQ ID NO: 2659732 - protein, 7 aa, Entamoeba histolytica
SYFGRKE

SEQ ID NO: 2659733 - protein, 6 aa, Entamoeba histolytica
SYGEIE

SEQ ID NO: 2659734 - protein, 4 aa, Entamoeba histolytica
SYGF

SEQ ID NO: 2659735 - protein, 4 aa, Entamoeba histolytica
SYGI

SEQ ID NO: 2659736 - protein, 16 aa, Entamoeba histolytica
SYGIEMSSTNNDRSTF

SEQ ID NO: 2659737 - protein, 4 aa, Entamoeba histolytica
SYGL

SEQ ID NO: 2659738 - protein, 8 aa, Entamoeba histolytica
SYGNPSHP

SEQ ID NO: 2659739 - protein, 8 aa, Entamoeba histolytica
SYGPRTLT

SEQ ID NO: 2659740 - protein, 13 aa, Entamoeba histolytica
SYGRAGAKIDYTG

SEQ ID NO: 2659741 - protein, 13 aa, Entamoeba histolytica
SYGRGDTRKDNDI

SEQ ID NO: 2659742 - protein, 6 aa, Entamoeba histolytica
SYGSSY

SEQ ID NO: 2659743 - protein, 5 aa, Entamoeba histolytica
SYGTD

SEQ ID NO: 2659744 - protein, 7 aa, Entamoeba histolytica
SYGYPST

SEQ ID NO: 2659745 - protein, 27 aa, Entamoeba histolytica
SYHPKAKTTQPEPQAAPAPSGSDVFDF

SEQ ID NO: 2659746 - protein, 7 aa, Entamoeba histolytica
SYHPSTS

SEQ ID NO: 2659747 - protein, 7 aa, Entamoeba histolytica
SYHSNPF

SEQ ID NO: 2659748 - protein, 4 aa, Entamoeba histolytica
SYIG

SEQ ID NO: 2659749 - protein, 13 aa, Entamoeba histolytica
SYKEDDDTPVTTR

SEQ ID NO: 2659750 - protein, 7 aa, Entamoeba histolytica
SYKESWN

SEQ ID NO: 2659751 - protein, 6 aa, Entamoeba histolytica
SYKGNL

SEQ ID NO: 2659752 - protein, 5 aa, Entamoeba histolytica
SYKGT

SEQ ID NO: 2659753 - protein, 13 aa, Entamoeba histolytica
SYKKKRKNNNMET

SEQ ID NO: 2659754 - protein, 8 aa, Entamoeba histolytica
SYKKPTSW

SEQ ID NO: 2659755 - protein, 10 aa, Entamoeba histolytica
SYKKQNDNLE

SEQ ID NO: 2659756 - protein, 7 aa, Entamoeba histolytica
SYKNENQ

SEQ ID NO: 2659757 - protein, 19 aa, Entamoeba histolytica
SYKQAEELRKKAKQTEESK

SEQ ID NO: 2659758 - protein, 26 aa, Entamoeba histolytica
SYKQAEHSCSKAKKTKQDKKEQIPQM

SEQ ID NO: 2659759 - protein, 9 aa, Entamoeba histolytica
SYKQEDLTH

SEQ ID NO: 2659760 - protein, 9 aa, Entamoeba histolytica
SYKQGNGSV

SEQ ID NO: 2659761 - protein, 7 aa, Entamoeba histolytica
SYKQQNK

SEQ ID NO: 2659762 - protein, 6 aa, Entamoeba histolytica
SYKRTP

SEQ ID NO: 2659763 - protein, 8 aa, Entamoeba histolytica
SYKSATTP

SEQ ID NO: 2659764 - protein, 4 aa, Entamoeba histolytica
SYLE

SEQ ID NO: 2659765 - protein, 4 aa, Entamoeba histolytica
SYLP

SEQ ID NO: 2659766 - protein, 12 aa, Entamoeba histolytica
SYLPSRDKAPKM

SEQ ID NO: 2659767 - protein, 11 aa, Entamoeba histolytica
SYLRGGGGVDG

SEQ ID NO: 2659768 - protein, 14 aa, Entamoeba histolytica
SYLTEKNRADGPPI

SEQ ID NO: 2659769 - protein, 21 aa, Entamoeba histolytica
SYNEKKPKQFKKHQKQSKRYT

SEQ ID NO: 2659770 - protein, 34 aa, Entamoeba histolytica
SYNENKSNTVGANRKSSEIDSESYEPKKKTQTIE

SEQ ID NO: 2659771 - protein, 10 aa, Entamoeba histolytica
SYNEQGRKTV

SEQ ID NO: 2659772 - protein, 26 aa, Entamoeba histolytica
SYNGASNKREYSEFPIDPDKQYEEEE

SEQ ID NO: 2659773 - protein, 13 aa, Entamoeba histolytica
SYNGTNKSANYPK

SEQ ID NO: 2659774 - protein, 13 aa, Entamoeba histolytica
SYNKSEKTKEETL

SEQ ID NO: 2659775 - protein, 7 aa, Entamoeba histolytica
SYNPEEQ

SEQ ID NO: 2659776 - protein, 21 aa, Entamoeba histolytica
SYNPNEQIQTQTLPEPNIPES

SEQ ID NO: 2659777 - protein, 11 aa, Entamoeba histolytica
SYNSTNTSNTS

SEQ ID NO: 2659778 - protein, 4 aa, Entamoeba histolytica
SYPA

SEQ ID NO: 2659779 - protein, 5 aa, Entamoeba histolytica
SYPEL

SEQ ID NO: 2659780 - protein, 7 aa, Entamoeba histolytica
SYPIEQE

SEQ ID NO: 2659781 - protein, 4 aa, Entamoeba histolytica
SYPK

SEQ ID NO: 2659782 - protein, 7 aa, Entamoeba histolytica
SYPKGLQ

SEQ ID NO: 2659783 - protein, 16 aa, Entamoeba histolytica
SYPKTTLRNKNEKKTL

SEQ ID NO: 2659784 - protein, 4 aa, Entamoeba histolytica
SYPM

SEQ ID NO: 2659785 - protein, 4 aa, Entamoeba histolytica
SYPN

SEQ ID NO: 2659786 - protein, 9 aa, Entamoeba histolytica
SYPNEETQR

SEQ ID NO: 2659787 - protein, 4 aa, Entamoeba histolytica
SYPQ

SEQ ID NO: 2659788 - protein, 9 aa, Entamoeba histolytica
SYPQDDGTY

SEQ ID NO: 2659789 - protein, 7 aa, Entamoeba histolytica
SYPQEKI

SEQ ID NO: 2659790 - protein, 15 aa, Entamoeba histolytica
SYPSFKNSSCTDDDA

SEQ ID NO: 2659791 - protein, 6 aa, Entamoeba histolytica
SYPTAP

SEQ ID NO: 2659792 - protein, 7 aa, Entamoeba histolytica
SYPTNDP

SEQ ID NO: 2659793 - protein, 4 aa, Entamoeba histolytica
SYQF

SEQ ID NO: 2659794 - protein, 15 aa, Entamoeba histolytica
SYQKEGKSSLKAPSS

SEQ ID NO: 2659795 - protein, 25 aa, Entamoeba histolytica
SYQPPTQPPQYQSYGQSQYSGAPPM

SEQ ID NO: 2659796 - protein, 30 aa, Entamoeba histolytica; identical to SEQ ID NO: 2464622

SEQ ID NO: 2659797 - protein, 14 aa, Entamoeba histolytica
SYQQFNDPQIKEEN

SEQ ID NO: 2659798 - protein, 12 aa, Entamoeba histolytica
SYQTATSSMNEE

SEQ ID NO: 2659799 - protein, 4 aa, Entamoeba histolytica
SYRD

SEQ ID NO: 2659800 - protein, 24 aa, Entamoeba histolytica
SYREPTLDKSMNKKRVSNENKTLQ

SEQ ID NO: 2659801 - protein, 5 aa, Entamoeba histolytica
SYREY

SEQ ID NO: 2659802 - protein, 5 aa, Entamoeba histolytica
SYRGD

SEQ ID NO: 2659803 - protein, 7 aa, Entamoeba histolytica
SYRNGKI

SEQ ID NO: 2659804 - protein, 7 aa, Entamoeba histolytica
SYRPYQA

SEQ ID NO: 2659805 - protein, 6 aa, Entamoeba histolytica
SYRSSL

SEQ ID NO: 2659806 - protein, 4 aa, Entamoeba histolytica
SYSD

SEQ ID NO: 2659807 - protein, 5 aa, Entamoeba histolytica
SYSEE

SEQ ID NO: 2659808 - protein, 10 aa, Entamoeba histolytica
SYSEENPRKA

SEQ ID NO: 2659809 - protein, 6 aa, Entamoeba histolytica
SYSGAP

SEQ ID NO: 2659810 - protein, 4 aa, Entamoeba histolytica
SYSK

SEQ ID NO: 2659811 - protein, 5 aa, Entamoeba histolytica
SYSKE

SEQ ID NO: 2659812 - protein, 6 aa, Entamoeba histolytica
SYSPNI

SEQ ID NO: 2659813 - protein, 15 aa, Entamoeba histolytica
SYSPSNESNENSSLS

SEQ ID NO: 2659814 - protein, 11 aa, Entamoeba histolytica
SYSQLKETNVN

SEQ ID NO: 2659815 - protein, 5 aa, Entamoeba histolytica
SYSRN

SEQ ID NO: 2659816 - protein, 13 aa, Entamoeba histolytica
SYSSGKNNSKKMQ

SEQ ID NO: 2659817 - protein, 5 aa, Entamoeba histolytica
SYSSL

SEQ ID NO: 2659818 - protein, 6 aa, Entamoeba histolytica
SYSSPY

SEQ ID NO: 2659819 - protein, 15 aa, Entamoeba histolytica
SYSSSKKQHNSNSQL

SEQ ID NO: 2659820 - protein, 9 aa, Entamoeba histolytica
SYSSTINST

SEQ ID NO: 2659821 - protein, 4 aa, Entamoeba histolytica
SYST

SEQ ID NO: 2659822 - protein, 9 aa, Entamoeba histolytica
SYSTGNGKF

SEQ ID NO: 2659823 - protein, 15 aa, Entamoeba histolytica
SYSTGSVRDPEEKSI

SEQ ID NO: 2659824 - protein, 21 aa, Entamoeba histolytica
SYSTSEENDRRRSRSRSHHRR

SEQ ID NO: 2659825 - protein, 6 aa, Entamoeba histolytica
SYSTSN

SEQ ID NO: 2659826 - protein, 7 aa, Entamoeba histolytica
SYSTSNS

SEQ ID NO: 2659827 - protein, 6 aa, Entamoeba histolytica
SYTEPL

SEQ ID NO: 2659828 - protein, 12 aa, Entamoeba histolytica
SYTGEKISEEDI

SEQ ID NO: 2659829 - protein, 16 aa, Entamoeba histolytica
SYTKSDEEATTNSEEC

SEQ ID NO: 2659830 - protein, 9 aa, Entamoeba histolytica
SYTNQPEIS

SEQ ID NO: 2659831 - protein, 13 aa, Entamoeba histolytica
SYTPNEKRRSKTG

SEQ ID NO: 2659832 - protein, 5 aa, Entamoeba histolytica
SYTPS

SEQ ID NO: 2659833 - protein, 11 aa, Entamoeba histolytica
SYTPSSYKTEN

SEQ ID NO: 2659834 - protein, 13 aa, Entamoeba histolytica
SYTRNTNELRQPT

SEQ ID NO: 2659835 - protein, 9 aa, Entamoeba histolytica
SYTTRTGDI

SEQ ID NO: 2659836 - protein, 12 aa, Entamoeba histolytica
SYVNKQNMNGET

SEQ ID NO: 2659837 - protein, 9 aa, Entamoeba histolytica
SYVSKEASK

SEQ ID NO: 2659838 - protein, 10 aa, Entamoeba histolytica
SYYAPSGQGF

SEQ ID NO: 2659839 - protein, 10 aa, Entamoeba histolytica
SYYNSKDEEF

SEQ ID NO: 2659840 - protein, 4 aa, Entamoeba histolytica
SYYR

SEQ ID NO: 2659841 - protein, 6 aa, Entamoeba histolytica
SYYRGS

SEQ ID NO: 2659842 - protein, 6 aa, Entamoeba histolytica
SYYRNA

SEQ ID NO: 2659843 - protein, 15 aa, Entamoeba histolytica
SYYSDKNYPKRRTME

SEQ ID NO: 2659844 - protein, 64 aa, Entamoeba histolytica; identical to SEQ ID NO: 2464676

SEQ ID NO: 2659845 - protein, 8 aa, Entamoeba histolytica
TAADPEIL

SEQ ID NO: 2659846 - protein, 7 aa, Entamoeba histolytica
TAAEKSI

SEQ ID NO: 2659847 - protein, 8 aa, Entamoeba histolytica
TAANQPEM

SEQ ID NO: 2659848 - protein, 35 aa, Entamoeba histolytica
TAANSSGTVAYYLYLMDKKQVLKIDNLTGDVNVIK

SEQ ID NO: 2659849 - protein, 44 aa, Entamoeba histolytica
TAAPVAAAAPAAAVAASETETKEEKKEDKKEEEEEEDFGGFGDL

SEQ ID NO: 2659850 - protein, 12 aa, Entamoeba histolytica
TAAYTKDLENGE

SEQ ID NO: 2659851 - protein, 5 aa, Entamoeba histolytica
TACET

SEQ ID NO: 2659852 - protein, 4 aa, Entamoeba histolytica
TADG

SEQ ID NO: 2659853 - protein, 9 aa, Entamoeba histolytica
TADGSARVR

SEQ ID NO: 2659854 - protein, 8 aa, Entamoeba histolytica
TADISDAA

SEQ ID NO: 2659855 - protein, 4 aa, Entamoeba histolytica
TADK

SEQ ID NO: 2659856 - protein, 13 aa, Entamoeba histolytica
TAEAESELTITEG

SEQ ID NO: 2659857 - protein, 8 aa, Entamoeba histolytica
TAEDDEVK

SEQ ID NO: 2659858 - protein, 5 aa, Entamoeba histolytica
TAEDI

SEQ ID NO: 2659859 - protein, 5 aa, Entamoeba histolytica
TAEEE

SEQ ID NO: 2659860 - protein, 60 aa, Entamoeba histolytica
TAEEIEKKKRREEMKKAKNAAKNEKFKKKQEAQQQQQQKNNLGKAKKENKKQTKEKEEIK

SEQ ID NO: 2659861 - protein, 12 aa, Entamoeba histolytica
TAEELEVQSNEM

SEQ ID NO: 2659862 - protein, 9 aa, Entamoeba histolytica
TAEEQKKAI

SEQ ID NO: 2659863 - protein, 6 aa, Entamoeba histolytica
TAEGKD

SEQ ID NO: 2659864 - protein, 10 aa, Entamoeba histolytica
TAEHSCGTEQ

SEQ ID NO: 2659865 - protein, 7 aa, Entamoeba histolytica
TAEISNE

SEQ ID NO: 2659866 - protein, 12 aa, Entamoeba histolytica
TAEKASNNVPHV

SEQ ID NO: 2659867 - protein, 5 aa, Entamoeba histolytica
TAEKE

SEQ ID NO: 2659868 - protein, 6 aa, Entamoeba histolytica
TAEKID

SEQ ID NO: 2659869 - protein, 15 aa, Entamoeba histolytica
TAENEETAKRSEEIA

SEQ ID NO: 2659870 - protein, 4 aa, Entamoeba histolytica
TAEQ

SEQ ID NO: 2659871 - protein, 10 aa, Entamoeba histolytica
TAEQQKKAIA

SEQ ID NO: 2659872 - protein, 17 aa, Entamoeba histolytica
TAERKKEIQEKRQVSQL

SEQ ID NO: 2659873 - protein, 5 aa, Entamoeba histolytica
TAESS

SEQ ID NO: 2659874 - protein, 5 aa, Entamoeba histolytica
TAFDG

SEQ ID NO: 2659875 - protein, 7 aa, Entamoeba histolytica
TAFRGNA

SEQ ID NO: 2659876 - protein, 6 aa, Entamoeba histolytica
TAGAKR

SEQ ID NO: 2659877 - protein, 5 aa, Entamoeba histolytica
TAGDL

SEQ ID NO: 2659878 - protein, 9 aa, Entamoeba histolytica
TAGEEKYRS

SEQ ID NO: 2659879 - protein, 8 aa, Entamoeba histolytica
TAGGKDYH

SEQ ID NO: 2659880 - protein, 7 aa, Entamoeba histolytica
TAGIPSP

SEQ ID NO: 2659881 - protein, 8 aa, Entamoeba histolytica
TAGKTNRK

SEQ ID NO: 2659882 - protein, 4 aa, Entamoeba histolytica
TAGL

SEQ ID NO: 2659883 - protein, 8 aa, Entamoeba histolytica
TAGNTHRL

SEQ ID NO: 2659884 - protein, 8 aa, Entamoeba histolytica
TAGPDRYS

SEQ ID NO: 2659885 - protein, 14 aa, Entamoeba histolytica
TAGPKTIEEPTNYK

SEQ ID NO: 2659886 - protein, 17 aa, Entamoeba histolytica
TAGPQANPSLVAPTRGV

SEQ ID NO: 2659887 - protein, 7 aa, Entamoeba histolytica
TAGQDEF

SEQ ID NO: 2659888 - protein, 8 aa, Entamoeba histolytica
TAGQEEFD

SEQ ID NO: 2659889 - protein, 8 aa, Entamoeba histolytica
TAGQEEYA

SEQ ID NO: 2659890 - protein, 9 aa, Entamoeba histolytica
TAGQEEYDQ

SEQ ID NO: 2659891 - protein, 9 aa, Entamoeba histolytica
TAGQEEYES

SEQ ID NO: 2659892 - protein, 9 aa, Entamoeba histolytica
TAGQEEYNS

SEQ ID NO: 2659893 - protein, 10 aa, Entamoeba histolytica
TAGQEEYNSL

SEQ ID NO: 2659894 - protein, 10 aa, Entamoeba histolytica
TAGQEEYSSL

SEQ ID NO: 2659895 - protein, 6 aa, Entamoeba histolytica
TAGQEK

SEQ ID NO: 2659896 - protein, 7 aa, Entamoeba histolytica
TAGQEKF

SEQ ID NO: 2659897 - protein, 8 aa, Entamoeba histolytica
TAGQEKFR

SEQ ID NO: 2659898 - protein, 14 aa, Entamoeba histolytica
TAGQEKFRSTTKSY

SEQ ID NO: 2659899 - protein, 7 aa, Entamoeba histolytica
TAGQEKY

SEQ ID NO: 2659900 - protein, 9 aa, Entamoeba histolytica
TAGQEKYRA

SEQ ID NO: 2659901 - protein, 8 aa, Entamoeba histolytica
TAGQEKYS

SEQ ID NO: 2659902 - protein, 6 aa, Entamoeba histolytica
TAGQER

SEQ ID NO: 2659903 - protein, 8 aa, Entamoeba histolytica
TAGREEYQ

SEQ ID NO: 2659904 - protein, 12 aa, Entamoeba histolytica
TAGRGRGKSAAL

SEQ ID NO: 2659905 - protein, 6 aa, Entamoeba histolytica
TAGSEK

SEQ ID NO: 2659906 - protein, 9 aa, Entamoeba histolytica
TAGSEKFRS

SEQ ID NO: 2659907 - protein, 7 aa, Entamoeba histolytica
TAGSERF

SEQ ID NO: 2659908 - protein, 6 aa, Entamoeba histolytica
TAHENM

SEQ ID NO: 2659909 - protein, 5 aa, Entamoeba histolytica
TAHVQ

SEQ ID NO: 2659910 - protein, 12 aa, Entamoeba histolytica
TAINTNAGLNDE

SEQ ID NO: 2659911 - protein, 25 aa, Entamoeba histolytica
TAIPNNSNKSFSKRTLDNSASSPII

SEQ ID NO: 2659912 - protein, 9 aa, Entamoeba histolytica
TAIPSSSEY

SEQ ID NO: 2659913 - protein, 6 aa, Entamoeba histolytica
TAKAPS

SEQ ID NO: 2659914 - protein, 15 aa, Entamoeba histolytica
TAKDESEKQRMKSKG

SEQ ID NO: 2659915 - protein, 10 aa, Entamoeba histolytica
TAKDGSQSRT

SEQ ID NO: 2659916 - protein, 10 aa, Entamoeba histolytica
TAKDKKSMQY

SEQ ID NO: 2659917 - protein, 11 aa, Entamoeba histolytica
TAKDNTTKSRI

SEQ ID NO: 2659918 - protein, 15 aa, Entamoeba histolytica
TAKDPEKASNKKAQW

SEQ ID NO: 2659919 - protein, 13 aa, Entamoeba histolytica
TAKDSGNYLKENS

SEQ ID NO: 2659920 - protein, 6 aa, Entamoeba histolytica
TAKEYN

SEQ ID NO: 2659921 - protein, 10 aa, Entamoeba histolytica
TAKGEELKNR

SEQ ID NO: 2659922 - protein, 7 aa, Entamoeba histolytica
TAKGTGC

SEQ ID NO: 2659923 - protein, 7 aa, Entamoeba histolytica
TAKKEGL

SEQ ID NO: 2659924 - protein, 13 aa, Entamoeba histolytica
TAKKQSDADLEEL

SEQ ID NO: 2659925 - protein, 9 aa, Entamoeba histolytica
TAKKTGEWE

SEQ ID NO: 2659926 - protein, 7 aa, Entamoeba histolytica
TAKMGSN

SEQ ID NO: 2659927 - protein, 10 aa, Entamoeba histolytica
TAKQEEELKN

SEQ ID NO: 2659928 - protein, 20 aa, Entamoeba histolytica
TAKQQKEITQKMKKDKDNYI

SEQ ID NO: 2659929 - protein, 5 aa, Entamoeba histolytica
TAKRE

SEQ ID NO: 2659930 - protein, 14 aa, Entamoeba histolytica
TAKRRYQTNKKTDG

SEQ ID NO: 2659931 - protein, 11 aa, Entamoeba histolytica
TALGNGPIKKK

SEQ ID NO: 2659932 - protein, 12 aa, Entamoeba histolytica
TALNEREQQEMK

SEQ ID NO: 2659933 - protein, 9 aa, Entamoeba histolytica
TALSRTNKQ

SEQ ID NO: 2659934 - protein, 7 aa, Entamoeba histolytica
TALSSSN

SEQ ID NO: 2659935 - protein, 7 aa, Entamoeba histolytica
TALTKEK

SEQ ID NO: 2659936 - protein, 11 aa, Entamoeba histolytica
TAMTEKNINEM

SEQ ID NO: 2659937 - protein, 8 aa, Entamoeba histolytica
TANDPFEE

SEQ ID NO: 2659938 - protein, 8 aa, Entamoeba histolytica
TANEEGNE

SEQ ID NO: 2659939 - protein, 9 aa, Entamoeba histolytica
TANNTLKKS

SEQ ID NO: 2659940 - protein, 42 aa, Entamoeba histolytica
TANPSTKQSNPLTSELSPSLSTQKTQEISNTNNVKQNISKDV

SEQ ID NO: 2659941 - protein, 7 aa, Entamoeba histolytica
TANPTWA

SEQ ID NO: 2659942 - protein, 6 aa, Entamoeba histolytica
TANQAV

SEQ ID NO: 2659943 - protein, 7 aa, Entamoeba histolytica
TANQNVE

SEQ ID NO: 2659944 - protein, 12 aa, Entamoeba histolytica
TANSGQSDDIRK

SEQ ID NO: 2659945 - protein, 7 aa, Entamoeba histolytica
TANTTLN

SEQ ID NO: 2659946 - protein, 6 aa, Entamoeba histolytica
TAPDNT

SEQ ID NO: 2659947 - protein, 13 aa, Entamoeba histolytica
TAPEAGDPNSPSY

SEQ ID NO: 2659948 - protein, 9 aa, Entamoeba histolytica
TAPGGSSSY

SEQ ID NO: 2659949 - protein, 16 aa, Entamoeba histolytica
TAPKVTSQKERPFKFL

SEQ ID NO: 2659950 - protein, 7 aa, Entamoeba histolytica
TAPPEEE

SEQ ID NO: 2659951 - protein, 8 aa, Entamoeba histolytica
TAPQNEID

SEQ ID NO: 2659952 - protein, 14 aa, Entamoeba histolytica
TAPTLVPNKIESPL

SEQ ID NO: 2659953 - protein, 7 aa, Entamoeba histolytica
TAPTTEL

SEQ ID NO: 2659954 - protein, 35 aa, Entamoeba histolytica; identical to SEQ ID NO: 2464788

SEQ ID NO: 2659955 - protein, 34 aa, Entamoeba histolytica
TAPVGPDAYEAGYRGVSSDAAGPMASKGTWEATT

SEQ ID NO: 2659956 - protein, 14 aa, Entamoeba histolytica
TAQEFQDMDEQQRS

SEQ ID NO: 2659957 - protein, 8 aa, Entamoeba histolytica
TAQEQAGD

SEQ ID NO: 2659958 - protein, 5 aa, Entamoeba histolytica
TAQET

SEQ ID NO: 2659959 - protein, 13 aa, Entamoeba histolytica
TAQKSTPEEKKSC

SEQ ID NO: 2659960 - protein, 11 aa, Entamoeba histolytica
TAQNSLKTEIE

SEQ ID NO: 2659961 - protein, 8 aa, Entamoeba histolytica
TAQNTQTY

SEQ ID NO: 2659962 - protein, 7 aa, Entamoeba histolytica
TAQPNEI

SEQ ID NO: 2659963 - protein, 37 aa, Entamoeba histolytica
TAQPYSSTSKPPPRPINRNNQPLSKSSGGTQTTPVIP

SEQ ID NO: 2659964 - protein, 9 aa, Entamoeba histolytica
TAQQENQGN

SEQ ID NO: 2659965 - protein, 5 aa, Entamoeba histolytica
TAQST

SEQ ID NO: 2659966 - protein, 12 aa, Entamoeba histolytica
TAQTDEPSNHTD

SEQ ID NO: 2659967 - protein, 6 aa, Entamoeba histolytica
TAQYKA

SEQ ID NO: 2659968 - protein, 12 aa, Entamoeba histolytica
TAQYKGIFEHNY

SEQ ID NO: 2659969 - protein, 9 aa, Entamoeba histolytica
TARIGRNGN

SEQ ID NO: 2659970 - protein, 8 aa, Entamoeba histolytica
TARKNKPS

SEQ ID NO: 2659971 - protein, 6 aa, Entamoeba histolytica
TARMGS

SEQ ID NO: 2659972 - protein, 6 aa, Entamoeba histolytica
TARQTL

SEQ ID NO: 2659973 - protein, 9 aa, Entamoeba histolytica
TARSDQIPY

SEQ ID NO: 2659974 - protein, 7 aa, Entamoeba histolytica
TASADRT

SEQ ID NO: 2659975 - protein, 6 aa, Entamoeba histolytica
TASDEA

SEQ ID NO: 2659976 - protein, 7 aa, Entamoeba histolytica
TASEKEC

SEQ ID NO: 2659977 - protein, 5 aa, Entamoeba histolytica
TASEM

SEQ ID NO: 2659978 - protein, 7 aa, Entamoeba histolytica
TASEQSN

SEQ ID NO: 2659979 - protein, 9 aa, Entamoeba histolytica
TASGKSTVA

SEQ ID NO: 2659980 - protein, 5 aa, Entamoeba histolytica
TASGN

SEQ ID NO: 2659981 - protein, 7 aa, Entamoeba histolytica
TASGTTA

SEQ ID NO: 2659982 - protein, 8 aa, Entamoeba histolytica
TASKECNE

SEQ ID NO: 2659983 - protein, 10 aa, Entamoeba histolytica
TASKRGLNYK

SEQ ID NO: 2659984 - protein, 7 aa, Entamoeba histolytica
TASNFGI

SEQ ID NO: 2659985 - protein, 6 aa, Entamoeba histolytica
TASPEL

SEQ ID NO: 2659986 - protein, 10 aa, Entamoeba histolytica
TASRGRLSHD

SEQ ID NO: 2659987 - protein, 17 aa, Entamoeba histolytica
TASSDRSARISTAESGK

SEQ ID NO: 2659988 - protein, 11 aa, Entamoeba histolytica
TASSQDPTTPL

SEQ ID NO: 2659989 - protein, 5 aa, Entamoeba histolytica
TASTG

SEQ ID NO: 2659990 - protein, 18 aa, Entamoeba histolytica
TASTNSISYSTSEIPEIN

SEQ ID NO: 2659991 - protein, 4 aa, Entamoeba histolytica
TATC

SEQ ID NO: 2659992 - protein, 5 aa, Entamoeba histolytica
TATCH

SEQ ID NO: 2659993 - protein, 4 aa, Entamoeba histolytica
TATD

SEQ ID NO: 2659994 - protein, 6 aa, Entamoeba histolytica
TATDGS

SEQ ID NO: 2659995 - protein, 5 aa, Entamoeba histolytica
TATGS

SEQ ID NO: 2659996 - protein, 9 aa, Entamoeba histolytica
TATKATKYF

SEQ ID NO: 2659997 - protein, 5 aa, Entamoeba histolytica
TATNV

SEQ ID NO: 2659998 - protein, 10 aa, Entamoeba histolytica
TATPGSENSL

SEQ ID NO: 2659999 - protein, 10 aa, Entamoeba histolytica
TATPKVTADT

SEQ ID NO: 2660000 - protein, 6 aa, Entamoeba histolytica
TATPMN

SEQ ID NO: 2660001 - protein, 5 aa, Entamoeba histolytica
TATPV

SEQ ID NO: 2660002 - protein, 5 aa, Entamoeba histolytica
TATQE

SEQ ID NO: 2660003 - protein, 8 aa, Entamoeba histolytica
TATRGEDK

SEQ ID NO: 2660004 - protein, 8 aa, Entamoeba histolytica
TATSHPSQ

SEQ ID NO: 2660005 - protein, 8 aa, Entamoeba histolytica
TATSSSTL

SEQ ID NO: 2660006 - protein, 17 aa, Entamoeba histolytica
TATTRVKTCGDSNCEGK

SEQ ID NO: 2660007 - protein, 4 aa, Entamoeba histolytica
TATY

SEQ ID NO: 2660008 - protein, 5 aa, Entamoeba histolytica
TAVEN

SEQ ID NO: 2660009 - protein, 11 aa, Entamoeba histolytica
TAVGTGLNAEP

SEQ ID NO: 2660010 - protein, 7 aa, Entamoeba histolytica
TAVPVTG

SEQ ID NO: 2660011 - protein, 18 aa, Entamoeba histolytica
TAVQEKEKKRPGELEQGI

SEQ ID NO: 2660012 - protein, 5 aa, Entamoeba histolytica
TAVSA

SEQ ID NO: 2660013 - protein, 5 aa, Entamoeba histolytica
TAVSR

SEQ ID NO: 2660014 - protein, 6 aa, Entamoeba histolytica
TAYARK

SEQ ID NO: 2660015 - protein, 6 aa, Entamoeba histolytica
TAYGSE

SEQ ID NO: 2660016 - protein, 18 aa, Entamoeba histolytica
TAYKATTTTTEITKGYNL

SEQ ID NO: 2660017 - protein, 16 aa, Entamoeba histolytica
TAYPSFQPKLANQSAV

SEQ ID NO: 2660018 - protein, 23 aa, Entamoeba histolytica
TAYQEAKKSSEGANSLKIQSEEN

SEQ ID NO: 2660019 - protein, 25 aa, Entamoeba histolytica
TAYQEAKKSSEGANSLKIQSEENDK

SEQ ID NO: 2660020 - protein, 25 aa, Entamoeba histolytica
TAYSDSDESKEEQPKKEPEFEVDND

SEQ ID NO: 2660021 - protein, 8 aa, Entamoeba histolytica
TAYTSLPD

SEQ ID NO: 2660022 - protein, 5 aa, Entamoeba histolytica
TCAEP

SEQ ID NO: 2660023 - protein, 4 aa, Entamoeba histolytica
TCDD

SEQ ID NO: 2660024 - protein, 45 aa, Entamoeba histolytica; identical to SEQ ID NO: 2464852

SEQ ID NO: 2660025 - protein, 5 aa, Entamoeba histolytica
TCESR

SEQ ID NO: 2660026 - protein, 5 aa, Entamoeba histolytica
TCETI

SEQ ID NO: 2660027 - protein, 7 aa, Entamoeba histolytica
TCGAEQM

SEQ ID NO: 2660028 - protein, 12 aa, Entamoeba histolytica
TCGKIEENTIKQ

SEQ ID NO: 2660029 - protein, 8 aa, Entamoeba histolytica
TCGKPLDG

SEQ ID NO: 2660030 - protein, 9 aa, Entamoeba histolytica
TCGQEQYKS

SEQ ID NO: 2660031 - protein, 8 aa, Entamoeba histolytica
TCGQEQYR

SEQ ID NO: 2660032 - protein, 7 aa, Entamoeba histolytica
TCGQTKL

SEQ ID NO: 2660033 - protein, 4 aa, Entamoeba histolytica
TCHP

SEQ ID NO: 2660034 - protein, 5 aa, Entamoeba histolytica
TCKEA

SEQ ID NO: 2660035 - protein, 8 aa, Entamoeba histolytica
TCKNENKK

SEQ ID NO: 2660036 - protein, 7 aa, Entamoeba histolytica
TCKTGDQ

SEQ ID NO: 2660037 - protein, 4 aa, Entamoeba histolytica
TCND

SEQ ID NO: 2660038 - protein, 6 aa, Entamoeba histolytica
TCNEKK

SEQ ID NO: 2660039 - protein, 7 aa, Entamoeba histolytica
TCNNGRS

SEQ ID NO: 2660040 - protein, 4 aa, Entamoeba histolytica
TCNQ

SEQ ID NO: 2660041 - protein, 4 aa, Entamoeba histolytica
TCNS

SEQ ID NO: 2660042 - protein, 7 aa, Entamoeba histolytica
TCPHTKK

SEQ ID NO: 2660043 - protein, 8 aa, Entamoeba histolytica
TCQTDNIE

SEQ ID NO: 2660044 - protein, 4 aa, Entamoeba histolytica
TCRN

SEQ ID NO: 2660045 - protein, 13 aa, Entamoeba histolytica
TCRVGNAGESMPT

SEQ ID NO: 2660046 - protein, 6 aa, Entamoeba histolytica
TCSETE

SEQ ID NO: 2660047 - protein, 8 aa, Entamoeba histolytica
TCSNDADQ

SEQ ID NO: 2660048 - protein, 5 aa, Entamoeba histolytica
TCSNK

SEQ ID NO: 2660049 - protein, 7 aa, Entamoeba histolytica
TCSSNEA

SEQ ID NO: 2660050 - protein, 16 aa, Entamoeba histolytica
TCTDITDPSTRTEVSE

SEQ ID NO: 2660051 - protein, 14 aa, Entamoeba histolytica
TCTTESQPYESPIY

SEQ ID NO: 2660052 - protein, 12 aa, Entamoeba histolytica
TDAFGTSKFTEE

SEQ ID NO: 2660053 - protein, 4 aa, Entamoeba histolytica
TDAG

SEQ ID NO: 2660054 - protein, 4 aa, Entamoeba histolytica
TDAI

SEQ ID NO: 2660055 - protein, 8 aa, Entamoeba histolytica
TDAKSISH

SEQ ID NO: 2660056 - protein, 11 aa, Entamoeba histolytica
TDANNEKEKET

SEQ ID NO: 2660057 - protein, 4 aa, Entamoeba histolytica
TDAT

SEQ ID NO: 2660058 - protein, 14 aa, Entamoeba histolytica
TDCNDKKTVAESKR

SEQ ID NO: 2660059 - protein, 5 aa, Entamoeba histolytica
TDDAM

SEQ ID NO: 2660060 - protein, 6 aa, Entamoeba histolytica
TDDDFV

SEQ ID NO: 2660061 - protein, 7 aa, Entamoeba histolytica
TDDDNIN

SEQ ID NO: 2660062 - protein, 6 aa, Entamoeba histolytica
TDDDTV

SEQ ID NO: 2660063 - protein, 10 aa, Entamoeba histolytica
TDDEERNRGI

SEQ ID NO: 2660064 - protein, 7 aa, Entamoeba histolytica
TDDEQNQ

SEQ ID NO: 2660065 - protein, 9 aa, Entamoeba histolytica
TDDETKEGL

SEQ ID NO: 2660066 - protein, 4 aa, Entamoeba histolytica
TDDG

SEQ ID NO: 2660067 - protein, 11 aa, Entamoeba histolytica
TDDGNKSSEGK

SEQ ID NO: 2660068 - protein, 8 aa, Entamoeba histolytica
TDDKIQTV

SEQ ID NO: 2660069 - protein, 5 aa, Entamoeba histolytica
TDDNM

SEQ ID NO: 2660070 - protein, 7 aa, Entamoeba histolytica
TDDNPIV

SEQ ID NO: 2660071 - protein, 11 aa, Entamoeba histolytica
TDDPRVSKRIP

SEQ ID NO: 2660072 - protein, 5 aa, Entamoeba histolytica
TDDSC

SEQ ID NO: 2660073 - protein, 8 aa, Entamoeba histolytica
TDDSPRRR

SEQ ID NO: 2660074 - protein, 4 aa, Entamoeba histolytica
TDED

SEQ ID NO: 2660075 - protein, 7 aa, Entamoeba histolytica
TDEDEKV

SEQ ID NO: 2660076 - protein, 8 aa, Entamoeba histolytica
TDEDGKKC

SEQ ID NO: 2660077 - protein, 11 aa, Entamoeba histolytica
TDEDRFDESKN

SEQ ID NO: 2660078 - protein, 4 aa, Entamoeba histolytica
TDEE

SEQ ID NO: 2660079 - protein, 5 aa, Entamoeba histolytica
TDEEI

SEQ ID NO: 2660080 - protein, 25 aa, Entamoeba histolytica
TDEEIQGYQANNECPANESSEYQNG

SEQ ID NO: 2660081 - protein, 10 aa, Entamoeba histolytica
TDEERELPKY

SEQ ID NO: 2660082 - protein, 8 aa, Entamoeba histolytica
TDEETAEE

SEQ ID NO: 2660083 - protein, 5 aa, Entamoeba histolytica
TDEIT

SEQ ID NO: 2660084 - protein, 9 aa, Entamoeba histolytica
TDEKGCENK

SEQ ID NO: 2660085 - protein, 6 aa, Entamoeba histolytica
TDEKPI

SEQ ID NO: 2660086 - protein, 14 aa, Entamoeba histolytica
TDEKTQSKMKETLS

SEQ ID NO: 2660087 - protein, 9 aa, Entamoeba histolytica
TDENELSKS

SEQ ID NO: 2660088 - protein, 17 aa, Entamoeba histolytica
TDENIPIAKSDNTQKDF

SEQ ID NO: 2660089 - protein, 5 aa, Entamoeba histolytica
TDEPF

SEQ ID NO: 2660090 - protein, 5 aa, Entamoeba histolytica
TDEPY

SEQ ID NO: 2660091 - protein, 4 aa, Entamoeba histolytica
TDEQ

SEQ ID NO: 2660092 - protein, 6 aa, Entamoeba histolytica
TDERSK

SEQ ID NO: 2660093 - protein, 14 aa, Entamoeba histolytica
TDERYKSYPKDPCE

SEQ ID NO: 2660094 - protein, 11 aa, Entamoeba histolytica
TDESESSVVTE

SEQ ID NO: 2660095 - protein, 7 aa, Entamoeba histolytica
TDETQQQ

SEQ ID NO: 2660096 - protein, 12 aa, Entamoeba histolytica
TDETSEAPLEEQ

SEQ ID NO: 2660097 - protein, 6 aa, Entamoeba histolytica
TDETSH

SEQ ID NO: 2660098 - protein, 6 aa, Entamoeba histolytica
TDETTL

SEQ ID NO: 2660099 - protein, 17 aa, Entamoeba histolytica
TDEYDEPPKYDLKDKTF

SEQ ID NO: 2660100 - protein, 7 aa, Entamoeba histolytica
TDFDTSK

SEQ ID NO: 2660101 - protein, 5 aa, Entamoeba histolytica
TDFGS

SEQ ID NO: 2660102 - protein, 7 aa, Entamoeba histolytica
TDFGSSR

SEQ ID NO: 2660103 - protein, 18 aa, Entamoeba histolytica
TDFGSSTLKDESHMTGGV

SEQ ID NO: 2660104 - protein, 6 aa, Entamoeba histolytica
TDFGTS

SEQ ID NO: 2660105 - protein, 9 aa, Entamoeba histolytica
TDFNKEHRE

SEQ ID NO: 2660106 - protein, 6 aa, Entamoeba histolytica
TDFNPK

SEQ ID NO: 2660107 - protein, 5 aa, Entamoeba histolytica
TDFPT

SEQ ID NO: 2660108 - protein, 4 aa, Entamoeba histolytica
TDFS

SEQ ID NO: 2660109 - protein, 5 aa, Entamoeba histolytica
TDFSI

SEQ ID NO: 2660110 - protein, 26 aa, Entamoeba histolytica
TDFSKGYKKGGLKEGLKQGGKTLAKN

SEQ ID NO: 2660111 - protein, 4 aa, Entamoeba histolytica
TDGA

SEQ ID NO: 2660112 - protein, 5 aa, Entamoeba histolytica
TDGEP

SEQ ID NO: 2660113 - protein, 7 aa, Entamoeba histolytica
TDGGSKI

SEQ ID NO: 2660114 - protein, 9 aa, Entamoeba histolytica
TDGKEKMEP

SEQ ID NO: 2660115 - protein, 9 aa, Entamoeba histolytica
TDGKNGAQV

SEQ ID NO: 2660116 - protein, 5 aa, Entamoeba histolytica
TDGKY

SEQ ID NO: 2660117 - protein, 4 aa, Entamoeba histolytica
TDGM

SEQ ID NO: 2660118 - protein, 5 aa, Entamoeba histolytica
TDGMP

SEQ ID NO: 2660119 - protein, 9 aa, Entamoeba histolytica
TDGNKQGDK

SEQ ID NO: 2660120 - protein, 7 aa, Entamoeba histolytica
TDGNRTL

SEQ ID NO: 2660121 - protein, 11 aa, Entamoeba histolytica
TDGSESSVVTE

SEQ ID NO: 2660122 - protein, 8 aa, Entamoeba histolytica
TDGSLGAA

SEQ ID NO: 2660123 - protein, 7 aa, Entamoeba histolytica
TDGTTTI

SEQ ID NO: 2660124 - protein, 8 aa, Entamoeba histolytica
TDGYDGST

SEQ ID NO: 2660125 - protein, 7 aa, Entamoeba histolytica
TDGYKGG

SEQ ID NO: 2660126 - protein, 14 aa, Entamoeba histolytica
TDGYTTKSVNEHIT

SEQ ID NO: 2660127 - protein, 4 aa, Entamoeba histolytica
TDHI

SEQ ID NO: 2660128 - protein, 10 aa, Entamoeba histolytica
TDHPSIKKNT

SEQ ID NO: 2660129 - protein, 6 aa, Entamoeba histolytica
TDHQKE

SEQ ID NO: 2660130 - protein, 7 aa, Entamoeba histolytica
TDHRDAV

SEQ ID NO: 2660131 - protein, 7 aa, Entamoeba histolytica
TDIDKRN

SEQ ID NO: 2660132 - protein, 37 aa, Entamoeba histolytica
TDIEEIKDKEEIKDKEEIKDKEEIKDKEEIGKESIEI

SEQ ID NO: 2660133 - protein, 9 aa, Entamoeba histolytica
TDIEQYDEA

SEQ ID NO: 2660134 - protein, 4 aa, Entamoeba histolytica
TDIG

SEQ ID NO: 2660135 - protein, 6 aa, Entamoeba histolytica
TDIGDE

SEQ ID NO: 2660136 - protein, 13 aa, Entamoeba histolytica
TDIKKEGGENGRK

SEQ ID NO: 2660137 - protein, 7 aa, Entamoeba histolytica
TDIKRPP

SEQ ID NO: 2660138 - protein, 4 aa, Entamoeba histolytica
TDIN

SEQ ID NO: 2660139 - protein, 6 aa, Entamoeba histolytica
TDINNQ

SEQ ID NO: 2660140 - protein, 4 aa, Entamoeba histolytica
TDIP

SEQ ID NO: 2660141 - protein, 17 aa, Entamoeba histolytica
TDIQKGDVISKNGPHGD

SEQ ID NO: 2660142 - protein, 6 aa, Entamoeba histolytica
TDIRRK

SEQ ID NO: 2660143 - protein, 9 aa, Entamoeba histolytica
TDISADQSI

SEQ ID NO: 2660144 - protein, 9 aa, Entamoeba histolytica
TDISTTATF

SEQ ID NO: 2660145 - protein, 11 aa, Entamoeba histolytica
TDITKKGETIS

SEQ ID NO: 2660146 - protein, 4 aa, Entamoeba histolytica
TDKD

SEQ ID NO: 2660147 - protein, 11 aa, Entamoeba histolytica
TDKDDNKQYAT

SEQ ID NO: 2660148 - protein, 10 aa, Entamoeba histolytica
TDKDESSVDS

SEQ ID NO: 2660149 - protein, 7 aa, Entamoeba histolytica
TDKDEVN

SEQ ID NO: 2660150 - protein, 11 aa, Entamoeba histolytica
TDKDKSGSLEL

SEQ ID NO: 2660151 - protein, 6 aa, Entamoeba histolytica
TDKEAD

SEQ ID NO: 2660152 - protein, 6 aa, Entamoeba histolytica
TDKEQA

SEQ ID NO: 2660153 - protein, 8 aa, Entamoeba histolytica
TDKESFDN

SEQ ID NO: 2660154 - protein, 9 aa, Entamoeba histolytica
TDKGRTNSD

SEQ ID NO: 2660155 - protein, 11 aa, Entamoeba histolytica
TDKKEFDQTTF

SEQ ID NO: 2660156 - protein, 8 aa, Entamoeba histolytica
TDKKPKVK

SEQ ID NO: 2660157 - protein, 18 aa, Entamoeba histolytica
TDKKTSSNIDSKTKEALE

SEQ ID NO: 2660158 - protein, 5 aa, Entamoeba histolytica
TDKLE

SEQ ID NO: 2660159 - protein, 5 aa, Entamoeba histolytica
TDKLP

SEQ ID NO: 2660160 - protein, 24 aa, Entamoeba histolytica
TDKPFDTKEESKSPSFDIKPSSSF

SEQ ID NO: 2660161 - protein, 7 aa, Entamoeba histolytica
TDKPIRD

SEQ ID NO: 2660162 - protein, 32 aa, Entamoeba histolytica
TDKPKSIESNTEKQTTSIDKTPSTTTEQPSTN

SEQ ID NO: 2660163 - protein, 15 aa, Entamoeba histolytica
TDKQEIDNTSTVSPP

SEQ ID NO: 2660164 - protein, 34 aa, Entamoeba histolytica
TDKSEQKIKDKKETKSVTDSSDIKTPNDTEKPET

SEQ ID NO: 2660165 - protein, 22 aa, Entamoeba histolytica
TDKSQLEEVEKNGENVYSTKQA

SEQ ID NO: 2660166 - protein, 25 aa, Entamoeba histolytica
TDKSTRRKKVGGSLSIASTTSAVRK

SEQ ID NO: 2660167 - protein, 4 aa, Entamoeba histolytica
TDKT

SEQ ID NO: 2660168 - protein, 8 aa, Entamoeba histolytica
TDKTDSTI

SEQ ID NO: 2660169 - protein, 5 aa, Entamoeba histolytica
TDKTR

SEQ ID NO: 2660170 - protein, 9 aa, Entamoeba histolytica
TDLDTGANS

SEQ ID NO: 2660171 - protein, 7 aa, Entamoeba histolytica
TDLEQGV

SEQ ID NO: 2660172 - protein, 8 aa, Entamoeba histolytica
TDLETGQS

SEQ ID NO: 2660173 - protein, 5 aa, Entamoeba histolytica
TDLGK

SEQ ID NO: 2660174 - protein, 7 aa, Entamoeba histolytica
TDLGRPK

SEQ ID NO: 2660175 - protein, 7 aa, Entamoeba histolytica
TDLIQDE

SEQ ID NO: 2660176 - protein, 7 aa, Entamoeba histolytica
TDLKIES

SEQ ID NO: 2660177 - protein, 16 aa, Entamoeba histolytica
TDLPSDVNLQQPGRIY

SEQ ID NO: 2660178 - protein, 5 aa, Entamoeba histolytica
TDLQR

SEQ ID NO: 2660179 - protein, 6 aa, Entamoeba histolytica
TDMENK

SEQ ID NO: 2660180 - protein, 7 aa, Entamoeba histolytica
TDNDETH

SEQ ID NO: 2660181 - protein, 34 aa, Entamoeba histolytica
TDNDNPDEMKSRRAMTKGPKKDATEKKPKKPESK

SEQ ID NO: 2660182 - protein, 11 aa, Entamoeba histolytica
TDNDRFDESKT

SEQ ID NO: 2660183 - protein, 7 aa, Entamoeba histolytica
TDNDTIE

SEQ ID NO: 2660184 - protein, 4 aa, Entamoeba histolytica
TDNE

SEQ ID NO: 2660185 - protein, 5 aa, Entamoeba histolytica
TDNEN

SEQ ID NO: 2660186 - protein, 7 aa, Entamoeba histolytica
TDNETRC

SEQ ID NO: 2660187 - protein, 7 aa, Entamoeba histolytica
TDNFESK

SEQ ID NO: 2660188 - protein, 5 aa, Entamoeba histolytica
TDNGS

SEQ ID NO: 2660189 - protein, 9 aa, Entamoeba histolytica
TDNKDIEEQ

SEQ ID NO: 2660190 - protein, 6 aa, Entamoeba histolytica
TDNKDK

SEQ ID NO: 2660191 - protein, 11 aa, Entamoeba histolytica
TDNKPAPMKTN

SEQ ID NO: 2660192 - protein, 9 aa, Entamoeba histolytica
TDNKPSPMY

SEQ ID NO: 2660193 - protein, 9 aa, Entamoeba histolytica
TDNPAQSIT

SEQ ID NO: 2660194 - protein, 5 aa, Entamoeba histolytica
TDNPG

SEQ ID NO: 2660195 - protein, 5 aa, Entamoeba histolytica
TDNPI

SEQ ID NO: 2660196 - protein, 5 aa, Entamoeba histolytica
TDNQK

SEQ ID NO: 2660197 - protein, 6 aa, Entamoeba histolytica
TDNSNK

SEQ ID NO: 2660198 - protein, 8 aa, Entamoeba histolytica
TDNTNEYT

SEQ ID NO: 2660199 - protein, 32 aa, Entamoeba histolytica
TDPDDEELETKIEKKEDGTYHAEYKPTKPGKY

SEQ ID NO: 2660200 - protein, 6 aa, Entamoeba histolytica
TDPDEM

SEQ ID NO: 2660201 - protein, 17 aa, Entamoeba histolytica
TDPERRLGTKKGAEEIK

SEQ ID NO: 2660202 - protein, 7 aa, Entamoeba histolytica
TDPESDS

SEQ ID NO: 2660203 - protein, 7 aa, Entamoeba histolytica
TDPETGY

SEQ ID NO: 2660204 - protein, 5 aa, Entamoeba histolytica
TDPID

SEQ ID NO: 2660205 - protein, 8 aa, Entamoeba histolytica
TDPKNSDY

SEQ ID NO: 2660206 - protein, 10 aa, Entamoeba histolytica
TDPKPESPDW

SEQ ID NO: 2660207 - protein, 5 aa, Entamoeba histolytica
TDPNN

SEQ ID NO: 2660208 - protein, 15 aa, Entamoeba histolytica
TDPNNKNDAMSPTEF

SEQ ID NO: 2660209 - protein, 25 aa, Entamoeba histolytica
TDPNPNSPANPQASALYTSNRKEYN

SEQ ID NO: 2660210 - protein, 6 aa, Entamoeba histolytica
TDPPHA

SEQ ID NO: 2660211 - protein, 6 aa, Entamoeba histolytica
TDPQEN

SEQ ID NO: 2660212 - protein, 7 aa, Entamoeba histolytica
TDPRASG

SEQ ID NO: 2660213 - protein, 12 aa, Entamoeba histolytica
TDPRKCTSFTDR

SEQ ID NO: 2660214 - protein, 6 aa, Entamoeba histolytica
TDPTMK

SEQ ID NO: 2660215 - protein, 6 aa, Entamoeba histolytica
TDPTMP

SEQ ID NO: 2660216 - protein, 5 aa, Entamoeba histolytica
TDPYT

SEQ ID NO: 2660217 - protein, 9 aa, Entamoeba histolytica
TDQDRRSSY

SEQ ID NO: 2660218 - protein, 7 aa, Entamoeba histolytica
TDQEELS

SEQ ID NO: 2660219 - protein, 11 aa, Entamoeba histolytica
TDQKPNVKSEV

SEQ ID NO: 2660220 - protein, 7 aa, Entamoeba histolytica
TDQKRHG

SEQ ID NO: 2660221 - protein, 9 aa, Entamoeba histolytica
TDQNEETLQ

SEQ ID NO: 2660222 - protein, 7 aa, Entamoeba histolytica
TDQSSDF

SEQ ID NO: 2660223 - protein, 10 aa, Entamoeba histolytica
TDQYKKPQET

SEQ ID NO: 2660224 - protein, 14 aa, Entamoeba histolytica
TDQYRSWQNGSKIE

SEQ ID NO: 2660225 - protein, 4 aa, Entamoeba histolytica
TDRC

SEQ ID NO: 2660226 - protein, 10 aa, Entamoeba histolytica
TDRDSQRSKG

SEQ ID NO: 2660227 - protein, 11 aa, Entamoeba histolytica
TDRETKKSKGC

SEQ ID NO: 2660228 - protein, 7 aa, Entamoeba histolytica
TDRFGEA

SEQ ID NO: 2660229 - protein, 6 aa, Entamoeba histolytica
TDRKGE

SEQ ID NO: 2660230 - protein, 12 aa, Entamoeba histolytica
TDRKVEEEAEEI

SEQ ID NO: 2660231 - protein, 7 aa, Entamoeba histolytica
TDRSGTI

SEQ ID NO: 2660232 - protein, 16 aa, Entamoeba histolytica
TDRSIQEKKKQTINEE

SEQ ID NO: 2660233 - protein, 5 aa, Entamoeba histolytica
TDRTS

SEQ ID NO: 2660234 - protein, 8 aa, Entamoeba histolytica
TDSADPNV

SEQ ID NO: 2660235 - protein, 5 aa, Entamoeba histolytica
TDSDI

SEQ ID NO: 2660236 - protein, 9 aa, Entamoeba histolytica
TDSETITKR

SEQ ID NO: 2660237 - protein, 5 aa, Entamoeba histolytica
TDSFN

SEQ ID NO: 2660238 - protein, 5 aa, Entamoeba histolytica
TDSGG

SEQ ID NO: 2660239 - protein, 5 aa, Entamoeba histolytica
TDSGK

SEQ ID NO: 2660240 - protein, 5 aa, Entamoeba histolytica
TDSHT

SEQ ID NO: 2660241 - protein, 5 aa, Entamoeba histolytica
TDSIE

SEQ ID NO: 2660242 - protein, 6 aa, Entamoeba histolytica
TDSIKK

SEQ ID NO: 2660243 - protein, 10 aa, Entamoeba histolytica
TDSKKAAIAS

SEQ ID NO: 2660244 - protein, 9 aa, Entamoeba histolytica
TDSKNKRIE

SEQ ID NO: 2660245 - protein, 5 aa, Entamoeba histolytica
TDSKS

SEQ ID NO: 2660246 - protein, 11 aa, Entamoeba histolytica
TDSKTDVTGAT

SEQ ID NO: 2660247 - protein, 18 aa, Entamoeba histolytica
TDSLDSTVKENRETKEEF

SEQ ID NO: 2660248 - protein, 6 aa, Entamoeba histolytica
TDSMEQ

SEQ ID NO: 2660249 - protein, 6 aa, Entamoeba histolytica
TDSNTK

SEQ ID NO: 2660250 - protein, 5 aa, Entamoeba histolytica
TDSPT

SEQ ID NO: 2660251 - protein, 5 aa, Entamoeba histolytica
TDSPY

SEQ ID NO: 2660252 - protein, 5 aa, Entamoeba histolytica
TDSQA

SEQ ID NO: 2660253 - protein, 11 aa, Entamoeba histolytica
TDSQNKELSKK

SEQ ID NO: 2660254 - protein, 6 aa, Entamoeba histolytica
TDSSDV

SEQ ID NO: 2660255 - protein, 11 aa, Entamoeba histolytica
TDSSKRSKETL

SEQ ID NO: 2660256 - protein, 9 aa, Entamoeba histolytica
TDSSSIEKI

SEQ ID NO: 2660257 - protein, 9 aa, Entamoeba histolytica
TDSTSNLYN

SEQ ID NO: 2660258 - protein, 4 aa, Entamoeba histolytica
TDTA

SEQ ID NO: 2660259 - protein, 8 aa, Entamoeba histolytica
TDTDNKSQ

SEQ ID NO: 2660260 - protein, 11 aa, Entamoeba histolytica
TDTEKVQNEIQ

SEQ ID NO: 2660261 - protein, 12 aa, Entamoeba histolytica
TDTENDSEMPPL

SEQ ID NO: 2660262 - protein, 6 aa, Entamoeba histolytica
TDTFDS

SEQ ID NO: 2660263 - protein, 13 aa, Entamoeba histolytica
TDTGKDDPNRTSL

SEQ ID NO: 2660264 - protein, 9 aa, Entamoeba histolytica
TDTLRAENA

SEQ ID NO: 2660265 - protein, 8 aa, Entamoeba histolytica
TDTNQFNV

SEQ ID NO: 2660266 - protein, 5 aa, Entamoeba histolytica
TDTPN

SEQ ID NO: 2660267 - protein, 6 aa, Entamoeba histolytica
TDTQFK

SEQ ID NO: 2660268 - protein, 8 aa, Entamoeba histolytica
TDTRAGRL

SEQ ID NO: 2660269 - protein, 10 aa, Entamoeba histolytica
TDTSDEQGVI

SEQ ID NO: 2660270 - protein, 6 aa, Entamoeba histolytica
TDTSMV

SEQ ID NO: 2660271 - protein, 19 aa, Entamoeba histolytica
TDTVPVENKKQQKKSKCYL

SEQ ID NO: 2660272 - protein, 6 aa, Entamoeba histolytica
TDTYTL

SEQ ID NO: 2660273 - protein, 6 aa, Entamoeba histolytica
TDVDNI

SEQ ID NO: 2660274 - protein, 12 aa, Entamoeba histolytica
TDVNGESKELTD

SEQ ID NO: 2660275 - protein, 9 aa, Entamoeba histolytica
TDVSSGKSL

SEQ ID NO: 2660276 - protein, 14 aa, Entamoeba histolytica
TDYEPPKKPTKYSR

SEQ ID NO: 2660277 - protein, 6 aa, Entamoeba histolytica
TDYQKE

SEQ ID NO: 2660278 - protein, 4 aa, Entamoeba histolytica
TDYS

SEQ ID NO: 2660279 - protein, 11 aa, Entamoeba histolytica
TDYSDTSKTEF

SEQ ID NO: 2660280 - protein, 11 aa, Entamoeba histolytica
TDYSGRGELAS

SEQ ID NO: 2660281 - protein, 6 aa, Entamoeba histolytica
TDYSNG

SEQ ID NO: 2660282 - protein, 17 aa, Entamoeba histolytica
TEAAANALNNENGTDWD

SEQ ID NO: 2660283 - protein, 8 aa, Entamoeba histolytica
TEAEIAGS

SEQ ID NO: 2660284 - protein, 17 aa, Entamoeba histolytica
TEAKAAYTQAEKNNNNI

SEQ ID NO: 2660285 - protein, 8 aa, Entamoeba histolytica
TEAKDGYK

SEQ ID NO: 2660286 - protein, 21 aa, Entamoeba histolytica
TEAKIQADKEKEKRLAQKMFG

SEQ ID NO: 2660287 - protein, 11 aa, Entamoeba histolytica
TEAKKKNSNIL

SEQ ID NO: 2660288 - protein, 5 aa, Entamoeba histolytica
TEAKR

SEQ ID NO: 2660289 - protein, 8 aa, Entamoeba histolytica
TEAPKKKV

SEQ ID NO: 2660290 - protein, 13 aa, Entamoeba histolytica
TEAPNSTDEKPPY

SEQ ID NO: 2660291 - protein, 8 aa, Entamoeba histolytica
TEARSSKV

SEQ ID NO: 2660292 - protein, 5 aa, Entamoeba histolytica
TEASC

SEQ ID NO: 2660293 - protein, 13 aa, Entamoeba histolytica
TEAVENPKRVKAP

SEQ ID NO: 2660294 - protein, 7 aa, Entamoeba histolytica
TECAGSR

SEQ ID NO: 2660295 - protein, 5 aa, Entamoeba histolytica
TECNN

SEQ ID NO: 2660296 - protein, 5 aa, Entamoeba histolytica
TECPR

SEQ ID NO: 2660297 - protein, 5 aa, Entamoeba histolytica
TEDDL

SEQ ID NO: 2660298 - protein, 12 aa, Entamoeba histolytica
TEDENKKEKYPT

SEQ ID NO: 2660299 - protein, 5 aa, Entamoeba histolytica
TEDEV

SEQ ID NO: 2660300 - protein, 5 aa, Entamoeba histolytica
TEDGK

SEQ ID NO: 2660301 - protein, 6 aa, Entamoeba histolytica
TEDGQN

SEQ ID NO: 2660302 - protein, 12 aa, Entamoeba histolytica
TEDIDTKTTVKQ

SEQ ID NO: 2660303 - protein, 14 aa, Entamoeba histolytica
TEDIKTISSKEAWS

SEQ ID NO: 2660304 - protein, 4 aa, Entamoeba histolytica
TEDK

SEQ ID NO: 2660305 - protein, 6 aa, Entamoeba histolytica
TEDKKQ

SEQ ID NO: 2660306 - protein, 9 aa, Entamoeba histolytica
TEDLSGHPR

SEQ ID NO: 2660307 - protein, 15 aa, Entamoeba histolytica
TEDLTPETIYKESSK

SEQ ID NO: 2660308 - protein, 7 aa, Entamoeba histolytica
TEDNEIE

SEQ ID NO: 2660309 - protein, 5 aa, Entamoeba histolytica
TEDNL

SEQ ID NO: 2660310 - protein, 10 aa, Entamoeba histolytica
TEDNNGINPF

SEQ ID NO: 2660311 - protein, 11 aa, Entamoeba histolytica
TEDNNHSDGFG

SEQ ID NO: 2660312 - protein, 5 aa, Entamoeba histolytica
TEDNP

SEQ ID NO: 2660313 - protein, 5 aa, Entamoeba histolytica
TEDPA

SEQ ID NO: 2660314 - protein, 6 aa, Entamoeba histolytica
TEDPHK

SEQ ID NO: 2660315 - protein, 21 aa, Entamoeba histolytica
TEDPQLGYNESKTPQNNVNNS

SEQ ID NO: 2660316 - protein, 6 aa, Entamoeba histolytica
TEDQMN

SEQ ID NO: 2660317 - protein, 6 aa, Entamoeba histolytica
TEDQYG

SEQ ID NO: 2660318 - protein, 5 aa, Entamoeba histolytica
TEDRS

SEQ ID NO: 2660319 - protein, 8 aa, Entamoeba histolytica
TEDSKLEQ

SEQ ID NO: 2660320 - protein, 8 aa, Entamoeba histolytica
TEDSLPSE

SEQ ID NO: 2660321 - protein, 5 aa, Entamoeba histolytica
TEDTL

SEQ ID NO: 2660322 - protein, 5 aa, Entamoeba histolytica
TEDTP

SEQ ID NO: 2660323 - protein, 15 aa, Entamoeba histolytica
TEDTSIIQTEQNEKY

SEQ ID NO: 2660324 - protein, 12 aa, Entamoeba histolytica
TEDWNEREPWEG

SEQ ID NO: 2660325 - protein, 6 aa, Entamoeba histolytica
TEDYDA

SEQ ID NO: 2660326 - protein, 4 aa, Entamoeba histolytica
TEEA

SEQ ID NO: 2660327 - protein, 35 aa, Entamoeba histolytica
TEEARKKSIDLKEQKEKKQNEDNGEKKSSHTKKPI

SEQ ID NO: 2660328 - protein, 8 aa, Entamoeba histolytica
TEEDANKI

SEQ ID NO: 2660329 - protein, 7 aa, Entamoeba histolytica
TEEDEKV

SEQ ID NO: 2660330 - protein, 8 aa, Entamoeba histolytica
TEEDERST

SEQ ID NO: 2660331 - protein, 13 aa, Entamoeba histolytica
TEEDMEKAKKTPI

SEQ ID NO: 2660332 - protein, 10 aa, Entamoeba histolytica
TEEEAIKNGQ

SEQ ID NO: 2660333 - protein, 5 aa, Entamoeba histolytica
TEEEC

SEQ ID NO: 2660334 - protein, 5 aa, Entamoeba histolytica
TEEEG

SEQ ID NO: 2660335 - protein, 15 aa, Entamoeba histolytica
TEEELEEYGEKADIK

SEQ ID NO: 2660336 - protein, 27 aa, Entamoeba histolytica
TEEENSNGMSEDEKKEEIESSDESISV

SEQ ID NO: 2660337 - protein, 7 aa, Entamoeba histolytica
TEEEQEV

SEQ ID NO: 2660338 - protein, 7 aa, Entamoeba histolytica
TEEEQNI

SEQ ID NO: 2660339 - protein, 9 aa, Entamoeba histolytica
TEEESNDKD

SEQ ID NO: 2660340 - protein, 40 aa, Entamoeba histolytica
TEEEVNTFNKTKEEQTQKEQTEEIKKKEEADNESKKQNQL

SEQ ID NO: 2660341 - protein, 8 aa, Entamoeba histolytica
TEEEYSKD

SEQ ID NO: 2660342 - protein, 12 aa, Entamoeba histolytica
TEEFTKQPFPVD

SEQ ID NO: 2660343 - protein, 60 aa, Entamoeba histolytica
  misc_feature (16)..(49): Xaa can be any naturally occurring amino acid
TEEFTKQPFPVDPYAXXXXXXXXXXXXXXXXXXXXXXXXXXXXXXXXXXFQMLQKLMNLL

SEQ ID NO: 2660344 - protein, 6 aa, Entamoeba histolytica
TEEGCP

SEQ ID NO: 2660345 - protein, 9 aa, Entamoeba histolytica
TEEGEGIDG

SEQ ID NO: 2660346 - protein, 9 aa, Entamoeba histolytica
TEEGEQTKW

SEQ ID NO: 2660347 - protein, 11 aa, Entamoeba histolytica
TEEGKKRIAQL

SEQ ID NO: 2660348 - protein, 6 aa, Entamoeba histolytica
TEEGKV

SEQ ID NO: 2660349 - protein, 9 aa, Entamoeba histolytica
TEEGSPKVF

SEQ ID NO: 2660350 - protein, 4 aa, Entamoeba histolytica
TEEK

SEQ ID NO: 2660351 - protein, 24 aa, Entamoeba histolytica
TEEKAYEKKQRKHKHQGKGKEKYS

SEQ ID NO: 2660352 - protein, 6 aa, Entamoeba histolytica
TEEKEK

SEQ ID NO: 2660353 - protein, 18 aa, Entamoeba histolytica
TEEKELNENIKSEEERYY

SEQ ID NO: 2660354 - protein, 9 aa, Entamoeba histolytica
TEEKGTEGI

SEQ ID NO: 2660355 - protein, 31 aa, Entamoeba histolytica
TEEKKKNIKPKKVSKKEFKEPKEEKKEKEIT

SEQ ID NO: 2660356 - protein, 10 aa, Entamoeba histolytica
TEEKQESQDL

SEQ ID NO: 2660357 - protein, 20 aa, Entamoeba histolytica
TEEKRPKLKKGEEFDEQRPK

SEQ ID NO: 2660358 - protein, 8 aa, Entamoeba histolytica
TEEKTDQL

SEQ ID NO: 2660359 - protein, 9 aa, Entamoeba histolytica
TEENEHRKS

SEQ ID NO: 2660360 - protein, 21 aa, Entamoeba histolytica
TEENIQQSEIEESTNNFTENQ

SEQ ID NO: 2660361 - protein, 5 aa, Entamoeba histolytica
TEENP

SEQ ID NO: 2660362 - protein, 9 aa, Entamoeba histolytica
TEENQPKYQ

SEQ ID NO: 2660363 - protein, 8 aa, Entamoeba histolytica
TEENTRLQ

SEQ ID NO: 2660364 - protein, 5 aa, Entamoeba histolytica
TEEPS

SEQ ID NO: 2660365 - protein, 6 aa, Entamoeba histolytica
TEEQDV

SEQ ID NO: 2660366 - protein, 32 aa, Entamoeba histolytica
TEEQKASYRPKPRQVPQKKQVKKEEEIVEEKK

SEQ ID NO: 2660367 - protein, 4 aa, Entamoeba histolytica
TEER

SEQ ID NO: 2660368 - protein, 6 aa, Entamoeba histolytica
TEESAI

SEQ ID NO: 2660369 - protein, 35 aa, Entamoeba histolytica
TEESNEIDCSKDVRSSLSSSVLSNEESASILSDRT

SEQ ID NO: 2660370 - protein, 8 aa, Entamoeba histolytica
TEESNVNK

SEQ ID NO: 2660371 - protein, 6 aa, Entamoeba histolytica
TEESYV

SEQ ID NO: 2660372 - protein, 4 aa, Entamoeba histolytica
TEEY

SEQ ID NO: 2660373 - protein, 4 aa, Entamoeba histolytica
TEFE

SEQ ID NO: 2660374 - protein, 5 aa, Entamoeba histolytica
TEFPD

SEQ ID NO: 2660375 - protein, 12 aa, Entamoeba histolytica
TEFPEKELSHEG

SEQ ID NO: 2660376 - protein, 16 aa, Entamoeba histolytica
TEFPHGTKVDADNPAH

SEQ ID NO: 2660377 - protein, 4 aa, Entamoeba histolytica
TEFS

SEQ ID NO: 2660378 - protein, 8 aa, Entamoeba histolytica
TEFSEKRD

SEQ ID NO: 2660379 - protein, 10 aa, Entamoeba histolytica
TEFSNRDLET

SEQ ID NO: 2660380 - protein, 7 aa, Entamoeba histolytica
TEGAANN

SEQ ID NO: 2660381 - protein, 9 aa, Entamoeba histolytica
TEGDCKKLE

SEQ ID NO: 2660382 - protein, 5 aa, Entamoeba histolytica
TEGEC

SEQ ID NO: 2660383 - protein, 12 aa, Entamoeba histolytica
TEGEDGDDETDL

SEQ ID NO: 2660384 - protein, 7 aa, Entamoeba histolytica
TEGFNGA

SEQ ID NO: 2660385 - protein, 9 aa, Entamoeba histolytica
TEGGGGIKR

SEQ ID NO: 2660386 - protein, 4 aa, Entamoeba histolytica
TEGH

SEQ ID NO: 2660387 - protein, 4 aa, Entamoeba histolytica
TEGI

SEQ ID NO: 2660388 - protein, 13 aa, Entamoeba histolytica
TEGISEMEKEDLN

SEQ ID NO: 2660389 - protein, 5 aa, Entamoeba histolytica
TEGKD

SEQ ID NO: 2660390 - protein, 13 aa, Entamoeba histolytica
TEGKRNEKPLTEE

SEQ ID NO: 2660391 - protein, 8 aa, Entamoeba histolytica
TEGQTLES

SEQ ID NO: 2660392 - protein, 11 aa, Entamoeba histolytica
TEGSKESYPHS

SEQ ID NO: 2660393 - protein, 6 aa, Entamoeba histolytica
TEGSKK

SEQ ID NO: 2660394 - protein, 4 aa, Entamoeba histolytica
TEGT

SEQ ID NO: 2660395 - protein, 8 aa, Entamoeba histolytica
TEGTFRPE

SEQ ID NO: 2660396 - protein, 6 aa, Entamoeba histolytica
TEGTIE

SEQ ID NO: 2660397 - protein, 11 aa, Entamoeba histolytica
TEGVNDTELGK

SEQ ID NO: 2660398 - protein, 7 aa, Entamoeba histolytica
TEGYTNP

SEQ ID NO: 2660399 - protein, 4 aa, Entamoeba histolytica
TEHE

SEQ ID NO: 2660400 - protein, 4 aa, Entamoeba histolytica
TEHK

SEQ ID NO: 2660401 - protein, 9 aa, Entamoeba histolytica
TEHKHGTTT

SEQ ID NO: 2660402 - protein, 8 aa, Entamoeba histolytica
TEHSYSTT

SEQ ID NO: 2660403 - protein, 16 aa, Entamoeba histolytica
TEIDDQIKTQENSTTI

SEQ ID NO: 2660404 - protein, 5 aa, Entamoeba histolytica
TEIDK

SEQ ID NO: 2660405 - protein, 10 aa, Entamoeba histolytica
TEIEANNEQN

SEQ ID NO: 2660406 - protein, 11 aa, Entamoeba histolytica
TEIEKDRSQYE

SEQ ID NO: 2660407 - protein, 11 aa, Entamoeba histolytica
TEIENSFSSNE

SEQ ID NO: 2660408 - protein, 24 aa, Entamoeba histolytica
TEIETLKKESETKELEKKTKDEEV

SEQ ID NO: 2660409 - protein, 7 aa, Entamoeba histolytica
TEIGDRK

SEQ ID NO: 2660410 - protein, 14 aa, Entamoeba histolytica
TEIHEEENGKMDIE

SEQ ID NO: 2660411 - protein, 12 aa, Entamoeba histolytica
TEIKNEPEPNLS

SEQ ID NO: 2660412 - protein, 18 aa, Entamoeba histolytica
TEIKPKTKLTNYEPEDGQ

SEQ ID NO: 2660413 - protein, 12 aa, Entamoeba histolytica
TEIKRESKSFEA

SEQ ID NO: 2660414 - protein, 11 aa, Entamoeba histolytica
TEIPDNLTNPE

SEQ ID NO: 2660415 - protein, 11 aa, Entamoeba histolytica
TEIPETSKKEE

SEQ ID NO: 2660416 - protein, 6 aa, Entamoeba histolytica
TEIPSI

SEQ ID NO: 2660417 - protein, 12 aa, Entamoeba histolytica
TEIQTSSKNITP

SEQ ID NO: 2660418 - protein, 6 aa, Entamoeba histolytica
TEITHK

SEQ ID NO: 2660419 - protein, 15 aa, Entamoeba histolytica
TEITISKEKAPPIKM

SEQ ID NO: 2660420 - protein, 6 aa, Entamoeba histolytica
TEKDDL

SEQ ID NO: 2660421 - protein, 25 aa, Entamoeba histolytica
TEKDPTLKDKNEILPSEKLGDGYEL

SEQ ID NO: 2660422 - protein, 4 aa, Entamoeba histolytica
TEKE

SEQ ID NO: 2660423 - protein, 26 aa, Entamoeba histolytica
TEKEESDTSPTNTSAHGTSQNNTINV

SEQ ID NO: 2660424 - protein, 9 aa, Entamoeba histolytica
TEKEKGCTR

SEQ ID NO: 2660425 - protein, 5 aa, Entamoeba histolytica
TEKEL

SEQ ID NO: 2660426 - protein, 9 aa, Entamoeba histolytica
TEKEREEIT

SEQ ID NO: 2660427 - protein, 7 aa, Entamoeba histolytica
TEKEWND

SEQ ID NO: 2660428 - protein, 9 aa, Entamoeba histolytica
TEKFGHDQY

SEQ ID NO: 2660429 - protein, 8 aa, Entamoeba histolytica
TEKGFNND

SEQ ID NO: 2660430 - protein, 5 aa, Entamoeba histolytica
TEKGI

SEQ ID NO: 2660431 - protein, 13 aa, Entamoeba histolytica
TEKHQFDSKSDAV

SEQ ID NO: 2660432 - protein, 6 aa, Entamoeba histolytica
TEKHST

SEQ ID NO: 2660433 - protein, 4 aa, Entamoeba histolytica
TEKK

SEQ ID NO: 2660434 - protein, 6 aa, Entamoeba histolytica
TEKKDV

SEQ ID NO: 2660435 - protein, 42 aa, Entamoeba histolytica
TEKKEDDKKEKQENKEEIEGKEEDGKIKVEKEYTKSRRGNSF

SEQ ID NO: 2660436 - protein, 10 aa, Entamoeba histolytica
TEKKEQRGNF

SEQ ID NO: 2660437 - protein, 10 aa, Entamoeba histolytica
TEKKKESQHE

SEQ ID NO: 2660438 - protein, 5 aa, Entamoeba histolytica
TEKKL

SEQ ID NO: 2660439 - protein, 9 aa, Entamoeba histolytica
TEKKPKAIS

SEQ ID NO: 2660440 - protein, 8 aa, Entamoeba histolytica
TEKNESCE

SEQ ID NO: 2660441 - protein, 8 aa, Entamoeba histolytica
TEKPKIKT

SEQ ID NO: 2660442 - protein, 8 aa, Entamoeba histolytica
TEKPQVKH

SEQ ID NO: 2660443 - protein, 5 aa, Entamoeba histolytica
TEKQA

SEQ ID NO: 2660444 - protein, 7 aa, Entamoeba histolytica
TEKQMTV

SEQ ID NO: 2660445 - protein, 6 aa, Entamoeba histolytica
TEKQSL

SEQ ID NO: 2660446 - protein, 19 aa, Entamoeba histolytica
TEKQVSKQPSDTNNDDNKT

SEQ ID NO: 2660447 - protein, 11 aa, Entamoeba histolytica
TEKRDRNKPQT

SEQ ID NO: 2660448 - protein, 18 aa, Entamoeba histolytica
TEKSDSQRQKDESEEMRK

SEQ ID NO: 2660449 - protein, 18 aa, Entamoeba histolytica
TEKSKKKVNVKKGEEEYM

SEQ ID NO: 2660450 - protein, 5 aa, Entamoeba histolytica
TEKTI

SEQ ID NO: 2660451 - protein, 8 aa, Entamoeba histolytica
TEKTMSET

SEQ ID NO: 2660452 - protein, 10 aa, Entamoeba histolytica
TEKTSKRRMQ

SEQ ID NO: 2660453 - protein, 5 aa, Entamoeba histolytica
TEKTY

SEQ ID NO: 2660454 - protein, 8 aa, Entamoeba histolytica
TEKTYDDD

SEQ ID NO: 2660455 - protein, 6 aa, Entamoeba histolytica
TEKTYV

SEQ ID NO: 2660456 - protein, 9 aa, Entamoeba histolytica
TEKVAKSTA

SEQ ID NO: 2660457 - protein, 5 aa, Entamoeba histolytica
TEKWE

SEQ ID NO: 2660458 - protein, 9 aa, Entamoeba histolytica
TEKYQPTQF

SEQ ID NO: 2660459 - protein, 8 aa, Entamoeba histolytica
TEKYRNER

SEQ ID NO: 2660460 - protein, 10 aa, Entamoeba histolytica
TELDDGPKVE

SEQ ID NO: 2660461 - protein, 9 aa, Entamoeba histolytica
TELESNGHA

SEQ ID NO: 2660462 - protein, 13 aa, Entamoeba histolytica
TELKAKKLTEAGC

SEQ ID NO: 2660463 - protein, 8 aa, Entamoeba histolytica
TELKPEET

SEQ ID NO: 2660464 - protein, 15 aa, Entamoeba histolytica
TELNEEKKKIKKAQN

SEQ ID NO: 2660465 - protein, 4 aa, Entamoeba histolytica
TELP

SEQ ID NO: 2660466 - protein, 11 aa, Entamoeba histolytica
TELPDKEPNAI

SEQ ID NO: 2660467 - protein, 8 aa, Entamoeba histolytica
TELPTEKV

SEQ ID NO: 2660468 - protein, 9 aa, Entamoeba histolytica
TELQNPKYS

SEQ ID NO: 2660469 - protein, 4 aa, Entamoeba histolytica
TELS

SEQ ID NO: 2660470 - protein, 18 aa, Entamoeba histolytica
TELSEDNKENRMTNEEED

SEQ ID NO: 2660471 - protein, 4 aa, Entamoeba histolytica
TELT

SEQ ID NO: 2660472 - protein, 6 aa, Entamoeba histolytica
TEMEEN

SEQ ID NO: 2660473 - protein, 6 aa, Entamoeba histolytica
TEMKDD

SEQ ID NO: 2660474 - protein, 12 aa, Entamoeba histolytica
TEMNTKTAIKSL

SEQ ID NO: 2660475 - protein, 7 aa, Entamoeba histolytica
TEMPKEL

SEQ ID NO: 2660476 - protein, 9 aa, Entamoeba histolytica
TEMREQQSK

SEQ ID NO: 2660477 - protein, 6 aa, Entamoeba histolytica
TENAAA

SEQ ID NO: 2660478 - protein, 6 aa, Entamoeba histolytica
TENALP

SEQ ID NO: 2660479 - protein, 9 aa, Entamoeba histolytica
TENAQNAFS

SEQ ID NO: 2660480 - protein, 7 aa, Entamoeba histolytica
TENASSF

SEQ ID NO: 2660481 - protein, 6 aa, Entamoeba histolytica
TENDEI

SEQ ID NO: 2660482 - protein, 12 aa, Entamoeba histolytica
TENDEKKPGYDV

SEQ ID NO: 2660483 - protein, 13 aa, Entamoeba histolytica
TENDEKKPGYEAR

SEQ ID NO: 2660484 - protein, 17 aa, Entamoeba histolytica
TENDEKKPGYKERIEGY

SEQ ID NO: 2660485 - protein, 5 aa, Entamoeba histolytica
TENDF

SEQ ID NO: 2660486 - protein, 11 aa, Entamoeba histolytica
TENDKKKLREI

SEQ ID NO: 2660487 - protein, 8 aa, Entamoeba histolytica
TENDWYDS

SEQ ID NO: 2660488 - protein, 17 aa, Entamoeba histolytica
TENEEKKDRYKERIEEY

SEQ ID NO: 2660489 - protein, 13 aa, Entamoeba histolytica
TENEEKKPGYEAR

SEQ ID NO: 2660490 - protein, 14 aa, Entamoeba histolytica
TENEEKKQGYEARV

SEQ ID NO: 2660491 - protein, 7 aa, Entamoeba histolytica
TENEEME

SEQ ID NO: 2660492 - protein, 6 aa, Entamoeba histolytica
TENEEQ

SEQ ID NO: 2660493 - protein, 11 aa, Entamoeba histolytica
TENELKNSKDS

SEQ ID NO: 2660494 - protein, 18 aa, Entamoeba histolytica
TENEQIRKQEKLSDGSMI

SEQ ID NO: 2660495 - protein, 9 aa, Entamoeba histolytica
TENESEKTS

SEQ ID NO: 2660496 - protein, 7 aa, Entamoeba histolytica
TENFSGA

SEQ ID NO: 2660497 - protein, 8 aa, Entamoeba histolytica
TENFSSTR

SEQ ID NO: 2660498 - protein, 4 aa, Entamoeba histolytica
TENG

SEQ ID NO: 2660499 - protein, 8 aa, Entamoeba histolytica
TENGKITS

SEQ ID NO: 2660500 - protein, 9 aa, Entamoeba histolytica
TENGQQKRR

SEQ ID NO: 2660501 - protein, 16 aa, Entamoeba histolytica
TENKQQLSVTSEERDI

SEQ ID NO: 2660502 - protein, 4 aa, Entamoeba histolytica
TENN

SEQ ID NO: 2660503 - protein, 9 aa, Entamoeba histolytica
TENNELKKA

SEQ ID NO: 2660504 - protein, 8 aa, Entamoeba histolytica
TENNKGSF

SEQ ID NO: 2660505 - protein, 10 aa, Entamoeba histolytica
TENNSGFSKE

SEQ ID NO: 2660506 - protein, 7 aa, Entamoeba histolytica
TENPDQP

SEQ ID NO: 2660507 - protein, 7 aa, Entamoeba histolytica
TENPRQH

SEQ ID NO: 2660508 - protein, 10 aa, Entamoeba histolytica
TENPYDPTPF

SEQ ID NO: 2660509 - protein, 12 aa, Entamoeba histolytica
TENQRKKCEEYK

SEQ ID NO: 2660510 - protein, 8 aa, Entamoeba histolytica
TENQTLRE

SEQ ID NO: 2660511 - protein, 4 aa, Entamoeba histolytica
TENR

SEQ ID NO: 2660512 - protein, 5 aa, Entamoeba histolytica
TENRS

SEQ ID NO: 2660513 - protein, 8 aa, Entamoeba histolytica
TENSLSND

SEQ ID NO: 2660514 - protein, 7 aa, Entamoeba histolytica
TENTENQ

SEQ ID NO: 2660515 - protein, 15 aa, Entamoeba histolytica
TENTFGATRVDEEEA

SEQ ID NO: 2660516 - protein, 27 aa, Entamoeba histolytica
TENTKIENKIQQKENEIEEIKKEKEIA

SEQ ID NO: 2660517 - protein, 6 aa, Entamoeba histolytica
TENTNE

SEQ ID NO: 2660518 - protein, 13 aa, Entamoeba histolytica
TENTTNSGFDNEE

SEQ ID NO: 2660519 - protein, 7 aa, Entamoeba histolytica
TENVGTK

SEQ ID NO: 2660520 - protein, 6 aa, Entamoeba histolytica
TENYDN

SEQ ID NO: 2660521 - protein, 8 aa, Entamoeba histolytica
TEPAESYK

SEQ ID NO: 2660522 - protein, 14 aa, Entamoeba histolytica
TEPAKGSDPTFTPK

SEQ ID NO: 2660523 - protein, 9 aa, Entamoeba histolytica
TEPDHSGSL

SEQ ID NO: 2660524 - protein, 6 aa, Entamoeba histolytica
TEPEFT

SEQ ID NO: 2660525 - protein, 8 aa, Entamoeba histolytica
TEPEPDPL

SEQ ID NO: 2660526 - protein, 14 aa, Entamoeba histolytica
TEPKQDSSCSEIEK

SEQ ID NO: 2660527 - protein, 12 aa, Entamoeba histolytica
TEPMYDEKGNIS

SEQ ID NO: 2660528 - protein, 4 aa, Entamoeba histolytica
TEPN

SEQ ID NO: 2660529 - protein, 5 aa, Entamoeba histolytica
TEPNN

SEQ ID NO: 2660530 - protein, 12 aa, Entamoeba histolytica
TEPNPKDRPTID

SEQ ID NO: 2660531 - protein, 4 aa, Entamoeba histolytica
TEPP

SEQ ID NO: 2660532 - protein, 6 aa, Entamoeba histolytica
TEPPHS

SEQ ID NO: 2660533 - protein, 4 aa, Entamoeba histolytica
TEPQ

SEQ ID NO: 2660534 - protein, 6 aa, Entamoeba histolytica
TEPQDI

SEQ ID NO: 2660535 - protein, 8 aa, Entamoeba histolytica
TEPQTSFT

SEQ ID NO: 2660536 - protein, 9 aa, Entamoeba histolytica
TEPSKRIKE

SEQ ID NO: 2660537 - protein, 13 aa, Entamoeba histolytica
TEPSLKQNKNQIL

SEQ ID NO: 2660538 - protein, 15 aa, Entamoeba histolytica
TEPTNKSYKQEDESN

SEQ ID NO: 2660539 - protein, 7 aa, Entamoeba histolytica
TEPTQLN

SEQ ID NO: 2660540 - protein, 10 aa, Entamoeba histolytica
TEPVGTLGKK

SEQ ID NO: 2660541 - protein, 61 aa, Entamoeba histolytica; identical to SEQ ID NO: 2465374

SEQ ID NO: 2660542 - protein, 7 aa, Entamoeba histolytica
TEQEEYI

SEQ ID NO: 2660543 - protein, 7 aa, Entamoeba histolytica
TEQHGAY

SEQ ID NO: 2660544 - protein, 8 aa, Entamoeba histolytica
TEQHSQPC

SEQ ID NO: 2660545 - protein, 21 aa, Entamoeba histolytica
TEQHYRKRNQTKGDYLDKRGL

SEQ ID NO: 2660546 - protein, 11 aa, Entamoeba histolytica
TEQIEEEKKEI

SEQ ID NO: 2660547 - protein, 30 aa, Entamoeba histolytica
TEQIPPPSLESNQTQQQPQPTKPAIGSDGK

SEQ ID NO: 2660548 - protein, 11 aa, Entamoeba histolytica
TEQKKETQKFQ

SEQ ID NO: 2660549 - protein, 9 aa, Entamoeba histolytica
TEQLQNNAT

SEQ ID NO: 2660550 - protein, 54 aa, Entamoeba histolytica
TEQNMKPIHEDKRHSEEKKPIQKKENNKDSKKEAKKPNVKKEFKKSKETNNDKK

SEQ ID NO: 2660551 - protein, 4 aa, Entamoeba histolytica
TEQP

SEQ ID NO: 2660552 - protein, 16 aa, Entamoeba histolytica
TEQPQKVELDEKSQLE

SEQ ID NO: 2660553 - protein, 9 aa, Entamoeba histolytica
TEQPQLPND

SEQ ID NO: 2660554 - protein, 11 aa, Entamoeba histolytica
TEQQEAKETIE

SEQ ID NO: 2660555 - protein, 6 aa, Entamoeba histolytica
TEQQMN

SEQ ID NO: 2660556 - protein, 10 aa, Entamoeba histolytica
TEQQNGMGSG

SEQ ID NO: 2660557 - protein, 6 aa, Entamoeba histolytica
TEQREP

SEQ ID NO: 2660558 - protein, 9 aa, Entamoeba histolytica
TEQRGDDEV

SEQ ID NO: 2660559 - protein, 12 aa, Entamoeba histolytica
TEQRKKTGNEEQ

SEQ ID NO: 2660560 - protein, 15 aa, Entamoeba histolytica
TEQRNATLRQQPTKQ

SEQ ID NO: 2660561 - protein, 11 aa, Entamoeba histolytica
TEQRVQSSITS

SEQ ID NO: 2660562 - protein, 4 aa, Entamoeba histolytica
TEQS

SEQ ID NO: 2660563 - protein, 13 aa, Entamoeba histolytica
TEQTESLRRQGND

SEQ ID NO: 2660564 - protein, 5 aa, Entamoeba histolytica
TEQTY

SEQ ID NO: 2660565 - protein, 12 aa, Entamoeba histolytica
TEQYNEENENRD

SEQ ID NO: 2660566 - protein, 8 aa, Entamoeba histolytica
TERARRRR

SEQ ID NO: 2660567 - protein, 6 aa, Entamoeba histolytica
TEREEI

SEQ ID NO: 2660568 - protein, 5 aa, Entamoeba histolytica
TERKQ

SEQ ID NO: 2660569 - protein, 19 aa, Entamoeba histolytica
TERKQHEHKERSRSRERNQ

SEQ ID NO: 2660570 - protein, 8 aa, Entamoeba histolytica
TERLEKSR

SEQ ID NO: 2660571 - protein, 11 aa, Entamoeba histolytica
TERLNDDDKDQ

SEQ ID NO: 2660572 - protein, 4 aa, Entamoeba histolytica
TERP

SEQ ID NO: 2660573 - protein, 6 aa, Entamoeba histolytica
TERPER

SEQ ID NO: 2660574 - protein, 5 aa, Entamoeba histolytica
TERQR

SEQ ID NO: 2660575 - protein, 4 aa, Entamoeba histolytica
TERS

SEQ ID NO: 2660576 - protein, 7 aa, Entamoeba histolytica
TERTKAL

SEQ ID NO: 2660577 - protein, 10 aa, Entamoeba histolytica
TERTSGKNGA

SEQ ID NO: 2660578 - protein, 6 aa, Entamoeba histolytica
TESCGG

SEQ ID NO: 2660579 - protein, 10 aa, Entamoeba histolytica
TESEALRSRI

SEQ ID NO: 2660580 - protein, 9 aa, Entamoeba histolytica
TESEHYDGS

SEQ ID NO: 2660581 - protein, 8 aa, Entamoeba histolytica
TESEKIEV

SEQ ID NO: 2660582 - protein, 12 aa, Entamoeba histolytica
TESESSLDMESA

SEQ ID NO: 2660583 - protein, 9 aa, Entamoeba histolytica
TESGQHQMD

SEQ ID NO: 2660584 - protein, 7 aa, Entamoeba histolytica
TESGYSN

SEQ ID NO: 2660585 - protein, 5 aa, Entamoeba histolytica
TESHQ

SEQ ID NO: 2660586 - protein, 6 aa, Entamoeba histolytica
TESIEK

SEQ ID NO: 2660587 - protein, 26 aa, Entamoeba histolytica
TESKEKPLLKEDSNNSKEENPKEEIK

SEQ ID NO: 2660588 - protein, 14 aa, Entamoeba histolytica
TESKTSQLIAIAWY

SEQ ID NO: 2660589 - protein, 10 aa, Entamoeba histolytica
TESNNKKQFT

SEQ ID NO: 2660590 - protein, 10 aa, Entamoeba histolytica
TESNQKQNNM

SEQ ID NO: 2660591 - protein, 5 aa, Entamoeba histolytica
TESPA

SEQ ID NO: 2660592 - protein, 6 aa, Entamoeba histolytica
TESRCK

SEQ ID NO: 2660593 - protein, 13 aa, Entamoeba histolytica
TESSALIKSSAAR

SEQ ID NO: 2660594 - protein, 22 aa, Entamoeba histolytica
TESSFKENSGKPYCFTCYGKLF

SEQ ID NO: 2660595 - protein, 12 aa, Entamoeba histolytica
TESSQSKNQSIE

SEQ ID NO: 2660596 - protein, 15 aa, Entamoeba histolytica
TESTSVSSDGKPVLG

SEQ ID NO: 2660597 - protein, 11 aa, Entamoeba histolytica
TESTTGKKALQ

SEQ ID NO: 2660598 - protein, 6 aa, Entamoeba histolytica
TESVSV

SEQ ID NO: 2660599 - protein, 6 aa, Entamoeba histolytica
TETAPI

SEQ ID NO: 2660600 - protein, 9 aa, Entamoeba histolytica
TETEAYQGA

SEQ ID NO: 2660601 - protein, 15 aa, Entamoeba histolytica
TETEGANQNDDAETV

SEQ ID NO: 2660602 - protein, 17 aa, Entamoeba histolytica
TETEKIAKQKNNETALK

SEQ ID NO: 2660603 - protein, 9 aa, Entamoeba histolytica
TETEPDGIY

SEQ ID NO: 2660604 - protein, 28 aa, Entamoeba histolytica
TETEQSNNNNSTFNHSSNPPSIPSTPTK

SEQ ID NO: 2660605 - protein, 6 aa, Entamoeba histolytica
TETEST

SEQ ID NO: 2660606 - protein, 5 aa, Entamoeba histolytica
TETFS

SEQ ID NO: 2660607 - protein, 7 aa, Entamoeba histolytica
TETGPKY

SEQ ID NO: 2660608 - protein, 4 aa, Entamoeba histolytica
TETK

SEQ ID NO: 2660609 - protein, 8 aa, Entamoeba histolytica
TETKKLAE

SEQ ID NO: 2660610 - protein, 13 aa, Entamoeba histolytica
TETKKSDKKEALA

SEQ ID NO: 2660611 - protein, 7 aa, Entamoeba histolytica
TETKTTI

SEQ ID NO: 2660612 - protein, 8 aa, Entamoeba histolytica
TETNLNDN

SEQ ID NO: 2660613 - protein, 18 aa, Entamoeba histolytica
TETPITSDYKQLSESHRK

SEQ ID NO: 2660614 - protein, 18 aa, Entamoeba histolytica
TETPKNVISKSKQTTVAD

SEQ ID NO: 2660615 - protein, 8 aa, Entamoeba histolytica
TETSPIPM

SEQ ID NO: 2660616 - protein, 6 aa, Entamoeba histolytica
TETSQC

SEQ ID NO: 2660617 - protein, 8 aa, Entamoeba histolytica
TETSYTNQ

SEQ ID NO: 2660618 - protein, 8 aa, Entamoeba histolytica
TETTDYQK

SEQ ID NO: 2660619 - protein, 15 aa, Entamoeba histolytica
TETTEYSSSSDDLEL

SEQ ID NO: 2660620 - protein, 6 aa, Entamoeba histolytica
TETTGM

SEQ ID NO: 2660621 - protein, 5 aa, Entamoeba histolytica
TETTH

SEQ ID NO: 2660622 - protein, 8 aa, Entamoeba histolytica
TETTPSAD

SEQ ID NO: 2660623 - protein, 9 aa, Entamoeba histolytica
TETVQDPSQ

SEQ ID NO: 2660624 - protein, 6 aa, Entamoeba histolytica
TEVDGP

SEQ ID NO: 2660625 - protein, 6 aa, Entamoeba histolytica
TEVEEP

SEQ ID NO: 2660626 - protein, 9 aa, Entamoeba histolytica
TEVEKRKPV

SEQ ID NO: 2660627 - protein, 9 aa, Entamoeba histolytica
TEVKESYEE

SEQ ID NO: 2660628 - protein, 14 aa, Entamoeba histolytica
TEVNDVSGAKIAKH

SEQ ID NO: 2660629 - protein, 17 aa, Entamoeba histolytica
TEVPPLTGPLSKTPNIE

SEQ ID NO: 2660630 - protein, 4 aa, Entamoeba histolytica
TEVT

SEQ ID NO: 2660631 - protein, 11 aa, Entamoeba histolytica
TEVYAQSTHAD

SEQ ID NO: 2660632 - protein, 4 aa, Entamoeba histolytica
TEWK

SEQ ID NO: 2660633 - protein, 9 aa, Entamoeba histolytica
TEYDKNGPI

SEQ ID NO: 2660634 - protein, 4 aa, Entamoeba histolytica
TEYE

SEQ ID NO: 2660635 - protein, 10 aa, Entamoeba histolytica
TEYEKNPKFN

SEQ ID NO: 2660636 - protein, 6 aa, Entamoeba histolytica
TEYKAC

SEQ ID NO: 2660637 - protein, 21 aa, Entamoeba histolytica
TEYNQSIGYSQQYSQESKSNN

SEQ ID NO: 2660638 - protein, 4 aa, Entamoeba histolytica
TEYQ

SEQ ID NO: 2660639 - protein, 5 aa, Entamoeba histolytica
TEYQE

SEQ ID NO: 2660640 - protein, 22 aa, Entamoeba histolytica
TEYRKATIKKENVIKKSDAINS

SEQ ID NO: 2660641 - protein, 31 aa, Entamoeba histolytica
TFAHENEEKTKEQENKSQIGKKEESPTSKPF

SEQ ID NO: 2660642 - protein, 19 aa, Entamoeba histolytica
TFDKRKNDRTDFSWFFNDL

SEQ ID NO: 2660643 - protein, 9 aa, Entamoeba histolytica
TFDSASDDI

SEQ ID NO: 2660644 - protein, 4 aa, Entamoeba histolytica
TFDY

SEQ ID NO: 2660645 - protein, 17 aa, Entamoeba histolytica
TFEKEKKNRLKRKPSEH

SEQ ID NO: 2660646 - protein, 18 aa, Entamoeba histolytica
TFENEEYNEETEKKEGDD

SEQ ID NO: 2660647 - protein, 22 aa, Entamoeba histolytica
TFENQQDKLPPTQSKHEITNQT

SEQ ID NO: 2660648 - protein, 6 aa, Entamoeba histolytica
TFEPKE

SEQ ID NO: 2660649 - protein, 5 aa, Entamoeba histolytica
TFEQS

SEQ ID NO: 2660650 - protein, 8 aa, Entamoeba histolytica
TFGHTSEV

SEQ ID NO: 2660651 - protein, 12 aa, Entamoeba histolytica
TFGKNDSLGSTH

SEQ ID NO: 2660652 - protein, 9 aa, Entamoeba histolytica
TFGKNEESV

SEQ ID NO: 2660653 - protein, 4 aa, Entamoeba histolytica
TFGQ

SEQ ID NO: 2660654 - protein, 12 aa, Entamoeba histolytica
TFGQQPNNSMGG

SEQ ID NO: 2660655 - protein, 30 aa, Entamoeba histolytica
TFGQQQNSGLGGFGQQPNNSMGGFGQPQNN

SEQ ID NO: 2660656 - protein, 15 aa, Entamoeba histolytica
TFGSDKKEDDEEEDD

SEQ ID NO: 2660657 - protein, 4 aa, Entamoeba histolytica
TFKE

SEQ ID NO: 2660658 - protein, 7 aa, Entamoeba histolytica
TFKGSEE

SEQ ID NO: 2660659 - protein, 5 aa, Entamoeba histolytica
TFKNG

SEQ ID NO: 2660660 - protein, 10 aa, Entamoeba histolytica
TFKPQYSESE

SEQ ID NO: 2660661 - protein, 22 aa, Entamoeba histolytica
TFKRSQSTQSTPQKRVYSSRSP

SEQ ID NO: 2660662 - protein, 15 aa, Entamoeba histolytica
TFKSRGGKDVQETFN

SEQ ID NO: 2660663 - protein, 6 aa, Entamoeba histolytica
TFNDGK

SEQ ID NO: 2660664 - protein, 6 aa, Entamoeba histolytica
TFNEKK

SEQ ID NO: 2660665 - protein, 13 aa, Entamoeba histolytica
TFNEKNKRLPVDS

SEQ ID NO: 2660666 - protein, 8 aa, Entamoeba histolytica
TFNGKENE

SEQ ID NO: 2660667 - protein, 7 aa, Entamoeba histolytica
TFNGSGK

SEQ ID NO: 2660668 - protein, 4 aa, Entamoeba histolytica
TFNK

SEQ ID NO: 2660669 - protein, 19 aa, Entamoeba histolytica
TFNSSQAQPIDVEEEKEET

SEQ ID NO: 2660670 - protein, 21 aa, Entamoeba histolytica
TFNSSTSYIPQQNQQYSYNPY

SEQ ID NO: 2660671 - protein, 16 aa, Entamoeba histolytica
TFNTPTVSQQNTFPSF

SEQ ID NO: 2660672 - protein, 11 aa, Entamoeba histolytica
TFNVPSDSNRL

SEQ ID NO: 2660673 - protein, 5 aa, Entamoeba histolytica
TFPAT

SEQ ID NO: 2660674 - protein, 49 aa, Entamoeba histolytica
TFPKEIEAKEKEYKSQKKKEVDEVSKVEKKLSSVSKNTKLQAKDPKALA

SEQ ID NO: 2660675 - protein, 12 aa, Entamoeba histolytica
TFPKGNDLPTSP

SEQ ID NO: 2660676 - protein, 9 aa, Entamoeba histolytica
TFPKKPKKA

SEQ ID NO: 2660677 - protein, 6 aa, Entamoeba histolytica
TFPPPI

SEQ ID NO: 2660678 - protein, 21 aa, Entamoeba histolytica
TFPQQGGNGTPQTNCQNNTPL

SEQ ID NO: 2660679 - protein, 23 aa, Entamoeba histolytica
TFPQQGGNGTSQTNCQNNTPLGR

SEQ ID NO: 2660680 - protein, 5 aa, Entamoeba histolytica
TFQED

SEQ ID NO: 2660681 - protein, 21 aa, Entamoeba histolytica
TFQENKRPTSAPLEPNNQGIE

SEQ ID NO: 2660682 - protein, 4 aa, Entamoeba histolytica
TFQQ

SEQ ID NO: 2660683 - protein, 8 aa, Entamoeba histolytica
TFREEYES

SEQ ID NO: 2660684 - protein, 4 aa, Entamoeba histolytica
TFRR

SEQ ID NO: 2660685 - protein, 12 aa, Entamoeba histolytica
TFSDPDINEYKN

SEQ ID NO: 2660686 - protein, 5 aa, Entamoeba histolytica
TFSNE

SEQ ID NO: 2660687 - protein, 13 aa, Entamoeba histolytica
TFSNEVDGMNTSM

SEQ ID NO: 2660688 - protein, 5 aa, Entamoeba histolytica
TFSPE

SEQ ID NO: 2660689 - protein, 7 aa, Entamoeba histolytica
TFSPSGK

SEQ ID NO: 2660690 - protein, 7 aa, Entamoeba histolytica
TFSPTTQ

SEQ ID NO: 2660691 - protein, 13 aa, Entamoeba histolytica
TFSSGKHNSTKLE

SEQ ID NO: 2660692 - protein, 13 aa, Entamoeba histolytica
TFSSPPMNQGDKK

SEQ ID NO: 2660693 - protein, 4 aa, Entamoeba histolytica
TFTD

SEQ ID NO: 2660694 - protein, 10 aa, Entamoeba histolytica
TFTDQQKDAT

SEQ ID NO: 2660695 - protein, 11 aa, Entamoeba histolytica
TFTNRGKRVSD

SEQ ID NO: 2660696 - protein, 12 aa, Entamoeba histolytica
TFTSDDSLGDAK

SEQ ID NO: 2660697 - protein, 13 aa, Entamoeba histolytica
TGADGTIQWYSDW

SEQ ID NO: 2660698 - protein, 8 aa, Entamoeba histolytica
TGADKKAL

SEQ ID NO: 2660699 - protein, 9 aa, Entamoeba histolytica
TGAFSTKGK

SEQ ID NO: 2660700 - protein, 5 aa, Entamoeba histolytica
TGAGF

SEQ ID NO: 2660701 - protein, 8 aa, Entamoeba histolytica
TGAGLSGR

SEQ ID NO: 2660702 - protein, 4 aa, Entamoeba histolytica
TGAL

SEQ ID NO: 2660703 - protein, 4 aa, Entamoeba histolytica
TGAN

SEQ ID NO: 2660704 - protein, 7 aa, Entamoeba histolytica
TGANGQK

SEQ ID NO: 2660705 - protein, 7 aa, Entamoeba histolytica
TGAPNMP

SEQ ID NO: 2660706 - protein, 6 aa, Entamoeba histolytica
TGATAK

SEQ ID NO: 2660707 - protein, 5 aa, Entamoeba histolytica
TGATL

SEQ ID NO: 2660708 - protein, 6 aa, Entamoeba histolytica
TGCADG

SEQ ID NO: 2660709 - protein, 7 aa, Entamoeba histolytica
TGCGKSR

SEQ ID NO: 2660710 - protein, 6 aa, Entamoeba histolytica
TGCGKT

SEQ ID NO: 2660711 - protein, 7 aa, Entamoeba histolytica
TGCGKTT

SEQ ID NO: 2660712 - protein, 10 aa, Entamoeba histolytica
TGCGKTTQLT

SEQ ID NO: 2660713 - protein, 16 aa, Entamoeba histolytica
TGCNGTTGAYSPSKGL

SEQ ID NO: 2660714 - protein, 10 aa, Entamoeba histolytica
TGCPSGKKIK

SEQ ID NO: 2660715 - protein, 4 aa, Entamoeba histolytica
TGCS

SEQ ID NO: 2660716 - protein, 7 aa, Entamoeba histolytica
TGDASTI

SEQ ID NO: 2660717 - protein, 21 aa, Entamoeba histolytica
TGDDDFKDLPPVKPWQDTTVT

SEQ ID NO: 2660718 - protein, 6 aa, Entamoeba histolytica
TGDEND

SEQ ID NO: 2660719 - protein, 8 aa, Entamoeba histolytica
TGDETGKI

SEQ ID NO: 2660720 - protein, 8 aa, Entamoeba histolytica
TGDGESRA

SEQ ID NO: 2660721 - protein, 6 aa, Entamoeba histolytica
TGDGIS

SEQ ID NO: 2660722 - protein, 14 aa, Entamoeba histolytica
TGDGTIRKNVDART

SEQ ID NO: 2660723 - protein, 5 aa, Entamoeba histolytica
TGDGV

SEQ ID NO: 2660724 - protein, 4 aa, Entamoeba histolytica
TGDH

SEQ ID NO: 2660725 - protein, 5 aa, Entamoeba histolytica
TGDHL

SEQ ID NO: 2660726 - protein, 4 aa, Entamoeba histolytica
TGDI

SEQ ID NO: 2660727 - protein, 29 aa, Entamoeba histolytica
TGDINTQPTYTPNDQSMINETKQHNNEIK

SEQ ID NO: 2660728 - protein, 8 aa, Entamoeba histolytica
TGDNCPSI

SEQ ID NO: 2660729 - protein, 6 aa, Entamoeba histolytica
TGDREP

SEQ ID NO: 2660730 - protein, 18 aa, Entamoeba histolytica
TGDTAISSSYYNPNGSIE

SEQ ID NO: 2660731 - protein, 4 aa, Entamoeba histolytica
TGEE

SEQ ID NO: 2660732 - protein, 6 aa, Entamoeba histolytica
TGEEAK

SEQ ID NO: 2660733 - protein, 7 aa, Entamoeba histolytica
TGEETPY

SEQ ID NO: 2660734 - protein, 7 aa, Entamoeba histolytica
TGEGDNE

SEQ ID NO: 2660735 - protein, 7 aa, Entamoeba histolytica
TGEGKES

SEQ ID NO: 2660736 - protein, 15 aa, Entamoeba histolytica
TGELTESVQEDEYPL

SEQ ID NO: 2660737 - protein, 10 aa, Entamoeba histolytica
TGENPQNFRT

SEQ ID NO: 2660738 - protein, 11 aa, Entamoeba histolytica
TGENTQTLDVS

SEQ ID NO: 2660739 - protein, 13 aa, Entamoeba histolytica
TGEPRPLKPEEMT

SEQ ID NO: 2660740 - protein, 12 aa, Entamoeba histolytica
TGESGTKATGIP

SEQ ID NO: 2660741 - protein, 5 aa, Entamoeba histolytica
TGETL

SEQ ID NO: 2660742 - protein, 8 aa, Entamoeba histolytica
TGETPQQL

SEQ ID NO: 2660743 - protein, 6 aa, Entamoeba histolytica
TGETTI

SEQ ID NO: 2660744 - protein, 5 aa, Entamoeba histolytica
TGEVQ

SEQ ID NO: 2660745 - protein, 10 aa, Entamoeba histolytica
TGFGGKGANQ

SEQ ID NO: 2660746 - protein, 22 aa, Entamoeba histolytica
TGFHSSGGSKKTALSIEKGNQF

SEQ ID NO: 2660747 - protein, 8 aa, Entamoeba histolytica
TGFNEESK

SEQ ID NO: 2660748 - protein, 5 aa, Entamoeba histolytica
TGFQP

SEQ ID NO: 2660749 - protein, 31 aa, Entamoeba histolytica
TGFTCDSRSTIQLSTESQKSTKEEIQSVNHP

SEQ ID NO: 2660750 - protein, 8 aa, Entamoeba histolytica
TGFTGTSQ

SEQ ID NO: 2660751 - protein, 9 aa, Entamoeba histolytica
TGGEDAQYD

SEQ ID NO: 2660752 - protein, 7 aa, Entamoeba histolytica
TGGEVPA

SEQ ID NO: 2660753 - protein, 6 aa, Entamoeba histolytica
TGGGAY

SEQ ID NO: 2660754 - protein, 9 aa, Entamoeba histolytica
TGGGSSDRT

SEQ ID NO: 2660755 - protein, 8 aa, Entamoeba histolytica
TGGIAGET

SEQ ID NO: 2660756 - protein, 11 aa, Entamoeba histolytica
TGGKDTKEEAK

SEQ ID NO: 2660757 - protein, 15 aa, Entamoeba histolytica
TGGKTVDDSRLAGRK

SEQ ID NO: 2660758 - protein, 6 aa, Entamoeba histolytica
TGGKVP

SEQ ID NO: 2660759 - protein, 4 aa, Entamoeba histolytica
TGGM

SEQ ID NO: 2660760 - protein, 7 aa, Entamoeba histolytica
TGGNDGI

SEQ ID NO: 2660761 - protein, 5 aa, Entamoeba histolytica
TGGNK

SEQ ID NO: 2660762 - protein, 29 aa, Entamoeba histolytica
TGGSDNTSIAKNSNKMKQAYAFGEKIAQK

SEQ ID NO: 2660763 - protein, 7 aa, Entamoeba histolytica
TGGSNDV

SEQ ID NO: 2660764 - protein, 9 aa, Entamoeba histolytica
TGGYKTKNY

SEQ ID NO: 2660765 - protein, 5 aa, Entamoeba histolytica
TGHEK

SEQ ID NO: 2660766 - protein, 6 aa, Entamoeba histolytica
TGHENR

SEQ ID NO: 2660767 - protein, 11 aa, Entamoeba histolytica
TGHKSHEKIPI

SEQ ID NO: 2660768 - protein, 17 aa, Entamoeba histolytica
TGHKSRDCPKAKGNNRP

SEQ ID NO: 2660769 - protein, 5 aa, Entamoeba histolytica
TGHND

SEQ ID NO: 2660770 - protein, 9 aa, Entamoeba histolytica
TGHNGDDVA

SEQ ID NO: 2660771 - protein, 14 aa, Entamoeba histolytica
TGHNPALVQNFTSE

SEQ ID NO: 2660772 - protein, 4 aa, Entamoeba histolytica
TGHP

SEQ ID NO: 2660773 - protein, 8 aa, Entamoeba histolytica
TGHSQAVS

SEQ ID NO: 2660774 - protein, 5 aa, Entamoeba histolytica
TGHSY

SEQ ID NO: 2660775 - protein, 8 aa, Entamoeba histolytica
TGHVESEQ

SEQ ID NO: 2660776 - protein, 17 aa, Entamoeba histolytica
TGHYTPASAGNSPINRP

SEQ ID NO: 2660777 - protein, 8 aa, Entamoeba histolytica
TGIEGDIK

SEQ ID NO: 2660778 - protein, 5 aa, Entamoeba histolytica
TGIGH

SEQ ID NO: 2660779 - protein, 4 aa, Entamoeba histolytica
TGIK

SEQ ID NO: 2660780 - protein, 6 aa, Entamoeba histolytica
TGINEE

SEQ ID NO: 2660781 - protein, 5 aa, Entamoeba histolytica
TGINV

SEQ ID NO: 2660782 - protein, 8 aa, Entamoeba histolytica
TGIPKETG

SEQ ID NO: 2660783 - protein, 10 aa, Entamoeba histolytica
TGIQSSNVGR

SEQ ID NO: 2660784 - protein, 5 aa, Entamoeba histolytica
TGIRK

SEQ ID NO: 2660785 - protein, 7 aa, Entamoeba histolytica
TGISSES

SEQ ID NO: 2660786 - protein, 7 aa, Entamoeba histolytica
TGITKED

SEQ ID NO: 2660787 - protein, 12 aa, Entamoeba histolytica
TGITKGRKFSYS

SEQ ID NO: 2660788 - protein, 7 aa, Entamoeba histolytica
TGKCWKD

SEQ ID NO: 2660789 - protein, 8 aa, Entamoeba histolytica
TGKCWKDD

SEQ ID NO: 2660790 - protein, 12 aa, Entamoeba histolytica
TGKDDTKRTSKA

SEQ ID NO: 2660791 - protein, 10 aa, Entamoeba histolytica
TGKDLPKDTI

SEQ ID NO: 2660792 - protein, 5 aa, Entamoeba histolytica
TGKEV

SEQ ID NO: 2660793 - protein, 4 aa, Entamoeba histolytica
TGKG

SEQ ID NO: 2660794 - protein, 4 aa, Entamoeba histolytica
TGKI

SEQ ID NO: 2660795 - protein, 5 aa, Entamoeba histolytica
TGKIA

SEQ ID NO: 2660796 - protein, 11 aa, Entamoeba histolytica
TGKKSKEEIKA

SEQ ID NO: 2660797 - protein, 5 aa, Entamoeba histolytica
TGKNG

SEQ ID NO: 2660798 - protein, 8 aa, Entamoeba histolytica
TGKNKKGI

SEQ ID NO: 2660799 - protein, 10 aa, Entamoeba histolytica
TGKQKEENFG

SEQ ID NO: 2660800 - protein, 4 aa, Entamoeba histolytica
TGKS

SEQ ID NO: 2660801 - protein, 10 aa, Entamoeba histolytica
TGKSFGKYKA

SEQ ID NO: 2660802 - protein, 5 aa, Entamoeba histolytica
TGKSL

SEQ ID NO: 2660803 - protein, 5 aa, Entamoeba histolytica
TGKSS

SEQ ID NO: 2660804 - protein, 8 aa, Entamoeba histolytica
TGKSYSGT

SEQ ID NO: 2660805 - protein, 12 aa, Entamoeba histolytica
TGKTATPDQAQE

SEQ ID NO: 2660806 - protein, 9 aa, Entamoeba histolytica
TGKTFKGEF

SEQ ID NO: 2660807 - protein, 17 aa, Entamoeba histolytica
TGKTLDKKYDKNPKDVI

SEQ ID NO: 2660808 - protein, 8 aa, Entamoeba histolytica
TGKVNDGV

SEQ ID NO: 2660809 - protein, 12 aa, Entamoeba histolytica
TGKYTRKQEDII

SEQ ID NO: 2660810 - protein, 4 aa, Entamoeba histolytica
TGLE

SEQ ID NO: 2660811 - protein, 32 aa, Entamoeba histolytica
TGLGSSTGLSTGLGSSTSSGFGLGSSTSSGFG

SEQ ID NO: 2660812 - protein, 4 aa, Entamoeba histolytica
TGLN

SEQ ID NO: 2660813 - protein, 16 aa, Entamoeba histolytica
TGLNPGNNAAESLASE

SEQ ID NO: 2660814 - protein, 5 aa, Entamoeba histolytica
TGLTP

SEQ ID NO: 2660815 - protein, 5 aa, Entamoeba histolytica
TGMNN

SEQ ID NO: 2660816 - protein, 4 aa, Entamoeba histolytica
TGNA

SEQ ID NO: 2660817 - protein, 10 aa, Entamoeba histolytica
TGNALKGSRP

SEQ ID NO: 2660818 - protein, 32 aa, Entamoeba histolytica
TGNDITEQAKAKSKARGIAARARGGKKTNLSN

SEQ ID NO: 2660819 - protein, 5 aa, Entamoeba histolytica
TGNDL

SEQ ID NO: 2660820 - protein, 19 aa, Entamoeba histolytica
TGNDMSISTGWGGGYDGED

SEQ ID NO: 2660821 - protein, 5 aa, Entamoeba histolytica
TGNDN

SEQ ID NO: 2660822 - protein, 4 aa, Entamoeba histolytica
TGNE

SEQ ID NO: 2660823 - protein, 6 aa, Entamoeba histolytica
TGNETG

SEQ ID NO: 2660824 - protein, 4 aa, Entamoeba histolytica
TGNF

SEQ ID NO: 2660825 - protein, 11 aa, Entamoeba histolytica
TGNFTANAQDI

SEQ ID NO: 2660826 - protein, 12 aa, Entamoeba histolytica
TGNGDISKGIPI

SEQ ID NO: 2660827 - protein, 5 aa, Entamoeba histolytica
TGNGF

SEQ ID NO: 2660828 - protein, 8 aa, Entamoeba histolytica
TGNGISGI

SEQ ID NO: 2660829 - protein, 6 aa, Entamoeba histolytica
TGNGRN

SEQ ID NO: 2660830 - protein, 5 aa, Entamoeba histolytica
TGNHD

SEQ ID NO: 2660831 - protein, 4 aa, Entamoeba histolytica
TGNI

SEQ ID NO: 2660832 - protein, 8 aa, Entamoeba histolytica
TGNIPDNY

SEQ ID NO: 2660833 - protein, 7 aa, Entamoeba histolytica
TGNIQSG

SEQ ID NO: 2660834 - protein, 4 aa, Entamoeba histolytica
TGNN

SEQ ID NO: 2660835 - protein, 7 aa, Entamoeba histolytica
TGNPNKV

SEQ ID NO: 2660836 - protein, 8 aa, Entamoeba histolytica
TGNQQPAI

SEQ ID NO: 2660837 - protein, 6 aa, Entamoeba histolytica
TGNSLQ

SEQ ID NO: 2660838 - protein, 5 aa, Entamoeba histolytica
TGNSW

SEQ ID NO: 2660839 - protein, 6 aa, Entamoeba histolytica
TGNTAG

SEQ ID NO: 2660840 - protein, 7 aa, Entamoeba histolytica
TGNTKNR

SEQ ID NO: 2660841 - protein, 9 aa, Entamoeba histolytica
TGNTSESAL

SEQ ID NO: 2660842 - protein, 7 aa, Entamoeba histolytica
TGNVEAA

SEQ ID NO: 2660843 - protein, 5 aa, Entamoeba histolytica
TGPAT

SEQ ID NO: 2660844 - protein, 15 aa, Entamoeba histolytica
TGPIQSDANHQQSEK

SEQ ID NO: 2660845 - protein, 9 aa, Entamoeba histolytica
TGPKADISK

SEQ ID NO: 2660846 - protein, 11 aa, Entamoeba histolytica
TGPNGAGKTTI

SEQ ID NO: 2660847 - protein, 10 aa, Entamoeba histolytica
TGPNSSGKTV

SEQ ID NO: 2660848 - protein, 5 aa, Entamoeba histolytica
TGPQG

SEQ ID NO: 2660849 - protein, 10 aa, Entamoeba histolytica
TGPSPITGEI

SEQ ID NO: 2660850 - protein, 10 aa, Entamoeba histolytica
TGPTSFSTSI

SEQ ID NO: 2660851 - protein, 11 aa, Entamoeba histolytica
TGPVAEQREIG

SEQ ID NO: 2660852 - protein, 17 aa, Entamoeba histolytica
TGQKGYISKRPKIEEAR

SEQ ID NO: 2660853 - protein, 7 aa, Entamoeba histolytica
TGQPSSL

SEQ ID NO: 2660854 - protein, 6 aa, Entamoeba histolytica
TGQSAI

SEQ ID NO: 2660855 - protein, 17 aa, Entamoeba histolytica
TGQSDFPNQQPQQTTFQ

SEQ ID NO: 2660856 - protein, 9 aa, Entamoeba histolytica
TGRDQALQE

SEQ ID NO: 2660857 - protein, 7 aa, Entamoeba histolytica
TGRKTEV

SEQ ID NO: 2660858 - protein, 5 aa, Entamoeba histolytica
TGRLN

SEQ ID NO: 2660859 - protein, 4 aa, Entamoeba histolytica
TGRV

SEQ ID NO: 2660860 - protein, 6 aa, Entamoeba histolytica
TGRYNV

SEQ ID NO: 2660861 - protein, 11 aa, Entamoeba histolytica
TGSFGENGSQA

SEQ ID NO: 2660862 - protein, 7 aa, Entamoeba histolytica
TGSGKNA

SEQ ID NO: 2660863 - protein, 6 aa, Entamoeba histolytica
TGSHEP

SEQ ID NO: 2660864 - protein, 6 aa, Entamoeba histolytica
TGSHPP

SEQ ID NO: 2660865 - protein, 8 aa, Entamoeba histolytica
TGSHQPDT

SEQ ID NO: 2660866 - protein, 7 aa, Entamoeba histolytica
TGSIGGN

SEQ ID NO: 2660867 - protein, 5 aa, Entamoeba histolytica
TGSII

SEQ ID NO: 2660868 - protein, 15 aa, Entamoeba histolytica
TGSKCVTSKQHNNNI

SEQ ID NO: 2660869 - protein, 6 aa, Entamoeba histolytica
TGSKDG

SEQ ID NO: 2660870 - protein, 8 aa, Entamoeba histolytica
TGSKDKKL

SEQ ID NO: 2660871 - protein, 9 aa, Entamoeba histolytica
TGSKPVIQS

SEQ ID NO: 2660872 - protein, 5 aa, Entamoeba histolytica
TGSMG

SEQ ID NO: 2660873 - protein, 15 aa, Entamoeba histolytica
TGSNASSGKKTYGRN

SEQ ID NO: 2660874 - protein, 8 aa, Entamoeba histolytica
TGSNCGDV

SEQ ID NO: 2660875 - protein, 6 aa, Entamoeba histolytica
TGSNSL

SEQ ID NO: 2660876 - protein, 8 aa, Entamoeba histolytica
TGSRFNGK

SEQ ID NO: 2660877 - protein, 9 aa, Entamoeba histolytica
TGSRNPHSW

SEQ ID NO: 2660878 - protein, 11 aa, Entamoeba histolytica
TGSSLTSSGDK

SEQ ID NO: 2660879 - protein, 5 aa, Entamoeba histolytica
TGSSP

SEQ ID NO: 2660880 - protein, 7 aa, Entamoeba histolytica
TGSTDGI

SEQ ID NO: 2660881 - protein, 6 aa, Entamoeba histolytica
TGTAVS

SEQ ID NO: 2660882 - protein, 4 aa, Entamoeba histolytica
TGTE

SEQ ID NO: 2660883 - protein, 5 aa, Entamoeba histolytica
TGTEQ

SEQ ID NO: 2660884 - protein, 9 aa, Entamoeba histolytica
TGTGKTFTA

SEQ ID NO: 2660885 - protein, 7 aa, Entamoeba histolytica
TGTGSTL

SEQ ID NO: 2660886 - protein, 4 aa, Entamoeba histolytica
TGTK

SEQ ID NO: 2660887 - protein, 13 aa, Entamoeba histolytica
TGTKMYETKRAEA

SEQ ID NO: 2660888 - protein, 4 aa, Entamoeba histolytica
TGTL

SEQ ID NO: 2660889 - protein, 19 aa, Entamoeba histolytica
TGTNDTNKSSDDCSNVDKS

SEQ ID NO: 2660890 - protein, 19 aa, Entamoeba histolytica
TGTNHPAEFTTRRVIVVQM

SEQ ID NO: 2660891 - protein, 10 aa, Entamoeba histolytica
TGTNIDNGSE

SEQ ID NO: 2660892 - protein, 8 aa, Entamoeba histolytica
TGTQTGEG

SEQ ID NO: 2660893 - protein, 9 aa, Entamoeba histolytica
TGTSSKVTN

SEQ ID NO: 2660894 - protein, 7 aa, Entamoeba histolytica
TGTYNDK

SEQ ID NO: 2660895 - protein, 12 aa, Entamoeba histolytica
TGVDPTQTTGKL

SEQ ID NO: 2660896 - protein, 6 aa, Entamoeba histolytica
TGVGKS

SEQ ID NO: 2660897 - protein, 7 aa, Entamoeba histolytica
TGVGKSS

SEQ ID NO: 2660898 - protein, 8 aa, Entamoeba histolytica
TGVGKSSL

SEQ ID NO: 2660899 - protein, 7 aa, Entamoeba histolytica
TGVPSKR

SEQ ID NO: 2660900 - protein, 4 aa, Entamoeba histolytica
TGVY

SEQ ID NO: 2660901 - protein, 7 aa, Entamoeba histolytica
TGVYPPK

SEQ ID NO: 2660902 - protein, 13 aa, Entamoeba histolytica
TGWGTKQGGSWKS

SEQ ID NO: 2660903 - protein, 14 aa, Entamoeba histolytica
TGWPAGKRIKPTER

SEQ ID NO: 2660904 - protein, 4 aa, Entamoeba histolytica
TGYE

SEQ ID NO: 2660905 - protein, 6 aa, Entamoeba histolytica
TGYEEA

SEQ ID NO: 2660906 - protein, 5 aa, Entamoeba histolytica
TGYEN

SEQ ID NO: 2660907 - protein, 17 aa, Entamoeba histolytica
TGYGSNIGDPSESNCDQ

SEQ ID NO: 2660908 - protein, 10 aa, Entamoeba histolytica
TGYPASPPRC

SEQ ID NO: 2660909 - protein, 7 aa, Entamoeba histolytica
TGYPVVG

SEQ ID NO: 2660910 - protein, 9 aa, Entamoeba histolytica
TGYRQCNSN

SEQ ID NO: 2660911 - protein, 5 aa, Entamoeba histolytica
TGYTQ

SEQ ID NO: 2660912 - protein, 4 aa, Entamoeba histolytica
TGYY

SEQ ID NO: 2660913 - protein, 6 aa, Entamoeba histolytica
THAGFT

SEQ ID NO: 2660914 - protein, 5 aa, Entamoeba histolytica
THARD

SEQ ID NO: 2660915 - protein, 5 aa, Entamoeba histolytica
THCPD

SEQ ID NO: 2660916 - protein, 5 aa, Entamoeba histolytica
THDEM

SEQ ID NO: 2660917 - protein, 21 aa, Entamoeba histolytica
THDGRSPDYDDWSSETKEGYH

SEQ ID NO: 2660918 - protein, 5 aa, Entamoeba histolytica
THDHQ

SEQ ID NO: 2660919 - protein, 5 aa, Entamoeba histolytica
THDNE

SEQ ID NO: 2660920 - protein, 4 aa, Entamoeba histolytica
THDP

SEQ ID NO: 2660921 - protein, 7 aa, Entamoeba histolytica
THDPKQC

SEQ ID NO: 2660922 - protein, 10 aa, Entamoeba histolytica
THDSAAQAIS

SEQ ID NO: 2660923 - protein, 7 aa, Entamoeba histolytica
THDSQGL

SEQ ID NO: 2660924 - protein, 11 aa, Entamoeba histolytica
THEDKEQLKKA

SEQ ID NO: 2660925 - protein, 22 aa, Entamoeba histolytica
THEDTSKEVKENKEVKENKEVK

SEQ ID NO: 2660926 - protein, 11 aa, Entamoeba histolytica
THENEKPFNGT

SEQ ID NO: 2660927 - protein, 8 aa, Entamoeba histolytica
THEPKIPD

SEQ ID NO: 2660928 - protein, 8 aa, Entamoeba histolytica
THGSSSQI

SEQ ID NO: 2660929 - protein, 9 aa, Entamoeba histolytica
THGSYPKTE

SEQ ID NO: 2660930 - protein, 13 aa, Entamoeba histolytica
THGTSKKTCQRRF

SEQ ID NO: 2660931 - protein, 10 aa, Entamoeba histolytica
THISDGGASI

SEQ ID NO: 2660932 - protein, 17 aa, Entamoeba histolytica
THISDTEDIEKETLDDI

SEQ ID NO: 2660933 - protein, 10 aa, Entamoeba histolytica
THISPRQFSG

SEQ ID NO: 2660934 - protein, 7 aa, Entamoeba histolytica
THKDTVA

SEQ ID NO: 2660935 - protein, 6 aa, Entamoeba histolytica
THKEDT

SEQ ID NO: 2660936 - protein, 4 aa, Entamoeba histolytica
THKG

SEQ ID NO: 2660937 - protein, 9 aa, Entamoeba histolytica
THKKSTGEW

SEQ ID NO: 2660938 - protein, 31 aa, Entamoeba histolytica
THKKSVDSLKSKNELTKPIKEEKESNEKKKF

SEQ ID NO: 2660939 - protein, 36 aa, Entamoeba histolytica
THMSQESSISDRTNTAPSSVQSSVTTSAIGSTQQTL

SEQ ID NO: 2660940 - protein, 20 aa, Entamoeba histolytica
THMTSKQTPVIENQNSLSKQ

SEQ ID NO: 2660941 - protein, 6 aa, Entamoeba histolytica
THMTYD

SEQ ID NO: 2660942 - protein, 6 aa, Entamoeba histolytica
THNATQ

SEQ ID NO: 2660943 - protein, 4 aa, Entamoeba histolytica
THNK

SEQ ID NO: 2660944 - protein, 16 aa, Entamoeba histolytica
THNKSQKYKKTKNYQV

SEQ ID NO: 2660945 - protein, 12 aa, Entamoeba histolytica
THNLKATDNPNR

SEQ ID NO: 2660946 - protein, 5 aa, Entamoeba histolytica
THNNG

SEQ ID NO: 2660947 - protein, 6 aa, Entamoeba histolytica
THNNPS

SEQ ID NO: 2660948 - protein, 10 aa, Entamoeba histolytica
THNPKGTNFL

SEQ ID NO: 2660949 - protein, 14 aa, Entamoeba histolytica
THPDKIKNPQPSDF

SEQ ID NO: 2660950 - protein, 4 aa, Entamoeba histolytica
THPE

SEQ ID NO: 2660951 - protein, 30 aa, Entamoeba histolytica; identical to SEQ ID NO: 2465781

SEQ ID NO: 2660952 - protein, 5 aa, Entamoeba histolytica
THPEV

SEQ ID NO: 2660953 - protein, 5 aa, Entamoeba histolytica
THPGQ

SEQ ID NO: 2660954 - protein, 4 aa, Entamoeba histolytica
THPI

SEQ ID NO: 2660955 - protein, 4 aa, Entamoeba histolytica
THPK

SEQ ID NO: 2660956 - protein, 12 aa, Entamoeba histolytica
THPKHPDYSTLK

SEQ ID NO: 2660957 - protein, 18 aa, Entamoeba histolytica
THPNLEEKMKQDKTEKYI

SEQ ID NO: 2660958 - protein, 4 aa, Entamoeba histolytica
THPS

SEQ ID NO: 2660959 - protein, 4 aa, Entamoeba histolytica
THPT

SEQ ID NO: 2660960 - protein, 7 aa, Entamoeba histolytica
THPTDPL

SEQ ID NO: 2660961 - protein, 5 aa, Entamoeba histolytica
THPVG

SEQ ID NO: 2660962 - protein, 6 aa, Entamoeba histolytica
THQQEG

SEQ ID NO: 2660963 - protein, 12 aa, Entamoeba histolytica
THQSNSKWKPQE

SEQ ID NO: 2660964 - protein, 6 aa, Entamoeba histolytica
THQTTS

SEQ ID NO: 2660965 - protein, 10 aa, Entamoeba histolytica
THSESDAVVT

SEQ ID NO: 2660966 - protein, 7 aa, Entamoeba histolytica
THSGRVS

SEQ ID NO: 2660967 - protein, 18 aa, Entamoeba histolytica
THSIQTKQNNKENEEDEL

SEQ ID NO: 2660968 - protein, 5 aa, Entamoeba histolytica
THSKS

SEQ ID NO: 2660969 - protein, 20 aa, Entamoeba histolytica
THSQIEKNKKECGEKGKKSF

SEQ ID NO: 2660970 - protein, 5 aa, Entamoeba histolytica
THSQK

SEQ ID NO: 2660971 - protein, 15 aa, Entamoeba histolytica
THSSQHSVKTPSTTI

SEQ ID NO: 2660972 - protein, 7 aa, Entamoeba histolytica
THSTEGV

SEQ ID NO: 2660973 - protein, 15 aa, Entamoeba histolytica
THTKKSTYKHTTNIK

SEQ ID NO: 2660974 - protein, 6 aa, Entamoeba histolytica
THTNQL

SEQ ID NO: 2660975 - protein, 4 aa, Entamoeba histolytica
THTP

SEQ ID NO: 2660976 - protein, 8 aa, Entamoeba histolytica
THTSAIQK

SEQ ID NO: 2660977 - protein, 27 aa, Entamoeba histolytica
THVGKSAPRMKGKVEHKGAAAETKKLE

SEQ ID NO: 2660978 - protein, 5 aa, Entamoeba histolytica
THWAN

SEQ ID NO: 2660979 - protein, 16 aa, Entamoeba histolytica
THYNSQNQNENQNENN

SEQ ID NO: 2660980 - protein, 16 aa, Entamoeba histolytica
TIAEEEEEEDEDEQMN

SEQ ID NO: 2660981 - protein, 8 aa, Entamoeba histolytica
TIAGDNDG

SEQ ID NO: 2660982 - protein, 6 aa, Entamoeba histolytica
TIAGGP

SEQ ID NO: 2660983 - protein, 7 aa, Entamoeba histolytica
TIARSST

SEQ ID NO: 2660984 - protein, 6 aa, Entamoeba histolytica
TIATNE

SEQ ID NO: 2660985 - protein, 14 aa, Entamoeba histolytica
TIATSKPNKNSDRI

SEQ ID NO: 2660986 - protein, 18 aa, Entamoeba histolytica
TIDDDDGWKVKQDKNGTK

SEQ ID NO: 2660987 - protein, 10 aa, Entamoeba histolytica
TIDESDPNPY

SEQ ID NO: 2660988 - protein, 7 aa, Entamoeba histolytica
TIDEVAN

SEQ ID NO: 2660989 - protein, 4 aa, Entamoeba histolytica
TIDG

SEQ ID NO: 2660990 - protein, 6 aa, Entamoeba histolytica
TIDGDA

SEQ ID NO: 2660991 - protein, 16 aa, Entamoeba histolytica
TIDGKEMTQLDDEGRV

SEQ ID NO: 2660992 - protein, 6 aa, Entamoeba histolytica
TIDGSR

SEQ ID NO: 2660993 - protein, 4 aa, Entamoeba histolytica
TIDK

SEQ ID NO: 2660994 - protein, 4 aa, Entamoeba histolytica
TIDN

SEQ ID NO: 2660995 - protein, 9 aa, Entamoeba histolytica
TIDPSEDEL

SEQ ID NO: 2660996 - protein, 6 aa, Entamoeba histolytica
TIEDDQ

SEQ ID NO: 2660997 - protein, 6 aa, Entamoeba histolytica
TIEDRK

SEQ ID NO: 2660998 - protein, 15 aa, Entamoeba histolytica
TIEEGTKQQVLDSLL

SEQ ID NO: 2660999 - protein, 9 aa, Entamoeba histolytica
TIEEKRAQY

SEQ ID NO: 2661000 - protein, 10 aa, Entamoeba histolytica
TIEENKREEL

SEQ ID NO: 2661001 - protein, 11 aa, Entamoeba histolytica
TIEESKSKETD

SEQ ID NO: 2661002 - protein, 11 aa, Entamoeba histolytica
TIEGGEQSLTE

SEQ ID NO: 2661003 - protein, 11 aa, Entamoeba histolytica
TIEGKKVNERV

SEQ ID NO: 2661004 - protein, 15 aa, Entamoeba histolytica
TIEKATENKQQSREI

SEQ ID NO: 2661005 - protein, 6 aa, Entamoeba histolytica
TIEKKE

SEQ ID NO: 2661006 - protein, 10 aa, Entamoeba histolytica
TIEKPRTISK

SEQ ID NO: 2661007 - protein, 10 aa, Entamoeba histolytica
TIEKRSGDVI

SEQ ID NO: 2661008 - protein, 14 aa, Entamoeba histolytica
TIEKSDKSYEAKTK

SEQ ID NO: 2661009 - protein, 10 aa, Entamoeba histolytica
TIELNTSDGK

SEQ ID NO: 2661010 - protein, 9 aa, Entamoeba histolytica
TIEQDPREF

SEQ ID NO: 2661011 - protein, 29 aa, Entamoeba histolytica
TIEQLSTNKPMEEETKENDNKENKSEDEL

SEQ ID NO: 2661012 - protein, 5 aa, Entamoeba histolytica
TIEQM

SEQ ID NO: 2661013 - protein, 6 aa, Entamoeba histolytica
TIEQNN

SEQ ID NO: 2661014 - protein, 49 aa, Entamoeba histolytica
TIEQTKEKMENEKQEETEKADEKIKGGNEDNSNEEDIDIEEDEKEQEYP

SEQ ID NO: 2661015 - protein, 9 aa, Entamoeba histolytica
TIESNENVD

SEQ ID NO: 2661016 - protein, 6 aa, Entamoeba histolytica
TIESSV

SEQ ID NO: 2661017 - protein, 4 aa, Entamoeba histolytica
TIET

SEQ ID NO: 2661018 - protein, 18 aa, Entamoeba histolytica
TIETKEQSVEGKKRQLEI

SEQ ID NO: 2661019 - protein, 6 aa, Entamoeba histolytica
TIFTGA

SEQ ID NO: 2661020 - protein, 7 aa, Entamoeba histolytica
TIGANYS

SEQ ID NO: 2661021 - protein, 21 aa, Entamoeba histolytica
TIGDESIEVSDEERNKKIESV

SEQ ID NO: 2661022 - protein, 6 aa, Entamoeba histolytica
TIGDGM

SEQ ID NO: 2661023 - protein, 4 aa, Entamoeba histolytica
TIGE

SEQ ID NO: 2661024 - protein, 12 aa, Entamoeba histolytica
TIGEKFKEQGLK

SEQ ID NO: 2661025 - protein, 25 aa, Entamoeba histolytica
TIGEKSKSGRRSLKRTGSCAELQPS

SEQ ID NO: 2661026 - protein, 8 aa, Entamoeba histolytica
TIGENTSK

SEQ ID NO: 2661027 - protein, 6 aa, Entamoeba histolytica
TIGGDG

SEQ ID NO: 2661028 - protein, 6 aa, Entamoeba histolytica
TIGGEP

SEQ ID NO: 2661029 - protein, 13 aa, Entamoeba histolytica
TIGGYGNETGKFN

SEQ ID NO: 2661030 - protein, 6 aa, Entamoeba histolytica
TIGKND

SEQ ID NO: 2661031 - protein, 12 aa, Entamoeba histolytica
TIGKNDRMQDTA

SEQ ID NO: 2661032 - protein, 7 aa, Entamoeba histolytica
TIGNENA

SEQ ID NO: 2661033 - protein, 7 aa, Entamoeba histolytica
TIGNQAV

SEQ ID NO: 2661034 - protein, 15 aa, Entamoeba histolytica
TIGPEEVQEFQKSLR

SEQ ID NO: 2661035 - protein, 12 aa, Entamoeba histolytica
TIGSDSSQYTPG

SEQ ID NO: 2661036 - protein, 7 aa, Entamoeba histolytica
TIGSNDL

SEQ ID NO: 2661037 - protein, 6 aa, Entamoeba histolytica
TIGSSE

SEQ ID NO: 2661038 - protein, 12 aa, Entamoeba histolytica
TIGTKEGEDNSL

SEQ ID NO: 2661039 - protein, 6 aa, Entamoeba histolytica
TIIGNN

SEQ ID NO: 2661040 - protein, 10 aa, Entamoeba histolytica
TIISNNDNSQ

SEQ ID NO: 2661041 - protein, 9 aa, Entamoeba histolytica
TIITGSSDG

SEQ ID NO: 2661042 - protein, 6 aa, Entamoeba histolytica
TIITSE

SEQ ID NO: 2661043 - protein, 6 aa, Entamoeba histolytica
TIKDIT

SEQ ID NO: 2661044 - protein, 5 aa, Entamoeba histolytica
TIKEE

SEQ ID NO: 2661045 - protein, 6 aa, Entamoeba histolytica
TIKEEI

SEQ ID NO: 2661046 - protein, 34 aa, Entamoeba histolytica
TIKEKQNKVRSKKSLKKEEQIAQIEEKEKQIDKE

SEQ ID NO: 2661047 - protein, 7 aa, Entamoeba histolytica
TIKEPKN

SEQ ID NO: 2661048 - protein, 8 aa, Entamoeba histolytica
TIKKQSKG

SEQ ID NO: 2661049 - protein, 12 aa, Entamoeba histolytica
TIKKSCSQEFAD

SEQ ID NO: 2661050 - protein, 13 aa, Entamoeba histolytica
TIKKSKAKAHASK

SEQ ID NO: 2661051 - protein, 11 aa, Entamoeba histolytica
TIKKSSKGTND

SEQ ID NO: 2661052 - protein, 9 aa, Entamoeba histolytica
TIKNNEECS

SEQ ID NO: 2661053 - protein, 4 aa, Entamoeba histolytica
TIKP

SEQ ID NO: 2661054 - protein, 8 aa, Entamoeba histolytica
TIKPMSSN

SEQ ID NO: 2661055 - protein, 14 aa, Entamoeba histolytica
TIKREECDGFEVLE

SEQ ID NO: 2661056 - protein, 8 aa, Entamoeba histolytica
TIKRKNGQ

SEQ ID NO: 2661057 - protein, 6 aa, Entamoeba histolytica
TIKSQQ

SEQ ID NO: 2661058 - protein, 10 aa, Entamoeba histolytica
TIKTNETTEF

SEQ ID NO: 2661059 - protein, 6 aa, Entamoeba histolytica
TIKTNL

SEQ ID NO: 2661060 - protein, 10 aa, Entamoeba histolytica
TINDTTKKDI

SEQ ID NO: 2661061 - protein, 6 aa, Entamoeba histolytica
TINDYS

SEQ ID NO: 2661062 - protein, 4 aa, Entamoeba histolytica
TINE

SEQ ID NO: 2661063 - protein, 7 aa, Entamoeba histolytica
TINEESE

SEQ ID NO: 2661064 - protein, 25 aa, Entamoeba histolytica
TINEPKPTETEKPIEEKKKSETQTI

SEQ ID NO: 2661065 - protein, 24 aa, Entamoeba histolytica
TINEQNPEDSLMSKTQAKELANEY

SEQ ID NO: 2661066 - protein, 9 aa, Entamoeba histolytica
TINESTSKE

SEQ ID NO: 2661067 - protein, 11 aa, Entamoeba histolytica
TINGKSIEKKD

SEQ ID NO: 2661068 - protein, 6 aa, Entamoeba histolytica
TINGPT

SEQ ID NO: 2661069 - protein, 5 aa, Entamoeba histolytica
TININ

SEQ ID NO: 2661070 - protein, 5 aa, Entamoeba histolytica
TINIP

SEQ ID NO: 2661071 - protein, 12 aa, Entamoeba histolytica
TINIPSSVNKIG

SEQ ID NO: 2661072 - protein, 10 aa, Entamoeba histolytica
TINKENEALK

SEQ ID NO: 2661073 - protein, 10 aa, Entamoeba histolytica
TINNPDEVQR

SEQ ID NO: 2661074 - protein, 14 aa, Entamoeba histolytica
TINPRAKRIESEHA

SEQ ID NO: 2661075 - protein, 15 aa, Entamoeba histolytica
TINQKDNETQTEVNS

SEQ ID NO: 2661076 - protein, 23 aa, Entamoeba histolytica
TINQNNSKLSDIKKSFGLNDILF

SEQ ID NO: 2661077 - protein, 8 aa, Entamoeba histolytica
TINRQQSV

SEQ ID NO: 2661078 - protein, 8 aa, Entamoeba histolytica
TINSNKRY

SEQ ID NO: 2661079 - protein, 5 aa, Entamoeba histolytica
TINSQ

SEQ ID NO: 2661080 - protein, 6 aa, Entamoeba histolytica
TINSSH

SEQ ID NO: 2661081 - protein, 7 aa, Entamoeba histolytica
TINSTKG

SEQ ID NO: 2661082 - protein, 9 aa, Entamoeba histolytica
TINTDNKPV

SEQ ID NO: 2661083 - protein, 6 aa, Entamoeba histolytica
TINTIQ

SEQ ID NO: 2661084 - protein, 16 aa, Entamoeba histolytica
TINTNGETKIKELEDE

SEQ ID NO: 2661085 - protein, 11 aa, Entamoeba histolytica
TINTNSIPKDI

SEQ ID NO: 2661086 - protein, 6 aa, Entamoeba histolytica
TINTNT

SEQ ID NO: 2661087 - protein, 9 aa, Entamoeba histolytica
TIPDNCETA

SEQ ID NO: 2661088 - protein, 4 aa, Entamoeba histolytica
TIPE

SEQ ID NO: 2661089 - protein, 9 aa, Entamoeba histolytica
TIPEGPGKV

SEQ ID NO: 2661090 - protein, 5 aa, Entamoeba histolytica
TIPGG

SEQ ID NO: 2661091 - protein, 5 aa, Entamoeba histolytica
TIPIP

SEQ ID NO: 2661092 - protein, 7 aa, Entamoeba histolytica
TIPIQGQ

SEQ ID NO: 2661093 - protein, 4 aa, Entamoeba histolytica
TIPK

SEQ ID NO: 2661094 - protein, 6 aa, Entamoeba histolytica
TIPKKD

SEQ ID NO: 2661095 - protein, 37 aa, Entamoeba histolytica
TIPKKKIQTLKDEIKPSKFNTRPSLPSFNSSSSLTST

SEQ ID NO: 2661096 - protein, 6 aa, Entamoeba histolytica
TIPKPS

SEQ ID NO: 2661097 - protein, 9 aa, Entamoeba histolytica
TIPKSPNIA

SEQ ID NO: 2661098 - protein, 17 aa, Entamoeba histolytica
TIPKSQPASVIKSRTNA

SEQ ID NO: 2661099 - protein, 26 aa, Entamoeba histolytica
TIPKSQPASVIKSRTNAFNFDQQNNL

SEQ ID NO: 2661100 - protein, 5 aa, Entamoeba histolytica
TIPNE

SEQ ID NO: 2661101 - protein, 5 aa, Entamoeba histolytica
TIPNS

SEQ ID NO: 2661102 - protein, 7 aa, Entamoeba histolytica
TIPPEVT

SEQ ID NO: 2661103 - protein, 20 aa, Entamoeba histolytica
TIPPLEDELSPTKRNKIEGT

SEQ ID NO: 2661104 - protein, 6 aa, Entamoeba histolytica
TIPPPM

SEQ ID NO: 2661105 - protein, 30 aa, Entamoeba histolytica
TIPPVPQRSYEQQPIPQNFESAQPPCSSQI

SEQ ID NO: 2661106 - protein, 12 aa, Entamoeba histolytica
TIPQQPSAGPAF

SEQ ID NO: 2661107 - protein, 6 aa, Entamoeba histolytica
TIPQRG

SEQ ID NO: 2661108 - protein, 11 aa, Entamoeba histolytica
TIPQRKQNKTI

SEQ ID NO: 2661109 - protein, 9 aa, Entamoeba histolytica
TIPTKESAL

SEQ ID NO: 2661110 - protein, 5 aa, Entamoeba histolytica
TIPTR

SEQ ID NO: 2661111 - protein, 9 aa, Entamoeba histolytica
TIPTSVSKQ

SEQ ID NO: 2661112 - protein, 9 aa, Entamoeba histolytica
TIQDIDKDN

SEQ ID NO: 2661113 - protein, 5 aa, Entamoeba histolytica
TIQEE

SEQ ID NO: 2661114 - protein, 17 aa, Entamoeba histolytica
TIQENTTTTYTPDSNYY

SEQ ID NO: 2661115 - protein, 10 aa, Entamoeba histolytica
TIQETQQQEI

SEQ ID NO: 2661116 - protein, 12 aa, Entamoeba histolytica
TIQFTGSSLEDS

SEQ ID NO: 2661117 - protein, 16 aa, Entamoeba histolytica
TIQKKTNDVEKEDVSN

SEQ ID NO: 2661118 - protein, 12 aa, Entamoeba histolytica
TIQKQSPQANDW

SEQ ID NO: 2661119 - protein, 6 aa, Entamoeba histolytica
TIQNTF

SEQ ID NO: 2661120 - protein, 10 aa, Entamoeba histolytica
TIQNTGESSI

SEQ ID NO: 2661121 - protein, 4 aa, Entamoeba histolytica
TIQQ

SEQ ID NO: 2661122 - protein, 6 aa, Entamoeba histolytica
TIQSSG

SEQ ID NO: 2661123 - protein, 14 aa, Entamoeba histolytica
TIQTNELKKKNDEI

SEQ ID NO: 2661124 - protein, 6 aa, Entamoeba histolytica
TIQTPP

SEQ ID NO: 2661125 - protein, 20 aa, Entamoeba histolytica
TIRAGQGKMRGRKIKERKGP

SEQ ID NO: 2661126 - protein, 9 aa, Entamoeba histolytica
TIREGENKL

SEQ ID NO: 2661127 - protein, 7 aa, Entamoeba histolytica
TIRNSGS

SEQ ID NO: 2661128 - protein, 6 aa, Entamoeba histolytica
TIRPKD

SEQ ID NO: 2661129 - protein, 10 aa, Entamoeba histolytica
TISADDYEYG

SEQ ID NO: 2661130 - protein, 11 aa, Entamoeba histolytica
TISDNEELTDS

SEQ ID NO: 2661131 - protein, 4 aa, Entamoeba histolytica
TISE

SEQ ID NO: 2661132 - protein, 10 aa, Entamoeba histolytica
TISEGSKEIN

SEQ ID NO: 2661133 - protein, 5 aa, Entamoeba histolytica
TISGT

SEQ ID NO: 2661134 - protein, 29 aa, Entamoeba histolytica
TISHGSITQTQSSGDNTSLQNGNEENKMQ

SEQ ID NO: 2661135 - protein, 4 aa, Entamoeba histolytica
TISL

SEQ ID NO: 2661136 - protein, 4 aa, Entamoeba histolytica
TISN

SEQ ID NO: 2661137 - protein, 9 aa, Entamoeba histolytica
TISNNKEEI

SEQ ID NO: 2661138 - protein, 7 aa, Entamoeba histolytica
TISNPSW

SEQ ID NO: 2661139 - protein, 17 aa, Entamoeba histolytica
TISPKEYGETMEEERAQ

SEQ ID NO: 2661140 - protein, 6 aa, Entamoeba histolytica
TISPND

SEQ ID NO: 2661141 - protein, 17 aa, Entamoeba histolytica
TISPNGQYIATGDGQGN

SEQ ID NO: 2661142 - protein, 13 aa, Entamoeba histolytica
TISPTSSKPTRHS

SEQ ID NO: 2661143 - protein, 12 aa, Entamoeba histolytica
TISQTNQKQTSN

SEQ ID NO: 2661144 - protein, 4 aa, Entamoeba histolytica
TISR

SEQ ID NO: 2661145 - protein, 10 aa, Entamoeba histolytica
TISRESSVAG

SEQ ID NO: 2661146 - protein, 13 aa, Entamoeba histolytica
TISRTLSQNEEYG

SEQ ID NO: 2661147 - protein, 10 aa, Entamoeba histolytica
TISSDGTADM

SEQ ID NO: 2661148 - protein, 10 aa, Entamoeba histolytica
TISSDSNKFG

SEQ ID NO: 2661149 - protein, 28 aa, Entamoeba histolytica
TISSDTPDKDNKKDDINEHSPAEEDELK

SEQ ID NO: 2661150 - protein, 6 aa, Entamoeba histolytica
TISSEK

SEQ ID NO: 2661151 - protein, 10 aa, Entamoeba histolytica
TISSFPPEYK

SEQ ID NO: 2661152 - protein, 8 aa, Entamoeba histolytica
TISTDGNT

SEQ ID NO: 2661153 - protein, 11 aa, Entamoeba histolytica
TISTNSQPTLP

SEQ ID NO: 2661154 - protein, 6 aa, Entamoeba histolytica
TISTPN

SEQ ID NO: 2661155 - protein, 13 aa, Entamoeba histolytica
TISTTSKEEYEEE

SEQ ID NO: 2661156 - protein, 7 aa, Entamoeba histolytica
TISVNGQ

SEQ ID NO: 2661157 - protein, 5 aa, Entamoeba histolytica
TITDE

SEQ ID NO: 2661158 - protein, 7 aa, Entamoeba histolytica
TITEEEI

SEQ ID NO: 2661159 - protein, 10 aa, Entamoeba histolytica
TITEEPKNYE

SEQ ID NO: 2661160 - protein, 9 aa, Entamoeba histolytica
TITELGNGA

SEQ ID NO: 2661161 - protein, 16 aa, Entamoeba histolytica
TITENGSYTISPDDNL

SEQ ID NO: 2661162 - protein, 17 aa, Entamoeba histolytica
TITENKRNIYQPYGCVM

SEQ ID NO: 2661163 - protein, 9 aa, Entamoeba histolytica
TITESKPPV

SEQ ID NO: 2661164 - protein, 11 aa, Entamoeba histolytica
TITETDCKEDY

SEQ ID NO: 2661165 - protein, 9 aa, Entamoeba histolytica
TITIEKDST

SEQ ID NO: 2661166 - protein, 5 aa, Entamoeba histolytica
TITKK

SEQ ID NO: 2661167 - protein, 25 aa, Entamoeba histolytica
TITKPQNNTKHSSLKLSSSKPIPTF

SEQ ID NO: 2661168 - protein, 7 aa, Entamoeba histolytica
TITNDGA

SEQ ID NO: 2661169 - protein, 6 aa, Entamoeba histolytica
TITNKN

SEQ ID NO: 2661170 - protein, 7 aa, Entamoeba histolytica
TITNNNQ

SEQ ID NO: 2661171 - protein, 5 aa, Entamoeba histolytica
TITNR

SEQ ID NO: 2661172 - protein, 24 aa, Entamoeba histolytica
TITNTNSSLKKNLTSQQPRSPIKI

SEQ ID NO: 2661173 - protein, 11 aa, Entamoeba histolytica
TITPQLTQEAK

SEQ ID NO: 2661174 - protein, 4 aa, Entamoeba histolytica
TITQ

SEQ ID NO: 2661175 - protein, 11 aa, Entamoeba histolytica
TITQQYPNDER

SEQ ID NO: 2661176 - protein, 8 aa, Entamoeba histolytica
TITQTPPF

SEQ ID NO: 2661177 - protein, 43 aa, Entamoeba histolytica
TITSSATTPNTTGTNTSNPFGNFTSSTTNTTTTNGSGNPFGTN

SEQ ID NO: 2661178 - protein, 7 aa, Entamoeba histolytica
TITTGKR

SEQ ID NO: 2661179 - protein, 25 aa, Entamoeba histolytica
TITTTETDNEGKVHQTTREVETPKT

SEQ ID NO: 2661180 - protein, 10 aa, Entamoeba histolytica
TIVGDATPPF

SEQ ID NO: 2661181 - protein, 5 aa, Entamoeba histolytica
TIVSS

SEQ ID NO: 2661182 - protein, 19 aa, Entamoeba histolytica
TIYGDEDEYMATRKSDGME

SEQ ID NO: 2661183 - protein, 5 aa, Entamoeba histolytica
TIYGT

SEQ ID NO: 2661184 - protein, 4 aa, Entamoeba histolytica
TIYK

SEQ ID NO: 2661185 - protein, 6 aa, Entamoeba histolytica
TIYPKE

SEQ ID NO: 2661186 - protein, 11 aa, Entamoeba histolytica
TKAEDSTKKRY

SEQ ID NO: 2661187 - protein, 8 aa, Entamoeba histolytica
TKAEEKLL

SEQ ID NO: 2661188 - protein, 6 aa, Entamoeba histolytica
TKAGLY

SEQ ID NO: 2661189 - protein, 9 aa, Entamoeba histolytica
TKAKTNAVP

SEQ ID NO: 2661190 - protein, 6 aa, Entamoeba histolytica
TKAPNT

SEQ ID NO: 2661191 - protein, 10 aa, Entamoeba histolytica
TKARFRTTLG

SEQ ID NO: 2661192 - protein, 7 aa, Entamoeba histolytica
TKARNTV

SEQ ID NO: 2661193 - protein, 8 aa, Entamoeba histolytica
TKASFTDD

SEQ ID NO: 2661194 - protein, 9 aa, Entamoeba histolytica
TKASVKSLT

SEQ ID NO: 2661195 - protein, 6 aa, Entamoeba histolytica
TKATIK

SEQ ID NO: 2661196 - protein, 5 aa, Entamoeba histolytica
TKAYD

SEQ ID NO: 2661197 - protein, 10 aa, Entamoeba histolytica
TKCGSGTDLI

SEQ ID NO: 2661198 - protein, 21 aa, Entamoeba histolytica
TKCNPKNKRLVKRDSKCDKEI

SEQ ID NO: 2661199 - protein, 4 aa, Entamoeba histolytica
TKCS

SEQ ID NO: 2661200 - protein, 6 aa, Entamoeba histolytica
TKDAID

SEQ ID NO: 2661201 - protein, 13 aa, Entamoeba histolytica
TKDAKAYEKAEDP

SEQ ID NO: 2661202 - protein, 10 aa, Entamoeba histolytica
TKDDASYNEY

SEQ ID NO: 2661203 - protein, 8 aa, Entamoeba histolytica
TKDDEDMS

SEQ ID NO: 2661204 - protein, 8 aa, Entamoeba histolytica
TKDDETPL

SEQ ID NO: 2661205 - protein, 6 aa, Entamoeba histolytica
TKDEDL

SEQ ID NO: 2661206 - protein, 8 aa, Entamoeba histolytica
TKDEEKVN

SEQ ID NO: 2661207 - protein, 8 aa, Entamoeba histolytica
TKDGLNKR

SEQ ID NO: 2661208 - protein, 9 aa, Entamoeba histolytica
TKDIKEKEN

SEQ ID NO: 2661209 - protein, 9 aa, Entamoeba histolytica
TKDKEVMKK

SEQ ID NO: 2661210 - protein, 8 aa, Entamoeba histolytica
TKDKKNIT

SEQ ID NO: 2661211 - protein, 6 aa, Entamoeba histolytica
TKDKTV

SEQ ID NO: 2661212 - protein, 4 aa, Entamoeba histolytica
TKDL

SEQ ID NO: 2661213 - protein, 6 aa, Entamoeba histolytica
TKDNEL

SEQ ID NO: 2661214 - protein, 4 aa, Entamoeba histolytica
TKDP

SEQ ID NO: 2661215 - protein, 19 aa, Entamoeba histolytica
TKDSGGRIGSADGTHPDLR

SEQ ID NO: 2661216 - protein, 8 aa, Entamoeba histolytica
TKDSQRNF

SEQ ID NO: 2661217 - protein, 6 aa, Entamoeba histolytica
TKDSRQ

SEQ ID NO: 2661218 - protein, 8 aa, Entamoeba histolytica
TKDSYQYS

SEQ ID NO: 2661219 - protein, 6 aa, Entamoeba histolytica
TKDTKY

SEQ ID NO: 2661220 - protein, 16 aa, Entamoeba histolytica
TKDTPDDSIKEKLKHK

SEQ ID NO: 2661221 - protein, 13 aa, Entamoeba histolytica
TKDVNESIKESER

SEQ ID NO: 2661222 - protein, 7 aa, Entamoeba histolytica
TKEAIGE

SEQ ID NO: 2661223 - protein, 10 aa, Entamoeba histolytica
TKEASDMKEQ

SEQ ID NO: 2661224 - protein, 12 aa, Entamoeba histolytica
TKEASKNAEKCK

SEQ ID NO: 2661225 - protein, 9 aa, Entamoeba histolytica
TKECQDNTI

SEQ ID NO: 2661226 - protein, 9 aa, Entamoeba histolytica
TKEDETKCK

SEQ ID NO: 2661227 - protein, 6 aa, Entamoeba histolytica
TKEDGN

SEQ ID NO: 2661228 - protein, 11 aa, Entamoeba histolytica
TKEDGYNVKRR

SEQ ID NO: 2661229 - protein, 8 aa, Entamoeba histolytica
TKEDHPLT

SEQ ID NO: 2661230 - protein, 6 aa, Entamoeba histolytica
TKEDNE

SEQ ID NO: 2661231 - protein, 21 aa, Entamoeba histolytica
TKEDRKKYGNNVPENANRLEN

SEQ ID NO: 2661232 - protein, 11 aa, Entamoeba histolytica
TKEDTKTEASR

SEQ ID NO: 2661233 - protein, 5 aa, Entamoeba histolytica
TKEDV

SEQ ID NO: 2661234 - protein, 18 aa, Entamoeba histolytica
TKEEEAEIKQKNKWLEEF

SEQ ID NO: 2661235 - protein, 6 aa, Entamoeba histolytica
TKEEEL

SEQ ID NO: 2661236 - protein, 20 aa, Entamoeba histolytica
TKEEGDPQKGHGRKEKKDDE

SEQ ID NO: 2661237 - protein, 11 aa, Entamoeba histolytica
TKEEGEARAKE

SEQ ID NO: 2661238 - protein, 10 aa, Entamoeba histolytica
TKEEIDERKK

SEQ ID NO: 2661239 - protein, 8 aa, Entamoeba histolytica
TKEEINQC

SEQ ID NO: 2661240 - protein, 11 aa, Entamoeba histolytica
TKEEKAQSLRT

SEQ ID NO: 2661241 - protein, 12 aa, Entamoeba histolytica
TKEEKENTTIKE

SEQ ID NO: 2661242 - protein, 63 aa, Entamoeba histolytica
TKEELTSENNSKNDELSKCKKDTNQKLTTNETKETTVNNSSNTLKRSKKVTKKLNKKSSKKIN

SEQ ID NO: 2661243 - protein, 8 aa, Entamoeba histolytica
TKEENLNK

SEQ ID NO: 2661244 - protein, 6 aa, Entamoeba histolytica
TKEEQS

SEQ ID NO: 2661245 - protein, 12 aa, Entamoeba histolytica
TKEERASTNETI

SEQ ID NO: 2661246 - protein, 8 aa, Entamoeba histolytica
TKEFSKEA

SEQ ID NO: 2661247 - protein, 10 aa, Entamoeba histolytica
TKEGGKKKSA

SEQ ID NO: 2661248 - protein, 7 aa, Entamoeba histolytica
TKEGGQF

SEQ ID NO: 2661249 - protein, 10 aa, Entamoeba histolytica
TKEGKTPRII

SEQ ID NO: 2661250 - protein, 4 aa, Entamoeba histolytica
TKEI

SEQ ID NO: 2661251 - protein, 9 aa, Entamoeba histolytica
TKEIPPIDP

SEQ ID NO: 2661252 - protein, 8 aa, Entamoeba histolytica
TKEITPKR

SEQ ID NO: 2661253 - protein, 4 aa, Entamoeba histolytica
TKEK

SEQ ID NO: 2661254 - protein, 11 aa, Entamoeba histolytica
TKEKDSSYEKR

SEQ ID NO: 2661255 - protein, 8 aa, Entamoeba histolytica
TKEKGQLD

SEQ ID NO: 2661256 - protein, 9 aa, Entamoeba histolytica
TKEKGTKRV

SEQ ID NO: 2661257 - protein, 8 aa, Entamoeba histolytica
TKEKKKVT

SEQ ID NO: 2661258 - protein, 7 aa, Entamoeba histolytica
TKEKLEK

SEQ ID NO: 2661259 - protein, 14 aa, Entamoeba histolytica
TKEKTEIKIKPQQI

SEQ ID NO: 2661260 - protein, 10 aa, Entamoeba histolytica
TKEKTNEFEK

SEQ ID NO: 2661261 - protein, 41 aa, Entamoeba histolytica
TKELEQDLAGDMNQNQDNGKGDMNEERKNNEEVEAEHTPMD

SEQ ID NO: 2661262 - protein, 6 aa, Entamoeba histolytica
TKELET

SEQ ID NO: 2661263 - protein, 9 aa, Entamoeba histolytica
TKENENNSS

SEQ ID NO: 2661264 - protein, 10 aa, Entamoeba histolytica
TKENETKEIT

SEQ ID NO: 2661265 - protein, 6 aa, Entamoeba histolytica
TKENLD

SEQ ID NO: 2661266 - protein, 7 aa, Entamoeba histolytica
TKENLPP

SEQ ID NO: 2661267 - protein, 7 aa, Entamoeba histolytica
TKENNEF

SEQ ID NO: 2661268 - protein, 5 aa, Entamoeba histolytica
TKENR

SEQ ID NO: 2661269 - protein, 6 aa, Entamoeba histolytica
TKENRQ

SEQ ID NO: 2661270 - protein, 8 aa, Entamoeba histolytica
TKEPSENQ

SEQ ID NO: 2661271 - protein, 8 aa, Entamoeba histolytica
TKEQKLED

SEQ ID NO: 2661272 - protein, 7 aa, Entamoeba histolytica
TKEQTDI

SEQ ID NO: 2661273 - protein, 7 aa, Entamoeba histolytica
TKEQVYQ

SEQ ID NO: 2661274 - protein, 6 aa, Entamoeba histolytica
TKERQS

SEQ ID NO: 2661275 - protein, 27 aa, Entamoeba histolytica
TKERVTRSSVYGKKMEKQEKKTEENEI

SEQ ID NO: 2661276 - protein, 9 aa, Entamoeba histolytica
TKESGLSKE

SEQ ID NO: 2661277 - protein, 9 aa, Entamoeba histolytica
TKESGSNAK

SEQ ID NO: 2661278 - protein, 5 aa, Entamoeba histolytica
TKESY

SEQ ID NO: 2661279 - protein, 5 aa, Entamoeba histolytica
TKEVN

SEQ ID NO: 2661280 - protein, 34 aa, Entamoeba histolytica
TKEVNKDSTETKQGNQNISNNEQQTEEIRSGKQS

SEQ ID NO: 2661281 - protein, 6 aa, Entamoeba histolytica
TKEYAS

SEQ ID NO: 2661282 - protein, 8 aa, Entamoeba histolytica
TKFDGYSK

SEQ ID NO: 2661283 - protein, 37 aa, Entamoeba histolytica
TKFENKDFEGVDDNSEHVNANGVAPPSLPNIPPPQRK

SEQ ID NO: 2661284 - protein, 4 aa, Entamoeba histolytica
TKFG

SEQ ID NO: 2661285 - protein, 6 aa, Entamoeba histolytica
TKFKPT

SEQ ID NO: 2661286 - protein, 4 aa, Entamoeba histolytica
TKFN

SEQ ID NO: 2661287 - protein, 5 aa, Entamoeba histolytica
TKFNQ

SEQ ID NO: 2661288 - protein, 5 aa, Entamoeba histolytica
TKFPG

SEQ ID NO: 2661289 - protein, 4 aa, Entamoeba histolytica
TKFQ

SEQ ID NO: 2661290 - protein, 6 aa, Entamoeba histolytica
TKFQQY

SEQ ID NO: 2661291 - protein, 5 aa, Entamoeba histolytica
TKFSG

SEQ ID NO: 2661292 - protein, 11 aa, Entamoeba histolytica
TKFSKKGRTIA

SEQ ID NO: 2661293 - protein, 7 aa, Entamoeba histolytica
TKFTGSV

SEQ ID NO: 2661294 - protein, 11 aa, Entamoeba histolytica
TKGAQGSQRIE

SEQ ID NO: 2661295 - protein, 5 aa, Entamoeba histolytica
TKGDV

SEQ ID NO: 2661296 - protein, 9 aa, Entamoeba histolytica
TKGETVENL

SEQ ID NO: 2661297 - protein, 4 aa, Entamoeba histolytica
TKGG

SEQ ID NO: 2661298 - protein, 6 aa, Entamoeba histolytica
TKGGSK

SEQ ID NO: 2661299 - protein, 6 aa, Entamoeba histolytica
TKGICN

SEQ ID NO: 2661300 - protein, 8 aa, Entamoeba histolytica
TKGIETVR

SEQ ID NO: 2661301 - protein, 9 aa, Entamoeba histolytica
TKGIPPVQY

SEQ ID NO: 2661302 - protein, 7 aa, Entamoeba histolytica
TKGKDKY

SEQ ID NO: 2661303 - protein, 5 aa, Entamoeba histolytica
TKGKR

SEQ ID NO: 2661304 - protein, 14 aa, Entamoeba histolytica
TKGMDGVKNNKTLQ

SEQ ID NO: 2661305 - protein, 12 aa, Entamoeba histolytica
TKGNDEVMKESE

SEQ ID NO: 2661306 - protein, 10 aa, Entamoeba histolytica
TKGNLTDKSF

SEQ ID NO: 2661307 - protein, 11 aa, Entamoeba histolytica
TKGQKKRFGYS

SEQ ID NO: 2661308 - protein, 9 aa, Entamoeba histolytica
TKGQVNGNV

SEQ ID NO: 2661309 - protein, 21 aa, Entamoeba histolytica
TKGQYQELPENEPTKEESKKD

SEQ ID NO: 2661310 - protein, 4 aa, Entamoeba histolytica
TKGR

SEQ ID NO: 2661311 - protein, 14 aa, Entamoeba histolytica
TKGRTKAGETKPRK

SEQ ID NO: 2661312 - protein, 6 aa, Entamoeba histolytica
TKGTAI

SEQ ID NO: 2661313 - protein, 5 aa, Entamoeba histolytica
TKGTE

SEQ ID NO: 2661314 - protein, 7 aa, Entamoeba histolytica
TKGTEEV

SEQ ID NO: 2661315 - protein, 5 aa, Entamoeba histolytica
TKGTI

SEQ ID NO: 2661316 - protein, 9 aa, Entamoeba histolytica
TKGTKLSRK

SEQ ID NO: 2661317 - protein, 5 aa, Entamoeba histolytica
TKGTL

SEQ ID NO: 2661318 - protein, 10 aa, Entamoeba histolytica
TKGTTTGFSG

SEQ ID NO: 2661319 - protein, 4 aa, Entamoeba histolytica
TKGV

SEQ ID NO: 2661320 - protein, 8 aa, Entamoeba histolytica
TKGVEESI

SEQ ID NO: 2661321 - protein, 7 aa, Entamoeba histolytica
TKGYGDK

SEQ ID NO: 2661322 - protein, 8 aa, Entamoeba histolytica
TKHEEQAE

SEQ ID NO: 2661323 - protein, 14 aa, Entamoeba histolytica
TKHETPSPLPLGGL

SEQ ID NO: 2661324 - protein, 6 aa, Entamoeba histolytica
TKHPKK

SEQ ID NO: 2661325 - protein, 5 aa, Entamoeba histolytica
TKHQG

SEQ ID NO: 2661326 - protein, 7 aa, Entamoeba histolytica
TKHYNTS

SEQ ID NO: 2661327 - protein, 4 aa, Entamoeba histolytica
TKID

SEQ ID NO: 2661328 - protein, 5 aa, Entamoeba histolytica
TKIDQ

SEQ ID NO: 2661329 - protein, 7 aa, Entamoeba histolytica
TKIDTEF

SEQ ID NO: 2661330 - protein, 8 aa, Entamoeba histolytica
TKIEDKNP

SEQ ID NO: 2661331 - protein, 6 aa, Entamoeba histolytica
TKIEEI

SEQ ID NO: 2661332 - protein, 31 aa, Entamoeba histolytica
TKIEENKQTTINEEEQNEVDTAKIKNEDNNY

SEQ ID NO: 2661333 - protein, 7 aa, Entamoeba histolytica
TKIENEN

SEQ ID NO: 2661334 - protein, 6 aa, Entamoeba histolytica
TKIGLT

SEQ ID NO: 2661335 - protein, 9 aa, Entamoeba histolytica
TKIKENHTD

SEQ ID NO: 2661336 - protein, 8 aa, Entamoeba histolytica
TKIPKNKE

SEQ ID NO: 2661337 - protein, 9 aa, Entamoeba histolytica
TKIPNGCSG

SEQ ID NO: 2661338 - protein, 6 aa, Entamoeba histolytica
TKIPTK

SEQ ID NO: 2661339 - protein, 5 aa, Entamoeba histolytica
TKIQN

SEQ ID NO: 2661340 - protein, 6 aa, Entamoeba histolytica
TKIQPE

SEQ ID NO: 2661341 - protein, 8 aa, Entamoeba histolytica
TKISKEEL

SEQ ID NO: 2661342 - protein, 11 aa, Entamoeba histolytica
TKITEEKTEEM

SEQ ID NO: 2661343 - protein, 18 aa, Entamoeba histolytica
TKITESKSKTNEKEKESQ

SEQ ID NO: 2661344 - protein, 7 aa, Entamoeba histolytica
TKITETG

SEQ ID NO: 2661345 - protein, 6 aa, Entamoeba histolytica
TKITKQ

SEQ ID NO: 2661346 - protein, 13 aa, Entamoeba histolytica
TKITRNSSNINLT

SEQ ID NO: 2661347 - protein, 11 aa, Entamoeba histolytica
TKITSNDEDIE

SEQ ID NO: 2661348 - protein, 6 aa, Entamoeba histolytica
TKKDDT

SEQ ID NO: 2661349 - protein, 8 aa, Entamoeba histolytica
TKKDGEEY

SEQ ID NO: 2661350 - protein, 9 aa, Entamoeba histolytica
TKKDIPEDQ

SEQ ID NO: 2661351 - protein, 8 aa, Entamoeba histolytica
TKKDKEME

SEQ ID NO: 2661352 - protein, 15 aa, Entamoeba histolytica
TKKDNVDAPLHTNEE

SEQ ID NO: 2661353 - protein, 8 aa, Entamoeba histolytica
TKKDQTYN

SEQ ID NO: 2661354 - protein, 8 aa, Entamoeba histolytica
TKKDTKMS

SEQ ID NO: 2661355 - protein, 7 aa, Entamoeba histolytica
TKKEDQP

SEQ ID NO: 2661356 - protein, 8 aa, Entamoeba histolytica
TKKEENEI

SEQ ID NO: 2661357 - protein, 10 aa, Entamoeba histolytica
TKKEKISRTV

SEQ ID NO: 2661358 - protein, 11 aa, Entamoeba histolytica
TKKENSDKLKE

SEQ ID NO: 2661359 - protein, 13 aa, Entamoeba histolytica
TKKERKQEFKQHA

SEQ ID NO: 2661360 - protein, 10 aa, Entamoeba histolytica
TKKETPPPIQ

SEQ ID NO: 2661361 - protein, 10 aa, Entamoeba histolytica
TKKETSDENE

SEQ ID NO: 2661362 - protein, 8 aa, Entamoeba histolytica
TKKEYKSG

SEQ ID NO: 2661363 - protein, 6 aa, Entamoeba histolytica
TKKEYN

SEQ ID NO: 2661364 - protein, 25 aa, Entamoeba histolytica
TKKFDSKEFEKDCDKADKDSKEQFQ

SEQ ID NO: 2661365 - protein, 8 aa, Entamoeba histolytica
TKKGAPDL

SEQ ID NO: 2661366 - protein, 10 aa, Entamoeba histolytica
TKKGDEEEQQ

SEQ ID NO: 2661367 - protein, 15 aa, Entamoeba histolytica
TKKGDENRMVMERPL

SEQ ID NO: 2661368 - protein, 8 aa, Entamoeba histolytica
TKKGEYRS

SEQ ID NO: 2661369 - protein, 15 aa, Entamoeba histolytica
TKKGFLTPQGSPRNC

SEQ ID NO: 2661370 - protein, 25 aa, Entamoeba histolytica
TKKGGKDICGQKDNEMTTPKEVGEY

SEQ ID NO: 2661371 - protein, 10 aa, Entamoeba histolytica
TKKGHLGASE

SEQ ID NO: 2661372 - protein, 8 aa, Entamoeba histolytica
TKKGKWVS

SEQ ID NO: 2661373 - protein, 16 aa, Entamoeba histolytica
TKKGLSPTISQPASPK

SEQ ID NO: 2661374 - protein, 7 aa, Entamoeba histolytica
TKKIDKR

SEQ ID NO: 2661375 - protein, 9 aa, Entamoeba histolytica
TKKIGKQTI

SEQ ID NO: 2661376 - protein, 6 aa, Entamoeba histolytica
TKKIGR

SEQ ID NO: 2661377 - protein, 7 aa, Entamoeba histolytica
TKKIQER

SEQ ID NO: 2661378 - protein, 10 aa, Entamoeba histolytica
TKKKASKTLK

SEQ ID NO: 2661379 - protein, 5 aa, Entamoeba histolytica
TKKKE

SEQ ID NO: 2661380 - protein, 8 aa, Entamoeba histolytica
TKKKEEGI

SEQ ID NO: 2661381 - protein, 8 aa, Entamoeba histolytica
TKKKELKE

SEQ ID NO: 2661382 - protein, 7 aa, Entamoeba histolytica
TKKKELL

SEQ ID NO: 2661383 - protein, 7 aa, Entamoeba histolytica
TKKKRIK

SEQ ID NO: 2661384 - protein, 9 aa, Entamoeba histolytica
TKKKRTELE

SEQ ID NO: 2661385 - protein, 5 aa, Entamoeba histolytica
TKKKT

SEQ ID NO: 2661386 - protein, 8 aa, Entamoeba histolytica
TKKKTPKY

SEQ ID NO: 2661387 - protein, 15 aa, Entamoeba histolytica
TKKLKKDKKEKLKRK

SEQ ID NO: 2661388 - protein, 19 aa, Entamoeba histolytica
TKKLKQTITQSTVEKTQQL

SEQ ID NO: 2661389 - protein, 11 aa, Entamoeba histolytica
TKKNGSKCRSD

SEQ ID NO: 2661390 - protein, 5 aa, Entamoeba histolytica
TKKNI

SEQ ID NO: 2661391 - protein, 11 aa, Entamoeba histolytica
TKKNKKATKDT

SEQ ID NO: 2661392 - protein, 9 aa, Entamoeba histolytica
TKKNQNDEI

SEQ ID NO: 2661393 - protein, 10 aa, Entamoeba histolytica
TKKNRDESEL

SEQ ID NO: 2661394 - protein, 7 aa, Entamoeba histolytica
TKKPLRG

SEQ ID NO: 2661395 - protein, 9 aa, Entamoeba histolytica
TKKPTEFSE

SEQ ID NO: 2661396 - protein, 4 aa, Entamoeba histolytica
TKKQ

SEQ ID NO: 2661397 - protein, 17 aa, Entamoeba histolytica
TKKQAEKALSEKERNEE

SEQ ID NO: 2661398 - protein, 6 aa, Entamoeba histolytica
TKKQID

SEQ ID NO: 2661399 - protein, 21 aa, Entamoeba histolytica
TKKQKKNKRRNGKQISPLKEE

SEQ ID NO: 2661400 - protein, 7 aa, Entamoeba histolytica
TKKQSRK

SEQ ID NO: 2661401 - protein, 7 aa, Entamoeba histolytica
TKKQTRN

SEQ ID NO: 2661402 - protein, 9 aa, Entamoeba histolytica
TKKRPNSTS

SEQ ID NO: 2661403 - protein, 6 aa, Entamoeba histolytica
TKKSKG

SEQ ID NO: 2661404 - protein, 17 aa, Entamoeba histolytica
TKKSKKITKKEETEEEK

SEQ ID NO: 2661405 - protein, 8 aa, Entamoeba histolytica
TKKSKRAI

SEQ ID NO: 2661406 - protein, 22 aa, Entamoeba histolytica
TKKSQWVQAGGHGGPQQLHPDG

SEQ ID NO: 2661407 - protein, 8 aa, Entamoeba histolytica
TKKTKSPF

SEQ ID NO: 2661408 - protein, 9 aa, Entamoeba histolytica
TKKTNTLSS

SEQ ID NO: 2661409 - protein, 5 aa, Entamoeba histolytica
TKKTQ

SEQ ID NO: 2661410 - protein, 4 aa, Entamoeba histolytica
TKKV

SEQ ID NO: 2661411 - protein, 7 aa, Entamoeba histolytica
TKKVGAK

SEQ ID NO: 2661412 - protein, 10 aa, Entamoeba histolytica
TKKVNTHHEE

SEQ ID NO: 2661413 - protein, 19 aa, Entamoeba histolytica
TKKVSKKQVNKVPHGEKIN

SEQ ID NO: 2661414 - protein, 8 aa, Entamoeba histolytica
TKKWNELK

SEQ ID NO: 2661415 - protein, 7 aa, Entamoeba histolytica
TKKYEET

SEQ ID NO: 2661416 - protein, 12 aa, Entamoeba histolytica
TKKYSQTCSWKE

SEQ ID NO: 2661417 - protein, 10 aa, Entamoeba histolytica
TKKYSSTSAN

SEQ ID NO: 2661418 - protein, 7 aa, Entamoeba histolytica
TKLADPR

SEQ ID NO: 2661419 - protein, 4 aa, Entamoeba histolytica
TKLD

SEQ ID NO: 2661420 - protein, 6 aa, Entamoeba histolytica
TKLEYS

SEQ ID NO: 2661421 - protein, 8 aa, Entamoeba histolytica
TKLGESSF

SEQ ID NO: 2661422 - protein, 7 aa, Entamoeba histolytica
TKLGKTE

SEQ ID NO: 2661423 - protein, 5 aa, Entamoeba histolytica
TKLGR

SEQ ID NO: 2661424 - protein, 10 aa, Entamoeba histolytica
TKLKGNTVTK

SEQ ID NO: 2661425 - protein, 13 aa, Entamoeba histolytica
TKLKGNTVTKKTM

SEQ ID NO: 2661426 - protein, 12 aa, Entamoeba histolytica
TKLNDNKYKTAN

SEQ ID NO: 2661427 - protein, 4 aa, Entamoeba histolytica
TKLP

SEQ ID NO: 2661428 - protein, 7 aa, Entamoeba histolytica
TKLPNPY

SEQ ID NO: 2661429 - protein, 6 aa, Entamoeba histolytica
TKLPTF

SEQ ID NO: 2661430 - protein, 18 aa, Entamoeba histolytica
TKLPTSKSSTKPETSPIN

SEQ ID NO: 2661431 - protein, 7 aa, Entamoeba histolytica
TKLSDNG

SEQ ID NO: 2661432 - protein, 5 aa, Entamoeba histolytica
TKLTS

SEQ ID NO: 2661433 - protein, 6 aa, Entamoeba histolytica
TKMGKT

SEQ ID NO: 2661434 - protein, 13 aa, Entamoeba histolytica
TKMPERDPPKGKV

SEQ ID NO: 2661435 - protein, 7 aa, Entamoeba histolytica
TKMPEYS

SEQ ID NO: 2661436 - protein, 10 aa, Entamoeba histolytica
TKNAEPRKEE

SEQ ID NO: 2661437 - protein, 8 aa, Entamoeba histolytica
TKNCNTDL

SEQ ID NO: 2661438 - protein, 4 aa, Entamoeba histolytica
TKND

SEQ ID NO: 2661439 - protein, 10 aa, Entamoeba histolytica
TKNDGDIEIE

SEQ ID NO: 2661440 - protein, 4 aa, Entamoeba histolytica
TKNE

SEQ ID NO: 2661441 - protein, 9 aa, Entamoeba histolytica
TKNEKLTEA

SEQ ID NO: 2661442 - protein, 5 aa, Entamoeba histolytica
TKNEN

SEQ ID NO: 2661443 - protein, 9 aa, Entamoeba histolytica
TKNENKEKY

SEQ ID NO: 2661444 - protein, 7 aa, Entamoeba histolytica
TKNEQTN

SEQ ID NO: 2661445 - protein, 6 aa, Entamoeba histolytica
TKNETI

SEQ ID NO: 2661446 - protein, 7 aa, Entamoeba histolytica
TKNGEEF

SEQ ID NO: 2661447 - protein, 8 aa, Entamoeba histolytica
TKNGNLSI

SEQ ID NO: 2661448 - protein, 13 aa, Entamoeba histolytica
TKNIQPGQEQAQI

SEQ ID NO: 2661449 - protein, 8 aa, Entamoeba histolytica
TKNKEECK

SEQ ID NO: 2661450 - protein, 5 aa, Entamoeba histolytica
TKNKR

SEQ ID NO: 2661451 - protein, 6 aa, Entamoeba histolytica
TKNKSG

SEQ ID NO: 2661452 - protein, 11 aa, Entamoeba histolytica
TKNKSKRNTIV

SEQ ID NO: 2661453 - protein, 14 aa, Entamoeba histolytica
TKNLEKKKRDITEL

SEQ ID NO: 2661454 - protein, 23 aa, Entamoeba histolytica
TKNNNEKSNKKKIESGDNEEERI

SEQ ID NO: 2661455 - protein, 6 aa, Entamoeba histolytica
TKNNTL

SEQ ID NO: 2661456 - protein, 8 aa, Entamoeba histolytica
TKNPKMKT

SEQ ID NO: 2661457 - protein, 7 aa, Entamoeba histolytica
TKNQCEI

SEQ ID NO: 2661458 - protein, 5 aa, Entamoeba histolytica
TKNQG

SEQ ID NO: 2661459 - protein, 8 aa, Entamoeba histolytica
TKNQTTTK

SEQ ID NO: 2661460 - protein, 23 aa, Entamoeba histolytica
TKNSEEAPTQKRPKESQKNKKYC

SEQ ID NO: 2661461 - protein, 7 aa, Entamoeba histolytica
TKNTVNR

SEQ ID NO: 2661462 - protein, 7 aa, Entamoeba histolytica
TKNVPGY

SEQ ID NO: 2661463 - protein, 12 aa, Entamoeba histolytica
TKNYGQNTESFA

SEQ ID NO: 2661464 - protein, 20 aa, Entamoeba histolytica
TKPALRSTKTQPKKEVRKTL

SEQ ID NO: 2661465 - protein, 11 aa, Entamoeba histolytica
TKPCNGETIER

SEQ ID NO: 2661466 - protein, 7 aa, Entamoeba histolytica
TKPEVST

SEQ ID NO: 2661467 - protein, 8 aa, Entamoeba histolytica
TKPFDEKS

SEQ ID NO: 2661468 - protein, 26 aa, Entamoeba histolytica
TKPIEKNNTNKEKEEGKIKERISKRE

SEQ ID NO: 2661469 - protein, 12 aa, Entamoeba histolytica
TKPIYSNQGENF

SEQ ID NO: 2661470 - protein, 8 aa, Entamoeba histolytica
TKPKETVQ

SEQ ID NO: 2661471 - protein, 8 aa, Entamoeba histolytica
TKPKIEPK

SEQ ID NO: 2661472 - protein, 9 aa, Entamoeba histolytica
TKPKKNNFM

SEQ ID NO: 2661473 - protein, 6 aa, Entamoeba histolytica
TKPKSV

SEQ ID NO: 2661474 - protein, 10 aa, Entamoeba histolytica
TKPKTNNRNG

SEQ ID NO: 2661475 - protein, 6 aa, Entamoeba histolytica
TKPKVK

SEQ ID NO: 2661476 - protein, 16 aa, Entamoeba histolytica
TKPLNSQDDLKTVREK

SEQ ID NO: 2661477 - protein, 24 aa, Entamoeba histolytica
TKPLNSQDKLKTAREKIKEKMSDS

SEQ ID NO: 2661478 - protein, 16 aa, Entamoeba histolytica
TKPLNSQDSLKTVREK

SEQ ID NO: 2661479 - protein, 8 aa, Entamoeba histolytica
TKPLYTSK

SEQ ID NO: 2661480 - protein, 6 aa, Entamoeba histolytica
TKPNQF

SEQ ID NO: 2661481 - protein, 7 aa, Entamoeba histolytica
TKPNSIE

SEQ ID NO: 2661482 - protein, 11 aa, Entamoeba histolytica
TKPPASRNTSA

SEQ ID NO: 2661483 - protein, 5 aa, Entamoeba histolytica
TKPPI

SEQ ID NO: 2661484 - protein, 7 aa, Entamoeba histolytica
TKPPKKA

SEQ ID NO: 2661485 - protein, 10 aa, Entamoeba histolytica
TKPPKPKDQI

SEQ ID NO: 2661486 - protein, 9 aa, Entamoeba histolytica
TKPPPYNSP

SEQ ID NO: 2661487 - protein, 29 aa, Entamoeba histolytica
TKPPTKTGHTKMNQTKLSYGNKQAGQSLN

SEQ ID NO: 2661488 - protein, 7 aa, Entamoeba histolytica
TKPPVRM

SEQ ID NO: 2661489 - protein, 6 aa, Entamoeba histolytica
TKPPYL

SEQ ID NO: 2661490 - protein, 19 aa, Entamoeba histolytica
TKPQLTENDVSIKKDEQVH

SEQ ID NO: 2661491 - protein, 5 aa, Entamoeba histolytica
TKPQR

SEQ ID NO: 2661492 - protein, 6 aa, Entamoeba histolytica
TKPRSI

SEQ ID NO: 2661493 - protein, 4 aa, Entamoeba histolytica
TKPS

SEQ ID NO: 2661494 - protein, 8 aa, Entamoeba histolytica
TKPSINPF

SEQ ID NO: 2661495 - protein, 12 aa, Entamoeba histolytica
TKPSKIIEDNPV

SEQ ID NO: 2661496 - protein, 24 aa, Entamoeba histolytica
TKPSKVKPSKPKTITIRPQSQNLA

SEQ ID NO: 2661497 - protein, 8 aa, Entamoeba histolytica
TKPSLPTN

SEQ ID NO: 2661498 - protein, 9 aa, Entamoeba histolytica
TKPSRNLEW

SEQ ID NO: 2661499 - protein, 7 aa, Entamoeba histolytica
TKPSSIK

SEQ ID NO: 2661500 - protein, 6 aa, Entamoeba histolytica
TKPTCR

SEQ ID NO: 2661501 - protein, 13 aa, Entamoeba histolytica
TKPTETGDKTKTM

SEQ ID NO: 2661502 - protein, 6 aa, Entamoeba histolytica
TKPTIT

SEQ ID NO: 2661503 - protein, 8 aa, Entamoeba histolytica
TKPTNNKS

SEQ ID NO: 2661504 - protein, 9 aa, Entamoeba histolytica
TKPTRPRNE

SEQ ID NO: 2661505 - protein, 8 aa, Entamoeba histolytica
TKPTRRHN

SEQ ID NO: 2661506 - protein, 8 aa, Entamoeba histolytica
TKQAREEI

SEQ ID NO: 2661507 - protein, 8 aa, Entamoeba histolytica
TKQDELNE

SEQ ID NO: 2661508 - protein, 12 aa, Entamoeba histolytica
TKQDRENLGNKI

SEQ ID NO: 2661509 - protein, 9 aa, Entamoeba histolytica
TKQEAANAM

SEQ ID NO: 2661510 - protein, 9 aa, Entamoeba histolytica
TKQEDKTPL

SEQ ID NO: 2661511 - protein, 7 aa, Entamoeba histolytica
TKQEQSL

SEQ ID NO: 2661512 - protein, 6 aa, Entamoeba histolytica
TKQGFS

SEQ ID NO: 2661513 - protein, 6 aa, Entamoeba histolytica
TKQGVS

SEQ ID NO: 2661514 - protein, 17 aa, Entamoeba histolytica
TKQGVSQQTAKRRMQEA

SEQ ID NO: 2661515 - protein, 5 aa, Entamoeba histolytica
TKQHY

SEQ ID NO: 2661516 - protein, 4 aa, Entamoeba histolytica
TKQI

SEQ ID NO: 2661517 - protein, 5 aa, Entamoeba histolytica
TKQIK

SEQ ID NO: 2661518 - protein, 5 aa, Entamoeba histolytica
TKQLE

SEQ ID NO: 2661519 - protein, 11 aa, Entamoeba histolytica
TKQLENEISDQ

SEQ ID NO: 2661520 - protein, 19 aa, Entamoeba histolytica
TKQLKEAEKTQKKEAKKVE

SEQ ID NO: 2661521 - protein, 31 aa, Entamoeba histolytica
TKQLPQNLSTQLNSTISPDKLHTTNSPQSTI

SEQ ID NO: 2661522 - protein, 14 aa, Entamoeba histolytica
TKQMDKQLAEQPPE

SEQ ID NO: 2661523 - protein, 8 aa, Entamoeba histolytica
TKQNPDFQ

SEQ ID NO: 2661524 - protein, 11 aa, Entamoeba histolytica
TKQPNSEQPLL

SEQ ID NO: 2661525 - protein, 8 aa, Entamoeba histolytica
TKQQATDT

SEQ ID NO: 2661526 - protein, 5 aa, Entamoeba histolytica
TKQQI

SEQ ID NO: 2661527 - protein, 10 aa, Entamoeba histolytica
TKQQTDALKS

SEQ ID NO: 2661528 - protein, 8 aa, Entamoeba histolytica
TKQQTQPI

SEQ ID NO: 2661529 - protein, 13 aa, Entamoeba histolytica
TKQREELDQKRRK

SEQ ID NO: 2661530 - protein, 7 aa, Entamoeba histolytica
TKQSAEY

SEQ ID NO: 2661531 - protein, 10 aa, Entamoeba histolytica
TKQSKPTLKE

SEQ ID NO: 2661532 - protein, 9 aa, Entamoeba histolytica
TKQSNNGDG

SEQ ID NO: 2661533 - protein, 9 aa, Entamoeba histolytica
TKQSSIYQQ

SEQ ID NO: 2661534 - protein, 43 aa, Entamoeba histolytica
TKQTEKSLNNADQKIVQRDEEKEVDDNKQKPSLSTKNPQKQDN

SEQ ID NO: 2661535 - protein, 35 aa, Entamoeba histolytica
TKQTEKSLNNADQKMVQRDEGSAQMNYGESQKQRT

SEQ ID NO: 2661536 - protein, 8 aa, Entamoeba histolytica
TKRAKLTE

SEQ ID NO: 2661537 - protein, 7 aa, Entamoeba histolytica
TKRAREC

SEQ ID NO: 2661538 - protein, 10 aa, Entamoeba histolytica
TKRENGRKAQ

SEQ ID NO: 2661539 - protein, 4 aa, Entamoeba histolytica
TKRG

SEQ ID NO: 2661540 - protein, 4 aa, Entamoeba histolytica
TKRK

SEQ ID NO: 2661541 - protein, 8 aa, Entamoeba histolytica
TKRKINPE

SEQ ID NO: 2661542 - protein, 5 aa, Entamoeba histolytica
TKRKN

SEQ ID NO: 2661543 - protein, 9 aa, Entamoeba histolytica
TKRKNNKRL

SEQ ID NO: 2661544 - protein, 11 aa, Entamoeba histolytica
TKRKSKRNTVV

SEQ ID NO: 2661545 - protein, 7 aa, Entamoeba histolytica
TKRLQSP

SEQ ID NO: 2661546 - protein, 5 aa, Entamoeba histolytica
TKRLR

SEQ ID NO: 2661547 - protein, 5 aa, Entamoeba histolytica
TKRLS

SEQ ID NO: 2661548 - protein, 17 aa, Entamoeba histolytica
TKRNRTPEIESYKSKED

SEQ ID NO: 2661549 - protein, 10 aa, Entamoeba histolytica
TKRPEIDSSV

SEQ ID NO: 2661550 - protein, 13 aa, Entamoeba histolytica
TKRPKPQGYDTSK

SEQ ID NO: 2661551 - protein, 6 aa, Entamoeba histolytica
TKRQSS

SEQ ID NO: 2661552 - protein, 37 aa, Entamoeba histolytica
TKRSKIPTVSNNGMSQDNVNVSNPVNPQPSKRRFCSI

SEQ ID NO: 2661553 - protein, 11 aa, Entamoeba histolytica
TKRSQNPAKNL

SEQ ID NO: 2661554 - protein, 7 aa, Entamoeba histolytica
TKRTPPI

SEQ ID NO: 2661555 - protein, 14 aa, Entamoeba histolytica
TKRTSKLGSRHNSG

SEQ ID NO: 2661556 - protein, 9 aa, Entamoeba histolytica
TKSDLSTQR

SEQ ID NO: 2661557 - protein, 14 aa, Entamoeba histolytica
TKSDREKTKGKIPQ

SEQ ID NO: 2661558 - protein, 26 aa, Entamoeba histolytica
TKSDRRKDKSTDCISTAKGEELKTKI

SEQ ID NO: 2661559 - protein, 10 aa, Entamoeba histolytica
TKSDSKNPCE

SEQ ID NO: 2661560 - protein, 6 aa, Entamoeba histolytica
TKSERY

SEQ ID NO: 2661561 - protein, 4 aa, Entamoeba histolytica
TKSF

SEQ ID NO: 2661562 - protein, 10 aa, Entamoeba histolytica
TKSFNKDEIK

SEQ ID NO: 2661563 - protein, 9 aa, Entamoeba histolytica
TKSFPNAKS

SEQ ID NO: 2661564 - protein, 8 aa, Entamoeba histolytica
TKSGVSKR

SEQ ID NO: 2661565 - protein, 4 aa, Entamoeba histolytica
TKSI

SEQ ID NO: 2661566 - protein, 9 aa, Entamoeba histolytica
TKSIDRDEL

SEQ ID NO: 2661567 - protein, 7 aa, Entamoeba histolytica
TKSIKST

SEQ ID NO: 2661568 - protein, 6 aa, Entamoeba histolytica
TKSKEF

SEQ ID NO: 2661569 - protein, 7 aa, Entamoeba histolytica
TKSKFSE

SEQ ID NO: 2661570 - protein, 8 aa, Entamoeba histolytica
TKSKGGNA

SEQ ID NO: 2661571 - protein, 9 aa, Entamoeba histolytica
TKSKNGEDG

SEQ ID NO: 2661572 - protein, 8 aa, Entamoeba histolytica
TKSKSSLN

SEQ ID NO: 2661573 - protein, 9 aa, Entamoeba histolytica
TKSKYYQEE

SEQ ID NO: 2661574 - protein, 5 aa, Entamoeba histolytica
TKSLH

SEQ ID NO: 2661575 - protein, 7 aa, Entamoeba histolytica
TKSLSRK

SEQ ID NO: 2661576 - protein, 10 aa, Entamoeba histolytica
TKSLYKKDNG

SEQ ID NO: 2661577 - protein, 5 aa, Entamoeba histolytica
TKSND

SEQ ID NO: 2661578 - protein, 5 aa, Entamoeba histolytica
TKSNQ

SEQ ID NO: 2661579 - protein, 6 aa, Entamoeba histolytica
TKSNQV

SEQ ID NO: 2661580 - protein, 31 aa, Entamoeba histolytica
TKSNTQTKTKKTKKAKKTKKTKKNNKVIDDS

SEQ ID NO: 2661581 - protein, 7 aa, Entamoeba histolytica
TKSPFEG

SEQ ID NO: 2661582 - protein, 15 aa, Entamoeba histolytica
TKSQGKNGIAKSETI

SEQ ID NO: 2661583 - protein, 26 aa, Entamoeba histolytica
TKSQQGYHNDRRRRFHDGRNRQRQFG

SEQ ID NO: 2661584 - protein, 7 aa, Entamoeba histolytica
TKSQSDN

SEQ ID NO: 2661585 - protein, 11 aa, Entamoeba histolytica
TKSRSTKKTQK

SEQ ID NO: 2661586 - protein, 4 aa, Entamoeba histolytica
TKSS

SEQ ID NO: 2661587 - protein, 5 aa, Entamoeba histolytica
TKSSD

SEQ ID NO: 2661588 - protein, 12 aa, Entamoeba histolytica
TKSSDSVDNVVK

SEQ ID NO: 2661589 - protein, 7 aa, Entamoeba histolytica
TKSSPAF

SEQ ID NO: 2661590 - protein, 11 aa, Entamoeba histolytica
TKSSPTQQTGK

SEQ ID NO: 2661591 - protein, 7 aa, Entamoeba histolytica
TKSSVQP

SEQ ID NO: 2661592 - protein, 9 aa, Entamoeba histolytica
TKSSWTEKT

SEQ ID NO: 2661593 - protein, 8 aa, Entamoeba histolytica
TKSTEQHL

SEQ ID NO: 2661594 - protein, 8 aa, Entamoeba histolytica
TKSTHSNT

SEQ ID NO: 2661595 - protein, 13 aa, Entamoeba histolytica
TKSTQGNNLSNET

SEQ ID NO: 2661596 - protein, 5 aa, Entamoeba histolytica
TKSTR

SEQ ID NO: 2661597 - protein, 7 aa, Entamoeba histolytica
TKSVGLN

SEQ ID NO: 2661598 - protein, 4 aa, Entamoeba histolytica
TKTA

SEQ ID NO: 2661599 - protein, 9 aa, Entamoeba histolytica
TKTAKECRS

SEQ ID NO: 2661600 - protein, 6 aa, Entamoeba histolytica
TKTALP

SEQ ID NO: 2661601 - protein, 6 aa, Entamoeba histolytica
TKTCSS

SEQ ID NO: 2661602 - protein, 11 aa, Entamoeba histolytica
TKTDDEKKEDI

SEQ ID NO: 2661603 - protein, 6 aa, Entamoeba histolytica
TKTDDI

SEQ ID NO: 2661604 - protein, 19 aa, Entamoeba histolytica
TKTDFSDFKKESEDKIKKL

SEQ ID NO: 2661605 - protein, 14 aa, Entamoeba histolytica
TKTDVPSRSQRTSI

SEQ ID NO: 2661606 - protein, 7 aa, Entamoeba histolytica
TKTENIT

SEQ ID NO: 2661607 - protein, 7 aa, Entamoeba histolytica
TKTEVYN

SEQ ID NO: 2661608 - protein, 13 aa, Entamoeba histolytica
TKTFEKKKKGDLV

SEQ ID NO: 2661609 - protein, 6 aa, Entamoeba histolytica
TKTGEL

SEQ ID NO: 2661610 - protein, 5 aa, Entamoeba histolytica
TKTGK

SEQ ID NO: 2661611 - protein, 4 aa, Entamoeba histolytica
TKTI

SEQ ID NO: 2661612 - protein, 8 aa, Entamoeba histolytica
TKTKEFKS

SEQ ID NO: 2661613 - protein, 20 aa, Entamoeba histolytica
TKTKEITYEEMSEEKYNIPN

SEQ ID NO: 2661614 - protein, 9 aa, Entamoeba histolytica
TKTKKEEIV

SEQ ID NO: 2661615 - protein, 35 aa, Entamoeba histolytica; identical to SEQ ID NO: 2466445

SEQ ID NO: 2661616 - protein, 16 aa, Entamoeba histolytica
TKTKTQQQNKLPSPLD

SEQ ID NO: 2661617 - protein, 8 aa, Entamoeba histolytica
TKTKYEQA

SEQ ID NO: 2661618 - protein, 5 aa, Entamoeba histolytica
TKTLN

SEQ ID NO: 2661619 - protein, 9 aa, Entamoeba histolytica
TKTNGDKYV

SEQ ID NO: 2661620 - protein, 8 aa, Entamoeba histolytica
TKTNKSAA

SEQ ID NO: 2661621 - protein, 5 aa, Entamoeba histolytica
TKTNL

SEQ ID NO: 2661622 - protein, 8 aa, Entamoeba histolytica
TKTNNEQY

SEQ ID NO: 2661623 - protein, 10 aa, Entamoeba histolytica
TKTNQEKVSD

SEQ ID NO: 2661624 - protein, 10 aa, Entamoeba histolytica
TKTNTSSPSL

SEQ ID NO: 2661625 - protein, 6 aa, Entamoeba histolytica
TKTNVA

SEQ ID NO: 2661626 - protein, 13 aa, Entamoeba histolytica
TKTPKKETIPGRA

SEQ ID NO: 2661627 - protein, 6 aa, Entamoeba histolytica
TKTPKS

SEQ ID NO: 2661628 - protein, 7 aa, Entamoeba histolytica
TKTPLLR

SEQ ID NO: 2661629 - protein, 7 aa, Entamoeba histolytica
TKTPLSD

SEQ ID NO: 2661630 - protein, 6 aa, Entamoeba histolytica
TKTPYQ

SEQ ID NO: 2661631 - protein, 4 aa, Entamoeba histolytica
TKTQ

SEQ ID NO: 2661632 - protein, 5 aa, Entamoeba histolytica
TKTQG

SEQ ID NO: 2661633 - protein, 12 aa, Entamoeba histolytica
TKTQIKAAEPYD

SEQ ID NO: 2661634 - protein, 10 aa, Entamoeba histolytica
TKTQSPLPLN

SEQ ID NO: 2661635 - protein, 8 aa, Entamoeba histolytica
TKTSAIPS

SEQ ID NO: 2661636 - protein, 14 aa, Entamoeba histolytica
TKTSEWRTGESPNT

SEQ ID NO: 2661637 - protein, 5 aa, Entamoeba histolytica
TKTSL

SEQ ID NO: 2661638 - protein, 5 aa, Entamoeba histolytica
TKTSN

SEQ ID NO: 2661639 - protein, 8 aa, Entamoeba histolytica
TKTSQIPQ

SEQ ID NO: 2661640 - protein, 8 aa, Entamoeba histolytica
TKTSTSEL

SEQ ID NO: 2661641 - protein, 7 aa, Entamoeba histolytica
TKTTEYI

SEQ ID NO: 2661642 - protein, 5 aa, Entamoeba histolytica
TKTTQ

SEQ ID NO: 2661643 - protein, 5 aa, Entamoeba histolytica
TKTTS

SEQ ID NO: 2661644 - protein, 7 aa, Entamoeba histolytica
TKTTTTI

SEQ ID NO: 2661645 - protein, 8 aa, Entamoeba histolytica
TKTYERDY

SEQ ID NO: 2661646 - protein, 6 aa, Entamoeba histolytica
TKTYNQ

SEQ ID NO: 2661647 - protein, 8 aa, Entamoeba histolytica
TKVEKKAP

SEQ ID NO: 2661648 - protein, 5 aa, Entamoeba histolytica
TKVKA

SEQ ID NO: 2661649 - protein, 8 aa, Entamoeba histolytica
TKVNSQST

SEQ ID NO: 2661650 - protein, 8 aa, Entamoeba histolytica
TKVPQQTT

SEQ ID NO: 2661651 - protein, 48 aa, Entamoeba histolytica
TKVQNENVTPINDDKEINEENNVSKEEESSIKDNEKRQTMRTGTKNKV

SEQ ID NO: 2661652 - protein, 15 aa, Entamoeba histolytica
TKVTDGKNGTLKTES

SEQ ID NO: 2661653 - protein, 7 aa, Entamoeba histolytica
TKVYEAN

SEQ ID NO: 2661654 - protein, 17 aa, Entamoeba histolytica
TKYEELSRAKKEIEDNS

SEQ ID NO: 2661655 - protein, 14 aa, Entamoeba histolytica
TKYENTNKGSFKER

SEQ ID NO: 2661656 - protein, 4 aa, Entamoeba histolytica
TKYG

SEQ ID NO: 2661657 - protein, 12 aa, Entamoeba histolytica
TKYKKSNGSFAD

SEQ ID NO: 2661658 - protein, 16 aa, Entamoeba histolytica
TKYNHGSGKGNEGSNE

SEQ ID NO: 2661659 - protein, 24 aa, Entamoeba histolytica
TKYNSWKEKHNPDVKPWRNIVEPT

SEQ ID NO: 2661660 - protein, 8 aa, Entamoeba histolytica
TKYPPRPY

SEQ ID NO: 2661661 - protein, 6 aa, Entamoeba histolytica
TKYSDI

SEQ ID NO: 2661662 - protein, 8 aa, Entamoeba histolytica
TKYSGDAK

SEQ ID NO: 2661663 - protein, 16 aa, Entamoeba histolytica
TKYTNGITEDDANRTI

SEQ ID NO: 2661664 - protein, 7 aa, Entamoeba histolytica
TKYTQSD

SEQ ID NO: 2661665 - protein, 12 aa, Entamoeba histolytica
TLAGNKGDRDWL

SEQ ID NO: 2661666 - protein, 10 aa, Entamoeba histolytica
TLAQSSKQHW

SEQ ID NO: 2661667 - protein, 13 aa, Entamoeba histolytica
TLASSKRNAVSEI

SEQ ID NO: 2661668 - protein, 4 aa, Entamoeba histolytica
TLAY

SEQ ID NO: 2661669 - protein, 4 aa, Entamoeba histolytica
TLDA

SEQ ID NO: 2661670 - protein, 4 aa, Entamoeba histolytica
TLDD

SEQ ID NO: 2661671 - protein, 18 aa, Entamoeba histolytica
TLDDDEGWTVDQDKNDTK

SEQ ID NO: 2661672 - protein, 8 aa, Entamoeba histolytica
TLDDPNAK

SEQ ID NO: 2661673 - protein, 8 aa, Entamoeba histolytica
TLDEKQRE

SEQ ID NO: 2661674 - protein, 8 aa, Entamoeba histolytica
TLDEKSKL

SEQ ID NO: 2661675 - protein, 5 aa, Entamoeba histolytica
TLDER

SEQ ID NO: 2661676 - protein, 5 aa, Entamoeba histolytica
TLDES

SEQ ID NO: 2661677 - protein, 11 aa, Entamoeba histolytica
TLDTKTGDNKR

SEQ ID NO: 2661678 - protein, 9 aa, Entamoeba histolytica
TLDTNGLDR

SEQ ID NO: 2661679 - protein, 11 aa, Entamoeba histolytica
TLEEQSSSSIN

SEQ ID NO: 2661680 - protein, 7 aa, Entamoeba histolytica
TLEERKK

SEQ ID NO: 2661681 - protein, 10 aa, Entamoeba histolytica
TLEKSQRLKT

SEQ ID NO: 2661682 - protein, 4 aa, Entamoeba histolytica
TLEL

SEQ ID NO: 2661683 - protein, 17 aa, Entamoeba histolytica
TLENASDIEKKISSSIQ

SEQ ID NO: 2661684 - protein, 8 aa, Entamoeba histolytica
TLENHQDY

SEQ ID NO: 2661685 - protein, 9 aa, Entamoeba histolytica
TLENQPGFD

SEQ ID NO: 2661686 - protein, 4 aa, Entamoeba histolytica
TLEQ

SEQ ID NO: 2661687 - protein, 7 aa, Entamoeba histolytica
TLEQTQK

SEQ ID NO: 2661688 - protein, 4 aa, Entamoeba histolytica
TLES

SEQ ID NO: 2661689 - protein, 17 aa, Entamoeba histolytica
TLESPNTLTKSNEDESF

SEQ ID NO: 2661690 - protein, 5 aa, Entamoeba histolytica
TLESR

SEQ ID NO: 2661691 - protein, 6 aa, Entamoeba histolytica
TLETQK

SEQ ID NO: 2661692 - protein, 7 aa, Entamoeba histolytica
TLETSKS

SEQ ID NO: 2661693 - protein, 5 aa, Entamoeba histolytica
TLGEK

SEQ ID NO: 2661694 - protein, 9 aa, Entamoeba histolytica
TLGENNVSL

SEQ ID NO: 2661695 - protein, 21 aa, Entamoeba histolytica
TLGGEEDDCSRRGGRKNVNQQ

SEQ ID NO: 2661696 - protein, 8 aa, Entamoeba histolytica
TLGGSSIN

SEQ ID NO: 2661697 - protein, 7 aa, Entamoeba histolytica
TLGPKGR

SEQ ID NO: 2661698 - protein, 5 aa, Entamoeba histolytica
TLGPM

SEQ ID NO: 2661699 - protein, 39 aa, Entamoeba histolytica
TLGPQTTPQSSSQPQTQVQQPVNTAPVQMSTETESTSVP

SEQ ID NO: 2661700 - protein, 12 aa, Entamoeba histolytica
TLGRQGNQKVTD

SEQ ID NO: 2661701 - protein, 6 aa, Entamoeba histolytica
TLGRQS

SEQ ID NO: 2661702 - protein, 7 aa, Entamoeba histolytica
TLGRSGP

SEQ ID NO: 2661703 - protein, 4 aa, Entamoeba histolytica
TLGS

SEQ ID NO: 2661704 - protein, 9 aa, Entamoeba histolytica
TLGSGSSNI

SEQ ID NO: 2661705 - protein, 20 aa, Entamoeba histolytica
TLHSKTKKSKKSIKLDSCIL

SEQ ID NO: 2661706 - protein, 27 aa, Entamoeba histolytica
TLHTTKKENKPSINSTNCTNENTTNQS

SEQ ID NO: 2661707 - protein, 8 aa, Entamoeba histolytica
TLKDGTPT

SEQ ID NO: 2661708 - protein, 7 aa, Entamoeba histolytica
TLKEEKK

SEQ ID NO: 2661709 - protein, 41 aa, Entamoeba histolytica
TLKESKEVTDEGCNENEEMKQSNNENVQKNNHPQKTQEEWK

SEQ ID NO: 2661710 - protein, 5 aa, Entamoeba histolytica
TLKGG

SEQ ID NO: 2661711 - protein, 7 aa, Entamoeba histolytica
TLKGKQT

SEQ ID NO: 2661712 - protein, 9 aa, Entamoeba histolytica
TLKGSSIKS

SEQ ID NO: 2661713 - protein, 13 aa, Entamoeba histolytica
TLKKEEDELNGFT

SEQ ID NO: 2661714 - protein, 9 aa, Entamoeba histolytica
TLKKQKELQ

SEQ ID NO: 2661715 - protein, 6 aa, Entamoeba histolytica
TLKPDY

SEQ ID NO: 2661716 - protein, 4 aa, Entamoeba histolytica
TLKQ

SEQ ID NO: 2661717 - protein, 8 aa, Entamoeba histolytica
TLKQPPAI

SEQ ID NO: 2661718 - protein, 20 aa, Entamoeba histolytica
TLKQSQSTLPINKSHQNINK

SEQ ID NO: 2661719 - protein, 13 aa, Entamoeba histolytica
TLKSFKENEYPFD

SEQ ID NO: 2661720 - protein, 41 aa, Entamoeba histolytica
TLKSPSLSSETVNTTIPSAEIKSNSPKRKRWDKTSREKAVK

SEQ ID NO: 2661721 - protein, 10 aa, Entamoeba histolytica
TLKTNDNEPM

SEQ ID NO: 2661722 - protein, 10 aa, Entamoeba histolytica
TLLSGSDDTY

SEQ ID NO: 2661723 - protein, 4 aa, Entamoeba histolytica
TLLT

SEQ ID NO: 2661724 - protein, 11 aa, Entamoeba histolytica
TLNDAQLTPDE

SEQ ID NO: 2661725 - protein, 13 aa, Entamoeba histolytica
TLNESNDKKMEEE

SEQ ID NO: 2661726 - protein, 9 aa, Entamoeba histolytica
TLNETPEDN

SEQ ID NO: 2661727 - protein, 4 aa, Entamoeba histolytica
TLNG

SEQ ID NO: 2661728 - protein, 8 aa, Entamoeba histolytica
TLNGHNGA

SEQ ID NO: 2661729 - protein, 8 aa, Entamoeba histolytica
TLNGSNFA

SEQ ID NO: 2661730 - protein, 9 aa, Entamoeba histolytica
TLNHNVSKE

SEQ ID NO: 2661731 - protein, 25 aa, Entamoeba histolytica
TLNKTTKESIIKEENESKRRGSTPI

SEQ ID NO: 2661732 - protein, 5 aa, Entamoeba histolytica
TLNNK

SEQ ID NO: 2661733 - protein, 6 aa, Entamoeba histolytica
TLNNQT

SEQ ID NO: 2661734 - protein, 5 aa, Entamoeba histolytica
TLNNT

SEQ ID NO: 2661735 - protein, 9 aa, Entamoeba histolytica
TLNPDDKPI

SEQ ID NO: 2661736 - protein, 9 aa, Entamoeba histolytica
TLNPNDSRK

SEQ ID NO: 2661737 - protein, 9 aa, Entamoeba histolytica
TLNRDGSPM

SEQ ID NO: 2661738 - protein, 11 aa, Entamoeba histolytica
TLNSKDYQKMA

SEQ ID NO: 2661739 - protein, 15 aa, Entamoeba histolytica
TLNTTSTLDDPEAEA

SEQ ID NO: 2661740 - protein, 4 aa, Entamoeba histolytica
TLPD

SEQ ID NO: 2661741 - protein, 15 aa, Entamoeba histolytica
TLPDERRRTSTEYDY

SEQ ID NO: 2661742 - protein, 18 aa, Entamoeba histolytica
TLPEETLPQDEEDEEERV

SEQ ID NO: 2661743 - protein, 5 aa, Entamoeba histolytica
TLPEL

SEQ ID NO: 2661744 - protein, 8 aa, Entamoeba histolytica
TLPEPQVA

SEQ ID NO: 2661745 - protein, 8 aa, Entamoeba histolytica
TLPGPQDK

SEQ ID NO: 2661746 - protein, 7 aa, Entamoeba histolytica
TLPKSSA

SEQ ID NO: 2661747 - protein, 5 aa, Entamoeba histolytica
TLPNC

SEQ ID NO: 2661748 - protein, 12 aa, Entamoeba histolytica
TLPNHSKKPHRK

SEQ ID NO: 2661749 - protein, 9 aa, Entamoeba histolytica
TLPNNSSLK

SEQ ID NO: 2661750 - protein, 6 aa, Entamoeba histolytica
TLPNYQ

SEQ ID NO: 2661751 - protein, 12 aa, Entamoeba histolytica
TLPPNYSGSSEN

SEQ ID NO: 2661752 - protein, 5 aa, Entamoeba histolytica
TLPPS

SEQ ID NO: 2661753 - protein, 7 aa, Entamoeba histolytica
TLPPSTM

SEQ ID NO: 2661754 - protein, 16 aa, Entamoeba histolytica
TLPRKSLEKSKEVLRK

SEQ ID NO: 2661755 - protein, 5 aa, Entamoeba histolytica
TLPRL

SEQ ID NO: 2661756 - protein, 12 aa, Entamoeba histolytica
TLPRTDEDEYYN

SEQ ID NO: 2661757 - protein, 4 aa, Entamoeba histolytica
TLPS

SEQ ID NO: 2661758 - protein, 6 aa, Entamoeba histolytica
TLPSDI

SEQ ID NO: 2661759 - protein, 7 aa, Entamoeba histolytica
TLPSDKQ

SEQ ID NO: 2661760 - protein, 23 aa, Entamoeba histolytica
TLPSKKGVEEERLNRRKSAYSNA

SEQ ID NO: 2661761 - protein, 10 aa, Entamoeba histolytica
TLPSKPDYNT

SEQ ID NO: 2661762 - protein, 9 aa, Entamoeba histolytica
TLPSSNEMK

SEQ ID NO: 2661763 - protein, 8 aa, Entamoeba histolytica
TLPTNIRQ

SEQ ID NO: 2661764 - protein, 9 aa, Entamoeba histolytica
TLPTPADVN

SEQ ID NO: 2661765 - protein, 6 aa, Entamoeba histolytica
TLPTPT

SEQ ID NO: 2661766 - protein, 5 aa, Entamoeba histolytica
TLPTT

SEQ ID NO: 2661767 - protein, 9 aa, Entamoeba histolytica
TLQATTNYS

SEQ ID NO: 2661768 - protein, 8 aa, Entamoeba histolytica
TLQDSTTD

SEQ ID NO: 2661769 - protein, 7 aa, Entamoeba histolytica
TLQEREK

SEQ ID NO: 2661770 - protein, 5 aa, Entamoeba histolytica
TLQIS

SEQ ID NO: 2661771 - protein, 6 aa, Entamoeba histolytica
TLQKKM

SEQ ID NO: 2661772 - protein, 4 aa, Entamoeba histolytica
TLQN

SEQ ID NO: 2661773 - protein, 7 aa, Entamoeba histolytica
TLQNDKN

SEQ ID NO: 2661774 - protein, 5 aa, Entamoeba histolytica
TLQPI

SEQ ID NO: 2661775 - protein, 8 aa, Entamoeba histolytica
TLQPKKQQ

SEQ ID NO: 2661776 - protein, 17 aa, Entamoeba histolytica
TLQPPSREPPELPQYES

SEQ ID NO: 2661777 - protein, 9 aa, Entamoeba histolytica
TLQQNQNTI

SEQ ID NO: 2661778 - protein, 5 aa, Entamoeba histolytica
TLQQV

SEQ ID NO: 2661779 - protein, 10 aa, Entamoeba histolytica
TLQRTQQKKP

SEQ ID NO: 2661780 - protein, 6 aa, Entamoeba histolytica
TLQTQE

SEQ ID NO: 2661781 - protein, 35 aa, Entamoeba histolytica
TLQTRTKYSWSSRRGSTVLRPNSTGSFEIEPKDIP

SEQ ID NO: 2661782 - protein, 11 aa, Entamoeba histolytica
TLRDNGGHMEQ

SEQ ID NO: 2661783 - protein, 7 aa, Entamoeba histolytica
TLREKDH

SEQ ID NO: 2661784 - protein, 17 aa, Entamoeba histolytica
TLREQSDTSKKLKEFDK

SEQ ID NO: 2661785 - protein, 8 aa, Entamoeba histolytica
TLRPSNEE

SEQ ID NO: 2661786 - protein, 12 aa, Entamoeba histolytica
TLRQANETKATL

SEQ ID NO: 2661787 - protein, 10 aa, Entamoeba histolytica
TLRQSKVKNE

SEQ ID NO: 2661788 - protein, 4 aa, Entamoeba histolytica
TLRR

SEQ ID NO: 2661789 - protein, 5 aa, Entamoeba histolytica
TLRRK

SEQ ID NO: 2661790 - protein, 8 aa, Entamoeba histolytica
TLRTEDGS

SEQ ID NO: 2661791 - protein, 5 aa, Entamoeba histolytica
TLRTI

SEQ ID NO: 2661792 - protein, 7 aa, Entamoeba histolytica
TLSDGEV

SEQ ID NO: 2661793 - protein, 11 aa, Entamoeba histolytica
TLSDKGSQEAK

SEQ ID NO: 2661794 - protein, 4 aa, Entamoeba histolytica
TLSE

SEQ ID NO: 2661795 - protein, 8 aa, Entamoeba histolytica
TLSEKSNC

SEQ ID NO: 2661796 - protein, 6 aa, Entamoeba histolytica
TLSENG

SEQ ID NO: 2661797 - protein, 5 aa, Entamoeba histolytica
TLSEQ

SEQ ID NO: 2661798 - protein, 6 aa, Entamoeba histolytica
TLSEYE

SEQ ID NO: 2661799 - protein, 9 aa, Entamoeba histolytica
TLSGGQKSR

SEQ ID NO: 2661800 - protein, 6 aa, Entamoeba histolytica
TLSGNK

SEQ ID NO: 2661801 - protein, 12 aa, Entamoeba histolytica
TLSGRLPARNQQ

SEQ ID NO: 2661802 - protein, 4 aa, Entamoeba histolytica
TLSK

SEQ ID NO: 2661803 - protein, 6 aa, Entamoeba histolytica
TLSKPI

SEQ ID NO: 2661804 - protein, 6 aa, Entamoeba histolytica
TLSKSN

SEQ ID NO: 2661805 - protein, 6 aa, Entamoeba histolytica
TLSNKE

SEQ ID NO: 2661806 - protein, 9 aa, Entamoeba histolytica
TLSNKRKAN

SEQ ID NO: 2661807 - protein, 10 aa, Entamoeba histolytica
TLSNKTKATL

SEQ ID NO: 2661808 - protein, 14 aa, Entamoeba histolytica
TLSPDQNIRNQGEQ

SEQ ID NO: 2661809 - protein, 5 aa, Entamoeba histolytica
TLSPE

SEQ ID NO: 2661810 - protein, 5 aa, Entamoeba histolytica
TLSPL

SEQ ID NO: 2661811 - protein, 5 aa, Entamoeba histolytica
TLSPM

SEQ ID NO: 2661812 - protein, 15 aa, Entamoeba histolytica
TLSPNENASARLTEK

SEQ ID NO: 2661813 - protein, 33 aa, Entamoeba histolytica; identical to SEQ ID NO: 2466646

SEQ ID NO: 2661814 - protein, 7 aa, Entamoeba histolytica
TLSQDEQ

SEQ ID NO: 2661815 - protein, 14 aa, Entamoeba histolytica
TLSQEQERRNSKYR

SEQ ID NO: 2661816 - protein, 10 aa, Entamoeba histolytica
TLSQEQRAVA

SEQ ID NO: 2661817 - protein, 12 aa, Entamoeba histolytica
TLSQRDSKTFQK

SEQ ID NO: 2661818 - protein, 10 aa, Entamoeba histolytica
TLSSEKSNEL

SEQ ID NO: 2661819 - protein, 12 aa, Entamoeba histolytica
TLSSPNKPDITI

SEQ ID NO: 2661820 - protein, 13 aa, Entamoeba histolytica
TLSSQEENKGIQK

SEQ ID NO: 2661821 - protein, 33 aa, Entamoeba histolytica
TLSSSPPNTQIQPHQPKITPTNPFSRSAIDDSS

SEQ ID NO: 2661822 - protein, 16 aa, Entamoeba histolytica
TLSTGSEDGVLISSQF

SEQ ID NO: 2661823 - protein, 8 aa, Entamoeba histolytica
TLSTNKDE

SEQ ID NO: 2661824 - protein, 11 aa, Entamoeba histolytica
TLTAPNKHMSE

SEQ ID NO: 2661825 - protein, 8 aa, Entamoeba histolytica
TLTEEASL

SEQ ID NO: 2661826 - protein, 8 aa, Entamoeba histolytica
TLTEEQAN

SEQ ID NO: 2661827 - protein, 18 aa, Entamoeba histolytica
TLTEEQYQGEDKELKSSQ

SEQ ID NO: 2661828 - protein, 10 aa, Entamoeba histolytica
TLTHSSQASV

SEQ ID NO: 2661829 - protein, 4 aa, Entamoeba histolytica
TLTK

SEQ ID NO: 2661830 - protein, 11 aa, Entamoeba histolytica
TLTKPRNKITQ

SEQ ID NO: 2661831 - protein, 13 aa, Entamoeba histolytica
TLTPRIEKENTEI

SEQ ID NO: 2661832 - protein, 11 aa, Entamoeba histolytica
TLTSIRTGGIG

SEQ ID NO: 2661833 - protein, 8 aa, Entamoeba histolytica
TLTSPNNT

SEQ ID NO: 2661834 - protein, 5 aa, Entamoeba histolytica
TLTSQ

SEQ ID NO: 2661835 - protein, 12 aa, Entamoeba histolytica
TLTSTNNEIENS

SEQ ID NO: 2661836 - protein, 13 aa, Entamoeba histolytica
TLTTKERKKSRFG

SEQ ID NO: 2661837 - protein, 5 aa, Entamoeba histolytica
TLTTQ

SEQ ID NO: 2661838 - protein, 12 aa, Entamoeba histolytica
TLYDSDEDGLTA

SEQ ID NO: 2661839 - protein, 9 aa, Entamoeba histolytica
TLYKTPTNN

SEQ ID NO: 2661840 - protein, 12 aa, Entamoeba histolytica
TMAGNKGDRDWL

SEQ ID NO: 2661841 - protein, 4 aa, Entamoeba histolytica
TMDE

SEQ ID NO: 2661842 - protein, 42 aa, Entamoeba histolytica
TMEEESTKENSSITTIPQSPTQNQSSGTSSQPTQNDKNDTIG

SEQ ID NO: 2661843 - protein, 4 aa, Entamoeba histolytica
TMEL

SEQ ID NO: 2661844 - protein, 7 aa, Entamoeba histolytica
TMEPTDA

SEQ ID NO: 2661845 - protein, 4 aa, Entamoeba histolytica
TMEV

SEQ ID NO: 2661846 - protein, 5 aa, Entamoeba histolytica
TMKEN

SEQ ID NO: 2661847 - protein, 8 aa, Entamoeba histolytica
TMKETNKN

SEQ ID NO: 2661848 - protein, 11 aa, Entamoeba histolytica
TMKGGNDYEMA

SEQ ID NO: 2661849 - protein, 15 aa, Entamoeba histolytica
TMKGGRFFGKDFPRF

SEQ ID NO: 2661850 - protein, 5 aa, Entamoeba histolytica
TMKGR

SEQ ID NO: 2661851 - protein, 8 aa, Entamoeba histolytica
TMKNNSEI

SEQ ID NO: 2661852 - protein, 15 aa, Entamoeba histolytica
TMKNSNNKANINQKE

SEQ ID NO: 2661853 - protein, 8 aa, Entamoeba histolytica
TMKSNPCY

SEQ ID NO: 2661854 - protein, 6 aa, Entamoeba histolytica
TMKTPP

SEQ ID NO: 2661855 - protein, 5 aa, Entamoeba histolytica
TMNEE

SEQ ID NO: 2661856 - protein, 6 aa, Entamoeba histolytica
TMNGGY

SEQ ID NO: 2661857 - protein, 95 aa, Entamoeba histolytica
TMPDENTEIKKKTIKKVTTTRKRKDEDSSMSGDEKVKRKRTTKKSTTKKTTKKRTTKASKEEENDTVDTPAKTSRKKKTKKVTVKEEDDDESDSV

SEQ ID NO: 2661858 - protein, 4 aa, Entamoeba histolytica
TMPK

SEQ ID NO: 2661859 - protein, 9 aa, Entamoeba histolytica
TMPKPNKKK

SEQ ID NO: 2661860 - protein, 5 aa, Entamoeba histolytica
TMPQD

SEQ ID NO: 2661861 - protein, 8 aa, Entamoeba histolytica
TMQNVNSS

SEQ ID NO: 2661862 - protein, 7 aa, Entamoeba histolytica
TMRDAQQ

SEQ ID NO: 2661863 - protein, 6 aa, Entamoeba histolytica
TMSLQG

SEQ ID NO: 2661864 - protein, 12 aa, Entamoeba histolytica
TMSSDKSIDEKF

SEQ ID NO: 2661865 - protein, 9 aa, Entamoeba histolytica
TMTDQKYQL

SEQ ID NO: 2661866 - protein, 5 aa, Entamoeba histolytica
TMTEY

SEQ ID NO: 2661867 - protein, 4 aa, Entamoeba histolytica
TMTI

SEQ ID NO: 2661868 - protein, 4 aa, Entamoeba histolytica
TMTS

SEQ ID NO: 2661869 - protein, 5 aa, Entamoeba histolytica
TMTSE

SEQ ID NO: 2661870 - protein, 8 aa, Entamoeba histolytica
TMTTKNTN

SEQ ID NO: 2661871 - protein, 59 aa, Entamoeba histolytica
TMTTYEKQRSKYFNNTPNDNTMEEEDYDVDDDDDVDDYSDGPLERAPLGGKNDDMDIIY

SEQ ID NO: 2661872 - protein, 15 aa, Entamoeba histolytica
TMYSDTYDNNSENIC

SEQ ID NO: 2661873 - protein, 16 aa, Entamoeba histolytica
TNAAKVSKTTTKTGTV

SEQ ID NO: 2661874 - protein, 4 aa, Entamoeba histolytica
TNAD

SEQ ID NO: 2661875 - protein, 7 aa, Entamoeba histolytica
TNAEEYR

SEQ ID NO: 2661876 - protein, 4 aa, Entamoeba histolytica
TNAN

SEQ ID NO: 2661877 - protein, 10 aa, Entamoeba histolytica
TNANPNDETN

SEQ ID NO: 2661878 - protein, 19 aa, Entamoeba histolytica
TNARSSVAATFGDEPILGT

SEQ ID NO: 2661879 - protein, 7 aa, Entamoeba histolytica
TNATEVS

SEQ ID NO: 2661880 - protein, 5 aa, Entamoeba histolytica
TNCDE

SEQ ID NO: 2661881 - protein, 6 aa, Entamoeba histolytica
TNCPHP

SEQ ID NO: 2661882 - protein, 12 aa, Entamoeba histolytica
TNCSSSRDHHKK

SEQ ID NO: 2661883 - protein, 10 aa, Entamoeba histolytica
TNDAQSEKKY

SEQ ID NO: 2661884 - protein, 5 aa, Entamoeba histolytica
TNDDI

SEQ ID NO: 2661885 - protein, 4 aa, Entamoeba histolytica
TNDE

SEQ ID NO: 2661886 - protein, 8 aa, Entamoeba histolytica
TNDEEPIP

SEQ ID NO: 2661887 - protein, 6 aa, Entamoeba histolytica
TNDEIE

SEQ ID NO: 2661888 - protein, 9 aa, Entamoeba histolytica
TNDEPDQNW

SEQ ID NO: 2661889 - protein, 8 aa, Entamoeba histolytica
TNDEPSGY

SEQ ID NO: 2661890 - protein, 6 aa, Entamoeba histolytica
TNDEQI

SEQ ID NO: 2661891 - protein, 8 aa, Entamoeba histolytica
TNDGEEIE

SEQ ID NO: 2661892 - protein, 9 aa, Entamoeba histolytica
TNDGKDMNK

SEQ ID NO: 2661893 - protein, 6 aa, Entamoeba histolytica
TNDGTI

SEQ ID NO: 2661894 - protein, 16 aa, Entamoeba histolytica
TNDHPKKLQIERKSKM

SEQ ID NO: 2661895 - protein, 6 aa, Entamoeba histolytica
TNDIES

SEQ ID NO: 2661896 - protein, 10 aa, Entamoeba histolytica
TNDIPNSKKF

SEQ ID NO: 2661897 - protein, 18 aa, Entamoeba histolytica
TNDIQKEKYQMQETQLTQ

SEQ ID NO: 2661898 - protein, 14 aa, Entamoeba histolytica
TNDKPEKEDEVASG

SEQ ID NO: 2661899 - protein, 14 aa, Entamoeba histolytica
TNDKPTVSKSPRTI

SEQ ID NO: 2661900 - protein, 5 aa, Entamoeba histolytica
TNDKV

SEQ ID NO: 2661901 - protein, 7 aa, Entamoeba histolytica
TNDMTEQ

SEQ ID NO: 2661902 - protein, 12 aa, Entamoeba histolytica
TNDNDDSTDTED

SEQ ID NO: 2661903 - protein, 7 aa, Entamoeba histolytica
TNDNKGK

SEQ ID NO: 2661904 - protein, 4 aa, Entamoeba histolytica
TNDP

SEQ ID NO: 2661905 - protein, 8 aa, Entamoeba histolytica
TNDPNESV

SEQ ID NO: 2661906 - protein, 9 aa, Entamoeba histolytica
TNDPPNDAQ

SEQ ID NO: 2661907 - protein, 6 aa, Entamoeba histolytica
TNDPTY

SEQ ID NO: 2661908 - protein, 8 aa, Entamoeba histolytica
TNDQTDKE

SEQ ID NO: 2661909 - protein, 4 aa, Entamoeba histolytica
TNDS

SEQ ID NO: 2661910 - protein, 6 aa, Entamoeba histolytica
TNDSSS

SEQ ID NO: 2661911 - protein, 6 aa, Entamoeba histolytica
TNDTES

SEQ ID NO: 2661912 - protein, 42 aa, Entamoeba histolytica
TNDTPVPAKSPKTVSRSENNTVSTNPFGEPTTPQIDSTNPFL

SEQ ID NO: 2661913 - protein, 25 aa, Entamoeba histolytica
TNDVKKQEETKYEWEESKKSFKTYE

SEQ ID NO: 2661914 - protein, 8 aa, Entamoeba histolytica
TNEAKETL

SEQ ID NO: 2661915 - protein, 10 aa, Entamoeba histolytica
TNEASSSQIS

SEQ ID NO: 2661916 - protein, 10 aa, Entamoeba histolytica
TNECEKQKEE

SEQ ID NO: 2661917 - protein, 5 aa, Entamoeba histolytica
TNEDH

SEQ ID NO: 2661918 - protein, 19 aa, Entamoeba histolytica
TNEDMKNGKATGIRDAKET

SEQ ID NO: 2661919 - protein, 4 aa, Entamoeba histolytica
TNEE

SEQ ID NO: 2661920 - protein, 7 aa, Entamoeba histolytica
TNEEDVD

SEQ ID NO: 2661921 - protein, 5 aa, Entamoeba histolytica
TNEEF

SEQ ID NO: 2661922 - protein, 12 aa, Entamoeba histolytica
TNEEGNECNKEV

SEQ ID NO: 2661923 - protein, 7 aa, Entamoeba histolytica
TNEEGNS

SEQ ID NO: 2661924 - protein, 19 aa, Entamoeba histolytica
TNEEIEEDRKKLFEQCLEM

SEQ ID NO: 2661925 - protein, 6 aa, Entamoeba histolytica
TNEEIK

SEQ ID NO: 2661926 - protein, 22 aa, Entamoeba histolytica
TNEEIKQRETLTYQAENNSTYE

SEQ ID NO: 2661927 - protein, 26 aa, Entamoeba histolytica
TNEENKNTKEEDNKSNTNESTQPVEM

SEQ ID NO: 2661928 - protein, 6 aa, Entamoeba histolytica
TNEENL

SEQ ID NO: 2661929 - protein, 6 aa, Entamoeba histolytica
TNEESI

SEQ ID NO: 2661930 - protein, 6 aa, Entamoeba histolytica
TNEEYN

SEQ ID NO: 2661931 - protein, 9 aa, Entamoeba histolytica
TNEGDCDKS

SEQ ID NO: 2661932 - protein, 6 aa, Entamoeba histolytica
TNEGKC

SEQ ID NO: 2661933 - protein, 52 aa, Entamoeba histolytica
  misc_feature (15)..(48): Xaa can be any naturally occurring amino acid
TNEGKCTVKLHDLTXXXXXXXXXXXXXXXXXXXXXXXXXXXXXXXXXXLIKI

SEQ ID NO: 2661934 - protein, 63 aa, Entamoeba histolytica
  misc_feature (15)..(48): Xaa can be any naturally occurring amino acid
TNEGKCTVKLHDLTXXXXXXXXXXXXXXXXXXXXXXXXXXXXXXXXXXMKYHMVICLMHKFNK

SEQ ID NO: 2661935 - protein, 5 aa, Entamoeba histolytica
TNEID

SEQ ID NO: 2661936 - protein, 18 aa, Entamoeba histolytica
TNEIGNESTKINQNKEVD

SEQ ID NO: 2661937 - protein, 5 aa, Entamoeba histolytica
TNEIV

SEQ ID NO: 2661938 - protein, 4 aa, Entamoeba histolytica
TNEK

SEQ ID NO: 2661939 - protein, 11 aa, Entamoeba histolytica
TNEKDHTYQMS

SEQ ID NO: 2661940 - protein, 7 aa, Entamoeba histolytica
TNEKGDD

SEQ ID NO: 2661941 - protein, 14 aa, Entamoeba histolytica
TNEKGFRPKPVDDD

SEQ ID NO: 2661942 - protein, 5 aa, Entamoeba histolytica
TNEKM

SEQ ID NO: 2661943 - protein, 9 aa, Entamoeba histolytica
TNEKSQKRA

SEQ ID NO: 2661944 - protein, 5 aa, Entamoeba histolytica
TNEKV

SEQ ID NO: 2661945 - protein, 7 aa, Entamoeba histolytica
TNELART

SEQ ID NO: 2661946 - protein, 6 aa, Entamoeba histolytica
TNELSE

SEQ ID NO: 2661947 - protein, 11 aa, Entamoeba histolytica
TNENEDKGNLN

SEQ ID NO: 2661948 - protein, 5 aa, Entamoeba histolytica
TNENN

SEQ ID NO: 2661949 - protein, 31 aa, Entamoeba histolytica
TNENNTHTNSFSSLPTTPTISSTPSTNITTN

SEQ ID NO: 2661950 - protein, 9 aa, Entamoeba histolytica
TNENSNDYQ

SEQ ID NO: 2661951 - protein, 11 aa, Entamoeba histolytica
TNENSYQENSL

SEQ ID NO: 2661952 - protein, 19 aa, Entamoeba histolytica
TNEPFRQKEESQPDDKKFA

SEQ ID NO: 2661953 - protein, 7 aa, Entamoeba histolytica
TNEPNEN

SEQ ID NO: 2661954 - protein, 9 aa, Entamoeba histolytica
TNEQQDSSE

SEQ ID NO: 2661955 - protein, 9 aa, Entamoeba histolytica
TNEQQLKER

SEQ ID NO: 2661956 - protein, 7 aa, Entamoeba histolytica
TNERNIA

SEQ ID NO: 2661957 - protein, 5 aa, Entamoeba histolytica
TNESC

SEQ ID NO: 2661958 - protein, 8 aa, Entamoeba histolytica
TNESDKPI

SEQ ID NO: 2661959 - protein, 11 aa, Entamoeba histolytica
TNESEPNTSLL

SEQ ID NO: 2661960 - protein, 7 aa, Entamoeba histolytica
TNESNTI

SEQ ID NO: 2661961 - protein, 11 aa, Entamoeba histolytica
TNESSYNQGNW

SEQ ID NO: 2661962 - protein, 8 aa, Entamoeba histolytica
TNETNEGW

SEQ ID NO: 2661963 - protein, 4 aa, Entamoeba histolytica
TNEV

SEQ ID NO: 2661964 - protein, 5 aa, Entamoeba histolytica
TNEVA

SEQ ID NO: 2661965 - protein, 11 aa, Entamoeba histolytica
TNEVKNEGNEV

SEQ ID NO: 2661966 - protein, 12 aa, Entamoeba histolytica
TNEVNPSPNIKS

SEQ ID NO: 2661967 - protein, 5 aa, Entamoeba histolytica
TNEVR

SEQ ID NO: 2661968 - protein, 8 aa, Entamoeba histolytica
TNFDDGAC

SEQ ID NO: 2661969 - protein, 7 aa, Entamoeba histolytica
TNFPTSI

SEQ ID NO: 2661970 - protein, 4 aa, Entamoeba histolytica
TNFT

SEQ ID NO: 2661971 - protein, 4 aa, Entamoeba histolytica
TNGA

SEQ ID NO: 2661972 - protein, 6 aa, Entamoeba histolytica
TNGDAT

SEQ ID NO: 2661973 - protein, 5 aa, Entamoeba histolytica
TNGDS

SEQ ID NO: 2661974 - protein, 8 aa, Entamoeba histolytica
TNGDSVRT

SEQ ID NO: 2661975 - protein, 8 aa, Entamoeba histolytica
TNGEFNQG

SEQ ID NO: 2661976 - protein, 17 aa, Entamoeba histolytica
TNGIESQSISQSTSFIL

SEQ ID NO: 2661977 - protein, 6 aa, Entamoeba histolytica
TNGITG

SEQ ID NO: 2661978 - protein, 4 aa, Entamoeba histolytica
TNGL

SEQ ID NO: 2661979 - protein, 10 aa, Entamoeba histolytica
TNGNDGINQL

SEQ ID NO: 2661980 - protein, 23 aa, Entamoeba histolytica
TNGPKLDSIRTTGSSTSPKLSQA

SEQ ID NO: 2661981 - protein, 15 aa, Entamoeba histolytica
TNGRLNKKENVEYEP

SEQ ID NO: 2661982 - protein, 13 aa, Entamoeba histolytica
TNGRSVQAGTSHH

SEQ ID NO: 2661983 - protein, 7 aa, Entamoeba histolytica
TNGSGRY

SEQ ID NO: 2661984 - protein, 19 aa, Entamoeba histolytica
TNGTEKYGRVTSRANKGDG

SEQ ID NO: 2661985 - protein, 6 aa, Entamoeba histolytica
TNGTLT

SEQ ID NO: 2661986 - protein, 9 aa, Entamoeba histolytica
TNGTSNPNQ

SEQ ID NO: 2661987 - protein, 9 aa, Entamoeba histolytica
TNGWKKDQI

SEQ ID NO: 2661988 - protein, 6 aa, Entamoeba histolytica
TNHNRT

SEQ ID NO: 2661989 - protein, 4 aa, Entamoeba histolytica
TNHP

SEQ ID NO: 2661990 - protein, 19 aa, Entamoeba histolytica
TNHQDTSIAITGDTNDSSL

SEQ ID NO: 2661991 - protein, 5 aa, Entamoeba histolytica
TNHQN

SEQ ID NO: 2661992 - protein, 13 aa, Entamoeba histolytica
TNHSTKPRTRPMS

SEQ ID NO: 2661993 - protein, 12 aa, Entamoeba histolytica
TNIDSTGQSYYG

SEQ ID NO: 2661994 - protein, 4 aa, Entamoeba histolytica
TNIE

SEQ ID NO: 2661995 - protein, 15 aa, Entamoeba histolytica
TNIEENDEGNGVNKS

SEQ ID NO: 2661996 - protein, 4 aa, Entamoeba histolytica
TNIK

SEQ ID NO: 2661997 - protein, 15 aa, Entamoeba histolytica
TNIKDYNKRNDPTTK

SEQ ID NO: 2661998 - protein, 15 aa, Entamoeba histolytica
TNIKSKDNKDGTFAG

SEQ ID NO: 2661999 - protein, 4 aa, Entamoeba histolytica
TNIL

SEQ ID NO: 2662000 - protein, 9 aa, Entamoeba histolytica
TNINRKKDR

SEQ ID NO: 2662001 - protein, 9 aa, Entamoeba histolytica
TNISEDSYY

SEQ ID NO: 2662002 - protein, 9 aa, Entamoeba histolytica
TNISKEGAR

SEQ ID NO: 2662003 - protein, 5 aa, Entamoeba histolytica
TNITN

SEQ ID NO: 2662004 - protein, 5 aa, Entamoeba histolytica
TNKAN

SEQ ID NO: 2662005 - protein, 7 aa, Entamoeba histolytica
TNKENED

SEQ ID NO: 2662006 - protein, 8 aa, Entamoeba histolytica
TNKEQSEK

SEQ ID NO: 2662007 - protein, 31 aa, Entamoeba histolytica
TNKERDCTSVKNEEHIESSIEDTPKEINHPL

SEQ ID NO: 2662008 - protein, 11 aa, Entamoeba histolytica
TNKETGKSRGF

SEQ ID NO: 2662009 - protein, 13 aa, Entamoeba histolytica
TNKGSGLYTTPSS

SEQ ID NO: 2662010 - protein, 8 aa, Entamoeba histolytica
TNKGSTNY

SEQ ID NO: 2662011 - protein, 9 aa, Entamoeba histolytica
TNKKERNTE

SEQ ID NO: 2662012 - protein, 15 aa, Entamoeba histolytica
TNKKKVKERNGNTKL

SEQ ID NO: 2662013 - protein, 6 aa, Entamoeba histolytica
TNKKSY

SEQ ID NO: 2662014 - protein, 7 aa, Entamoeba histolytica
TNKKTTR

SEQ ID NO: 2662015 - protein, 4 aa, Entamoeba histolytica
TNKL

SEQ ID NO: 2662016 - protein, 4 aa, Entamoeba histolytica
TNKN

SEQ ID NO: 2662017 - protein, 8 aa, Entamoeba histolytica
TNKNDPKV

SEQ ID NO: 2662018 - protein, 8 aa, Entamoeba histolytica
TNKNGVEL

SEQ ID NO: 2662019 - protein, 8 aa, Entamoeba histolytica
TNKNKGMG

SEQ ID NO: 2662020 - protein, 15 aa, Entamoeba histolytica
TNKNSKKMESDKDLQ

SEQ ID NO: 2662021 - protein, 6 aa, Entamoeba histolytica
TNKPID

SEQ ID NO: 2662022 - protein, 5 aa, Entamoeba histolytica
TNKPL

SEQ ID NO: 2662023 - protein, 6 aa, Entamoeba histolytica
TNKQPN

SEQ ID NO: 2662024 - protein, 6 aa, Entamoeba histolytica
TNKRRG

SEQ ID NO: 2662025 - protein, 8 aa, Entamoeba histolytica
TNKRTEST

SEQ ID NO: 2662026 - protein, 6 aa, Entamoeba histolytica
TNKSNY

SEQ ID NO: 2662027 - protein, 4 aa, Entamoeba histolytica
TNKT

SEQ ID NO: 2662028 - protein, 7 aa, Entamoeba histolytica
TNKTPFS

SEQ ID NO: 2662029 - protein, 27 aa, Entamoeba histolytica
TNKVNKKKNEKVNKPIRQPVDENGQVI

SEQ ID NO: 2662030 - protein, 5 aa, Entamoeba histolytica
TNKYE

SEQ ID NO: 2662031 - protein, 6 aa, Entamoeba histolytica
TNKYLR

SEQ ID NO: 2662032 - protein, 5 aa, Entamoeba histolytica
TNKYR

SEQ ID NO: 2662033 - protein, 7 aa, Entamoeba histolytica
TNLDREG

SEQ ID NO: 2662034 - protein, 6 aa, Entamoeba histolytica
TNLNSV

SEQ ID NO: 2662035 - protein, 5 aa, Entamoeba histolytica
TNLPY

SEQ ID NO: 2662036 - protein, 6 aa, Entamoeba histolytica
TNLTPS

SEQ ID NO: 2662037 - protein, 6 aa, Entamoeba histolytica
TNMRPN

SEQ ID NO: 2662038 - protein, 4 aa, Entamoeba histolytica
TNMS

SEQ ID NO: 2662039 - protein, 9 aa, Entamoeba histolytica
TNMTNTQPV

SEQ ID NO: 2662040 - protein, 8 aa, Entamoeba histolytica
TNNANATS

SEQ ID NO: 2662041 - protein, 12 aa, Entamoeba histolytica
TNNAYSDKKGRQ

SEQ ID NO: 2662042 - protein, 7 aa, Entamoeba histolytica
TNNDPIK

SEQ ID NO: 2662043 - protein, 8 aa, Entamoeba histolytica
TNNEERKK

SEQ ID NO: 2662044 - protein, 25 aa, Entamoeba histolytica
TNNEKTTTCQEDKRCQKIDKTKNLT

SEQ ID NO: 2662045 - protein, 8 aa, Entamoeba histolytica
TNNESADM

SEQ ID NO: 2662046 - protein, 5 aa, Entamoeba histolytica
TNNFD

SEQ ID NO: 2662047 - protein, 19 aa, Entamoeba histolytica
TNNGAGNSWANGYYTTEKM

SEQ ID NO: 2662048 - protein, 5 aa, Entamoeba histolytica
TNNGE

SEQ ID NO: 2662049 - protein, 11 aa, Entamoeba histolytica
TNNGSRKQQLQ

SEQ ID NO: 2662050 - protein, 5 aa, Entamoeba histolytica
TNNKE

SEQ ID NO: 2662051 - protein, 9 aa, Entamoeba histolytica
TNNKEKIDE

SEQ ID NO: 2662052 - protein, 10 aa, Entamoeba histolytica
TNNKKDDEID

SEQ ID NO: 2662053 - protein, 8 aa, Entamoeba histolytica
TNNKSQEW

SEQ ID NO: 2662054 - protein, 4 aa, Entamoeba histolytica
TNNN

SEQ ID NO: 2662055 - protein, 7 aa, Entamoeba histolytica
TNNPDKY

SEQ ID NO: 2662056 - protein, 5 aa, Entamoeba histolytica
TNNPE

SEQ ID NO: 2662057 - protein, 8 aa, Entamoeba histolytica
TNNPEEID

SEQ ID NO: 2662058 - protein, 6 aa, Entamoeba histolytica
TNNPEV

SEQ ID NO: 2662059 - protein, 10 aa, Entamoeba histolytica
TNNPKYPVPS

SEQ ID NO: 2662060 - protein, 8 aa, Entamoeba histolytica
TNNPSIKK

SEQ ID NO: 2662061 - protein, 9 aa, Entamoeba histolytica
TNNQRLQTT

SEQ ID NO: 2662062 - protein, 4 aa, Entamoeba histolytica
TNNS

SEQ ID NO: 2662063 - protein, 9 aa, Entamoeba histolytica
TNNSHSSKG

SEQ ID NO: 2662064 - protein, 10 aa, Entamoeba histolytica
TNNSKETIYG

SEQ ID NO: 2662065 - protein, 11 aa, Entamoeba histolytica
TNNSKTDDNDP

SEQ ID NO: 2662066 - protein, 11 aa, Entamoeba histolytica
TNNSNENEKNL

SEQ ID NO: 2662067 - protein, 10 aa, Entamoeba histolytica
TNNSPEEITK

SEQ ID NO: 2662068 - protein, 8 aa, Entamoeba histolytica
TNNSQKKV

SEQ ID NO: 2662069 - protein, 8 aa, Entamoeba histolytica
TNNSTDKD

SEQ ID NO: 2662070 - protein, 6 aa, Entamoeba histolytica
TNNSTN

SEQ ID NO: 2662071 - protein, 6 aa, Entamoeba histolytica
TNNTPR

SEQ ID NO: 2662072 - protein, 7 aa, Entamoeba histolytica
TNNTTDI

SEQ ID NO: 2662073 - protein, 4 aa, Entamoeba histolytica
TNNW

SEQ ID NO: 2662074 - protein, 4 aa, Entamoeba histolytica
TNNY

SEQ ID NO: 2662075 - protein, 7 aa, Entamoeba histolytica
TNNYNET

SEQ ID NO: 2662076 - protein, 12 aa, Entamoeba histolytica
TNNYQPKGNAYL

SEQ ID NO: 2662077 - protein, 10 aa, Entamoeba histolytica
TNPASEKTKH

SEQ ID NO: 2662078 - protein, 6 aa, Entamoeba histolytica
TNPDGR

SEQ ID NO: 2662079 - protein, 5 aa, Entamoeba histolytica
TNPDV

SEQ ID NO: 2662080 - protein, 4 aa, Entamoeba histolytica
TNPE

SEQ ID NO: 2662081 - protein, 9 aa, Entamoeba histolytica
TNPEDDSIN

SEQ ID NO: 2662082 - protein, 10 aa, Entamoeba histolytica
TNPEQDYTNA

SEQ ID NO: 2662083 - protein, 7 aa, Entamoeba histolytica
TNPEQNT

SEQ ID NO: 2662084 - protein, 10 aa, Entamoeba histolytica
TNPFDNGPTM

SEQ ID NO: 2662085 - protein, 4 aa, Entamoeba histolytica
TNPH

SEQ ID NO: 2662086 - protein, 7 aa, Entamoeba histolytica
TNPIGES

SEQ ID NO: 2662087 - protein, 9 aa, Entamoeba histolytica
TNPLKESAE

SEQ ID NO: 2662088 - protein, 7 aa, Entamoeba histolytica
TNPLTGE

SEQ ID NO: 2662089 - protein, 10 aa, Entamoeba histolytica
TNPNANDNSL

SEQ ID NO: 2662090 - protein, 23 aa, Entamoeba histolytica
TNPNCPKPGCYRSYGSAKEDNPI

SEQ ID NO: 2662091 - protein, 7 aa, Entamoeba histolytica
TNPNDGG

SEQ ID NO: 2662092 - protein, 6 aa, Entamoeba histolytica
TNPNNE

SEQ ID NO: 2662093 - protein, 6 aa, Entamoeba histolytica
TNPPKV

SEQ ID NO: 2662094 - protein, 12 aa, Entamoeba histolytica
TNPQTINDLAIK

SEQ ID NO: 2662095 - protein, 12 aa, Entamoeba histolytica
TNPQTVTELTDK

SEQ ID NO: 2662096 - protein, 11 aa, Entamoeba histolytica
TNPRRAETMKR

SEQ ID NO: 2662097 - protein, 6 aa, Entamoeba histolytica
TNPRTK

SEQ ID NO: 2662098 - protein, 9 aa, Entamoeba histolytica
TNPSGVEEM

SEQ ID NO: 2662099 - protein, 7 aa, Entamoeba histolytica
TNPSYGT

SEQ ID NO: 2662100 - protein, 5 aa, Entamoeba histolytica
TNPTD

SEQ ID NO: 2662101 - protein, 6 aa, Entamoeba histolytica
TNPTFG

SEQ ID NO: 2662102 - protein, 5 aa, Entamoeba histolytica
TNPTI

SEQ ID NO: 2662103 - protein, 15 aa, Entamoeba histolytica
TNPTLESNENEQEIK

SEQ ID NO: 2662104 - protein, 4 aa, Entamoeba histolytica
TNPY

SEQ ID NO: 2662105 - protein, 4 aa, Entamoeba histolytica
TNQE

SEQ ID NO: 2662106 - protein, 15 aa, Entamoeba histolytica
TNQGESETVAKAREH

SEQ ID NO: 2662107 - protein, 4 aa, Entamoeba histolytica
TNQI

SEQ ID NO: 2662108 - protein, 10 aa, Entamoeba histolytica
TNQKDMEKTI

SEQ ID NO: 2662109 - protein, 9 aa, Entamoeba histolytica
TNQNKTNDI

SEQ ID NO: 2662110 - protein, 6 aa, Entamoeba histolytica
TNQPCS

SEQ ID NO: 2662111 - protein, 34 aa, Entamoeba histolytica
TNQPQQEEKENQQNPTLTAPPIPSQDFDKKETLY

SEQ ID NO: 2662112 - protein, 5 aa, Entamoeba histolytica
TNQPS

SEQ ID NO: 2662113 - protein, 14 aa, Entamoeba histolytica
TNQQVNLNTNNSQF

SEQ ID NO: 2662114 - protein, 7 aa, Entamoeba histolytica
TNQRETT

SEQ ID NO: 2662115 - protein, 10 aa, Entamoeba histolytica
TNQSDVNINE

SEQ ID NO: 2662116 - protein, 11 aa, Entamoeba histolytica
TNQSKRPGSFI

SEQ ID NO: 2662117 - protein, 6 aa, Entamoeba histolytica
TNQSQR

SEQ ID NO: 2662118 - protein, 6 aa, Entamoeba histolytica
TNQTRY

SEQ ID NO: 2662119 - protein, 5 aa, Entamoeba histolytica
TNQTS

SEQ ID NO: 2662120 - protein, 10 aa, Entamoeba histolytica
TNQYSGTNGI

SEQ ID NO: 2662121 - protein, 11 aa, Entamoeba histolytica
TNRDGLLNETE

SEQ ID NO: 2662122 - protein, 13 aa, Entamoeba histolytica
TNREQTEHLQTAT

SEQ ID NO: 2662123 - protein, 11 aa, Entamoeba histolytica
TNRGNKDNLKS

SEQ ID NO: 2662124 - protein, 19 aa, Entamoeba histolytica
TNRGVSKVDEENVELSSYN

SEQ ID NO: 2662125 - protein, 6 aa, Entamoeba histolytica
TNRPDL

SEQ ID NO: 2662126 - protein, 11 aa, Entamoeba histolytica
TNRPDSLDPAL

SEQ ID NO: 2662127 - protein, 5 aa, Entamoeba histolytica
TNRPF

SEQ ID NO: 2662128 - protein, 8 aa, Entamoeba histolytica
TNRPNAID

SEQ ID NO: 2662129 - protein, 7 aa, Entamoeba histolytica
TNRPNTI

SEQ ID NO: 2662130 - protein, 13 aa, Entamoeba histolytica
TNRPQEIDEAARR

SEQ ID NO: 2662131 - protein, 13 aa, Entamoeba histolytica
TNRQETCKKGEVD

SEQ ID NO: 2662132 - protein, 9 aa, Entamoeba histolytica
TNRSGTMEP

SEQ ID NO: 2662133 - protein, 7 aa, Entamoeba histolytica
TNRSTGE

SEQ ID NO: 2662134 - protein, 7 aa, Entamoeba histolytica
TNRTGKI

SEQ ID NO: 2662135 - protein, 7 aa, Entamoeba histolytica
TNRTKIK

SEQ ID NO: 2662136 - protein, 4 aa, Entamoeba histolytica
TNRY

SEQ ID NO: 2662137 - protein, 16 aa, Entamoeba histolytica
TNRYKEEIKQSNQTEG

SEQ ID NO: 2662138 - protein, 4 aa, Entamoeba histolytica
TNSE

SEQ ID NO: 2662139 - protein, 10 aa, Entamoeba histolytica
TNSEAQPEII

SEQ ID NO: 2662140 - protein, 15 aa, Entamoeba histolytica
TNSECDQILKVLTSS

SEQ ID NO: 2662141 - protein, 9 aa, Entamoeba histolytica
TNSEFKGDT

SEQ ID NO: 2662142 - protein, 19 aa, Entamoeba histolytica
TNSEPTTISDTLSNKSSIN

SEQ ID NO: 2662143 - protein, 6 aa, Entamoeba histolytica
TNSESV

SEQ ID NO: 2662144 - protein, 7 aa, Entamoeba histolytica
TNSETEQ

SEQ ID NO: 2662145 - protein, 5 aa, Entamoeba histolytica
TNSEV

SEQ ID NO: 2662146 - protein, 6 aa, Entamoeba histolytica
TNSEYL

SEQ ID NO: 2662147 - protein, 7 aa, Entamoeba histolytica
TNSGTSS

SEQ ID NO: 2662148 - protein, 4 aa, Entamoeba histolytica
TNSI

SEQ ID NO: 2662149 - protein, 7 aa, Entamoeba histolytica
TNSIDSN

SEQ ID NO: 2662150 - protein, 6 aa, Entamoeba histolytica
TNSINP

SEQ ID NO: 2662151 - protein, 21 aa, Entamoeba histolytica
TNSINQISQNQSQKLSSFQED

SEQ ID NO: 2662152 - protein, 6 aa, Entamoeba histolytica
TNSISV

SEQ ID NO: 2662153 - protein, 8 aa, Entamoeba histolytica
TNSKDLTE

SEQ ID NO: 2662154 - protein, 22 aa, Entamoeba histolytica
TNSKPPQKQPQQIQPPQKHSQQ

SEQ ID NO: 2662155 - protein, 33 aa, Entamoeba histolytica
TNSKYGTNTRGMSTTTRSLTTINGGNNANKTIG

SEQ ID NO: 2662156 - protein, 4 aa, Entamoeba histolytica
TNSL

SEQ ID NO: 2662157 - protein, 25 aa, Entamoeba histolytica
TNSLPRNDPRKKAYSTVKGQLSKLK

SEQ ID NO: 2662158 - protein, 18 aa, Entamoeba histolytica
TNSLSQRELKQESKSWEA

SEQ ID NO: 2662159 - protein, 9 aa, Entamoeba histolytica
TNSNGGGFA

SEQ ID NO: 2662160 - protein, 9 aa, Entamoeba histolytica
TNSNVRSQM

SEQ ID NO: 2662161 - protein, 6 aa, Entamoeba histolytica
TNSPQF

SEQ ID NO: 2662162 - protein, 6 aa, Entamoeba histolytica
TNSPTF

SEQ ID NO: 2662163 - protein, 6 aa, Entamoeba histolytica
TNSPYY

SEQ ID NO: 2662164 - protein, 23 aa, Entamoeba histolytica
TNSQQSTSVSQQNYIQNTQNNYM

SEQ ID NO: 2662165 - protein, 6 aa, Entamoeba histolytica
TNSQTG

SEQ ID NO: 2662166 - protein, 8 aa, Entamoeba histolytica
TNSSHTHA

SEQ ID NO: 2662167 - protein, 6 aa, Entamoeba histolytica
TNSSIG

SEQ ID NO: 2662168 - protein, 5 aa, Entamoeba histolytica
TNSSS

SEQ ID NO: 2662169 - protein, 10 aa, Entamoeba histolytica
TNSSSNPQKY

SEQ ID NO: 2662170 - protein, 19 aa, Entamoeba histolytica
TNSSSSDLPISSDVIQYLM

SEQ ID NO: 2662171 - protein, 8 aa, Entamoeba histolytica
TNSTGETP

SEQ ID NO: 2662172 - protein, 11 aa, Entamoeba histolytica
TNSTPPYPSPN

SEQ ID NO: 2662173 - protein, 7 aa, Entamoeba histolytica
TNSTQTI

SEQ ID NO: 2662174 - protein, 10 aa, Entamoeba histolytica
TNSVETTNKR

SEQ ID NO: 2662175 - protein, 6 aa, Entamoeba histolytica
TNSVGG

SEQ ID NO: 2662176 - protein, 5 aa, Entamoeba histolytica
TNSVK

SEQ ID NO: 2662177 - protein, 4 aa, Entamoeba histolytica
TNTD

SEQ ID NO: 2662178 - protein, 8 aa, Entamoeba histolytica
TNTDGMEV

SEQ ID NO: 2662179 - protein, 6 aa, Entamoeba histolytica
TNTESY

SEQ ID NO: 2662180 - protein, 7 aa, Entamoeba histolytica
TNTETRG

SEQ ID NO: 2662181 - protein, 5 aa, Entamoeba histolytica
TNTEY

SEQ ID NO: 2662182 - protein, 5 aa, Entamoeba histolytica
TNTGM

SEQ ID NO: 2662183 - protein, 7 aa, Entamoeba histolytica
TNTGRIP

SEQ ID NO: 2662184 - protein, 22 aa, Entamoeba histolytica
TNTHPTSSNPSTSSNSSTPING

SEQ ID NO: 2662185 - protein, 6 aa, Entamoeba histolytica
TNTIDS

SEQ ID NO: 2662186 - protein, 7 aa, Entamoeba histolytica
TNTKEIP

SEQ ID NO: 2662187 - protein, 8 aa, Entamoeba histolytica
TNTKEPDL

SEQ ID NO: 2662188 - protein, 7 aa, Entamoeba histolytica
TNTKKIK

SEQ ID NO: 2662189 - protein, 10 aa, Entamoeba histolytica
TNTKKLEQTI

SEQ ID NO: 2662190 - protein, 52 aa, Entamoeba histolytica
TNTKPETNKENDLNNTSNPLTSNDLETDTYNKEEIKETDKEKEQKSEEKEII

SEQ ID NO: 2662191 - protein, 4 aa, Entamoeba histolytica
TNTL

SEQ ID NO: 2662192 - protein, 7 aa, Entamoeba histolytica
TNTNGGK

SEQ ID NO: 2662193 - protein, 10 aa, Entamoeba histolytica
TNTPDESSYG

SEQ ID NO: 2662194 - protein, 4 aa, Entamoeba histolytica
TNTQ

SEQ ID NO: 2662195 - protein, 6 aa, Entamoeba histolytica
TNTQFK

SEQ ID NO: 2662196 - protein, 7 aa, Entamoeba histolytica
TNTRRKI

SEQ ID NO: 2662197 - protein, 4 aa, Entamoeba histolytica
TNTS

SEQ ID NO: 2662198 - protein, 10 aa, Entamoeba histolytica
TNTSNSQLTN

SEQ ID NO: 2662199 - protein, 10 aa, Entamoeba histolytica
TNTTEEKEIE

SEQ ID NO: 2662200 - protein, 8 aa, Entamoeba histolytica
TNTTGTQS

SEQ ID NO: 2662201 - protein, 5 aa, Entamoeba histolytica
TNTTI

SEQ ID NO: 2662202 - protein, 7 aa, Entamoeba histolytica
TNTTLGS

SEQ ID NO: 2662203 - protein, 10 aa, Entamoeba histolytica
TNTTNDRRNT

SEQ ID NO: 2662204 - protein, 7 aa, Entamoeba histolytica
TNTTTQS

SEQ ID NO: 2662205 - protein, 14 aa, Entamoeba histolytica
TNTVAEEKKSKSVN

SEQ ID NO: 2662206 - protein, 7 aa, Entamoeba histolytica
TNTWGEQ

SEQ ID NO: 2662207 - protein, 9 aa, Entamoeba histolytica
TNVDPSKPL

SEQ ID NO: 2662208 - protein, 6 aa, Entamoeba histolytica
TNVETE

SEQ ID NO: 2662209 - protein, 9 aa, Entamoeba histolytica
TNVGRNKSL

SEQ ID NO: 2662210 - protein, 9 aa, Entamoeba histolytica
TNVKAKRSL

SEQ ID NO: 2662211 - protein, 10 aa, Entamoeba histolytica
TNVKTDTPLQ

SEQ ID NO: 2662212 - protein, 4 aa, Entamoeba histolytica
TNVN

SEQ ID NO: 2662213 - protein, 6 aa, Entamoeba histolytica
TNVNPI

SEQ ID NO: 2662214 - protein, 45 aa, Entamoeba histolytica
TNVPTSSTCSNSKFAQSTPVNNTQSKLSSNSTLKGNGTLPTRSSV

SEQ ID NO: 2662215 - protein, 14 aa, Entamoeba histolytica
TNVQRGEAGGITQQ

SEQ ID NO: 2662216 - protein, 6 aa, Entamoeba histolytica
TNVSEI

SEQ ID NO: 2662217 - protein, 5 aa, Entamoeba histolytica
TNVSK

SEQ ID NO: 2662218 - protein, 7 aa, Entamoeba histolytica
TNVSKIG

SEQ ID NO: 2662219 - protein, 16 aa, Entamoeba histolytica
TNVSPSKTTTQCTPLS

SEQ ID NO: 2662220 - protein, 6 aa, Entamoeba histolytica
TNVSSL

SEQ ID NO: 2662221 - protein, 6 aa, Entamoeba histolytica
TNVSTE

SEQ ID NO: 2662222 - protein, 4 aa, Entamoeba histolytica
TNVT

SEQ ID NO: 2662223 - protein, 10 aa, Entamoeba histolytica
TNVTNNYEEK

SEQ ID NO: 2662224 - protein, 6 aa, Entamoeba histolytica
TNWSER

SEQ ID NO: 2662225 - protein, 7 aa, Entamoeba histolytica
TNYDDKI

SEQ ID NO: 2662226 - protein, 6 aa, Entamoeba histolytica
TNYDSK

SEQ ID NO: 2662227 - protein, 12 aa, Entamoeba histolytica
TNYKSSKSIENA

SEQ ID NO: 2662228 - protein, 4 aa, Entamoeba histolytica
TNYN

SEQ ID NO: 2662229 - protein, 12 aa, Entamoeba histolytica
TNYSNEHNFQGS

SEQ ID NO: 2662230 - protein, 7 aa, Entamoeba histolytica
TNYSQKT

SEQ ID NO: 2662231 - protein, 6 aa, Entamoeba histolytica
TPAFQG

SEQ ID NO: 2662232 - protein, 6 aa, Entamoeba histolytica
TPAGEN

SEQ ID NO: 2662233 - protein, 9 aa, Entamoeba histolytica
TPAHDPNDY

SEQ ID NO: 2662234 - protein, 11 aa, Entamoeba histolytica
TPAIGRTTTGL

SEQ ID NO: 2662235 - protein, 7 aa, Entamoeba histolytica
TPAIPRE

SEQ ID NO: 2662236 - protein, 6 aa, Entamoeba histolytica
TPALSR

SEQ ID NO: 2662237 - protein, 12 aa, Entamoeba histolytica
TPANVSKKEKEE

SEQ ID NO: 2662238 - protein, 5 aa, Entamoeba histolytica
TPAPY

SEQ ID NO: 2662239 - protein, 6 aa, Entamoeba histolytica
TPAQQD

SEQ ID NO: 2662240 - protein, 8 aa, Entamoeba histolytica
TPATLTKG

SEQ ID NO: 2662241 - protein, 6 aa, Entamoeba histolytica
TPATQL

SEQ ID NO: 2662242 - protein, 5 aa, Entamoeba histolytica
TPCNT

SEQ ID NO: 2662243 - protein, 15 aa, Entamoeba histolytica
TPCRPIASPQDDKDT

SEQ ID NO: 2662244 - protein, 4 aa, Entamoeba histolytica
TPCS

SEQ ID NO: 2662245 - protein, 6 aa, Entamoeba histolytica
TPCTPK

SEQ ID NO: 2662246 - protein, 4 aa, Entamoeba histolytica
TPDC

SEQ ID NO: 2662247 - protein, 21 aa, Entamoeba histolytica
TPDCPPQLPHSSNNQQEEPPV

SEQ ID NO: 2662248 - protein, 14 aa, Entamoeba histolytica
TPDDDRVERDNEEE

SEQ ID NO: 2662249 - protein, 9 aa, Entamoeba histolytica
TPDEKTYYS

SEQ ID NO: 2662250 - protein, 16 aa, Entamoeba histolytica
TPDESIGGLKDSNFGD

SEQ ID NO: 2662251 - protein, 6 aa, Entamoeba histolytica
TPDETS

SEQ ID NO: 2662252 - protein, 4 aa, Entamoeba histolytica
TPDG

SEQ ID NO: 2662253 - protein, 6 aa, Entamoeba histolytica
TPDGAP

SEQ ID NO: 2662254 - protein, 17 aa, Entamoeba histolytica
TPDGKDINQTETTKHQT

SEQ ID NO: 2662255 - protein, 8 aa, Entamoeba histolytica
TPDGNQDM

SEQ ID NO: 2662256 - protein, 4 aa, Entamoeba histolytica
TPDK

SEQ ID NO: 2662257 - protein, 5 aa, Entamoeba histolytica
TPDNK

SEQ ID NO: 2662258 - protein, 10 aa, Entamoeba histolytica
TPDNPKVSKN

SEQ ID NO: 2662259 - protein, 11 aa, Entamoeba histolytica
TPDPDAPPPID

SEQ ID NO: 2662260 - protein, 25 aa, Entamoeba histolytica
TPDQIAASRENKQPSPWRDRSVEEN

SEQ ID NO: 2662261 - protein, 7 aa, Entamoeba histolytica
TPDTIPV

SEQ ID NO: 2662262 - protein, 7 aa, Entamoeba histolytica
TPDTPEL

SEQ ID NO: 2662263 - protein, 6 aa, Entamoeba histolytica
TPDTRN

SEQ ID NO: 2662264 - protein, 19 aa, Entamoeba histolytica
TPDWGSSAAQDGFSQHSNG

SEQ ID NO: 2662265 - protein, 5 aa, Entamoeba histolytica
TPDYK

SEQ ID NO: 2662266 - protein, 6 aa, Entamoeba histolytica
TPEAEK

SEQ ID NO: 2662267 - protein, 7 aa, Entamoeba histolytica
TPEAEKQ

SEQ ID NO: 2662268 - protein, 16 aa, Entamoeba histolytica
TPEALSFGGGTGHPSL

SEQ ID NO: 2662269 - protein, 16 aa, Entamoeba histolytica
TPEAPNKKDEQKRQYY

SEQ ID NO: 2662270 - protein, 24 aa, Entamoeba histolytica
TPEDAKKINEDGEGIKIPTEVNTI

SEQ ID NO: 2662271 - protein, 10 aa, Entamoeba histolytica
TPEDSNTYST

SEQ ID NO: 2662272 - protein, 14 aa, Entamoeba histolytica
TPEEGPRTTQASYV

SEQ ID NO: 2662273 - protein, 8 aa, Entamoeba histolytica
TPEERKPV

SEQ ID NO: 2662274 - protein, 5 aa, Entamoeba histolytica
TPEEV

SEQ ID NO: 2662275 - protein, 5 aa, Entamoeba histolytica
TPEGA

SEQ ID NO: 2662276 - protein, 6 aa, Entamoeba histolytica
TPEHPW

SEQ ID NO: 2662277 - protein, 4 aa, Entamoeba histolytica
TPEK

SEQ ID NO: 2662278 - protein, 21 aa, Entamoeba histolytica
TPEKAKAKATSKWSKLDEDKM

SEQ ID NO: 2662279 - protein, 8 aa, Entamoeba histolytica
TPEKFPDY

SEQ ID NO: 2662280 - protein, 9 aa, Entamoeba histolytica
TPEKRPTAQ

SEQ ID NO: 2662281 - protein, 8 aa, Entamoeba histolytica
TPEKVPNE

SEQ ID NO: 2662282 - protein, 4 aa, Entamoeba histolytica
TPEL

SEQ ID NO: 2662283 - protein, 5 aa, Entamoeba histolytica
TPELA

SEQ ID NO: 2662284 - protein, 4 aa, Entamoeba histolytica
TPEN

SEQ ID NO: 2662285 - protein, 6 aa, Entamoeba histolytica
TPENDS

SEQ ID NO: 2662286 - protein, 6 aa, Entamoeba histolytica
TPENMS

SEQ ID NO: 2662287 - protein, 5 aa, Entamoeba histolytica
TPENP

SEQ ID NO: 2662288 - protein, 4 aa, Entamoeba histolytica
TPEP

SEQ ID NO: 2662289 - protein, 21 aa, Entamoeba histolytica
TPEQGGVRTSSIEKVKSVNSD

SEQ ID NO: 2662290 - protein, 5 aa, Entamoeba histolytica
TPEQL

SEQ ID NO: 2662291 - protein, 7 aa, Entamoeba histolytica
TPEQRGK

SEQ ID NO: 2662292 - protein, 6 aa, Entamoeba histolytica
TPEQSN

SEQ ID NO: 2662293 - protein, 4 aa, Entamoeba histolytica
TPES

SEQ ID NO: 2662294 - protein, 5 aa, Entamoeba histolytica
TPETF

SEQ ID NO: 2662295 - protein, 6 aa, Entamoeba histolytica
TPEVNT

SEQ ID NO: 2662296 - protein, 5 aa, Entamoeba histolytica
TPEYL

SEQ ID NO: 2662297 - protein, 16 aa, Entamoeba histolytica
TPFAADDDGNQNETYQ

SEQ ID NO: 2662298 - protein, 12 aa, Entamoeba histolytica
TPFDIWNDDEIK

SEQ ID NO: 2662299 - protein, 12 aa, Entamoeba histolytica
TPFDVWNDDEIK

SEQ ID NO: 2662300 - protein, 4 aa, Entamoeba histolytica
TPFE

SEQ ID NO: 2662301 - protein, 11 aa, Entamoeba histolytica
TPFKTGPIRKS

SEQ ID NO: 2662302 - protein, 5 aa, Entamoeba histolytica
TPFPS

SEQ ID NO: 2662303 - protein, 7 aa, Entamoeba histolytica
TPFPSDS

SEQ ID NO: 2662304 - protein, 13 aa, Entamoeba histolytica
TPFSDNSPLPIDG

SEQ ID NO: 2662305 - protein, 4 aa, Entamoeba histolytica
TPFT

SEQ ID NO: 2662306 - protein, 6 aa, Entamoeba histolytica
TPFTGT

SEQ ID NO: 2662307 - protein, 42 aa, Entamoeba histolytica
TPFTSPSLPLPDSKTTTPNQQSLTSSKISEDGLGVSLFYDPS

SEQ ID NO: 2662308 - protein, 8 aa, Entamoeba histolytica
TPGAEAPS

SEQ ID NO: 2662309 - protein, 9 aa, Entamoeba histolytica
TPGAYPSFE

SEQ ID NO: 2662310 - protein, 9 aa, Entamoeba histolytica
TPGDSPYYP

SEQ ID NO: 2662311 - protein, 4 aa, Entamoeba histolytica
TPGE

SEQ ID NO: 2662312 - protein, 6 aa, Entamoeba histolytica
TPGEIS

SEQ ID NO: 2662313 - protein, 10 aa, Entamoeba histolytica
TPGFGDTRGI

SEQ ID NO: 2662314 - protein, 11 aa, Entamoeba histolytica
TPGFGDTRGIA

SEQ ID NO: 2662315 - protein, 13 aa, Entamoeba histolytica
TPGFGDTRGPEWD

SEQ ID NO: 2662316 - protein, 18 aa, Entamoeba histolytica
TPGFGDTRGPEWDKETIK

SEQ ID NO: 2662317 - protein, 15 aa, Entamoeba histolytica
TPGFNDSDKLDKTQI

SEQ ID NO: 2662318 - protein, 5 aa, Entamoeba histolytica
TPGGH

SEQ ID NO: 2662319 - protein, 7 aa, Entamoeba histolytica
TPGHSPG

SEQ ID NO: 2662320 - protein, 8 aa, Entamoeba histolytica
TPGHSPGS

SEQ ID NO: 2662321 - protein, 4 aa, Entamoeba histolytica
TPGI

SEQ ID NO: 2662322 - protein, 20 aa, Entamoeba histolytica
TPGKESNFNTNIKEEEIDGS

SEQ ID NO: 2662323 - protein, 22 aa, Entamoeba histolytica
TPGKYDIETYDSQPIGDLAQGG

SEQ ID NO: 2662324 - protein, 13 aa, Entamoeba histolytica
TPGLNDTNKFDEE

SEQ ID NO: 2662325 - protein, 10 aa, Entamoeba histolytica
TPGLTSPYEL

SEQ ID NO: 2662326 - protein, 11 aa, Entamoeba histolytica
TPGNTKAGKAI

SEQ ID NO: 2662327 - protein, 7 aa, Entamoeba histolytica
TPGQNKP

SEQ ID NO: 2662328 - protein, 15 aa, Entamoeba histolytica
TPGRLASLNNSGALD

SEQ ID NO: 2662329 - protein, 6 aa, Entamoeba histolytica
TPGRTM

SEQ ID NO: 2662330 - protein, 11 aa, Entamoeba histolytica
TPGSVEERKKD

SEQ ID NO: 2662331 - protein, 17 aa, Entamoeba histolytica
TPGTEVKDLTQPGQKKK

SEQ ID NO: 2662332 - protein, 212 aa, Entamoeba histolytica
TPGVSTPKSGTAPTEGGSVTTQGDTTQTPSKSEKSEKPQATETSAQTPTTTHPASGNEATHSTETTSQPSSTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQPQNQPQDNGKQDHNKPEPQQQNHPQQNEKQDNKNTTTSDISHDKT

SEQ ID NO: 2662333 - protein, 219 aa, Entamoeba histolytica
TPGVSTPKSGTAPTEGGSVTTQGDTTQTPSKSEKSEKPQATETSAQTPTTTHPASGNEATHSTETTSQPSSTSPASPQQQNQPSSVSTSAANGYSTVKSNVHKPQKEDLKGQPQQPPSQPNSSAKPSEETSPTQTTNNPTQISPSTSTQQPKGNKDTQQKDEPPKEQPQNQPQDNGKQDHNKPEPQQQNHPQQNEKPDNKNTTTSDISHDKTIVSSGDS

SEQ ID NO: 2662334 - protein, 4 aa, Entamoeba histolytica
TPHH

SEQ ID NO: 2662335 - protein, 4 aa, Entamoeba histolytica
TPIA

SEQ ID NO: 2662336 - protein, 19 aa, Entamoeba histolytica
TPIAAPSANLSTKPSPTIG

SEQ ID NO: 2662337 - protein, 14 aa, Entamoeba histolytica
TPIEGYQKNGRYIN

SEQ ID NO: 2662338 - protein, 5 aa, Entamoeba histolytica
TPIEI

SEQ ID NO: 2662339 - protein, 6 aa, Entamoeba histolytica
TPIESL

SEQ ID NO: 2662340 - protein, 11 aa, Entamoeba histolytica
TPIGSHKEEIQ

SEQ ID NO: 2662341 - protein, 5 aa, Entamoeba histolytica
TPIIP

SEQ ID NO: 2662342 - protein, 32 aa, Entamoeba histolytica
TPIKGVNESPINNDYEKQKEETKPKKKHGKKW

SEQ ID NO: 2662343 - protein, 10 aa, Entamoeba histolytica
TPIKNPDYNR

SEQ ID NO: 2662344 - protein, 15 aa, Entamoeba histolytica
TPIKRRGKKTRKYTI

SEQ ID NO: 2662345 - protein, 7 aa, Entamoeba histolytica
TPIKTQD

SEQ ID NO: 2662346 - protein, 15 aa, Entamoeba histolytica
TPINRNSQQIHSNPY

SEQ ID NO: 2662347 - protein, 11 aa, Entamoeba histolytica
TPINTNGKKAC

SEQ ID NO: 2662348 - protein, 9 aa, Entamoeba histolytica
TPINTNGQS

SEQ ID NO: 2662349 - protein, 32 aa, Entamoeba histolytica
TPIPQPTVSPQGIQPIPRVPQGGAVPPQPGFH

SEQ ID NO: 2662350 - protein, 16 aa, Entamoeba histolytica
TPIPQQSQEGIGPMPS

SEQ ID NO: 2662351 - protein, 5 aa, Entamoeba histolytica
TPIPR

SEQ ID NO: 2662352 - protein, 5 aa, Entamoeba histolytica
TPIPV

SEQ ID NO: 2662353 - protein, 6 aa, Entamoeba histolytica
TPIQNE

SEQ ID NO: 2662354 - protein, 6 aa, Entamoeba histolytica
TPIQNN

SEQ ID NO: 2662355 - protein, 4 aa, Entamoeba histolytica
TPIR

SEQ ID NO: 2662356 - protein, 12 aa, Entamoeba histolytica
TPIRDKPSTDPI

SEQ ID NO: 2662357 - protein, 6 aa, Entamoeba histolytica
TPISNY

SEQ ID NO: 2662358 - protein, 10 aa, Entamoeba histolytica
TPISQPSSKL

SEQ ID NO: 2662359 - protein, 5 aa, Entamoeba histolytica
TPKCP

SEQ ID NO: 2662360 - protein, 10 aa, Entamoeba histolytica
TPKDVEANKP

SEQ ID NO: 2662361 - protein, 6 aa, Entamoeba histolytica
TPKECN

SEQ ID NO: 2662362 - protein, 5 aa, Entamoeba histolytica
TPKEE

SEQ ID NO: 2662363 - protein, 24 aa, Entamoeba histolytica
TPKEHETNYNTPPIESPGKTPPID

SEQ ID NO: 2662364 - protein, 8 aa, Entamoeba histolytica
TPKEHPDY

SEQ ID NO: 2662365 - protein, 5 aa, Entamoeba histolytica
TPKEK

SEQ ID NO: 2662366 - protein, 15 aa, Entamoeba histolytica
TPKEKKSNTSKTERR

SEQ ID NO: 2662367 - protein, 10 aa, Entamoeba histolytica
TPKEQKRLRK

SEQ ID NO: 2662368 - protein, 9 aa, Entamoeba histolytica
TPKETKLGE

SEQ ID NO: 2662369 - protein, 5 aa, Entamoeba histolytica
TPKGD

SEQ ID NO: 2662370 - protein, 8 aa, Entamoeba histolytica
TPKGTRDY

SEQ ID NO: 2662371 - protein, 34 aa, Entamoeba histolytica
TPKISKQKTRIMGSPNTSSSKVLTSSSCNTPKRK

SEQ ID NO: 2662372 - protein, 18 aa, Entamoeba histolytica
TPKITKLDEEKESFTQKI

SEQ ID NO: 2662373 - protein, 7 aa, Entamoeba histolytica
TPKKEKK

SEQ ID NO: 2662374 - protein, 12 aa, Entamoeba histolytica
TPKKRKGEMNSN

SEQ ID NO: 2662375 - protein, 9 aa, Entamoeba histolytica
TPKLTGDSL

SEQ ID NO: 2662376 - protein, 5 aa, Entamoeba histolytica
TPKNI

SEQ ID NO: 2662377 - protein, 9 aa, Entamoeba histolytica
TPKPSDYPD

SEQ ID NO: 2662378 - protein, 6 aa, Entamoeba histolytica
TPKPSY

SEQ ID NO: 2662379 - protein, 31 aa, Entamoeba histolytica
TPKPTGYGSKTPSSLTTQPKLQTKSNSMFSK

SEQ ID NO: 2662380 - protein, 9 aa, Entamoeba histolytica
TPKPTISTE

SEQ ID NO: 2662381 - protein, 4 aa, Entamoeba histolytica
TPKQ

SEQ ID NO: 2662382 - protein, 8 aa, Entamoeba histolytica
TPKQEEQL

SEQ ID NO: 2662383 - protein, 7 aa, Entamoeba histolytica
TPKTKWE

SEQ ID NO: 2662384 - protein, 8 aa, Entamoeba histolytica
TPKTTTQL

SEQ ID NO: 2662385 - protein, 4 aa, Entamoeba histolytica
TPKV

SEQ ID NO: 2662386 - protein, 10 aa, Entamoeba histolytica
TPKYPKEQVP

SEQ ID NO: 2662387 - protein, 7 aa, Entamoeba histolytica
TPKYPSI

SEQ ID NO: 2662388 - protein, 12 aa, Entamoeba histolytica
TPLDSNASISAD

SEQ ID NO: 2662389 - protein, 6 aa, Entamoeba histolytica
TPLEKT

SEQ ID NO: 2662390 - protein, 5 aa, Entamoeba histolytica
TPLET

SEQ ID NO: 2662391 - protein, 5 aa, Entamoeba histolytica
TPLGA

SEQ ID NO: 2662392 - protein, 7 aa, Entamoeba histolytica
TPLGGTG

SEQ ID NO: 2662393 - protein, 5 aa, Entamoeba histolytica
TPLGK

SEQ ID NO: 2662394 - protein, 4 aa, Entamoeba histolytica
TPLH

SEQ ID NO: 2662395 - protein, 5 aa, Entamoeba histolytica
TPLKA

SEQ ID NO: 2662396 - protein, 4 aa, Entamoeba histolytica
TPLN

SEQ ID NO: 2662397 - protein, 5 aa, Entamoeba histolytica
TPLNK

SEQ ID NO: 2662398 - protein, 6 aa, Entamoeba histolytica
TPLPSD

SEQ ID NO: 2662399 - protein, 28 aa, Entamoeba histolytica
TPLPSNYTLPPTTEPLRSFPPGTQLTTE

SEQ ID NO: 2662400 - protein, 8 aa, Entamoeba histolytica
TPLPSSDS

SEQ ID NO: 2662401 - protein, 5 aa, Entamoeba histolytica
TPLPT

SEQ ID NO: 2662402 - protein, 4 aa, Entamoeba histolytica
TPLQ

SEQ ID NO: 2662403 - protein, 5 aa, Entamoeba histolytica
TPLQN

SEQ ID NO: 2662404 - protein, 6 aa, Entamoeba histolytica
TPLQNT

SEQ ID NO: 2662405 - protein, 10 aa, Entamoeba histolytica
TPLQTETISK

SEQ ID NO: 2662406 - protein, 6 aa, Entamoeba histolytica
TPLSEK

SEQ ID NO: 2662407 - protein, 28 aa, Entamoeba histolytica
TPMGEEQITKEITNEESNSQKNKEEEVK

SEQ ID NO: 2662408 - protein, 6 aa, Entamoeba histolytica
TPMPTT

SEQ ID NO: 2662409 - protein, 5 aa, Entamoeba histolytica
TPNAE

SEQ ID NO: 2662410 - protein, 5 aa, Entamoeba histolytica
TPNAT

SEQ ID NO: 2662411 - protein, 5 aa, Entamoeba histolytica
TPNDE

SEQ ID NO: 2662412 - protein, 32 aa, Entamoeba histolytica
TPNDMGKNNPNEQSDEVEGEKEMRNGNEWKDG

SEQ ID NO: 2662413 - protein, 8 aa, Entamoeba histolytica
TPNDNLTK

SEQ ID NO: 2662414 - protein, 5 aa, Entamoeba histolytica
TPNDQ

SEQ ID NO: 2662415 - protein, 8 aa, Entamoeba histolytica
TPNESTSE

SEQ ID NO: 2662416 - protein, 10 aa, Entamoeba histolytica
TPNEVNKEND

SEQ ID NO: 2662417 - protein, 16 aa, Entamoeba histolytica
TPNGIQQANEVAQQIK

SEQ ID NO: 2662418 - protein, 6 aa, Entamoeba histolytica
TPNGTE

SEQ ID NO: 2662419 - protein, 8 aa, Entamoeba histolytica
TPNGTGIG

SEQ ID NO: 2662420 - protein, 6 aa, Entamoeba histolytica
TPNGVP

SEQ ID NO: 2662421 - protein, 4 aa, Entamoeba histolytica
TPNH

SEQ ID NO: 2662422 - protein, 4 aa, Entamoeba histolytica
TPNI

SEQ ID NO: 2662423 - protein, 13 aa, Entamoeba histolytica
TPNKLKVPSTEPI

SEQ ID NO: 2662424 - protein, 12 aa, Entamoeba histolytica
TPNNEKKTEEID

SEQ ID NO: 2662425 - protein, 15 aa, Entamoeba histolytica
TPNNLKGEEADEELE

SEQ ID NO: 2662426 - protein, 10 aa, Entamoeba histolytica
TPNNNDNKSI

SEQ ID NO: 2662427 - protein, 7 aa, Entamoeba histolytica
TPNNNNN

SEQ ID NO: 2662428 - protein, 6 aa, Entamoeba histolytica
TPNNTV

SEQ ID NO: 2662429 - protein, 6 aa, Entamoeba histolytica
TPNPLY

SEQ ID NO: 2662430 - protein, 5 aa, Entamoeba histolytica
TPNPV

SEQ ID NO: 2662431 - protein, 6 aa, Entamoeba histolytica
TPNQRN

SEQ ID NO: 2662432 - protein, 10 aa, Entamoeba histolytica
TPNSGPSSEW

SEQ ID NO: 2662433 - protein, 56 aa, Entamoeba histolytica
  misc_feature (21)..(54): Xaa can be any naturally occurring amino acid
TPNSGPSSEWVGVEKLQGYIXXXXXXXXXXXXXXXXXXXXXXXXXXXXXXXXXXYI

SEQ ID NO: 2662434 - protein, 7 aa, Entamoeba histolytica
TPNSRLT

SEQ ID NO: 2662435 - protein, 8 aa, Entamoeba histolytica
TPNTEAPA

SEQ ID NO: 2662436 - protein, 7 aa, Entamoeba histolytica
TPNTKEY

SEQ ID NO: 2662437 - protein, 11 aa, Entamoeba histolytica
TPNTSTKQQSV

SEQ ID NO: 2662438 - protein, 12 aa, Entamoeba histolytica
TPNTTSYEKGGK

SEQ ID NO: 2662439 - protein, 10 aa, Entamoeba histolytica
TPNYRPPEGD

SEQ ID NO: 2662440 - protein, 6 aa, Entamoeba histolytica
TPPERE

SEQ ID NO: 2662441 - protein, 9 aa, Entamoeba histolytica
TPPGTSDEH

SEQ ID NO: 2662442 - protein, 6 aa, Entamoeba histolytica
TPPIKP

SEQ ID NO: 2662443 - protein, 7 aa, Entamoeba histolytica
TPPISPE

SEQ ID NO: 2662444 - protein, 7 aa, Entamoeba histolytica
TPPLDAP

SEQ ID NO: 2662445 - protein, 12 aa, Entamoeba histolytica
TPPLPEEEEKPV

SEQ ID NO: 2662446 - protein, 9 aa, Entamoeba histolytica
TPPNNEVPG

SEQ ID NO: 2662447 - protein, 6 aa, Entamoeba histolytica
TPPNSL

SEQ ID NO: 2662448 - protein, 8 aa, Entamoeba histolytica
TPPNTQQQ

SEQ ID NO: 2662449 - protein, 4 aa, Entamoeba histolytica
TPPP

SEQ ID NO: 2662450 - protein, 15 aa, Entamoeba histolytica
TPPPPSKSQSGPQMD

SEQ ID NO: 2662451 - protein, 6 aa, Entamoeba histolytica
TPPSCN

SEQ ID NO: 2662452 - protein, 5 aa, Entamoeba histolytica
TPPTK

SEQ ID NO: 2662453 - protein, 6 aa, Entamoeba histolytica
TPQAVN

SEQ ID NO: 2662454 - protein, 5 aa, Entamoeba histolytica
TPQDA

SEQ ID NO: 2662455 - protein, 8 aa, Entamoeba histolytica
TPQEAEKA

SEQ ID NO: 2662456 - protein, 6 aa, Entamoeba histolytica
TPQGTK

SEQ ID NO: 2662457 - protein, 5 aa, Entamoeba histolytica
TPQKD

SEQ ID NO: 2662458 - protein, 11 aa, Entamoeba histolytica
TPQKINGEKEG

SEQ ID NO: 2662459 - protein, 6 aa, Entamoeba histolytica
TPQKNN

SEQ ID NO: 2662460 - protein, 7 aa, Entamoeba histolytica
TPQMNKK

SEQ ID NO: 2662461 - protein, 5 aa, Entamoeba histolytica
TPQNL

SEQ ID NO: 2662462 - protein, 12 aa, Entamoeba histolytica
TPQNSSSRLTTL

SEQ ID NO: 2662463 - protein, 9 aa, Entamoeba histolytica
TPQPPQPTD

SEQ ID NO: 2662464 - protein, 16 aa, Entamoeba histolytica
TPQQPIQNNSSLNQHN

SEQ ID NO: 2662465 - protein, 6 aa, Entamoeba histolytica
TPQSIT

SEQ ID NO: 2662466 - protein, 6 aa, Entamoeba histolytica
TPQTNT

SEQ ID NO: 2662467 - protein, 6 aa, Entamoeba histolytica
TPQTVK

SEQ ID NO: 2662468 - protein, 11 aa, Entamoeba histolytica
TPQVIDNTNST

SEQ ID NO: 2662469 - protein, 8 aa, Entamoeba histolytica
TPQVRPSA

SEQ ID NO: 2662470 - protein, 4 aa, Entamoeba histolytica
TPQY

SEQ ID NO: 2662471 - protein, 7 aa, Entamoeba histolytica
TPQYAGS

SEQ ID NO: 2662472 - protein, 4 aa, Entamoeba histolytica
TPRC

SEQ ID NO: 2662473 - protein, 7 aa, Entamoeba histolytica
TPRDRKM

SEQ ID NO: 2662474 - protein, 10 aa, Entamoeba histolytica
TPRGAKVRNG

SEQ ID NO: 2662475 - protein, 18 aa, Entamoeba histolytica
TPRGSIRKSEKKKDKREL

SEQ ID NO: 2662476 - protein, 9 aa, Entamoeba histolytica
TPRINQQTK

SEQ ID NO: 2662477 - protein, 7 aa, Entamoeba histolytica
TPRIRPT

SEQ ID NO: 2662478 - protein, 4 aa, Entamoeba histolytica
TPRK

SEQ ID NO: 2662479 - protein, 11 aa, Entamoeba histolytica
TPRKNKSKFKD

SEQ ID NO: 2662480 - protein, 5 aa, Entamoeba histolytica
TPRNC

SEQ ID NO: 2662481 - protein, 10 aa, Entamoeba histolytica
TPRQKKETIQ

SEQ ID NO: 2662482 - protein, 12 aa, Entamoeba histolytica
TPRQRGGPQTPL

SEQ ID NO: 2662483 - protein, 7 aa, Entamoeba histolytica
TPRRKAT

SEQ ID NO: 2662484 - protein, 18 aa, Entamoeba histolytica
TPRSLKSPRKKFSSPELQ

SEQ ID NO: 2662485 - protein, 21 aa, Entamoeba histolytica
TPRSLKSPRSPRKKFSSPELQ

SEQ ID NO: 2662486 - protein, 7 aa, Entamoeba histolytica
TPRTNRK

SEQ ID NO: 2662487 - protein, 7 aa, Entamoeba histolytica
TPRTSSL

SEQ ID NO: 2662488 - protein, 4 aa, Entamoeba histolytica
TPSA

SEQ ID NO: 2662489 - protein, 8 aa, Entamoeba histolytica
TPSAERQQ

SEQ ID NO: 2662490 - protein, 7 aa, Entamoeba histolytica
TPSASSI

SEQ ID NO: 2662491 - protein, 14 aa, Entamoeba histolytica
TPSAVADELIKLFG

SEQ ID NO: 2662492 - protein, 7 aa, Entamoeba histolytica
TPSETFT

SEQ ID NO: 2662493 - protein, 4 aa, Entamoeba histolytica
TPSF

SEQ ID NO: 2662494 - protein, 14 aa, Entamoeba histolytica
TPSFGKEDSKKFLQ

SEQ ID NO: 2662495 - protein, 9 aa, Entamoeba histolytica
TPSGTQYGH

SEQ ID NO: 2662496 - protein, 49 aa, Entamoeba histolytica
TPSHSPRASPRFSPRISPRTSLNSPHGSSSNSSNSPNSTSVNDKSQQFV

SEQ ID NO: 2662497 - protein, 6 aa, Entamoeba histolytica
TPSIAQ

SEQ ID NO: 2662498 - protein, 7 aa, Entamoeba histolytica
TPSIEPN

SEQ ID NO: 2662499 - protein, 9 aa, Entamoeba histolytica
TPSKTESIT

SEQ ID NO: 2662500 - protein, 5 aa, Entamoeba histolytica
TPSLQ

SEQ ID NO: 2662501 - protein, 6 aa, Entamoeba histolytica
TPSMKS

SEQ ID NO: 2662502 - protein, 8 aa, Entamoeba histolytica
TPSNEDSG

SEQ ID NO: 2662503 - protein, 8 aa, Entamoeba histolytica
TPSNSPVI

SEQ ID NO: 2662504 - protein, 6 aa, Entamoeba histolytica
TPSNTK

SEQ ID NO: 2662505 - protein, 4 aa, Entamoeba histolytica
TPSP

SEQ ID NO: 2662506 - protein, 8 aa, Entamoeba histolytica
TPSPLDQA

SEQ ID NO: 2662507 - protein, 8 aa, Entamoeba histolytica
TPSQEKII

SEQ ID NO: 2662508 - protein, 8 aa, Entamoeba histolytica
TPSQKEQV

SEQ ID NO: 2662509 - protein, 6 aa, Entamoeba histolytica
TPSQLA

SEQ ID NO: 2662510 - protein, 5 aa, Entamoeba histolytica
TPSRV

SEQ ID NO: 2662511 - protein, 9 aa, Entamoeba histolytica
TPSSLEKEY

SEQ ID NO: 2662512 - protein, 11 aa, Entamoeba histolytica
TPSSLSKKYDK

SEQ ID NO: 2662513 - protein, 5 aa, Entamoeba histolytica
TPSTI

SEQ ID NO: 2662514 - protein, 6 aa, Entamoeba histolytica
TPSTLQ

SEQ ID NO: 2662515 - protein, 4 aa, Entamoeba histolytica
TPSV

SEQ ID NO: 2662516 - protein, 6 aa, Entamoeba histolytica
TPSVNG

SEQ ID NO: 2662517 - protein, 6 aa, Entamoeba histolytica
TPSYYY

SEQ ID NO: 2662518 - protein, 4 aa, Entamoeba histolytica
TPTA

SEQ ID NO: 2662519 - protein, 7 aa, Entamoeba histolytica
TPTANTG

SEQ ID NO: 2662520 - protein, 5 aa, Entamoeba histolytica
TPTDK

SEQ ID NO: 2662521 - protein, 5 aa, Entamoeba histolytica
TPTDL

SEQ ID NO: 2662522 - protein, 5 aa, Entamoeba histolytica
TPTDR

SEQ ID NO: 2662523 - protein, 6 aa, Entamoeba histolytica
TPTDSL

SEQ ID NO: 2662524 - protein, 16 aa, Entamoeba histolytica
TPTDSQLQKLTPPHKD

SEQ ID NO: 2662525 - protein, 4 aa, Entamoeba histolytica
TPTE

SEQ ID NO: 2662526 - protein, 8 aa, Entamoeba histolytica
TPTEEEMK

SEQ ID NO: 2662527 - protein, 9 aa, Entamoeba histolytica
TPTEESWPG

SEQ ID NO: 2662528 - protein, 10 aa, Entamoeba histolytica
TPTEKVKQAL

SEQ ID NO: 2662529 - protein, 11 aa, Entamoeba histolytica
TPTHPLPSSNQ

SEQ ID NO: 2662530 - protein, 4 aa, Entamoeba histolytica
TPTI

SEQ ID NO: 2662531 - protein, 5 aa, Entamoeba histolytica
TPTNV

SEQ ID NO: 2662532 - protein, 5 aa, Entamoeba histolytica
TPTPE

SEQ ID NO: 2662533 - protein, 6 aa, Entamoeba histolytica
TPTPRI

SEQ ID NO: 2662534 - protein, 9 aa, Entamoeba histolytica
TPTPSPTPD

SEQ ID NO: 2662535 - protein, 4 aa, Entamoeba histolytica
TPTQ

SEQ ID NO: 2662536 - protein, 47 aa, Entamoeba histolytica
TPTQTPLTNADYPRFSRKRKGAKTGEEEDDTDEEDEKIKVEQPNQVP

SEQ ID NO: 2662537 - protein, 9 aa, Entamoeba histolytica
TPTRPETGY

SEQ ID NO: 2662538 - protein, 10 aa, Entamoeba histolytica
TPTRSDAEKL

SEQ ID NO: 2662539 - protein, 18 aa, Entamoeba histolytica
TPTSARHISQSSSPTTEM

SEQ ID NO: 2662540 - protein, 6 aa, Entamoeba histolytica
TPTSMA

SEQ ID NO: 2662541 - protein, 7 aa, Entamoeba histolytica
TPTSNQI

SEQ ID NO: 2662542 - protein, 8 aa, Entamoeba histolytica
TPTSTESN

SEQ ID NO: 2662543 - protein, 5 aa, Entamoeba histolytica
TPTSV

SEQ ID NO: 2662544 - protein, 26 aa, Entamoeba histolytica
TPTTEKKVKKVKKVKKTKKALKELPD

SEQ ID NO: 2662545 - protein, 8 aa, Entamoeba histolytica
TPTTHQSV

SEQ ID NO: 2662546 - protein, 6 aa, Entamoeba histolytica
TPTTPV

SEQ ID NO: 2662547 - protein, 30 aa, Entamoeba histolytica
TPTTSSQPQSKPVTTPTKSTEPQPKPVSGA

SEQ ID NO: 2662548 - protein, 27 aa, Entamoeba histolytica
TPTVSPLPQHVNDKSESVSEGSNNSSS

SEQ ID NO: 2662549 - protein, 8 aa, Entamoeba histolytica
TPTVSPTI

SEQ ID NO: 2662550 - protein, 5 aa, Entamoeba histolytica
TPTVT

SEQ ID NO: 2662551 - protein, 12 aa, Entamoeba histolytica
TPTYKISHETNE

SEQ ID NO: 2662552 - protein, 5 aa, Entamoeba histolytica
TPVDE

SEQ ID NO: 2662553 - protein, 10 aa, Entamoeba histolytica
TPVEPSEQVH

SEQ ID NO: 2662554 - protein, 5 aa, Entamoeba histolytica
TPVES

SEQ ID NO: 2662555 - protein, 6 aa, Entamoeba histolytica
TPVGVP

SEQ ID NO: 2662556 - protein, 6 aa, Entamoeba histolytica
TPVKTN

SEQ ID NO: 2662557 - protein, 7 aa, Entamoeba histolytica
TPVQNGL

SEQ ID NO: 2662558 - protein, 10 aa, Entamoeba histolytica
TPVQPSSKVD

SEQ ID NO: 2662559 - protein, 6 aa, Entamoeba histolytica
TPVTDT

SEQ ID NO: 2662560 - protein, 20 aa, Entamoeba histolytica
TPVTPPEGEKINPDNKEMKS

SEQ ID NO: 2662561 - protein, 25 aa, Entamoeba histolytica
TPVTSGTGVYQPRNPIVEKRSNDIY

SEQ ID NO: 2662562 - protein, 4 aa, Entamoeba histolytica
TPYK

SEQ ID NO: 2662563 - protein, 9 aa, Entamoeba histolytica
TPYKTVETI

SEQ ID NO: 2662564 - protein, 12 aa, Entamoeba histolytica
TPYKTVETIKNE

SEQ ID NO: 2662565 - protein, 5 aa, Entamoeba histolytica
TPYNP

SEQ ID NO: 2662566 - protein, 6 aa, Entamoeba histolytica
TPYNRE

SEQ ID NO: 2662567 - protein, 6 aa, Entamoeba histolytica
TPYRQE

SEQ ID NO: 2662568 - protein, 5 aa, Entamoeba histolytica
TPYYR

SEQ ID NO: 2662569 - protein, 18 aa, Entamoeba histolytica
TQADYTLDPEKAKPSRDR

SEQ ID NO: 2662570 - protein, 18 aa, Entamoeba histolytica
TQADYTLDPEKAKPSRDV

SEQ ID NO: 2662571 - protein, 5 aa, Entamoeba histolytica
TQAGT

SEQ ID NO: 2662572 - protein, 6 aa, Entamoeba histolytica
TQAKEG

SEQ ID NO: 2662573 - protein, 6 aa, Entamoeba histolytica
TQAQRT

SEQ ID NO: 2662574 - protein, 21 aa, Entamoeba histolytica
TQARADGNEKEIEDITQEQNG

SEQ ID NO: 2662575 - protein, 4 aa, Entamoeba histolytica
TQAT

SEQ ID NO: 2662576 - protein, 5 aa, Entamoeba histolytica
TQATV

SEQ ID NO: 2662577 - protein, 9 aa, Entamoeba histolytica
TQCKTPGKS

SEQ ID NO: 2662578 - protein, 4 aa, Entamoeba histolytica
TQCT

SEQ ID NO: 2662579 - protein, 6 aa, Entamoeba histolytica
TQDECV

SEQ ID NO: 2662580 - protein, 5 aa, Entamoeba histolytica
TQDHA

SEQ ID NO: 2662581 - protein, 8 aa, Entamoeba histolytica
TQDKEKKI

SEQ ID NO: 2662582 - protein, 7 aa, Entamoeba histolytica
TQDKNGD

SEQ ID NO: 2662583 - protein, 5 aa, Entamoeba histolytica
TQDST

SEQ ID NO: 2662584 - protein, 10 aa, Entamoeba histolytica
TQDTEEEYPY

SEQ ID NO: 2662585 - protein, 6 aa, Entamoeba histolytica
TQDYES

SEQ ID NO: 2662586 - protein, 9 aa, Entamoeba histolytica
TQECTQNCT

SEQ ID NO: 2662587 - protein, 11 aa, Entamoeba histolytica
TQEDAESNRNS

SEQ ID NO: 2662588 - protein, 4 aa, Entamoeba histolytica
TQEE

SEQ ID NO: 2662589 - protein, 11 aa, Entamoeba histolytica
TQEEIDKQKAA

SEQ ID NO: 2662590 - protein, 17 aa, Entamoeba histolytica
TQEELEQKRPKKPKINI

SEQ ID NO: 2662591 - protein, 4 aa, Entamoeba histolytica
TQEG

SEQ ID NO: 2662592 - protein, 8 aa, Entamoeba histolytica
TQEGKSGL

SEQ ID NO: 2662593 - protein, 37 aa, Entamoeba histolytica
TQEGLNKKDISKKFSSSIKTRFTKEKNGFSRIRQLCK

SEQ ID NO: 2662594 - protein, 22 aa, Entamoeba histolytica
TQEGMKKSFGSTCHGAGRKISR

SEQ ID NO: 2662595 - protein, 32 aa, Entamoeba histolytica
TQEGMKKSFGSTCHGAGRKMSRTKAMDNLTSK

SEQ ID NO: 2662596 - protein, 8 aa, Entamoeba histolytica
TQEGSQEV

SEQ ID NO: 2662597 - protein, 17 aa, Entamoeba histolytica
TQEIQQRKRVEKNLNNR

SEQ ID NO: 2662598 - protein, 4 aa, Entamoeba histolytica
TQEM

SEQ ID NO: 2662599 - protein, 5 aa, Entamoeba histolytica
TQENI

SEQ ID NO: 2662600 - protein, 29 aa, Entamoeba histolytica
TQENQTENTLNNITSQEMQQNSISNESNE

SEQ ID NO: 2662601 - protein, 8 aa, Entamoeba histolytica
TQEQKEMV

SEQ ID NO: 2662602 - protein, 7 aa, Entamoeba histolytica
TQEQNSK

SEQ ID NO: 2662603 - protein, 7 aa, Entamoeba histolytica
TQEQTEH

SEQ ID NO: 2662604 - protein, 8 aa, Entamoeba histolytica
TQEQTEQV

SEQ ID NO: 2662605 - protein, 16 aa, Entamoeba histolytica
TQEREEALAKTEDGQC

SEQ ID NO: 2662606 - protein, 16 aa, Entamoeba histolytica
TQEREETLSKTEDGQC

SEQ ID NO: 2662607 - protein, 7 aa, Entamoeba histolytica
TQERELL

SEQ ID NO: 2662608 - protein, 5 aa, Entamoeba histolytica
TQESL

SEQ ID NO: 2662609 - protein, 15 aa, Entamoeba histolytica
TQESSDVKEYNSQDK

SEQ ID NO: 2662610 - protein, 9 aa, Entamoeba histolytica
TQESTEQIK

SEQ ID NO: 2662611 - protein, 12 aa, Entamoeba histolytica
TQESTIHTPPPL

SEQ ID NO: 2662612 - protein, 7 aa, Entamoeba histolytica
TQEVPEK

SEQ ID NO: 2662613 - protein, 13 aa, Entamoeba histolytica
TQFGETEKKRYDI

SEQ ID NO: 2662614 - protein, 9 aa, Entamoeba histolytica
TQFNTNQNL

SEQ ID NO: 2662615 - protein, 5 aa, Entamoeba histolytica
TQFQQ

SEQ ID NO: 2662616 - protein, 5 aa, Entamoeba histolytica
TQFSD

SEQ ID NO: 2662617 - protein, 5 aa, Entamoeba histolytica
TQGAK

SEQ ID NO: 2662618 - protein, 5 aa, Entamoeba histolytica
TQGAR

SEQ ID NO: 2662619 - protein, 6 aa, Entamoeba histolytica
TQGEFD

SEQ ID NO: 2662620 - protein, 7 aa, Entamoeba histolytica
TQGKPFR

SEQ ID NO: 2662621 - protein, 4 aa, Entamoeba histolytica
TQGM

SEQ ID NO: 2662622 - protein, 5 aa, Entamoeba histolytica
TQGMT

SEQ ID NO: 2662623 - protein, 40 aa, Entamoeba histolytica
TQGPHKSKVKRVQKEKPWTVEDAKGRIDNGPKLGRKPWDN

SEQ ID NO: 2662624 - protein, 6 aa, Entamoeba histolytica
TQGRRS

SEQ ID NO: 2662625 - protein, 6 aa, Entamoeba histolytica
TQGSSI

SEQ ID NO: 2662626 - protein, 10 aa, Entamoeba histolytica
TQHETLTNEL

SEQ ID NO: 2662627 - protein, 11 aa, Entamoeba histolytica
TQIADSDKELT

SEQ ID NO: 2662628 - protein, 8 aa, Entamoeba histolytica
TQIKPSKY

SEQ ID NO: 2662629 - protein, 9 aa, Entamoeba histolytica
TQINEEPEE

SEQ ID NO: 2662630 - protein, 25 aa, Entamoeba histolytica
TQINENKNIEEKKPRQQKKKKVEIK

SEQ ID NO: 2662631 - protein, 4 aa, Entamoeba histolytica
TQIP

SEQ ID NO: 2662632 - protein, 6 aa, Entamoeba histolytica
TQIPKM

SEQ ID NO: 2662633 - protein, 7 aa, Entamoeba histolytica
TQIPKYQ

SEQ ID NO: 2662634 - protein, 11 aa, Entamoeba histolytica
TQIPLRKRGEK

SEQ ID NO: 2662635 - protein, 8 aa, Entamoeba histolytica
TQIPTTTN

SEQ ID NO: 2662636 - protein, 10 aa, Entamoeba histolytica
TQIRDDTDSV

SEQ ID NO: 2662637 - protein, 8 aa, Entamoeba histolytica
TQIRDEDT

SEQ ID NO: 2662638 - protein, 4 aa, Entamoeba histolytica
TQIS

SEQ ID NO: 2662639 - protein, 6 aa, Entamoeba histolytica
TQISAE

SEQ ID NO: 2662640 - protein, 10 aa, Entamoeba histolytica
TQISQTNITN

SEQ ID NO: 2662641 - protein, 8 aa, Entamoeba histolytica
TQKCPNSD

SEQ ID NO: 2662642 - protein, 10 aa, Entamoeba histolytica
TQKDPSLTPQ

SEQ ID NO: 2662643 - protein, 4 aa, Entamoeba histolytica
TQKE

SEQ ID NO: 2662644 - protein, 23 aa, Entamoeba histolytica
TQKEAEGNTENLQEVTEQEPQEI

SEQ ID NO: 2662645 - protein, 9 aa, Entamoeba histolytica
TQKEIKEYK

SEQ ID NO: 2662646 - protein, 6 aa, Entamoeba histolytica
TQKEKE

SEQ ID NO: 2662647 - protein, 33 aa, Entamoeba histolytica; identical to SEQ ID NO: 2467506

SEQ ID NO: 2662648 - protein, 12 aa, Entamoeba histolytica
TQKENPLSNNGN

SEQ ID NO: 2662649 - protein, 14 aa, Entamoeba histolytica
TQKEPEENKIPPWE

SEQ ID NO: 2662650 - protein, 5 aa, Entamoeba histolytica
TQKEY

SEQ ID NO: 2662651 - protein, 18 aa, Entamoeba histolytica
TQKFHSKKRSLPEMTNES

SEQ ID NO: 2662652 - protein, 8 aa, Entamoeba histolytica
TQKGGVRP

SEQ ID NO: 2662653 - protein, 7 aa, Entamoeba histolytica
TQKGSDL

SEQ ID NO: 2662654 - protein, 4 aa, Entamoeba histolytica
TQKH

SEQ ID NO: 2662655 - protein, 6 aa, Entamoeba histolytica
TQKHLK

SEQ ID NO: 2662656 - protein, 4 aa, Entamoeba histolytica
TQKI

SEQ ID NO: 2662657 - protein, 6 aa, Entamoeba histolytica
TQKIKE

SEQ ID NO: 2662658 - protein, 10 aa, Entamoeba histolytica
TQKKKEVTEV

SEQ ID NO: 2662659 - protein, 7 aa, Entamoeba histolytica
TQKKPGM

SEQ ID NO: 2662660 - protein, 15 aa, Entamoeba histolytica
TQKKTQSVNVQNKRT

SEQ ID NO: 2662661 - protein, 9 aa, Entamoeba histolytica
TQKNENDMV

SEQ ID NO: 2662662 - protein, 12 aa, Entamoeba histolytica
TQKQVHEEEMEK

SEQ ID NO: 2662663 - protein, 9 aa, Entamoeba histolytica
TQKRNEKIT

SEQ ID NO: 2662664 - protein, 7 aa, Entamoeba histolytica
TQKSKVL

SEQ ID NO: 2662665 - protein, 14 aa, Entamoeba histolytica
TQKTDKTDKTDEIV

SEQ ID NO: 2662666 - protein, 7 aa, Entamoeba histolytica
TQKTEDI

SEQ ID NO: 2662667 - protein, 7 aa, Entamoeba histolytica
TQKTLSI

SEQ ID NO: 2662668 - protein, 8 aa, Entamoeba histolytica
TQKYDEKK

SEQ ID NO: 2662669 - protein, 4 aa, Entamoeba histolytica
TQLC

SEQ ID NO: 2662670 - protein, 4 aa, Entamoeba histolytica
TQLD

SEQ ID NO: 2662671 - protein, 6 aa, Entamoeba histolytica
TQLENT

SEQ ID NO: 2662672 - protein, 5 aa, Entamoeba histolytica
TQLNP

SEQ ID NO: 2662673 - protein, 4 aa, Entamoeba histolytica
TQLR

SEQ ID NO: 2662674 - protein, 5 aa, Entamoeba histolytica
TQMLS

SEQ ID NO: 2662675 - protein, 10 aa, Entamoeba histolytica
TQMSGVDAEK

SEQ ID NO: 2662676 - protein, 6 aa, Entamoeba histolytica
TQMTKN

SEQ ID NO: 2662677 - protein, 6 aa, Entamoeba histolytica
TQNDPR

SEQ ID NO: 2662678 - protein, 6 aa, Entamoeba histolytica
TQNDRI

SEQ ID NO: 2662679 - protein, 6 aa, Entamoeba histolytica
TQNDTE

SEQ ID NO: 2662680 - protein, 14 aa, Entamoeba histolytica
TQNEEVKNQIEQEL

SEQ ID NO: 2662681 - protein, 7 aa, Entamoeba histolytica
TQNERQQ

SEQ ID NO: 2662682 - protein, 34 aa, Entamoeba histolytica
TQNESSVNTTNSQPSQSNNETNNVTRTQETEEQP

SEQ ID NO: 2662683 - protein, 5 aa, Entamoeba histolytica
TQNGI

SEQ ID NO: 2662684 - protein, 6 aa, Entamoeba histolytica
TQNGPI

SEQ ID NO: 2662685 - protein, 7 aa, Entamoeba histolytica
TQNHKGS

SEQ ID NO: 2662686 - protein, 12 aa, Entamoeba histolytica
TQNIQDQSNDDL

SEQ ID NO: 2662687 - protein, 6 aa, Entamoeba histolytica
TQNKKF

SEQ ID NO: 2662688 - protein, 7 aa, Entamoeba histolytica
TQNKREP

SEQ ID NO: 2662689 - protein, 5 aa, Entamoeba histolytica
TQNKV

SEQ ID NO: 2662690 - protein, 12 aa, Entamoeba histolytica
TQNKYQSQNLTN

SEQ ID NO: 2662691 - protein, 25 aa, Entamoeba histolytica
TQNLGNNKEETSQEDKEELKHSRRG

SEQ ID NO: 2662692 - protein, 14 aa, Entamoeba histolytica
TQNNNEVLKILHSL

SEQ ID NO: 2662693 - protein, 9 aa, Entamoeba histolytica
TQNNPPEAY

SEQ ID NO: 2662694 - protein, 7 aa, Entamoeba histolytica
TQNPQSY

SEQ ID NO: 2662695 - protein, 4 aa, Entamoeba histolytica
TQNS

SEQ ID NO: 2662696 - protein, 17 aa, Entamoeba histolytica
TQNSIPTKEIPEINNDT

SEQ ID NO: 2662697 - protein, 6 aa, Entamoeba histolytica
TQNSRV

SEQ ID NO: 2662698 - protein, 6 aa, Entamoeba histolytica
TQNSSF

SEQ ID NO: 2662699 - protein, 7 aa, Entamoeba histolytica
TQNTANG

SEQ ID NO: 2662700 - protein, 5 aa, Entamoeba histolytica
TQNTI

SEQ ID NO: 2662701 - protein, 9 aa, Entamoeba histolytica
TQNVNQENI

SEQ ID NO: 2662702 - protein, 11 aa, Entamoeba histolytica
TQPCLNSKNDL

SEQ ID NO: 2662703 - protein, 5 aa, Entamoeba histolytica
TQPDE

SEQ ID NO: 2662704 - protein, 9 aa, Entamoeba histolytica
TQPDHSTKK

SEQ ID NO: 2662705 - protein, 5 aa, Entamoeba histolytica
TQPEI

SEQ ID NO: 2662706 - protein, 7 aa, Entamoeba histolytica
TQPEPKI

SEQ ID NO: 2662707 - protein, 9 aa, Entamoeba histolytica
TQPEVENKL

SEQ ID NO: 2662708 - protein, 4 aa, Entamoeba histolytica
TQPF

SEQ ID NO: 2662709 - protein, 4 aa, Entamoeba histolytica
TQPH

SEQ ID NO: 2662710 - protein, 11 aa, Entamoeba histolytica
TQPIKEEKNEL

SEQ ID NO: 2662711 - protein, 14 aa, Entamoeba histolytica
TQPIKGAQTKGVSG

SEQ ID NO: 2662712 - protein, 6 aa, Entamoeba histolytica
TQPIPT

SEQ ID NO: 2662713 - protein, 5 aa, Entamoeba histolytica
TQPKR

SEQ ID NO: 2662714 - protein, 12 aa, Entamoeba histolytica
TQPKTTTTSSDD

SEQ ID NO: 2662715 - protein, 20 aa, Entamoeba histolytica
TQPLNNEDSTIEEEKEVHST

SEQ ID NO: 2662716 - protein, 4 aa, Entamoeba histolytica
TQPN

SEQ ID NO: 2662717 - protein, 5 aa, Entamoeba histolytica
TQPNS

SEQ ID NO: 2662718 - protein, 36 aa, Entamoeba histolytica
TQPNTPKGTSTFYSSYSEDKYDSPRITESSLNPKTF

SEQ ID NO: 2662719 - protein, 5 aa, Entamoeba histolytica
TQPPG

SEQ ID NO: 2662720 - protein, 7 aa, Entamoeba histolytica
TQPPTPY

SEQ ID NO: 2662721 - protein, 8 aa, Entamoeba histolytica
TQPPYKEH

SEQ ID NO: 2662722 - protein, 4 aa, Entamoeba histolytica
TQPQ

SEQ ID NO: 2662723 - protein, 5 aa, Entamoeba histolytica
TQPQA

SEQ ID NO: 2662724 - protein, 15 aa, Entamoeba histolytica
TQPQMEEENSGVIKD

SEQ ID NO: 2662725 - protein, 9 aa, Entamoeba histolytica
TQPQPPQVL

SEQ ID NO: 2662726 - protein, 4 aa, Entamoeba histolytica
TQPR

SEQ ID NO: 2662727 - protein, 5 aa, Entamoeba histolytica
TQPRL

SEQ ID NO: 2662728 - protein, 18 aa, Entamoeba histolytica
TQPRPNRKETLDEMQTHR

SEQ ID NO: 2662729 - protein, 6 aa, Entamoeba histolytica
TQPRRI

SEQ ID NO: 2662730 - protein, 4 aa, Entamoeba histolytica
TQPS

SEQ ID NO: 2662731 - protein, 6 aa, Entamoeba histolytica
TQPSDA

SEQ ID NO: 2662732 - protein, 11 aa, Entamoeba histolytica
TQPSEKEDYSD

SEQ ID NO: 2662733 - protein, 19 aa, Entamoeba histolytica
TQPSFQKKLPNKNKSYSLP

SEQ ID NO: 2662734 - protein, 5 aa, Entamoeba histolytica
TQPSK

SEQ ID NO: 2662735 - protein, 6 aa, Entamoeba histolytica
TQPTPV

SEQ ID NO: 2662736 - protein, 6 aa, Entamoeba histolytica
TQPVEN

SEQ ID NO: 2662737 - protein, 12 aa, Entamoeba histolytica
TQQDKEEARKLD

SEQ ID NO: 2662738 - protein, 4 aa, Entamoeba histolytica
TQQE

SEQ ID NO: 2662739 - protein, 9 aa, Entamoeba histolytica
TQQEYNEYE

SEQ ID NO: 2662740 - protein, 5 aa, Entamoeba histolytica
TQQFT

SEQ ID NO: 2662741 - protein, 7 aa, Entamoeba histolytica
TQQGPNS

SEQ ID NO: 2662742 - protein, 7 aa, Entamoeba histolytica
TQQGTQS

SEQ ID NO: 2662743 - protein, 9 aa, Entamoeba histolytica
TQQHETLHQ

SEQ ID NO: 2662744 - protein, 6 aa, Entamoeba histolytica
TQQINS

SEQ ID NO: 2662745 - protein, 15 aa, Entamoeba histolytica
TQQKKNKDIPEGGSK

SEQ ID NO: 2662746 - protein, 10 aa, Entamoeba histolytica
TQQNAGESLK

SEQ ID NO: 2662747 - protein, 10 aa, Entamoeba histolytica
TQQNAPEDYE

SEQ ID NO: 2662748 - protein, 18 aa, Entamoeba histolytica
TQQNSTQPKSVSKGSSQV

SEQ ID NO: 2662749 - protein, 11 aa, Entamoeba histolytica
TQQNTQLCTPD

SEQ ID NO: 2662750 - protein, 20 aa, Entamoeba histolytica
TQQNWKSNDSSIDENFCSSF

SEQ ID NO: 2662751 - protein, 4 aa, Entamoeba histolytica
TQQP

SEQ ID NO: 2662752 - protein, 6 aa, Entamoeba histolytica
TQQPIQ

SEQ ID NO: 2662753 - protein, 6 aa, Entamoeba histolytica
TQQQKD

SEQ ID NO: 2662754 - protein, 10 aa, Entamoeba histolytica
TQQQPKSNNE

SEQ ID NO: 2662755 - protein, 5 aa, Entamoeba histolytica
TQQRK

SEQ ID NO: 2662756 - protein, 7 aa, Entamoeba histolytica
TQQSENL

SEQ ID NO: 2662757 - protein, 5 aa, Entamoeba histolytica
TQQSI

SEQ ID NO: 2662758 - protein, 8 aa, Entamoeba histolytica
TQQSSQLI

SEQ ID NO: 2662759 - protein, 11 aa, Entamoeba histolytica
TQQTNVNPLSS

SEQ ID NO: 2662760 - protein, 9 aa, Entamoeba histolytica
TQQYPGYNQ

SEQ ID NO: 2662761 - protein, 4 aa, Entamoeba histolytica
TQRF

SEQ ID NO: 2662762 - protein, 14 aa, Entamoeba histolytica
TQRKEDITNGGYNM

SEQ ID NO: 2662763 - protein, 15 aa, Entamoeba histolytica
TQRKIQDGLKEKKSG

SEQ ID NO: 2662764 - protein, 13 aa, Entamoeba histolytica
TQRQSQDTSREGV

SEQ ID NO: 2662765 - protein, 4 aa, Entamoeba histolytica
TQRR

SEQ ID NO: 2662766 - protein, 5 aa, Entamoeba histolytica
TQRSP

SEQ ID NO: 2662767 - protein, 9 aa, Entamoeba histolytica
TQRSTVDTT

SEQ ID NO: 2662768 - protein, 6 aa, Entamoeba histolytica
TQRTEM

SEQ ID NO: 2662769 - protein, 7 aa, Entamoeba histolytica
TQRVNNR

SEQ ID NO: 2662770 - protein, 7 aa, Entamoeba histolytica
TQRYSNL

SEQ ID NO: 2662771 - protein, 16 aa, Entamoeba histolytica
TQSEKTEYVERNNTLK

SEQ ID NO: 2662772 - protein, 8 aa, Entamoeba histolytica
TQSEKVDD

SEQ ID NO: 2662773 - protein, 9 aa, Entamoeba histolytica
TQSEKYGTT

SEQ ID NO: 2662774 - protein, 7 aa, Entamoeba histolytica
TQSFNKD

SEQ ID NO: 2662775 - protein, 4 aa, Entamoeba histolytica
TQSG

SEQ ID NO: 2662776 - protein, 15 aa, Entamoeba histolytica
TQSHSSFQEKLPENL

SEQ ID NO: 2662777 - protein, 8 aa, Entamoeba histolytica
TQSKLKAE

SEQ ID NO: 2662778 - protein, 5 aa, Entamoeba histolytica
TQSKM

SEQ ID NO: 2662779 - protein, 11 aa, Entamoeba histolytica
TQSLNGNQLSQ

SEQ ID NO: 2662780 - protein, 6 aa, Entamoeba histolytica
TQSNEV

SEQ ID NO: 2662781 - protein, 11 aa, Entamoeba histolytica
TQSNNSDGKKH

SEQ ID NO: 2662782 - protein, 5 aa, Entamoeba histolytica
TQSQC

SEQ ID NO: 2662783 - protein, 7 aa, Entamoeba histolytica
TQSQREI

SEQ ID NO: 2662784 - protein, 33 aa, Entamoeba histolytica
TQSRDSSRRLSPQYSPSHLPQQRGRDSTPFCSR

SEQ ID NO: 2662785 - protein, 7 aa, Entamoeba histolytica
TQSRTTT

SEQ ID NO: 2662786 - protein, 8 aa, Entamoeba histolytica
TQSSQLTQ

SEQ ID NO: 2662787 - protein, 6 aa, Entamoeba histolytica
TQSSTG

SEQ ID NO: 2662788 - protein, 4 aa, Entamoeba histolytica
TQST

SEQ ID NO: 2662789 - protein, 7 aa, Entamoeba histolytica
TQSTPRE

SEQ ID NO: 2662790 - protein, 6 aa, Entamoeba histolytica
TQSTSL

SEQ ID NO: 2662791 - protein, 5 aa, Entamoeba histolytica
TQSYK

SEQ ID NO: 2662792 - protein, 5 aa, Entamoeba histolytica
TQTAQ

SEQ ID NO: 2662793 - protein, 19 aa, Entamoeba histolytica
TQTDAMKTDFTRKGKREIK

SEQ ID NO: 2662794 - protein, 6 aa, Entamoeba histolytica
TQTDSK

SEQ ID NO: 2662795 - protein, 12 aa, Entamoeba histolytica
TQTEENIEQNDV

SEQ ID NO: 2662796 - protein, 35 aa, Entamoeba histolytica
TQTEEVLNENEQRKRKKEMNEISTKRSLEEMTQNE

SEQ ID NO: 2662797 - protein, 7 aa, Entamoeba histolytica
TQTELEH

SEQ ID NO: 2662798 - protein, 9 aa, Entamoeba histolytica
TQTGKSKGY

SEQ ID NO: 2662799 - protein, 5 aa, Entamoeba histolytica
TQTIN

SEQ ID NO: 2662800 - protein, 4 aa, Entamoeba histolytica
TQTK

SEQ ID NO: 2662801 - protein, 8 aa, Entamoeba histolytica
TQTKSEVN

SEQ ID NO: 2662802 - protein, 7 aa, Entamoeba histolytica
TQTKSVQ

SEQ ID NO: 2662803 - protein, 9 aa, Entamoeba histolytica
TQTLSHEDK

SEQ ID NO: 2662804 - protein, 64 aa, Entamoeba histolytica
TQTPAFKSKPIVSEHTKPNPILPTPKQINSNTSEQKPKCETENAPIISTTKSPKKNKSLPQPPM

SEQ ID NO: 2662805 - protein, 6 aa, Entamoeba histolytica
TQTQIL

SEQ ID NO: 2662806 - protein, 7 aa, Entamoeba histolytica
TQTRNEV

SEQ ID NO: 2662807 - protein, 4 aa, Entamoeba histolytica
TQTS

SEQ ID NO: 2662808 - protein, 17 aa, Entamoeba histolytica
TQTSAKKCFADKKDQLQ

SEQ ID NO: 2662809 - protein, 8 aa, Entamoeba histolytica
TQTSPSAM

SEQ ID NO: 2662810 - protein, 5 aa, Entamoeba histolytica
TQTSS

SEQ ID NO: 2662811 - protein, 10 aa, Entamoeba histolytica
TQTTGHTKTL

SEQ ID NO: 2662812 - protein, 6 aa, Entamoeba histolytica
TQTTSW

SEQ ID NO: 2662813 - protein, 5 aa, Entamoeba histolytica
TQTVS

SEQ ID NO: 2662814 - protein, 14 aa, Entamoeba histolytica
TQTWDPETASSKMK

SEQ ID NO: 2662815 - protein, 14 aa, Entamoeba histolytica
TQTWDPETSSKKMK

SEQ ID NO: 2662816 - protein, 5 aa, Entamoeba histolytica
TQVET

SEQ ID NO: 2662817 - protein, 19 aa, Entamoeba histolytica
TQVKKTKKEISSNHSEKRS

SEQ ID NO: 2662818 - protein, 5 aa, Entamoeba histolytica
TQVNN

SEQ ID NO: 2662819 - protein, 6 aa, Entamoeba histolytica
TQVRTV

SEQ ID NO: 2662820 - protein, 7 aa, Entamoeba histolytica
TQVSEAP

SEQ ID NO: 2662821 - protein, 6 aa, Entamoeba histolytica
TQVSEV

SEQ ID NO: 2662822 - protein, 6 aa, Entamoeba histolytica
TQVSKA

SEQ ID NO: 2662823 - protein, 146 aa, Entamoeba histolytica
TQYAQKDQEEVPKVQPTGKKWTPKVAPAPEVPQPTYQRPTAPKPTYRPPQQTIPEPVQEQQQYQEEQQQYQEEQQQYQEEQQQYQEEQQQYQEEQQQYQEEQQPEQQYQEEPVQEESQQYEETPQEEVSSVPPLPPKPRQQQGETY

SEQ ID NO: 2662824 - protein, 9 aa, Entamoeba histolytica
TQYATNQDN

SEQ ID NO: 2662825 - protein, 5 aa, Entamoeba histolytica
TQYGG

SEQ ID NO: 2662826 - protein, 4 aa, Entamoeba histolytica
TQYN

SEQ ID NO: 2662827 - protein, 11 aa, Entamoeba histolytica
TQYPAEKRESI

SEQ ID NO: 2662828 - protein, 4 aa, Entamoeba histolytica
TQYS

SEQ ID NO: 2662829 - protein, 4 aa, Entamoeba histolytica
TRAE

SEQ ID NO: 2662830 - protein, 14 aa, Entamoeba histolytica
TRAEMEKTIGAKNL

SEQ ID NO: 2662831 - protein, 4 aa, Entamoeba histolytica
TRAG

SEQ ID NO: 2662832 - protein, 6 aa, Entamoeba histolytica
TRAHTE

SEQ ID NO: 2662833 - protein, 6 aa, Entamoeba histolytica
TRAPSL

SEQ ID NO: 2662834 - protein, 4 aa, Entamoeba histolytica
TRCS

SEQ ID NO: 2662835 - protein, 4 aa, Entamoeba histolytica
TRDD

SEQ ID NO: 2662836 - protein, 5 aa, Entamoeba histolytica
TRDIE

SEQ ID NO: 2662837 - protein, 5 aa, Entamoeba histolytica
TRDNG

SEQ ID NO: 2662838 - protein, 15 aa, Entamoeba histolytica
TREDGNNGCNGGLGS

SEQ ID NO: 2662839 - protein, 6 aa, Entamoeba histolytica
TREDKI

SEQ ID NO: 2662840 - protein, 7 aa, Entamoeba histolytica
TREEEEI

SEQ ID NO: 2662841 - protein, 8 aa, Entamoeba histolytica
TREELKEA

SEQ ID NO: 2662842 - protein, 8 aa, Entamoeba histolytica
TREERAKS

SEQ ID NO: 2662843 - protein, 4 aa, Entamoeba histolytica
TREG

SEQ ID NO: 2662844 - protein, 5 aa, Entamoeba histolytica
TREGQ

SEQ ID NO: 2662845 - protein, 9 aa, Entamoeba histolytica
TREHNGNTE

SEQ ID NO: 2662846 - protein, 6 aa, Entamoeba histolytica
TRELGQ

SEQ ID NO: 2662847 - protein, 6 aa, Entamoeba histolytica
TRELTQ

SEQ ID NO: 2662848 - protein, 6 aa, Entamoeba histolytica
TREPNV

SEQ ID NO: 2662849 - protein, 4 aa, Entamoeba histolytica
TRER

SEQ ID NO: 2662850 - protein, 6 aa, Entamoeba histolytica
TRESGY

SEQ ID NO: 2662851 - protein, 12 aa, Entamoeba histolytica
TRETKAVKPYSQ

SEQ ID NO: 2662852 - protein, 10 aa, Entamoeba histolytica
TRETNQKKRM

SEQ ID NO: 2662853 - protein, 6 aa, Entamoeba histolytica
TREYDQ

SEQ ID NO: 2662854 - protein, 16 aa, Entamoeba histolytica
TRFDRSQRLSTSSLEQ

SEQ ID NO: 2662855 - protein, 5 aa, Entamoeba histolytica
TRFQQ

SEQ ID NO: 2662856 - protein, 5 aa, Entamoeba histolytica
TRGFD

SEQ ID NO: 2662857 - protein, 4 aa, Entamoeba histolytica
TRGG

SEQ ID NO: 2662858 - protein, 8 aa, Entamoeba histolytica
TRGGKNAC

SEQ ID NO: 2662859 - protein, 4 aa, Entamoeba histolytica
TRGI

SEQ ID NO: 2662860 - protein, 16 aa, Entamoeba histolytica
TRGMRGGYRGNSRGNL

SEQ ID NO: 2662861 - protein, 6 aa, Entamoeba histolytica
TRGNEM

SEQ ID NO: 2662862 - protein, 8 aa, Entamoeba histolytica
TRGNTPKY

SEQ ID NO: 2662863 - protein, 5 aa, Entamoeba histolytica
TRGPV

SEQ ID NO: 2662864 - protein, 4 aa, Entamoeba histolytica
TRGV

SEQ ID NO: 2662865 - protein, 5 aa, Entamoeba histolytica
TRHDI

SEQ ID NO: 2662866 - protein, 14 aa, Entamoeba histolytica
TRHNGTGGKSIYGT

SEQ ID NO: 2662867 - protein, 11 aa, Entamoeba histolytica
TRHSSFANDPI

SEQ ID NO: 2662868 - protein, 6 aa, Entamoeba histolytica
TRIENK

SEQ ID NO: 2662869 - protein, 5 aa, Entamoeba histolytica
TRIES

SEQ ID NO: 2662870 - protein, 5 aa, Entamoeba histolytica
TRIGK

SEQ ID NO: 2662871 - protein, 5 aa, Entamoeba histolytica
TRIGR

SEQ ID NO: 2662872 - protein, 22 aa, Entamoeba histolytica
TRIKSYNDEEFKEDITKKEEEY

SEQ ID NO: 2662873 - protein, 9 aa, Entamoeba histolytica
TRINQKGKK

SEQ ID NO: 2662874 - protein, 16 aa, Entamoeba histolytica
TRINTTNRLTIEETVN

SEQ ID NO: 2662875 - protein, 5 aa, Entamoeba histolytica
TRIQE

SEQ ID NO: 2662876 - protein, 16 aa, Entamoeba histolytica
TRKACNTSNCPPKPKH

SEQ ID NO: 2662877 - protein, 6 aa, Entamoeba histolytica
TRKADG

SEQ ID NO: 2662878 - protein, 8 aa, Entamoeba histolytica
TRKDIDSK

SEQ ID NO: 2662879 - protein, 9 aa, Entamoeba histolytica
TRKDTKVGV

SEQ ID NO: 2662880 - protein, 8 aa, Entamoeba histolytica
TRKENEVG

SEQ ID NO: 2662881 - protein, 8 aa, Entamoeba histolytica
TRKESDEV

SEQ ID NO: 2662882 - protein, 11 aa, Entamoeba histolytica
TRKETNEVPMS

SEQ ID NO: 2662883 - protein, 8 aa, Entamoeba histolytica
TRKFNKRQ

SEQ ID NO: 2662884 - protein, 4 aa, Entamoeba histolytica
TRKG

SEQ ID NO: 2662885 - protein, 4 aa, Entamoeba histolytica
TRKH

SEQ ID NO: 2662886 - protein, 11 aa, Entamoeba histolytica
TRKLQEETTAY

SEQ ID NO: 2662887 - protein, 6 aa, Entamoeba histolytica
TRKMDN

SEQ ID NO: 2662888 - protein, 8 aa, Entamoeba histolytica
TRKPPKYE

SEQ ID NO: 2662889 - protein, 4 aa, Entamoeba histolytica
TRKQ

SEQ ID NO: 2662890 - protein, 6 aa, Entamoeba histolytica
TRKQCR

SEQ ID NO: 2662891 - protein, 25 aa, Entamoeba histolytica
TRKQGDASEVEEDIEKHTTPEYRSP

SEQ ID NO: 2662892 - protein, 11 aa, Entamoeba histolytica
TRKQNQNQLEE

SEQ ID NO: 2662893 - protein, 9 aa, Entamoeba histolytica
TRKSNEGQI

SEQ ID NO: 2662894 - protein, 6 aa, Entamoeba histolytica
TRKTPR

SEQ ID NO: 2662895 - protein, 6 aa, Entamoeba histolytica
TRKTTY

SEQ ID NO: 2662896 - protein, 10 aa, Entamoeba histolytica
TRLEGKEGDV

SEQ ID NO: 2662897 - protein, 14 aa, Entamoeba histolytica
TRLNSQNNSYEPNQ

SEQ ID NO: 2662898 - protein, 5 aa, Entamoeba histolytica
TRLSE

SEQ ID NO: 2662899 - protein, 5 aa, Entamoeba histolytica
TRMKV

SEQ ID NO: 2662900 - protein, 6 aa, Entamoeba histolytica
TRNAAS

SEQ ID NO: 2662901 - protein, 11 aa, Entamoeba histolytica
TRNANNKLKAF

SEQ ID NO: 2662902 - protein, 17 aa, Entamoeba histolytica
TRNDASKEREKSLNNKI

SEQ ID NO: 2662903 - protein, 4 aa, Entamoeba histolytica
TRNE

SEQ ID NO: 2662904 - protein, 12 aa, Entamoeba histolytica
TRNEENPPKEKH

SEQ ID NO: 2662905 - protein, 9 aa, Entamoeba histolytica
TRNGEIDPN

SEQ ID NO: 2662906 - protein, 9 aa, Entamoeba histolytica
TRNNPNGRE

SEQ ID NO: 2662907 - protein, 6 aa, Entamoeba histolytica
TRNNRA

SEQ ID NO: 2662908 - protein, 7 aa, Entamoeba histolytica
TRNNSIS

SEQ ID NO: 2662909 - protein, 5 aa, Entamoeba histolytica
TRNPE

SEQ ID NO: 2662910 - protein, 5 aa, Entamoeba histolytica
TRNPR

SEQ ID NO: 2662911 - protein, 8 aa, Entamoeba histolytica
TRNQLSDD

SEQ ID NO: 2662912 - protein, 10 aa, Entamoeba histolytica
TRNRSGTKKV

SEQ ID NO: 2662913 - protein, 7 aa, Entamoeba histolytica
TRNSNKE

SEQ ID NO: 2662914 - protein, 6 aa, Entamoeba histolytica
TRPDCC

SEQ ID NO: 2662915 - protein, 7 aa, Entamoeba histolytica
TRPDNQC

SEQ ID NO: 2662916 - protein, 6 aa, Entamoeba histolytica
TRPDTY

SEQ ID NO: 2662917 - protein, 8 aa, Entamoeba histolytica
TRPELGPT

SEQ ID NO: 2662918 - protein, 9 aa, Entamoeba histolytica
TRPKNKTYH

SEQ ID NO: 2662919 - protein, 4 aa, Entamoeba histolytica
TRPL

SEQ ID NO: 2662920 - protein, 10 aa, Entamoeba histolytica
TRPPMDRPLP

SEQ ID NO: 2662921 - protein, 8 aa, Entamoeba histolytica
TRPSDSTL

SEQ ID NO: 2662922 - protein, 4 aa, Entamoeba histolytica
TRPT

SEQ ID NO: 2662923 - protein, 10 aa, Entamoeba histolytica
TRPTKKSLVT

SEQ ID NO: 2662924 - protein, 11 aa, Entamoeba histolytica
TRPTKSSKKTL

SEQ ID NO: 2662925 - protein, 5 aa, Entamoeba histolytica
TRPYC

SEQ ID NO: 2662926 - protein, 7 aa, Entamoeba histolytica
TRQAYSQ

SEQ ID NO: 2662927 - protein, 6 aa, Entamoeba histolytica
TRQDAG

SEQ ID NO: 2662928 - protein, 10 aa, Entamoeba histolytica
TRQDSSPTEI

SEQ ID NO: 2662929 - protein, 28 aa, Entamoeba histolytica
TRQIPQTFTTSQPLSQTFTTSQPLSQTV

SEQ ID NO: 2662930 - protein, 6 aa, Entamoeba histolytica
TRQKAT

SEQ ID NO: 2662931 - protein, 4 aa, Entamoeba histolytica
TRQN

SEQ ID NO: 2662932 - protein, 14 aa, Entamoeba histolytica
TRQPLEGRSRDGGL

SEQ ID NO: 2662933 - protein, 17 aa, Entamoeba histolytica
TRQQLPPQIPSQPIPQE

SEQ ID NO: 2662934 - protein, 10 aa, Entamoeba histolytica
TRQQPTPTIN

SEQ ID NO: 2662935 - protein, 6 aa, Entamoeba histolytica
TRQTTL

SEQ ID NO: 2662936 - protein, 6 aa, Entamoeba histolytica
TRQVEG

SEQ ID NO: 2662937 - protein, 10 aa, Entamoeba histolytica
TRRDPKGTHS

SEQ ID NO: 2662938 - protein, 6 aa, Entamoeba histolytica
TRRKGI

SEQ ID NO: 2662939 - protein, 11 aa, Entamoeba histolytica
TRRKTNDTRVE

SEQ ID NO: 2662940 - protein, 10 aa, Entamoeba histolytica
TRRNTVKRKP

SEQ ID NO: 2662941 - protein, 5 aa, Entamoeba histolytica
TRRPR

SEQ ID NO: 2662942 - protein, 9 aa, Entamoeba histolytica
TRRQATSNI

SEQ ID NO: 2662943 - protein, 16 aa, Entamoeba histolytica
TRRSIKSEDEYEDQNI

SEQ ID NO: 2662944 - protein, 5 aa, Entamoeba histolytica
TRRSV

SEQ ID NO: 2662945 - protein, 6 aa, Entamoeba histolytica
TRSAGS

SEQ ID NO: 2662946 - protein, 17 aa, Entamoeba histolytica
TRSATLGGKRIPLVIPK

SEQ ID NO: 2662947 - protein, 6 aa, Entamoeba histolytica
TRSDGT

SEQ ID NO: 2662948 - protein, 39 aa, Entamoeba histolytica
TRSEMRKERKERAKERRKEMRESGQYIPRKKKRTTENLE

SEQ ID NO: 2662949 - protein, 14 aa, Entamoeba histolytica
TRSGITHDTTNTSP

SEQ ID NO: 2662950 - protein, 4 aa, Entamoeba histolytica
TRSI

SEQ ID NO: 2662951 - protein, 9 aa, Entamoeba histolytica
TRSKEQAQY

SEQ ID NO: 2662952 - protein, 7 aa, Entamoeba histolytica
TRSKNSI

SEQ ID NO: 2662953 - protein, 5 aa, Entamoeba histolytica
TRSLE

SEQ ID NO: 2662954 - protein, 8 aa, Entamoeba histolytica
TRSPEMKK

SEQ ID NO: 2662955 - protein, 8 aa, Entamoeba histolytica
TRSPPDYI

SEQ ID NO: 2662956 - protein, 7 aa, Entamoeba histolytica
TRSPSVP

SEQ ID NO: 2662957 - protein, 6 aa, Entamoeba histolytica
TRSQIE

SEQ ID NO: 2662958 - protein, 5 aa, Entamoeba histolytica
TRSQL

SEQ ID NO: 2662959 - protein, 5 aa, Entamoeba histolytica
TRSSD

SEQ ID NO: 2662960 - protein, 8 aa, Entamoeba histolytica
TRSSEVRP

SEQ ID NO: 2662961 - protein, 9 aa, Entamoeba histolytica
TRSSGPDSP

SEQ ID NO: 2662962 - protein, 6 aa, Entamoeba histolytica
TRSTEQ

SEQ ID NO: 2662963 - protein, 11 aa, Entamoeba histolytica
TRSTKHPLGGT

SEQ ID NO: 2662964 - protein, 14 aa, Entamoeba histolytica
TRTAEKSSTPKYNE

SEQ ID NO: 2662965 - protein, 4 aa, Entamoeba histolytica
TRTD

SEQ ID NO: 2662966 - protein, 9 aa, Entamoeba histolytica
TRTEGNRNG

SEQ ID NO: 2662967 - protein, 29 aa, Entamoeba histolytica
TRTEREAKKKLAKGQLKRKQQLSKLNEEC

SEQ ID NO: 2662968 - protein, 4 aa, Entamoeba histolytica
TRTG

SEQ ID NO: 2662969 - protein, 7 aa, Entamoeba histolytica
TRTHTYE

SEQ ID NO: 2662970 - protein, 4 aa, Entamoeba histolytica
TRTI

SEQ ID NO: 2662971 - protein, 10 aa, Entamoeba histolytica
TRTKEDSPEV

SEQ ID NO: 2662972 - protein, 17 aa, Entamoeba histolytica
TRTKGSAEESGRRESEV

SEQ ID NO: 2662973 - protein, 7 aa, Entamoeba histolytica
TRTMGEL

SEQ ID NO: 2662974 - protein, 7 aa, Entamoeba histolytica
TRTPEQC

SEQ ID NO: 2662975 - protein, 7 aa, Entamoeba histolytica
TRTPVQV

SEQ ID NO: 2662976 - protein, 8 aa, Entamoeba histolytica
TRTQERKQ

SEQ ID NO: 2662977 - protein, 6 aa, Entamoeba histolytica
TRTRSV

SEQ ID NO: 2662978 - protein, 13 aa, Entamoeba histolytica
TRTSASKRTISPR

SEQ ID NO: 2662979 - protein, 4 aa, Entamoeba histolytica
TRVN

SEQ ID NO: 2662980 - protein, 5 aa, Entamoeba histolytica
TRYEG

SEQ ID NO: 2662981 - protein, 6 aa, Entamoeba histolytica
TRYKGE

SEQ ID NO: 2662982 - protein, 10 aa, Entamoeba histolytica
TRYKPGSDMS

SEQ ID NO: 2662983 - protein, 6 aa, Entamoeba histolytica
TRYPRT

SEQ ID NO: 2662984 - protein, 10 aa, Entamoeba histolytica
TRYQEPTPFT

SEQ ID NO: 2662985 - protein, 8 aa, Entamoeba histolytica
TSAANSQT

SEQ ID NO: 2662986 - protein, 8 aa, Entamoeba histolytica
TSADGSIT

SEQ ID NO: 2662987 - protein, 7 aa, Entamoeba histolytica
TSAGKVE

SEQ ID NO: 2662988 - protein, 9 aa, Entamoeba histolytica
TSAGPLCDE

SEQ ID NO: 2662989 - protein, 22 aa, Entamoeba histolytica
TSAIASPPKDCITPPKKNDRSI

SEQ ID NO: 2662990 - protein, 11 aa, Entamoeba histolytica
TSAIGGKPLRD

SEQ ID NO: 2662991 - protein, 9 aa, Entamoeba histolytica
TSAITGEGI

SEQ ID NO: 2662992 - protein, 8 aa, Entamoeba histolytica
TSAKANIN

SEQ ID NO: 2662993 - protein, 9 aa, Entamoeba histolytica
TSAKEGSNV

SEQ ID NO: 2662994 - protein, 6 aa, Entamoeba histolytica
TSAKER

SEQ ID NO: 2662995 - protein, 10 aa, Entamoeba histolytica
TSAKKKSNIN

SEQ ID NO: 2662996 - protein, 8 aa, Entamoeba histolytica
TSAKQSIN

SEQ ID NO: 2662997 - protein, 8 aa, Entamoeba histolytica
TSAKSNIN

SEQ ID NO: 2662998 - protein, 7 aa, Entamoeba histolytica
TSAKTSF

SEQ ID NO: 2662999 - protein, 4 aa, Entamoeba histolytica
TSAP

SEQ ID NO: 2663000 - protein, 6 aa, Entamoeba histolytica
TSAPHY

SEQ ID NO: 2663001 - protein, 19 aa, Entamoeba histolytica
TSAPKEKIEEKPIDPHENK

SEQ ID NO: 2663002 - protein, 6 aa, Entamoeba histolytica
TSAPTA

SEQ ID NO: 2663003 - protein, 5 aa, Entamoeba histolytica
TSAST

SEQ ID NO: 2663004 - protein, 10 aa, Entamoeba histolytica
TSASTKSKPF

SEQ ID NO: 2663005 - protein, 15 aa, Entamoeba histolytica
TSATFRKTKRSKQTV

SEQ ID NO: 2663006 - protein, 7 aa, Entamoeba histolytica
TSATLGT

SEQ ID NO: 2663007 - protein, 15 aa, Entamoeba histolytica
TSAYQRAEKKEETTS

SEQ ID NO: 2663008 - protein, 8 aa, Entamoeba histolytica
TSCESSKE

SEQ ID NO: 2663009 - protein, 4 aa, Entamoeba histolytica
TSCK

SEQ ID NO: 2663010 - protein, 5 aa, Entamoeba histolytica
TSCPN

SEQ ID NO: 2663011 - protein, 13 aa, Entamoeba histolytica
TSCPTTSLPFPPT

SEQ ID NO: 2663012 - protein, 10 aa, Entamoeba histolytica
TSCSTDKNKF

SEQ ID NO: 2663013 - protein, 10 aa, Entamoeba histolytica
TSCVGSKDTF

SEQ ID NO: 2663014 - protein, 16 aa, Entamoeba histolytica
TSDCTSKTKDCNKCGG

SEQ ID NO: 2663015 - protein, 6 aa, Entamoeba histolytica
TSDDGI

SEQ ID NO: 2663016 - protein, 13 aa, Entamoeba histolytica
TSDFDTRDAALSA

SEQ ID NO: 2663017 - protein, 12 aa, Entamoeba histolytica
TSDGNKASTNNK

SEQ ID NO: 2663018 - protein, 9 aa, Entamoeba histolytica
TSDGSKRTR

SEQ ID NO: 2663019 - protein, 5 aa, Entamoeba histolytica
TSDHK

SEQ ID NO: 2663020 - protein, 6 aa, Entamoeba histolytica
TSDKEV

SEQ ID NO: 2663021 - protein, 8 aa, Entamoeba histolytica
TSDKQGKD

SEQ ID NO: 2663022 - protein, 5 aa, Entamoeba histolytica
TSDKW

SEQ ID NO: 2663023 - protein, 4 aa, Entamoeba histolytica
TSDL

SEQ ID NO: 2663024 - protein, 8 aa, Entamoeba histolytica
TSDPQSSH

SEQ ID NO: 2663025 - protein, 5 aa, Entamoeba histolytica
TSDQI

SEQ ID NO: 2663026 - protein, 9 aa, Entamoeba histolytica
TSDQPTKAN

SEQ ID NO: 2663027 - protein, 19 aa, Entamoeba histolytica
TSDRLNATSKLNDQMQNTP

SEQ ID NO: 2663028 - protein, 9 aa, Entamoeba histolytica
TSDSQEEYA

SEQ ID NO: 2663029 - protein, 24 aa, Entamoeba histolytica
TSDYKEYNKDIDNTHDESKQQEIQ

SEQ ID NO: 2663030 - protein, 5 aa, Entamoeba histolytica
TSEDV

SEQ ID NO: 2663031 - protein, 9 aa, Entamoeba histolytica
TSEDYDNEQ

SEQ ID NO: 2663032 - protein, 7 aa, Entamoeba histolytica
TSEEDEY

SEQ ID NO: 2663033 - protein, 5 aa, Entamoeba histolytica
TSEEQ

SEQ ID NO: 2663034 - protein, 17 aa, Entamoeba histolytica
TSEESTPINLDCFVSCQ

SEQ ID NO: 2663035 - protein, 5 aa, Entamoeba histolytica
TSEFI

SEQ ID NO: 2663036 - protein, 8 aa, Entamoeba histolytica
TSEGDNEL

SEQ ID NO: 2663037 - protein, 7 aa, Entamoeba histolytica
TSEIEQK

SEQ ID NO: 2663038 - protein, 12 aa, Entamoeba histolytica
TSEKEEEKIDSD

SEQ ID NO: 2663039 - protein, 10 aa, Entamoeba histolytica
TSEKGNTQTW

SEQ ID NO: 2663040 - protein, 21 aa, Entamoeba histolytica
TSEKHNPSVDKEKARIESAGG

SEQ ID NO: 2663041 - protein, 13 aa, Entamoeba histolytica
TSEKQSQYQIGWF

SEQ ID NO: 2663042 - protein, 7 aa, Entamoeba histolytica
TSELGEG

SEQ ID NO: 2663043 - protein, 9 aa, Entamoeba histolytica
TSELKKNDD

SEQ ID NO: 2663044 - protein, 6 aa, Entamoeba histolytica
TSELPK

SEQ ID NO: 2663045 - protein, 8 aa, Entamoeba histolytica
TSENNNIH

SEQ ID NO: 2663046 - protein, 11 aa, Entamoeba histolytica
TSENQTKKQTL

SEQ ID NO: 2663047 - protein, 8 aa, Entamoeba histolytica
TSERRVEG

SEQ ID NO: 2663048 - protein, 9 aa, Entamoeba histolytica
TSESEEDRK

SEQ ID NO: 2663049 - protein, 8 aa, Entamoeba histolytica
TSETGYHG

SEQ ID NO: 2663050 - protein, 5 aa, Entamoeba histolytica
TSETK

SEQ ID NO: 2663051 - protein, 26 aa, Entamoeba histolytica
TSETKDKVEKKMSKKKTNTKKPRRVV

SEQ ID NO: 2663052 - protein, 19 aa, Entamoeba histolytica
TSETPSSSEEESTEVTDKE

SEQ ID NO: 2663053 - protein, 7 aa, Entamoeba histolytica
TSEVEDI

SEQ ID NO: 2663054 - protein, 26 aa, Entamoeba histolytica
TSEVQSSATSQSENSALKSNKNRNKK

SEQ ID NO: 2663055 - protein, 7 aa, Entamoeba histolytica
TSEYSDY

SEQ ID NO: 2663056 - protein, 4 aa, Entamoeba histolytica
TSFE

SEQ ID NO: 2663057 - protein, 6 aa, Entamoeba histolytica
TSFGLS

SEQ ID NO: 2663058 - protein, 7 aa, Entamoeba histolytica
TSFGPGD

SEQ ID NO: 2663059 - protein, 6 aa, Entamoeba histolytica
TSFGVN

SEQ ID NO: 2663060 - protein, 13 aa, Entamoeba histolytica
TSFNPTSGNDGCG

SEQ ID NO: 2663061 - protein, 16 aa, Entamoeba histolytica
TSFPSLNSSFSGPQQQ

SEQ ID NO: 2663062 - protein, 6 aa, Entamoeba histolytica
TSFPTP

SEQ ID NO: 2663063 - protein, 15 aa, Entamoeba histolytica
TSFSSSNKDKAKDIK

SEQ ID NO: 2663064 - protein, 5 aa, Entamoeba histolytica
TSFST

SEQ ID NO: 2663065 - protein, 4 aa, Entamoeba histolytica
TSFT

SEQ ID NO: 2663066 - protein, 5 aa, Entamoeba histolytica
TSFVQ

SEQ ID NO: 2663067 - protein, 13 aa, Entamoeba histolytica
TSGAISKNTPIGT

SEQ ID NO: 2663068 - protein, 14 aa, Entamoeba histolytica
TSGALQSSTKLGTT

SEQ ID NO: 2663069 - protein, 13 aa, Entamoeba histolytica
TSGAVQETTELGT

SEQ ID NO: 2663070 - protein, 7 aa, Entamoeba histolytica
TSGDERF

SEQ ID NO: 2663071 - protein, 7 aa, Entamoeba histolytica
TSGDGRD

SEQ ID NO: 2663072 - protein, 9 aa, Entamoeba histolytica
TSGDNTRKV

SEQ ID NO: 2663073 - protein, 7 aa, Entamoeba histolytica
TSGDPTV

SEQ ID NO: 2663074 - protein, 7 aa, Entamoeba histolytica
TSGDSQF

SEQ ID NO: 2663075 - protein, 9 aa, Entamoeba histolytica
TSGEERYHS

SEQ ID NO: 2663076 - protein, 7 aa, Entamoeba histolytica
TSGFSDL

SEQ ID NO: 2663077 - protein, 8 aa, Entamoeba histolytica
TSGGDNTY

SEQ ID NO: 2663078 - protein, 8 aa, Entamoeba histolytica
TSGGGKTT

SEQ ID NO: 2663079 - protein, 8 aa, Entamoeba histolytica
TSGGTIED

SEQ ID NO: 2663080 - protein, 13 aa, Entamoeba histolytica
TSGISSNHVNPSG

SEQ ID NO: 2663081 - protein, 4 aa, Entamoeba histolytica
TSGK

SEQ ID NO: 2663082 - protein, 24 aa, Entamoeba histolytica
TSGKGSSAAGLTAAVNKDSSTGEF

SEQ ID NO: 2663083 - protein, 4 aa, Entamoeba histolytica
TSGL

SEQ ID NO: 2663084 - protein, 7 aa, Entamoeba histolytica
TSGMKTR

SEQ ID NO: 2663085 - protein, 5 aa, Entamoeba histolytica
TSGMT

SEQ ID NO: 2663086 - protein, 9 aa, Entamoeba histolytica
TSGNDEIPK

SEQ ID NO: 2663087 - protein, 7 aa, Entamoeba histolytica
TSGNEKM

SEQ ID NO: 2663088 - protein, 17 aa, Entamoeba histolytica
TSGNGVDSLRDELKDDE

SEQ ID NO: 2663089 - protein, 5 aa, Entamoeba histolytica
TSGNV

SEQ ID NO: 2663090 - protein, 6 aa, Entamoeba histolytica
TSGNYG

SEQ ID NO: 2663091 - protein, 9 aa, Entamoeba histolytica
TSGRNKTLK

SEQ ID NO: 2663092 - protein, 5 aa, Entamoeba histolytica
TSGSD

SEQ ID NO: 2663093 - protein, 13 aa, Entamoeba histolytica
TSGSENITRENSY

SEQ ID NO: 2663094 - protein, 9 aa, Entamoeba histolytica
TSGSTGEPK

SEQ ID NO: 2663095 - protein, 10 aa, Entamoeba histolytica
TSGSTGEPKI

SEQ ID NO: 2663096 - protein, 7 aa, Entamoeba histolytica
TSGSTGI

SEQ ID NO: 2663097 - protein, 9 aa, Entamoeba histolytica
TSGSTGNPK

SEQ ID NO: 2663098 - protein, 4 aa, Entamoeba histolytica
TSGT

SEQ ID NO: 2663099 - protein, 6 aa, Entamoeba histolytica
TSGTEL

SEQ ID NO: 2663100 - protein, 9 aa, Entamoeba histolytica
TSGTGKGEL

SEQ ID NO: 2663101 - protein, 5 aa, Entamoeba histolytica
TSGTI

SEQ ID NO: 2663102 - protein, 9 aa, Entamoeba histolytica
TSGVTATPI

SEQ ID NO: 2663103 - protein, 13 aa, Entamoeba histolytica
TSGVTDNKKPPHK

SEQ ID NO: 2663104 - protein, 13 aa, Entamoeba histolytica
TSGVTNNKKPPHK

SEQ ID NO: 2663105 - protein, 8 aa, Entamoeba histolytica
TSGYADVR

SEQ ID NO: 2663106 - protein, 11 aa, Entamoeba histolytica
TSHGNGTKITN

SEQ ID NO: 2663107 - protein, 4 aa, Entamoeba histolytica
TSHH

SEQ ID NO: 2663108 - protein, 7 aa, Entamoeba histolytica
TSHHPPV

SEQ ID NO: 2663109 - protein, 4 aa, Entamoeba histolytica
TSHI

SEQ ID NO: 2663110 - protein, 9 aa, Entamoeba histolytica
TSHKPKEEI

SEQ ID NO: 2663111 - protein, 5 aa, Entamoeba histolytica
TSHSS

SEQ ID NO: 2663112 - protein, 16 aa, Entamoeba histolytica
TSIASTESINRVNQEK

SEQ ID NO: 2663113 - protein, 10 aa, Entamoeba histolytica
TSIDQSNNIE

SEQ ID NO: 2663114 - protein, 10 aa, Entamoeba histolytica
TSIDSKTRTS

SEQ ID NO: 2663115 - protein, 5 aa, Entamoeba histolytica
TSIEN

SEQ ID NO: 2663116 - protein, 7 aa, Entamoeba histolytica
TSIENNK

SEQ ID NO: 2663117 - protein, 14 aa, Entamoeba histolytica
TSIGKTTKKPSKHS

SEQ ID NO: 2663118 - protein, 6 aa, Entamoeba histolytica
TSIGNY

SEQ ID NO: 2663119 - protein, 4 aa, Entamoeba histolytica
TSIK

SEQ ID NO: 2663120 - protein, 5 aa, Entamoeba histolytica
TSIKS

SEQ ID NO: 2663121 - protein, 6 aa, Entamoeba histolytica
TSINGS

SEQ ID NO: 2663122 - protein, 6 aa, Entamoeba histolytica
TSINNN

SEQ ID NO: 2663123 - protein, 6 aa, Entamoeba histolytica
TSINSN

SEQ ID NO: 2663124 - protein, 6 aa, Entamoeba histolytica
TSIPET

SEQ ID NO: 2663125 - protein, 6 aa, Entamoeba histolytica
TSIPIP

SEQ ID NO: 2663126 - protein, 6 aa, Entamoeba histolytica
TSIPSI

SEQ ID NO: 2663127 - protein, 18 aa, Entamoeba histolytica
TSIQKDGETFTSSQLEKI

SEQ ID NO: 2663128 - protein, 5 aa, Entamoeba histolytica
TSIQQ

SEQ ID NO: 2663129 - protein, 6 aa, Entamoeba histolytica
TSIQTA

SEQ ID NO: 2663130 - protein, 4 aa, Entamoeba histolytica
TSIR

SEQ ID NO: 2663131 - protein, 4 aa, Entamoeba histolytica
TSIS

SEQ ID NO: 2663132 - protein, 8 aa, Entamoeba histolytica
TSISPTGR

SEQ ID NO: 2663133 - protein, 12 aa, Entamoeba histolytica
TSISQKDKKKTK

SEQ ID NO: 2663134 - protein, 10 aa, Entamoeba histolytica
TSISSSNTLT

SEQ ID NO: 2663135 - protein, 7 aa, Entamoeba histolytica
TSITRPN

SEQ ID NO: 2663136 - protein, 9 aa, Entamoeba histolytica
TSITSSPSH

SEQ ID NO: 2663137 - protein, 16 aa, Entamoeba histolytica
TSKALSNELQSSPTMQ

SEQ ID NO: 2663138 - protein, 8 aa, Entamoeba histolytica
TSKAPKAF

SEQ ID NO: 2663139 - protein, 7 aa, Entamoeba histolytica
TSKDNLS

SEQ ID NO: 2663140 - protein, 6 aa, Entamoeba histolytica
TSKDTI

SEQ ID NO: 2663141 - protein, 10 aa, Entamoeba histolytica
TSKDTKINEL

SEQ ID NO: 2663142 - protein, 9 aa, Entamoeba histolytica
TSKDYSTQY

SEQ ID NO: 2663143 - protein, 8 aa, Entamoeba histolytica
TSKEFKGK

SEQ ID NO: 2663144 - protein, 9 aa, Entamoeba histolytica
TSKEPFNKI

SEQ ID NO: 2663145 - protein, 9 aa, Entamoeba histolytica
TSKEREKVD

SEQ ID NO: 2663146 - protein, 10 aa, Entamoeba histolytica
TSKFQKRKSG

SEQ ID NO: 2663147 - protein, 7 aa, Entamoeba histolytica
TSKFSNR

SEQ ID NO: 2663148 - protein, 4 aa, Entamoeba histolytica
TSKI

SEQ ID NO: 2663149 - protein, 6 aa, Entamoeba histolytica
TSKIPK

SEQ ID NO: 2663150 - protein, 7 aa, Entamoeba histolytica
TSKIRDD

SEQ ID NO: 2663151 - protein, 4 aa, Entamoeba histolytica
TSKK

SEQ ID NO: 2663152 - protein, 12 aa, Entamoeba histolytica
TSKKEAIESDHK

SEQ ID NO: 2663153 - protein, 34 aa, Entamoeba histolytica
TSKKIEEPTSTPQVNQTPSHTSNSQISTQPATAR

SEQ ID NO: 2663154 - protein, 8 aa, Entamoeba histolytica
TSKKKSTL

SEQ ID NO: 2663155 - protein, 10 aa, Entamoeba histolytica
TSKKSAEETL

SEQ ID NO: 2663156 - protein, 9 aa, Entamoeba histolytica
TSKKSCEEA

SEQ ID NO: 2663157 - protein, 5 aa, Entamoeba histolytica
TSKLK

SEQ ID NO: 2663158 - protein, 5 aa, Entamoeba histolytica
TSKMN

SEQ ID NO: 2663159 - protein, 7 aa, Entamoeba histolytica
TSKMPRI

SEQ ID NO: 2663160 - protein, 8 aa, Entamoeba histolytica
TSKMPRIK

SEQ ID NO: 2663161 - protein, 8 aa, Entamoeba histolytica
TSKMPRIR

SEQ ID NO: 2663162 - protein, 8 aa, Entamoeba histolytica
TSKNAREA

SEQ ID NO: 2663163 - protein, 8 aa, Entamoeba histolytica
TSKNEKSL

SEQ ID NO: 2663164 - protein, 6 aa, Entamoeba histolytica
TSKNGG

SEQ ID NO: 2663165 - protein, 12 aa, Entamoeba histolytica
TSKNKSNEKPKI

SEQ ID NO: 2663166 - protein, 5 aa, Entamoeba histolytica
TSKNQ

SEQ ID NO: 2663167 - protein, 4 aa, Entamoeba histolytica
TSKP

SEQ ID NO: 2663168 - protein, 10 aa, Entamoeba histolytica
TSKPPKQFAE

SEQ ID NO: 2663169 - protein, 9 aa, Entamoeba histolytica
TSKQKKDWY

SEQ ID NO: 2663170 - protein, 8 aa, Entamoeba histolytica
TSKQNKSV

SEQ ID NO: 2663171 - protein, 8 aa, Entamoeba histolytica
TSKRQQKY

SEQ ID NO: 2663172 - protein, 7 aa, Entamoeba histolytica
TSKRSKL

SEQ ID NO: 2663173 - protein, 7 aa, Entamoeba histolytica
TSKSFTS

SEQ ID NO: 2663174 - protein, 9 aa, Entamoeba histolytica
TSKTAKQQS

SEQ ID NO: 2663175 - protein, 9 aa, Entamoeba histolytica
TSKTDDTKG

SEQ ID NO: 2663176 - protein, 10 aa, Entamoeba histolytica
TSKVQKTERR

SEQ ID NO: 2663177 - protein, 4 aa, Entamoeba histolytica
TSKY

SEQ ID NO: 2663178 - protein, 7 aa, Entamoeba histolytica
TSLDPSL

SEQ ID NO: 2663179 - protein, 8 aa, Entamoeba histolytica
TSLEKEKE

SEQ ID NO: 2663180 - protein, 16 aa, Entamoeba histolytica
TSLESDSQDKDEQIAK

SEQ ID NO: 2663181 - protein, 4 aa, Entamoeba histolytica
TSLG

SEQ ID NO: 2663182 - protein, 8 aa, Entamoeba histolytica
TSLGEETF

SEQ ID NO: 2663183 - protein, 4 aa, Entamoeba histolytica
TSLK

SEQ ID NO: 2663184 - protein, 7 aa, Entamoeba histolytica
TSLNEAN

SEQ ID NO: 2663185 - protein, 8 aa, Entamoeba histolytica
TSLNENKD

SEQ ID NO: 2663186 - protein, 8 aa, Entamoeba histolytica
TSLNPDVQ

SEQ ID NO: 2663187 - protein, 14 aa, Entamoeba histolytica
TSLPNGKQRNAELE

SEQ ID NO: 2663188 - protein, 5 aa, Entamoeba histolytica
TSLPP

SEQ ID NO: 2663189 - protein, 8 aa, Entamoeba histolytica
TSLPSRSQ

SEQ ID NO: 2663190 - protein, 8 aa, Entamoeba histolytica
TSLQTKSN

SEQ ID NO: 2663191 - protein, 4 aa, Entamoeba histolytica
TSLR

SEQ ID NO: 2663192 - protein, 9 aa, Entamoeba histolytica
TSLRSNGVS

SEQ ID NO: 2663193 - protein, 12 aa, Entamoeba histolytica
TSLSAGENGSKI

SEQ ID NO: 2663194 - protein, 19 aa, Entamoeba histolytica
TSLSDNTVTLRDRDTTKQI

SEQ ID NO: 2663195 - protein, 9 aa, Entamoeba histolytica
TSLSRNGTI

SEQ ID NO: 2663196 - protein, 6 aa, Entamoeba histolytica
TSLSSQ

SEQ ID NO: 2663197 - protein, 11 aa, Entamoeba histolytica
TSLSTNINYTD

SEQ ID NO: 2663198 - protein, 14 aa, Entamoeba histolytica
TSLSTRDSQNSHYQ

SEQ ID NO: 2663199 - protein, 24 aa, Entamoeba histolytica
TSLSTTNGPTNGSSMRQTEQMNQS

SEQ ID NO: 2663200 - protein, 4 aa, Entamoeba histolytica
TSLT

SEQ ID NO: 2663201 - protein, 7 aa, Entamoeba histolytica
TSLTEEQ

SEQ ID NO: 2663202 - protein, 9 aa, Entamoeba histolytica
TSLTGEKPY

SEQ ID NO: 2663203 - protein, 8 aa, Entamoeba histolytica
TSLTNERI

SEQ ID NO: 2663204 - protein, 6 aa, Entamoeba histolytica
TSLYEG

SEQ ID NO: 2663205 - protein, 6 aa, Entamoeba histolytica
TSLYND

SEQ ID NO: 2663206 - protein, 4 aa, Entamoeba histolytica
TSML

SEQ ID NO: 2663207 - protein, 6 aa, Entamoeba histolytica
TSMPPL

SEQ ID NO: 2663208 - protein, 5 aa, Entamoeba histolytica
TSMQQ

SEQ ID NO: 2663209 - protein, 4 aa, Entamoeba histolytica
TSMT

SEQ ID NO: 2663210 - protein, 8 aa, Entamoeba histolytica
TSMTKRSI

SEQ ID NO: 2663211 - protein, 5 aa, Entamoeba histolytica
TSMTL

SEQ ID NO: 2663212 - protein, 4 aa, Entamoeba histolytica
TSNC

SEQ ID NO: 2663213 - protein, 11 aa, Entamoeba histolytica
TSNDPPQGELE

SEQ ID NO: 2663214 - protein, 7 aa, Entamoeba histolytica
TSNDSTA

SEQ ID NO: 2663215 - protein, 9 aa, Entamoeba histolytica
TSNESQFSD

SEQ ID NO: 2663216 - protein, 9 aa, Entamoeba histolytica
TSNGGIQEL

SEQ ID NO: 2663217 - protein, 8 aa, Entamoeba histolytica
TSNGNYNK

SEQ ID NO: 2663218 - protein, 4 aa, Entamoeba histolytica
TSNI

SEQ ID NO: 2663219 - protein, 17 aa, Entamoeba histolytica
TSNIETKSKGTTFERPA

SEQ ID NO: 2663220 - protein, 4 aa, Entamoeba histolytica
TSNK

SEQ ID NO: 2663221 - protein, 10 aa, Entamoeba histolytica
TSNKYVQSGE

SEQ ID NO: 2663222 - protein, 7 aa, Entamoeba histolytica
TSNLPYP

SEQ ID NO: 2663223 - protein, 4 aa, Entamoeba histolytica
TSNN

SEQ ID NO: 2663224 - protein, 6 aa, Entamoeba histolytica
TSNNLK

SEQ ID NO: 2663225 - protein, 5 aa, Entamoeba histolytica
TSNNN

SEQ ID NO: 2663226 - protein, 6 aa, Entamoeba histolytica
TSNNNY

SEQ ID NO: 2663227 - protein, 7 aa, Entamoeba histolytica
TSNNTEI

SEQ ID NO: 2663228 - protein, 8 aa, Entamoeba histolytica
TSNNTLSD

SEQ ID NO: 2663229 - protein, 30 aa, Entamoeba histolytica
TSNPFGTTQSTPLQTDNKKPNDLKQTSNGF

SEQ ID NO: 2663230 - protein, 9 aa, Entamoeba histolytica
TSNPQIPSE

SEQ ID NO: 2663231 - protein, 5 aa, Entamoeba histolytica
TSNQP

SEQ ID NO: 2663232 - protein, 9 aa, Entamoeba histolytica
TSNQPQFSN

SEQ ID NO: 2663233 - protein, 13 aa, Entamoeba histolytica
TSNRNHANQFAQN

SEQ ID NO: 2663234 - protein, 9 aa, Entamoeba histolytica
TSNSCSSLN

SEQ ID NO: 2663235 - protein, 9 aa, Entamoeba histolytica
TSNSGQGIP

SEQ ID NO: 2663236 - protein, 7 aa, Entamoeba histolytica
TSNSINQ

SEQ ID NO: 2663237 - protein, 8 aa, Entamoeba histolytica
TSNSIQPI

SEQ ID NO: 2663238 - protein, 7 aa, Entamoeba histolytica
TSNSNKK

SEQ ID NO: 2663239 - protein, 19 aa, Entamoeba histolytica
TSNSQNDLSLNDSSIPEGR

SEQ ID NO: 2663240 - protein, 8 aa, Entamoeba histolytica
TSNSRNVG

SEQ ID NO: 2663241 - protein, 10 aa, Entamoeba histolytica
TSNSSYPTLN

SEQ ID NO: 2663242 - protein, 13 aa, Entamoeba histolytica
TSNTKRVEEKYSV

SEQ ID NO: 2663243 - protein, 9 aa, Entamoeba histolytica
TSNTTKGHS

SEQ ID NO: 2663244 - protein, 10 aa, Entamoeba histolytica
TSPAPNTTIK

SEQ ID NO: 2663245 - protein, 15 aa, Entamoeba histolytica
TSPCDSQTRQNAERT

SEQ ID NO: 2663246 - protein, 13 aa, Entamoeba histolytica
TSPCPEEEKTEHE

SEQ ID NO: 2663247 - protein, 4 aa, Entamoeba histolytica
TSPD

SEQ ID NO: 2663248 - protein, 12 aa, Entamoeba histolytica
TSPDFSKKTEQY

SEQ ID NO: 2663249 - protein, 9 aa, Entamoeba histolytica
TSPDINPTL

SEQ ID NO: 2663250 - protein, 10 aa, Entamoeba histolytica
TSPEASGEGV

SEQ ID NO: 2663251 - protein, 7 aa, Entamoeba histolytica
TSPEIKN

SEQ ID NO: 2663252 - protein, 16 aa, Entamoeba histolytica
TSPESTQTIQNSDKGI

SEQ ID NO: 2663253 - protein, 12 aa, Entamoeba histolytica
TSPFGGDADEIN

SEQ ID NO: 2663254 - protein, 4 aa, Entamoeba histolytica
TSPI

SEQ ID NO: 2663255 - protein, 13 aa, Entamoeba histolytica
TSPINKKKTTCSD

SEQ ID NO: 2663256 - protein, 10 aa, Entamoeba histolytica
TSPKQERLTK

SEQ ID NO: 2663257 - protein, 7 aa, Entamoeba histolytica
TSPKSLT

SEQ ID NO: 2663258 - protein, 8 aa, Entamoeba histolytica
TSPKYTME

SEQ ID NO: 2663259 - protein, 6 aa, Entamoeba histolytica
TSPNKI

SEQ ID NO: 2663260 - protein, 8 aa, Entamoeba histolytica
TSPPNTTI

SEQ ID NO: 2663261 - protein, 5 aa, Entamoeba histolytica
TSPPV

SEQ ID NO: 2663262 - protein, 5 aa, Entamoeba histolytica
TSPRL

SEQ ID NO: 2663263 - protein, 8 aa, Entamoeba histolytica
TSPRQQGQ

SEQ ID NO: 2663264 - protein, 11 aa, Entamoeba histolytica
TSPSFNNQSYS

SEQ ID NO: 2663265 - protein, 14 aa, Entamoeba histolytica
TSPSLNQDTSCDKV

SEQ ID NO: 2663266 - protein, 7 aa, Entamoeba histolytica
TSPSQKP

SEQ ID NO: 2663267 - protein, 4 aa, Entamoeba histolytica
TSPT

SEQ ID NO: 2663268 - protein, 7 aa, Entamoeba histolytica
TSPTPAI

SEQ ID NO: 2663269 - protein, 8 aa, Entamoeba histolytica
TSPTYTSK

SEQ ID NO: 2663270 - protein, 4 aa, Entamoeba histolytica
TSPY

SEQ ID NO: 2663271 - protein, 7 aa, Entamoeba histolytica
TSPYNPD

SEQ ID NO: 2663272 - protein, 9 aa, Entamoeba histolytica
TSQAPGSAI

SEQ ID NO: 2663273 - protein, 5 aa, Entamoeba histolytica
TSQAY

SEQ ID NO: 2663274 - protein, 38 aa, Entamoeba histolytica
TSQDELRKKLETNNPDDCGTTCYDDGGPEPSSGSPEDD

SEQ ID NO: 2663275 - protein, 16 aa, Entamoeba histolytica
TSQENIDKRNQTKESI

SEQ ID NO: 2663276 - protein, 8 aa, Entamoeba histolytica
TSQENTIP

SEQ ID NO: 2663277 - protein, 7 aa, Entamoeba histolytica
TSQESFD

SEQ ID NO: 2663278 - protein, 13 aa, Entamoeba histolytica
TSQFDSSNDYAEE

SEQ ID NO: 2663279 - protein, 4 aa, Entamoeba histolytica
TSQG

SEQ ID NO: 2663280 - protein, 8 aa, Entamoeba histolytica
TSQGSTNL

SEQ ID NO: 2663281 - protein, 12 aa, Entamoeba histolytica
TSQIEEKADAIS

SEQ ID NO: 2663282 - protein, 5 aa, Entamoeba histolytica
TSQIN

SEQ ID NO: 2663283 - protein, 11 aa, Entamoeba histolytica
TSQKKKKEINF

SEQ ID NO: 2663284 - protein, 10 aa, Entamoeba histolytica
TSQKTTPNDY

SEQ ID NO: 2663285 - protein, 7 aa, Entamoeba histolytica
TSQKYKT

SEQ ID NO: 2663286 - protein, 9 aa, Entamoeba histolytica
TSQPKHIDN

SEQ ID NO: 2663287 - protein, 4 aa, Entamoeba histolytica
TSQR

SEQ ID NO: 2663288 - protein, 5 aa, Entamoeba histolytica
TSQSE

SEQ ID NO: 2663289 - protein, 6 aa, Entamoeba histolytica
TSQTDI

SEQ ID NO: 2663290 - protein, 14 aa, Entamoeba histolytica
TSQTINGQKSGNLA

SEQ ID NO: 2663291 - protein, 6 aa, Entamoeba histolytica
TSQTRQ

SEQ ID NO: 2663292 - protein, 9 aa, Entamoeba histolytica
TSQTSFPQP

SEQ ID NO: 2663293 - protein, 16 aa, Entamoeba histolytica
TSQTYKGTVTENKANY

SEQ ID NO: 2663294 - protein, 12 aa, Entamoeba histolytica
TSQVNEKYLPDK

SEQ ID NO: 2663295 - protein, 6 aa, Entamoeba histolytica
TSQVRP

SEQ ID NO: 2663296 - protein, 5 aa, Entamoeba histolytica
TSQYS

SEQ ID NO: 2663297 - protein, 22 aa, Entamoeba histolytica
TSRAGIGSSRSSVPLPNPSTMI

SEQ ID NO: 2663298 - protein, 8 aa, Entamoeba histolytica
TSRDPTSI

SEQ ID NO: 2663299 - protein, 7 aa, Entamoeba histolytica
TSRDSLS

SEQ ID NO: 2663300 - protein, 4 aa, Entamoeba histolytica
TSRE

SEQ ID NO: 2663301 - protein, 6 aa, Entamoeba histolytica
TSRESE

SEQ ID NO: 2663302 - protein, 7 aa, Entamoeba histolytica
TSRGKEK

SEQ ID NO: 2663303 - protein, 10 aa, Entamoeba histolytica
TSRGSFEADE

SEQ ID NO: 2663304 - protein, 6 aa, Entamoeba histolytica
TSRIST

SEQ ID NO: 2663305 - protein, 7 aa, Entamoeba histolytica
TSRKEIQ

SEQ ID NO: 2663306 - protein, 5 aa, Entamoeba histolytica
TSRNC

SEQ ID NO: 2663307 - protein, 13 aa, Entamoeba histolytica
TSRQARVQSMLDE

SEQ ID NO: 2663308 - protein, 12 aa, Entamoeba histolytica
TSRQDYSDSESE

SEQ ID NO: 2663309 - protein, 6 aa, Entamoeba histolytica
TSRRSL

SEQ ID NO: 2663310 - protein, 8 aa, Entamoeba histolytica
TSRSCSEE

SEQ ID NO: 2663311 - protein, 4 aa, Entamoeba histolytica
TSSA

SEQ ID NO: 2663312 - protein, 13 aa, Entamoeba histolytica
TSSALKNYKDIYL

SEQ ID NO: 2663313 - protein, 7 aa, Entamoeba histolytica
TSSDDTF

SEQ ID NO: 2663314 - protein, 10 aa, Entamoeba histolytica
TSSDTTSNAI

SEQ ID NO: 2663315 - protein, 11 aa, Entamoeba histolytica
TSSDVSSVTPS

SEQ ID NO: 2663316 - protein, 6 aa, Entamoeba histolytica
TSSDWG

SEQ ID NO: 2663317 - protein, 4 aa, Entamoeba histolytica
TSSE

SEQ ID NO: 2663318 - protein, 16 aa, Entamoeba histolytica
TSSEADRKRSQTITRQ

SEQ ID NO: 2663319 - protein, 8 aa, Entamoeba histolytica
TSSEEGCQ

SEQ ID NO: 2663320 - protein, 8 aa, Entamoeba histolytica
TSSENDPL

SEQ ID NO: 2663321 - protein, 6 aa, Entamoeba histolytica
TSSEPL

SEQ ID NO: 2663322 - protein, 19 aa, Entamoeba histolytica
TSSEPQTTQVTPQKSDNSI

SEQ ID NO: 2663323 - protein, 10 aa, Entamoeba histolytica
TSSEQPDVKK

SEQ ID NO: 2663324 - protein, 6 aa, Entamoeba histolytica
TSSESS

SEQ ID NO: 2663325 - protein, 32 aa, Entamoeba histolytica
TSSFSRQTQQPQQHTQSDLDKQKEKQKREELL

SEQ ID NO: 2663326 - protein, 7 aa, Entamoeba histolytica
TSSGIED

SEQ ID NO: 2663327 - protein, 8 aa, Entamoeba histolytica
TSSGKLCD

SEQ ID NO: 2663328 - protein, 6 aa, Entamoeba histolytica
TSSGKS

SEQ ID NO: 2663329 - protein, 17 aa, Entamoeba histolytica
TSSGSNLSIREENEERI

SEQ ID NO: 2663330 - protein, 7 aa, Entamoeba histolytica
TSSINKK

SEQ ID NO: 2663331 - protein, 9 aa, Entamoeba histolytica
TSSIQNKRD

SEQ ID NO: 2663332 - protein, 5 aa, Entamoeba histolytica
TSSIS

SEQ ID NO: 2663333 - protein, 7 aa, Entamoeba histolytica
TSSKPTI

SEQ ID NO: 2663334 - protein, 9 aa, Entamoeba histolytica
TSSKQGDVF

SEQ ID NO: 2663335 - protein, 7 aa, Entamoeba histolytica
TSSLKED

SEQ ID NO: 2663336 - protein, 9 aa, Entamoeba histolytica
TSSLNKTTL

SEQ ID NO: 2663337 - protein, 8 aa, Entamoeba histolytica
TSSLPIEG

SEQ ID NO: 2663338 - protein, 4 aa, Entamoeba histolytica
TSSN

SEQ ID NO: 2663339 - protein, 7 aa, Entamoeba histolytica
TSSNDID

SEQ ID NO: 2663340 - protein, 9 aa, Entamoeba histolytica
TSSNEKEEI

SEQ ID NO: 2663341 - protein, 17 aa, Entamoeba histolytica
TSSNGTQYKDEDIGKGN

SEQ ID NO: 2663342 - protein, 9 aa, Entamoeba histolytica
TSSNPIKSH

SEQ ID NO: 2663343 - protein, 11 aa, Entamoeba histolytica
TSSNSSNSPIN

SEQ ID NO: 2663344 - protein, 15 aa, Entamoeba histolytica
TSSNVDSGKKTYGGK

SEQ ID NO: 2663345 - protein, 5 aa, Entamoeba histolytica
TSSNY

SEQ ID NO: 2663346 - protein, 7 aa, Entamoeba histolytica
TSSPAVL

SEQ ID NO: 2663347 - protein, 23 aa, Entamoeba histolytica
TSSPIPKRLPTKQEEKYVPPSPK

SEQ ID NO: 2663348 - protein, 4 aa, Entamoeba histolytica
TSSQ

SEQ ID NO: 2663349 - protein, 10 aa, Entamoeba histolytica
TSSQEETISA

SEQ ID NO: 2663350 - protein, 9 aa, Entamoeba histolytica
TSSQPKEPT

SEQ ID NO: 2663351 - protein, 8 aa, Entamoeba histolytica
TSSQQNIP

SEQ ID NO: 2663352 - protein, 13 aa, Entamoeba histolytica
TSSRINQPKIKSD

SEQ ID NO: 2663353 - protein, 9 aa, Entamoeba histolytica
TSSRRSNTK

SEQ ID NO: 2663354 - protein, 20 aa, Entamoeba histolytica
TSSSDDELVDTQYDPSDITQ

SEQ ID NO: 2663355 - protein, 6 aa, Entamoeba histolytica
TSSSEI

SEQ ID NO: 2663356 - protein, 10 aa, Entamoeba histolytica
TSSSESQSEK

SEQ ID NO: 2663357 - protein, 12 aa, Entamoeba histolytica
TSSSIEKKQLNN

SEQ ID NO: 2663358 - protein, 7 aa, Entamoeba histolytica
TSSSIKP

SEQ ID NO: 2663359 - protein, 9 aa, Entamoeba histolytica
TSSSISKKQ

SEQ ID NO: 2663360 - protein, 6 aa, Entamoeba histolytica
TSSSKL

SEQ ID NO: 2663361 - protein, 10 aa, Entamoeba histolytica
TSSSTADGLD

SEQ ID NO: 2663362 - protein, 30 aa, Entamoeba histolytica
TSSSTNCTSDITTPNNSSTSPKVNDLSCQS

SEQ ID NO: 2663363 - protein, 7 aa, Entamoeba histolytica
TSSTITE

SEQ ID NO: 2663364 - protein, 18 aa, Entamoeba histolytica
TSSTPSRPKGNSTSNAPI

SEQ ID NO: 2663365 - protein, 14 aa, Entamoeba histolytica
TSSTTTTNQLGNSS

SEQ ID NO: 2663366 - protein, 6 aa, Entamoeba histolytica
TSSTVV

SEQ ID NO: 2663367 - protein, 24 aa, Entamoeba histolytica
TSSYDVDCEKGTDLITGKSYSGTC

SEQ ID NO: 2663368 - protein, 6 aa, Entamoeba histolytica
TSTAFR

SEQ ID NO: 2663369 - protein, 9 aa, Entamoeba histolytica
TSTAPRSKS

SEQ ID NO: 2663370 - protein, 7 aa, Entamoeba histolytica
TSTATTV

SEQ ID NO: 2663371 - protein, 7 aa, Entamoeba histolytica
TSTDEIN

SEQ ID NO: 2663372 - protein, 13 aa, Entamoeba histolytica
TSTDFDETGHNYY

SEQ ID NO: 2663373 - protein, 12 aa, Entamoeba histolytica
TSTDKESEETFN

SEQ ID NO: 2663374 - protein, 12 aa, Entamoeba histolytica
TSTDLVSKGKQY

SEQ ID NO: 2663375 - protein, 4 aa, Entamoeba histolytica
TSTE

SEQ ID NO: 2663376 - protein, 6 aa, Entamoeba histolytica
TSTIDK

SEQ ID NO: 2663377 - protein, 6 aa, Entamoeba histolytica
TSTINK

SEQ ID NO: 2663378 - protein, 4 aa, Entamoeba histolytica
TSTK

SEQ ID NO: 2663379 - protein, 7 aa, Entamoeba histolytica
TSTKAVH

SEQ ID NO: 2663380 - protein, 5 aa, Entamoeba histolytica
TSTKE

SEQ ID NO: 2663381 - protein, 13 aa, Entamoeba histolytica
TSTKEIDGVEVLD

SEQ ID NO: 2663382 - protein, 8 aa, Entamoeba histolytica
TSTKEYTI

SEQ ID NO: 2663383 - protein, 10 aa, Entamoeba histolytica
TSTKFNKGES

SEQ ID NO: 2663384 - protein, 22 aa, Entamoeba histolytica
TSTKKANNKKHKKTVKKKSTKT

SEQ ID NO: 2663385 - protein, 10 aa, Entamoeba histolytica
TSTKLDDKAS

SEQ ID NO: 2663386 - protein, 6 aa, Entamoeba histolytica
TSTKSQ

SEQ ID NO: 2663387 - protein, 16 aa, Entamoeba histolytica
TSTKTNQDESHEPTHE

SEQ ID NO: 2663388 - protein, 7 aa, Entamoeba histolytica
TSTKYGI

SEQ ID NO: 2663389 - protein, 6 aa, Entamoeba histolytica
TSTKYK

SEQ ID NO: 2663390 - protein, 7 aa, Entamoeba histolytica
TSTLSSY

SEQ ID NO: 2663391 - protein, 7 aa, Entamoeba histolytica
TSTLTQP

SEQ ID NO: 2663392 - protein, 25 aa, Entamoeba histolytica
TSTMGKKFGETSKGFKSAKGKTEQV

SEQ ID NO: 2663393 - protein, 22 aa, Entamoeba histolytica
TSTMTIPNTTTTTTTTNTNTNV

SEQ ID NO: 2663394 - protein, 5 aa, Entamoeba histolytica
TSTNE

SEQ ID NO: 2663395 - protein, 14 aa, Entamoeba histolytica
TSTNEIKEKVPEKK

SEQ ID NO: 2663396 - protein, 8 aa, Entamoeba histolytica
TSTNGSYI

SEQ ID NO: 2663397 - protein, 8 aa, Entamoeba histolytica
TSTNGTYI

SEQ ID NO: 2663398 - protein, 14 aa, Entamoeba histolytica
TSTNINEKINNGYT

SEQ ID NO: 2663399 - protein, 7 aa, Entamoeba histolytica
TSTNKEV

SEQ ID NO: 2663400 - protein, 33 aa, Entamoeba histolytica
TSTNLNSNVHNQNEESTTQPSTQEEKKDSGNSN

SEQ ID NO: 2663401 - protein, 11 aa, Entamoeba histolytica
TSTPKSGTLDE

SEQ ID NO: 2663402 - protein, 15 aa, Entamoeba histolytica
TSTPLPNKGTKVKLE

SEQ ID NO: 2663403 - protein, 11 aa, Entamoeba histolytica
TSTPSTTKNTD

SEQ ID NO: 2663404 - protein, 6 aa, Entamoeba histolytica
TSTQIQ

SEQ ID NO: 2663405 - protein, 6 aa, Entamoeba histolytica
TSTQNR

SEQ ID NO: 2663406 - protein, 6 aa, Entamoeba histolytica
TSTQPY

SEQ ID NO: 2663407 - protein, 23 aa, Entamoeba histolytica
TSTRNEEEKEKDIEKLKEENKTM

SEQ ID NO: 2663408 - protein, 10 aa, Entamoeba histolytica
TSTRRASEST

SEQ ID NO: 2663409 - protein, 14 aa, Entamoeba histolytica
TSTRTKKEKKGNYK

SEQ ID NO: 2663410 - protein, 7 aa, Entamoeba histolytica
TSTSMTA

SEQ ID NO: 2663411 - protein, 15 aa, Entamoeba histolytica
TSTSQENNTSPQSVK

SEQ ID NO: 2663412 - protein, 11 aa, Entamoeba histolytica
TSTSYRSEFDR

SEQ ID NO: 2663413 - protein, 6 aa, Entamoeba histolytica
TSTTKA

SEQ ID NO: 2663414 - protein, 7 aa, Entamoeba histolytica
TSTTKSV

SEQ ID NO: 2663415 - protein, 7 aa, Entamoeba histolytica
TSTTQYP

SEQ ID NO: 2663416 - protein, 6 aa, Entamoeba histolytica
TSTTSG

SEQ ID NO: 2663417 - protein, 11 aa, Entamoeba histolytica
TSTTSTNNSQM

SEQ ID NO: 2663418 - protein, 8 aa, Entamoeba histolytica
TSTVQGQQ

SEQ ID NO: 2663419 - protein, 14 aa, Entamoeba histolytica
TSTVQTKLDAMTNT

SEQ ID NO: 2663420 - protein, 11 aa, Entamoeba histolytica
TSVENTKSQLD

SEQ ID NO: 2663421 - protein, 8 aa, Entamoeba histolytica
TSVEQQPI

SEQ ID NO: 2663422 - protein, 8 aa, Entamoeba histolytica
TSVGGETL

SEQ ID NO: 2663423 - protein, 5 aa, Entamoeba histolytica
TSVGK

SEQ ID NO: 2663424 - protein, 13 aa, Entamoeba histolytica
TSVGSIAGGGRYD

SEQ ID NO: 2663425 - protein, 8 aa, Entamoeba histolytica
TSVKNGGL

SEQ ID NO: 2663426 - protein, 6 aa, Entamoeba histolytica
TSVNEI

SEQ ID NO: 2663427 - protein, 11 aa, Entamoeba histolytica
TSVNGTKTSVC

SEQ ID NO: 2663428 - protein, 22 aa, Entamoeba histolytica
TSVPKNTTAIEPSQSDISIGSG

SEQ ID NO: 2663429 - protein, 9 aa, Entamoeba histolytica
TSVPSPSER

SEQ ID NO: 2663430 - protein, 4 aa, Entamoeba histolytica
TSVQ

SEQ ID NO: 2663431 - protein, 15 aa, Entamoeba histolytica
TSVQKNTSEPKWDQS

SEQ ID NO: 2663432 - protein, 10 aa, Entamoeba histolytica
TSVQTDPQQQ

SEQ ID NO: 2663433 - protein, 6 aa, Entamoeba histolytica
TSVRET

SEQ ID NO: 2663434 - protein, 5 aa, Entamoeba histolytica
TSVSA

SEQ ID NO: 2663435 - protein, 9 aa, Entamoeba histolytica
TSVSKIGDG

SEQ ID NO: 2663436 - protein, 5 aa, Entamoeba histolytica
TSVTK

SEQ ID NO: 2663437 - protein, 5 aa, Entamoeba histolytica
TSVTQ

SEQ ID NO: 2663438 - protein, 6 aa, Entamoeba histolytica
TSVTSI

SEQ ID NO: 2663439 - protein, 8 aa, Entamoeba histolytica
TSYDKTKP

SEQ ID NO: 2663440 - protein, 5 aa, Entamoeba histolytica
TSYEI

SEQ ID NO: 2663441 - protein, 6 aa, Entamoeba histolytica
TSYEKG

SEQ ID NO: 2663442 - protein, 5 aa, Entamoeba histolytica
TSYET

SEQ ID NO: 2663443 - protein, 5 aa, Entamoeba histolytica
TSYIQ

SEQ ID NO: 2663444 - protein, 5 aa, Entamoeba histolytica
TSYIS

SEQ ID NO: 2663445 - protein, 5 aa, Entamoeba histolytica
TSYPG

SEQ ID NO: 2663446 - protein, 6 aa, Entamoeba histolytica
TSYPTQ

SEQ ID NO: 2663447 - protein, 9 aa, Entamoeba histolytica
TSYSDGSPL

SEQ ID NO: 2663448 - protein, 15 aa, Entamoeba histolytica
TSYSTVKSGIPSGGF

SEQ ID NO: 2663449 - protein, 8 aa, Entamoeba histolytica
TSYTSGSI

SEQ ID NO: 2663450 - protein, 6 aa, Entamoeba histolytica
TSYTTQ

SEQ ID NO: 2663451 - protein, 13 aa, Entamoeba histolytica
TTADTIDEDFDSS

SEQ ID NO: 2663452 - protein, 5 aa, Entamoeba histolytica
TTADW

SEQ ID NO: 2663453 - protein, 6 aa, Entamoeba histolytica
TTAENV

SEQ ID NO: 2663454 - protein, 13 aa, Entamoeba histolytica
TTAERKENSSNPI

SEQ ID NO: 2663455 - protein, 7 aa, Entamoeba histolytica
TTAGDIP

SEQ ID NO: 2663456 - protein, 4 aa, Entamoeba histolytica
TTAN

SEQ ID NO: 2663457 - protein, 7 aa, Entamoeba histolytica
TTANEPY

SEQ ID NO: 2663458 - protein, 10 aa, Entamoeba histolytica
TTAPAGEQEM

SEQ ID NO: 2663459 - protein, 12 aa, Entamoeba histolytica
TTAPPPPQQDHQ

SEQ ID NO: 2663460 - protein, 15 aa, Entamoeba histolytica
TTAPTQTNNNSTKDV

SEQ ID NO: 2663461 - protein, 6 aa, Entamoeba histolytica
TTAQIG

SEQ ID NO: 2663462 - protein, 10 aa, Entamoeba histolytica
TTAQLQTVDD

SEQ ID NO: 2663463 - protein, 12 aa, Entamoeba histolytica
TTARFAKDNMDG

SEQ ID NO: 2663464 - protein, 5 aa, Entamoeba histolytica
TTARS

SEQ ID NO: 2663465 - protein, 4 aa, Entamoeba histolytica
TTAS

SEQ ID NO: 2663466 - protein, 5 aa, Entamoeba histolytica
TTATE

SEQ ID NO: 2663467 - protein, 9 aa, Entamoeba histolytica
TTATINSNL

SEQ ID NO: 2663468 - protein, 8 aa, Entamoeba histolytica
TTAVSSRT

SEQ ID NO: 2663469 - protein, 5 aa, Entamoeba histolytica
TTAVT

SEQ ID NO: 2663470 - protein, 7 aa, Entamoeba histolytica
TTCDPGN

SEQ ID NO: 2663471 - protein, 6 aa, Entamoeba histolytica
TTDAER

SEQ ID NO: 2663472 - protein, 5 aa, Entamoeba histolytica
TTDAG

SEQ ID NO: 2663473 - protein, 14 aa, Entamoeba histolytica
TTDDPETVNKQNYP

SEQ ID NO: 2663474 - protein, 12 aa, Entamoeba histolytica
TTDEKNTKVDIR

SEQ ID NO: 2663475 - protein, 6 aa, Entamoeba histolytica
TTDIDS

SEQ ID NO: 2663476 - protein, 11 aa, Entamoeba histolytica
TTDIERTRSAM

SEQ ID NO: 2663477 - protein, 6 aa, Entamoeba histolytica
TTDIGQ

SEQ ID NO: 2663478 - protein, 5 aa, Entamoeba histolytica
TTDIP

SEQ ID NO: 2663479 - protein, 9 aa, Entamoeba histolytica
TTDLDEEDA

SEQ ID NO: 2663480 - protein, 17 aa, Entamoeba histolytica
TTDLKPEEREKIQKQTE

SEQ ID NO: 2663481 - protein, 10 aa, Entamoeba histolytica
TTDLSQNKEV

SEQ ID NO: 2663482 - protein, 5 aa, Entamoeba histolytica
TTDNN

SEQ ID NO: 2663483 - protein, 7 aa, Entamoeba histolytica
TTDPKYP

SEQ ID NO: 2663484 - protein, 10 aa, Entamoeba histolytica
TTDSGEKELE

SEQ ID NO: 2663485 - protein, 9 aa, Entamoeba histolytica
TTDSSFKSD

SEQ ID NO: 2663486 - protein, 7 aa, Entamoeba histolytica
TTDTNSV

SEQ ID NO: 2663487 - protein, 11 aa, Entamoeba histolytica
TTEANARNNGF

SEQ ID NO: 2663488 - protein, 9 aa, Entamoeba histolytica
TTEASNEEI

SEQ ID NO: 2663489 - protein, 6 aa, Entamoeba histolytica
TTEDKQ

SEQ ID NO: 2663490 - protein, 7 aa, Entamoeba histolytica
TTEDVNI

SEQ ID NO: 2663491 - protein, 13 aa, Entamoeba histolytica
TTEEEASKISNEL

SEQ ID NO: 2663492 - protein, 6 aa, Entamoeba histolytica
TTEEED

SEQ ID NO: 2663493 - protein, 6 aa, Entamoeba histolytica
TTEEEE

SEQ ID NO: 2663494 - protein, 31 aa, Entamoeba histolytica
TTEEGELEVEPDESINQSDNEPDRTYQTTPL

SEQ ID NO: 2663495 - protein, 20 aa, Entamoeba histolytica
TTEEIKKEEVSDDSEEFKPF

SEQ ID NO: 2663496 - protein, 10 aa, Entamoeba histolytica
TTEEINKSIE

SEQ ID NO: 2663497 - protein, 6 aa, Entamoeba histolytica
TTEESY

SEQ ID NO: 2663498 - protein, 6 aa, Entamoeba histolytica
TTEEYN

SEQ ID NO: 2663499 - protein, 8 aa, Entamoeba histolytica
TTEGHGTT

SEQ ID NO: 2663500 - protein, 7 aa, Entamoeba histolytica
TTEGYAG

SEQ ID NO: 2663501 - protein, 4 aa, Entamoeba histolytica
TTEI

SEQ ID NO: 2663502 - protein, 6 aa, Entamoeba histolytica
TTEITK

SEQ ID NO: 2663503 - protein, 6 aa, Entamoeba histolytica
TTEKTY

SEQ ID NO: 2663504 - protein, 18 aa, Entamoeba histolytica
TTELSKPQLESPEDDDLP

SEQ ID NO: 2663505 - protein, 5 aa, Entamoeba histolytica
TTENE

SEQ ID NO: 2663506 - protein, 10 aa, Entamoeba histolytica
TTENELENLS

SEQ ID NO: 2663507 - protein, 5 aa, Entamoeba histolytica
TTENG

SEQ ID NO: 2663508 - protein, 50 aa, Entamoeba histolytica
TTENNVENKKELKKLTQNDKDNIKKDSKKEKESTEPSKGNNELTTNQKNL

SEQ ID NO: 2663509 - protein, 6 aa, Entamoeba histolytica
TTENPP

SEQ ID NO: 2663510 - protein, 7 aa, Entamoeba histolytica
TTENPSF

SEQ ID NO: 2663511 - protein, 8 aa, Entamoeba histolytica
TTENPSFE

SEQ ID NO: 2663512 - protein, 4 aa, Entamoeba histolytica
TTEP

SEQ ID NO: 2663513 - protein, 21 aa, Entamoeba histolytica
TTEPNEQNPMLEDTPGEADDA

SEQ ID NO: 2663514 - protein, 6 aa, Entamoeba histolytica
TTEPNN

SEQ ID NO: 2663515 - protein, 6 aa, Entamoeba histolytica
TTEPYF

SEQ ID NO: 2663516 - protein, 6 aa, Entamoeba histolytica
TTEQNN

SEQ ID NO: 2663517 - protein, 6 aa, Entamoeba histolytica
TTEQPI

SEQ ID NO: 2663518 - protein, 9 aa, Entamoeba histolytica
TTEQPIATR

SEQ ID NO: 2663519 - protein, 4 aa, Entamoeba histolytica
TTER

SEQ ID NO: 2663520 - protein, 4 aa, Entamoeba histolytica
TTES

SEQ ID NO: 2663521 - protein, 17 aa, Entamoeba histolytica
TTESSKLYANTTGTSNI

SEQ ID NO: 2663522 - protein, 4 aa, Entamoeba histolytica
TTET

SEQ ID NO: 2663523 - protein, 6 aa, Entamoeba histolytica
TTETDF

SEQ ID NO: 2663524 - protein, 10 aa, Entamoeba histolytica
TTETKKDIES

SEQ ID NO: 2663525 - protein, 8 aa, Entamoeba histolytica
TTETSSGI

SEQ ID NO: 2663526 - protein, 8 aa, Entamoeba histolytica
TTEVQKRK

SEQ ID NO: 2663527 - protein, 8 aa, Entamoeba histolytica
TTFDEKDN

SEQ ID NO: 2663528 - protein, 10 aa, Entamoeba histolytica
TTFEEVEKKN

SEQ ID NO: 2663529 - protein, 6 aa, Entamoeba histolytica
TTFKPN

SEQ ID NO: 2663530 - protein, 4 aa, Entamoeba histolytica
TTFN

SEQ ID NO: 2663531 - protein, 4 aa, Entamoeba histolytica
TTFP

SEQ ID NO: 2663532 - protein, 9 aa, Entamoeba histolytica
TTFPTPLST

SEQ ID NO: 2663533 - protein, 25 aa, Entamoeba histolytica
TTFSNPSDLDGYDELEKTATNSHSN

SEQ ID NO: 2663534 - protein, 25 aa, Entamoeba histolytica
TTFSNPSDLDGYGELEKTANNSHSN

SEQ ID NO: 2663535 - protein, 8 aa, Entamoeba histolytica
TTFSPVDT

SEQ ID NO: 2663536 - protein, 14 aa, Entamoeba histolytica
TTFVPTPEGELQQK

SEQ ID NO: 2663537 - protein, 8 aa, Entamoeba histolytica
TTGASAKV

SEQ ID NO: 2663538 - protein, 24 aa, Entamoeba histolytica
TTGGIKQNRKRRETWTDEERSKFE

SEQ ID NO: 2663539 - protein, 9 aa, Entamoeba histolytica
TTGKKTKEL

SEQ ID NO: 2663540 - protein, 7 aa, Entamoeba histolytica
TTGNKHQ

SEQ ID NO: 2663541 - protein, 4 aa, Entamoeba histolytica
TTGP

SEQ ID NO: 2663542 - protein, 10 aa, Entamoeba histolytica
TTGRGSTAVG

SEQ ID NO: 2663543 - protein, 13 aa, Entamoeba histolytica
TTGSLQNRQEAES

SEQ ID NO: 2663544 - protein, 7 aa, Entamoeba histolytica
TTGSSQF

SEQ ID NO: 2663545 - protein, 6 aa, Entamoeba histolytica
TTGVGA

SEQ ID NO: 2663546 - protein, 4 aa, Entamoeba histolytica
TTHL

SEQ ID NO: 2663547 - protein, 7 aa, Entamoeba histolytica
TTHNGKN

SEQ ID NO: 2663548 - protein, 4 aa, Entamoeba histolytica
TTHP

SEQ ID NO: 2663549 - protein, 6 aa, Entamoeba histolytica
TTHRGE

SEQ ID NO: 2663550 - protein, 5 aa, Entamoeba histolytica
TTHSL

SEQ ID NO: 2663551 - protein, 5 aa, Entamoeba histolytica
TTHSY

SEQ ID NO: 2663552 - protein, 10 aa, Entamoeba histolytica
TTIDDSTKQK

SEQ ID NO: 2663553 - protein, 5 aa, Entamoeba histolytica
TTIDE

SEQ ID NO: 2663554 - protein, 7 aa, Entamoeba histolytica
TTIDNET

SEQ ID NO: 2663555 - protein, 6 aa, Entamoeba histolytica
TTIDPE

SEQ ID NO: 2663556 - protein, 5 aa, Entamoeba histolytica
TTIDQ

SEQ ID NO: 2663557 - protein, 6 aa, Entamoeba histolytica
TTIEDP

SEQ ID NO: 2663558 - protein, 9 aa, Entamoeba histolytica
TTIEEKVNN

SEQ ID NO: 2663559 - protein, 6 aa, Entamoeba histolytica
TTIENG

SEQ ID NO: 2663560 - protein, 20 aa, Entamoeba histolytica
TTIEPNKQKKTSKPIESKKT

SEQ ID NO: 2663561 - protein, 4 aa, Entamoeba histolytica
TTIG

SEQ ID NO: 2663562 - protein, 4 aa, Entamoeba histolytica
TTIN

SEQ ID NO: 2663563 - protein, 4 aa, Entamoeba histolytica
TTIP

SEQ ID NO: 2663564 - protein, 7 aa, Entamoeba histolytica
TTIPIPE

SEQ ID NO: 2663565 - protein, 6 aa, Entamoeba histolytica
TTIPNG

SEQ ID NO: 2663566 - protein, 5 aa, Entamoeba histolytica
TTIQS

SEQ ID NO: 2663567 - protein, 17 aa, Entamoeba histolytica
TTIQSTSSQLKKNDTKP

SEQ ID NO: 2663568 - protein, 4 aa, Entamoeba histolytica
TTIS

SEQ ID NO: 2663569 - protein, 7 aa, Entamoeba histolytica
TTISQSG

SEQ ID NO: 2663570 - protein, 21 aa, Entamoeba histolytica
TTITEKEGTKEDVNTENERLQ

SEQ ID NO: 2663571 - protein, 131 aa, Entamoeba histolytica
TTITNNATSTMPPPPPPPGASSIPPPPPPPGMPGMPPPPPPPGMPGMPPPPPPPGMPGMPPPPPPPGMPGMPPPPPPGMPGMPPPPPGMPGMPPPPPPGMPGMPPPPPGMPGMPPPPPGMPGMPPPPPGGF

SEQ ID NO: 2663572 - protein, 11 aa, Entamoeba histolytica
TTITRTKEQAI

SEQ ID NO: 2663573 - protein, 15 aa, Entamoeba histolytica
TTKADTLVSGSRDKT

SEQ ID NO: 2663574 - protein, 4 aa, Entamoeba histolytica
TTKD

SEQ ID NO: 2663575 - protein, 9 aa, Entamoeba histolytica
TTKDLRNED

SEQ ID NO: 2663576 - protein, 6 aa, Entamoeba histolytica
TTKDND

SEQ ID NO: 2663577 - protein, 13 aa, Entamoeba histolytica
TTKDNKKKKNYTE

SEQ ID NO: 2663578 - protein, 12 aa, Entamoeba histolytica
TTKDRRRYGNEI

SEQ ID NO: 2663579 - protein, 6 aa, Entamoeba histolytica
TTKETY

SEQ ID NO: 2663580 - protein, 4 aa, Entamoeba histolytica
TTKF

SEQ ID NO: 2663581 - protein, 8 aa, Entamoeba histolytica
TTKGETNK

SEQ ID NO: 2663582 - protein, 10 aa, Entamoeba histolytica
TTKGKKGTMK

SEQ ID NO: 2663583 - protein, 13 aa, Entamoeba histolytica
TTKGYREQSVIEE

SEQ ID NO: 2663584 - protein, 4 aa, Entamoeba histolytica
TTKK

SEQ ID NO: 2663585 - protein, 9 aa, Entamoeba histolytica
TTKKAFNDN

SEQ ID NO: 2663586 - protein, 13 aa, Entamoeba histolytica
TTKKNNVTTEDEF

SEQ ID NO: 2663587 - protein, 4 aa, Entamoeba histolytica
TTKM

SEQ ID NO: 2663588 - protein, 4 aa, Entamoeba histolytica
TTKN

SEQ ID NO: 2663589 - protein, 7 aa, Entamoeba histolytica
TTKNPEL

SEQ ID NO: 2663590 - protein, 6 aa, Entamoeba histolytica
TTKNQI

SEQ ID NO: 2663591 - protein, 11 aa, Entamoeba histolytica
TTKPRNKDGFE

SEQ ID NO: 2663592 - protein, 7 aa, Entamoeba histolytica
TTKPSKS

SEQ ID NO: 2663593 - protein, 9 aa, Entamoeba histolytica
TTKQPKTGI

SEQ ID NO: 2663594 - protein, 8 aa, Entamoeba histolytica
TTKQYEKC

SEQ ID NO: 2663595 - protein, 6 aa, Entamoeba histolytica
TTKRAD

SEQ ID NO: 2663596 - protein, 7 aa, Entamoeba histolytica
TTKRQKE

SEQ ID NO: 2663597 - protein, 4 aa, Entamoeba histolytica
TTKS

SEQ ID NO: 2663598 - protein, 6 aa, Entamoeba histolytica
TTKSDL

SEQ ID NO: 2663599 - protein, 8 aa, Entamoeba histolytica
TTKSEYGK

SEQ ID NO: 2663600 - protein, 37 aa, Entamoeba histolytica
TTKSLAPTQFTNETTKLSTNTNESKKDSKKQQEDDNE

SEQ ID NO: 2663601 - protein, 9 aa, Entamoeba histolytica
TTKSPLETI

SEQ ID NO: 2663602 - protein, 15 aa, Entamoeba histolytica
TTKSPNDSSLIGRSK

SEQ ID NO: 2663603 - protein, 8 aa, Entamoeba histolytica
TTKSQNKR

SEQ ID NO: 2663604 - protein, 44 aa, Entamoeba histolytica
TTKTQNDKRLAYTQSSPDTIIESTRKRVSSSKSITNSLTKKERK

SEQ ID NO: 2663605 - protein, 10 aa, Entamoeba histolytica
TTKYEKRGIA

SEQ ID NO: 2663606 - protein, 5 aa, Entamoeba histolytica
TTKYT

SEQ ID NO: 2663607 - protein, 4 aa, Entamoeba histolytica
TTLE

SEQ ID NO: 2663608 - protein, 8 aa, Entamoeba histolytica
TTLEGREQ

SEQ ID NO: 2663609 - protein, 13 aa, Entamoeba histolytica
TTLENELKTPKFE

SEQ ID NO: 2663610 - protein, 13 aa, Entamoeba histolytica
TTLENERKNNNKL

SEQ ID NO: 2663611 - protein, 8 aa, Entamoeba histolytica
TTLEQKST

SEQ ID NO: 2663612 - protein, 12 aa, Entamoeba histolytica
TTLESTDGDISP

SEQ ID NO: 2663613 - protein, 4 aa, Entamoeba histolytica
TTLG

SEQ ID NO: 2663614 - protein, 4 aa, Entamoeba histolytica
TTLH

SEQ ID NO: 2663615 - protein, 12 aa, Entamoeba histolytica
TTLKDAQNEIKE

SEQ ID NO: 2663616 - protein, 10 aa, Entamoeba histolytica
TTLKGKKKKK

SEQ ID NO: 2663617 - protein, 5 aa, Entamoeba histolytica
TTLKS

SEQ ID NO: 2663618 - protein, 10 aa, Entamoeba histolytica
TTLNATAKTV

SEQ ID NO: 2663619 - protein, 5 aa, Entamoeba histolytica
TTLND

SEQ ID NO: 2663620 - protein, 14 aa, Entamoeba histolytica
TTLNDDKKKQSITL

SEQ ID NO: 2663621 - protein, 5 aa, Entamoeba histolytica
TTLPQ

SEQ ID NO: 2663622 - protein, 13 aa, Entamoeba histolytica
TTLPQEDNDNEWV

SEQ ID NO: 2663623 - protein, 4 aa, Entamoeba histolytica
TTLS

SEQ ID NO: 2663624 - protein, 13 aa, Entamoeba histolytica
TTLSDGPSQMNNQ

SEQ ID NO: 2663625 - protein, 11 aa, Entamoeba histolytica
TTMDQTSNQHS

SEQ ID NO: 2663626 - protein, 11 aa, Entamoeba histolytica
TTMNANSSGFY

SEQ ID NO: 2663627 - protein, 5 aa, Entamoeba histolytica
TTNAP

SEQ ID NO: 2663628 - protein, 7 aa, Entamoeba histolytica
TTNDNIT

SEQ ID NO: 2663629 - protein, 7 aa, Entamoeba histolytica
TTNDQEK

SEQ ID NO: 2663630 - protein, 4 aa, Entamoeba histolytica
TTNE

SEQ ID NO: 2663631 - protein, 7 aa, Entamoeba histolytica
TTNEEIN

SEQ ID NO: 2663632 - protein, 7 aa, Entamoeba histolytica
TTNEGDS

SEQ ID NO: 2663633 - protein, 13 aa, Entamoeba histolytica
TTNEKAKRERAKM

SEQ ID NO: 2663634 - protein, 5 aa, Entamoeba histolytica
TTNEM

SEQ ID NO: 2663635 - protein, 5 aa, Entamoeba histolytica
TTNEP

SEQ ID NO: 2663636 - protein, 6 aa, Entamoeba histolytica
TTNGDL

SEQ ID NO: 2663637 - protein, 5 aa, Entamoeba histolytica
TTNGM

SEQ ID NO: 2663638 - protein, 4 aa, Entamoeba histolytica
TTNI

SEQ ID NO: 2663639 - protein, 8 aa, Entamoeba histolytica
TTNKDTSF

SEQ ID NO: 2663640 - protein, 25 aa, Entamoeba histolytica
TTNKEENKENNLSNDIEPKGYTQCS

SEQ ID NO: 2663641 - protein, 14 aa, Entamoeba histolytica
TTNKGEKYQKIDYQ

SEQ ID NO: 2663642 - protein, 5 aa, Entamoeba histolytica
TTNKN

SEQ ID NO: 2663643 - protein, 7 aa, Entamoeba histolytica
TTNKNIP

SEQ ID NO: 2663644 - protein, 14 aa, Entamoeba histolytica
TTNKNQTQQQQTTI

SEQ ID NO: 2663645 - protein, 5 aa, Entamoeba histolytica
TTNKS

SEQ ID NO: 2663646 - protein, 8 aa, Entamoeba histolytica
TTNKSPDI

SEQ ID NO: 2663647 - protein, 7 aa, Entamoeba histolytica
TTNKSSD

SEQ ID NO: 2663648 - protein, 5 aa, Entamoeba histolytica
TTNKT

SEQ ID NO: 2663649 - protein, 4 aa, Entamoeba histolytica
TTNL

SEQ ID NO: 2663650 - protein, 10 aa, Entamoeba histolytica
TTNLSPEGDS

SEQ ID NO: 2663651 - protein, 5 aa, Entamoeba histolytica
TTNND

SEQ ID NO: 2663652 - protein, 6 aa, Entamoeba histolytica
TTNNIE

SEQ ID NO: 2663653 - protein, 7 aa, Entamoeba histolytica
TTNNTKF

SEQ ID NO: 2663654 - protein, 6 aa, Entamoeba histolytica
TTNNTM

SEQ ID NO: 2663655 - protein, 4 aa, Entamoeba histolytica
TTNP

SEQ ID NO: 2663656 - protein, 6 aa, Entamoeba histolytica
TTNPEL

SEQ ID NO: 2663657 - protein, 6 aa, Entamoeba histolytica
TTNPNR

SEQ ID NO: 2663658 - protein, 4 aa, Entamoeba histolytica
TTNQ

SEQ ID NO: 2663659 - protein, 7 aa, Entamoeba histolytica
TTNQSIG

SEQ ID NO: 2663660 - protein, 11 aa, Entamoeba histolytica
TTNTHVKSKEE

SEQ ID NO: 2663661 - protein, 6 aa, Entamoeba histolytica
TTNTIS

SEQ ID NO: 2663662 - protein, 5 aa, Entamoeba histolytica
TTNTK

SEQ ID NO: 2663663 - protein, 7 aa, Entamoeba histolytica
TTNTNIN

SEQ ID NO: 2663664 - protein, 8 aa, Entamoeba histolytica
TTNTPVER

SEQ ID NO: 2663665 - protein, 5 aa, Entamoeba histolytica
TTNTT

SEQ ID NO: 2663666 - protein, 14 aa, Entamoeba histolytica
TTNVEEEKKIGKRN

SEQ ID NO: 2663667 - protein, 5 aa, Entamoeba histolytica
TTNYE

SEQ ID NO: 2663668 - protein, 10 aa, Entamoeba histolytica
TTPARPIPSK

SEQ ID NO: 2663669 - protein, 6 aa, Entamoeba histolytica
TTPDIT

SEQ ID NO: 2663670 - protein, 16 aa, Entamoeba histolytica
TTPEDAEKAAKEIDGK

SEQ ID NO: 2663671 - protein, 7 aa, Entamoeba histolytica
TTPEDKM

SEQ ID NO: 2663672 - protein, 8 aa, Entamoeba histolytica
TTPEKKKG

SEQ ID NO: 2663673 - protein, 21 aa, Entamoeba histolytica
TTPERKPMLSASKRSSLPANV

SEQ ID NO: 2663674 - protein, 4 aa, Entamoeba histolytica
TTPF

SEQ ID NO: 2663675 - protein, 6 aa, Entamoeba histolytica
TTPGYS

SEQ ID NO: 2663676 - protein, 8 aa, Entamoeba histolytica
TTPKPPTT

SEQ ID NO: 2663677 - protein, 9 aa, Entamoeba histolytica
TTPKTPVST

SEQ ID NO: 2663678 - protein, 16 aa, Entamoeba histolytica
TTPLASRSYLQKQQSI

SEQ ID NO: 2663679 - protein, 5 aa, Entamoeba histolytica
TTPLG

SEQ ID NO: 2663680 - protein, 9 aa, Entamoeba histolytica
TTPLPSQKN

SEQ ID NO: 2663681 - protein, 20 aa, Entamoeba histolytica
TTPMNPKQERRSKEAEVSNG

SEQ ID NO: 2663682 - protein, 6 aa, Entamoeba histolytica
TTPNEN

SEQ ID NO: 2663683 - protein, 8 aa, Entamoeba histolytica
TTPNQLNK

SEQ ID NO: 2663684 - protein, 4 aa, Entamoeba histolytica
TTPP

SEQ ID NO: 2663685 - protein, 10 aa, Entamoeba histolytica
TTPPKPGFSQ

SEQ ID NO: 2663686 - protein, 5 aa, Entamoeba histolytica
TTPPP

SEQ ID NO: 2663687 - protein, 13 aa, Entamoeba histolytica
TTPPTKREKHTLG

SEQ ID NO: 2663688 - protein, 9 aa, Entamoeba histolytica
TTPRNSLRR

SEQ ID NO: 2663689 - protein, 60 aa, Entamoeba histolytica
TTPSFSNKPSNGFLNTSSSAPPQTSKLTKTSTSISAPLGNNSSAIADSQISNTSLKKNFQ

SEQ ID NO: 2663690 - protein, 7 aa, Entamoeba histolytica
TTPSGSI

SEQ ID NO: 2663691 - protein, 9 aa, Entamoeba histolytica
TTPSKEITP

SEQ ID NO: 2663692 - protein, 7 aa, Entamoeba histolytica
TTPSLNQ

SEQ ID NO: 2663693 - protein, 6 aa, Entamoeba histolytica
TTPSRE

SEQ ID NO: 2663694 - protein, 4 aa, Entamoeba histolytica
TTPT

SEQ ID NO: 2663695 - protein, 12 aa, Entamoeba histolytica
TTPYNADFDGDE

SEQ ID NO: 2663696 - protein, 6 aa, Entamoeba histolytica
TTPYST

SEQ ID NO: 2663697 - protein, 11 aa, Entamoeba histolytica
TTQDMDEVPAG

SEQ ID NO: 2663698 - protein, 8 aa, Entamoeba histolytica
TTQINEEK

SEQ ID NO: 2663699 - protein, 13 aa, Entamoeba histolytica
TTQKEEKRKLEKG

SEQ ID NO: 2663700 - protein, 9 aa, Entamoeba histolytica
TTQLDSSSI

SEQ ID NO: 2663701 - protein, 14 aa, Entamoeba histolytica
TTQLPGVTSEGNFR

SEQ ID NO: 2663702 - protein, 10 aa, Entamoeba histolytica
TTQMQEATKN

SEQ ID NO: 2663703 - protein, 7 aa, Entamoeba histolytica
TTQNPPS

SEQ ID NO: 2663704 - protein, 10 aa, Entamoeba histolytica
TTQNRPVRYE

SEQ ID NO: 2663705 - protein, 9 aa, Entamoeba histolytica
TTQPPSLQQ

SEQ ID NO: 2663706 - protein, 6 aa, Entamoeba histolytica
TTQPSD

SEQ ID NO: 2663707 - protein, 7 aa, Entamoeba histolytica
TTQQGEI

SEQ ID NO: 2663708 - protein, 9 aa, Entamoeba histolytica
TTQSGNAAG

SEQ ID NO: 2663709 - protein, 29 aa, Entamoeba histolytica
TTQSNGREMEKSQNWKEQIESNKTTQKEI

SEQ ID NO: 2663710 - protein, 4 aa, Entamoeba histolytica
TTQV

SEQ ID NO: 2663711 - protein, 6 aa, Entamoeba histolytica
TTQYND

SEQ ID NO: 2663712 - protein, 4 aa, Entamoeba histolytica
TTRA

SEQ ID NO: 2663713 - protein, 26 aa, Entamoeba histolytica
TTRARRAIKSEEYTQNLDRSTRKEKE

SEQ ID NO: 2663714 - protein, 8 aa, Entamoeba histolytica
TTRGGYRP

SEQ ID NO: 2663715 - protein, 18 aa, Entamoeba histolytica
TTRGSYIGEGKTPLPGQS

SEQ ID NO: 2663716 - protein, 7 aa, Entamoeba histolytica
TTRKEQK

SEQ ID NO: 2663717 - protein, 13 aa, Entamoeba histolytica
TTRKTPCGEGSKT

SEQ ID NO: 2663718 - protein, 14 aa, Entamoeba histolytica
TTRKTPCGEGSKTW

SEQ ID NO: 2663719 - protein, 6 aa, Entamoeba histolytica
TTRKTW

SEQ ID NO: 2663720 - protein, 7 aa, Entamoeba histolytica
TTRLQNG

SEQ ID NO: 2663721 - protein, 5 aa, Entamoeba histolytica
TTRNE

SEQ ID NO: 2663722 - protein, 12 aa, Entamoeba histolytica
TTRNKDKDGSMR

SEQ ID NO: 2663723 - protein, 7 aa, Entamoeba histolytica
TTRPNSN

SEQ ID NO: 2663724 - protein, 16 aa, Entamoeba histolytica
TTRSSHQEYAPGNYSV

SEQ ID NO: 2663725 - protein, 7 aa, Entamoeba histolytica
TTRTTDY

SEQ ID NO: 2663726 - protein, 8 aa, Entamoeba histolytica
TTSDKETI

SEQ ID NO: 2663727 - protein, 11 aa, Entamoeba histolytica
TTSDTIEKTTK

SEQ ID NO: 2663728 - protein, 10 aa, Entamoeba histolytica
TTSEKYCEGE

SEQ ID NO: 2663729 - protein, 11 aa, Entamoeba histolytica
TTSENKEGYSS

SEQ ID NO: 2663730 - protein, 9 aa, Entamoeba histolytica
TTSGNGSEV

SEQ ID NO: 2663731 - protein, 6 aa, Entamoeba histolytica
TTSIDT

SEQ ID NO: 2663732 - protein, 5 aa, Entamoeba histolytica
TTSIE

SEQ ID NO: 2663733 - protein, 7 aa, Entamoeba histolytica
TTSIEDK

SEQ ID NO: 2663734 - protein, 9 aa, Entamoeba histolytica
TTSKDNLVK

SEQ ID NO: 2663735 - protein, 6 aa, Entamoeba histolytica
TTSKFD

SEQ ID NO: 2663736 - protein, 9 aa, Entamoeba histolytica
TTSKGETSE

SEQ ID NO: 2663737 - protein, 8 aa, Entamoeba histolytica
TTSKTKCQ

SEQ ID NO: 2663738 - protein, 9 aa, Entamoeba histolytica
TTSKYPTGH

SEQ ID NO: 2663739 - protein, 7 aa, Entamoeba histolytica
TTSLERR

SEQ ID NO: 2663740 - protein, 8 aa, Entamoeba histolytica
TTSLKSNP

SEQ ID NO: 2663741 - protein, 10 aa, Entamoeba histolytica
TTSLSPKKDS

SEQ ID NO: 2663742 - protein, 17 aa, Entamoeba histolytica
TTSNAMSSSVPSTPTQI

SEQ ID NO: 2663743 - protein, 8 aa, Entamoeba histolytica
TTSNPNMK

SEQ ID NO: 2663744 - protein, 48 aa, Entamoeba histolytica
TTSNTTEHKEQIQTQSNEIKNNLEKDTPPITNKGEQLDQTKTSSLSTE

SEQ ID NO: 2663745 - protein, 9 aa, Entamoeba histolytica
TTSPASVVD

SEQ ID NO: 2663746 - protein, 5 aa, Entamoeba histolytica
TTSPI

SEQ ID NO: 2663747 - protein, 6 aa, Entamoeba histolytica
TTSPLD

SEQ ID NO: 2663748 - protein, 14 aa, Entamoeba histolytica
TTSPNDFKDDEPPI

SEQ ID NO: 2663749 - protein, 7 aa, Entamoeba histolytica
TTSPSDL

SEQ ID NO: 2663750 - protein, 6 aa, Entamoeba histolytica
TTSPVS

SEQ ID NO: 2663751 - protein, 6 aa, Entamoeba histolytica
TTSPYQ

SEQ ID NO: 2663752 - protein, 7 aa, Entamoeba histolytica
TTSQLND

SEQ ID NO: 2663753 - protein, 7 aa, Entamoeba histolytica
TTSRFDV

SEQ ID NO: 2663754 - protein, 11 aa, Entamoeba histolytica
TTSRPSSGNTI

SEQ ID NO: 2663755 - protein, 6 aa, Entamoeba histolytica
TTSSAI

SEQ ID NO: 2663756 - protein, 11 aa, Entamoeba histolytica
TTSSFPSNSTF

SEQ ID NO: 2663757 - protein, 4 aa, Entamoeba histolytica
TTST

SEQ ID NO: 2663758 - protein, 14 aa, Entamoeba histolytica
TTSTESNNGQVGQT

SEQ ID NO: 2663759 - protein, 8 aa, Entamoeba histolytica
TTSTGNKY

SEQ ID NO: 2663760 - protein, 8 aa, Entamoeba histolytica
TTSTPYEQ

SEQ ID NO: 2663761 - protein, 8 aa, Entamoeba histolytica
TTSTSNKY

SEQ ID NO: 2663762 - protein, 9 aa, Entamoeba histolytica
TTSTSSQVD

SEQ ID NO: 2663763 - protein, 22 aa, Entamoeba histolytica
TTSTTTPNFTSSITSKSLSSSY

SEQ ID NO: 2663764 - protein, 8 aa, Entamoeba histolytica
TTSTVSST

SEQ ID NO: 2663765 - protein, 9 aa, Entamoeba histolytica
TTSWKDPRD

SEQ ID NO: 2663766 - protein, 6 aa, Entamoeba histolytica
TTSYDS

SEQ ID NO: 2663767 - protein, 6 aa, Entamoeba histolytica
TTSYNG

SEQ ID NO: 2663768 - protein, 7 aa, Entamoeba histolytica
TTTADQA

SEQ ID NO: 2663769 - protein, 13 aa, Entamoeba histolytica
TTTDCDETEEENF

SEQ ID NO: 2663770 - protein, 6 aa, Entamoeba histolytica
TTTDQN

SEQ ID NO: 2663771 - protein, 10 aa, Entamoeba histolytica
TTTDSDHPGV

SEQ ID NO: 2663772 - protein, 7 aa, Entamoeba histolytica
TTTEDKD

SEQ ID NO: 2663773 - protein, 10 aa, Entamoeba histolytica
TTTEKKKETQ

SEQ ID NO: 2663774 - protein, 5 aa, Entamoeba histolytica
TTTEN

SEQ ID NO: 2663775 - protein, 13 aa, Entamoeba histolytica
TTTGAKGSKVNHS

SEQ ID NO: 2663776 - protein, 6 aa, Entamoeba histolytica
TTTGNT

SEQ ID NO: 2663777 - protein, 4 aa, Entamoeba histolytica
TTTH

SEQ ID NO: 2663778 - protein, 18 aa, Entamoeba histolytica
TTTIDETKTKADSERVKP

SEQ ID NO: 2663779 - protein, 4 aa, Entamoeba histolytica
TTTK

SEQ ID NO: 2663780 - protein, 8 aa, Entamoeba histolytica
TTTLEDKK

SEQ ID NO: 2663781 - protein, 8 aa, Entamoeba histolytica
TTTLPNDV

SEQ ID NO: 2663782 - protein, 5 aa, Entamoeba histolytica
TTTNE

SEQ ID NO: 2663783 - protein, 12 aa, Entamoeba histolytica
TTTNGYEGTGRS

SEQ ID NO: 2663784 - protein, 15 aa, Entamoeba histolytica
TTTNNGGVVTTENPI

SEQ ID NO: 2663785 - protein, 15 aa, Entamoeba histolytica
TTTNQAAFAATEKAE

SEQ ID NO: 2663786 - protein, 15 aa, Entamoeba histolytica
TTTNQGGVVTTDNPI

SEQ ID NO: 2663787 - protein, 16 aa, Entamoeba histolytica
TTTNTEEIQKYSELES

SEQ ID NO: 2663788 - protein, 10 aa, Entamoeba histolytica
TTTPHTNLSK

SEQ ID NO: 2663789 - protein, 5 aa, Entamoeba histolytica
TTTPL

SEQ ID NO: 2663790 - protein, 19 aa, Entamoeba histolytica
TTTPRSSMIKTEKQKNSIK

SEQ ID NO: 2663791 - protein, 6 aa, Entamoeba histolytica
TTTPWS

SEQ ID NO: 2663792 - protein, 25 aa, Entamoeba histolytica
TTTQEQNTTTKKPSKPKEEDTTSKS

SEQ ID NO: 2663793 - protein, 8 aa, Entamoeba histolytica
TTTQQPLS

SEQ ID NO: 2663794 - protein, 8 aa, Entamoeba histolytica
TTTQQRPL

SEQ ID NO: 2663795 - protein, 4 aa, Entamoeba histolytica
TTTR

SEQ ID NO: 2663796 - protein, 5 aa, Entamoeba histolytica
TTTRV

SEQ ID NO: 2663797 - protein, 5 aa, Entamoeba histolytica
TTTSI

SEQ ID NO: 2663798 - protein, 11 aa, Entamoeba histolytica
TTTSTSGPLTT

SEQ ID NO: 2663799 - protein, 5 aa, Entamoeba histolytica
TTTTD

SEQ ID NO: 2663800 - protein, 11 aa, Entamoeba histolytica
TTTTNTPKKLP

SEQ ID NO: 2663801 - protein, 5 aa, Entamoeba histolytica
TTTTP

SEQ ID NO: 2663802 - protein, 21 aa, Entamoeba histolytica
TTTTSEGKNGAMKNESIKSVY

SEQ ID NO: 2663803 - protein, 32 aa, Entamoeba histolytica
TTTVMEEENDDEKTQDEEELKPVDHNQKIKER

SEQ ID NO: 2663804 - protein, 27 aa, Entamoeba histolytica
TTTVPIEKEQKSSKKNKKGKSKKGYET

SEQ ID NO: 2663805 - protein, 11 aa, Entamoeba histolytica
TTTYKKLGEQI

SEQ ID NO: 2663806 - protein, 14 aa, Entamoeba histolytica
TTTYNPNLQTKPTN

SEQ ID NO: 2663807 - protein, 8 aa, Entamoeba histolytica
TTTYNSIQ

SEQ ID NO: 2663808 - protein, 4 aa, Entamoeba histolytica
TTVE

SEQ ID NO: 2663809 - protein, 14 aa, Entamoeba histolytica
TTVEEKYSKKNGFP

SEQ ID NO: 2663810 - protein, 5 aa, Entamoeba histolytica
TTVEF

SEQ ID NO: 2663811 - protein, 7 aa, Entamoeba histolytica
TTVQPRL

SEQ ID NO: 2663812 - protein, 6 aa, Entamoeba histolytica
TTVSEI

SEQ ID NO: 2663813 - protein, 9 aa, Entamoeba histolytica
TTVSEIPSF

SEQ ID NO: 2663814 - protein, 6 aa, Entamoeba histolytica
TTVSTP

SEQ ID NO: 2663815 - protein, 11 aa, Entamoeba histolytica
TTVTNQPEQNT

SEQ ID NO: 2663816 - protein, 14 aa, Entamoeba histolytica
TTYDPDDGEDEYFE

SEQ ID NO: 2663817 - protein, 5 aa, Entamoeba histolytica
TTYGI

SEQ ID NO: 2663818 - protein, 5 aa, Entamoeba histolytica
TTYPS

SEQ ID NO: 2663819 - protein, 5 aa, Entamoeba histolytica
TTYRE

SEQ ID NO: 2663820 - protein, 7 aa, Entamoeba histolytica
TTYSDKI

SEQ ID NO: 2663821 - protein, 6 aa, Entamoeba histolytica
TTYTGA

SEQ ID NO: 2663822 - protein, 10 aa, Entamoeba histolytica
TVAENQEGQI

SEQ ID NO: 2663823 - protein, 6 aa, Entamoeba histolytica
TVAGTG

SEQ ID NO: 2663824 - protein, 6 aa, Entamoeba histolytica
TVAPGR

SEQ ID NO: 2663825 - protein, 8 aa, Entamoeba histolytica
TVAQQDDL

SEQ ID NO: 2663826 - protein, 6 aa, Entamoeba histolytica
TVAYEE

SEQ ID NO: 2663827 - protein, 10 aa, Entamoeba histolytica
TVCETKSLST

SEQ ID NO: 2663828 - protein, 13 aa, Entamoeba histolytica
TVDDHESNSQRKF

SEQ ID NO: 2663829 - protein, 10 aa, Entamoeba histolytica
TVDNKNQGIM

SEQ ID NO: 2663830 - protein, 21 aa, Entamoeba histolytica
TVDPRTTGIKKITSQNEIGSE

SEQ ID NO: 2663831 - protein, 10 aa, Entamoeba histolytica
TVDSERPITD

SEQ ID NO: 2663832 - protein, 8 aa, Entamoeba histolytica
TVDSHKEG

SEQ ID NO: 2663833 - protein, 10 aa, Entamoeba histolytica
TVDSSEVDKA

SEQ ID NO: 2663834 - protein, 9 aa, Entamoeba histolytica
TVEASSAGL

SEQ ID NO: 2663835 - protein, 5 aa, Entamoeba histolytica
TVEGD

SEQ ID NO: 2663836 - protein, 9 aa, Entamoeba histolytica
TVEKDGTKY

SEQ ID NO: 2663837 - protein, 12 aa, Entamoeba histolytica
TVELKKQNESIT

SEQ ID NO: 2663838 - protein, 6 aa, Entamoeba histolytica
TVENEN

SEQ ID NO: 2663839 - protein, 4 aa, Entamoeba histolytica
TVEP

SEQ ID NO: 2663840 - protein, 6 aa, Entamoeba histolytica
TVERHD

SEQ ID NO: 2663841 - protein, 5 aa, Entamoeba histolytica
TVERP

SEQ ID NO: 2663842 - protein, 8 aa, Entamoeba histolytica
TVERPIPS

SEQ ID NO: 2663843 - protein, 5 aa, Entamoeba histolytica
TVETE

SEQ ID NO: 2663844 - protein, 6 aa, Entamoeba histolytica
TVETND

SEQ ID NO: 2663845 - protein, 8 aa, Entamoeba histolytica
TVEVEEDT

SEQ ID NO: 2663846 - protein, 5 aa, Entamoeba histolytica
TVEYQ

SEQ ID NO: 2663847 - protein, 5 aa, Entamoeba histolytica
TVGGG

SEQ ID NO: 2663848 - protein, 15 aa, Entamoeba histolytica
TVGGGVKKNASTHFS

SEQ ID NO: 2663849 - protein, 6 aa, Entamoeba histolytica
TVGKTS

SEQ ID NO: 2663850 - protein, 5 aa, Entamoeba histolytica
TVGNG

SEQ ID NO: 2663851 - protein, 11 aa, Entamoeba histolytica
TVGSDDPLGKA

SEQ ID NO: 2663852 - protein, 13 aa, Entamoeba histolytica
TVGSENSLIGEKT

SEQ ID NO: 2663853 - protein, 12 aa, Entamoeba histolytica
TVGSKIEQTVED

SEQ ID NO: 2663854 - protein, 34 aa, Entamoeba histolytica
TVGSPAVEKPTEHNSLPQKELPKIPTKAVPPLPQ

SEQ ID NO: 2663855 - protein, 7 aa, Entamoeba histolytica
TVGTNRN

SEQ ID NO: 2663856 - protein, 53 aa, Entamoeba histolytica
TVKESENVKDVKDIQQENIKTETKEIIQPKQKTTQIQKEEKKVDGNKEESDYY

SEQ ID NO: 2663857 - protein, 8 aa, Entamoeba histolytica
TVKGGSSK

SEQ ID NO: 2663858 - protein, 7 aa, Entamoeba histolytica
TVKKEYT

SEQ ID NO: 2663859 - protein, 9 aa, Entamoeba histolytica
TVKKNRSEA

SEQ ID NO: 2663860 - protein, 5 aa, Entamoeba histolytica
TVKPL

SEQ ID NO: 2663861 - protein, 9 aa, Entamoeba histolytica
TVKSDNQVT

SEQ ID NO: 2663862 - protein, 6 aa, Entamoeba histolytica
TVKSES

SEQ ID NO: 2663863 - protein, 7 aa, Entamoeba histolytica
TVKTKEE

SEQ ID NO: 2663864 - protein, 7 aa, Entamoeba histolytica
TVLPSTV

SEQ ID NO: 2663865 - protein, 5 aa, Entamoeba histolytica
TVNDS

SEQ ID NO: 2663866 - protein, 28 aa, Entamoeba histolytica
TVNEKTEKFKRTSIPRTSFSSRGSVDDF

SEQ ID NO: 2663867 - protein, 7 aa, Entamoeba histolytica
TVNGKPY

SEQ ID NO: 2663868 - protein, 11 aa, Entamoeba histolytica
TVNGTPSSDGK

SEQ ID NO: 2663869 - protein, 14 aa, Entamoeba histolytica
TVNKSSSKLTKQSL

SEQ ID NO: 2663870 - protein, 10 aa, Entamoeba histolytica
TVNNPQTEIP

SEQ ID NO: 2663871 - protein, 5 aa, Entamoeba histolytica
TVNPV

SEQ ID NO: 2663872 - protein, 8 aa, Entamoeba histolytica
TVNQQAYR

SEQ ID NO: 2663873 - protein, 8 aa, Entamoeba histolytica
TVNRGSDL

SEQ ID NO: 2663874 - protein, 14 aa, Entamoeba histolytica
TVNTDEYVVIDLLY

SEQ ID NO: 2663875 - protein, 20 aa, Entamoeba histolytica
TVNTEVSKSDITKHKSQNDL

SEQ ID NO: 2663876 - protein, 9 aa, Entamoeba histolytica
TVNTKKSNK

SEQ ID NO: 2663877 - protein, 16 aa, Entamoeba histolytica
TVPCENNSTRVEIDSD

SEQ ID NO: 2663878 - protein, 5 aa, Entamoeba histolytica
TVPKK

SEQ ID NO: 2663879 - protein, 5 aa, Entamoeba histolytica
TVPPI

SEQ ID NO: 2663880 - protein, 29 aa, Entamoeba histolytica
TVPPPLSPYGTVPAPATPYHSPYPYGYNP

SEQ ID NO: 2663881 - protein, 7 aa, Entamoeba histolytica
TVPPSVT

SEQ ID NO: 2663882 - protein, 14 aa, Entamoeba histolytica
TVPSSPLRKKTKEL

SEQ ID NO: 2663883 - protein, 6 aa, Entamoeba histolytica
TVPSTV

SEQ ID NO: 2663884 - protein, 4 aa, Entamoeba histolytica
TVPT

SEQ ID NO: 2663885 - protein, 7 aa, Entamoeba histolytica
TVQESSL

SEQ ID NO: 2663886 - protein, 7 aa, Entamoeba histolytica
TVQKGNE

SEQ ID NO: 2663887 - protein, 56 aa, Entamoeba histolytica
TVQPNEIKDEKQNEEKIVSEKKKLKEKVKKEKKPKKNDDKKKVKKPKKVHKEQIEE

SEQ ID NO: 2663888 - protein, 11 aa, Entamoeba histolytica
TVQSKQQEEEI

SEQ ID NO: 2663889 - protein, 8 aa, Entamoeba histolytica
TVREKKNI

SEQ ID NO: 2663890 - protein, 5 aa, Entamoeba histolytica
TVRGG

SEQ ID NO: 2663891 - protein, 6 aa, Entamoeba histolytica
TVRKGD

SEQ ID NO: 2663892 - protein, 8 aa, Entamoeba histolytica
TVRKKDRS

SEQ ID NO: 2663893 - protein, 5 aa, Entamoeba histolytica
TVRRG

SEQ ID NO: 2663894 - protein, 9 aa, Entamoeba histolytica
TVSDNETAG

SEQ ID NO: 2663895 - protein, 5 aa, Entamoeba histolytica
TVSEG

SEQ ID NO: 2663896 - protein, 7 aa, Entamoeba histolytica
TVSETQV

SEQ ID NO: 2663897 - protein, 12 aa, Entamoeba histolytica
TVSEVPQSDIHQ

SEQ ID NO: 2663898 - protein, 14 aa, Entamoeba histolytica
TVSGGGKSEISKNI

SEQ ID NO: 2663899 - protein, 8 aa, Entamoeba histolytica
TVSGIRGQ

SEQ ID NO: 2663900 - protein, 19 aa, Entamoeba histolytica
TVSLEESQHKEEQNGSMTI

SEQ ID NO: 2663901 - protein, 6 aa, Entamoeba histolytica
TVSNEE

SEQ ID NO: 2663902 - protein, 6 aa, Entamoeba histolytica
TVSNVD

SEQ ID NO: 2663903 - protein, 7 aa, Entamoeba histolytica
TVSPANE

SEQ ID NO: 2663904 - protein, 25 aa, Entamoeba histolytica
TVSSERVSNSQKDEEKRTIKKKKPL

SEQ ID NO: 2663905 - protein, 8 aa, Entamoeba histolytica
TVSSNSLE

SEQ ID NO: 2663906 - protein, 13 aa, Entamoeba histolytica
TVSSYSSETFGNP

SEQ ID NO: 2663907 - protein, 4 aa, Entamoeba histolytica
TVST

SEQ ID NO: 2663908 - protein, 12 aa, Entamoeba histolytica
TVSTQPTKKKGF

SEQ ID NO: 2663909 - protein, 4 aa, Entamoeba histolytica
TVTE

SEQ ID NO: 2663910 - protein, 10 aa, Entamoeba histolytica
TVTESTTSQV

SEQ ID NO: 2663911 - protein, 14 aa, Entamoeba histolytica
TVTGGLNGRPEKLP

SEQ ID NO: 2663912 - protein, 5 aa, Entamoeba histolytica
TVTGK

SEQ ID NO: 2663913 - protein, 12 aa, Entamoeba histolytica
TVTGKKALYNKE

SEQ ID NO: 2663914 - protein, 6 aa, Entamoeba histolytica
TVTIPS

SEQ ID NO: 2663915 - protein, 6 aa, Entamoeba histolytica
TVTIRS

SEQ ID NO: 2663916 - protein, 5 aa, Entamoeba histolytica
TVTNL

SEQ ID NO: 2663917 - protein, 5 aa, Entamoeba histolytica
TVTNR

SEQ ID NO: 2663918 - protein, 8 aa, Entamoeba histolytica
TVTPKLPR

SEQ ID NO: 2663919 - protein, 8 aa, Entamoeba histolytica
TVTPSTQT

SEQ ID NO: 2663920 - protein, 6 aa, Entamoeba histolytica
TVTRPG

SEQ ID NO: 2663921 - protein, 5 aa, Entamoeba histolytica
TVTSE

SEQ ID NO: 2663922 - protein, 18 aa, Entamoeba histolytica
TVTSMKDPYQSVEGSITT

SEQ ID NO: 2663923 - protein, 11 aa, Entamoeba histolytica
TVTSPMMNNSD

SEQ ID NO: 2663924 - protein, 6 aa, Entamoeba histolytica
TVTSRK

SEQ ID NO: 2663925 - protein, 5 aa, Entamoeba histolytica
TVTSS

SEQ ID NO: 2663926 - protein, 11 aa, Entamoeba histolytica
TVVDRPKNIGF

SEQ ID NO: 2663927 - protein, 30 aa, Entamoeba histolytica
TVVQSETKVSPSTRRPLPSLPRNYSQQSIE

SEQ ID NO: 2663928 - protein, 10 aa, Entamoeba histolytica
TVYPTETKTQ

SEQ ID NO: 2663929 - protein, 10 aa, Entamoeba histolytica
TWNDHPDANN

SEQ ID NO: 2663930 - protein, 5 aa, Entamoeba histolytica
TWPEI

SEQ ID NO: 2663931 - protein, 9 aa, Entamoeba histolytica
TWRENKGLT

SEQ ID NO: 2663932 - protein, 11 aa, Entamoeba histolytica
TWSDEKPENQF

SEQ ID NO: 2663933 - protein, 5 aa, Entamoeba histolytica
TWSPQ

SEQ ID NO: 2663934 - protein, 5 aa, Entamoeba histolytica
TYAGQ

SEQ ID NO: 2663935 - protein, 7 aa, Entamoeba histolytica
TYDEDQQ

SEQ ID NO: 2663936 - protein, 5 aa, Entamoeba histolytica
TYDEE

SEQ ID NO: 2663937 - protein, 6 aa, Entamoeba histolytica
TYDEKA

SEQ ID NO: 2663938 - protein, 5 aa, Entamoeba histolytica
TYDEL

SEQ ID NO: 2663939 - protein, 8 aa, Entamoeba histolytica
TYDKENDQ

SEQ ID NO: 2663940 - protein, 7 aa, Entamoeba histolytica
TYDKTKS

SEQ ID NO: 2663941 - protein, 5 aa, Entamoeba histolytica
TYDPE

SEQ ID NO: 2663942 - protein, 19 aa, Entamoeba histolytica
TYDQEDDQEDSDLPNPEYH

SEQ ID NO: 2663943 - protein, 4 aa, Entamoeba histolytica
TYDV

SEQ ID NO: 2663944 - protein, 4 aa, Entamoeba histolytica
TYEE

SEQ ID NO: 2663945 - protein, 5 aa, Entamoeba histolytica
TYEIS

SEQ ID NO: 2663946 - protein, 5 aa, Entamoeba histolytica
TYETV

SEQ ID NO: 2663947 - protein, 11 aa, Entamoeba histolytica
TYFEGSNNDGY

SEQ ID NO: 2663948 - protein, 7 aa, Entamoeba histolytica
TYGEIGK

SEQ ID NO: 2663949 - protein, 9 aa, Entamoeba histolytica
TYGEKKLSD

SEQ ID NO: 2663950 - protein, 10 aa, Entamoeba histolytica
TYGEKKLTDL

SEQ ID NO: 2663951 - protein, 4 aa, Entamoeba histolytica
TYGF

SEQ ID NO: 2663952 - protein, 4 aa, Entamoeba histolytica
TYGG

SEQ ID NO: 2663953 - protein, 6 aa, Entamoeba histolytica
TYGGGN

SEQ ID NO: 2663954 - protein, 5 aa, Entamoeba histolytica
TYGNY

SEQ ID NO: 2663955 - protein, 6 aa, Entamoeba histolytica
TYGSET

SEQ ID NO: 2663956 - protein, 10 aa, Entamoeba histolytica
TYHNSTRETL

SEQ ID NO: 2663957 - protein, 6 aa, Entamoeba histolytica
TYHQNL

SEQ ID NO: 2663958 - protein, 6 aa, Entamoeba histolytica
TYIRSG

SEQ ID NO: 2663959 - protein, 5 aa, Entamoeba histolytica
TYKED

SEQ ID NO: 2663960 - protein, 6 aa, Entamoeba histolytica
TYKEEE

SEQ ID NO: 2663961 - protein, 5 aa, Entamoeba histolytica
TYKEQ

SEQ ID NO: 2663962 - protein, 17 aa, Entamoeba histolytica
TYKGPSGVSSIGTIAKS

SEQ ID NO: 2663963 - protein, 6 aa, Entamoeba histolytica
TYKNGS

SEQ ID NO: 2663964 - protein, 4 aa, Entamoeba histolytica
TYKP

SEQ ID NO: 2663965 - protein, 5 aa, Entamoeba histolytica
TYKPE

SEQ ID NO: 2663966 - protein, 17 aa, Entamoeba histolytica
TYKQKSDQILKWKRNKL

SEQ ID NO: 2663967 - protein, 6 aa, Entamoeba histolytica
TYKRGV

SEQ ID NO: 2663968 - protein, 5 aa, Entamoeba histolytica
TYKSR

SEQ ID NO: 2663969 - protein, 7 aa, Entamoeba histolytica
TYLSTGK

SEQ ID NO: 2663970 - protein, 6 aa, Entamoeba histolytica
TYLTED

SEQ ID NO: 2663971 - protein, 14 aa, Entamoeba histolytica
TYNGDAYLMIWNSV

SEQ ID NO: 2663972 - protein, 10 aa, Entamoeba histolytica
TYNGPNSPIG

SEQ ID NO: 2663973 - protein, 8 aa, Entamoeba histolytica
TYNKQGTL

SEQ ID NO: 2663974 - protein, 10 aa, Entamoeba histolytica
TYNLPKQSKL

SEQ ID NO: 2663975 - protein, 8 aa, Entamoeba histolytica
TYNPEYQP

SEQ ID NO: 2663976 - protein, 12 aa, Entamoeba histolytica
TYNQEKAVASGN

SEQ ID NO: 2663977 - protein, 8 aa, Entamoeba histolytica
TYNTNPSL

SEQ ID NO: 2663978 - protein, 6 aa, Entamoeba histolytica
TYNYSS

SEQ ID NO: 2663979 - protein, 4 aa, Entamoeba histolytica
TYPD

SEQ ID NO: 2663980 - protein, 7 aa, Entamoeba histolytica
TYPDQMS

SEQ ID NO: 2663981 - protein, 21 aa, Entamoeba histolytica
TYPFRDGKKIGNPICDKGKGA

SEQ ID NO: 2663982 - protein, 5 aa, Entamoeba histolytica
TYPGY

SEQ ID NO: 2663983 - protein, 8 aa, Entamoeba histolytica
TYPNPIKE

SEQ ID NO: 2663984 - protein, 16 aa, Entamoeba histolytica
TYPPPNVPTYTDIYKM

SEQ ID NO: 2663985 - protein, 5 aa, Entamoeba histolytica
TYPPY

SEQ ID NO: 2663986 - protein, 6 aa, Entamoeba histolytica
TYPQEN

SEQ ID NO: 2663987 - protein, 5 aa, Entamoeba histolytica
TYQEE

SEQ ID NO: 2663988 - protein, 20 aa, Entamoeba histolytica
TYQEQKQDDHSLSSATELSQ

SEQ ID NO: 2663989 - protein, 12 aa, Entamoeba histolytica
TYQQEEIDERDG

SEQ ID NO: 2663990 - protein, 5 aa, Entamoeba histolytica
TYQQN

SEQ ID NO: 2663991 - protein, 5 aa, Entamoeba histolytica
TYQQY

SEQ ID NO: 2663992 - protein, 11 aa, Entamoeba histolytica
TYQTNTINSQI

SEQ ID NO: 2663993 - protein, 7 aa, Entamoeba histolytica
TYSDDPY

SEQ ID NO: 2663994 - protein, 8 aa, Entamoeba histolytica
TYSDSKHI

SEQ ID NO: 2663995 - protein, 11 aa, Entamoeba histolytica
TYSDTNKMNAQ

SEQ ID NO: 2663996 - protein, 5 aa, Entamoeba histolytica
TYSER

SEQ ID NO: 2663997 - protein, 9 aa, Entamoeba histolytica
TYSESNEEY

SEQ ID NO: 2663998 - protein, 44 aa, Entamoeba histolytica
TYSHSSSHSLSHSSSHSAASSCQRSRSHSKPSSTSNSRKNSLSF

SEQ ID NO: 2663999 - protein, 4 aa, Entamoeba histolytica
TYSP

SEQ ID NO: 2664000 - protein, 9 aa, Entamoeba histolytica
TYSTNTEAL

SEQ ID NO: 2664001 - protein, 10 aa, Entamoeba histolytica
TYSVEGTEEI

SEQ ID NO: 2664002 - protein, 6 aa, Entamoeba histolytica
TYSYRK

SEQ ID NO: 2664003 - protein, 7 aa, Entamoeba histolytica
TYTEEDR

SEQ ID NO: 2664004 - protein, 12 aa, Entamoeba histolytica
TYTEHAKRRTVT

SEQ ID NO: 2664005 - protein, 5 aa, Entamoeba histolytica
TYTEK

SEQ ID NO: 2664006 - protein, 9 aa, Entamoeba histolytica
TYTIDNGNY

SEQ ID NO: 2664007 - protein, 18 aa, Entamoeba histolytica
TYTNPTLDDSKSHSTNVK

SEQ ID NO: 2664008 - protein, 5 aa, Entamoeba histolytica
TYTPT

SEQ ID NO: 2664009 - protein, 6 aa, Entamoeba histolytica
TYTSDQ

SEQ ID NO: 2664010 - protein, 6 aa, Entamoeba histolytica
TYTSEG

SEQ ID NO: 2664011 - protein, 11 aa, Entamoeba histolytica
VAAAPAESDTY

SEQ ID NO: 2664012 - protein, 17 aa, Entamoeba histolytica
VAAGGADQVSSVSPSHY

SEQ ID NO: 2664013 - protein, 10 aa, Entamoeba histolytica
VAAGGQLTTT

SEQ ID NO: 2664014 - protein, 4 aa, Entamoeba histolytica
VAAN

SEQ ID NO: 2664015 - protein, 13 aa, Entamoeba histolytica
VAASSEASSANEL

SEQ ID NO: 2664016 - protein, 11 aa, Entamoeba histolytica
VADNKKMTKTL

SEQ ID NO: 2664017 - protein, 54 aa, Entamoeba histolytica
VADSFNDSTEIPQEQPQQEDNKTTSKIIQTPQSTEENNEKNQSQTITDPTTAGV

SEQ ID NO: 2664018 - protein, 20 aa, Entamoeba histolytica
VADTSTSDTDVSEPNEPIEG

SEQ ID NO: 2664019 - protein, 8 aa, Entamoeba histolytica
VAEAVKDD

SEQ ID NO: 2664020 - protein, 16 aa, Entamoeba histolytica
VAEDYGQFEHTGDRKF

SEQ ID NO: 2664021 - protein, 11 aa, Entamoeba histolytica
VAEEDTKTIPE

SEQ ID NO: 2664022 - protein, 22 aa, Entamoeba histolytica
VAEEHTISTATTEAPKQSFTEN

SEQ ID NO: 2664023 - protein, 6 aa, Entamoeba histolytica
VAEENG

SEQ ID NO: 2664024 - protein, 9 aa, Entamoeba histolytica
VAEKGKTDN

SEQ ID NO: 2664025 - protein, 7 aa, Entamoeba histolytica
VAEPADG

SEQ ID NO: 2664026 - protein, 10 aa, Entamoeba histolytica
VAEQSDNIGQ

SEQ ID NO: 2664027 - protein, 17 aa, Entamoeba histolytica
VAERGQKIDKQKEEITK

SEQ ID NO: 2664028 - protein, 36 aa, Entamoeba histolytica
VAERKRQLQERMEEEEKQREEEFKRQEAEEREHAER

SEQ ID NO: 2664029 - protein, 7 aa, Entamoeba histolytica
VAETKGH

SEQ ID NO: 2664030 - protein, 6 aa, Entamoeba histolytica
VAETSI

SEQ ID NO: 2664031 - protein, 18 aa, Entamoeba histolytica
VAETSPKTTDVSEPNIPI

SEQ ID NO: 2664032 - protein, 7 aa, Entamoeba histolytica
VAGDASV

SEQ ID NO: 2664033 - protein, 8 aa, Entamoeba histolytica
VAGDQQAS

SEQ ID NO: 2664034 - protein, 7 aa, Entamoeba histolytica
VAGENES

SEQ ID NO: 2664035 - protein, 4 aa, Entamoeba histolytica
VAGF

SEQ ID NO: 2664036 - protein, 17 aa, Entamoeba histolytica
VAGGVSQTTSTRRYEKN

SEQ ID NO: 2664037 - protein, 4 aa, Entamoeba histolytica
VAGK

SEQ ID NO: 2664038 - protein, 12 aa, Entamoeba histolytica
VAGKSGIEQEEQ

SEQ ID NO: 2664039 - protein, 17 aa, Entamoeba histolytica
VAGQEITTTFGKTDETI

SEQ ID NO: 2664040 - protein, 6 aa, Entamoeba histolytica
VAGRGG

SEQ ID NO: 2664041 - protein, 10 aa, Entamoeba histolytica
VAGRTSVSNK

SEQ ID NO: 2664042 - protein, 5 aa, Entamoeba histolytica
VAGRY

SEQ ID NO: 2664043 - protein, 7 aa, Entamoeba histolytica
VAGSDIT

SEQ ID NO: 2664044 - protein, 10 aa, Entamoeba histolytica
VAISNNKQTV

SEQ ID NO: 2664045 - protein, 10 aa, Entamoeba histolytica
VAKAKDEVYR

SEQ ID NO: 2664046 - protein, 8 aa, Entamoeba histolytica
VAKEQNVP

SEQ ID NO: 2664047 - protein, 9 aa, Entamoeba histolytica
VAKESKANF

SEQ ID NO: 2664048 - protein, 13 aa, Entamoeba histolytica
VAKGKRPNFDPDF

SEQ ID NO: 2664049 - protein, 9 aa, Entamoeba histolytica
VAKKERKGR

SEQ ID NO: 2664050 - protein, 10 aa, Entamoeba histolytica
VAKNENQNDV

SEQ ID NO: 2664051 - protein, 24 aa, Entamoeba histolytica
VAKPQRSKATSSLIRTGDETGQPV

SEQ ID NO: 2664052 - protein, 4 aa, Entamoeba histolytica
VALG

SEQ ID NO: 2664053 - protein, 7 aa, Entamoeba histolytica
VANETSA

SEQ ID NO: 2664054 - protein, 5 aa, Entamoeba histolytica
VANPE

SEQ ID NO: 2664055 - protein, 5 aa, Entamoeba histolytica
VANSK

SEQ ID NO: 2664056 - protein, 11 aa, Entamoeba histolytica
VANSSNEANQE

SEQ ID NO: 2664057 - protein, 7 aa, Entamoeba histolytica
VANTNDT

SEQ ID NO: 2664058 - protein, 8 aa, Entamoeba histolytica
VANTRQQS

SEQ ID NO: 2664059 - protein, 4 aa, Entamoeba histolytica
VAPE

SEQ ID NO: 2664060 - protein, 5 aa, Entamoeba histolytica
VAPGK

SEQ ID NO: 2664061 - protein, 7 aa, Entamoeba histolytica
VAPHEKD

SEQ ID NO: 2664062 - protein, 13 aa, Entamoeba histolytica
VAPPPPPPPSTAS

SEQ ID NO: 2664063 - protein, 29 aa, Entamoeba histolytica
VAPPPPPPTAIPKDVPPAAAEKLSSGGMG

SEQ ID NO: 2664064 - protein, 42 aa, Entamoeba histolytica
VAPRAKMNQQRSRRFKSAKDAENAELKHAEENRNKVRNGLPE

SEQ ID NO: 2664065 - protein, 36 aa, Entamoeba histolytica
VAPRAKMNQQRSRRFKSAKDAENAELRQAEDNKKRL

SEQ ID NO: 2664066 - protein, 18 aa, Entamoeba histolytica
VAPRAKMNQQRSRRFKTA

SEQ ID NO: 2664067 - protein, 19 aa, Entamoeba histolytica
VAPRSVYTTGKGSSGAGLT

SEQ ID NO: 2664068 - protein, 5 aa, Entamoeba histolytica
VAPSG

SEQ ID NO: 2664069 - protein, 8 aa, Entamoeba histolytica
VAPSITEM

SEQ ID NO: 2664070 - protein, 13 aa, Entamoeba histolytica
VAPTPRPMSTTQH

SEQ ID NO: 2664071 - protein, 7 aa, Entamoeba histolytica
VAPTTGH

SEQ ID NO: 2664072 - protein, 12 aa, Entamoeba histolytica
VAQESNRRKTLS

SEQ ID NO: 2664073 - protein, 15 aa, Entamoeba histolytica
VAQQPPYPKMPSSLP

SEQ ID NO: 2664074 - protein, 22 aa, Entamoeba histolytica
VAQSDTEKKEIQRKYNKQISDV

SEQ ID NO: 2664075 - protein, 15 aa, Entamoeba histolytica
VARGAALKASNKTQI

SEQ ID NO: 2664076 - protein, 6 aa, Entamoeba histolytica
VARRSS

SEQ ID NO: 2664077 - protein, 5 aa, Entamoeba histolytica
VARSD

SEQ ID NO: 2664078 - protein, 4 aa, Entamoeba histolytica
VASE

SEQ ID NO: 2664079 - protein, 5 aa, Entamoeba histolytica
VASEQ

SEQ ID NO: 2664080 - protein, 9 aa, Entamoeba histolytica
VASGSDENF

SEQ ID NO: 2664081 - protein, 5 aa, Entamoeba histolytica
VASHS

SEQ ID NO: 2664082 - protein, 14 aa, Entamoeba histolytica
VASKTDRRKQSLQT

SEQ ID NO: 2664083 - protein, 8 aa, Entamoeba histolytica
VASPSNKE

SEQ ID NO: 2664084 - protein, 6 aa, Entamoeba histolytica
VASQQN

SEQ ID NO: 2664085 - protein, 12 aa, Entamoeba histolytica
VASQVTQEGQSV

SEQ ID NO: 2664086 - protein, 4 aa, Entamoeba histolytica
VASS

SEQ ID NO: 2664087 - protein, 7 aa, Entamoeba histolytica
VASSKER

SEQ ID NO: 2664088 - protein, 15 aa, Entamoeba histolytica
VASYKGCPSVILNII

SEQ ID NO: 2664089 - protein, 9 aa, Entamoeba histolytica
VATEADSTF

SEQ ID NO: 2664090 - protein, 7 aa, Entamoeba histolytica
VATEEKK

SEQ ID NO: 2664091 - protein, 8 aa, Entamoeba histolytica
VATESKSN

SEQ ID NO: 2664092 - protein, 7 aa, Entamoeba histolytica
VATGKTA

SEQ ID NO: 2664093 - protein, 6 aa, Entamoeba histolytica
VATSGA

SEQ ID NO: 2664094 - protein, 5 aa, Entamoeba histolytica
VATSI

SEQ ID NO: 2664095 - protein, 8 aa, Entamoeba histolytica
VATSISGK

SEQ ID NO: 2664096 - protein, 10 aa, Entamoeba histolytica
VCDGTKQNDI

SEQ ID NO: 2664097 - protein, 11 aa, Entamoeba histolytica
VCESENNRTRI

SEQ ID NO: 2664098 - protein, 4 aa, Entamoeba histolytica
VCGE

SEQ ID NO: 2664099 - protein, 7 aa, Entamoeba histolytica
VCPNAQD

SEQ ID NO: 2664100 - protein, 6 aa, Entamoeba histolytica
VCPQPV

SEQ ID NO: 2664101 - protein, 9 aa, Entamoeba histolytica
VCTKTSDGK

SEQ ID NO: 2664102 - protein, 5 aa, Entamoeba histolytica
VDAKK

SEQ ID NO: 2664103 - protein, 6 aa, Entamoeba histolytica
VDALNQ

SEQ ID NO: 2664104 - protein, 14 aa, Entamoeba histolytica
VDAPADGEKHNKND

SEQ ID NO: 2664105 - protein, 5 aa, Entamoeba histolytica
VDAPG

SEQ ID NO: 2664106 - protein, 14 aa, Entamoeba histolytica
VDARDEIAKEIGDE

SEQ ID NO: 2664107 - protein, 8 aa, Entamoeba histolytica
VDASGKAL

SEQ ID NO: 2664108 - protein, 4 aa, Entamoeba histolytica
VDDA

SEQ ID NO: 2664109 - protein, 13 aa, Entamoeba histolytica
VDDDEAIETMNGE

SEQ ID NO: 2664110 - protein, 27 aa, Entamoeba histolytica
VDDEDDDESNEEINTISEDDTERNNPL

SEQ ID NO: 2664111 - protein, 11 aa, Entamoeba histolytica
VDDENGENVGD

SEQ ID NO: 2664112 - protein, 11 aa, Entamoeba histolytica
VDDGEEKREIS

SEQ ID NO: 2664113 - protein, 5 aa, Entamoeba histolytica
VDDGN

SEQ ID NO: 2664114 - protein, 6 aa, Entamoeba histolytica
VDDITT

SEQ ID NO: 2664115 - protein, 14 aa, Entamoeba histolytica
VDDKSAEIQTIQLN

SEQ ID NO: 2664116 - protein, 4 aa, Entamoeba histolytica
VDDN

SEQ ID NO: 2664117 - protein, 8 aa, Entamoeba histolytica
VDDNKKRE

SEQ ID NO: 2664118 - protein, 5 aa, Entamoeba histolytica
VDDSN

SEQ ID NO: 2664119 - protein, 21 aa, Entamoeba histolytica
VDDSSSDNEIITKSTNNQTKG

SEQ ID NO: 2664120 - protein, 6 aa, Entamoeba histolytica
VDDVES

SEQ ID NO: 2664121 - protein, 4 aa, Entamoeba histolytica
VDDY

SEQ ID NO: 2664122 - protein, 10 aa, Entamoeba histolytica
VDEAKQKDAI

SEQ ID NO: 2664123 - protein, 18 aa, Entamoeba histolytica
VDEAKSPNPSIKSDSDEF

SEQ ID NO: 2664124 - protein, 11 aa, Entamoeba histolytica
VDEDETKQLEE

SEQ ID NO: 2664125 - protein, 8 aa, Entamoeba histolytica
VDEDPQRF

SEQ ID NO: 2664126 - protein, 15 aa, Entamoeba histolytica
VDEEKESVTMNSPNE

SEQ ID NO: 2664127 - protein, 4 aa, Entamoeba histolytica
VDEF

SEQ ID NO: 2664128 - protein, 10 aa, Entamoeba histolytica
VDEGEGRIPR

SEQ ID NO: 2664129 - protein, 9 aa, Entamoeba histolytica
VDEHSLDRR

SEQ ID NO: 2664130 - protein, 10 aa, Entamoeba histolytica
VDEKGKGTGV

SEQ ID NO: 2664131 - protein, 11 aa, Entamoeba histolytica
VDEKNKSIYES

SEQ ID NO: 2664132 - protein, 5 aa, Entamoeba histolytica
VDEKP

SEQ ID NO: 2664133 - protein, 5 aa, Entamoeba histolytica
VDEKV

SEQ ID NO: 2664134 - protein, 5 aa, Entamoeba histolytica
VDELK

SEQ ID NO: 2664135 - protein, 5 aa, Entamoeba histolytica
VDEND

SEQ ID NO: 2664136 - protein, 11 aa, Entamoeba histolytica
VDENDDEQIED

SEQ ID NO: 2664137 - protein, 20 aa, Entamoeba histolytica
VDENEVNNVSQLQNKKKERL

SEQ ID NO: 2664138 - protein, 10 aa, Entamoeba histolytica
VDENGEQLNT

SEQ ID NO: 2664139 - protein, 8 aa, Entamoeba histolytica
VDENGTTF

SEQ ID NO: 2664140 - protein, 5 aa, Entamoeba histolytica
VDENS

SEQ ID NO: 2664141 - protein, 8 aa, Entamoeba histolytica
VDENYRPY

SEQ ID NO: 2664142 - protein, 7 aa, Entamoeba histolytica
VDEPEED

SEQ ID NO: 2664143 - protein, 6 aa, Entamoeba histolytica
VDEPSI

SEQ ID NO: 2664144 - protein, 11 aa, Entamoeba histolytica
VDEQGAQLPEK

SEQ ID NO: 2664145 - protein, 6 aa, Entamoeba histolytica
VDEQGK

SEQ ID NO: 2664146 - protein, 4 aa, Entamoeba histolytica
VDER

SEQ ID NO: 2664147 - protein, 7 aa, Entamoeba histolytica
VDERYTK

SEQ ID NO: 2664148 - protein, 9 aa, Entamoeba histolytica
VDETHRADT

SEQ ID NO: 2664149 - protein, 30 aa, Entamoeba histolytica
VDETLTHNNSLNPSTNNSTCTSRSSTPPLN

SEQ ID NO: 2664150 - protein, 7 aa, Entamoeba histolytica
VDETQST

SEQ ID NO: 2664151 - protein, 4 aa, Entamoeba histolytica
VDEY

SEQ ID NO: 2664152 - protein, 4 aa, Entamoeba histolytica
VDGC

SEQ ID NO: 2664153 - protein, 14 aa, Entamoeba histolytica
VDGDELGTYNDEGF

SEQ ID NO: 2664154 - protein, 6 aa, Entamoeba histolytica
VDGESS

SEQ ID NO: 2664155 - protein, 11 aa, Entamoeba histolytica
VDGETLNESIE

SEQ ID NO: 2664156 - protein, 8 aa, Entamoeba histolytica
VDGGVSRS

SEQ ID NO: 2664157 - protein, 7 aa, Entamoeba histolytica
VDGLNGK

SEQ ID NO: 2664158 - protein, 7 aa, Entamoeba histolytica
VDGNTNS

SEQ ID NO: 2664159 - protein, 7 aa, Entamoeba histolytica
VDGPQGA

SEQ ID NO: 2664160 - protein, 19 aa, Entamoeba histolytica
VDGQASMFGGDTKKPVGGN

SEQ ID NO: 2664161 - protein, 8 aa, Entamoeba histolytica
VDGQDNAM

SEQ ID NO: 2664162 - protein, 6 aa, Entamoeba histolytica
VDGSLT

SEQ ID NO: 2664163 - protein, 8 aa, Entamoeba histolytica
VDGTQNSD

SEQ ID NO: 2664164 - protein, 15 aa, Entamoeba histolytica
VDGYSTIKSLTAIEW

SEQ ID NO: 2664165 - protein, 9 aa, Entamoeba histolytica
VDKANTTRE

SEQ ID NO: 2664166 - protein, 15 aa, Entamoeba histolytica
VDKCSSDDFLDLSES

SEQ ID NO: 2664167 - protein, 17 aa, Entamoeba histolytica
VDKDRADNVDEKTIRRR

SEQ ID NO: 2664168 - protein, 13 aa, Entamoeba histolytica
VDKETSKKGKGGC

SEQ ID NO: 2664169 - protein, 4 aa, Entamoeba histolytica
VDKG

SEQ ID NO: 2664170 - protein, 8 aa, Entamoeba histolytica
VDKKAAED

SEQ ID NO: 2664171 - protein, 13 aa, Entamoeba histolytica
VDKKGKRCTEGEN

SEQ ID NO: 2664172 - protein, 11 aa, Entamoeba histolytica
VDKKKEETLSS

SEQ ID NO: 2664173 - protein, 9 aa, Entamoeba histolytica
VDKKKKSDV

SEQ ID NO: 2664174 - protein, 13 aa, Entamoeba histolytica
VDKLTTNDVDRGR

SEQ ID NO: 2664175 - protein, 9 aa, Entamoeba histolytica
VDKPLKPIT

SEQ ID NO: 2664176 - protein, 8 aa, Entamoeba histolytica
VDKSGNLD

SEQ ID NO: 2664177 - protein, 10 aa, Entamoeba histolytica
VDKSGRLNGE

SEQ ID NO: 2664178 - protein, 21 aa, Entamoeba histolytica
VDKSQERVITEEQGKSLANER

SEQ ID NO: 2664179 - protein, 18 aa, Entamoeba histolytica
VDKSWASMKGGKPIEDPK

SEQ ID NO: 2664180 - protein, 10 aa, Entamoeba histolytica
VDKYDKIPQD

SEQ ID NO: 2664181 - protein, 8 aa, Entamoeba histolytica
VDLATSDA

SEQ ID NO: 2664182 - protein, 6 aa, Entamoeba histolytica
VDLDDD

SEQ ID NO: 2664183 - protein, 14 aa, Entamoeba histolytica
VDLGNSNENIPKRN

SEQ ID NO: 2664184 - protein, 5 aa, Entamoeba histolytica
VDLKK

SEQ ID NO: 2664185 - protein, 9 aa, Entamoeba histolytica
VDNEDSQRL

SEQ ID NO: 2664186 - protein, 14 aa, Entamoeba histolytica
VDNEYSQQMSEEQK

SEQ ID NO: 2664187 - protein, 4 aa, Entamoeba histolytica
VDNG

SEQ ID NO: 2664188 - protein, 9 aa, Entamoeba histolytica
VDNGDNNAF

SEQ ID NO: 2664189 - protein, 8 aa, Entamoeba histolytica
VDNKLDNL

SEQ ID NO: 2664190 - protein, 7 aa, Entamoeba histolytica
VDNLDTR

SEQ ID NO: 2664191 - protein, 4 aa, Entamoeba histolytica
VDNN

SEQ ID NO: 2664192 - protein, 5 aa, Entamoeba histolytica
VDNNN

SEQ ID NO: 2664193 - protein, 7 aa, Entamoeba histolytica
VDNQEPI

SEQ ID NO: 2664194 - protein, 18 aa, Entamoeba histolytica
VDNRLSPKETLKILFQSQ

SEQ ID NO: 2664195 - protein, 4 aa, Entamoeba histolytica
VDNV

SEQ ID NO: 2664196 - protein, 7 aa, Entamoeba histolytica
VDNVEKQ

SEQ ID NO: 2664197 - protein, 10 aa, Entamoeba histolytica
VDPDNPNNIY

SEQ ID NO: 2664198 - protein, 10 aa, Entamoeba histolytica
VDPEEAQKNF

SEQ ID NO: 2664199 - protein, 7 aa, Entamoeba histolytica
VDPKRHD

SEQ ID NO: 2664200 - protein, 12 aa, Entamoeba histolytica
VDPKTEKSYKTL

SEQ ID NO: 2664201 - protein, 7 aa, Entamoeba histolytica
VDPKTKI

SEQ ID NO: 2664202 - protein, 4 aa, Entamoeba histolytica
VDPL

SEQ ID NO: 2664203 - protein, 10 aa, Entamoeba histolytica
VDPNETDEIE

SEQ ID NO: 2664204 - protein, 9 aa, Entamoeba histolytica
VDPPESKKN

SEQ ID NO: 2664205 - protein, 6 aa, Entamoeba histolytica
VDPPTQ

SEQ ID NO: 2664206 - protein, 7 aa, Entamoeba histolytica
VDPRSMS

SEQ ID NO: 2664207 - protein, 8 aa, Entamoeba histolytica
VDPSCPEG

SEQ ID NO: 2664208 - protein, 10 aa, Entamoeba histolytica
VDPSEDTNIK

SEQ ID NO: 2664209 - protein, 6 aa, Entamoeba histolytica
VDPSGS

SEQ ID NO: 2664210 - protein, 8 aa, Entamoeba histolytica
VDPSSEMD

SEQ ID NO: 2664211 - protein, 5 aa, Entamoeba histolytica
VDPSV

SEQ ID NO: 2664212 - protein, 10 aa, Entamoeba histolytica
VDQEESQQNV

SEQ ID NO: 2664213 - protein, 7 aa, Entamoeba histolytica
VDQGGVS

SEQ ID NO: 2664214 - protein, 28 aa, Entamoeba histolytica
VDQNKSYNSLPGTPLQQISSPKKQISSL

SEQ ID NO: 2664215 - protein, 15 aa, Entamoeba histolytica
VDQPKPISTEKRVDP

SEQ ID NO: 2664216 - protein, 10 aa, Entamoeba histolytica
VDQPTTKPYI

SEQ ID NO: 2664217 - protein, 15 aa, Entamoeba histolytica
VDQQQEELLTNLNSL

SEQ ID NO: 2664218 - protein, 14 aa, Entamoeba histolytica
VDQRGELTDLQKEQ

SEQ ID NO: 2664219 - protein, 17 aa, Entamoeba histolytica
VDQSHKTTVENLQETNA

SEQ ID NO: 2664220 - protein, 8 aa, Entamoeba histolytica
VDQTTIDK

SEQ ID NO: 2664221 - protein, 7 aa, Entamoeba histolytica
VDRNKES

SEQ ID NO: 2664222 - protein, 5 aa, Entamoeba histolytica
VDRQS

SEQ ID NO: 2664223 - protein, 12 aa, Entamoeba histolytica
VDSDIPPVKGSI

SEQ ID NO: 2664224 - protein, 10 aa, Entamoeba histolytica
VDSDKTKIRD

SEQ ID NO: 2664225 - protein, 7 aa, Entamoeba histolytica
VDSDSDI

SEQ ID NO: 2664226 - protein, 47 aa, Entamoeba histolytica
VDSEEVSVDHSEKTQKKEDQTNEKAPKISTYQSKYVPSKEQQDRDRR

SEQ ID NO: 2664227 - protein, 34 aa, Entamoeba histolytica
VDSENNNEELTHKKPLKKPKEVKKEDKKLKVCVN

SEQ ID NO: 2664228 - protein, 8 aa, Entamoeba histolytica
VDSHRCSP

SEQ ID NO: 2664229 - protein, 17 aa, Entamoeba histolytica
VDSKESNSNNIIQPRKT

SEQ ID NO: 2664230 - protein, 8 aa, Entamoeba histolytica
VDSKQSSC

SEQ ID NO: 2664231 - protein, 6 aa, Entamoeba histolytica
VDSKSN

SEQ ID NO: 2664232 - protein, 6 aa, Entamoeba histolytica
VDSNNK

SEQ ID NO: 2664233 - protein, 13 aa, Entamoeba histolytica
VDSNNTIQRENGV

SEQ ID NO: 2664234 - protein, 11 aa, Entamoeba histolytica
VDSPKDENGNY

SEQ ID NO: 2664235 - protein, 5 aa, Entamoeba histolytica
VDSPN

SEQ ID NO: 2664236 - protein, 5 aa, Entamoeba histolytica
VDSPP

SEQ ID NO: 2664237 - protein, 24 aa, Entamoeba histolytica
VDSPSNEKVVDSQEDVPQQQPEEL

SEQ ID NO: 2664238 - protein, 7 aa, Entamoeba histolytica
VDSPVKR

SEQ ID NO: 2664239 - protein, 8 aa, Entamoeba histolytica
VDSQESQL

SEQ ID NO: 2664240 - protein, 16 aa, Entamoeba histolytica
VDSQRGVTKEEGMQKS

SEQ ID NO: 2664241 - protein, 12 aa, Entamoeba histolytica
VDSTEIPNGDIS

SEQ ID NO: 2664242 - protein, 7 aa, Entamoeba histolytica
VDSTSTS

SEQ ID NO: 2664243 - protein, 12 aa, Entamoeba histolytica
VDTAANSIRDTA

SEQ ID NO: 2664244 - protein, 9 aa, Entamoeba histolytica
VDTEKDDLR

SEQ ID NO: 2664245 - protein, 4 aa, Entamoeba histolytica
VDTF

SEQ ID NO: 2664246 - protein, 6 aa, Entamoeba histolytica
VDTNDD

SEQ ID NO: 2664247 - protein, 4 aa, Entamoeba histolytica
VDTP

SEQ ID NO: 2664248 - protein, 18 aa, Entamoeba histolytica
VDTPPSEEQEQNKDNTFE

SEQ ID NO: 2664249 - protein, 15 aa, Entamoeba histolytica
VDTQSMSSLNEYNEI

SEQ ID NO: 2664250 - protein, 12 aa, Entamoeba histolytica
VDTTGAGDSYAG

SEQ ID NO: 2664251 - protein, 10 aa, Entamoeba histolytica
VDTVKTTKTK

SEQ ID NO: 2664252 - protein, 155 aa, Entamoeba histolytica
VDVEAQKKKEEEKENINEEEKKATEEEARKRKEEEERKLKEAEEARKLKEAEEARKRKEEEERKRKEEEERKRKEEAKKRKEEEERKLKEAEEARKLKEAEEARKLKEAEEARKRKEEEERKRKEEEEERKRKEEEDKKKAKEAAVAKAKSVNGY

SEQ ID NO: 2664253 - protein, 14 aa, Entamoeba histolytica
VDYGKKKKIDEENS

SEQ ID NO: 2664254 - protein, 13 aa, Entamoeba histolytica
VEAPKSDKEIREE

SEQ ID NO: 2664255 - protein, 21 aa, Entamoeba histolytica
VEARERAVTNLNGTKLGENEI

SEQ ID NO: 2664256 - protein, 9 aa, Entamoeba histolytica
VEARRRSEM

SEQ ID NO: 2664257 - protein, 18 aa, Entamoeba histolytica
VEDAQKAISSPKTGVLGS

SEQ ID NO: 2664258 - protein, 9 aa, Entamoeba histolytica
VEDASDEFK

SEQ ID NO: 2664259 - protein, 16 aa, Entamoeba histolytica
VEDDGKTAWKLGNPEE

SEQ ID NO: 2664260 - protein, 7 aa, Entamoeba histolytica
VEDDSQK

SEQ ID NO: 2664261 - protein, 5 aa, Entamoeba histolytica
VEDEG

SEQ ID NO: 2664262 - protein, 11 aa, Entamoeba histolytica
VEDGTNASDFN

SEQ ID NO: 2664263 - protein, 18 aa, Entamoeba histolytica
VEDGVEGYYEKKQGMTQQ

SEQ ID NO: 2664264 - protein, 22 aa, Entamoeba histolytica
VEDGVEGYYEKKRGMTQKEKIT

SEQ ID NO: 2664265 - protein, 5 aa, Entamoeba histolytica
VEDIP

SEQ ID NO: 2664266 - protein, 9 aa, Entamoeba histolytica
VEDKEKELN

SEQ ID NO: 2664267 - protein, 7 aa, Entamoeba histolytica
VEDKKMT

SEQ ID NO: 2664268 - protein, 5 aa, Entamoeba histolytica
VEDKT

SEQ ID NO: 2664269 - protein, 6 aa, Entamoeba histolytica
VEDKVS

SEQ ID NO: 2664270 - protein, 4 aa, Entamoeba histolytica
VEDL

SEQ ID NO: 2664271 - protein, 19 aa, Entamoeba histolytica
VEDPPADDYTGENQQYEEI

SEQ ID NO: 2664272 - protein, 7 aa, Entamoeba histolytica
VEDPPPT

SEQ ID NO: 2664273 - protein, 5 aa, Entamoeba histolytica
VEDQM

SEQ ID NO: 2664274 - protein, 8 aa, Entamoeba histolytica
VEDSRQND

SEQ ID NO: 2664275 - protein, 7 aa, Entamoeba histolytica
VEDSSFH

SEQ ID NO: 2664276 - protein, 4 aa, Entamoeba histolytica
VEEA

SEQ ID NO: 2664277 - protein, 6 aa, Entamoeba histolytica
VEEAQK

SEQ ID NO: 2664278 - protein, 11 aa, Entamoeba histolytica
VEEAQRQKEYI

SEQ ID NO: 2664279 - protein, 14 aa, Entamoeba histolytica
VEEDDKQNGGPQYD

SEQ ID NO: 2664280 - protein, 6 aa, Entamoeba histolytica
VEEDDM

SEQ ID NO: 2664281 - protein, 9 aa, Entamoeba histolytica
VEEDIPGYY

SEQ ID NO: 2664282 - protein, 6 aa, Entamoeba histolytica
VEEDKI

SEQ ID NO: 2664283 - protein, 7 aa, Entamoeba histolytica
VEEDKIP

SEQ ID NO: 2664284 - protein, 12 aa, Entamoeba histolytica
VEEDSEENARYD

SEQ ID NO: 2664285 - protein, 4 aa, Entamoeba histolytica
VEEE

SEQ ID NO: 2664286 - protein, 22 aa, Entamoeba histolytica
VEEEANFARNREKKEQPSDQIQ

SEQ ID NO: 2664287 - protein, 17 aa, Entamoeba histolytica
VEEEDPELAEQMREDPE

SEQ ID NO: 2664288 - protein, 19 aa, Entamoeba histolytica
VEEEERENEERRKGLEQEM

SEQ ID NO: 2664289 - protein, 117 aa, Entamoeba histolytica
VEEEERRRKEEEERRKREEEERKRKEEERRLEEERKRKEEEENLKRKEEERQRQIEEAKRKAAEERKRLEEEKKRLEEERKRIEEEQRRIEEEKKKKEEEERIKKEQERKKKEEEEL

SEQ ID NO: 2664290 - protein, 6 aa, Entamoeba histolytica
VEEEES

SEQ ID NO: 2664291 - protein, 9 aa, Entamoeba histolytica
VEEEETEGN

SEQ ID NO: 2664292 - protein, 7 aa, Entamoeba histolytica
VEEEKRM

SEQ ID NO: 2664293 - protein, 14 aa, Entamoeba histolytica
VEEEKSDDSFINRP

SEQ ID NO: 2664294 - protein, 11 aa, Entamoeba histolytica
VEEEMGEDGGV

SEQ ID NO: 2664295 - protein, 8 aa, Entamoeba histolytica
VEEEQGII

SEQ ID NO: 2664296 - protein, 11 aa, Entamoeba histolytica
VEEEVKKTNMK

SEQ ID NO: 2664297 - protein, 6 aa, Entamoeba histolytica
VEEEYD

SEQ ID NO: 2664298 - protein, 7 aa, Entamoeba histolytica
VEEFTKK

SEQ ID NO: 2664299 - protein, 4 aa, Entamoeba histolytica
VEEG

SEQ ID NO: 2664300 - protein, 6 aa, Entamoeba histolytica
VEEGIK

SEQ ID NO: 2664301 - protein, 13 aa, Entamoeba histolytica
VEEGNSLSSSVNQ

SEQ ID NO: 2664302 - protein, 16 aa, Entamoeba histolytica
VEEKDTAQFPEGSPDY

SEQ ID NO: 2664303 - protein, 29 aa, Entamoeba histolytica
VEEKEKLNDESEQIKQDIDEAYKRKQTTR

SEQ ID NO: 2664304 - protein, 19 aa, Entamoeba histolytica
VEEKEVEGKEEREKLEQKR

SEQ ID NO: 2664305 - protein, 12 aa, Entamoeba histolytica
VEEKGFKGVEEN

SEQ ID NO: 2664306 - protein, 14 aa, Entamoeba histolytica
VEEKKQSNDEEQTI

SEQ ID NO: 2664307 - protein, 9 aa, Entamoeba histolytica
VEEKPERAH

SEQ ID NO: 2664308 - protein, 5 aa, Entamoeba histolytica
VEEKY

SEQ ID NO: 2664309 - protein, 20 aa, Entamoeba histolytica
VEELENEKNDIKQKNEEQES

SEQ ID NO: 2664310 - protein, 5 aa, Entamoeba histolytica
VEELK

SEQ ID NO: 2664311 - protein, 4 aa, Entamoeba histolytica
VEEN

SEQ ID NO: 2664312 - protein, 14 aa, Entamoeba histolytica
VEENNESGDDEEEL

SEQ ID NO: 2664313 - protein, 10 aa, Entamoeba histolytica
VEENREKKKS

SEQ ID NO: 2664314 - protein, 10 aa, Entamoeba histolytica
VEENREKNKS

SEQ ID NO: 2664315 - protein, 68 aa, Entamoeba histolytica
VEENTGMKSNAKIDSTQQKEGEGSGNNEENNTKVGDGEGHVNGNSKKEQQELRKVQQEKKGNGDTQNH

SEQ ID NO: 2664316 - protein, 10 aa, Entamoeba histolytica
VEEPKIDEDG

SEQ ID NO: 2664317 - protein, 23 aa, Entamoeba histolytica
VEEQPKQYESSPQPSVTEPPVPA

SEQ ID NO: 2664318 - protein, 4 aa, Entamoeba histolytica
VEES

SEQ ID NO: 2664319 - protein, 21 aa, Entamoeba histolytica
VEESNDPSFSQEQGSLTSADK

SEQ ID NO: 2664320 - protein, 24 aa, Entamoeba histolytica
VEESSSSSDSLSNSLNSSSSDEYV

SEQ ID NO: 2664321 - protein, 10 aa, Entamoeba histolytica
VEESTISGKG

SEQ ID NO: 2664322 - protein, 7 aa, Entamoeba histolytica
VEETDGL

SEQ ID NO: 2664323 - protein, 8 aa, Entamoeba histolytica
VEETGRGI

SEQ ID NO: 2664324 - protein, 14 aa, Entamoeba histolytica
VEETPIEDSKMEEV

SEQ ID NO: 2664325 - protein, 5 aa, Entamoeba histolytica
VEEVR

SEQ ID NO: 2664326 - protein, 13 aa, Entamoeba histolytica
VEEYQKAGHNPWP

SEQ ID NO: 2664327 - protein, 13 aa, Entamoeba histolytica
VEEYTKEDELKGL

SEQ ID NO: 2664328 - protein, 8 aa, Entamoeba histolytica
VEFDESRR

SEQ ID NO: 2664329 - protein, 10 aa, Entamoeba histolytica
VEFPNDKKNI

SEQ ID NO: 2664330 - protein, 6 aa, Entamoeba histolytica
VEGEAE

SEQ ID NO: 2664331 - protein, 27 aa, Entamoeba histolytica
VEGEKKRILSQNSIRKDKETKDIISDA

SEQ ID NO: 2664332 - protein, 10 aa, Entamoeba histolytica
VEGESKKEVE

SEQ ID NO: 2664333 - protein, 18 aa, Entamoeba histolytica
VEGESKLSQLSSKTKGII

SEQ ID NO: 2664334 - protein, 31 aa, Entamoeba histolytica
VEGETSNTKIDNTFTKSDTEEGKSINEKDMK

SEQ ID NO: 2664335 - protein, 4 aa, Entamoeba histolytica
VEGG

SEQ ID NO: 2664336 - protein, 6 aa, Entamoeba histolytica
VEGGAY

SEQ ID NO: 2664337 - protein, 4 aa, Entamoeba histolytica
VEGI

SEQ ID NO: 2664338 - protein, 8 aa, Entamoeba histolytica
VEGIKSNY

SEQ ID NO: 2664339 - protein, 5 aa, Entamoeba histolytica
VEGIT

SEQ ID NO: 2664340 - protein, 9 aa, Entamoeba histolytica
VEGKKRKEV

SEQ ID NO: 2664341 - protein, 9 aa, Entamoeba histolytica
VEGKPTGKI

SEQ ID NO: 2664342 - protein, 7 aa, Entamoeba histolytica
VEGKTHV

SEQ ID NO: 2664343 - protein, 7 aa, Entamoeba histolytica
VEGKTSE

SEQ ID NO: 2664344 - protein, 5 aa, Entamoeba histolytica
VEGKW

SEQ ID NO: 2664345 - protein, 77 aa, Entamoeba histolytica
VEGNKKETNTRDIGETFSHKSQQPNNHSEKHKNEKKPRKDGEEKKRKKTKTRSRMKNVKKDKRPDHLKPSYLQNNNN

SEQ ID NO: 2664346 - protein, 6 aa, Entamoeba histolytica
VEGNKS

SEQ ID NO: 2664347 - protein, 5 aa, Entamoeba histolytica
VEGPS

SEQ ID NO: 2664348 - protein, 11 aa, Entamoeba histolytica
VEGQNLKGQEE

SEQ ID NO: 2664349 - protein, 10 aa, Entamoeba histolytica
VEGRDDENTV

SEQ ID NO: 2664350 - protein, 9 aa, Entamoeba histolytica
VEGTPDANG

SEQ ID NO: 2664351 - protein, 178 aa, Entamoeba histolytica
VEGTRKSSRGGNGGFQRGGRGFGGGNGRGRGAERREDRRRDDRDRHDYDRRDDRDRRDYYDRRDDRDRRDYYDRRDDRDRHEYESSRRDDRDRHGYSSSRRDDRYDYESSRRDDRDRHGYSSSRRDDRDRYEESSRRDDRDRHGYSSSRRDDRGDRYDDRSPRRDDRSSNRRDDRDHH

SEQ ID NO: 2664352 - protein, 7 aa, Entamoeba histolytica
VEGVTDE

SEQ ID NO: 2664353 - protein, 6 aa, Entamoeba histolytica
VEHDSK

SEQ ID NO: 2664354 - protein, 4 aa, Entamoeba histolytica
VEHN

SEQ ID NO: 2664355 - protein, 11 aa, Entamoeba histolytica
VEHPGKQSKVT

SEQ ID NO: 2664356 - protein, 6 aa, Entamoeba histolytica
VEHPGL

SEQ ID NO: 2664357 - protein, 5 aa, Entamoeba histolytica
VEIEN

SEQ ID NO: 2664358 - protein, 4 aa, Entamoeba histolytica
VEIN

SEQ ID NO: 2664359 - protein, 7 aa, Entamoeba histolytica
VEISQDK

SEQ ID NO: 2664360 - protein, 10 aa, Entamoeba histolytica
VEITKSNKAT

SEQ ID NO: 2664361 - protein, 13 aa, Entamoeba histolytica
VEKATHNEGQSYL

SEQ ID NO: 2664362 - protein, 12 aa, Entamoeba histolytica
VEKDEKKGRDEK

SEQ ID NO: 2664363 - protein, 7 aa, Entamoeba histolytica
VEKEDEQ

SEQ ID NO: 2664364 - protein, 8 aa, Entamoeba histolytica
VEKENQEA

SEQ ID NO: 2664365 - protein, 11 aa, Entamoeba histolytica
VEKEPTPPLTE

SEQ ID NO: 2664366 - protein, 19 aa, Entamoeba histolytica
VEKERKELKDLETNKIKEE

SEQ ID NO: 2664367 - protein, 15 aa, Entamoeba histolytica
VEKESSQTSSERTKR

SEQ ID NO: 2664368 - protein, 9 aa, Entamoeba histolytica
VEKEYSLEE

SEQ ID NO: 2664369 - protein, 7 aa, Entamoeba histolytica
VEKGDLK

SEQ ID NO: 2664370 - protein, 14 aa, Entamoeba histolytica
VEKGIEEAINTTEK

SEQ ID NO: 2664371 - protein, 6 aa, Entamoeba histolytica
VEKGSI

SEQ ID NO: 2664372 - protein, 4 aa, Entamoeba histolytica
VEKK

SEQ ID NO: 2664373 - protein, 8 aa, Entamoeba histolytica
VEKNNEPF

SEQ ID NO: 2664374 - protein, 4 aa, Entamoeba histolytica
VEKS

SEQ ID NO: 2664375 - protein, 10 aa, Entamoeba histolytica
VEKSDYSKTA

SEQ ID NO: 2664376 - protein, 5 aa, Entamoeba histolytica
VEKSV

SEQ ID NO: 2664377 - protein, 7 aa, Entamoeba histolytica
VEKTQMT

SEQ ID NO: 2664378 - protein, 7 aa, Entamoeba histolytica
VEKYPEE

SEQ ID NO: 2664379 - protein, 4 aa, Entamoeba histolytica
VELN

SEQ ID NO: 2664380 - protein, 8 aa, Entamoeba histolytica
VELSENQN

SEQ ID NO: 2664381 - protein, 4 aa, Entamoeba histolytica
VEND

SEQ ID NO: 2664382 - protein, 28 aa, Entamoeba histolytica
VENENKNTQNQESNQQNDLTNKEKNKEE

SEQ ID NO: 2664383 - protein, 12 aa, Entamoeba histolytica
VENGANGSKLDE

SEQ ID NO: 2664384 - protein, 8 aa, Entamoeba histolytica
VENGDNEC

SEQ ID NO: 2664385 - protein, 8 aa, Entamoeba histolytica
VENGTIQA

SEQ ID NO: 2664386 - protein, 10 aa, Entamoeba histolytica
VENIGRERID

SEQ ID NO: 2664387 - protein, 6 aa, Entamoeba histolytica
VENKPA

SEQ ID NO: 2664388 - protein, 11 aa, Entamoeba histolytica
VENKVTEEKSQ

SEQ ID NO: 2664389 - protein, 5 aa, Entamoeba histolytica
VENPN

SEQ ID NO: 2664390 - protein, 13 aa, Entamoeba histolytica
VENPSNPSKPKKN

SEQ ID NO: 2664391 - protein, 5 aa, Entamoeba histolytica
VENQG

SEQ ID NO: 2664392 - protein, 28 aa, Entamoeba histolytica
VENSKSPLGRSIGRKEKLKNQKKGESMK

SEQ ID NO: 2664393 - protein, 5 aa, Entamoeba histolytica
VENTP

SEQ ID NO: 2664394 - protein, 7 aa, Entamoeba histolytica
VEPEESV

SEQ ID NO: 2664395 - protein, 4 aa, Entamoeba histolytica
VEPI

SEQ ID NO: 2664396 - protein, 5 aa, Entamoeba histolytica
VEPKV

SEQ ID NO: 2664397 - protein, 27 aa, Entamoeba histolytica
VEPKVDENDTKKTWDSSTKTGENNIPQ

SEQ ID NO: 2664398 - protein, 5 aa, Entamoeba histolytica
VEPLK

SEQ ID NO: 2664399 - protein, 4 aa, Entamoeba histolytica
VEPM

SEQ ID NO: 2664400 - protein, 10 aa, Entamoeba histolytica
VEPNKEKSLQ

SEQ ID NO: 2664401 - protein, 7 aa, Entamoeba histolytica
VEPPDNN

SEQ ID NO: 2664402 - protein, 49 aa, Entamoeba histolytica
VEPPPVPPPHGQAPSLPPPVPPPRGGAPALPPPRRGTKNAPPPPPPLEP

SEQ ID NO: 2664403 - protein, 9 aa, Entamoeba histolytica
VEPRGSNGF

SEQ ID NO: 2664404 - protein, 10 aa, Entamoeba histolytica
VEPSNKDTYV

SEQ ID NO: 2664405 - protein, 5 aa, Entamoeba histolytica
VEPSV

SEQ ID NO: 2664406 - protein, 8 aa, Entamoeba histolytica
VEPTDDLT

SEQ ID NO: 2664407 - protein, 43 aa, Entamoeba histolytica
VEPTKDQQTGISDSVNNLESVDSSKEKSIPSELPKKESDKSIT

SEQ ID NO: 2664408 - protein, 9 aa, Entamoeba histolytica
VEPTNERAF

SEQ ID NO: 2664409 - protein, 8 aa, Entamoeba histolytica
VEPYQPRR

SEQ ID NO: 2664410 - protein, 11 aa, Entamoeba histolytica
VEQAEATKNAI

SEQ ID NO: 2664411 - protein, 12 aa, Entamoeba histolytica
VEQARGDRSREN

SEQ ID NO: 2664412 - protein, 7 aa, Entamoeba histolytica
VEQDEGL

SEQ ID NO: 2664413 - protein, 10 aa, Entamoeba histolytica
VEQDEVNPHP

SEQ ID NO: 2664414 - protein, 22 aa, Entamoeba histolytica
VEQEKEKRIKEEVEKAHQLREK

SEQ ID NO: 2664415 - protein, 4 aa, Entamoeba histolytica
VEQF

SEQ ID NO: 2664416 - protein, 7 aa, Entamoeba histolytica
VEQGAEE

SEQ ID NO: 2664417 - protein, 5 aa, Entamoeba histolytica
VEQGD

SEQ ID NO: 2664418 - protein, 10 aa, Entamoeba histolytica
VEQHKTSSPV

SEQ ID NO: 2664419 - protein, 5 aa, Entamoeba histolytica
VEQKD

SEQ ID NO: 2664420 - protein, 15 aa, Entamoeba histolytica
VEQKQIQRDPSPVSQ

SEQ ID NO: 2664421 - protein, 4 aa, Entamoeba histolytica
VEQL

SEQ ID NO: 2664422 - protein, 6 aa, Entamoeba histolytica
VEQMQS

SEQ ID NO: 2664423 - protein, 5 aa, Entamoeba histolytica
VEQNG

SEQ ID NO: 2664424 - protein, 5 aa, Entamoeba histolytica
VEQNQ

SEQ ID NO: 2664425 - protein, 9 aa, Entamoeba histolytica
VEQPSKDGI

SEQ ID NO: 2664426 - protein, 5 aa, Entamoeba histolytica
VEQQP

SEQ ID NO: 2664427 - protein, 9 aa, Entamoeba histolytica
VEQVRPGQT

SEQ ID NO: 2664428 - protein, 10 aa, Entamoeba histolytica
VEQYNSNETV

SEQ ID NO: 2664429 - protein, 9 aa, Entamoeba histolytica
VERDDESYS

SEQ ID NO: 2664430 - protein, 11 aa, Entamoeba histolytica
VERDEANEHPH

SEQ ID NO: 2664431 - protein, 9 aa, Entamoeba histolytica
VERDGSLNT

SEQ ID NO: 2664432 - protein, 5 aa, Entamoeba histolytica
VEREE

SEQ ID NO: 2664433 - protein, 4 aa, Entamoeba histolytica
VERI

SEQ ID NO: 2664434 - protein, 9 aa, Entamoeba histolytica
VERKEQSSS

SEQ ID NO: 2664435 - protein, 22 aa, Entamoeba histolytica
VERKKDKKQPTHEEKPNIPLTK

SEQ ID NO: 2664436 - protein, 9 aa, Entamoeba histolytica
VERKNNEKA

SEQ ID NO: 2664437 - protein, 8 aa, Entamoeba histolytica
VESAGDSG

SEQ ID NO: 2664438 - protein, 18 aa, Entamoeba histolytica
VESDDTLFSGDTTYIEEN

SEQ ID NO: 2664439 - protein, 14 aa, Entamoeba histolytica
VESDEKEKELQKEI

SEQ ID NO: 2664440 - protein, 25 aa, Entamoeba histolytica
VESEDDDDDSGSLSDDESSEEQEND

SEQ ID NO: 2664441 - protein, 43 aa, Entamoeba histolytica
VESEEEEETSKPSPRKPRQTKDKSKITHQKKINEKKEIDESED

SEQ ID NO: 2664442 - protein, 20 aa, Entamoeba histolytica
VESEETKKELKKKKEEEMKL

SEQ ID NO: 2664443 - protein, 5 aa, Entamoeba histolytica
VESEH

SEQ ID NO: 2664444 - protein, 13 aa, Entamoeba histolytica
VESENTKNQRATA

SEQ ID NO: 2664445 - protein, 6 aa, Entamoeba histolytica
VESESI

SEQ ID NO: 2664446 - protein, 6 aa, Entamoeba histolytica
VESGIT

SEQ ID NO: 2664447 - protein, 6 aa, Entamoeba histolytica
VESGPV

SEQ ID NO: 2664448 - protein, 4 aa, Entamoeba histolytica
VESK

SEQ ID NO: 2664449 - protein, 7 aa, Entamoeba histolytica
VESKEKS

SEQ ID NO: 2664450 - protein, 15 aa, Entamoeba histolytica
VESLEDKLKDAQGIQ

SEQ ID NO: 2664451 - protein, 4 aa, Entamoeba histolytica
VESN

SEQ ID NO: 2664452 - protein, 7 aa, Entamoeba histolytica
VESNKRE

SEQ ID NO: 2664453 - protein, 20 aa, Entamoeba histolytica
VESNYTPRSATSTDSERHSD

SEQ ID NO: 2664454 - protein, 26 aa, Entamoeba histolytica
VESPNYKECEEKIEQTKKEIKSCENI

SEQ ID NO: 2664455 - protein, 10 aa, Entamoeba histolytica
VESQRPNLHQ

SEQ ID NO: 2664456 - protein, 5 aa, Entamoeba histolytica
VESRT

SEQ ID NO: 2664457 - protein, 5 aa, Entamoeba histolytica
VESSD

SEQ ID NO: 2664458 - protein, 8 aa, Entamoeba histolytica
VESSDGEA

SEQ ID NO: 2664459 - protein, 14 aa, Entamoeba histolytica
VESSGGDQNLGGND

SEQ ID NO: 2664460 - protein, 7 aa, Entamoeba histolytica
VESTKKQ

SEQ ID NO: 2664461 - protein, 8 aa, Entamoeba histolytica
VESTTKKE

SEQ ID NO: 2664462 - protein, 7 aa, Entamoeba histolytica
VESTTKP

SEQ ID NO: 2664463 - protein, 14 aa, Entamoeba histolytica
VETARSTKSFATGN

SEQ ID NO: 2664464 - protein, 5 aa, Entamoeba histolytica
VETEA

SEQ ID NO: 2664465 - protein, 26 aa, Entamoeba histolytica
VETEQPKETNDDGIESKEYPKELSKA

SEQ ID NO: 2664466 - protein, 5 aa, Entamoeba histolytica
VETET

SEQ ID NO: 2664467 - protein, 7 aa, Entamoeba histolytica
VETGKGW

SEQ ID NO: 2664468 - protein, 4 aa, Entamoeba histolytica
VETI

SEQ ID NO: 2664469 - protein, 18 aa, Entamoeba histolytica
VETKRRNSLTTSQPQQIV

SEQ ID NO: 2664470 - protein, 15 aa, Entamoeba histolytica
VETNLPNGCEPKPLQ

SEQ ID NO: 2664471 - protein, 5 aa, Entamoeba histolytica
VETPE

SEQ ID NO: 2664472 - protein, 8 aa, Entamoeba histolytica
VETPQNVP

SEQ ID NO: 2664473 - protein, 41 aa, Entamoeba histolytica
VETQKEKEEETKKYEEVKGQIDGAHQEVENIKKETEQQINQ

SEQ ID NO: 2664474 - protein, 6 aa, Entamoeba histolytica
VETTEK

SEQ ID NO: 2664475 - protein, 6 aa, Entamoeba histolytica
VETTGK

SEQ ID NO: 2664476 - protein, 18 aa, Entamoeba histolytica
VETTMKSDPKEKRHPKFS

SEQ ID NO: 2664477 - protein, 5 aa, Entamoeba histolytica
VETVD

SEQ ID NO: 2664478 - protein, 4 aa, Entamoeba histolytica
VEVH

SEQ ID NO: 2664479 - protein, 4 aa, Entamoeba histolytica
VEWN

SEQ ID NO: 2664480 - protein, 13 aa, Entamoeba histolytica
VEYSNSSSTMTTH

SEQ ID NO: 2664481 - protein, 7 aa, Entamoeba histolytica
VEYTGAP

SEQ ID NO: 2664482 - protein, 4 aa, Entamoeba histolytica
VFEE

SEQ ID NO: 2664483 - protein, 7 aa, Entamoeba histolytica
VFGESSE

SEQ ID NO: 2664484 - protein, 8 aa, Entamoeba histolytica
VFGGEQSD

SEQ ID NO: 2664485 - protein, 7 aa, Entamoeba histolytica
VFGSDDD

SEQ ID NO: 2664486 - protein, 17 aa, Entamoeba histolytica
VFGSNTAAQPPLKPSGL

SEQ ID NO: 2664487 - protein, 7 aa, Entamoeba histolytica
VFGTGDR

SEQ ID NO: 2664488 - protein, 13 aa, Entamoeba histolytica
VFGTQQNGFGQQQ

SEQ ID NO: 2664489 - protein, 6 aa, Entamoeba histolytica
VFPNNR

SEQ ID NO: 2664490 - protein, 30 aa, Entamoeba histolytica
VFSGSPDDTDCDHSKKYTSRNTGIVEDTTP

SEQ ID NO: 2664491 - protein, 25 aa, Entamoeba histolytica
VFTGSSDLTQAANNLKTSNLKEGYQ

SEQ ID NO: 2664492 - protein, 6 aa, Entamoeba histolytica
VGAGDS

SEQ ID NO: 2664493 - protein, 24 aa, Entamoeba histolytica
VGAGQKTMDSDVQYAKNKLSESYK

SEQ ID NO: 2664494 - protein, 4 aa, Entamoeba histolytica
VGAN

SEQ ID NO: 2664495 - protein, 7 aa, Entamoeba histolytica
VGAQRGH

SEQ ID NO: 2664496 - protein, 10 aa, Entamoeba histolytica
VGASKEDLQR

SEQ ID NO: 2664497 - protein, 10 aa, Entamoeba histolytica
VGCEGKASTT

SEQ ID NO: 2664498 - protein, 4 aa, Entamoeba histolytica
VGDA

SEQ ID NO: 2664499 - protein, 15 aa, Entamoeba histolytica
VGDGEEIIYDDDDEI

SEQ ID NO: 2664500 - protein, 9 aa, Entamoeba histolytica
VGDKEESIM

SEQ ID NO: 2664501 - protein, 18 aa, Entamoeba histolytica
VGDKEKQQELDEKNKEIY

SEQ ID NO: 2664502 - protein, 10 aa, Entamoeba histolytica
VGDKMTKEEV

SEQ ID NO: 2664503 - protein, 39 aa, Entamoeba histolytica
VGDLDKEPVYTATEQSMVGEPNVQARREKEIANGTYVKV

SEQ ID NO: 2664504 - protein, 12 aa, Entamoeba histolytica
VGDNKDDTIQEI

SEQ ID NO: 2664505 - protein, 6 aa, Entamoeba histolytica
VGDNQP

SEQ ID NO: 2664506 - protein, 5 aa, Entamoeba histolytica
VGDQT

SEQ ID NO: 2664507 - protein, 14 aa, Entamoeba histolytica
VGDQTPRKSIPKAP

SEQ ID NO: 2664508 - protein, 9 aa, Entamoeba histolytica
VGDSTTDLP

SEQ ID NO: 2664509 - protein, 7 aa, Entamoeba histolytica
VGDVKNK

SEQ ID NO: 2664510 - protein, 6 aa, Entamoeba histolytica
VGEAND

SEQ ID NO: 2664511 - protein, 7 aa, Entamoeba histolytica
VGEATEN

SEQ ID NO: 2664512 - protein, 8 aa, Entamoeba histolytica
VGEDPDEI

SEQ ID NO: 2664513 - protein, 7 aa, Entamoeba histolytica
VGEEGSI

SEQ ID NO: 2664514 - protein, 9 aa, Entamoeba histolytica
VGEEKPRSV

SEQ ID NO: 2664515 - protein, 6 aa, Entamoeba histolytica
VGEGAM

SEQ ID NO: 2664516 - protein, 6 aa, Entamoeba histolytica
VGEGGE

SEQ ID NO: 2664517 - protein, 11 aa, Entamoeba histolytica
VGEGKKDMERR

SEQ ID NO: 2664518 - protein, 6 aa, Entamoeba histolytica
VGEGTF

SEQ ID NO: 2664519 - protein, 4 aa, Entamoeba histolytica
VGEH

SEQ ID NO: 2664520 - protein, 12 aa, Entamoeba histolytica
VGEIQEPNDSKP

SEQ ID NO: 2664521 - protein, 30 aa, Entamoeba histolytica
VGEKKEPMFGTGNGTENVPQQTWYEWFKSM

SEQ ID NO: 2664522 - protein, 15 aa, Entamoeba histolytica
VGEKPKLDEKVQKTL

SEQ ID NO: 2664523 - protein, 6 aa, Entamoeba histolytica
VGENKN

SEQ ID NO: 2664524 - protein, 5 aa, Entamoeba histolytica
VGENM

SEQ ID NO: 2664525 - protein, 21 aa, Entamoeba histolytica
VGERKQEKKHEVTSQELTAGK

SEQ ID NO: 2664526 - protein, 8 aa, Entamoeba histolytica
VGESERNV

SEQ ID NO: 2664527 - protein, 19 aa, Entamoeba histolytica
VGESQENKEENKEEVKEEK

SEQ ID NO: 2664528 - protein, 6 aa, Entamoeba histolytica
VGESVD

SEQ ID NO: 2664529 - protein, 10 aa, Entamoeba histolytica
VGESVSKPIE

SEQ ID NO: 2664530 - protein, 7 aa, Entamoeba histolytica
VGETEGK

SEQ ID NO: 2664531 - protein, 7 aa, Entamoeba histolytica
VGETEKN

SEQ ID NO: 2664532 - protein, 6 aa, Entamoeba histolytica
VGETNL

SEQ ID NO: 2664533 - protein, 9 aa, Entamoeba histolytica
VGETNQRNM

SEQ ID NO: 2664534 - protein, 6 aa, Entamoeba histolytica
VGETYK

SEQ ID NO: 2664535 - protein, 9 aa, Entamoeba histolytica
VGEVGPTKY

SEQ ID NO: 2664536 - protein, 17 aa, Entamoeba histolytica
VGEYEERKNEVDESIKR

SEQ ID NO: 2664537 - protein, 6 aa, Entamoeba histolytica
VGGATA

SEQ ID NO: 2664538 - protein, 9 aa, Entamoeba histolytica
VGGDADRVI

SEQ ID NO: 2664539 - protein, 7 aa, Entamoeba histolytica
VGGFGGK

SEQ ID NO: 2664540 - protein, 10 aa, Entamoeba histolytica
VGGGHEEYYP

SEQ ID NO: 2664541 - protein, 7 aa, Entamoeba histolytica
VGGGQDK

SEQ ID NO: 2664542 - protein, 6 aa, Entamoeba histolytica
VGGNEI

SEQ ID NO: 2664543 - protein, 5 aa, Entamoeba histolytica
VGGNG

SEQ ID NO: 2664544 - protein, 5 aa, Entamoeba histolytica
VGGNN

SEQ ID NO: 2664545 - protein, 5 aa, Entamoeba histolytica
VGGNV

SEQ ID NO: 2664546 - protein, 7 aa, Entamoeba histolytica
VGGSGST

SEQ ID NO: 2664547 - protein, 17 aa, Entamoeba histolytica
VGGSSEAEVGERKDRIE

SEQ ID NO: 2664548 - protein, 6 aa, Entamoeba histolytica
VGHGPG

SEQ ID NO: 2664549 - protein, 34 aa, Entamoeba histolytica
VGHQPSQETPMEEEKQEEIKQEEIKQEEIKQEEN

SEQ ID NO: 2664550 - protein, 17 aa, Entamoeba histolytica
VGINDEKEKDFPQPKRK

SEQ ID NO: 2664551 - protein, 11 aa, Entamoeba histolytica
VGIRKENDARL

SEQ ID NO: 2664552 - protein, 6 aa, Entamoeba histolytica
VGISAG

SEQ ID NO: 2664553 - protein, 14 aa, Entamoeba histolytica
VGISKKSEDKEFQN

SEQ ID NO: 2664554 - protein, 8 aa, Entamoeba histolytica
VGKEKKKR

SEQ ID NO: 2664555 - protein, 13 aa, Entamoeba histolytica
VGKIEEVTKEKRI

SEQ ID NO: 2664556 - protein, 17 aa, Entamoeba histolytica
VGKIEPNEQSLKPIRGH

SEQ ID NO: 2664557 - protein, 19 aa, Entamoeba histolytica
VGKKKEKTKIAKPSLNPDW

SEQ ID NO: 2664558 - protein, 4 aa, Entamoeba histolytica
VGKL

SEQ ID NO: 2664559 - protein, 23 aa, Entamoeba histolytica
VGKNTQSTRSKYEDIHLDYPLGW

SEQ ID NO: 2664560 - protein, 6 aa, Entamoeba histolytica
VGKPRN

SEQ ID NO: 2664561 - protein, 8 aa, Entamoeba histolytica
VGKRSETY

SEQ ID NO: 2664562 - protein, 7 aa, Entamoeba histolytica
VGKSNSK

SEQ ID NO: 2664563 - protein, 6 aa, Entamoeba histolytica
VGKSQV

SEQ ID NO: 2664564 - protein, 12 aa, Entamoeba histolytica
VGKSSIAKSFGE

SEQ ID NO: 2664565 - protein, 10 aa, Entamoeba histolytica
VGKSSKVSNV

SEQ ID NO: 2664566 - protein, 8 aa, Entamoeba histolytica
VGKSSTIN

SEQ ID NO: 2664567 - protein, 8 aa, Entamoeba histolytica
VGKSTSLS

SEQ ID NO: 2664568 - protein, 4 aa, Entamoeba histolytica
VGKT

SEQ ID NO: 2664569 - protein, 5 aa, Entamoeba histolytica
VGKTS

SEQ ID NO: 2664570 - protein, 5 aa, Entamoeba histolytica
VGKTT

SEQ ID NO: 2664571 - protein, 11 aa, Entamoeba histolytica
VGKTVKKEYTV

SEQ ID NO: 2664572 - protein, 9 aa, Entamoeba histolytica
VGKTVTKEY

SEQ ID NO: 2664573 - protein, 12 aa, Entamoeba histolytica
VGLKGNAFSDGQ

SEQ ID NO: 2664574 - protein, 73 aa, Entamoeba histolytica
VGLKKETAEEKKAKEEEIEKEKTKEEMEKKERERLTKSSNNLNVPESSSSNSSLEKDDKSDDSSKSIQTPRGG

SEQ ID NO: 2664575 - protein, 11 aa, Entamoeba histolytica
VGLPSDGIACN

SEQ ID NO: 2664576 - protein, 13 aa, Entamoeba histolytica
VGLREQKQQLQQK

SEQ ID NO: 2664577 - protein, 73 aa, Entamoeba histolytica
VGLSSSNLSVTQPPKKIPPQVPNKSRTSESTLTQSTPLHQKSTSRLSQTNRLSYKSRPLPQPPVKSETSKPEI

SEQ ID NO: 2664578 - protein, 12 aa, Entamoeba histolytica
VGNDNTIKYQPP

SEQ ID NO: 2664579 - protein, 5 aa, Entamoeba histolytica
VGNEK

SEQ ID NO: 2664580 - protein, 16 aa, Entamoeba histolytica
VGNGKSTTFSMKGSSC

SEQ ID NO: 2664581 - protein, 17 aa, Entamoeba histolytica
VGNGTQVKLNQPGNTQP

SEQ ID NO: 2664582 - protein, 5 aa, Entamoeba histolytica
VGNNN

SEQ ID NO: 2664583 - protein, 23 aa, Entamoeba histolytica
VGNNPKSGIGAISNSSNNSSYEE

SEQ ID NO: 2664584 - protein, 10 aa, Entamoeba histolytica
VGNNQENDYA

SEQ ID NO: 2664585 - protein, 10 aa, Entamoeba histolytica
VGNPTYKNEY

SEQ ID NO: 2664586 - protein, 5 aa, Entamoeba histolytica
VGNSM

SEQ ID NO: 2664587 - protein, 6 aa, Entamoeba histolytica
VGNSNE

SEQ ID NO: 2664588 - protein, 12 aa, Entamoeba histolytica
VGNSPDSETKEV

SEQ ID NO: 2664589 - protein, 230 aa, Entamoeba histolytica
VGNSVSEEKKPKPPTNEETKAEEKVKEVKKVKEEKKGEAKEEKKEKKEKKEKKEKKEKKEKKPKSTSTEESETEPVKEKKEAKKEKKEKKEEKEKKEEKEKKEEKEKKEAKKEKKEKKKEKKEKEEKEPKSTSTEESETEPVKEKKEAKKEKKEKKEAKKEKKEKKEEKEKKPKPAISKEENAEVVKEKKEHKRHDKEHKKHDKGSKKEHTKKHKKHEKKVNEKPEHKEV

SEQ ID NO: 2664590 - protein, 7 aa, Entamoeba histolytica
VGNTEAQ

SEQ ID NO: 2664591 - protein, 9 aa, Entamoeba histolytica
VGNTENVQT

SEQ ID NO: 2664592 - protein, 7 aa, Entamoeba histolytica
VGPGAVE

SEQ ID NO: 2664593 - protein, 6 aa, Entamoeba histolytica
VGPGPT

SEQ ID NO: 2664594 - protein, 5 aa, Entamoeba histolytica
VGPKD

SEQ ID NO: 2664595 - protein, 5 aa, Entamoeba histolytica
VGPKT

SEQ ID NO: 2664596 - protein, 10 aa, Entamoeba histolytica
VGPNGATQKA

SEQ ID NO: 2664597 - protein, 10 aa, Entamoeba histolytica
VGPNGTGKST

SEQ ID NO: 2664598 - protein, 7 aa, Entamoeba histolytica
VGPSDDI

SEQ ID NO: 2664599 - protein, 12 aa, Entamoeba histolytica
VGQPKEIKKNTS

SEQ ID NO: 2664600 - protein, 12 aa, Entamoeba histolytica
VGREEQKRGIES

SEQ ID NO: 2664601 - protein, 4 aa, Entamoeba histolytica
VGRP

SEQ ID NO: 2664602 - protein, 8 aa, Entamoeba histolytica
VGRRDSQR

SEQ ID NO: 2664603 - protein, 7 aa, Entamoeba histolytica
VGRSSRG

SEQ ID NO: 2664604 - protein, 13 aa, Entamoeba histolytica
VGRTGRAGKGGNA

SEQ ID NO: 2664605 - protein, 5 aa, Entamoeba histolytica
VGSDG

SEQ ID NO: 2664606 - protein, 8 aa, Entamoeba histolytica
VGSDGQVN

SEQ ID NO: 2664607 - protein, 6 aa, Entamoeba histolytica
VGSEAK

SEQ ID NO: 2664608 - protein, 10 aa, Entamoeba histolytica
VGSENTIKQS

SEQ ID NO: 2664609 - protein, 4 aa, Entamoeba histolytica
VGSG

SEQ ID NO: 2664610 - protein, 7 aa, Entamoeba histolytica
VGSGDNA

SEQ ID NO: 2664611 - protein, 10 aa, Entamoeba histolytica
VGSGGTGTVR

SEQ ID NO: 2664612 - protein, 8 aa, Entamoeba histolytica
VGSGQNGH

SEQ ID NO: 2664613 - protein, 15 aa, Entamoeba histolytica
VGSKSGKLYVFDEVY

SEQ ID NO: 2664614 - protein, 10 aa, Entamoeba histolytica
VGSQGSGKSS

SEQ ID NO: 2664615 - protein, 6 aa, Entamoeba histolytica
VGSQQK

SEQ ID NO: 2664616 - protein, 15 aa, Entamoeba histolytica
VGSQRSGLESNDEEI

SEQ ID NO: 2664617 - protein, 5 aa, Entamoeba histolytica
VGSRR

SEQ ID NO: 2664618 - protein, 10 aa, Entamoeba histolytica
VGSRSDVEEC

SEQ ID NO: 2664619 - protein, 7 aa, Entamoeba histolytica
VGSSETD

SEQ ID NO: 2664620 - protein, 22 aa, Entamoeba histolytica
VGSSKNSPRHLSANYKKGSISV

SEQ ID NO: 2664621 - protein, 9 aa, Entamoeba histolytica
VGSSQNPAW

SEQ ID NO: 2664622 - protein, 18 aa, Entamoeba histolytica
VGSSSQTFCGNNGTPIQN

SEQ ID NO: 2664623 - protein, 5 aa, Entamoeba histolytica
VGSYT

SEQ ID NO: 2664624 - protein, 15 aa, Entamoeba histolytica
VGSYYGRGTAQEKQE

SEQ ID NO: 2664625 - protein, 4 aa, Entamoeba histolytica
VGTA

SEQ ID NO: 2664626 - protein, 4 aa, Entamoeba histolytica
VGTD

SEQ ID NO: 2664627 - protein, 10 aa, Entamoeba histolytica
VGTDVKGDLS

SEQ ID NO: 2664628 - protein, 5 aa, Entamoeba histolytica
VGTER

SEQ ID NO: 2664629 - protein, 8 aa, Entamoeba histolytica
VGTGFSDE

SEQ ID NO: 2664630 - protein, 7 aa, Entamoeba histolytica
VGTGSNE

SEQ ID NO: 2664631 - protein, 17 aa, Entamoeba histolytica
VGTKRYDAHSGGEKEIQ

SEQ ID NO: 2664632 - protein, 7 aa, Entamoeba histolytica
VGTPKYK

SEQ ID NO: 2664633 - protein, 13 aa, Entamoeba histolytica
VGTQIKAGQVEKT

SEQ ID NO: 2664634 - protein, 7 aa, Entamoeba histolytica
VGTSAAD

SEQ ID NO: 2664635 - protein, 8 aa, Entamoeba histolytica
VGTSNGNV

SEQ ID NO: 2664636 - protein, 20 aa, Entamoeba histolytica
VGTTEEIEEIPESEFSEMPG

SEQ ID NO: 2664637 - protein, 16 aa, Entamoeba histolytica
VGTTQKGFDEFKKSAG

SEQ ID NO: 2664638 - protein, 14 aa, Entamoeba histolytica
VGTTQKGFDEFKNT

SEQ ID NO: 2664639 - protein, 7 aa, Entamoeba histolytica
VGVRESN

SEQ ID NO: 2664640 - protein, 42 aa, Entamoeba histolytica
VGVSNQRTKLTVSSSISSPGQDSIPSSQNPSPRLEESEVTNE

SEQ ID NO: 2664641 - protein, 7 aa, Entamoeba histolytica
VGVTGDN

SEQ ID NO: 2664642 - protein, 14 aa, Entamoeba histolytica
VGVTPNGQPPSGMQ

SEQ ID NO: 2664643 - protein, 6 aa, Entamoeba histolytica
VGWEDG

SEQ ID NO: 2664644 - protein, 7 aa, Entamoeba histolytica
VGYGPKQ

SEQ ID NO: 2664645 - protein, 5 aa, Entamoeba histolytica
VGYGQ

SEQ ID NO: 2664646 - protein, 4 aa, Entamoeba histolytica
VGYL

SEQ ID NO: 2664647 - protein, 8 aa, Entamoeba histolytica
VGYTNYPD

SEQ ID NO: 2664648 - protein, 6 aa, Entamoeba histolytica
VHATDA

SEQ ID NO: 2664649 - protein, 13 aa, Entamoeba histolytica
VHDDTIQGYTSTN

SEQ ID NO: 2664650 - protein, 4 aa, Entamoeba histolytica
VHDG

SEQ ID NO: 2664651 - protein, 10 aa, Entamoeba histolytica
VHDKNDYKNY

SEQ ID NO: 2664652 - protein, 4 aa, Entamoeba histolytica
VHDP

SEQ ID NO: 2664653 - protein, 12 aa, Entamoeba histolytica
VHGRATGPYATL

SEQ ID NO: 2664654 - protein, 28 aa, Entamoeba histolytica
VHKEKRKEIRNKKKAEEEKKEEEWKKGM

SEQ ID NO: 2664655 - protein, 7 aa, Entamoeba histolytica
VHLPRKS

SEQ ID NO: 2664656 - protein, 5 aa, Entamoeba histolytica
VHPGE

SEQ ID NO: 2664657 - protein, 5 aa, Entamoeba histolytica
VHPSG

SEQ ID NO: 2664658 - protein, 13 aa, Entamoeba histolytica
VHQETSERLISTK

SEQ ID NO: 2664659 - protein, 26 aa, Entamoeba histolytica
VHQPNGKIKTQKWKGGSNKEKKSKGK

SEQ ID NO: 2664660 - protein, 8 aa, Entamoeba histolytica
VHQQPPTL

SEQ ID NO: 2664661 - protein, 7 aa, Entamoeba histolytica
VHQTTIQ

SEQ ID NO: 2664662 - protein, 6 aa, Entamoeba histolytica
VHREGN

SEQ ID NO: 2664663 - protein, 6 aa, Entamoeba histolytica
VHRKNE

SEQ ID NO: 2664664 - protein, 5 aa, Entamoeba histolytica
VHRQS

SEQ ID NO: 2664665 - protein, 4 aa, Entamoeba histolytica
VHSG

SEQ ID NO: 2664666 - protein, 12 aa, Entamoeba histolytica
VHSNGQNNLPSI

SEQ ID NO: 2664667 - protein, 14 aa, Entamoeba histolytica
VHTPDETMDIESGN

SEQ ID NO: 2664668 - protein, 5 aa, Entamoeba histolytica
VHTPK

SEQ ID NO: 2664669 - protein, 17 aa, Entamoeba histolytica
VHTQPKKNEKIEYKQSP

SEQ ID NO: 2664670 - protein, 11 aa, Entamoeba histolytica
VHTQTQEIEQK

SEQ ID NO: 2664671 - protein, 7 aa, Entamoeba histolytica
VHTSSLS

SEQ ID NO: 2664672 - protein, 19 aa, Entamoeba histolytica
VHVSDENLNQIASKAHGDV

SEQ ID NO: 2664673 - protein, 4 aa, Entamoeba histolytica
VIDE

SEQ ID NO: 2664674 - protein, 12 aa, Entamoeba histolytica
VIDQPPQHQGER

SEQ ID NO: 2664675 - protein, 4 aa, Entamoeba histolytica
VIDS

SEQ ID NO: 2664676 - protein, 4 aa, Entamoeba histolytica
VIEA

SEQ ID NO: 2664677 - protein, 4 aa, Entamoeba histolytica
VIEE

SEQ ID NO: 2664678 - protein, 9 aa, Entamoeba histolytica
VIEKTKKNE

SEQ ID NO: 2664679 - protein, 4 aa, Entamoeba histolytica
VIEP

SEQ ID NO: 2664680 - protein, 20 aa, Entamoeba histolytica
VIEPKKQRSEVKKRNIESMK

SEQ ID NO: 2664681 - protein, 48 aa, Entamoeba histolytica
VIEQPQQSIQEEPKEEIKEEKKEEPKEEVKEEIKEEPKEEVKEKPKAI

SEQ ID NO: 2664682 - protein, 36 aa, Entamoeba histolytica
VIEQPQQSIQEEPKEEVREEIKEEPKEEVKEKPKAI

SEQ ID NO: 2664683 - protein, 11 aa, Entamoeba histolytica
VIGDPNTPEIE

SEQ ID NO: 2664684 - protein, 10 aa, Entamoeba histolytica
VIGEETTSNH

SEQ ID NO: 2664685 - protein, 5 aa, Entamoeba histolytica
VIGEK

SEQ ID NO: 2664686 - protein, 14 aa, Entamoeba histolytica
VIGSLNQENQEPLS

SEQ ID NO: 2664687 - protein, 8 aa, Entamoeba histolytica
VIGSPSGI

SEQ ID NO: 2664688 - protein, 5 aa, Entamoeba histolytica
VIGTE

SEQ ID NO: 2664689 - protein, 13 aa, Entamoeba histolytica
VIKESQKKRGASV

SEQ ID NO: 2664690 - protein, 10 aa, Entamoeba histolytica
VIKPSSQRQI

SEQ ID NO: 2664691 - protein, 11 aa, Entamoeba histolytica
VINAQNELGET

SEQ ID NO: 2664692 - protein, 4 aa, Entamoeba histolytica
VIND

SEQ ID NO: 2664693 - protein, 11 aa, Entamoeba histolytica
VINDGDNNGNE

SEQ ID NO: 2664694 - protein, 53 aa, Entamoeba histolytica
VINPKKKSKELDRNNKSTSTLRKNEMPQKQVNTTNPFDDTNDLTNKKPTTTQS

SEQ ID NO: 2664695 - protein, 10 aa, Entamoeba histolytica
VINQNENSYE

SEQ ID NO: 2664696 - protein, 7 aa, Entamoeba histolytica
VINQQPK

SEQ ID NO: 2664697 - protein, 4 aa, Entamoeba histolytica
VIPD

SEQ ID NO: 2664698 - protein, 12 aa, Entamoeba histolytica
VIPNTKKPQIKE

SEQ ID NO: 2664699 - protein, 4 aa, Entamoeba histolytica
VIPQ

SEQ ID NO: 2664700 - protein, 8 aa, Entamoeba histolytica
VIPQEGEI

SEQ ID NO: 2664701 - protein, 9 aa, Entamoeba histolytica
VIPTKDGSI

SEQ ID NO: 2664702 - protein, 15 aa, Entamoeba histolytica
VIPTNQTAGNINMED

SEQ ID NO: 2664703 - protein, 9 aa, Entamoeba histolytica
VIRKRGKNL

SEQ ID NO: 2664704 - protein, 12 aa, Entamoeba histolytica
VIRTSNEEKQLR

SEQ ID NO: 2664705 - protein, 4 aa, Entamoeba histolytica
VISE

SEQ ID NO: 2664706 - protein, 10 aa, Entamoeba histolytica
VISEAKRKNC

SEQ ID NO: 2664707 - protein, 21 aa, Entamoeba histolytica
VISEEGPKKVKKSKPQPPPTA

SEQ ID NO: 2664708 - protein, 12 aa, Entamoeba histolytica
VISEGTSKHQVI

SEQ ID NO: 2664709 - protein, 14 aa, Entamoeba histolytica
VISEKKKNKSLKQI

SEQ ID NO: 2664710 - protein, 11 aa, Entamoeba histolytica
VISGGTKEHAD

SEQ ID NO: 2664711 - protein, 18 aa, Entamoeba histolytica
VISPQKQTFLSPKKTIPL

SEQ ID NO: 2664712 - protein, 5 aa, Entamoeba histolytica
VISRQ

SEQ ID NO: 2664713 - protein, 12 aa, Entamoeba histolytica
VISSQSSTTSFP

SEQ ID NO: 2664714 - protein, 18 aa, Entamoeba histolytica
VKAAKKAQHFPARKFFVL

SEQ ID NO: 2664715 - protein, 14 aa, Entamoeba histolytica
VKADQEEEGIPSTA

SEQ ID NO: 2664716 - protein, 7 aa, Entamoeba histolytica
VKAESTD

SEQ ID NO: 2664717 - protein, 7 aa, Entamoeba histolytica
VKAKGNR

SEQ ID NO: 2664718 - protein, 18 aa, Entamoeba histolytica
VKAKREKRKAAKFSAEKQ

SEQ ID NO: 2664719 - protein, 4 aa, Entamoeba histolytica
VKAN

SEQ ID NO: 2664720 - protein, 7 aa, Entamoeba histolytica
VKANPEM

SEQ ID NO: 2664721 - protein, 20 aa, Entamoeba histolytica
VKASQTKHIKQSISTQYPGL

SEQ ID NO: 2664722 - protein, 7 aa, Entamoeba histolytica
VKDDESK

SEQ ID NO: 2664723 - protein, 19 aa, Entamoeba histolytica
VKDEKQNQNKEDKKLNEIK

SEQ ID NO: 2664724 - protein, 8 aa, Entamoeba histolytica
VKDEVSRH

SEQ ID NO: 2664725 - protein, 7 aa, Entamoeba histolytica
VKDGRKI

SEQ ID NO: 2664726 - protein, 23 aa, Entamoeba histolytica
VKDHMDNPQHRGEITEEEGKEHG

SEQ ID NO: 2664727 - protein, 8 aa, Entamoeba histolytica
VKDIKKEI

SEQ ID NO: 2664728 - protein, 8 aa, Entamoeba histolytica
VKDKEEMK

SEQ ID NO: 2664729 - protein, 11 aa, Entamoeba histolytica
VKDKEETIAKL

SEQ ID NO: 2664730 - protein, 8 aa, Entamoeba histolytica
VKDKINKE

SEQ ID NO: 2664731 - protein, 10 aa, Entamoeba histolytica
VKDKKESDIS

SEQ ID NO: 2664732 - protein, 16 aa, Entamoeba histolytica
VKDKKKETKKCNTEDR

SEQ ID NO: 2664733 - protein, 12 aa, Entamoeba histolytica
VKDNEVKIEQQE

SEQ ID NO: 2664734 - protein, 10 aa, Entamoeba histolytica
VKDNNGTSNL

SEQ ID NO: 2664735 - protein, 7 aa, Entamoeba histolytica
VKDNTVD

SEQ ID NO: 2664736 - protein, 6 aa, Entamoeba histolytica
VKDPKI

SEQ ID NO: 2664737 - protein, 22 aa, Entamoeba histolytica
VKDQLDKAQDDLADKEDELATL

SEQ ID NO: 2664738 - protein, 8 aa, Entamoeba histolytica
VKDRDQET

SEQ ID NO: 2664739 - protein, 8 aa, Entamoeba histolytica
VKDREEHE

SEQ ID NO: 2664740 - protein, 8 aa, Entamoeba histolytica
VKDRETVE

SEQ ID NO: 2664741 - protein, 35 aa, Entamoeba histolytica
VKDSEIKEISKKIEEGMVGKKNKEKNKEMIKESKE

SEQ ID NO: 2664742 - protein, 7 aa, Entamoeba histolytica
VKDVSRG

SEQ ID NO: 2664743 - protein, 6 aa, Entamoeba histolytica
VKEAEN

SEQ ID NO: 2664744 - protein, 6 aa, Entamoeba histolytica
VKEAGA

SEQ ID NO: 2664745 - protein, 7 aa, Entamoeba histolytica
VKEANEA

SEQ ID NO: 2664746 - protein, 4 aa, Entamoeba histolytica
VKEC

SEQ ID NO: 2664747 - protein, 11 aa, Entamoeba histolytica
VKEDEENNDEL

SEQ ID NO: 2664748 - protein, 5 aa, Entamoeba histolytica
VKEDN

SEQ ID NO: 2664749 - protein, 6 aa, Entamoeba histolytica
VKEDNE

SEQ ID NO: 2664750 - protein, 14 aa, Entamoeba histolytica
VKEEAKEEEKKIQE

SEQ ID NO: 2664751 - protein, 6 aa, Entamoeba histolytica
VKEEEE

SEQ ID NO: 2664752 - protein, 17 aa, Entamoeba histolytica
VKEEEMPKTKELTPETT

SEQ ID NO: 2664753 - protein, 12 aa, Entamoeba histolytica
VKEEESDDDDDL

SEQ ID NO: 2664754 - protein, 34 aa, Entamoeba histolytica
VKEEETNKSTEPIQETKNKQQEESKEEEDSEEEL

SEQ ID NO: 2664755 - protein, 18 aa, Entamoeba histolytica
VKEEKKDEEEKKPAKCEN

SEQ ID NO: 2664756 - protein, 7 aa, Entamoeba histolytica
VKEEREK

SEQ ID NO: 2664757 - protein, 8 aa, Entamoeba histolytica
VKEGDIDE

SEQ ID NO: 2664758 - protein, 13 aa, Entamoeba histolytica
VKEGELVNKRNKQ

SEQ ID NO: 2664759 - protein, 10 aa, Entamoeba histolytica
VKEGKSNSHE

SEQ ID NO: 2664760 - protein, 9 aa, Entamoeba histolytica
VKEGNQPSF

SEQ ID NO: 2664761 - protein, 15 aa, Entamoeba histolytica
VKEIEKENKKIRKEI

SEQ ID NO: 2664762 - protein, 55 aa, Entamoeba histolytica
VKEIPTHNNSEKKEERQQLPPREGRRYGERKEHTHGRREGGNQRRGGKKQFHASE

SEQ ID NO: 2664763 - protein, 13 aa, Entamoeba histolytica
VKEKEKDLKENDE

SEQ ID NO: 2664764 - protein, 14 aa, Entamoeba histolytica
VKEKIGKDGIKQIE

SEQ ID NO: 2664765 - protein, 28 aa, Entamoeba histolytica
VKEKKEEEKKDKEEEDNKDKEEEEKKEE

SEQ ID NO: 2664766 - protein, 24 aa, Entamoeba histolytica
VKEKKREETSRNNGVSQSTSIQPP

SEQ ID NO: 2664767 - protein, 10 aa, Entamoeba histolytica
VKEKKVRNIP

SEQ ID NO: 2664768 - protein, 10 aa, Entamoeba histolytica
VKEKRKTEDL

SEQ ID NO: 2664769 - protein, 8 aa, Entamoeba histolytica
VKELGNKA

SEQ ID NO: 2664770 - protein, 31 aa, Entamoeba histolytica
VKELNDRIKEKNKQIDDYEKTIEENKEDFEA

SEQ ID NO: 2664771 - protein, 10 aa, Entamoeba histolytica
VKELTDTQTV

SEQ ID NO: 2664772 - protein, 11 aa, Entamoeba histolytica
VKENEEPLDQR

SEQ ID NO: 2664773 - protein, 9 aa, Entamoeba histolytica
VKENKNENI

SEQ ID NO: 2664774 - protein, 5 aa, Entamoeba histolytica
VKENQ

SEQ ID NO: 2664775 - protein, 6 aa, Entamoeba histolytica
VKENSE

SEQ ID NO: 2664776 - protein, 8 aa, Entamoeba histolytica
VKEPGTTI

SEQ ID NO: 2664777 - protein, 9 aa, Entamoeba histolytica
VKEQTRENG

SEQ ID NO: 2664778 - protein, 4 aa, Entamoeba histolytica
VKER

SEQ ID NO: 2664779 - protein, 8 aa, Entamoeba histolytica
VKESAGKQ

SEQ ID NO: 2664780 - protein, 17 aa, Entamoeba histolytica
VKESDQNTLKEIREEGN

SEQ ID NO: 2664781 - protein, 11 aa, Entamoeba histolytica
VKESPDKDFDI

SEQ ID NO: 2664782 - protein, 6 aa, Entamoeba histolytica
VKESQL

SEQ ID NO: 2664783 - protein, 7 aa, Entamoeba histolytica
VKETPGW

SEQ ID NO: 2664784 - protein, 9 aa, Entamoeba histolytica
VKETPSPIL

SEQ ID NO: 2664785 - protein, 11 aa, Entamoeba histolytica
VKETQEESNQN

SEQ ID NO: 2664786 - protein, 5 aa, Entamoeba histolytica
VKEVE

SEQ ID NO: 2664787 - protein, 8 aa, Entamoeba histolytica
VKFQGKRS

SEQ ID NO: 2664788 - protein, 8 aa, Entamoeba histolytica
VKFSPDGQ

SEQ ID NO: 2664789 - protein, 10 aa, Entamoeba histolytica
VKGKEGEKEE

SEQ ID NO: 2664790 - protein, 7 aa, Entamoeba histolytica
VKGKEGR

SEQ ID NO: 2664791 - protein, 6 aa, Entamoeba histolytica
VKGKKL

SEQ ID NO: 2664792 - protein, 9 aa, Entamoeba histolytica
VKGKKPEVI

SEQ ID NO: 2664793 - protein, 6 aa, Entamoeba histolytica
VKGLES

SEQ ID NO: 2664794 - protein, 10 aa, Entamoeba histolytica
VKGPNGIEED

SEQ ID NO: 2664795 - protein, 7 aa, Entamoeba histolytica
VKGRKQM

SEQ ID NO: 2664796 - protein, 6 aa, Entamoeba histolytica
VKGRQI

SEQ ID NO: 2664797 - protein, 13 aa, Entamoeba histolytica
VKGSSKNSSLPSH

SEQ ID NO: 2664798 - protein, 11 aa, Entamoeba histolytica
VKGTEQEHKTL

SEQ ID NO: 2664799 - protein, 17 aa, Entamoeba histolytica
VKGTLQTDYTVKDTDPR

SEQ ID NO: 2664800 - protein, 7 aa, Entamoeba histolytica
VKGVEKE

SEQ ID NO: 2664801 - protein, 12 aa, Entamoeba histolytica
VKHSDVDDPLGR

SEQ ID NO: 2664802 - protein, 11 aa, Entamoeba histolytica
VKHSNAIDDEI

SEQ ID NO: 2664803 - protein, 19 aa, Entamoeba histolytica
VKHTNSSEFSESSHGGDYK

SEQ ID NO: 2664804 - protein, 4 aa, Entamoeba histolytica
VKIE

SEQ ID NO: 2664805 - protein, 29 aa, Entamoeba histolytica
VKIQEEKKKKISKEKKEQQEGEEETNTNP

SEQ ID NO: 2664806 - protein, 4 aa, Entamoeba histolytica
VKKA

SEQ ID NO: 2664807 - protein, 10 aa, Entamoeba histolytica
VKKAKRHDAV

SEQ ID NO: 2664808 - protein, 6 aa, Entamoeba histolytica
VKKDDK

SEQ ID NO: 2664809 - protein, 9 aa, Entamoeba histolytica
VKKDGKKVE

SEQ ID NO: 2664810 - protein, 8 aa, Entamoeba histolytica
VKKDLSKS

SEQ ID NO: 2664811 - protein, 5 aa, Entamoeba histolytica
VKKDV

SEQ ID NO: 2664812 - protein, 5 aa, Entamoeba histolytica
VKKED

SEQ ID NO: 2664813 - protein, 9 aa, Entamoeba histolytica
VKKEEKVIE

SEQ ID NO: 2664814 - protein, 8 aa, Entamoeba histolytica
VKKESSNT

SEQ ID NO: 2664815 - protein, 13 aa, Entamoeba histolytica
VKKETKRKTSKLY

SEQ ID NO: 2664816 - protein, 7 aa, Entamoeba histolytica
VKKGERC

SEQ ID NO: 2664817 - protein, 13 aa, Entamoeba histolytica
VKKGKTSSKSYQM

SEQ ID NO: 2664818 - protein, 6 aa, Entamoeba histolytica
VKKGNK

SEQ ID NO: 2664819 - protein, 6 aa, Entamoeba histolytica
VKKGNL

SEQ ID NO: 2664820 - protein, 6 aa, Entamoeba histolytica
VKKGVS

SEQ ID NO: 2664821 - protein, 9 aa, Entamoeba histolytica
VKKHGSDKA

SEQ ID NO: 2664822 - protein, 16 aa, Entamoeba histolytica
VKKKQNKKTDNGFDGG

SEQ ID NO: 2664823 - protein, 40 aa, Entamoeba histolytica
VKKNVKRKNVVKNVVVQEKHLRNLTHLKKHKLEKKRQNLK

SEQ ID NO: 2664824 - protein, 12 aa, Entamoeba histolytica
VKKNVTKSKKSK

SEQ ID NO: 2664825 - protein, 17 aa, Entamoeba histolytica
VKKPKKNNKKPTLVQSS

SEQ ID NO: 2664826 - protein, 8 aa, Entamoeba histolytica
VKKRGTRR

SEQ ID NO: 2664827 - protein, 8 aa, Entamoeba histolytica
VKKSDEKD

SEQ ID NO: 2664828 - protein, 10 aa, Entamoeba histolytica
VKKSFSGNLS

SEQ ID NO: 2664829 - protein, 9 aa, Entamoeba histolytica
VKKTPSRKI

SEQ ID NO: 2664830 - protein, 8 aa, Entamoeba histolytica
VKKTSNTA

SEQ ID NO: 2664831 - protein, 38 aa, Entamoeba histolytica
VKKTTTLMKPSKKQSKINQEDEEIKTTSSLRKEIENKR

SEQ ID NO: 2664832 - protein, 10 aa, Entamoeba histolytica
VKKYEAGYHQ

SEQ ID NO: 2664833 - protein, 8 aa, Entamoeba histolytica
VKLNEQSK

SEQ ID NO: 2664834 - protein, 10 aa, Entamoeba histolytica
VKLNSEVNKE

SEQ ID NO: 2664835 - protein, 10 aa, Entamoeba histolytica
VKNDIKEKGF

SEQ ID NO: 2664836 - protein, 21 aa, Entamoeba histolytica
VKNDKTVTISSAVPNNSSHRK

SEQ ID NO: 2664837 - protein, 7 aa, Entamoeba histolytica
VKNEEAY

SEQ ID NO: 2664838 - protein, 28 aa, Entamoeba histolytica
VKNERKSLQKKEIKEQNEEDIRKKSDNV

SEQ ID NO: 2664839 - protein, 10 aa, Entamoeba histolytica
VKNGSNAGYS

SEQ ID NO: 2664840 - protein, 10 aa, Entamoeba histolytica
VKNKDGEDTL

SEQ ID NO: 2664841 - protein, 8 aa, Entamoeba histolytica
VKNKEGEY

SEQ ID NO: 2664842 - protein, 6 aa, Entamoeba histolytica
VKNNEL

SEQ ID NO: 2664843 - protein, 28 aa, Entamoeba histolytica
VKNPQEKEELVQSSNKENSLQDTTLPSK

SEQ ID NO: 2664844 - protein, 6 aa, Entamoeba histolytica
VKNPSK

SEQ ID NO: 2664845 - protein, 9 aa, Entamoeba histolytica
VKNPSQQAI

SEQ ID NO: 2664846 - protein, 9 aa, Entamoeba histolytica
VKNQSNKTN

SEQ ID NO: 2664847 - protein, 7 aa, Entamoeba histolytica
VKNREEF

SEQ ID NO: 2664848 - protein, 7 aa, Entamoeba histolytica
VKNSGEV

SEQ ID NO: 2664849 - protein, 17 aa, Entamoeba histolytica
VKNSSTDDDFMKRFTRK

SEQ ID NO: 2664850 - protein, 8 aa, Entamoeba histolytica
VKNSTIEQ

SEQ ID NO: 2664851 - protein, 11 aa, Entamoeba histolytica
VKPAPRQETPI

SEQ ID NO: 2664852 - protein, 5 aa, Entamoeba histolytica
VKPAQ

SEQ ID NO: 2664853 - protein, 4 aa, Entamoeba histolytica
VKPD

SEQ ID NO: 2664854 - protein, 9 aa, Entamoeba histolytica
VKPDIPSTI

SEQ ID NO: 2664855 - protein, 6 aa, Entamoeba histolytica
VKPEDD

SEQ ID NO: 2664856 - protein, 6 aa, Entamoeba histolytica
VKPEET

SEQ ID NO: 2664857 - protein, 8 aa, Entamoeba histolytica
VKPEYQSP

SEQ ID NO: 2664858 - protein, 10 aa, Entamoeba histolytica
VKPHTKPKNN

SEQ ID NO: 2664859 - protein, 9 aa, Entamoeba histolytica
VKPIPQSSF

SEQ ID NO: 2664860 - protein, 14 aa, Entamoeba histolytica
VKPKVEYDEFGQPK

SEQ ID NO: 2664861 - protein, 24 aa, Entamoeba histolytica
VKPNEKEGVGIKEEEENGAVIEIA

SEQ ID NO: 2664862 - protein, 7 aa, Entamoeba histolytica
VKPPSAT

SEQ ID NO: 2664863 - protein, 10 aa, Entamoeba histolytica
VKPPSSNLPK

SEQ ID NO: 2664864 - protein, 5 aa, Entamoeba histolytica
VKPSD

SEQ ID NO: 2664865 - protein, 6 aa, Entamoeba histolytica
VKPSEQ

SEQ ID NO: 2664866 - protein, 5 aa, Entamoeba histolytica
VKPSL

SEQ ID NO: 2664867 - protein, 6 aa, Entamoeba histolytica
VKPSPF

SEQ ID NO: 2664868 - protein, 6 aa, Entamoeba histolytica
VKPTNY

SEQ ID NO: 2664869 - protein, 9 aa, Entamoeba histolytica
VKPTTTLKK

SEQ ID NO: 2664870 - protein, 21 aa, Entamoeba histolytica
VKQAINESKKPKPEGRYTVPP

SEQ ID NO: 2664871 - protein, 5 aa, Entamoeba histolytica
VKQAL

SEQ ID NO: 2664872 - protein, 9 aa, Entamoeba histolytica
VKQDLKSKR

SEQ ID NO: 2664873 - protein, 40 aa, Entamoeba histolytica
VKQEEEKKKRAEEEEKRRRAEERKRKEEEARKKEEEEVER

SEQ ID NO: 2664874 - protein, 12 aa, Entamoeba histolytica
VKQEEGWKGTPY

SEQ ID NO: 2664875 - protein, 7 aa, Entamoeba histolytica
VKQEKGR

SEQ ID NO: 2664876 - protein, 21 aa, Entamoeba histolytica
VKQETKKDEEQPIQPKQIKHE

SEQ ID NO: 2664877 - protein, 5 aa, Entamoeba histolytica
VKQGD

SEQ ID NO: 2664878 - protein, 8 aa, Entamoeba histolytica
VKQGEPNC

SEQ ID NO: 2664879 - protein, 5 aa, Entamoeba histolytica
VKQGY

SEQ ID NO: 2664880 - protein, 6 aa, Entamoeba histolytica
VKQKDS

SEQ ID NO: 2664881 - protein, 123 aa, Entamoeba histolytica
VKQKQEQKKSDFSTKPTSAHTYSSSYTSHSTQPVSYNTSHNVKETTKSSTVTKKENSLELKTSTTTQHKDDKINHTSSSTRAYQQPQFTKPKITPSQSNTSSKSQVSTSKPIKFEQKQSNDVD

SEQ ID NO: 2664882 - protein, 38 aa, Entamoeba histolytica; identical to SEQ ID NO: 2469758

SEQ ID NO: 2664883 - protein, 98 aa, Entamoeba histolytica
VKQNGTKEGPPHLQPPSEQSLPKQNTLPPKPAAPAALPPKHHQSLSPKTSSQTQLQTTPAAPIEQPPTPPKPAHLTSKEEKKKKKEEKKKEKEKKKSK

SEQ ID NO: 2664884 - protein, 8 aa, Entamoeba histolytica
VKQQDEID

SEQ ID NO: 2664885 - protein, 24 aa, Entamoeba histolytica
VKQQEEITKEKQDEEDKQADDTKI

SEQ ID NO: 2664886 - protein, 7 aa, Entamoeba histolytica
VKQQNST

SEQ ID NO: 2664887 - protein, 7 aa, Entamoeba histolytica
VKQSPMD

SEQ ID NO: 2664888 - protein, 12 aa, Entamoeba histolytica
VKQTKENAILVE

SEQ ID NO: 2664889 - protein, 9 aa, Entamoeba histolytica
VKQTNGEFS

SEQ ID NO: 2664890 - protein, 11 aa, Entamoeba histolytica
VKREEGKEKNK

SEQ ID NO: 2664891 - protein, 8 aa, Entamoeba histolytica
VKREETDL

SEQ ID NO: 2664892 - protein, 10 aa, Entamoeba histolytica
VKREGSQNGQ

SEQ ID NO: 2664893 - protein, 10 aa, Entamoeba histolytica
VKREKKAIAL

SEQ ID NO: 2664894 - protein, 17 aa, Entamoeba histolytica
VKRGDEEKKPKKSETKD

SEQ ID NO: 2664895 - protein, 14 aa, Entamoeba histolytica
VKRGESAKETFKGY

SEQ ID NO: 2664896 - protein, 7 aa, Entamoeba histolytica
VKRGTDW

SEQ ID NO: 2664897 - protein, 7 aa, Entamoeba histolytica
VKRKAAA

SEQ ID NO: 2664898 - protein, 13 aa, Entamoeba histolytica
VKRKKSEENNNVE

SEQ ID NO: 2664899 - protein, 15 aa, Entamoeba histolytica
VKRNEKGKAKYPVSG

SEQ ID NO: 2664900 - protein, 10 aa, Entamoeba histolytica
VKRNEKRKEM

SEQ ID NO: 2664901 - protein, 21 aa, Entamoeba histolytica
VKRQEKGGGGSTIGPKIASHT

SEQ ID NO: 2664902 - protein, 5 aa, Entamoeba histolytica
VKRTE

SEQ ID NO: 2664903 - protein, 13 aa, Entamoeba histolytica
VKRVGTDGKVSYN

SEQ ID NO: 2664904 - protein, 25 aa, Entamoeba histolytica
VKRVKGEKNTKKSKTLQKEGNDITP

SEQ ID NO: 2664905 - protein, 35 aa, Entamoeba histolytica
VKSDDSKNLLSSSPRIKKISNNTNQQNSPSPFRTP

SEQ ID NO: 2664906 - protein, 8 aa, Entamoeba histolytica
VKSDSKEV

SEQ ID NO: 2664907 - protein, 10 aa, Entamoeba histolytica
VKSEDSQEIA

SEQ ID NO: 2664908 - protein, 11 aa, Entamoeba histolytica
VKSGEGDRSDV

SEQ ID NO: 2664909 - protein, 8 aa, Entamoeba histolytica
VKSGNGWR

SEQ ID NO: 2664910 - protein, 6 aa, Entamoeba histolytica
VKSKEE

SEQ ID NO: 2664911 - protein, 19 aa, Entamoeba histolytica
VKSKEQKQTQPQVKKTLGQ

SEQ ID NO: 2664912 - protein, 19 aa, Entamoeba histolytica
VKSKPKSKNTENEKNEGLY

SEQ ID NO: 2664913 - protein, 14 aa, Entamoeba histolytica
VKSKTVHTRIERRE

SEQ ID NO: 2664914 - protein, 5 aa, Entamoeba histolytica
VKSNE

SEQ ID NO: 2664915 - protein, 8 aa, Entamoeba histolytica
VKSNLNGD

SEQ ID NO: 2664916 - protein, 9 aa, Entamoeba histolytica
VKSNSGDAA

SEQ ID NO: 2664917 - protein, 9 aa, Entamoeba histolytica
VKSNTDEFG

SEQ ID NO: 2664918 - protein, 10 aa, Entamoeba histolytica
VKSQQDAGKE

SEQ ID NO: 2664919 - protein, 11 aa, Entamoeba histolytica
VKSQTETSQID

SEQ ID NO: 2664920 - protein, 9 aa, Entamoeba histolytica
VKSRNERIE

SEQ ID NO: 2664921 - protein, 5 aa, Entamoeba histolytica
VKSSG

SEQ ID NO: 2664922 - protein, 7 aa, Entamoeba histolytica
VKSSKNA

SEQ ID NO: 2664923 - protein, 7 aa, Entamoeba histolytica
VKSSTSC

SEQ ID NO: 2664924 - protein, 6 aa, Entamoeba histolytica
VKSTEL

SEQ ID NO: 2664925 - protein, 10 aa, Entamoeba histolytica
VKSTIDDSTK

SEQ ID NO: 2664926 - protein, 8 aa, Entamoeba histolytica
VKSTTLDN

SEQ ID NO: 2664927 - protein, 9 aa, Entamoeba histolytica
VKSYQRSPE

SEQ ID NO: 2664928 - protein, 8 aa, Entamoeba histolytica
VKTAETGY

SEQ ID NO: 2664929 - protein, 8 aa, Entamoeba histolytica
VKTASSGY

SEQ ID NO: 2664930 - protein, 11 aa, Entamoeba histolytica
VKTCTSNGNDY

SEQ ID NO: 2664931 - protein, 7 aa, Entamoeba histolytica
VKTDQLY

SEQ ID NO: 2664932 - protein, 5 aa, Entamoeba histolytica
VKTED

SEQ ID NO: 2664933 - protein, 6 aa, Entamoeba histolytica
VKTGVL

SEQ ID NO: 2664934 - protein, 17 aa, Entamoeba histolytica
VKTKNQPSILTGDDSLN

SEQ ID NO: 2664935 - protein, 13 aa, Entamoeba histolytica
VKTKPSPVTLGPG

SEQ ID NO: 2664936 - protein, 8 aa, Entamoeba histolytica
VKTKQNLH

SEQ ID NO: 2664937 - protein, 7 aa, Entamoeba histolytica
VKTKYNE

SEQ ID NO: 2664938 - protein, 28 aa, Entamoeba histolytica
VKTNDDFDDEDDEMDKNINTELPVLPPS

SEQ ID NO: 2664939 - protein, 8 aa, Entamoeba histolytica
VKTQNKER

SEQ ID NO: 2664940 - protein, 9 aa, Entamoeba histolytica
VKTREDAET

SEQ ID NO: 2664941 - protein, 8 aa, Entamoeba histolytica
VKTRTSVQ

SEQ ID NO: 2664942 - protein, 9 aa, Entamoeba histolytica
VKTSDTGYI

SEQ ID NO: 2664943 - protein, 35 aa, Entamoeba histolytica
VKTSTNTQKQQPSISKQESFSSQRVAKSPEPTLKD

SEQ ID NO: 2664944 - protein, 10 aa, Entamoeba histolytica
VKTTFTKHTG

SEQ ID NO: 2664945 - protein, 11 aa, Entamoeba histolytica
VKTTKMADDSM

SEQ ID NO: 2664946 - protein, 11 aa, Entamoeba histolytica
VKTTTGASTDV

SEQ ID NO: 2664947 - protein, 19 aa, Entamoeba histolytica
VKVDTARSFAAANKEMTKI

SEQ ID NO: 2664948 - protein, 10 aa, Entamoeba histolytica
VKVRRPKDYN

SEQ ID NO: 2664949 - protein, 10 aa, Entamoeba histolytica
VKVSSPKKKV

SEQ ID NO: 2664950 - protein, 4 aa, Entamoeba histolytica
VKYA

SEQ ID NO: 2664951 - protein, 11 aa, Entamoeba histolytica
VKYEESSAASL

SEQ ID NO: 2664952 - protein, 14 aa, Entamoeba histolytica
VKYGNLRQSYDDPH

SEQ ID NO: 2664953 - protein, 8 aa, Entamoeba histolytica
VKYQTTRA

SEQ ID NO: 2664954 - protein, 9 aa, Entamoeba histolytica
VKYSQSDLK

SEQ ID NO: 2664955 - protein, 10 aa, Entamoeba histolytica
VKYTDQSEVE

SEQ ID NO: 2664956 - protein, 19 aa, Entamoeba histolytica
VLDDEEYEKIQDAAEEEDD

SEQ ID NO: 2664957 - protein, 6 aa, Entamoeba histolytica
VLEQGK

SEQ ID NO: 2664958 - protein, 26 aa, Entamoeba histolytica
VLGKKEKKIKEKMTNEIDKEKPVKDE

SEQ ID NO: 2664959 - protein, 4 aa, Entamoeba histolytica
VLGN

SEQ ID NO: 2664960 - protein, 7 aa, Entamoeba histolytica
VLGTSDT

SEQ ID NO: 2664961 - protein, 7 aa, Entamoeba histolytica
VLKEGET

SEQ ID NO: 2664962 - protein, 21 aa, Entamoeba histolytica
VLKGRNQLEEFTGTNGKSLNE

SEQ ID NO: 2664963 - protein, 17 aa, Entamoeba histolytica
VLKKRGRKKSENTDLQE

SEQ ID NO: 2664964 - protein, 11 aa, Entamoeba histolytica
VLNGNRATLNG

SEQ ID NO: 2664965 - protein, 4 aa, Entamoeba histolytica
VLNQ

SEQ ID NO: 2664966 - protein, 12 aa, Entamoeba histolytica
VLPDNTNEKNEL

SEQ ID NO: 2664967 - protein, 8 aa, Entamoeba histolytica
VLPDSENF

SEQ ID NO: 2664968 - protein, 21 aa, Entamoeba histolytica
VLPPEPKEIKMEESDEETIDE

SEQ ID NO: 2664969 - protein, 10 aa, Entamoeba histolytica
VLPPTEINEG

SEQ ID NO: 2664970 - protein, 4 aa, Entamoeba histolytica
VLPT

SEQ ID NO: 2664971 - protein, 6 aa, Entamoeba histolytica
VLQQTR

SEQ ID NO: 2664972 - protein, 23 aa, Entamoeba histolytica
VLQRTNTLETGVGERNLTPTTSI

SEQ ID NO: 2664973 - protein, 17 aa, Entamoeba histolytica
VLRTKKNERSNERTNRR

SEQ ID NO: 2664974 - protein, 14 aa, Entamoeba histolytica
VLRTPQPRKSYSIK

SEQ ID NO: 2664975 - protein, 9 aa, Entamoeba histolytica
VLSDQEKKA

SEQ ID NO: 2664976 - protein, 8 aa, Entamoeba histolytica
VLSKSKNP

SEQ ID NO: 2664977 - protein, 13 aa, Entamoeba histolytica
VLSPRSKAQSNQT

SEQ ID NO: 2664978 - protein, 21 aa, Entamoeba histolytica
VLSSTRSSARSTAGDQASRVS

SEQ ID NO: 2664979 - protein, 25 aa, Entamoeba histolytica
VLTKEKKKKKKVAENAQVKETISND

SEQ ID NO: 2664980 - protein, 15 aa, Entamoeba histolytica
VMAQEEKKEVIPENK

SEQ ID NO: 2664981 - protein, 9 aa, Entamoeba histolytica
VMASSSAEG

SEQ ID NO: 2664982 - protein, 15 aa, Entamoeba histolytica
VMKKETEKLIESPKN

SEQ ID NO: 2664983 - protein, 5 aa, Entamoeba histolytica
VMQSG

SEQ ID NO: 2664984 - protein, 6 aa, Entamoeba histolytica
VMREYT

SEQ ID NO: 2664985 - protein, 7 aa, Entamoeba histolytica
VNAKHPE

SEQ ID NO: 2664986 - protein, 4 aa, Entamoeba histolytica
VNAN

SEQ ID NO: 2664987 - protein, 6 aa, Entamoeba histolytica
VNAPEE

SEQ ID NO: 2664988 - protein, 54 aa, Entamoeba histolytica
VNAPKKEISNEEYQDEEEIRKKNEEKEQKLQEEREAEEKRKKEEEEKKTKVEKM

SEQ ID NO: 2664989 - protein, 12 aa, Entamoeba histolytica
VNASDEEQLLVF

SEQ ID NO: 2664990 - protein, 10 aa, Entamoeba histolytica
VNASDGSHFS

SEQ ID NO: 2664991 - protein, 6 aa, Entamoeba histolytica
VNATKE

SEQ ID NO: 2664992 - protein, 9 aa, Entamoeba histolytica
VNDEDANGK

SEQ ID NO: 2664993 - protein, 10 aa, Entamoeba histolytica
VNDENKIKED

SEQ ID NO: 2664994 - protein, 9 aa, Entamoeba histolytica
VNDGKTKIE

SEQ ID NO: 2664995 - protein, 14 aa, Entamoeba histolytica
VNDITDDERRKAKT

SEQ ID NO: 2664996 - protein, 6 aa, Entamoeba histolytica
VNDKSY

SEQ ID NO: 2664997 - protein, 6 aa, Entamoeba histolytica
VNDPDE

SEQ ID NO: 2664998 - protein, 6 aa, Entamoeba histolytica
VNDPEN

SEQ ID NO: 2664999 - protein, 7 aa, Entamoeba histolytica
VNDPQMS

SEQ ID NO: 2665000 - protein, 7 aa, Entamoeba histolytica
VNDRETF

SEQ ID NO: 2665001 - protein, 9 aa, Entamoeba histolytica
VNDSNKKQY

SEQ ID NO: 2665002 - protein, 5 aa, Entamoeba histolytica
VNDTD

SEQ ID NO: 2665003 - protein, 6 aa, Entamoeba histolytica
VNDTEQ

SEQ ID NO: 2665004 - protein, 6 aa, Entamoeba histolytica
VNDTRI

SEQ ID NO: 2665005 - protein, 9 aa, Entamoeba histolytica
VNEATKLPA

SEQ ID NO: 2665006 - protein, 33 aa, Entamoeba histolytica
VNEDDFNNKMKESRNQGIKELQEKEKLKEKGNK

SEQ ID NO: 2665007 - protein, 10 aa, Entamoeba histolytica
VNEDKVREAM

SEQ ID NO: 2665008 - protein, 8 aa, Entamoeba histolytica
VNEDNEKI

SEQ ID NO: 2665009 - protein, 16 aa, Entamoeba histolytica
VNEDNTKSQTELSSPH

SEQ ID NO: 2665010 - protein, 7 aa, Entamoeba histolytica
VNEDPIR

SEQ ID NO: 2665011 - protein, 9 aa, Entamoeba histolytica
VNEDRSIQS

SEQ ID NO: 2665012 - protein, 6 aa, Entamoeba histolytica
VNEEEQ

SEQ ID NO: 2665013 - protein, 10 aa, Entamoeba histolytica
VNEEKEQETH

SEQ ID NO: 2665014 - protein, 41 aa, Entamoeba histolytica
VNEEMEEENDLKKQIKDDKEIISTRNGKRKSDKKEIKERTE

SEQ ID NO: 2665015 - protein, 39 aa, Entamoeba histolytica
VNEEPDVSQQSKNQTPIEKKEEPHKENIQEEKKEITEKN

SEQ ID NO: 2665016 - protein, 54 aa, Entamoeba histolytica
VNEEQEKTNENNQTEDQNNISLQNNQNKTQDEIKEITQNSSTPIVSKPEEIPLP

SEQ ID NO: 2665017 - protein, 4 aa, Entamoeba histolytica
VNEG

SEQ ID NO: 2665018 - protein, 12 aa, Entamoeba histolytica
VNEKDINKESFE

SEQ ID NO: 2665019 - protein, 7 aa, Entamoeba histolytica
VNEKGQE

SEQ ID NO: 2665020 - protein, 6 aa, Entamoeba histolytica
VNEKKF

SEQ ID NO: 2665021 - protein, 9 aa, Entamoeba histolytica
VNEKTTQQN

SEQ ID NO: 2665022 - protein, 20 aa, Entamoeba histolytica
VNELESRPVGTGNADENEIK

SEQ ID NO: 2665023 - protein, 7 aa, Entamoeba histolytica
VNELTNE

SEQ ID NO: 2665024 - protein, 15 aa, Entamoeba histolytica
VNEMKEKQGITTNKR

SEQ ID NO: 2665025 - protein, 4 aa, Entamoeba histolytica
VNEN

SEQ ID NO: 2665026 - protein, 10 aa, Entamoeba histolytica
VNENECGKVQ

SEQ ID NO: 2665027 - protein, 7 aa, Entamoeba histolytica
VNENNSP

SEQ ID NO: 2665028 - protein, 8 aa, Entamoeba histolytica
VNENPPVQ

SEQ ID NO: 2665029 - protein, 13 aa, Entamoeba histolytica
VNENSSSNTDSDL

SEQ ID NO: 2665030 - protein, 7 aa, Entamoeba histolytica
VNENTKM

SEQ ID NO: 2665031 - protein, 81 aa, Entamoeba histolytica
VNEPEEDEEKEEEKKPKKPIKKEEKEKKTSKKEAKKETKKSSKKEDEKKKTSKKEEKKPKVPKVEKKTTSTKKEVKTKGKK

SEQ ID NO: 2665032 - protein, 8 aa, Entamoeba histolytica
VNEPKKSI

SEQ ID NO: 2665033 - protein, 7 aa, Entamoeba histolytica
VNEQEAE

SEQ ID NO: 2665034 - protein, 9 aa, Entamoeba histolytica
VNEQHNDGI

SEQ ID NO: 2665035 - protein, 9 aa, Entamoeba histolytica
VNEQNRQSL

SEQ ID NO: 2665036 - protein, 37 aa, Entamoeba histolytica
VNEQPTIKQEVTETNTHSLPQSYQSSLSIPSQNTLSS

SEQ ID NO: 2665037 - protein, 13 aa, Entamoeba histolytica
VNEQTKHRQFRSK

SEQ ID NO: 2665038 - protein, 6 aa, Entamoeba histolytica
VNERTP

SEQ ID NO: 2665039 - protein, 8 aa, Entamoeba histolytica
VNESIDKN

SEQ ID NO: 2665040 - protein, 5 aa, Entamoeba histolytica
VNESQ

SEQ ID NO: 2665041 - protein, 15 aa, Entamoeba histolytica
VNESSDNLTFIVIKI

SEQ ID NO: 2665042 - protein, 20 aa, Entamoeba histolytica
VNETQGQRCTLQPADKKNIT

SEQ ID NO: 2665043 - protein, 6 aa, Entamoeba histolytica
VNEYND

SEQ ID NO: 2665044 - protein, 6 aa, Entamoeba histolytica
VNFDNS

SEQ ID NO: 2665045 - protein, 7 aa, Entamoeba histolytica
VNGDGVL

SEQ ID NO: 2665046 - protein, 6 aa, Entamoeba histolytica
VNGDTQ

SEQ ID NO: 2665047 - protein, 13 aa, Entamoeba histolytica
VNGEKFDPTDIDK

SEQ ID NO: 2665048 - protein, 6 aa, Entamoeba histolytica
VNGERT

SEQ ID NO: 2665049 - protein, 8 aa, Entamoeba histolytica
VNGESVDS

SEQ ID NO: 2665050 - protein, 4 aa, Entamoeba histolytica
VNGG

SEQ ID NO: 2665051 - protein, 12 aa, Entamoeba histolytica
VNGISSGSSVGE

SEQ ID NO: 2665052 - protein, 7 aa, Entamoeba histolytica
VNGKADR

SEQ ID NO: 2665053 - protein, 7 aa, Entamoeba histolytica
VNGKPLT

SEQ ID NO: 2665054 - protein, 8 aa, Entamoeba histolytica
VNGKTLTS

SEQ ID NO: 2665055 - protein, 10 aa, Entamoeba histolytica
VNGNGTGSIS

SEQ ID NO: 2665056 - protein, 10 aa, Entamoeba histolytica
VNGNKVDLNP

SEQ ID NO: 2665057 - protein, 10 aa, Entamoeba histolytica
VNGNNPNAMT

SEQ ID NO: 2665058 - protein, 17 aa, Entamoeba histolytica
VNGQEVPKSNIRGGKNS

SEQ ID NO: 2665059 - protein, 4 aa, Entamoeba histolytica
VNGR

SEQ ID NO: 2665060 - protein, 9 aa, Entamoeba histolytica
VNGSEGYGY

SEQ ID NO: 2665061 - protein, 7 aa, Entamoeba histolytica
VNGSGKH

SEQ ID NO: 2665062 - protein, 13 aa, Entamoeba histolytica
VNGSNKVSEDIVS

SEQ ID NO: 2665063 - protein, 5 aa, Entamoeba histolytica
VNGST

SEQ ID NO: 2665064 - protein, 4 aa, Entamoeba histolytica
VNGT

SEQ ID NO: 2665065 - protein, 7 aa, Entamoeba histolytica
VNGTSYK

SEQ ID NO: 2665066 - protein, 11 aa, Entamoeba histolytica
VNHPGLESFPG

SEQ ID NO: 2665067 - protein, 7 aa, Entamoeba histolytica
VNHPNKQ

SEQ ID NO: 2665068 - protein, 7 aa, Entamoeba histolytica
VNHQTNN

SEQ ID NO: 2665069 - protein, 9 aa, Entamoeba histolytica
VNIQEEKRI

SEQ ID NO: 2665070 - protein, 10 aa, Entamoeba histolytica
VNIQNNKGIT

SEQ ID NO: 2665071 - protein, 9 aa, Entamoeba histolytica
VNKDQQRYE

SEQ ID NO: 2665072 - protein, 17 aa, Entamoeba histolytica
VNKEETFKHAASGSTMT

SEQ ID NO: 2665073 - protein, 8 aa, Entamoeba histolytica
VNKEGVTV

SEQ ID NO: 2665074 - protein, 7 aa, Entamoeba histolytica
VNKENAQ

SEQ ID NO: 2665075 - protein, 13 aa, Entamoeba histolytica
VNKGANQPTVKPK

SEQ ID NO: 2665076 - protein, 10 aa, Entamoeba histolytica
VNKGKKRNIR

SEQ ID NO: 2665077 - protein, 5 aa, Entamoeba histolytica
VNKKE

SEQ ID NO: 2665078 - protein, 10 aa, Entamoeba histolytica
VNKKTDEQKL

SEQ ID NO: 2665079 - protein, 10 aa, Entamoeba histolytica
VNKNESATIG

SEQ ID NO: 2665080 - protein, 9 aa, Entamoeba histolytica
VNKNNTVGE

SEQ ID NO: 2665081 - protein, 7 aa, Entamoeba histolytica
VNKQEPI

SEQ ID NO: 2665082 - protein, 8 aa, Entamoeba histolytica
VNKSQNEI

SEQ ID NO: 2665083 - protein, 9 aa, Entamoeba histolytica
VNKSSESDF

SEQ ID NO: 2665084 - protein, 31 aa, Entamoeba histolytica
VNKTKKEKVIENDKERKRDEKEEAKDQIINT

SEQ ID NO: 2665085 - protein, 9 aa, Entamoeba histolytica
VNKTSNAGD

SEQ ID NO: 2665086 - protein, 10 aa, Entamoeba histolytica
VNKTSQSSDQ

SEQ ID NO: 2665087 - protein, 4 aa, Entamoeba histolytica
VNKY

SEQ ID NO: 2665088 - protein, 15 aa, Entamoeba histolytica
VNLEGDEKKSSGSFK

SEQ ID NO: 2665089 - protein, 9 aa, Entamoeba histolytica
VNLNEEKPV

SEQ ID NO: 2665090 - protein, 5 aa, Entamoeba histolytica
VNNAT

SEQ ID NO: 2665091 - protein, 4 aa, Entamoeba histolytica
VNND

SEQ ID NO: 2665092 - protein, 6 aa, Entamoeba histolytica
VNNDTH

SEQ ID NO: 2665093 - protein, 31 aa, Entamoeba histolytica
VNNEEKKKSVTKRISQESDVSITGIKEGNNY

SEQ ID NO: 2665094 - protein, 7 aa, Entamoeba histolytica
VNNETES

SEQ ID NO: 2665095 - protein, 18 aa, Entamoeba histolytica
VNNETNTDKETQKINKEN

SEQ ID NO: 2665096 - protein, 6 aa, Entamoeba histolytica
VNNKET

SEQ ID NO: 2665097 - protein, 8 aa, Entamoeba histolytica
VNNKTSTI

SEQ ID NO: 2665098 - protein, 12 aa, Entamoeba histolytica
VNNMGKKVSEED

SEQ ID NO: 2665099 - protein, 7 aa, Entamoeba histolytica
VNNNETL

SEQ ID NO: 2665100 - protein, 8 aa, Entamoeba histolytica
VNNNSTEL

SEQ ID NO: 2665101 - protein, 10 aa, Entamoeba histolytica
VNNNTKKREM

SEQ ID NO: 2665102 - protein, 4 aa, Entamoeba histolytica
VNNQ

SEQ ID NO: 2665103 - protein, 15 aa, Entamoeba histolytica
VNNSKGDASKRDRRS

SEQ ID NO: 2665104 - protein, 8 aa, Entamoeba histolytica
VNNTVSGF

SEQ ID NO: 2665105 - protein, 10 aa, Entamoeba histolytica
VNPDNKTQER

SEQ ID NO: 2665106 - protein, 16 aa, Entamoeba histolytica
VNPDQRPSTESSVKNP

SEQ ID NO: 2665107 - protein, 4 aa, Entamoeba histolytica
VNPK

SEQ ID NO: 2665108 - protein, 25 aa, Entamoeba histolytica
VNPKPDANNVDISKQGQQTQKEGGC

SEQ ID NO: 2665109 - protein, 10 aa, Entamoeba histolytica
VNPKSKTGGY

SEQ ID NO: 2665110 - protein, 11 aa, Entamoeba histolytica
VNPKTSIKTSI

SEQ ID NO: 2665111 - protein, 7 aa, Entamoeba histolytica
VNPLENK

SEQ ID NO: 2665112 - protein, 6 aa, Entamoeba histolytica
VNPMTN

SEQ ID NO: 2665113 - protein, 9 aa, Entamoeba histolytica
VNPNNEELK

SEQ ID NO: 2665114 - protein, 7 aa, Entamoeba histolytica
VNPPFND

SEQ ID NO: 2665115 - protein, 5 aa, Entamoeba histolytica
VNPPH

SEQ ID NO: 2665116 - protein, 9 aa, Entamoeba histolytica
VNPQSQTEN

SEQ ID NO: 2665117 - protein, 5 aa, Entamoeba histolytica
VNPSD

SEQ ID NO: 2665118 - protein, 7 aa, Entamoeba histolytica
VNPSKTA

SEQ ID NO: 2665119 - protein, 9 aa, Entamoeba histolytica
VNPTDDMKY

SEQ ID NO: 2665120 - protein, 4 aa, Entamoeba histolytica
VNQG

SEQ ID NO: 2665121 - protein, 8 aa, Entamoeba histolytica
VNQKTNNI

SEQ ID NO: 2665122 - protein, 7 aa, Entamoeba histolytica
VNQMGAS

SEQ ID NO: 2665123 - protein, 20 aa, Entamoeba histolytica
VNQNGYRSNLETISDKATSP

SEQ ID NO: 2665124 - protein, 14 aa, Entamoeba histolytica
VNQPNIDETDKANW

SEQ ID NO: 2665125 - protein, 21 aa, Entamoeba histolytica
VNQQKEIDQPISESEIKPTKL

SEQ ID NO: 2665126 - protein, 135 aa, Entamoeba histolytica
VNQQTNETYSQPPQLPVRNQPPQLSPRSQQNSQAPPQLPPRGQQNTQVPPQLPPRGQQNTQVPPQLPPRSQQQPNYGINPQMQQPQYIPPNGYTPNQPGYNPYQQVPRNQYNNPMNQPPQQYGYAPQQGFNQPYH

SEQ ID NO: 2665127 - protein, 16 aa, Entamoeba histolytica
VNQSEKEDITSPKDDM

SEQ ID NO: 2665128 - protein, 9 aa, Entamoeba histolytica
VNQSENNQY

SEQ ID NO: 2665129 - protein, 7 aa, Entamoeba histolytica
VNQSSSQ

SEQ ID NO: 2665130 - protein, 8 aa, Entamoeba histolytica
VNQTEEQF

SEQ ID NO: 2665131 - protein, 7 aa, Entamoeba histolytica
VNQTREK

SEQ ID NO: 2665132 - protein, 9 aa, Entamoeba histolytica
VNRDGVEKE

SEQ ID NO: 2665133 - protein, 6 aa, Entamoeba histolytica
VNRKPQ

SEQ ID NO: 2665134 - protein, 10 aa, Entamoeba histolytica
VNRNKQNPYQ

SEQ ID NO: 2665135 - protein, 7 aa, Entamoeba histolytica
VNRNSGC

SEQ ID NO: 2665136 - protein, 10 aa, Entamoeba histolytica
VNRQKKGLQL

SEQ ID NO: 2665137 - protein, 16 aa, Entamoeba histolytica
VNRSDTTMDLEPIIEG

SEQ ID NO: 2665138 - protein, 11 aa, Entamoeba histolytica
VNRTTIQSEGF

SEQ ID NO: 2665139 - protein, 9 aa, Entamoeba histolytica
VNSDKDELS

SEQ ID NO: 2665140 - protein, 9 aa, Entamoeba histolytica
VNSDTTGIK

SEQ ID NO: 2665141 - protein, 26 aa, Entamoeba histolytica
VNSEENKKPTTKSTKTKKDNKMEEEN

SEQ ID NO: 2665142 - protein, 6 aa, Entamoeba histolytica
VNSEIA

SEQ ID NO: 2665143 - protein, 11 aa, Entamoeba histolytica
VNSEKENTYNE

SEQ ID NO: 2665144 - protein, 17 aa, Entamoeba histolytica
VNSKPKKDTFNLDDKKE

SEQ ID NO: 2665145 - protein, 10 aa, Entamoeba histolytica
VNSNETETSL

SEQ ID NO: 2665146 - protein, 8 aa, Entamoeba histolytica
VNSNETPS

SEQ ID NO: 2665147 - protein, 9 aa, Entamoeba histolytica
VNSNFKDES

SEQ ID NO: 2665148 - protein, 5 aa, Entamoeba histolytica
VNSPE

SEQ ID NO: 2665149 - protein, 7 aa, Entamoeba histolytica
VNSPKYG

SEQ ID NO: 2665150 - protein, 14 aa, Entamoeba histolytica
VNSPPISSASSQIT

SEQ ID NO: 2665151 - protein, 9 aa, Entamoeba histolytica
VNSPRSPLT

SEQ ID NO: 2665152 - protein, 28 aa, Entamoeba histolytica
VNSQNTSNELTKMNEEKIQNKKGYTQPL

SEQ ID NO: 2665153 - protein, 12 aa, Entamoeba histolytica
VNSQSTWEETKK

SEQ ID NO: 2665154 - protein, 9 aa, Entamoeba histolytica
VNSSGETAL

SEQ ID NO: 2665155 - protein, 10 aa, Entamoeba histolytica
VNSSQNKIQV

SEQ ID NO: 2665156 - protein, 17 aa, Entamoeba histolytica
VNSSQSSDISKTTNQNT

SEQ ID NO: 2665157 - protein, 4 aa, Entamoeba histolytica
VNST

SEQ ID NO: 2665158 - protein, 10 aa, Entamoeba histolytica
VNSTEYNQPE

SEQ ID NO: 2665159 - protein, 5 aa, Entamoeba histolytica
VNSTH

SEQ ID NO: 2665160 - protein, 7 aa, Entamoeba histolytica
VNSTTQK

SEQ ID NO: 2665161 - protein, 9 aa, Entamoeba histolytica
VNTGQGLQR

SEQ ID NO: 2665162 - protein, 8 aa, Entamoeba histolytica
VNTKNNQN

SEQ ID NO: 2665163 - protein, 5 aa, Entamoeba histolytica
VNTLE

SEQ ID NO: 2665164 - protein, 6 aa, Entamoeba histolytica
VNTPQL

SEQ ID NO: 2665165 - protein, 12 aa, Entamoeba histolytica
VNTQDEQGNTPL

SEQ ID NO: 2665166 - protein, 12 aa, Entamoeba histolytica
VNTQSKKQENME

SEQ ID NO: 2665167 - protein, 7 aa, Entamoeba histolytica
VNTRDSL

SEQ ID NO: 2665168 - protein, 7 aa, Entamoeba histolytica
VNTSDIT

SEQ ID NO: 2665169 - protein, 9 aa, Entamoeba histolytica
VNTSENNGI

SEQ ID NO: 2665170 - protein, 5 aa, Entamoeba histolytica
VNTSG

SEQ ID NO: 2665171 - protein, 15 aa, Entamoeba histolytica
VNTSNTTKPSDQSVH

SEQ ID NO: 2665172 - protein, 19 aa, Entamoeba histolytica
VNTTPSNNKPSTQSKPKIL

SEQ ID NO: 2665173 - protein, 7 aa, Entamoeba histolytica
VNTTTRA

SEQ ID NO: 2665174 - protein, 6 aa, Entamoeba histolytica
VNVENT

SEQ ID NO: 2665175 - protein, 14 aa, Entamoeba histolytica
VNVPQSSRSPSSFN

SEQ ID NO: 2665176 - protein, 4 aa, Entamoeba histolytica
VNVT

SEQ ID NO: 2665177 - protein, 13 aa, Entamoeba histolytica
VNYDQSDYQPTYD

SEQ ID NO: 2665178 - protein, 9 aa, Entamoeba histolytica
VNYEDRDNW

SEQ ID NO: 2665179 - protein, 11 aa, Entamoeba histolytica
VNYNEACTSNT

SEQ ID NO: 2665180 - protein, 14 aa, Entamoeba histolytica
VNYPPNTQTYQQQV

SEQ ID NO: 2665181 - protein, 4 aa, Entamoeba histolytica
VNYT

SEQ ID NO: 2665182 - protein, 5 aa, Entamoeba histolytica
VPADV

SEQ ID NO: 2665183 - protein, 4 aa, Entamoeba histolytica
VPAG

SEQ ID NO: 2665184 - protein, 7 aa, Entamoeba histolytica
VPAGLSV

SEQ ID NO: 2665185 - protein, 8 aa, Entamoeba histolytica
VPAKGSTG

SEQ ID NO: 2665186 - protein, 8 aa, Entamoeba histolytica
VPANPSTF

SEQ ID NO: 2665187 - protein, 9 aa, Entamoeba histolytica
VPASEVPDV

SEQ ID NO: 2665188 - protein, 9 aa, Entamoeba histolytica
VPCESKAGK

SEQ ID NO: 2665189 - protein, 14 aa, Entamoeba histolytica
VPCGEAKNHYSEAD

SEQ ID NO: 2665190 - protein, 15 aa, Entamoeba histolytica
VPDEDFDNSRSENEI

SEQ ID NO: 2665191 - protein, 7 aa, Entamoeba histolytica
VPDETGR

SEQ ID NO: 2665192 - protein, 14 aa, Entamoeba histolytica
VPDFGDETSSDEDV

SEQ ID NO: 2665193 - protein, 25 aa, Entamoeba histolytica
VPDGQVATEQTLNPQYPTEPAKTYP

SEQ ID NO: 2665194 - protein, 6 aa, Entamoeba histolytica
VPDQDA

SEQ ID NO: 2665195 - protein, 11 aa, Entamoeba histolytica
VPDSQKKGVSR

SEQ ID NO: 2665196 - protein, 8 aa, Entamoeba histolytica
VPDSVTNQ

SEQ ID NO: 2665197 - protein, 8 aa, Entamoeba histolytica
VPDTALDE

SEQ ID NO: 2665198 - protein, 4 aa, Entamoeba histolytica
VPED

SEQ ID NO: 2665199 - protein, 9 aa, Entamoeba histolytica
VPEEPSSEV

SEQ ID NO: 2665200 - protein, 4 aa, Entamoeba histolytica
VPEG

SEQ ID NO: 2665201 - protein, 4 aa, Entamoeba histolytica
VPEI

SEQ ID NO: 2665202 - protein, 10 aa, Entamoeba histolytica
VPEKDLEDIQ

SEQ ID NO: 2665203 - protein, 9 aa, Entamoeba histolytica
VPENGRKSP

SEQ ID NO: 2665204 - protein, 4 aa, Entamoeba histolytica
VPEP

SEQ ID NO: 2665205 - protein, 6 aa, Entamoeba histolytica
VPEPVG

SEQ ID NO: 2665206 - protein, 17 aa, Entamoeba histolytica
VPEQLPPTNNIDDVDDN

SEQ ID NO: 2665207 - protein, 6 aa, Entamoeba histolytica
VPEQPS

SEQ ID NO: 2665208 - protein, 18 aa, Entamoeba histolytica
VPERAKPTEAKETKKQGP

SEQ ID NO: 2665209 - protein, 20 aa, Entamoeba histolytica
VPERSTLGKRSANNIKKGDN

SEQ ID NO: 2665210 - protein, 15 aa, Entamoeba histolytica
VPESSKERNNTTPIH

SEQ ID NO: 2665211 - protein, 8 aa, Entamoeba histolytica
VPETKKNM

SEQ ID NO: 2665212 - protein, 7 aa, Entamoeba histolytica
VPETRSQ

SEQ ID NO: 2665213 - protein, 5 aa, Entamoeba histolytica
VPEYT

SEQ ID NO: 2665214 - protein, 7 aa, Entamoeba histolytica
VPGAPRA

SEQ ID NO: 2665215 - protein, 9 aa, Entamoeba histolytica
VPGAQFESD

SEQ ID NO: 2665216 - protein, 6 aa, Entamoeba histolytica
VPGEGE

SEQ ID NO: 2665217 - protein, 4 aa, Entamoeba histolytica
VPGK

SEQ ID NO: 2665218 - protein, 9 aa, Entamoeba histolytica
VPGNENTSK

SEQ ID NO: 2665219 - protein, 6 aa, Entamoeba histolytica
VPGSGF

SEQ ID NO: 2665220 - protein, 5 aa, Entamoeba histolytica
VPGSS

SEQ ID NO: 2665221 - protein, 10 aa, Entamoeba histolytica
VPGTYKAQNV

SEQ ID NO: 2665222 - protein, 5 aa, Entamoeba histolytica
VPHEG

SEQ ID NO: 2665223 - protein, 10 aa, Entamoeba histolytica
VPHKNTPNNA

SEQ ID NO: 2665224 - protein, 4 aa, Entamoeba histolytica
VPHN

SEQ ID NO: 2665225 - protein, 4 aa, Entamoeba histolytica
VPIE

SEQ ID NO: 2665226 - protein, 9 aa, Entamoeba histolytica
VPIGATPEY

SEQ ID NO: 2665227 - protein, 15 aa, Entamoeba histolytica
VPIGQEKESIGFDSN

SEQ ID NO: 2665228 - protein, 9 aa, Entamoeba histolytica
VPIKGGNGT

SEQ ID NO: 2665229 - protein, 6 aa, Entamoeba histolytica
VPIPTK

SEQ ID NO: 2665230 - protein, 11 aa, Entamoeba histolytica
VPIQSESNGFE

SEQ ID NO: 2665231 - protein, 5 aa, Entamoeba histolytica
VPITE

SEQ ID NO: 2665232 - protein, 11 aa, Entamoeba histolytica
VPKATATAVTD

SEQ ID NO: 2665233 - protein, 12 aa, Entamoeba histolytica
VPKEKRPKQPYT

SEQ ID NO: 2665234 - protein, 5 aa, Entamoeba histolytica
VPKET

SEQ ID NO: 2665235 - protein, 9 aa, Entamoeba histolytica
VPKGGKDKG

SEQ ID NO: 2665236 - protein, 8 aa, Entamoeba histolytica
VPKGQNEY

SEQ ID NO: 2665237 - protein, 5 aa, Entamoeba histolytica
VPKGY

SEQ ID NO: 2665238 - protein, 6 aa, Entamoeba histolytica
VPKISS

SEQ ID NO: 2665239 - protein, 12 aa, Entamoeba histolytica
VPKKKKKKTNFV

SEQ ID NO: 2665240 - protein, 5 aa, Entamoeba histolytica
VPKNL

SEQ ID NO: 2665241 - protein, 5 aa, Entamoeba histolytica
VPKNT

SEQ ID NO: 2665242 - protein, 14 aa, Entamoeba histolytica
VPKPQQTQQPNITQ

SEQ ID NO: 2665243 - protein, 13 aa, Entamoeba histolytica
VPKRSIKHKTVSV

SEQ ID NO: 2665244 - protein, 7 aa, Entamoeba histolytica
VPKTGRD

SEQ ID NO: 2665245 - protein, 5 aa, Entamoeba histolytica
VPKTS

SEQ ID NO: 2665246 - protein, 40 aa, Entamoeba histolytica
VPKTSVNEQPRLPITQTQKIEDKSNNSNLLESQTETISDS

SEQ ID NO: 2665247 - protein, 5 aa, Entamoeba histolytica
VPLAD

SEQ ID NO: 2665248 - protein, 11 aa, Entamoeba histolytica
VPLEEPQVGSG

SEQ ID NO: 2665249 - protein, 4 aa, Entamoeba histolytica
VPLG

SEQ ID NO: 2665250 - protein, 24 aa, Entamoeba histolytica
VPLKKRKGNGDEYEAAEDKKLTEE

SEQ ID NO: 2665251 - protein, 4 aa, Entamoeba histolytica
VPLP

SEQ ID NO: 2665252 - protein, 5 aa, Entamoeba histolytica
VPLPT

SEQ ID NO: 2665253 - protein, 10 aa, Entamoeba histolytica
VPLQSDSSEA

SEQ ID NO: 2665254 - protein, 7 aa, Entamoeba histolytica
VPLSNGY

SEQ ID NO: 2665255 - protein, 7 aa, Entamoeba histolytica
VPNESTN

SEQ ID NO: 2665256 - protein, 12 aa, Entamoeba histolytica
VPNKVISSSQGH

SEQ ID NO: 2665257 - protein, 4 aa, Entamoeba histolytica
VPNN

SEQ ID NO: 2665258 - protein, 9 aa, Entamoeba histolytica
VPNNDSKLN

SEQ ID NO: 2665259 - protein, 10 aa, Entamoeba histolytica
VPNNTTTSQL

SEQ ID NO: 2665260 - protein, 8 aa, Entamoeba histolytica
VPNPESIS

SEQ ID NO: 2665261 - protein, 8 aa, Entamoeba histolytica
VPNRNTMD

SEQ ID NO: 2665262 - protein, 26 aa, Entamoeba histolytica
VPNSPKQHLSNPQRSNTSPIKPTDIH

SEQ ID NO: 2665263 - protein, 198 aa, Entamoeba histolytica
VPPEEVSDVPPPVPSKPPRLEQNEVPKESEEEKRHREEERKQKEEEKRQKEEEDKKQKEAEKRQKEEEKRLREEEKRLREEEKRQKEEEKRQKEEEEKRQKEEEKRLREEEKLKKKQEEDERKKMKEEMKKAQKEEERLKKEEKKQEKKSKKTEETNNNENNEELTPNTPAQTFPTPAAVSNPVDGEFSSKGIETPKE

SEQ ID NO: 2665264 - protein, 15 aa, Entamoeba histolytica
VPPENGKYVSNEESV

SEQ ID NO: 2665265 - protein, 5 aa, Entamoeba histolytica
VPPGA

SEQ ID NO: 2665266 - protein, 7 aa, Entamoeba histolytica
VPPITGN

SEQ ID NO: 2665267 - protein, 12 aa, Entamoeba histolytica
VPPKFSKKPTKV

SEQ ID NO: 2665268 - protein, 7 aa, Entamoeba histolytica
VPPKGLD

SEQ ID NO: 2665269 - protein, 31 aa, Entamoeba histolytica
VPPKGTVPFNSNPKKKSTTTTQKKNYKTDIK

SEQ ID NO: 2665270 - protein, 6 aa, Entamoeba histolytica
VPPKKP

SEQ ID NO: 2665271 - protein, 12 aa, Entamoeba histolytica
VPPLSPKRKKQV

SEQ ID NO: 2665272 - protein, 12 aa, Entamoeba histolytica
VPPPIPKTNPIL

SEQ ID NO: 2665273 - protein, 26 aa, Entamoeba histolytica
VPPPPPLSEDAYTTEMTSPNSAPTVS

SEQ ID NO: 2665274 - protein, 11 aa, Entamoeba histolytica
VPPPRNSNPIL

SEQ ID NO: 2665275 - protein, 10 aa, Entamoeba histolytica
VPPPTSNKSH

SEQ ID NO: 2665276 - protein, 6 aa, Entamoeba histolytica
VPPPYG

SEQ ID NO: 2665277 - protein, 8 aa, Entamoeba histolytica
VPPQHDEY

SEQ ID NO: 2665278 - protein, 11 aa, Entamoeba histolytica
VPPQSKTPPMY

SEQ ID NO: 2665279 - protein, 121 aa, Entamoeba histolytica; identical to SEQ ID NO: 2470142

SEQ ID NO: 2665280 - protein, 121 aa, Entamoeba histolytica
VPPRDDSQKNSFNKPRRDGREPREEGNEQRRRGRGNREGGSYRERKENQERKERGEGEEQGHRGRGGYRNNYRNGEKRDYKPRHHYGNEQQKESTKEEVKSTETTPQGTTVESKTIEHKTD

SEQ ID NO: 2665281 - protein, 9 aa, Entamoeba histolytica
VPPRSRSRS

SEQ ID NO: 2665282 - protein, 12 aa, Entamoeba histolytica
VPPSLTDENWKR

SEQ ID NO: 2665283 - protein, 6 aa, Entamoeba histolytica
VPPSPD

SEQ ID NO: 2665284 - protein, 33 aa, Entamoeba histolytica
VPPSTNEKTQKNIKDSQENNQRIKEDENEKENE

SEQ ID NO: 2665285 - protein, 4 aa, Entamoeba histolytica
VPPT

SEQ ID NO: 2665286 - protein, 6 aa, Entamoeba histolytica
VPPTAR

SEQ ID NO: 2665287 - protein, 6 aa, Entamoeba histolytica
VPPTEN

SEQ ID NO: 2665288 - protein, 6 aa, Entamoeba histolytica
VPPTSV

SEQ ID NO: 2665289 - protein, 14 aa, Entamoeba histolytica
VPQDRIKSTIVYQT

SEQ ID NO: 2665290 - protein, 6 aa, Entamoeba histolytica
VPQEEL

SEQ ID NO: 2665291 - protein, 6 aa, Entamoeba histolytica
VPQETR

SEQ ID NO: 2665292 - protein, 7 aa, Entamoeba histolytica
VPQGRYD

SEQ ID NO: 2665293 - protein, 12 aa, Entamoeba histolytica
VPQGSSVSYPSN

SEQ ID NO: 2665294 - protein, 8 aa, Entamoeba histolytica
VPQGTECN

SEQ ID NO: 2665295 - protein, 28 aa, Entamoeba histolytica
VPQKESDKEDSSEEDEKPKYKSKKERKE

SEQ ID NO: 2665296 - protein, 8 aa, Entamoeba histolytica
VPQPMSRG

SEQ ID NO: 2665297 - protein, 5 aa, Entamoeba histolytica
VPQQL

SEQ ID NO: 2665298 - protein, 15 aa, Entamoeba histolytica
VPQRRPQTKLNKKNL

SEQ ID NO: 2665299 - protein, 13 aa, Entamoeba histolytica
VPQSIGDVIDVDD

SEQ ID NO: 2665300 - protein, 19 aa, Entamoeba histolytica
VPQSKIHTRSSTRHKASQN

SEQ ID NO: 2665301 - protein, 8 aa, Entamoeba histolytica
VPQSPQAC

SEQ ID NO: 2665302 - protein, 11 aa, Entamoeba histolytica
VPQSSQMKDFQ

SEQ ID NO: 2665303 - protein, 14 aa, Entamoeba histolytica
VPQTERPKRATGAA

SEQ ID NO: 2665304 - protein, 12 aa, Entamoeba histolytica
VPQTTEGAVLVV

SEQ ID NO: 2665305 - protein, 15 aa, Entamoeba histolytica
VPQYPQRYQQLTEDF

SEQ ID NO: 2665306 - protein, 11 aa, Entamoeba histolytica
VPRDPNGDYPF

SEQ ID NO: 2665307 - protein, 6 aa, Entamoeba histolytica
VPREKQ

SEQ ID NO: 2665308 - protein, 11 aa, Entamoeba histolytica
VPRESTAEKRR

SEQ ID NO: 2665309 - protein, 11 aa, Entamoeba histolytica
VPRSPASPVIP

SEQ ID NO: 2665310 - protein, 4 aa, Entamoeba histolytica
VPRV

SEQ ID NO: 2665311 - protein, 6 aa, Entamoeba histolytica
VPSDED

SEQ ID NO: 2665312 - protein, 7 aa, Entamoeba histolytica
VPSDSVP

SEQ ID NO: 2665313 - protein, 4 aa, Entamoeba histolytica
VPSE

SEQ ID NO: 2665314 - protein, 7 aa, Entamoeba histolytica
VPSGKLS

SEQ ID NO: 2665315 - protein, 6 aa, Entamoeba histolytica
VPSHST

SEQ ID NO: 2665316 - protein, 5 aa, Entamoeba histolytica
VPSKE

SEQ ID NO: 2665317 - protein, 13 aa, Entamoeba histolytica
VPSKKDKEEYDAR

SEQ ID NO: 2665318 - protein, 9 aa, Entamoeba histolytica
VPSKSASLQ

SEQ ID NO: 2665319 - protein, 11 aa, Entamoeba histolytica
VPSNIQNIERE

SEQ ID NO: 2665320 - protein, 7 aa, Entamoeba histolytica
VPSPAPI

SEQ ID NO: 2665321 - protein, 10 aa, Entamoeba histolytica
VPSPEEQELY

SEQ ID NO: 2665322 - protein, 10 aa, Entamoeba histolytica
VPSPESDNAK

SEQ ID NO: 2665323 - protein, 5 aa, Entamoeba histolytica
VPSPI

SEQ ID NO: 2665324 - protein, 7 aa, Entamoeba histolytica
VPSPNDL

SEQ ID NO: 2665325 - protein, 9 aa, Entamoeba histolytica
VPSPTVSET

SEQ ID NO: 2665326 - protein, 12 aa, Entamoeba histolytica
VPSQPKQQLPQQ

SEQ ID NO: 2665327 - protein, 8 aa, Entamoeba histolytica
VPSQPNIQ

SEQ ID NO: 2665328 - protein, 6 aa, Entamoeba histolytica
VPSSSQ

SEQ ID NO: 2665329 - protein, 11 aa, Entamoeba histolytica
VPSSSQEAERI

SEQ ID NO: 2665330 - protein, 6 aa, Entamoeba histolytica
VPSTDD

SEQ ID NO: 2665331 - protein, 13 aa, Entamoeba histolytica
VPSTPLPKVPPRQ

SEQ ID NO: 2665332 - protein, 20 aa, Entamoeba histolytica
VPSTQFQGYPQQQPYPYPQQ

SEQ ID NO: 2665333 - protein, 8 aa, Entamoeba histolytica
VPSTRGAG

SEQ ID NO: 2665334 - protein, 9 aa, Entamoeba histolytica
VPSTRKSHR

SEQ ID NO: 2665335 - protein, 4 aa, Entamoeba histolytica
VPSY

SEQ ID NO: 2665336 - protein, 4 aa, Entamoeba histolytica
VPTA

SEQ ID NO: 2665337 - protein, 5 aa, Entamoeba histolytica
VPTEE

SEQ ID NO: 2665338 - protein, 8 aa, Entamoeba histolytica
VPTEKPAE

SEQ ID NO: 2665339 - protein, 8 aa, Entamoeba histolytica
VPTESTSK

SEQ ID NO: 2665340 - protein, 5 aa, Entamoeba histolytica
VPTGE

SEQ ID NO: 2665341 - protein, 8 aa, Entamoeba histolytica
VPTGPREG

SEQ ID NO: 2665342 - protein, 4 aa, Entamoeba histolytica
VPTI

SEQ ID NO: 2665343 - protein, 12 aa, Entamoeba histolytica
VPTKDKSEYINE

SEQ ID NO: 2665344 - protein, 11 aa, Entamoeba histolytica
VPTKKPSNLGG

SEQ ID NO: 2665345 - protein, 6 aa, Entamoeba histolytica
VPTNEI

SEQ ID NO: 2665346 - protein, 6 aa, Entamoeba histolytica
VPTNPN

SEQ ID NO: 2665347 - protein, 4 aa, Entamoeba histolytica
VPTQ

SEQ ID NO: 2665348 - protein, 9 aa, Entamoeba histolytica
VPTRGSKCA

SEQ ID NO: 2665349 - protein, 8 aa, Entamoeba histolytica
VPTSKDNV

SEQ ID NO: 2665350 - protein, 7 aa, Entamoeba histolytica
VPTSNEL

SEQ ID NO: 2665351 - protein, 8 aa, Entamoeba histolytica
VPTTTPPL

SEQ ID NO: 2665352 - protein, 12 aa, Entamoeba histolytica
VPTVSNKKNTKI

SEQ ID NO: 2665353 - protein, 7 aa, Entamoeba histolytica
VPVEEKK

SEQ ID NO: 2665354 - protein, 9 aa, Entamoeba histolytica
VPVGAGSYT

SEQ ID NO: 2665355 - protein, 13 aa, Entamoeba histolytica
VPVKSSDIKSIKT

SEQ ID NO: 2665356 - protein, 11 aa, Entamoeba histolytica
VPVKTINGEDP

SEQ ID NO: 2665357 - protein, 13 aa, Entamoeba histolytica
VPVQPNKLKNQNL

SEQ ID NO: 2665358 - protein, 4 aa, Entamoeba histolytica
VPWK

SEQ ID NO: 2665359 - protein, 13 aa, Entamoeba histolytica
VPYAEEKMSNAIE

SEQ ID NO: 2665360 - protein, 7 aa, Entamoeba histolytica
VPYGGNQ

SEQ ID NO: 2665361 - protein, 12 aa, Entamoeba histolytica
VQAEENANVYIC

SEQ ID NO: 2665362 - protein, 11 aa, Entamoeba histolytica
VQASTKRSEAM

SEQ ID NO: 2665363 - protein, 8 aa, Entamoeba histolytica
VQATPSPF

SEQ ID NO: 2665364 - protein, 7 aa, Entamoeba histolytica
VQDNGFK

SEQ ID NO: 2665365 - protein, 14 aa, Entamoeba histolytica
VQDPTEGVNRNSLG

SEQ ID NO: 2665366 - protein, 14 aa, Entamoeba histolytica
VQDQPDDIKEEEIG

SEQ ID NO: 2665367 - protein, 13 aa, Entamoeba histolytica
VQEAPIERDETRD

SEQ ID NO: 2665368 - protein, 13 aa, Entamoeba histolytica
VQEDDDEGEDQNS

SEQ ID NO: 2665369 - protein, 6 aa, Entamoeba histolytica
VQEDGV

SEQ ID NO: 2665370 - protein, 7 aa, Entamoeba histolytica
VQEDNDR

SEQ ID NO: 2665371 - protein, 32 aa, Entamoeba histolytica
VQEDRSVAEQQQEQQKTEQQQKKKEEAETNEL

SEQ ID NO: 2665372 - protein, 6 aa, Entamoeba histolytica
VQEEEV

SEQ ID NO: 2665373 - protein, 9 aa, Entamoeba histolytica
VQEEKKEKI

SEQ ID NO: 2665374 - protein, 10 aa, Entamoeba histolytica
VQEKDPHKEE

SEQ ID NO: 2665375 - protein, 10 aa, Entamoeba histolytica
VQEKGGMQQA

SEQ ID NO: 2665376 - protein, 37 aa, Entamoeba histolytica
VQEKPTAQIQEKPKTNPQKEETTKITQEKQKEQINTI

SEQ ID NO: 2665377 - protein, 49 aa, Entamoeba histolytica
VQEKSKSQKQRQNEMKKKESINQQGQLPLQKETQSITNSNTNKCIKSNG

SEQ ID NO: 2665378 - protein, 9 aa, Entamoeba histolytica
VQEPPSRGP

SEQ ID NO: 2665379 - protein, 10 aa, Entamoeba histolytica
VQEPQKISTQ

SEQ ID NO: 2665380 - protein, 11 aa, Entamoeba histolytica
VQEQSNEAGII

SEQ ID NO: 2665381 - protein, 8 aa, Entamoeba histolytica
VQESDDSM

SEQ ID NO: 2665382 - protein, 20 aa, Entamoeba histolytica
VQETQEEDEEIAVETPKEDE

SEQ ID NO: 2665383 - protein, 17 aa, Entamoeba histolytica
VQETTKGIKLNDNTSQV

SEQ ID NO: 2665384 - protein, 4 aa, Entamoeba histolytica
VQFS

SEQ ID NO: 2665385 - protein, 4 aa, Entamoeba histolytica
VQFT

SEQ ID NO: 2665386 - protein, 7 aa, Entamoeba histolytica
VQGKPGE

SEQ ID NO: 2665387 - protein, 12 aa, Entamoeba histolytica
VQGRAGNTKGIE

SEQ ID NO: 2665388 - protein, 4 aa, Entamoeba histolytica
VQGS

SEQ ID NO: 2665389 - protein, 19 aa, Entamoeba histolytica
VQHPRSNRTFNEKDEEQLK

SEQ ID NO: 2665390 - protein, 6 aa, Entamoeba histolytica
VQHPTK

SEQ ID NO: 2665391 - protein, 9 aa, Entamoeba histolytica
VQIDEPDGD

SEQ ID NO: 2665392 - protein, 10 aa, Entamoeba histolytica
VQIEGNDEER

SEQ ID NO: 2665393 - protein, 18 aa, Entamoeba histolytica
VQIPTESLPQTKQSHSHD

SEQ ID NO: 2665394 - protein, 7 aa, Entamoeba histolytica
VQKEELK

SEQ ID NO: 2665395 - protein, 34 aa, Entamoeba histolytica
VQKEEPITTPSSSEKKENLKPQNNQPKQEITKKE

SEQ ID NO: 2665396 - protein, 5 aa, Entamoeba histolytica
VQKEG

SEQ ID NO: 2665397 - protein, 13 aa, Entamoeba histolytica
VQKELKELNVIKA

SEQ ID NO: 2665398 - protein, 11 aa, Entamoeba histolytica
VQKENLPEDEA

SEQ ID NO: 2665399 - protein, 10 aa, Entamoeba histolytica
VQKESRRAIK

SEQ ID NO: 2665400 - protein, 6 aa, Entamoeba histolytica
VQKGNG

SEQ ID NO: 2665401 - protein, 10 aa, Entamoeba histolytica
VQKKDPENTE

SEQ ID NO: 2665402 - protein, 20 aa, Entamoeba histolytica
VQKKEKKEIELDGEKSKLGL

SEQ ID NO: 2665403 - protein, 11 aa, Entamoeba histolytica
VQKKPEQPNIQ

SEQ ID NO: 2665404 - protein, 6 aa, Entamoeba histolytica
VQKQNP

SEQ ID NO: 2665405 - protein, 7 aa, Entamoeba histolytica
VQKSEGM

SEQ ID NO: 2665406 - protein, 8 aa, Entamoeba histolytica
VQKSENAY

SEQ ID NO: 2665407 - protein, 34 aa, Entamoeba histolytica
VQKTEDKINQIQSDINSTKDQYKQQDTSPKSQKV

SEQ ID NO: 2665408 - protein, 6 aa, Entamoeba histolytica
VQKTHE

SEQ ID NO: 2665409 - protein, 14 aa, Entamoeba histolytica
VQKTQPVQQKKPTL

SEQ ID NO: 2665410 - protein, 13 aa, Entamoeba histolytica
VQLSGGKLTPKPM

SEQ ID NO: 2665411 - protein, 10 aa, Entamoeba histolytica
VQLSQQDTFD

SEQ ID NO: 2665412 - protein, 10 aa, Entamoeba histolytica
VQNASREYAK

SEQ ID NO: 2665413 - protein, 8 aa, Entamoeba histolytica
VQNDKTTI

SEQ ID NO: 2665414 - protein, 7 aa, Entamoeba histolytica
VQNEERV

SEQ ID NO: 2665415 - protein, 12 aa, Entamoeba histolytica
VQNEKGSSAYLS

SEQ ID NO: 2665416 - protein, 8 aa, Entamoeba histolytica
VQNGEELP

SEQ ID NO: 2665417 - protein, 7 aa, Entamoeba histolytica
VQNGEGI

SEQ ID NO: 2665418 - protein, 5 aa, Entamoeba histolytica
VQNKT

SEQ ID NO: 2665419 - protein, 21 aa, Entamoeba histolytica
VQNKWSSKEYRKRKKRKLEQM

SEQ ID NO: 2665420 - protein, 9 aa, Entamoeba histolytica
VQNNHSSNN

SEQ ID NO: 2665421 - protein, 10 aa, Entamoeba histolytica
VQNNTTGTHS

SEQ ID NO: 2665422 - protein, 20 aa, Entamoeba histolytica
VQNSPTVALENKQSNDKSGC

SEQ ID NO: 2665423 - protein, 7 aa, Entamoeba histolytica
VQNTEQG

SEQ ID NO: 2665424 - protein, 11 aa, Entamoeba histolytica
VQNTTRKPTNV

SEQ ID NO: 2665425 - protein, 17 aa, Entamoeba histolytica
VQPANNDKKTNINDDDW

SEQ ID NO: 2665426 - protein, 5 aa, Entamoeba histolytica
VQPEN

SEQ ID NO: 2665427 - protein, 4 aa, Entamoeba histolytica
VQPG

SEQ ID NO: 2665428 - protein, 8 aa, Entamoeba histolytica
VQPGNPTE

SEQ ID NO: 2665429 - protein, 4 aa, Entamoeba histolytica
VQPK

SEQ ID NO: 2665430 - protein, 6 aa, Entamoeba histolytica
VQPKPV

SEQ ID NO: 2665431 - protein, 5 aa, Entamoeba histolytica
VQPKT

SEQ ID NO: 2665432 - protein, 5 aa, Entamoeba histolytica
VQPNV

SEQ ID NO: 2665433 - protein, 6 aa, Entamoeba histolytica
VQPPAE

SEQ ID NO: 2665434 - protein, 8 aa, Entamoeba histolytica
VQPPPDQY

SEQ ID NO: 2665435 - protein, 27 aa, Entamoeba histolytica
VQPPPPPPIDNSKVPSVSSISTSGRGD

SEQ ID NO: 2665436 - protein, 6 aa, Entamoeba histolytica
VQPPQR

SEQ ID NO: 2665437 - protein, 6 aa, Entamoeba histolytica
VQPQND

SEQ ID NO: 2665438 - protein, 13 aa, Entamoeba histolytica
VQPQQPQGQQQFQ

SEQ ID NO: 2665439 - protein, 6 aa, Entamoeba histolytica
VQPRKN

SEQ ID NO: 2665440 - protein, 10 aa, Entamoeba histolytica
VQPSDGDKIN

SEQ ID NO: 2665441 - protein, 12 aa, Entamoeba histolytica
VQPSQPKNNEIN

SEQ ID NO: 2665442 - protein, 5 aa, Entamoeba histolytica
VQPTS

SEQ ID NO: 2665443 - protein, 14 aa, Entamoeba histolytica
VQQESNNQNISNFP

SEQ ID NO: 2665444 - protein, 8 aa, Entamoeba histolytica
VQQGGSYQ

SEQ ID NO: 2665445 - protein, 11 aa, Entamoeba histolytica
VQQIEAQKEEE

SEQ ID NO: 2665446 - protein, 61 aa, Entamoeba histolytica
VQQKPTIPPIKSSKKGNEIDTDKNPTTGLTTTSKEDRKKSSEKKEIKTTTPQENTVKEEIN

SEQ ID NO: 2665447 - protein, 10 aa, Entamoeba histolytica
VQQKSASTQP

SEQ ID NO: 2665448 - protein, 11 aa, Entamoeba histolytica
VQQLSTSTVTN

SEQ ID NO: 2665449 - protein, 6 aa, Entamoeba histolytica
VQQPMN

SEQ ID NO: 2665450 - protein, 7 aa, Entamoeba histolytica
VQQPTTP

SEQ ID NO: 2665451 - protein, 14 aa, Entamoeba histolytica
VQQQNTQTQPQKDI

SEQ ID NO: 2665452 - protein, 13 aa, Entamoeba histolytica
VQQQQRMQGMQGK

SEQ ID NO: 2665453 - protein, 5 aa, Entamoeba histolytica
VQQRA

SEQ ID NO: 2665454 - protein, 17 aa, Entamoeba histolytica
VQQRGEERVSDSSNDEV

SEQ ID NO: 2665455 - protein, 6 aa, Entamoeba histolytica
VQQRGM

SEQ ID NO: 2665456 - protein, 5 aa, Entamoeba histolytica
VQQTN

SEQ ID NO: 2665457 - protein, 13 aa, Entamoeba histolytica
VQQTQSVQQSDGS

SEQ ID NO: 2665458 - protein, 5 aa, Entamoeba histolytica
VQRNG

SEQ ID NO: 2665459 - protein, 14 aa, Entamoeba histolytica
VQRQERNNDFQPIA

SEQ ID NO: 2665460 - protein, 9 aa, Entamoeba histolytica
VQRRNEPSN

SEQ ID NO: 2665461 - protein, 18 aa, Entamoeba histolytica
VQSEETNPQIDNKTNSHN

SEQ ID NO: 2665462 - protein, 5 aa, Entamoeba histolytica
VQSGE

SEQ ID NO: 2665463 - protein, 30 aa, Entamoeba histolytica
VQSGSPMSSPFHSPRENHTRTSTGSPHQPN

SEQ ID NO: 2665464 - protein, 8 aa, Entamoeba histolytica
VQSGSVNL

SEQ ID NO: 2665465 - protein, 9 aa, Entamoeba histolytica
VQSGTPFQK

SEQ ID NO: 2665466 - protein, 9 aa, Entamoeba histolytica
VQSNSKKEF

SEQ ID NO: 2665467 - protein, 4 aa, Entamoeba histolytica
VQSP

SEQ ID NO: 2665468 - protein, 9 aa, Entamoeba histolytica
VQSPNKEKV

SEQ ID NO: 2665469 - protein, 8 aa, Entamoeba histolytica
VQSRGPEI

SEQ ID NO: 2665470 - protein, 6 aa, Entamoeba histolytica
VQSSPN

SEQ ID NO: 2665471 - protein, 63 aa, Entamoeba histolytica
VQSSTPPMSPQHSHSITPSASPKENKVSTPLSPNKEDGSVATPTSRKKEEETKPKKSPNDSVT

SEQ ID NO: 2665472 - protein, 5 aa, Entamoeba histolytica
VQSYG

SEQ ID NO: 2665473 - protein, 5 aa, Entamoeba histolytica
VQTDE

SEQ ID NO: 2665474 - protein, 5 aa, Entamoeba histolytica
VQTES

SEQ ID NO: 2665475 - protein, 6 aa, Entamoeba histolytica
VQTGDG

SEQ ID NO: 2665476 - protein, 13 aa, Entamoeba histolytica
VQTGSSDSSMKEK

SEQ ID NO: 2665477 - protein, 7 aa, Entamoeba histolytica
VQTPKYE

SEQ ID NO: 2665478 - protein, 31 aa, Entamoeba histolytica
VQTQKDEIITKTDTLTDIESTNLENKKKEKK

SEQ ID NO: 2665479 - protein, 17 aa, Entamoeba histolytica
VQTQQQPKKDNIDSLLF

SEQ ID NO: 2665480 - protein, 7 aa, Entamoeba histolytica
VQTSNYQ

SEQ ID NO: 2665481 - protein, 8 aa, Entamoeba histolytica
VQTTNDDI

SEQ ID NO: 2665482 - protein, 11 aa, Entamoeba histolytica
VQYPQTTPSKQ

SEQ ID NO: 2665483 - protein, 11 aa, Entamoeba histolytica
VRAPTGSGKTL

SEQ ID NO: 2665484 - protein, 12 aa, Entamoeba histolytica
VRDDYVKEASNL

SEQ ID NO: 2665485 - protein, 4 aa, Entamoeba histolytica
VRDK

SEQ ID NO: 2665486 - protein, 7 aa, Entamoeba histolytica
VRDNTSF

SEQ ID NO: 2665487 - protein, 17 aa, Entamoeba histolytica
VRDQQRNISYLDVPMEK

SEQ ID NO: 2665488 - protein, 9 aa, Entamoeba histolytica
VRDTKKEGI

SEQ ID NO: 2665489 - protein, 7 aa, Entamoeba histolytica
VRDTNRK

SEQ ID NO: 2665490 - protein, 16 aa, Entamoeba histolytica
VREAKNKDQWSPYEDN

SEQ ID NO: 2665491 - protein, 10 aa, Entamoeba histolytica
VREGEQQDQR

SEQ ID NO: 2665492 - protein, 5 aa, Entamoeba histolytica
VREKQ

SEQ ID NO: 2665493 - protein, 13 aa, Entamoeba histolytica
VREKSDNRETNKY

SEQ ID NO: 2665494 - protein, 15 aa, Entamoeba histolytica
VRENKLENDNDEGIP

SEQ ID NO: 2665495 - protein, 11 aa, Entamoeba histolytica
VRERNEINTSI

SEQ ID NO: 2665496 - protein, 7 aa, Entamoeba histolytica
VRESDGS

SEQ ID NO: 2665497 - protein, 13 aa, Entamoeba histolytica
VRGAGRNCQATES

SEQ ID NO: 2665498 - protein, 10 aa, Entamoeba histolytica
VRGGSDSYVS

SEQ ID NO: 2665499 - protein, 7 aa, Entamoeba histolytica
VRGPQVQ

SEQ ID NO: 2665500 - protein, 10 aa, Entamoeba histolytica
VRGRKGSYVQ

SEQ ID NO: 2665501 - protein, 7 aa, Entamoeba histolytica
VRGRNSE

SEQ ID NO: 2665502 - protein, 8 aa, Entamoeba histolytica
VRGSGNPI

SEQ ID NO: 2665503 - protein, 6 aa, Entamoeba histolytica
VRKEKP

SEQ ID NO: 2665504 - protein, 10 aa, Entamoeba histolytica
VRKEYEKKGI

SEQ ID NO: 2665505 - protein, 6 aa, Entamoeba histolytica
VRKGQF

SEQ ID NO: 2665506 - protein, 15 aa, Entamoeba histolytica
VRKGTPISKPEEHSD

SEQ ID NO: 2665507 - protein, 6 aa, Entamoeba histolytica
VRKQAA

SEQ ID NO: 2665508 - protein, 20 aa, Entamoeba histolytica
VRKREVDDAKKPDEEEETDH

SEQ ID NO: 2665509 - protein, 5 aa, Entamoeba histolytica
VRKST

SEQ ID NO: 2665510 - protein, 12 aa, Entamoeba histolytica
VRNENDIAAPHP

SEQ ID NO: 2665511 - protein, 12 aa, Entamoeba histolytica
VRNKEQTTTKLH

SEQ ID NO: 2665512 - protein, 13 aa, Entamoeba histolytica
VRPDPLKGLFPTK

SEQ ID NO: 2665513 - protein, 5 aa, Entamoeba histolytica
VRPEG

SEQ ID NO: 2665514 - protein, 5 aa, Entamoeba histolytica
VRPIS

SEQ ID NO: 2665515 - protein, 9 aa, Entamoeba histolytica
VRPNPSKHF

SEQ ID NO: 2665516 - protein, 6 aa, Entamoeba histolytica
VRPPIP

SEQ ID NO: 2665517 - protein, 6 aa, Entamoeba histolytica
VRPTAA

SEQ ID NO: 2665518 - protein, 9 aa, Entamoeba histolytica
VRQRSEELE

SEQ ID NO: 2665519 - protein, 7 aa, Entamoeba histolytica
VRRKSNE

SEQ ID NO: 2665520 - protein, 12 aa, Entamoeba histolytica
VRRNDENEGILL

SEQ ID NO: 2665521 - protein, 6 aa, Entamoeba histolytica
VRRPEE

SEQ ID NO: 2665522 - protein, 9 aa, Entamoeba histolytica
VRRSNEPLE

SEQ ID NO: 2665523 - protein, 11 aa, Entamoeba histolytica
VRRSVSKEDEL

SEQ ID NO: 2665524 - protein, 6 aa, Entamoeba histolytica
VRSAET

SEQ ID NO: 2665525 - protein, 4 aa, Entamoeba histolytica
VRSN

SEQ ID NO: 2665526 - protein, 8 aa, Entamoeba histolytica
VRSNANVA

SEQ ID NO: 2665527 - protein, 8 aa, Entamoeba histolytica
VRTDSGLQ

SEQ ID NO: 2665528 - protein, 4 aa, Entamoeba histolytica
VRTN

SEQ ID NO: 2665529 - protein, 6 aa, Entamoeba histolytica
VRTPAR

SEQ ID NO: 2665530 - protein, 4 aa, Entamoeba histolytica
VRTR

SEQ ID NO: 2665531 - protein, 7 aa, Entamoeba histolytica
VRTSGDP

SEQ ID NO: 2665532 - protein, 7 aa, Entamoeba histolytica
VRTTPAY

SEQ ID NO: 2665533 - protein, 9 aa, Entamoeba histolytica
VRTYNGSDL

SEQ ID NO: 2665534 - protein, 9 aa, Entamoeba histolytica
VRYNSNPKN

SEQ ID NO: 2665535 - protein, 14 aa, Entamoeba histolytica
VSAEDKTSSSEDLD

SEQ ID NO: 2665536 - protein, 4 aa, Entamoeba histolytica
VSAI

SEQ ID NO: 2665537 - protein, 5 aa, Entamoeba histolytica
VSAKE

SEQ ID NO: 2665538 - protein, 10 aa, Entamoeba histolytica
VSAKKQNPEI

SEQ ID NO: 2665539 - protein, 7 aa, Entamoeba histolytica
VSAPGLD

SEQ ID NO: 2665540 - protein, 15 aa, Entamoeba histolytica
VSAQTPLSQLSPSDG

SEQ ID NO: 2665541 - protein, 8 aa, Entamoeba histolytica
VSARPSSF

SEQ ID NO: 2665542 - protein, 5 aa, Entamoeba histolytica
VSASA

SEQ ID NO: 2665543 - protein, 6 aa, Entamoeba histolytica
VSASSV

SEQ ID NO: 2665544 - protein, 7 aa, Entamoeba histolytica
VSATDPI

SEQ ID NO: 2665545 - protein, 9 aa, Entamoeba histolytica
VSATNNEGL

SEQ ID NO: 2665546 - protein, 10 aa, Entamoeba histolytica
VSDASQSFSE

SEQ ID NO: 2665547 - protein, 19 aa, Entamoeba histolytica
VSDDENDCSVDDGCVDYAT

SEQ ID NO: 2665548 - protein, 9 aa, Entamoeba histolytica
VSDDETTTF

SEQ ID NO: 2665549 - protein, 9 aa, Entamoeba histolytica
VSDDKTSVT

SEQ ID NO: 2665550 - protein, 13 aa, Entamoeba histolytica
VSDDTKSQTKEAI

SEQ ID NO: 2665551 - protein, 4 aa, Entamoeba histolytica
VSDE

SEQ ID NO: 2665552 - protein, 11 aa, Entamoeba histolytica
VSDEDEDEGKY

SEQ ID NO: 2665553 - protein, 14 aa, Entamoeba histolytica
VSDESNNFKTGNKV

SEQ ID NO: 2665554 - protein, 5 aa, Entamoeba histolytica
VSDKT

SEQ ID NO: 2665555 - protein, 8 aa, Entamoeba histolytica
VSDLEESF

SEQ ID NO: 2665556 - protein, 28 aa, Entamoeba histolytica
VSDNQEQLTGESTSSDSVNASYILDQKF

SEQ ID NO: 2665557 - protein, 7 aa, Entamoeba histolytica
VSDNSIN

SEQ ID NO: 2665558 - protein, 6 aa, Entamoeba histolytica
VSDPEH

SEQ ID NO: 2665559 - protein, 6 aa, Entamoeba histolytica
VSDPEI

SEQ ID NO: 2665560 - protein, 6 aa, Entamoeba histolytica
VSDRGN

SEQ ID NO: 2665561 - protein, 7 aa, Entamoeba histolytica
VSDRGNS

SEQ ID NO: 2665562 - protein, 6 aa, Entamoeba histolytica
VSDSKE

SEQ ID NO: 2665563 - protein, 14 aa, Entamoeba histolytica
VSDSNKNIDETVCI

SEQ ID NO: 2665564 - protein, 22 aa, Entamoeba histolytica
VSDSPNPETREVVGENGEGERS

SEQ ID NO: 2665565 - protein, 8 aa, Entamoeba histolytica
VSDTGNGR

SEQ ID NO: 2665566 - protein, 17 aa, Entamoeba histolytica
VSDVGPNRRAIEEASKY

SEQ ID NO: 2665567 - protein, 15 aa, Entamoeba histolytica
VSEDEDKEVNEQEVE

SEQ ID NO: 2665568 - protein, 8 aa, Entamoeba histolytica
VSEDELGG

SEQ ID NO: 2665569 - protein, 15 aa, Entamoeba histolytica
VSEDETEIEDRNATL

SEQ ID NO: 2665570 - protein, 12 aa, Entamoeba histolytica
VSEDSDDEAKYK

SEQ ID NO: 2665571 - protein, 14 aa, Entamoeba histolytica
VSEEEAKKLKRGQK

SEQ ID NO: 2665572 - protein, 8 aa, Entamoeba histolytica
VSEEETEI

SEQ ID NO: 2665573 - protein, 8 aa, Entamoeba histolytica
VSEEVGTR

SEQ ID NO: 2665574 - protein, 9 aa, Entamoeba histolytica
VSEGHRPLR

SEQ ID NO: 2665575 - protein, 7 aa, Entamoeba histolytica
VSEGNYD

SEQ ID NO: 2665576 - protein, 6 aa, Entamoeba histolytica
VSEGYK

SEQ ID NO: 2665577 - protein, 6 aa, Entamoeba histolytica
VSEKEG

SEQ ID NO: 2665578 - protein, 9 aa, Entamoeba histolytica
VSEKEYQNT

SEQ ID NO: 2665579 - protein, 17 aa, Entamoeba histolytica
VSEKGDKEKKPKKVDKE

SEQ ID NO: 2665580 - protein, 10 aa, Entamoeba histolytica
VSEKSSYHHG

SEQ ID NO: 2665581 - protein, 12 aa, Entamoeba histolytica
VSELKSSTSRQR

SEQ ID NO: 2665582 - protein, 4 aa, Entamoeba histolytica
VSEM

SEQ ID NO: 2665583 - protein, 13 aa, Entamoeba histolytica
VSENKEGSESKTR

SEQ ID NO: 2665584 - protein, 7 aa, Entamoeba histolytica
VSENNKI

SEQ ID NO: 2665585 - protein, 27 aa, Entamoeba histolytica
VSEPHTNVNNSSHINESIPTQTSTQTN

SEQ ID NO: 2665586 - protein, 9 aa, Entamoeba histolytica
VSEPNDSTK

SEQ ID NO: 2665587 - protein, 11 aa, Entamoeba histolytica
VSEPSAPISPF

SEQ ID NO: 2665588 - protein, 10 aa, Entamoeba histolytica
VSEQGEKTSV

SEQ ID NO: 2665589 - protein, 7 aa, Entamoeba histolytica
VSEQNFG

SEQ ID NO: 2665590 - protein, 7 aa, Entamoeba histolytica
VSERPQI

SEQ ID NO: 2665591 - protein, 10 aa, Entamoeba histolytica
VSESDKSNYK

SEQ ID NO: 2665592 - protein, 9 aa, Entamoeba histolytica
VSESGRKPF

SEQ ID NO: 2665593 - protein, 9 aa, Entamoeba histolytica
VSESYDSSV

SEQ ID NO: 2665594 - protein, 5 aa, Entamoeba histolytica
VSETG

SEQ ID NO: 2665595 - protein, 11 aa, Entamoeba histolytica
VSETPTLLTGS

SEQ ID NO: 2665596 - protein, 6 aa, Entamoeba histolytica
VSETSA

SEQ ID NO: 2665597 - protein, 10 aa, Entamoeba histolytica
VSEVRDSADK

SEQ ID NO: 2665598 - protein, 8 aa, Entamoeba histolytica
VSEYTDNV

SEQ ID NO: 2665599 - protein, 19 aa, Entamoeba histolytica
VSFEDNNTINNDSEDEEIH

SEQ ID NO: 2665600 - protein, 5 aa, Entamoeba histolytica
VSGDS

SEQ ID NO: 2665601 - protein, 6 aa, Entamoeba histolytica
VSGDSR

SEQ ID NO: 2665602 - protein, 8 aa, Entamoeba histolytica
VSGDSTKN

SEQ ID NO: 2665603 - protein, 8 aa, Entamoeba histolytica
VSGEGSVD

SEQ ID NO: 2665604 - protein, 6 aa, Entamoeba histolytica
VSGEKI

SEQ ID NO: 2665605 - protein, 7 aa, Entamoeba histolytica
VSGGAYG

SEQ ID NO: 2665606 - protein, 6 aa, Entamoeba histolytica
VSGGDK

SEQ ID NO: 2665607 - protein, 8 aa, Entamoeba histolytica
VSGGGKVI

SEQ ID NO: 2665608 - protein, 7 aa, Entamoeba histolytica
VSGGNEK

SEQ ID NO: 2665609 - protein, 7 aa, Entamoeba histolytica
VSGGTDK

SEQ ID NO: 2665610 - protein, 4 aa, Entamoeba histolytica
VSGK

SEQ ID NO: 2665611 - protein, 6 aa, Entamoeba histolytica
VSGKKY

SEQ ID NO: 2665612 - protein, 8 aa, Entamoeba histolytica
VSGPQENM

SEQ ID NO: 2665613 - protein, 15 aa, Entamoeba histolytica
VSGQKDNLRSPSGSV

SEQ ID NO: 2665614 - protein, 14 aa, Entamoeba histolytica
VSGSDTEETEYANS

SEQ ID NO: 2665615 - protein, 10 aa, Entamoeba histolytica
VSGSTKPVTK

SEQ ID NO: 2665616 - protein, 8 aa, Entamoeba histolytica
VSGTKAVG

SEQ ID NO: 2665617 - protein, 10 aa, Entamoeba histolytica
VSGTRDKTSL

SEQ ID NO: 2665618 - protein, 23 aa, Entamoeba histolytica
VSHKDGIEKEITNTNTSKESQKL

SEQ ID NO: 2665619 - protein, 29 aa, Entamoeba histolytica
VSHKRDESKIVNEERRNKRRVNKQREFTK

SEQ ID NO: 2665620 - protein, 18 aa, Entamoeba histolytica
VSHQQAAPADLSKGKITP

SEQ ID NO: 2665621 - protein, 22 aa, Entamoeba histolytica
VSHSPSNKASLPNQVKQTNKSI

SEQ ID NO: 2665622 - protein, 6 aa, Entamoeba histolytica
VSHSQN

SEQ ID NO: 2665623 - protein, 8 aa, Entamoeba histolytica
VSIDNSAK

SEQ ID NO: 2665624 - protein, 9 aa, Entamoeba histolytica
VSIEKQKEL

SEQ ID NO: 2665625 - protein, 9 aa, Entamoeba histolytica
VSIEPKKQQ

SEQ ID NO: 2665626 - protein, 11 aa, Entamoeba histolytica
VSIKGNEKCKS

SEQ ID NO: 2665627 - protein, 4 aa, Entamoeba histolytica
VSIN

SEQ ID NO: 2665628 - protein, 4 aa, Entamoeba histolytica
VSIP

SEQ ID NO: 2665629 - protein, 6 aa, Entamoeba histolytica
VSIPGE

SEQ ID NO: 2665630 - protein, 4 aa, Entamoeba histolytica
VSIR

SEQ ID NO: 2665631 - protein, 11 aa, Entamoeba histolytica
VSKADGEALAK

SEQ ID NO: 2665632 - protein, 6 aa, Entamoeba histolytica
VSKAEK

SEQ ID NO: 2665633 - protein, 26 aa, Entamoeba histolytica
VSKAKKGNENNRIENMTRGRSRNELK

SEQ ID NO: 2665634 - protein, 10 aa, Entamoeba histolytica
VSKASGLTGM

SEQ ID NO: 2665635 - protein, 6 aa, Entamoeba histolytica
VSKDAL

SEQ ID NO: 2665636 - protein, 9 aa, Entamoeba histolytica
VSKDEKLKE

SEQ ID NO: 2665637 - protein, 5 aa, Entamoeba histolytica
VSKED

SEQ ID NO: 2665638 - protein, 32 aa, Entamoeba histolytica
VSKEEEKKGQKKEREKKESKIEEGSSHRPMTR

SEQ ID NO: 2665639 - protein, 9 aa, Entamoeba histolytica
VSKEKEKME

SEQ ID NO: 2665640 - protein, 10 aa, Entamoeba histolytica
VSKEKKRYQK

SEQ ID NO: 2665641 - protein, 6 aa, Entamoeba histolytica
VSKEQA

SEQ ID NO: 2665642 - protein, 6 aa, Entamoeba histolytica
VSKGKN

SEQ ID NO: 2665643 - protein, 12 aa, Entamoeba histolytica
VSKKKKITTPVK

SEQ ID NO: 2665644 - protein, 5 aa, Entamoeba histolytica
VSKKR

SEQ ID NO: 2665645 - protein, 8 aa, Entamoeba histolytica
VSKLTSKN

SEQ ID NO: 2665646 - protein, 10 aa, Entamoeba histolytica
VSKNDKFKYA

SEQ ID NO: 2665647 - protein, 9 aa, Entamoeba histolytica
VSKNDQSIA

SEQ ID NO: 2665648 - protein, 11 aa, Entamoeba histolytica
VSKNEVNPQHP

SEQ ID NO: 2665649 - protein, 6 aa, Entamoeba histolytica
VSKNTG

SEQ ID NO: 2665650 - protein, 12 aa, Entamoeba histolytica
VSKPNTSNQYTS

SEQ ID NO: 2665651 - protein, 9 aa, Entamoeba histolytica
VSKPPAPEE

SEQ ID NO: 2665652 - protein, 9 aa, Entamoeba histolytica
VSKQDKEGK

SEQ ID NO: 2665653 - protein, 7 aa, Entamoeba histolytica
VSKQKRS

SEQ ID NO: 2665654 - protein, 5 aa, Entamoeba histolytica
VSKSD

SEQ ID NO: 2665655 - protein, 7 aa, Entamoeba histolytica
VSKSDLR

SEQ ID NO: 2665656 - protein, 7 aa, Entamoeba histolytica
VSKSEMA

SEQ ID NO: 2665657 - protein, 5 aa, Entamoeba histolytica
VSKSI

SEQ ID NO: 2665658 - protein, 15 aa, Entamoeba histolytica
VSKSSYSTTTTPPLE

SEQ ID NO: 2665659 - protein, 12 aa, Entamoeba histolytica
VSKTAPSGEYLT

SEQ ID NO: 2665660 - protein, 11 aa, Entamoeba histolytica
VSKTKTELKQR

SEQ ID NO: 2665661 - protein, 8 aa, Entamoeba histolytica
VSKTNEAC

SEQ ID NO: 2665662 - protein, 15 aa, Entamoeba histolytica
VSKTNESSQEGQSGC

SEQ ID NO: 2665663 - protein, 10 aa, Entamoeba histolytica
VSKTNNSNKS

SEQ ID NO: 2665664 - protein, 6 aa, Entamoeba histolytica
VSKVSG

SEQ ID NO: 2665665 - protein, 8 aa, Entamoeba histolytica
VSLESNNG

SEQ ID NO: 2665666 - protein, 6 aa, Entamoeba histolytica
VSLNGK

SEQ ID NO: 2665667 - protein, 14 aa, Entamoeba histolytica
VSLNPTEEETGKTY

SEQ ID NO: 2665668 - protein, 5 aa, Entamoeba histolytica
VSLPS

SEQ ID NO: 2665669 - protein, 14 aa, Entamoeba histolytica
VSLQEGSLTGAVNR

SEQ ID NO: 2665670 - protein, 8 aa, Entamoeba histolytica
VSLQKGAE

SEQ ID NO: 2665671 - protein, 8 aa, Entamoeba histolytica
VSLYNKEN

SEQ ID NO: 2665672 - protein, 4 aa, Entamoeba histolytica
VSME

SEQ ID NO: 2665673 - protein, 19 aa, Entamoeba histolytica
VSMPNGSAVRISKDAQEYM

SEQ ID NO: 2665674 - protein, 15 aa, Entamoeba histolytica
VSMTEGKASVNDQDG

SEQ ID NO: 2665675 - protein, 4 aa, Entamoeba histolytica
VSND

SEQ ID NO: 2665676 - protein, 7 aa, Entamoeba histolytica
VSNDDGK

SEQ ID NO: 2665677 - protein, 11 aa, Entamoeba histolytica
VSNDLKGKPKD

SEQ ID NO: 2665678 - protein, 14 aa, Entamoeba histolytica
VSNEEPSHEISEKG

SEQ ID NO: 2665679 - protein, 5 aa, Entamoeba histolytica
VSNEL

SEQ ID NO: 2665680 - protein, 25 aa, Entamoeba histolytica
VSNENKTINEEVSEIKKNKNNSVKE

SEQ ID NO: 2665681 - protein, 8 aa, Entamoeba histolytica
VSNEVNAN

SEQ ID NO: 2665682 - protein, 4 aa, Entamoeba histolytica
VSNI

SEQ ID NO: 2665683 - protein, 9 aa, Entamoeba histolytica
VSNKDSDEI

SEQ ID NO: 2665684 - protein, 7 aa, Entamoeba histolytica
VSNKEEF

SEQ ID NO: 2665685 - protein, 5 aa, Entamoeba histolytica
VSNNE

SEQ ID NO: 2665686 - protein, 8 aa, Entamoeba histolytica
VSNPPPHT

SEQ ID NO: 2665687 - protein, 8 aa, Entamoeba histolytica
VSNRQTPT

SEQ ID NO: 2665688 - protein, 5 aa, Entamoeba histolytica
VSNSI

SEQ ID NO: 2665689 - protein, 26 aa, Entamoeba histolytica
VSNSIEVEQKPELDQPSFTYPSEEFE

SEQ ID NO: 2665690 - protein, 21 aa, Entamoeba histolytica
VSNSSDSDVTKEVPRSSRDWS

SEQ ID NO: 2665691 - protein, 12 aa, Entamoeba histolytica
VSNSSDTEGMDT

SEQ ID NO: 2665692 - protein, 5 aa, Entamoeba histolytica
VSNSY

SEQ ID NO: 2665693 - protein, 5 aa, Entamoeba histolytica
VSNTP

SEQ ID NO: 2665694 - protein, 7 aa, Entamoeba histolytica
VSNTSFK

SEQ ID NO: 2665695 - protein, 6 aa, Entamoeba histolytica
VSNYNP

SEQ ID NO: 2665696 - protein, 7 aa, Entamoeba histolytica
VSPAGKT

SEQ ID NO: 2665697 - protein, 7 aa, Entamoeba histolytica
VSPASLP

SEQ ID NO: 2665698 - protein, 5 aa, Entamoeba histolytica
VSPDG

SEQ ID NO: 2665699 - protein, 5 aa, Entamoeba histolytica
VSPHE

SEQ ID NO: 2665700 - protein, 11 aa, Entamoeba histolytica
VSPKIKSNSPQ

SEQ ID NO: 2665701 - protein, 7 aa, Entamoeba histolytica
VSPNIGQ

SEQ ID NO: 2665702 - protein, 10 aa, Entamoeba histolytica
VSPNQQELSD

SEQ ID NO: 2665703 - protein, 16 aa, Entamoeba histolytica
VSPPGGDFSDPVTTST

SEQ ID NO: 2665704 - protein, 9 aa, Entamoeba histolytica
VSPPPRSQI

SEQ ID NO: 2665705 - protein, 6 aa, Entamoeba histolytica
VSPPTL

SEQ ID NO: 2665706 - protein, 9 aa, Entamoeba histolytica
VSPQIGSRN

SEQ ID NO: 2665707 - protein, 29 aa, Entamoeba histolytica
VSPRSTSSDSSTTEFKGQSKLTNEKSISE

SEQ ID NO: 2665708 - protein, 6 aa, Entamoeba histolytica
VSPSDS

SEQ ID NO: 2665709 - protein, 7 aa, Entamoeba histolytica
VSPSEAE

SEQ ID NO: 2665710 - protein, 6 aa, Entamoeba histolytica
VSPSGR

SEQ ID NO: 2665711 - protein, 13 aa, Entamoeba histolytica
VSPSLSPHNNEPL

SEQ ID NO: 2665712 - protein, 6 aa, Entamoeba histolytica
VSPSQM

SEQ ID NO: 2665713 - protein, 5 aa, Entamoeba histolytica
VSPSS

SEQ ID NO: 2665714 - protein, 13 aa, Entamoeba histolytica
VSPSTKPKPKNEW

SEQ ID NO: 2665715 - protein, 5 aa, Entamoeba histolytica
VSPTE

SEQ ID NO: 2665716 - protein, 33 aa, Entamoeba histolytica
VSPTGPLSPSFKKRGRTFSQTRNASFDKKSSPL

SEQ ID NO: 2665717 - protein, 6 aa, Entamoeba histolytica
VSPTVG

SEQ ID NO: 2665718 - protein, 8 aa, Entamoeba histolytica
VSQDTRLD

SEQ ID NO: 2665719 - protein, 9 aa, Entamoeba histolytica
VSQEPSTSL

SEQ ID NO: 2665720 - protein, 41 aa, Entamoeba histolytica
VSQESDDKKSCKQKERTTKESDDKKGCEEEEKEVDKKFEKR

SEQ ID NO: 2665721 - protein, 20 aa, Entamoeba histolytica
VSQGADARSEVAPPKARNAQ

SEQ ID NO: 2665722 - protein, 9 aa, Entamoeba histolytica
VSQHQNEDY

SEQ ID NO: 2665723 - protein, 9 aa, Entamoeba histolytica
VSQNDSERK

SEQ ID NO: 2665724 - protein, 18 aa, Entamoeba histolytica
VSQNKEVKDKSTTTPSLE

SEQ ID NO: 2665725 - protein, 10 aa, Entamoeba histolytica
VSQNTTTTIQ

SEQ ID NO: 2665726 - protein, 9 aa, Entamoeba histolytica
VSQPSKTID

SEQ ID NO: 2665727 - protein, 7 aa, Entamoeba histolytica
VSQQKAI

SEQ ID NO: 2665728 - protein, 23 aa, Entamoeba histolytica
VSQQPQEEQSVEQNQQPQRQGRI

SEQ ID NO: 2665729 - protein, 4 aa, Entamoeba histolytica
VSQR

SEQ ID NO: 2665730 - protein, 16 aa, Entamoeba histolytica
VSQREIKNQLKKPKTF

SEQ ID NO: 2665731 - protein, 4 aa, Entamoeba histolytica
VSQS

SEQ ID NO: 2665732 - protein, 7 aa, Entamoeba histolytica
VSQSFKN

SEQ ID NO: 2665733 - protein, 8 aa, Entamoeba histolytica
VSQSKENN

SEQ ID NO: 2665734 - protein, 6 aa, Entamoeba histolytica
VSQSPL

SEQ ID NO: 2665735 - protein, 10 aa, Entamoeba histolytica
VSQTQSGTTA

SEQ ID NO: 2665736 - protein, 16 aa, Entamoeba histolytica
VSQTTNNQPSIDTSTI

SEQ ID NO: 2665737 - protein, 8 aa, Entamoeba histolytica
VSQYPGSN

SEQ ID NO: 2665738 - protein, 4 aa, Entamoeba histolytica
VSRG

SEQ ID NO: 2665739 - protein, 15 aa, Entamoeba histolytica
VSRGKKYSPNQTVGT

SEQ ID NO: 2665740 - protein, 8 aa, Entamoeba histolytica
VSRGQSNG

SEQ ID NO: 2665741 - protein, 6 aa, Entamoeba histolytica
VSRGSE

SEQ ID NO: 2665742 - protein, 7 aa, Entamoeba histolytica
VSRGYNS

SEQ ID NO: 2665743 - protein, 15 aa, Entamoeba histolytica
VSRKAGPMTYQMLED

SEQ ID NO: 2665744 - protein, 29 aa, Entamoeba histolytica
VSRKGTDREEGDGEPPEFSDDEEEREWKA

SEQ ID NO: 2665745 - protein, 4 aa, Entamoeba histolytica
VSRL

SEQ ID NO: 2665746 - protein, 8 aa, Entamoeba histolytica
VSRNESFI

SEQ ID NO: 2665747 - protein, 7 aa, Entamoeba histolytica
VSRPGYG

SEQ ID NO: 2665748 - protein, 33 aa, Entamoeba histolytica
VSRPREEGRRRDYRHDDRDSRRDYRSRDDHYRR

SEQ ID NO: 2665749 - protein, 15 aa, Entamoeba histolytica
VSRREDEEEPEKPAP

SEQ ID NO: 2665750 - protein, 10 aa, Entamoeba histolytica
VSRSTSRGEF

SEQ ID NO: 2665751 - protein, 6 aa, Entamoeba histolytica
VSRWSN

SEQ ID NO: 2665752 - protein, 12 aa, Entamoeba histolytica
VSRYSNPKQSQI

SEQ ID NO: 2665753 - protein, 5 aa, Entamoeba histolytica
VSSDE

SEQ ID NO: 2665754 - protein, 11 aa, Entamoeba histolytica
VSSDEPDVSGE

SEQ ID NO: 2665755 - protein, 10 aa, Entamoeba histolytica
VSSDGAAINA

SEQ ID NO: 2665756 - protein, 6 aa, Entamoeba histolytica
VSSDIN

SEQ ID NO: 2665757 - protein, 8 aa, Entamoeba histolytica
VSSEEDNF

SEQ ID NO: 2665758 - protein, 6 aa, Entamoeba histolytica
VSSEER

SEQ ID NO: 2665759 - protein, 4 aa, Entamoeba histolytica
VSSG

SEQ ID NO: 2665760 - protein, 8 aa, Entamoeba histolytica
VSSGAKPV

SEQ ID NO: 2665761 - protein, 16 aa, Entamoeba histolytica
VSSHQPRMEEVSDFQE

SEQ ID NO: 2665762 - protein, 11 aa, Entamoeba histolytica
VSSKDEDNERI

SEQ ID NO: 2665763 - protein, 9 aa, Entamoeba histolytica
VSSKQKTIK

SEQ ID NO: 2665764 - protein, 9 aa, Entamoeba histolytica
VSSKSMTSK

SEQ ID NO: 2665765 - protein, 10 aa, Entamoeba histolytica
VSSLKSSTIH

SEQ ID NO: 2665766 - protein, 8 aa, Entamoeba histolytica
VSSNEGKI

SEQ ID NO: 2665767 - protein, 9 aa, Entamoeba histolytica
VSSNGEYGI

SEQ ID NO: 2665768 - protein, 77 aa, Entamoeba histolytica
VSSNNNPIEKPTEEEKKIEINEKKNEINTLQGEKQVDEKKTEEKQVDEVKKEETKHEELPKTLGDPKCVPNKDEKIL

SEQ ID NO: 2665769 - protein, 6 aa, Entamoeba histolytica
VSSNQI

SEQ ID NO: 2665770 - protein, 11 aa, Entamoeba histolytica
VSSNTKNINSE

SEQ ID NO: 2665771 - protein, 6 aa, Entamoeba histolytica
VSSNVQ

SEQ ID NO: 2665772 - protein, 6 aa, Entamoeba histolytica
VSSPKL

SEQ ID NO: 2665773 - protein, 16 aa, Entamoeba histolytica
VSSPPTYKKSNSTSIN

SEQ ID NO: 2665774 - protein, 18 aa, Entamoeba histolytica
VSSPSQLSRSTRARPKTM

SEQ ID NO: 2665775 - protein, 8 aa, Entamoeba histolytica
VSSPSQQK

SEQ ID NO: 2665776 - protein, 59 aa, Entamoeba histolytica
VSSPSTNGNHSTSSQEPFSLQNNEEQLSSSHSQFSSSIAPPIITSPTPKTESASIPDNH

SEQ ID NO: 2665777 - protein, 7 aa, Entamoeba histolytica
VSSQEIH

SEQ ID NO: 2665778 - protein, 7 aa, Entamoeba histolytica
VSSQSIK

SEQ ID NO: 2665779 - protein, 9 aa, Entamoeba histolytica
VSSQTSPNI

SEQ ID NO: 2665780 - protein, 6 aa, Entamoeba histolytica
VSSSFD

SEQ ID NO: 2665781 - protein, 5 aa, Entamoeba histolytica
VSSTI

SEQ ID NO: 2665782 - protein, 4 aa, Entamoeba histolytica
VSSV

SEQ ID NO: 2665783 - protein, 17 aa, Entamoeba histolytica
VSSVDSSDIPNNIDGTS

SEQ ID NO: 2665784 - protein, 10 aa, Entamoeba histolytica
VSTADGEKLA

SEQ ID NO: 2665785 - protein, 61 aa, Entamoeba histolytica
VSTANKTKFTKELKQATTPVIKETKGSSKKTKKEYEDDLEEMSESIEEDEEDNEQVFDEDM

SEQ ID NO: 2665786 - protein, 8 aa, Entamoeba histolytica
VSTARSPI

SEQ ID NO: 2665787 - protein, 4 aa, Entamoeba histolytica
VSTE

SEQ ID NO: 2665788 - protein, 13 aa, Entamoeba histolytica
VSTEKKKKKKKFG

SEQ ID NO: 2665789 - protein, 11 aa, Entamoeba histolytica
VSTEKTDSQVD

SEQ ID NO: 2665790 - protein, 11 aa, Entamoeba histolytica
VSTGSKASASL

SEQ ID NO: 2665791 - protein, 8 aa, Entamoeba histolytica
VSTKEENN

SEQ ID NO: 2665792 - protein, 9 aa, Entamoeba histolytica
VSTKPSTVT

SEQ ID NO: 2665793 - protein, 8 aa, Entamoeba histolytica
VSTNDVEK

SEQ ID NO: 2665794 - protein, 6 aa, Entamoeba histolytica
VSTNEL

SEQ ID NO: 2665795 - protein, 12 aa, Entamoeba histolytica
VSTNGRGATGVG

SEQ ID NO: 2665796 - protein, 8 aa, Entamoeba histolytica
VSTNNDKP

SEQ ID NO: 2665797 - protein, 8 aa, Entamoeba histolytica
VSTPQTSL

SEQ ID NO: 2665798 - protein, 14 aa, Entamoeba histolytica
VSTPRDSKKGSKKM

SEQ ID NO: 2665799 - protein, 8 aa, Entamoeba histolytica
VSTPSKPN

SEQ ID NO: 2665800 - protein, 10 aa, Entamoeba histolytica
VSTPTPLAQG

SEQ ID NO: 2665801 - protein, 35 aa, Entamoeba histolytica
VSTQKLSKQPSLPQQFSKSNDEYQRLDSEINSVFD

SEQ ID NO: 2665802 - protein, 12 aa, Entamoeba histolytica
VSTSGESKTTTE

SEQ ID NO: 2665803 - protein, 13 aa, Entamoeba histolytica
VSTSKEKFTDKGD

SEQ ID NO: 2665804 - protein, 16 aa, Entamoeba histolytica
VSTSSNRNIPSPLNEH

SEQ ID NO: 2665805 - protein, 13 aa, Entamoeba histolytica
VSTTFDTYDNPNG

SEQ ID NO: 2665806 - protein, 5 aa, Entamoeba histolytica
VSTTL

SEQ ID NO: 2665807 - protein, 14 aa, Entamoeba histolytica
VSTYDNNSPDSQYG

SEQ ID NO: 2665808 - protein, 7 aa, Entamoeba histolytica
VSVEGGK

SEQ ID NO: 2665809 - protein, 7 aa, Entamoeba histolytica
VSVENQK

SEQ ID NO: 2665810 - protein, 4 aa, Entamoeba histolytica
VSVT

SEQ ID NO: 2665811 - protein, 5 aa, Entamoeba histolytica
VSYEN

SEQ ID NO: 2665812 - protein, 4 aa, Entamoeba histolytica
VSYQ

SEQ ID NO: 2665813 - protein, 13 aa, Entamoeba histolytica
VTAAEAADINEKQ

SEQ ID NO: 2665814 - protein, 10 aa, Entamoeba histolytica
VTADSKAEQI

SEQ ID NO: 2665815 - protein, 17 aa, Entamoeba histolytica
VTAEQKKEQKKKIEERI

SEQ ID NO: 2665816 - protein, 9 aa, Entamoeba histolytica
VTAPDSPIN

SEQ ID NO: 2665817 - protein, 7 aa, Entamoeba histolytica
VTAPKEK

SEQ ID NO: 2665818 - protein, 9 aa, Entamoeba histolytica
VTAPSSEDK

SEQ ID NO: 2665819 - protein, 7 aa, Entamoeba histolytica
VTASNGV

SEQ ID NO: 2665820 - protein, 5 aa, Entamoeba histolytica
VTAYN

SEQ ID NO: 2665821 - protein, 5 aa, Entamoeba histolytica
VTDAL

SEQ ID NO: 2665822 - protein, 10 aa, Entamoeba histolytica
VTDEATKRSC

SEQ ID NO: 2665823 - protein, 9 aa, Entamoeba histolytica
VTDEDKERL

SEQ ID NO: 2665824 - protein, 7 aa, Entamoeba histolytica
VTDESLK

SEQ ID NO: 2665825 - protein, 4 aa, Entamoeba histolytica
VTDL

SEQ ID NO: 2665826 - protein, 5 aa, Entamoeba histolytica
VTDNG

SEQ ID NO: 2665827 - protein, 21 aa, Entamoeba histolytica
VTDNSKRAVKLEKNDRKPQQL

SEQ ID NO: 2665828 - protein, 9 aa, Entamoeba histolytica
VTDPQTGRK

SEQ ID NO: 2665829 - protein, 10 aa, Entamoeba histolytica
VTDRNAPNGS

SEQ ID NO: 2665830 - protein, 9 aa, Entamoeba histolytica
VTDSQRKSR

SEQ ID NO: 2665831 - protein, 7 aa, Entamoeba histolytica
VTDTEKK

SEQ ID NO: 2665832 - protein, 11 aa, Entamoeba histolytica
VTDTLTDEYNP

SEQ ID NO: 2665833 - protein, 12 aa, Entamoeba histolytica
VTDYAQNGDKEA

SEQ ID NO: 2665834 - protein, 7 aa, Entamoeba histolytica
VTEDNTF

SEQ ID NO: 2665835 - protein, 10 aa, Entamoeba histolytica
VTEEFSRTGV

SEQ ID NO: 2665836 - protein, 7 aa, Entamoeba histolytica
VTEEPTR

SEQ ID NO: 2665837 - protein, 7 aa, Entamoeba histolytica
VTEEREE

SEQ ID NO: 2665838 - protein, 10 aa, Entamoeba histolytica
VTEESSLQQI

SEQ ID NO: 2665839 - protein, 17 aa, Entamoeba histolytica
VTEGDVNAAIDEGARTV

SEQ ID NO: 2665840 - protein, 6 aa, Entamoeba histolytica
VTEGGC

SEQ ID NO: 2665841 - protein, 11 aa, Entamoeba histolytica
VTEKNHISSTG

SEQ ID NO: 2665842 - protein, 8 aa, Entamoeba histolytica
VTENRECD

SEQ ID NO: 2665843 - protein, 6 aa, Entamoeba histolytica
VTEPNE

SEQ ID NO: 2665844 - protein, 8 aa, Entamoeba histolytica
VTEPNSKL

SEQ ID NO: 2665845 - protein, 5 aa, Entamoeba histolytica
VTEPP

SEQ ID NO: 2665846 - protein, 32 aa, Entamoeba histolytica
VTESEKKKKKEGEKSSSSCSSSEEEEDDAEDE

SEQ ID NO: 2665847 - protein, 6 aa, Entamoeba histolytica
VTETKD

SEQ ID NO: 2665848 - protein, 5 aa, Entamoeba histolytica
VTGER

SEQ ID NO: 2665849 - protein, 6 aa, Entamoeba histolytica
VTGGDY

SEQ ID NO: 2665850 - protein, 7 aa, Entamoeba histolytica
VTGGMAG

SEQ ID NO: 2665851 - protein, 8 aa, Entamoeba histolytica
VTGGYRGE

SEQ ID NO: 2665852 - protein, 26 aa, Entamoeba histolytica
VTGIQDDEQEAIQSLDKKENVNIDGQ

SEQ ID NO: 2665853 - protein, 10 aa, Entamoeba histolytica
VTGKNTSGDV

SEQ ID NO: 2665854 - protein, 7 aa, Entamoeba histolytica
VTGNYDN

SEQ ID NO: 2665855 - protein, 21 aa, Entamoeba histolytica
VTGQTTRKVTQTAKTGSTVTN

SEQ ID NO: 2665856 - protein, 8 aa, Entamoeba histolytica
VTGSSDKK

SEQ ID NO: 2665857 - protein, 8 aa, Entamoeba histolytica
VTGSSDRK

SEQ ID NO: 2665858 - protein, 8 aa, Entamoeba histolytica
VTGSTDRT

SEQ ID NO: 2665859 - protein, 38 aa, Entamoeba histolytica
VTGVSEPSTTTSLLGSPNNSTIPGNSLTNSITSDISLS

SEQ ID NO: 2665860 - protein, 5 aa, Entamoeba histolytica
VTHSD

SEQ ID NO: 2665861 - protein, 6 aa, Entamoeba histolytica
VTHTGD

SEQ ID NO: 2665862 - protein, 4 aa, Entamoeba histolytica
VTIN

SEQ ID NO: 2665863 - protein, 6 aa, Entamoeba histolytica
VTIPTS

SEQ ID NO: 2665864 - protein, 17 aa, Entamoeba histolytica
VTKEKEDLEKEYSSGNN

SEQ ID NO: 2665865 - protein, 9 aa, Entamoeba histolytica
VTKGENGVS

SEQ ID NO: 2665866 - protein, 17 aa, Entamoeba histolytica
VTKGMDDLPQNPSIYTT

SEQ ID NO: 2665867 - protein, 7 aa, Entamoeba histolytica
VTKKCEG

SEQ ID NO: 2665868 - protein, 8 aa, Entamoeba histolytica
VTKKESEY

SEQ ID NO: 2665869 - protein, 30 aa, Entamoeba histolytica; identical to SEQ ID NO: 2470762

SEQ ID NO: 2665870 - protein, 20 aa, Entamoeba histolytica
VTKQTVSANAEDVLKNGSEE

SEQ ID NO: 2665871 - protein, 8 aa, Entamoeba histolytica
VTKSGRTP

SEQ ID NO: 2665872 - protein, 10 aa, Entamoeba histolytica
VTKSGTPVTI

SEQ ID NO: 2665873 - protein, 6 aa, Entamoeba histolytica
VTKSVG

SEQ ID NO: 2665874 - protein, 5 aa, Entamoeba histolytica
VTKTG

SEQ ID NO: 2665875 - protein, 6 aa, Entamoeba histolytica
VTNEEK

SEQ ID NO: 2665876 - protein, 6 aa, Entamoeba histolytica
VTNEKE

SEQ ID NO: 2665877 - protein, 10 aa, Entamoeba histolytica
VTNETKQHLD

SEQ ID NO: 2665878 - protein, 4 aa, Entamoeba histolytica
VTNN

SEQ ID NO: 2665879 - protein, 10 aa, Entamoeba histolytica
VTNPVEKKEE

SEQ ID NO: 2665880 - protein, 8 aa, Entamoeba histolytica
VTNPYTEE

SEQ ID NO: 2665881 - protein, 4 aa, Entamoeba histolytica
VTNT

SEQ ID NO: 2665882 - protein, 10 aa, Entamoeba histolytica
VTPDLPSSIT

SEQ ID NO: 2665883 - protein, 15 aa, Entamoeba histolytica
VTPEGKKCTKGGDEF

SEQ ID NO: 2665884 - protein, 6 aa, Entamoeba histolytica
VTPESI

SEQ ID NO: 2665885 - protein, 5 aa, Entamoeba histolytica
VTPGD

SEQ ID NO: 2665886 - protein, 22 aa, Entamoeba histolytica
VTPISSKNVSEQENTSSVYEND

SEQ ID NO: 2665887 - protein, 4 aa, Entamoeba histolytica
VTPK

SEQ ID NO: 2665888 - protein, 6 aa, Entamoeba histolytica
VTPKQL

SEQ ID NO: 2665889 - protein, 6 aa, Entamoeba histolytica
VTPKTD

SEQ ID NO: 2665890 - protein, 5 aa, Entamoeba histolytica
VTPNE

SEQ ID NO: 2665891 - protein, 5 aa, Entamoeba histolytica
VTPNR

SEQ ID NO: 2665892 - protein, 10 aa, Entamoeba histolytica
VTPPMSPRKT

SEQ ID NO: 2665893 - protein, 8 aa, Entamoeba histolytica
VTPPRQTE

SEQ ID NO: 2665894 - protein, 13 aa, Entamoeba histolytica
VTPQNELEKTYDG

SEQ ID NO: 2665895 - protein, 7 aa, Entamoeba histolytica
VTPQNQQ

SEQ ID NO: 2665896 - protein, 29 aa, Entamoeba histolytica
VTPQVTSTSSPIDKMRSQTLKRSSRLSLL

SEQ ID NO: 2665897 - protein, 5 aa, Entamoeba histolytica
VTPSG

SEQ ID NO: 2665898 - protein, 8 aa, Entamoeba histolytica
VTPSSKVV

SEQ ID NO: 2665899 - protein, 6 aa, Entamoeba histolytica
VTPVTS

SEQ ID NO: 2665900 - protein, 18 aa, Entamoeba histolytica
VTQEKQRRVEADENNINR

SEQ ID NO: 2665901 - protein, 40 aa, Entamoeba histolytica
VTQGSVETVHNPDCSYTEDELNQSRNRAATVSVSRPTKPL

SEQ ID NO: 2665902 - protein, 7 aa, Entamoeba histolytica
VTQKAKG

SEQ ID NO: 2665903 - protein, 92 aa, Entamoeba histolytica
VTQSEEVKETSPTIKEDDSLSDEEKEDDSLSDEEKEVHDKETVLPNNGEEPKEASIHSQSPIDYSNNEIDTNNSVEKDLQEKTSKPHSEEGH

SEQ ID NO: 2665904 - protein, 13 aa, Entamoeba histolytica
VTQSKQQHIESEK

SEQ ID NO: 2665905 - protein, 12 aa, Entamoeba histolytica
VTQSRRNQGIGK

SEQ ID NO: 2665906 - protein, 12 aa, Entamoeba histolytica
VTRKDEKELKNT

SEQ ID NO: 2665907 - protein, 4 aa, Entamoeba histolytica
VTRL

SEQ ID NO: 2665908 - protein, 8 aa, Entamoeba histolytica
VTRNDKIG

SEQ ID NO: 2665909 - protein, 9 aa, Entamoeba histolytica
VTRPARDIS

SEQ ID NO: 2665910 - protein, 11 aa, Entamoeba histolytica
VTRSLGDKKFH

SEQ ID NO: 2665911 - protein, 16 aa, Entamoeba histolytica
VTRSVTDSLEKQRMGS

SEQ ID NO: 2665912 - protein, 5 aa, Entamoeba histolytica
VTSAI

SEQ ID NO: 2665913 - protein, 6 aa, Entamoeba histolytica
VTSANK

SEQ ID NO: 2665914 - protein, 10 aa, Entamoeba histolytica
VTSATHEVKS

SEQ ID NO: 2665915 - protein, 5 aa, Entamoeba histolytica
VTSDR

SEQ ID NO: 2665916 - protein, 9 aa, Entamoeba histolytica
VTSEGKDLN

SEQ ID NO: 2665917 - protein, 6 aa, Entamoeba histolytica
VTSGNV

SEQ ID NO: 2665918 - protein, 4 aa, Entamoeba histolytica
VTSK

SEQ ID NO: 2665919 - protein, 6 aa, Entamoeba histolytica
VTSKED

SEQ ID NO: 2665920 - protein, 11 aa, Entamoeba histolytica
VTSKPESKKKL

SEQ ID NO: 2665921 - protein, 5 aa, Entamoeba histolytica
VTSLG

SEQ ID NO: 2665922 - protein, 13 aa, Entamoeba histolytica
VTSNPHPQSKTRE

SEQ ID NO: 2665923 - protein, 22 aa, Entamoeba histolytica
VTSNPLSSSVGNREQSTHASSV

SEQ ID NO: 2665924 - protein, 8 aa, Entamoeba histolytica
VTSNTTDF

SEQ ID NO: 2665925 - protein, 5 aa, Entamoeba histolytica
VTSPQ

SEQ ID NO: 2665926 - protein, 6 aa, Entamoeba histolytica
VTSRAK

SEQ ID NO: 2665927 - protein, 4 aa, Entamoeba histolytica
VTSS

SEQ ID NO: 2665928 - protein, 9 aa, Entamoeba histolytica
VTSSEFKAT

SEQ ID NO: 2665929 - protein, 48 aa, Entamoeba histolytica
VTSSGSKLEEEPKRKKLHQKKSISKTMKDLSTSGSFSSLSRHKTSNDI

SEQ ID NO: 2665930 - protein, 11 aa, Entamoeba histolytica
VTSSGYPLPGA

SEQ ID NO: 2665931 - protein, 6 aa, Entamoeba histolytica
VTSSNG

SEQ ID NO: 2665932 - protein, 13 aa, Entamoeba histolytica
VTSSQEKDEGSVT

SEQ ID NO: 2665933 - protein, 6 aa, Entamoeba histolytica
VTSTFS

SEQ ID NO: 2665934 - protein, 11 aa, Entamoeba histolytica
VTSTNISTSNY

SEQ ID NO: 2665935 - protein, 7 aa, Entamoeba histolytica
VTSVGNG

SEQ ID NO: 2665936 - protein, 10 aa, Entamoeba histolytica
VTSVSEPNQV

SEQ ID NO: 2665937 - protein, 12 aa, Entamoeba histolytica
VTSVSSHPGRTK

SEQ ID NO: 2665938 - protein, 5 aa, Entamoeba histolytica
VTSYG

SEQ ID NO: 2665939 - protein, 12 aa, Entamoeba histolytica
VTTAQTKSLDTQ

SEQ ID NO: 2665940 - protein, 10 aa, Entamoeba histolytica
VTTDELNGDY

SEQ ID NO: 2665941 - protein, 9 aa, Entamoeba histolytica
VTTDSNDEA

SEQ ID NO: 2665942 - protein, 7 aa, Entamoeba histolytica
VTTEGIS

SEQ ID NO: 2665943 - protein, 13 aa, Entamoeba histolytica
VTTEIDQEKKKMV

SEQ ID NO: 2665944 - protein, 6 aa, Entamoeba histolytica
VTTEKG

SEQ ID NO: 2665945 - protein, 6 aa, Entamoeba histolytica
VTTESF

SEQ ID NO: 2665946 - protein, 15 aa, Entamoeba histolytica
VTTKTGKTFATSSED

SEQ ID NO: 2665947 - protein, 12 aa, Entamoeba histolytica
VTTKTQNKLQET

SEQ ID NO: 2665948 - protein, 16 aa, Entamoeba histolytica
VTTKVNESISTNQQQQ

SEQ ID NO: 2665949 - protein, 10 aa, Entamoeba histolytica
VTTLSEGEFP

SEQ ID NO: 2665950 - protein, 6 aa, Entamoeba histolytica
VTTNPP

SEQ ID NO: 2665951 - protein, 5 aa, Entamoeba histolytica
VTTNT

SEQ ID NO: 2665952 - protein, 7 aa, Entamoeba histolytica
VTTPKKI

SEQ ID NO: 2665953 - protein, 5 aa, Entamoeba histolytica
VTTQL

SEQ ID NO: 2665954 - protein, 13 aa, Entamoeba histolytica
VTTQPEVNKKEKQ

SEQ ID NO: 2665955 - protein, 8 aa, Entamoeba histolytica
VTTQPTFN

SEQ ID NO: 2665956 - protein, 4 aa, Entamoeba histolytica
VTTS

SEQ ID NO: 2665957 - protein, 8 aa, Entamoeba histolytica
VTTSKEEL

SEQ ID NO: 2665958 - protein, 8 aa, Entamoeba histolytica
VTTSSDGN

SEQ ID NO: 2665959 - protein, 9 aa, Entamoeba histolytica
VTTSTNGKI

SEQ ID NO: 2665960 - protein, 14 aa, Entamoeba histolytica
VTTTEAQEKAQSYK

SEQ ID NO: 2665961 - protein, 10 aa, Entamoeba histolytica
VTTTSNPTTG

SEQ ID NO: 2665962 - protein, 5 aa, Entamoeba histolytica
VTTVE

SEQ ID NO: 2665963 - protein, 4 aa, Entamoeba histolytica
VTYN

SEQ ID NO: 2665964 - protein, 16 aa, Entamoeba histolytica
VVDEVEKKKGKKGKRI

SEQ ID NO: 2665965 - protein, 7 aa, Entamoeba histolytica
VVDGPKK

SEQ ID NO: 2665966 - protein, 16 aa, Entamoeba histolytica
VVEGGDDNDESTFDDK

SEQ ID NO: 2665967 - protein, 6 aa, Entamoeba histolytica
VVEGKN

SEQ ID NO: 2665968 - protein, 9 aa, Entamoeba histolytica
VVEKPSNVN

SEQ ID NO: 2665969 - protein, 7 aa, Entamoeba histolytica
VVGPSFN

SEQ ID NO: 2665970 - protein, 9 aa, Entamoeba histolytica
VVKKSPLER

SEQ ID NO: 2665971 - protein, 7 aa, Entamoeba histolytica
VVKTGKK

SEQ ID NO: 2665972 - protein, 13 aa, Entamoeba histolytica
VVNDESQKECEEN

SEQ ID NO: 2665973 - protein, 8 aa, Entamoeba histolytica
VVNGKSRR

SEQ ID NO: 2665974 - protein, 28 aa, Entamoeba histolytica
VVNKPKKDEESDSDNELSSSSSLDSEEA

SEQ ID NO: 2665975 - protein, 25 aa, Entamoeba histolytica
VVPISSPSIQTKSEVNQHPQEQNSF

SEQ ID NO: 2665976 - protein, 19 aa, Entamoeba histolytica
VVPSQSNQNLTINAGGTSV

SEQ ID NO: 2665977 - protein, 11 aa, Entamoeba histolytica
VVPSRAAPRPV

SEQ ID NO: 2665978 - protein, 13 aa, Entamoeba histolytica
VVQQAAEKISPQT

SEQ ID NO: 2665979 - protein, 6 aa, Entamoeba histolytica
VVSEEK

SEQ ID NO: 2665980 - protein, 7 aa, Entamoeba histolytica
VVSPNKG

SEQ ID NO: 2665981 - protein, 10 aa, Entamoeba histolytica
VVSQDDRRMK

SEQ ID NO: 2665982 - protein, 9 aa, Entamoeba histolytica
VVTERNDKT

SEQ ID NO: 2665983 - protein, 23 aa, Entamoeba histolytica
VVTSRKTRSPRKRINKNERSTGV

SEQ ID NO: 2665984 - protein, 10 aa, Entamoeba histolytica
VWNQQDEENI

SEQ ID NO: 2665985 - protein, 17 aa, Entamoeba histolytica
VYDDPNIPLSNPPKKKY

SEQ ID NO: 2665986 - protein, 23 aa, Entamoeba histolytica
VYEESSRKTEELIEETPENSPIL

SEQ ID NO: 2665987 - protein, 4 aa, Entamoeba histolytica
VYES

SEQ ID NO: 2665988 - protein, 12 aa, Entamoeba histolytica
VYETEKKIEGIT

SEQ ID NO: 2665989 - protein, 8 aa, Entamoeba histolytica
VYGENKLQ

SEQ ID NO: 2665990 - protein, 10 aa, Entamoeba histolytica
VYKSGNTNVK

SEQ ID NO: 2665991 - protein, 8 aa, Entamoeba histolytica
VYNDKSTD

SEQ ID NO: 2665992 - protein, 4 aa, Entamoeba histolytica
VYNQ

SEQ ID NO: 2665993 - protein, 6 aa, Entamoeba histolytica
VYNSSN

SEQ ID NO: 2665994 - protein, 21 aa, Entamoeba histolytica
VYPDGTLKPAEGEKLNKPATI

SEQ ID NO: 2665995 - protein, 10 aa, Entamoeba histolytica
VYPEDKYSEL

SEQ ID NO: 2665996 - protein, 20 aa, Entamoeba histolytica
VYQSQNPPFTRGYLYLYKSI

SEQ ID NO: 2665997 - protein, 5 aa, Entamoeba histolytica
VYSDD

SEQ ID NO: 2665998 - protein, 5 aa, Entamoeba histolytica
VYSGR

SEQ ID NO: 2665999 - protein, 6 aa, Entamoeba histolytica
VYSPYK

SEQ ID NO: 2666000 - protein, 4 aa, Entamoeba histolytica
VYSQ

SEQ ID NO: 2666001 - protein, 10 aa, Entamoeba histolytica
VYSSSNDTIG

SEQ ID NO: 2666002 - protein, 12 aa, Entamoeba histolytica
VYTGTPDEMKEE

SEQ ID NO: 2666003 - protein, 14 aa, Entamoeba histolytica
VYTNPTNATDGSNI

SEQ ID NO: 2666004 - protein, 6 aa, Entamoeba histolytica
VYTSQE

SEQ ID NO: 2666005 - protein, 7 aa, Entamoeba histolytica
VYTTEKE

SEQ ID NO: 2666006 - protein, 8 aa, Entamoeba histolytica
WAKSDGKL

SEQ ID NO: 2666007 - protein, 16 aa, Entamoeba histolytica
WAPNANDRTFTLKVNV

SEQ ID NO: 2666008 - protein, 10 aa, Entamoeba histolytica
WDEIDTEEDT

SEQ ID NO: 2666009 - protein, 16 aa, Entamoeba histolytica
WDEKRIESRQQYLPKR

SEQ ID NO: 2666010 - protein, 8 aa, Entamoeba histolytica
WDEKTKTS

SEQ ID NO: 2666011 - protein, 18 aa, Entamoeba histolytica
WDNENVRQSISKTKTKGQ

SEQ ID NO: 2666012 - protein, 15 aa, Entamoeba histolytica
WDPTHNLKATDNPNR

SEQ ID NO: 2666013 - protein, 8 aa, Entamoeba histolytica
WDRTPQIS

SEQ ID NO: 2666014 - protein, 6 aa, Entamoeba histolytica
WDRTSQ

SEQ ID NO: 2666015 - protein, 13 aa, Entamoeba histolytica
WDYTEDEYKSSRS

SEQ ID NO: 2666016 - protein, 14 aa, Entamoeba histolytica
WEAEARKKKKLQTR

SEQ ID NO: 2666017 - protein, 15 aa, Entamoeba histolytica
WEEAAKKDKTVKPRK

SEQ ID NO: 2666018 - protein, 50 aa, Entamoeba histolytica
WEECSDSSDSDEQEEEGMSEEEDEKEDNGKEEDEEDEMSEEDDNVPQYDG

SEQ ID NO: 2666019 - protein, 13 aa, Entamoeba histolytica
WEEEQQKRIKSRV

SEQ ID NO: 2666020 - protein, 15 aa, Entamoeba histolytica
WEKESDLREENDLKE

SEQ ID NO: 2666021 - protein, 7 aa, Entamoeba histolytica
WEKNEEL

SEQ ID NO: 2666022 - protein, 12 aa, Entamoeba histolytica
WENEYNNKLDGT

SEQ ID NO: 2666023 - protein, 8 aa, Entamoeba histolytica
WENSSSVN

SEQ ID NO: 2666024 - protein, 9 aa, Entamoeba histolytica
WEQEPKERI

SEQ ID NO: 2666025 - protein, 6 aa, Entamoeba histolytica
WEQSAN

SEQ ID NO: 2666026 - protein, 22 aa, Entamoeba histolytica
WEREQQDKRAEQTTAKSHGYEA

SEQ ID NO: 2666027 - protein, 10 aa, Entamoeba histolytica
WETNPRGRGY

SEQ ID NO: 2666028 - protein, 4 aa, Entamoeba histolytica
WGDD

SEQ ID NO: 2666029 - protein, 4 aa, Entamoeba histolytica
WGDG

SEQ ID NO: 2666030 - protein, 6 aa, Entamoeba histolytica
WGESDN

SEQ ID NO: 2666031 - protein, 10 aa, Entamoeba histolytica
WGGGYNGEDI

SEQ ID NO: 2666032 - protein, 9 aa, Entamoeba histolytica
WGKPSDPSI

SEQ ID NO: 2666033 - protein, 8 aa, Entamoeba histolytica
WGKSYGTC

SEQ ID NO: 2666034 - protein, 7 aa, Entamoeba histolytica
WGNEEGN

SEQ ID NO: 2666035 - protein, 19 aa, Entamoeba histolytica
WGNPVQSQQQQNTQQQKDI

SEQ ID NO: 2666036 - protein, 23 aa, Entamoeba histolytica
WGNSPTKETSSPENVEMPPEEQY

SEQ ID NO: 2666037 - protein, 7 aa, Entamoeba histolytica
WGSQPDQ

SEQ ID NO: 2666038 - protein, 6 aa, Entamoeba histolytica
WGSYGS

SEQ ID NO: 2666039 - protein, 8 aa, Entamoeba histolytica
WGSYGSIT

SEQ ID NO: 2666040 - protein, 11 aa, Entamoeba histolytica
WGTSDKRTDYE

SEQ ID NO: 2666041 - protein, 4 aa, Entamoeba histolytica
WIED

SEQ ID NO: 2666042 - protein, 8 aa, Entamoeba histolytica
WKAPDTNR

SEQ ID NO: 2666043 - protein, 10 aa, Entamoeba histolytica
WKDDEIKTNL

SEQ ID NO: 2666044 - protein, 15 aa, Entamoeba histolytica
WKDDENFESFISNNS

SEQ ID NO: 2666045 - protein, 6 aa, Entamoeba histolytica
WKDGTK

SEQ ID NO: 2666046 - protein, 6 aa, Entamoeba histolytica
WKDSGK

SEQ ID NO: 2666047 - protein, 6 aa, Entamoeba histolytica
WKEDLE

SEQ ID NO: 2666048 - protein, 7 aa, Entamoeba histolytica
WKEDNAL

SEQ ID NO: 2666049 - protein, 9 aa, Entamoeba histolytica
WKEDNPVVK

SEQ ID NO: 2666050 - protein, 8 aa, Entamoeba histolytica
WKEEEDAR

SEQ ID NO: 2666051 - protein, 10 aa, Entamoeba histolytica
WKEEGEGKYS

SEQ ID NO: 2666052 - protein, 12 aa, Entamoeba histolytica
WKEESNKVPIKE

SEQ ID NO: 2666053 - protein, 11 aa, Entamoeba histolytica
WKENESNDNDW

SEQ ID NO: 2666054 - protein, 9 aa, Entamoeba histolytica
WKENNPVVK

SEQ ID NO: 2666055 - protein, 7 aa, Entamoeba histolytica
WKEQKRE

SEQ ID NO: 2666056 - protein, 5 aa, Entamoeba histolytica
WKESE

SEQ ID NO: 2666057 - protein, 11 aa, Entamoeba histolytica
WKESEKESKAL

SEQ ID NO: 2666058 - protein, 9 aa, Entamoeba histolytica
WKESGKGDI

SEQ ID NO: 2666059 - protein, 8 aa, Entamoeba histolytica
WKESSSEE

SEQ ID NO: 2666060 - protein, 9 aa, Entamoeba histolytica
WKETNPVVQ

SEQ ID NO: 2666061 - protein, 5 aa, Entamoeba histolytica
WKGMS

SEQ ID NO: 2666062 - protein, 9 aa, Entamoeba histolytica
WKGNNASQL

SEQ ID NO: 2666063 - protein, 4 aa, Entamoeba histolytica
WKKD

SEQ ID NO: 2666064 - protein, 4 aa, Entamoeba histolytica
WKKE

SEQ ID NO: 2666065 - protein, 8 aa, Entamoeba histolytica
WKKYGETK

SEQ ID NO: 2666066 - protein, 9 aa, Entamoeba histolytica
WKLETDKNG

SEQ ID NO: 2666067 - protein, 5 aa, Entamoeba histolytica
WKPNT

SEQ ID NO: 2666068 - protein, 16 aa, Entamoeba histolytica
WKQPECKECTSGIEIP

SEQ ID NO: 2666069 - protein, 12 aa, Entamoeba histolytica
WKQQTEKQKAGL

SEQ ID NO: 2666070 - protein, 12 aa, Entamoeba histolytica
WKSCQAKNGELT

SEQ ID NO: 2666071 - protein, 6 aa, Entamoeba histolytica
WKSEGK

SEQ ID NO: 2666072 - protein, 4 aa, Entamoeba histolytica
WKSG

SEQ ID NO: 2666073 - protein, 9 aa, Entamoeba histolytica
WKSPSPGDK

SEQ ID NO: 2666074 - protein, 8 aa, Entamoeba histolytica
WKTTPKRF

SEQ ID NO: 2666075 - protein, 12 aa, Entamoeba histolytica
WNDPRPKNERLP

SEQ ID NO: 2666076 - protein, 5 aa, Entamoeba histolytica
WNETD

SEQ ID NO: 2666077 - protein, 10 aa, Entamoeba histolytica
WNETKQQSEE

SEQ ID NO: 2666078 - protein, 16 aa, Entamoeba histolytica
WNGEEENSQLPSREES

SEQ ID NO: 2666079 - protein, 13 aa, Entamoeba histolytica
WNGNQNTTKTVTE

SEQ ID NO: 2666080 - protein, 9 aa, Entamoeba histolytica
WNGNTEKSV

SEQ ID NO: 2666081 - protein, 7 aa, Entamoeba histolytica
WNGSEEY

SEQ ID NO: 2666082 - protein, 10 aa, Entamoeba histolytica
WNGSNEVESE

SEQ ID NO: 2666083 - protein, 6 aa, Entamoeba histolytica
WNKPKE

SEQ ID NO: 2666084 - protein, 9 aa, Entamoeba histolytica
WNKTCSENI

SEQ ID NO: 2666085 - protein, 5 aa, Entamoeba histolytica
WNNAE

SEQ ID NO: 2666086 - protein, 8 aa, Entamoeba histolytica
WNNGRAQG

SEQ ID NO: 2666087 - protein, 6 aa, Entamoeba histolytica
WNNKRA

SEQ ID NO: 2666088 - protein, 28 aa, Entamoeba histolytica
WNNSPSIKQINSPSTKTTTIPIESHSPG

SEQ ID NO: 2666089 - protein, 8 aa, Entamoeba histolytica
WNNSVSSN

SEQ ID NO: 2666090 - protein, 9 aa, Entamoeba histolytica
WNPAKDKQA

SEQ ID NO: 2666091 - protein, 10 aa, Entamoeba histolytica
WNPANDEQAM

SEQ ID NO: 2666092 - protein, 39 aa, Entamoeba histolytica
WNPKGGVASAQAAPVAPKVETPKEEPKPVVKQQQPNPAG

SEQ ID NO: 2666093 - protein, 9 aa, Entamoeba histolytica
WNPSPKTKY

SEQ ID NO: 2666094 - protein, 17 aa, Entamoeba histolytica
WNPTVDSQAKERTLRIG

SEQ ID NO: 2666095 - protein, 16 aa, Entamoeba histolytica
WNPYERTAKTVSPEER

SEQ ID NO: 2666096 - protein, 4 aa, Entamoeba histolytica
WNQA

SEQ ID NO: 2666097 - protein, 7 aa, Entamoeba histolytica
WNSESKI

SEQ ID NO: 2666098 - protein, 4 aa, Entamoeba histolytica
WNSH

SEQ ID NO: 2666099 - protein, 7 aa, Entamoeba histolytica
WNTEEKK

SEQ ID NO: 2666100 - protein, 7 aa, Entamoeba histolytica
WNVPQTQ

SEQ ID NO: 2666101 - protein, 13 aa, Entamoeba histolytica
WNYPSYEQLWNSH

SEQ ID NO: 2666102 - protein, 6 aa, Entamoeba histolytica
WPEGKY

SEQ ID NO: 2666103 - protein, 5 aa, Entamoeba histolytica
WPEVK

SEQ ID NO: 2666104 - protein, 6 aa, Entamoeba histolytica
WPGVGS

SEQ ID NO: 2666105 - protein, 6 aa, Entamoeba histolytica
WPKESS

SEQ ID NO: 2666106 - protein, 7 aa, Entamoeba histolytica
WPNTKQR

SEQ ID NO: 2666107 - protein, 6 aa, Entamoeba histolytica
WQNGEI

SEQ ID NO: 2666108 - protein, 8 aa, Entamoeba histolytica
WQNSGSGV

SEQ ID NO: 2666109 - protein, 10 aa, Entamoeba histolytica
WQRKSNENLE

SEQ ID NO: 2666110 - protein, 6 aa, Entamoeba histolytica
WRDPPL

SEQ ID NO: 2666111 - protein, 8 aa, Entamoeba histolytica
WRNSRNDV

SEQ ID NO: 2666112 - protein, 10 aa, Entamoeba histolytica
WRSTNALPSP

SEQ ID NO: 2666113 - protein, 10 aa, Entamoeba histolytica
WSDDNEEHWE

SEQ ID NO: 2666114 - protein, 18 aa, Entamoeba histolytica
WSEAQDKKLSGKDPLDEM

SEQ ID NO: 2666115 - protein, 4 aa, Entamoeba histolytica
WSER

SEQ ID NO: 2666116 - protein, 6 aa, Entamoeba histolytica
WSETQT

SEQ ID NO: 2666117 - protein, 5 aa, Entamoeba histolytica
WSGEG

SEQ ID NO: 2666118 - protein, 11 aa, Entamoeba histolytica
WSGQTDEDEIG

SEQ ID NO: 2666119 - protein, 10 aa, Entamoeba histolytica
WSKENNVEDE

SEQ ID NO: 2666120 - protein, 6 aa, Entamoeba histolytica
WSKKNA

SEQ ID NO: 2666121 - protein, 16 aa, Entamoeba histolytica
WSLSGNRIDYENSKRW

SEQ ID NO: 2666122 - protein, 6 aa, Entamoeba histolytica
WSPDGK

SEQ ID NO: 2666123 - protein, 6 aa, Entamoeba histolytica
WSPEGT

SEQ ID NO: 2666124 - protein, 5 aa, Entamoeba histolytica
WSPKE

SEQ ID NO: 2666125 - protein, 8 aa, Entamoeba histolytica
WSPTSSSE

SEQ ID NO: 2666126 - protein, 5 aa, Entamoeba histolytica
WSPVS

SEQ ID NO: 2666127 - protein, 10 aa, Entamoeba histolytica
WSQKKYNEQE

SEQ ID NO: 2666128 - protein, 6 aa, Entamoeba histolytica
WSQPKV

SEQ ID NO: 2666129 - protein, 5 aa, Entamoeba histolytica
WSQTI

SEQ ID NO: 2666130 - protein, 6 aa, Entamoeba histolytica
WSSKDN

SEQ ID NO: 2666131 - protein, 9 aa, Entamoeba histolytica
WSSQGRKNV

SEQ ID NO: 2666132 - protein, 4 aa, Entamoeba histolytica
WSTE

SEQ ID NO: 2666133 - protein, 4 aa, Entamoeba histolytica
WTAE

SEQ ID NO: 2666134 - protein, 6 aa, Entamoeba histolytica
WTDDTD

SEQ ID NO: 2666135 - protein, 8 aa, Entamoeba histolytica
WTGDAKEG

SEQ ID NO: 2666136 - protein, 11 aa, Entamoeba histolytica
WTGKKQCEEIY

SEQ ID NO: 2666137 - protein, 6 aa, Entamoeba histolytica
WTGKSQ

SEQ ID NO: 2666138 - protein, 10 aa, Entamoeba histolytica
WTKKDKYERC

SEQ ID NO: 2666139 - protein, 10 aa, Entamoeba histolytica
WTKKNKEQLT

SEQ ID NO: 2666140 - protein, 12 aa, Entamoeba histolytica
WTKPKPNDTEKD

SEQ ID NO: 2666141 - protein, 12 aa, Entamoeba histolytica
WTKSDKTERSPN

SEQ ID NO: 2666142 - protein, 7 aa, Entamoeba histolytica
WTKTKGA

SEQ ID NO: 2666143 - protein, 10 aa, Entamoeba histolytica
WTNPSQEGFE

SEQ ID NO: 2666144 - protein, 4 aa, Entamoeba histolytica
WTNS

SEQ ID NO: 2666145 - protein, 5 aa, Entamoeba histolytica
WTPSQ

SEQ ID NO: 2666146 - protein, 8 aa, Entamoeba histolytica
WTRSTTDN

SEQ ID NO: 2666147 - protein, 5 aa, Entamoeba histolytica
WTSKQ

SEQ ID NO: 2666148 - protein, 4 aa, Entamoeba histolytica
WVGT

SEQ ID NO: 2666149 - protein, 9 aa, Entamoeba histolytica
YAAKTGGVY

SEQ ID NO: 2666150 - protein, 9 aa, Entamoeba histolytica
YAASNGEYC

SEQ ID NO: 2666151 - protein, 6 aa, Entamoeba histolytica
YADDKQ

SEQ ID NO: 2666152 - protein, 9 aa, Entamoeba histolytica
YADGDARNG

SEQ ID NO: 2666153 - protein, 7 aa, Entamoeba histolytica
YADNQPG

SEQ ID NO: 2666154 - protein, 9 aa, Entamoeba histolytica
YAEGDTAYD

SEQ ID NO: 2666155 - protein, 11 aa, Entamoeba histolytica
YAEGRKPPIGT

SEQ ID NO: 2666156 - protein, 5 aa, Entamoeba histolytica
YAEKS

SEQ ID NO: 2666157 - protein, 8 aa, Entamoeba histolytica
YAENSVPR

SEQ ID NO: 2666158 - protein, 18 aa, Entamoeba histolytica
YAEPYRPSRSVNASPVLS

SEQ ID NO: 2666159 - protein, 9 aa, Entamoeba histolytica
YAESKGSKN

SEQ ID NO: 2666160 - protein, 7 aa, Entamoeba histolytica
YAGDSPL

SEQ ID NO: 2666161 - protein, 6 aa, Entamoeba histolytica
YAGGDQ

SEQ ID NO: 2666162 - protein, 4 aa, Entamoeba histolytica
YAGK

SEQ ID NO: 2666163 - protein, 10 aa, Entamoeba histolytica
YAGKNHPPEI

SEQ ID NO: 2666164 - protein, 9 aa, Entamoeba histolytica
YAGNTEPSY

SEQ ID NO: 2666165 - protein, 9 aa, Entamoeba histolytica
YAKEQKGHK

SEQ ID NO: 2666166 - protein, 8 aa, Entamoeba histolytica
YAKKNEDV

SEQ ID NO: 2666167 - protein, 13 aa, Entamoeba histolytica
YAKSQQASSASSL

SEQ ID NO: 2666168 - protein, 7 aa, Entamoeba histolytica
YAKTTAN

SEQ ID NO: 2666169 - protein, 12 aa, Entamoeba histolytica
YANEKIKQANGP

SEQ ID NO: 2666170 - protein, 10 aa, Entamoeba histolytica
YANNSDEKKV

SEQ ID NO: 2666171 - protein, 10 aa, Entamoeba histolytica
YANPDECNSK

SEQ ID NO: 2666172 - protein, 19 aa, Entamoeba histolytica
YANRVNGGGYENTNAYKKT

SEQ ID NO: 2666173 - protein, 11 aa, Entamoeba histolytica
YANSLGKYGTS

SEQ ID NO: 2666174 - protein, 12 aa, Entamoeba histolytica
YANSPYKKRAEK

SEQ ID NO: 2666175 - protein, 11 aa, Entamoeba histolytica
YANSSSKKIHK

SEQ ID NO: 2666176 - protein, 7 aa, Entamoeba histolytica
YANTEDG

SEQ ID NO: 2666177 - protein, 15 aa, Entamoeba histolytica
YAPKSMKEGKIDQYS

SEQ ID NO: 2666178 - protein, 4 aa, Entamoeba histolytica
YAPP

SEQ ID NO: 2666179 - protein, 50 aa, Entamoeba histolytica
YAPSTASSKKITINGKTVTVSANTQVGKSAPRMKGKVEHKGAAAETKKLE

SEQ ID NO: 2666180 - protein, 15 aa, Entamoeba histolytica
YAPTSGASKKITVNG

SEQ ID NO: 2666181 - protein, 7 aa, Entamoeba histolytica
YAPTVNR

SEQ ID NO: 2666182 - protein, 11 aa, Entamoeba histolytica
YAQRDKEEMEL

SEQ ID NO: 2666183 - protein, 16 aa, Entamoeba histolytica
YAQSKQKKNKNKNGEN

SEQ ID NO: 2666184 - protein, 9 aa, Entamoeba histolytica
YARKTTIGK

SEQ ID NO: 2666185 - protein, 7 aa, Entamoeba histolytica
YARRRKN

SEQ ID NO: 2666186 - protein, 4 aa, Entamoeba histolytica
YASE

SEQ ID NO: 2666187 - protein, 26 aa, Entamoeba histolytica
YASETGIKLSKKTKKEKGSKKQGCKN

SEQ ID NO: 2666188 - protein, 17 aa, Entamoeba histolytica
YASNEEKRYYQNNKEEV

SEQ ID NO: 2666189 - protein, 8 aa, Entamoeba histolytica
YASNRVKN

SEQ ID NO: 2666190 - protein, 9 aa, Entamoeba histolytica
YASQPDPRM

SEQ ID NO: 2666191 - protein, 5 aa, Entamoeba histolytica
YASQQ

SEQ ID NO: 2666192 - protein, 6 aa, Entamoeba histolytica
YASSEG

SEQ ID NO: 2666193 - protein, 6 aa, Entamoeba histolytica
YASSPI

SEQ ID NO: 2666194 - protein, 18 aa, Entamoeba histolytica
YASTPRSSLDLNRNDIKK

SEQ ID NO: 2666195 - protein, 5 aa, Entamoeba histolytica
YASVP

SEQ ID NO: 2666196 - protein, 8 aa, Entamoeba histolytica
YAYESNGS

SEQ ID NO: 2666197 - protein, 20 aa, Entamoeba histolytica
YCDNDEEKIGTPLEDAQRRD

SEQ ID NO: 2666198 - protein, 6 aa, Entamoeba histolytica
YCSKGG

SEQ ID NO: 2666199 - protein, 10 aa, Entamoeba histolytica
YCSSEDSIRK

SEQ ID NO: 2666200 - protein, 6 aa, Entamoeba histolytica
YDAQES

SEQ ID NO: 2666201 - protein, 11 aa, Entamoeba histolytica
YDASNPDTDKH

SEQ ID NO: 2666202 - protein, 10 aa, Entamoeba histolytica
YDATAEGDLT

SEQ ID NO: 2666203 - protein, 7 aa, Entamoeba histolytica
YDATESL

SEQ ID NO: 2666204 - protein, 5 aa, Entamoeba histolytica
YDDAE

SEQ ID NO: 2666205 - protein, 4 aa, Entamoeba histolytica
YDDD

SEQ ID NO: 2666206 - protein, 6 aa, Entamoeba histolytica
YDDEQN

SEQ ID NO: 2666207 - protein, 7 aa, Entamoeba histolytica
YDDHPDS

SEQ ID NO: 2666208 - protein, 7 aa, Entamoeba histolytica
YDDKPHK

SEQ ID NO: 2666209 - protein, 7 aa, Entamoeba histolytica
YDDMDEE

SEQ ID NO: 2666210 - protein, 8 aa, Entamoeba histolytica
YDDNDETE

SEQ ID NO: 2666211 - protein, 9 aa, Entamoeba histolytica
YDDQPFDRE

SEQ ID NO: 2666212 - protein, 39 aa, Entamoeba histolytica
YDDSSKSVDGEQSNTNEIKPATEPIDLGSQNNKPEEKKC

SEQ ID NO: 2666213 - protein, 10 aa, Entamoeba histolytica
YDEAGKKELN

SEQ ID NO: 2666214 - protein, 9 aa, Entamoeba histolytica
YDEDQEVRD

SEQ ID NO: 2666215 - protein, 8 aa, Entamoeba histolytica
YDEEITGR

SEQ ID NO: 2666216 - protein, 6 aa, Entamoeba histolytica
YDEEQN

SEQ ID NO: 2666217 - protein, 6 aa, Entamoeba histolytica
YDEGKH

SEQ ID NO: 2666218 - protein, 8 aa, Entamoeba histolytica
YDEKSKEI

SEQ ID NO: 2666219 - protein, 7 aa, Entamoeba histolytica
YDEKTDT

SEQ ID NO: 2666220 - protein, 4 aa, Entamoeba histolytica
YDEN

SEQ ID NO: 2666221 - protein, 17 aa, Entamoeba histolytica
YDENSVPASKARPGDNV

SEQ ID NO: 2666222 - protein, 11 aa, Entamoeba histolytica
YDENTESNYYE

SEQ ID NO: 2666223 - protein, 26 aa, Entamoeba histolytica
YDERKKLREEEEDRIEKRKLGKEELV

SEQ ID NO: 2666224 - protein, 8 aa, Entamoeba histolytica
YDERREES

SEQ ID NO: 2666225 - protein, 10 aa, Entamoeba histolytica
YDESKDTITN

SEQ ID NO: 2666226 - protein, 6 aa, Entamoeba histolytica
YDESQR

SEQ ID NO: 2666227 - protein, 4 aa, Entamoeba histolytica
YDET

SEQ ID NO: 2666228 - protein, 6 aa, Entamoeba histolytica
YDETAT

SEQ ID NO: 2666229 - protein, 8 aa, Entamoeba histolytica
YDETGTVG

SEQ ID NO: 2666230 - protein, 5 aa, Entamoeba histolytica
YDETI

SEQ ID NO: 2666231 - protein, 6 aa, Entamoeba histolytica
YDETKK

SEQ ID NO: 2666232 - protein, 5 aa, Entamoeba histolytica
YDETR

SEQ ID NO: 2666233 - protein, 15 aa, Entamoeba histolytica
YDEVEDANLLDNDET

SEQ ID NO: 2666234 - protein, 18 aa, Entamoeba histolytica
YDEVENELERKQHQLDGL

SEQ ID NO: 2666235 - protein, 9 aa, Entamoeba histolytica
YDEWNSNTF

SEQ ID NO: 2666236 - protein, 8 aa, Entamoeba histolytica
YDGAGSDE

SEQ ID NO: 2666237 - protein, 12 aa, Entamoeba histolytica
YDGAYEDGRSTI

SEQ ID NO: 2666238 - protein, 4 aa, Entamoeba histolytica
YDGE

SEQ ID NO: 2666239 - protein, 4 aa, Entamoeba histolytica
YDGI

SEQ ID NO: 2666240 - protein, 5 aa, Entamoeba histolytica
YDGIT

SEQ ID NO: 2666241 - protein, 10 aa, Entamoeba histolytica
YDGKQLATAS

SEQ ID NO: 2666242 - protein, 4 aa, Entamoeba histolytica
YDGS

SEQ ID NO: 2666243 - protein, 6 aa, Entamoeba histolytica
YDGTED

SEQ ID NO: 2666244 - protein, 37 aa, Entamoeba histolytica
YDHSKEKTLTNPSELQQQNNTFTKYKQSEQEQTTLNE

SEQ ID NO: 2666245 - protein, 8 aa, Entamoeba histolytica
YDITEEDI

SEQ ID NO: 2666246 - protein, 12 aa, Entamoeba histolytica
YDKDALGSRTLP

SEQ ID NO: 2666247 - protein, 6 aa, Entamoeba histolytica
YDKDGV

SEQ ID NO: 2666248 - protein, 11 aa, Entamoeba histolytica
YDKDNSGKFDQ

SEQ ID NO: 2666249 - protein, 20 aa, Entamoeba histolytica
YDKKEEINTNDLSSLSSSKL

SEQ ID NO: 2666250 - protein, 9 aa, Entamoeba histolytica
YDKKKDKDA

SEQ ID NO: 2666251 - protein, 4 aa, Entamoeba histolytica
YDKN

SEQ ID NO: 2666252 - protein, 10 aa, Entamoeba histolytica
YDKPKPTKLI

SEQ ID NO: 2666253 - protein, 13 aa, Entamoeba histolytica
YDKSGNQRFVINC

SEQ ID NO: 2666254 - protein, 9 aa, Entamoeba histolytica
YDKSQTLIN

SEQ ID NO: 2666255 - protein, 13 aa, Entamoeba histolytica
YDKTKSKNIPEKP

SEQ ID NO: 2666256 - protein, 21 aa, Entamoeba histolytica
YDKTYAEMSEVEKNQCSHRGV

SEQ ID NO: 2666257 - protein, 11 aa, Entamoeba histolytica
YDLKKKEHRKE

SEQ ID NO: 2666258 - protein, 14 aa, Entamoeba histolytica
YDNARTTAENELKE

SEQ ID NO: 2666259 - protein, 6 aa, Entamoeba histolytica
YDNDNT

SEQ ID NO: 2666260 - protein, 11 aa, Entamoeba histolytica
YDNISTKQLQP

SEQ ID NO: 2666261 - protein, 11 aa, Entamoeba histolytica
YDNKYQQQFNE

SEQ ID NO: 2666262 - protein, 10 aa, Entamoeba histolytica
YDNNKQIQNS

SEQ ID NO: 2666263 - protein, 9 aa, Entamoeba histolytica
YDNSEEELL

SEQ ID NO: 2666264 - protein, 5 aa, Entamoeba histolytica
YDNSF

SEQ ID NO: 2666265 - protein, 4 aa, Entamoeba histolytica
YDNW

SEQ ID NO: 2666266 - protein, 7 aa, Entamoeba histolytica
YDPAGDD

SEQ ID NO: 2666267 - protein, 6 aa, Entamoeba histolytica
YDPEHS

SEQ ID NO: 2666268 - protein, 6 aa, Entamoeba histolytica
YDPESA

SEQ ID NO: 2666269 - protein, 8 aa, Entamoeba histolytica
YDPGKGTR

SEQ ID NO: 2666270 - protein, 6 aa, Entamoeba histolytica
YDPKTL

SEQ ID NO: 2666271 - protein, 21 aa, Entamoeba histolytica
YDPNETRNSTIESPDGSATHT

SEQ ID NO: 2666272 - protein, 8 aa, Entamoeba histolytica
YDPNTYLD

SEQ ID NO: 2666273 - protein, 9 aa, Entamoeba histolytica
YDPNVSPDK

SEQ ID NO: 2666274 - protein, 7 aa, Entamoeba histolytica
YDQDELA

SEQ ID NO: 2666275 - protein, 9 aa, Entamoeba histolytica
YDQKTAEES

SEQ ID NO: 2666276 - protein, 8 aa, Entamoeba histolytica
YDQNAKEI

SEQ ID NO: 2666277 - protein, 8 aa, Entamoeba histolytica
YDQNTSSD

SEQ ID NO: 2666278 - protein, 15 aa, Entamoeba histolytica
YDQPLGDSYTNSTLQ

SEQ ID NO: 2666279 - protein, 9 aa, Entamoeba histolytica
YDQSKSKEI

SEQ ID NO: 2666280 - protein, 7 aa, Entamoeba histolytica
YDQSSIA

SEQ ID NO: 2666281 - protein, 6 aa, Entamoeba histolytica
YDRDNT

SEQ ID NO: 2666282 - protein, 13 aa, Entamoeba histolytica
YDRFSKRTGDQIT

SEQ ID NO: 2666283 - protein, 13 aa, Entamoeba histolytica
YDRRNERDQRHSR

SEQ ID NO: 2666284 - protein, 5 aa, Entamoeba histolytica
YDRSE

SEQ ID NO: 2666285 - protein, 11 aa, Entamoeba histolytica
YDSDDEKEDDL

SEQ ID NO: 2666286 - protein, 30 aa, Entamoeba histolytica
YDSEEDSEKMSEDYDERNSEEEDVPRTREG

SEQ ID NO: 2666287 - protein, 12 aa, Entamoeba histolytica
YDSEEDYDKAID

SEQ ID NO: 2666288 - protein, 5 aa, Entamoeba histolytica
YDSEG

SEQ ID NO: 2666289 - protein, 10 aa, Entamoeba histolytica
YDSGKNLREE

SEQ ID NO: 2666290 - protein, 6 aa, Entamoeba histolytica
YDSNTQ

SEQ ID NO: 2666291 - protein, 7 aa, Entamoeba histolytica
YDSQTTT

SEQ ID NO: 2666292 - protein, 6 aa, Entamoeba histolytica
YDSSQN

SEQ ID NO: 2666293 - protein, 14 aa, Entamoeba histolytica
YDSSSDEVKKIQSN

SEQ ID NO: 2666294 - protein, 13 aa, Entamoeba histolytica
YDSSTETELSIKR

SEQ ID NO: 2666295 - protein, 4 aa, Entamoeba histolytica
YDST

SEQ ID NO: 2666296 - protein, 5 aa, Entamoeba histolytica
YDSTA

SEQ ID NO: 2666297 - protein, 16 aa, Entamoeba histolytica
YDSTTQTYQPPPQQQY

SEQ ID NO: 2666298 - protein, 8 aa, Entamoeba histolytica
YDTDSGEV

SEQ ID NO: 2666299 - protein, 10 aa, Entamoeba histolytica
YDTKVRKTQN

SEQ ID NO: 2666300 - protein, 7 aa, Entamoeba histolytica
YDTPEGL

SEQ ID NO: 2666301 - protein, 5 aa, Entamoeba histolytica
YDTPL

SEQ ID NO: 2666302 - protein, 5 aa, Entamoeba histolytica
YDTTN

SEQ ID NO: 2666303 - protein, 4 aa, Entamoeba histolytica
YDVS

SEQ ID NO: 2666304 - protein, 12 aa, Entamoeba histolytica
YDVSTPKTFNAP

SEQ ID NO: 2666305 - protein, 4 aa, Entamoeba histolytica
YDYQ

SEQ ID NO: 2666306 - protein, 13 aa, Entamoeba histolytica
YEAKKKKPKGYDQ

SEQ ID NO: 2666307 - protein, 5 aa, Entamoeba histolytica
YEAPK

SEQ ID NO: 2666308 - protein, 11 aa, Entamoeba histolytica
YEASDSTELSL

SEQ ID NO: 2666309 - protein, 90 aa, Entamoeba histolytica
YEDAGEYEEDGDDEYEKEDDEYEYEAEEEGNEESEEYESGEEDEDQLESKKNATESKEKTIEDLRKEEKKKEDLEKKQRNKAVDKKNTYL

SEQ ID NO: 2666310 - protein, 298 aa, Entamoeba histolytica
YEDAKQEDKKEELKKEEDKQEENKKSEENKKEEVNEQNKEEKESVEDKKSEEKESDEDKKSEEKESDSSSSLTPTTESEKKEVIEEDKKEEPKQDEQPNETNESDKKEENPSPDSIKEDQKQQPSDNEEPKAEEPKAEEPKEEEPKEEEPKEEEPKAEEPKAEEPKAEEPKAEEPKAEEPKAEEPKAEEPKAEEPKAEEPKAEEPKAEEPKAEEPKAEEPKEEEPKAEEPKEEEPKEEEPKEEEPKEEEPKEEEPKEEEPKEEDPKAENSSTETDSSSTISSSSSKSDTSDKQSRDLS

SEQ ID NO: 2666311 - protein, 4 aa, Entamoeba histolytica
YEDE

SEQ ID NO: 2666312 - protein, 9 aa, Entamoeba histolytica
YEDEKRSCV

SEQ ID NO: 2666313 - protein, 11 aa, Entamoeba histolytica
YEDEQITETRS

SEQ ID NO: 2666314 - protein, 10 aa, Entamoeba histolytica
YEDETEEETI

SEQ ID NO: 2666315 - protein, 28 aa, Entamoeba histolytica
YEDGTNTSVVQDNEQSSQEEKQDTTCIN

SEQ ID NO: 2666316 - protein, 9 aa, Entamoeba histolytica
YEDKAKNEY

SEQ ID NO: 2666317 - protein, 12 aa, Entamoeba histolytica
YEDKQNKLIEES

SEQ ID NO: 2666318 - protein, 10 aa, Entamoeba histolytica
YEDNDKSNNY

SEQ ID NO: 2666319 - protein, 20 aa, Entamoeba histolytica
YEDNQEKETVCPNSPKVHYD

SEQ ID NO: 2666320 - protein, 13 aa, Entamoeba histolytica
YEDNYDPNQMDKN

SEQ ID NO: 2666321 - protein, 24 aa, Entamoeba histolytica
YEDPKEEENTIESKEINKENKSFN

SEQ ID NO: 2666322 - protein, 31 aa, Entamoeba histolytica
YEDTTHETKMEEEEQKEGVDEDLEEEQENQM

SEQ ID NO: 2666323 - protein, 8 aa, Entamoeba histolytica
YEEAEEVC

SEQ ID NO: 2666324 - protein, 5 aa, Entamoeba histolytica
YEEEC

SEQ ID NO: 2666325 - protein, 13 aa, Entamoeba histolytica
YEEEDESKPPISL

SEQ ID NO: 2666326 - protein, 9 aa, Entamoeba histolytica
YEEENQNAV

SEQ ID NO: 2666327 - protein, 12 aa, Entamoeba histolytica
YEEEQRSHTKTI

SEQ ID NO: 2666328 - protein, 19 aa, Entamoeba histolytica
YEEGIQKEQEEKKKEEEEV

SEQ ID NO: 2666329 - protein, 10 aa, Entamoeba histolytica
YEEHGKNKDY

SEQ ID NO: 2666330 - protein, 24 aa, Entamoeba histolytica
YEEKEEKGKIIKETESDITYEKKT

SEQ ID NO: 2666331 - protein, 27 aa, Entamoeba histolytica
YEEKEKTDKQLNSATERGVEEISLPPI

SEQ ID NO: 2666332 - protein, 8 aa, Entamoeba histolytica
YEEKSSYI

SEQ ID NO: 2666333 - protein, 8 aa, Entamoeba histolytica
YEEKTKMG

SEQ ID NO: 2666334 - protein, 4 aa, Entamoeba histolytica
YEEL

SEQ ID NO: 2666335 - protein, 18 aa, Entamoeba histolytica
YEENKRLKQQVNKIKQTQ

SEQ ID NO: 2666336 - protein, 6 aa, Entamoeba histolytica
YEENQN

SEQ ID NO: 2666337 - protein, 5 aa, Entamoeba histolytica
YEEPK

SEQ ID NO: 2666338 - protein, 11 aa, Entamoeba histolytica
YEEPSQGEQVI

SEQ ID NO: 2666339 - protein, 11 aa, Entamoeba histolytica
YEEQRKEDGMK

SEQ ID NO: 2666340 - protein, 10 aa, Entamoeba histolytica
YEEQRKETEL

SEQ ID NO: 2666341 - protein, 6 aa, Entamoeba histolytica
YEERDD

SEQ ID NO: 2666342 - protein, 9 aa, Entamoeba histolytica
YEESTKDLV

SEQ ID NO: 2666343 - protein, 10 aa, Entamoeba histolytica
YEETHEKVKP

SEQ ID NO: 2666344 - protein, 6 aa, Entamoeba histolytica
YEETNE

SEQ ID NO: 2666345 - protein, 8 aa, Entamoeba histolytica
YEETTIPY

SEQ ID NO: 2666346 - protein, 4 aa, Entamoeba histolytica
YEEY

SEQ ID NO: 2666347 - protein, 12 aa, Entamoeba histolytica
YEFGGKNHKEQY

SEQ ID NO: 2666348 - protein, 4 aa, Entamoeba histolytica
YEGE

SEQ ID NO: 2666349 - protein, 16 aa, Entamoeba histolytica
YEGEKQLQRLKDGEIT

SEQ ID NO: 2666350 - protein, 5 aa, Entamoeba histolytica
YEGEV

SEQ ID NO: 2666351 - protein, 12 aa, Entamoeba histolytica
YEGGDADTNGAV

SEQ ID NO: 2666352 - protein, 8 aa, Entamoeba histolytica
YEGGDVET

SEQ ID NO: 2666353 - protein, 17 aa, Entamoeba histolytica
YEGGFSGCPGGEAHGGY

SEQ ID NO: 2666354 - protein, 12 aa, Entamoeba histolytica
YEGGNEDNEIET

SEQ ID NO: 2666355 - protein, 4 aa, Entamoeba histolytica
YEGI

SEQ ID NO: 2666356 - protein, 13 aa, Entamoeba histolytica
YEGKNEKGGSTRY

SEQ ID NO: 2666357 - protein, 7 aa, Entamoeba histolytica
YEGKSEL

SEQ ID NO: 2666358 - protein, 8 aa, Entamoeba histolytica
YEGKTDHQ

SEQ ID NO: 2666359 - protein, 12 aa, Entamoeba histolytica
YEGLNEANKKVK

SEQ ID NO: 2666360 - protein, 10 aa, Entamoeba histolytica
YEGNEEEMKN

SEQ ID NO: 2666361 - protein, 14 aa, Entamoeba histolytica
YEGPEEDDDMKDST

SEQ ID NO: 2666362 - protein, 5 aa, Entamoeba histolytica
YEGQQ

SEQ ID NO: 2666363 - protein, 18 aa, Entamoeba histolytica
YEGTPDEQATNFREQGNE

SEQ ID NO: 2666364 - protein, 6 aa, Entamoeba histolytica
YEGTTS

SEQ ID NO: 2666365 - protein, 17 aa, Entamoeba histolytica
YEHEKREEVNRKDYGDV

SEQ ID NO: 2666366 - protein, 55 aa, Entamoeba histolytica
YEHNEKHNEKYNEIKDSSESKEENKEENKEENKEENKESSNEEKNEEKNEESSLL

SEQ ID NO: 2666367 - protein, 8 aa, Entamoeba histolytica
YEHQPDKE

SEQ ID NO: 2666368 - protein, 4 aa, Entamoeba histolytica
YEHS

SEQ ID NO: 2666369 - protein, 6 aa, Entamoeba histolytica
YEIDGK

SEQ ID NO: 2666370 - protein, 19 aa, Entamoeba histolytica
YEIKEDDEKVSTEIKDIED

SEQ ID NO: 2666371 - protein, 5 aa, Entamoeba histolytica
YEIPN

SEQ ID NO: 2666372 - protein, 19 aa, Entamoeba histolytica
YEKAEGSDERNEIKEQQMQ

SEQ ID NO: 2666373 - protein, 4 aa, Entamoeba histolytica
YEKC

SEQ ID NO: 2666374 - protein, 5 aa, Entamoeba histolytica
YEKDE

SEQ ID NO: 2666375 - protein, 5 aa, Entamoeba histolytica
YEKEG

SEQ ID NO: 2666376 - protein, 9 aa, Entamoeba histolytica
YEKEGDLNE

SEQ ID NO: 2666377 - protein, 10 aa, Entamoeba histolytica
YEKEKKKENL

SEQ ID NO: 2666378 - protein, 12 aa, Entamoeba histolytica
YEKGEKERVKKE

SEQ ID NO: 2666379 - protein, 5 aa, Entamoeba histolytica
YEKKD

SEQ ID NO: 2666380 - protein, 7 aa, Entamoeba histolytica
YEKKSAK

SEQ ID NO: 2666381 - protein, 12 aa, Entamoeba histolytica
YEKLPNSSLTTD

SEQ ID NO: 2666382 - protein, 10 aa, Entamoeba histolytica
YEKNKQSPPL

SEQ ID NO: 2666383 - protein, 7 aa, Entamoeba histolytica
YEKPIDD

SEQ ID NO: 2666384 - protein, 9 aa, Entamoeba histolytica
YEKPSPVQR

SEQ ID NO: 2666385 - protein, 5 aa, Entamoeba histolytica
YEKQV

SEQ ID NO: 2666386 - protein, 14 aa, Entamoeba histolytica
YEKSEMKYNENNKP

SEQ ID NO: 2666387 - protein, 9 aa, Entamoeba histolytica
YEKSEVNSS

SEQ ID NO: 2666388 - protein, 9 aa, Entamoeba histolytica
YEKTKKDCD

SEQ ID NO: 2666389 - protein, 6 aa, Entamoeba histolytica
YEKTKL

SEQ ID NO: 2666390 - protein, 8 aa, Entamoeba histolytica
YEKTQENV

SEQ ID NO: 2666391 - protein, 9 aa, Entamoeba histolytica
YEKVKPNDN

SEQ ID NO: 2666392 - protein, 10 aa, Entamoeba histolytica
YELKDQESPF

SEQ ID NO: 2666393 - protein, 5 aa, Entamoeba histolytica
YEMGG

SEQ ID NO: 2666394 - protein, 11 aa, Entamoeba histolytica
YEMKNTGQGYH

SEQ ID NO: 2666395 - protein, 5 aa, Entamoeba histolytica
YEMSK

SEQ ID NO: 2666396 - protein, 9 aa, Entamoeba histolytica
YENDQHNTI

SEQ ID NO: 2666397 - protein, 4 aa, Entamoeba histolytica
YENE

SEQ ID NO: 2666398 - protein, 13 aa, Entamoeba histolytica
YENEPRGDGAVDL

SEQ ID NO: 2666399 - protein, 5 aa, Entamoeba histolytica
YENEQ

SEQ ID NO: 2666400 - protein, 5 aa, Entamoeba histolytica
YENET

SEQ ID NO: 2666401 - protein, 9 aa, Entamoeba histolytica
YENETLPNS

SEQ ID NO: 2666402 - protein, 4 aa, Entamoeba histolytica
YENN

SEQ ID NO: 2666403 - protein, 42 aa, Entamoeba histolytica
YENNDEENDDEYEIEDNEEEENVEDDIEEEEENEEENEDIED

SEQ ID NO: 2666404 - protein, 13 aa, Entamoeba histolytica
YENNDKKKQEDAR

SEQ ID NO: 2666405 - protein, 5 aa, Entamoeba histolytica
YENNS

SEQ ID NO: 2666406 - protein, 6 aa, Entamoeba histolytica
YENSNL

SEQ ID NO: 2666407 - protein, 14 aa, Entamoeba histolytica
YENSRLKDDLEQAQ

SEQ ID NO: 2666408 - protein, 4 aa, Entamoeba histolytica
YENT

SEQ ID NO: 2666409 - protein, 14 aa, Entamoeba histolytica
YENTEDAQKAVTAP

SEQ ID NO: 2666410 - protein, 12 aa, Entamoeba histolytica
YENTKENEESVK

SEQ ID NO: 2666411 - protein, 15 aa, Entamoeba histolytica
YENYSNDSHKSNSIE

SEQ ID NO: 2666412 - protein, 9 aa, Entamoeba histolytica
YEPDKCPNS

SEQ ID NO: 2666413 - protein, 10 aa, Entamoeba histolytica
YEPESTDPME

SEQ ID NO: 2666414 - protein, 5 aa, Entamoeba histolytica
YEPKE

SEQ ID NO: 2666415 - protein, 8 aa, Entamoeba histolytica
YEPKNRPL

SEQ ID NO: 2666416 - protein, 7 aa, Entamoeba histolytica
YEPKTSY

SEQ ID NO: 2666417 - protein, 14 aa, Entamoeba histolytica
YEPNGISKSKNQLS

SEQ ID NO: 2666418 - protein, 7 aa, Entamoeba histolytica
YEPSERI

SEQ ID NO: 2666419 - protein, 7 aa, Entamoeba histolytica
YEPSTPC

SEQ ID NO: 2666420 - protein, 21 aa, Entamoeba histolytica
YEPTESETSSENEEKKSPSLK

SEQ ID NO: 2666421 - protein, 6 aa, Entamoeba histolytica
YEPTNN

SEQ ID NO: 2666422 - protein, 11 aa, Entamoeba histolytica
YEQDHNPKLQQ

SEQ ID NO: 2666423 - protein, 17 aa, Entamoeba histolytica
YEQEELNENGNEQREIN

SEQ ID NO: 2666424 - protein, 5 aa, Entamoeba histolytica
YEQEP

SEQ ID NO: 2666425 - protein, 12 aa, Entamoeba histolytica
YEQKELESNTPV

SEQ ID NO: 2666426 - protein, 10 aa, Entamoeba histolytica
YEQKERWKSI

SEQ ID NO: 2666427 - protein, 4 aa, Entamoeba histolytica
YEQM

SEQ ID NO: 2666428 - protein, 12 aa, Entamoeba histolytica
YEQNNQQGEKIT

SEQ ID NO: 2666429 - protein, 10 aa, Entamoeba histolytica
YEQNSKQTKD

SEQ ID NO: 2666430 - protein, 4 aa, Entamoeba histolytica
YEQP

SEQ ID NO: 2666431 - protein, 6 aa, Entamoeba histolytica
YEQTSE

SEQ ID NO: 2666432 - protein, 13 aa, Entamoeba histolytica
YERNNEKIKQNDD

SEQ ID NO: 2666433 - protein, 7 aa, Entamoeba histolytica
YERRNTM

SEQ ID NO: 2666434 - protein, 4 aa, Entamoeba histolytica
YERT

SEQ ID NO: 2666435 - protein, 10 aa, Entamoeba histolytica
YESDDKEVSA

SEQ ID NO: 2666436 - protein, 9 aa, Entamoeba histolytica
YESDRIQSI

SEQ ID NO: 2666437 - protein, 5 aa, Entamoeba histolytica
YESEN

SEQ ID NO: 2666438 - protein, 32 aa, Entamoeba histolytica
YESIESKKEYKSKEIDGSEENDKTEKEEGEWM

SEQ ID NO: 2666439 - protein, 4 aa, Entamoeba histolytica
YESL

SEQ ID NO: 2666440 - protein, 9 aa, Entamoeba histolytica
YESNQYSLD

SEQ ID NO: 2666441 - protein, 5 aa, Entamoeba histolytica
YESNS

SEQ ID NO: 2666442 - protein, 10 aa, Entamoeba histolytica
YESPEKQTSL

SEQ ID NO: 2666443 - protein, 12 aa, Entamoeba histolytica
YESQKSYKESEV

SEQ ID NO: 2666444 - protein, 4 aa, Entamoeba histolytica
YESR

SEQ ID NO: 2666445 - protein, 9 aa, Entamoeba histolytica
YESSENTDM

SEQ ID NO: 2666446 - protein, 7 aa, Entamoeba histolytica
YESSKET

SEQ ID NO: 2666447 - protein, 10 aa, Entamoeba histolytica
YESTSSDPME

SEQ ID NO: 2666448 - protein, 10 aa, Entamoeba histolytica
YETDTEDDQV

SEQ ID NO: 2666449 - protein, 14 aa, Entamoeba histolytica
YETEDTSYHSLTGS

SEQ ID NO: 2666450 - protein, 6 aa, Entamoeba histolytica
YETEKK

SEQ ID NO: 2666451 - protein, 6 aa, Entamoeba histolytica
YETGPL

SEQ ID NO: 2666452 - protein, 4 aa, Entamoeba histolytica
YETK

SEQ ID NO: 2666453 - protein, 9 aa, Entamoeba histolytica
YETKEELEK

SEQ ID NO: 2666454 - protein, 10 aa, Entamoeba histolytica
YETLKQAKQH

SEQ ID NO: 2666455 - protein, 10 aa, Entamoeba histolytica
YETNESGSKV

SEQ ID NO: 2666456 - protein, 7 aa, Entamoeba histolytica
YETNSHN

SEQ ID NO: 2666457 - protein, 25 aa, Entamoeba histolytica
YETQHAMDREKKNAMSEDSSSEAEL

SEQ ID NO: 2666458 - protein, 9 aa, Entamoeba histolytica
YETSTQCTS

SEQ ID NO: 2666459 - protein, 5 aa, Entamoeba histolytica
YETTI

SEQ ID NO: 2666460 - protein, 22 aa, Entamoeba histolytica
YEYEDEEYEDEVEEGDEEEEYE

SEQ ID NO: 2666461 - protein, 12 aa, Entamoeba histolytica
YEYEEGKKRIEE

SEQ ID NO: 2666462 - protein, 6 aa, Entamoeba histolytica
YEYEKS

SEQ ID NO: 2666463 - protein, 15 aa, Entamoeba histolytica
YFATPTRTVSFVTHQ

SEQ ID NO: 2666464 - protein, 10 aa, Entamoeba histolytica
YFEKGSPIQT

SEQ ID NO: 2666465 - protein, 14 aa, Entamoeba histolytica
YFESDGQPSLDNGE

SEQ ID NO: 2666466 - protein, 31 aa, Entamoeba histolytica
YFPDKKKRSSEGEEPETKKIDTTIQIDSREK

SEQ ID NO: 2666467 - protein, 12 aa, Entamoeba histolytica
YFPDQQELTPKQ

SEQ ID NO: 2666468 - protein, 5 aa, Entamoeba histolytica
YFPPG

SEQ ID NO: 2666469 - protein, 4 aa, Entamoeba histolytica
YFSD

SEQ ID NO: 2666470 - protein, 8 aa, Entamoeba histolytica
YGAERDEC

SEQ ID NO: 2666471 - protein, 4 aa, Entamoeba histolytica
YGAK

SEQ ID NO: 2666472 - protein, 17 aa, Entamoeba histolytica
YGAPTQPQEINDNEHKK

SEQ ID NO: 2666473 - protein, 7 aa, Entamoeba histolytica
YGDASQL

SEQ ID NO: 2666474 - protein, 13 aa, Entamoeba histolytica
YGDDISSKDNKGH

SEQ ID NO: 2666475 - protein, 4 aa, Entamoeba histolytica
YGDT

SEQ ID NO: 2666476 - protein, 5 aa, Entamoeba histolytica
YGDTD

SEQ ID NO: 2666477 - protein, 11 aa, Entamoeba histolytica
YGDYDTSDDKS

SEQ ID NO: 2666478 - protein, 6 aa, Entamoeba histolytica
YGEAKG

SEQ ID NO: 2666479 - protein, 9 aa, Entamoeba histolytica
YGECGKRGG

SEQ ID NO: 2666480 - protein, 9 aa, Entamoeba histolytica
YGEDTVEEG

SEQ ID NO: 2666481 - protein, 6 aa, Entamoeba histolytica
YGEEIS

SEQ ID NO: 2666482 - protein, 12 aa, Entamoeba histolytica
YGEEMGGHKGYG

SEQ ID NO: 2666483 - protein, 8 aa, Entamoeba histolytica
YGEESKIQ

SEQ ID NO: 2666484 - protein, 15 aa, Entamoeba histolytica
YGEGASTASTSLKYF

SEQ ID NO: 2666485 - protein, 5 aa, Entamoeba histolytica
YGEIE

SEQ ID NO: 2666486 - protein, 12 aa, Entamoeba histolytica
YGEKEDKAQRQL

SEQ ID NO: 2666487 - protein, 5 aa, Entamoeba histolytica
YGENG

SEQ ID NO: 2666488 - protein, 8 aa, Entamoeba histolytica
YGENRTDE

SEQ ID NO: 2666489 - protein, 6 aa, Entamoeba histolytica
YGENSK

SEQ ID NO: 2666490 - protein, 20 aa, Entamoeba histolytica
YGEPSQHYEPPNDFDSPHSS

SEQ ID NO: 2666491 - protein, 8 aa, Entamoeba histolytica
YGEQQGKK

SEQ ID NO: 2666492 - protein, 7 aa, Entamoeba histolytica
YGETDDP

SEQ ID NO: 2666493 - protein, 13 aa, Entamoeba histolytica
YGETSPPKPLTEP

SEQ ID NO: 2666494 - protein, 6 aa, Entamoeba histolytica
YGGAKG

SEQ ID NO: 2666495 - protein, 6 aa, Entamoeba histolytica
YGGETE

SEQ ID NO: 2666496 - protein, 9 aa, Entamoeba histolytica
YGGGEKEKH

SEQ ID NO: 2666497 - protein, 9 aa, Entamoeba histolytica
YGGISSRQS

SEQ ID NO: 2666498 - protein, 5 aa, Entamoeba histolytica
YGGKL

SEQ ID NO: 2666499 - protein, 4 aa, Entamoeba histolytica
YGGM

SEQ ID NO: 2666500 - protein, 6 aa, Entamoeba histolytica
YGGPRE

SEQ ID NO: 2666501 - protein, 8 aa, Entamoeba histolytica
YGGRKTEE

SEQ ID NO: 2666502 - protein, 13 aa, Entamoeba histolytica
YGGRNMTSENKKY

SEQ ID NO: 2666503 - protein, 5 aa, Entamoeba histolytica
YGGTT

SEQ ID NO: 2666504 - protein, 10 aa, Entamoeba histolytica
YGKDATNEKI

SEQ ID NO: 2666505 - protein, 7 aa, Entamoeba histolytica
YGKDSTC

SEQ ID NO: 2666506 - protein, 9 aa, Entamoeba histolytica
YGKEDEPFT

SEQ ID NO: 2666507 - protein, 13 aa, Entamoeba histolytica
YGKEGLEKGGMSQ

SEQ ID NO: 2666508 - protein, 6 aa, Entamoeba histolytica
YGKEVP

SEQ ID NO: 2666509 - protein, 9 aa, Entamoeba histolytica
YGKGEGSSL

SEQ ID NO: 2666510 - protein, 6 aa, Entamoeba histolytica
YGKHEA

SEQ ID NO: 2666511 - protein, 9 aa, Entamoeba histolytica
YGKKDKALG

SEQ ID NO: 2666512 - protein, 14 aa, Entamoeba histolytica
YGKKGLEEGGMNGY

SEQ ID NO: 2666513 - protein, 9 aa, Entamoeba histolytica
YGKKQGTRY

SEQ ID NO: 2666514 - protein, 4 aa, Entamoeba histolytica
YGKN

SEQ ID NO: 2666515 - protein, 7 aa, Entamoeba histolytica
YGKNEQN

SEQ ID NO: 2666516 - protein, 7 aa, Entamoeba histolytica
YGKNGKY

SEQ ID NO: 2666517 - protein, 14 aa, Entamoeba histolytica
YGKPSYKKKEKERN

SEQ ID NO: 2666518 - protein, 4 aa, Entamoeba histolytica
YGKR

SEQ ID NO: 2666519 - protein, 5 aa, Entamoeba histolytica
YGKRT

SEQ ID NO: 2666520 - protein, 4 aa, Entamoeba histolytica
YGKS

SEQ ID NO: 2666521 - protein, 9 aa, Entamoeba histolytica
YGKSSKESV

SEQ ID NO: 2666522 - protein, 5 aa, Entamoeba histolytica
YGKTA

SEQ ID NO: 2666523 - protein, 6 aa, Entamoeba histolytica
YGKTID

SEQ ID NO: 2666524 - protein, 5 aa, Entamoeba histolytica
YGKTP

SEQ ID NO: 2666525 - protein, 6 aa, Entamoeba histolytica
YGLEPP

SEQ ID NO: 2666526 - protein, 7 aa, Entamoeba histolytica
YGLNDDL

SEQ ID NO: 2666527 - protein, 9 aa, Entamoeba histolytica
YGLNSEEAL

SEQ ID NO: 2666528 - protein, 10 aa, Entamoeba histolytica
YGLSDDYLTK

SEQ ID NO: 2666529 - protein, 9 aa, Entamoeba histolytica
YGMGTSDEL

SEQ ID NO: 2666530 - protein, 5 aa, Entamoeba histolytica
YGNAS

SEQ ID NO: 2666531 - protein, 8 aa, Entamoeba histolytica
YGNEEGNY

SEQ ID NO: 2666532 - protein, 7 aa, Entamoeba histolytica
YGNEQEK

SEQ ID NO: 2666533 - protein, 14 aa, Entamoeba histolytica
YGNKFKTQTIPPPI

SEQ ID NO: 2666534 - protein, 4 aa, Entamoeba histolytica
YGNN

SEQ ID NO: 2666535 - protein, 6 aa, Entamoeba histolytica
YGNPTY

SEQ ID NO: 2666536 - protein, 11 aa, Entamoeba histolytica
YGNRGRFDGRR

SEQ ID NO: 2666537 - protein, 4 aa, Entamoeba histolytica
YGNW

SEQ ID NO: 2666538 - protein, 5 aa, Entamoeba histolytica
YGPDP

SEQ ID NO: 2666539 - protein, 4 aa, Entamoeba histolytica
YGPF

SEQ ID NO: 2666540 - protein, 4 aa, Entamoeba histolytica
YGPK

SEQ ID NO: 2666541 - protein, 4 aa, Entamoeba histolytica
YGPL

SEQ ID NO: 2666542 - protein, 12 aa, Entamoeba histolytica
YGPNDSDENGKT

SEQ ID NO: 2666543 - protein, 5 aa, Entamoeba histolytica
YGPNG

SEQ ID NO: 2666544 - protein, 5 aa, Entamoeba histolytica
YGPPK

SEQ ID NO: 2666545 - protein, 8 aa, Entamoeba histolytica
YGPRRERA

SEQ ID NO: 2666546 - protein, 7 aa, Entamoeba histolytica
YGPSTYS

SEQ ID NO: 2666547 - protein, 6 aa, Entamoeba histolytica
YGPTTP

SEQ ID NO: 2666548 - protein, 19 aa, Entamoeba histolytica
YGQAQSVIDDKSNQSEYAQ

SEQ ID NO: 2666549 - protein, 7 aa, Entamoeba histolytica
YGQPPSR

SEQ ID NO: 2666550 - protein, 7 aa, Entamoeba histolytica
YGQTLSQ

SEQ ID NO: 2666551 - protein, 8 aa, Entamoeba histolytica
YGQTTNPG

SEQ ID NO: 2666552 - protein, 16 aa, Entamoeba histolytica
YGQYLTEDENREKQKC

SEQ ID NO: 2666553 - protein, 5 aa, Entamoeba histolytica
YGRDY

SEQ ID NO: 2666554 - protein, 6 aa, Entamoeba histolytica
YGRESQ

SEQ ID NO: 2666555 - protein, 4 aa, Entamoeba histolytica
YGRG

SEQ ID NO: 2666556 - protein, 12 aa, Entamoeba histolytica
YGRGTSDMKGGN

SEQ ID NO: 2666557 - protein, 7 aa, Entamoeba histolytica
YGRKYEE

SEQ ID NO: 2666558 - protein, 10 aa, Entamoeba histolytica
YGRQDPKQQL

SEQ ID NO: 2666559 - protein, 9 aa, Entamoeba histolytica
YGRSDENTC

SEQ ID NO: 2666560 - protein, 13 aa, Entamoeba histolytica
YGRSVRTSKYPSL

SEQ ID NO: 2666561 - protein, 11 aa, Entamoeba histolytica
YGRTDKKEEKG

SEQ ID NO: 2666562 - protein, 16 aa, Entamoeba histolytica
YGSEAGEITEYCDKLL

SEQ ID NO: 2666563 - protein, 8 aa, Entamoeba histolytica
YGSEIRSG

SEQ ID NO: 2666564 - protein, 4 aa, Entamoeba histolytica
YGSG

SEQ ID NO: 2666565 - protein, 10 aa, Entamoeba histolytica
YGSKNNKSGV

SEQ ID NO: 2666566 - protein, 6 aa, Entamoeba histolytica
YGSKTP

SEQ ID NO: 2666567 - protein, 14 aa, Entamoeba histolytica
YGSPQVEYKKRREY

SEQ ID NO: 2666568 - protein, 4 aa, Entamoeba histolytica
YGST

SEQ ID NO: 2666569 - protein, 7 aa, Entamoeba histolytica
YGSTETF

SEQ ID NO: 2666570 - protein, 10 aa, Entamoeba histolytica
YGSTKKWPDY

SEQ ID NO: 2666571 - protein, 4 aa, Entamoeba histolytica
YGSY

SEQ ID NO: 2666572 - protein, 5 aa, Entamoeba histolytica
YGTAN

SEQ ID NO: 2666573 - protein, 6 aa, Entamoeba histolytica
YGTANS

SEQ ID NO: 2666574 - protein, 5 aa, Entamoeba histolytica
YGTEQ

SEQ ID NO: 2666575 - protein, 6 aa, Entamoeba histolytica
YGTGKG

SEQ ID NO: 2666576 - protein, 6 aa, Entamoeba histolytica
YGTGVK

SEQ ID NO: 2666577 - protein, 4 aa, Entamoeba histolytica
YGTK

SEQ ID NO: 2666578 - protein, 8 aa, Entamoeba histolytica
YGTPPKGV

SEQ ID NO: 2666579 - protein, 11 aa, Entamoeba histolytica
YGTQGKRENYR

SEQ ID NO: 2666580 - protein, 8 aa, Entamoeba histolytica
YGTSSQTD

SEQ ID NO: 2666581 - protein, 10 aa, Entamoeba histolytica
YGYEGETVQP

SEQ ID NO: 2666582 - protein, 12 aa, Entamoeba histolytica
YGYGRDNNDYWG

SEQ ID NO: 2666583 - protein, 18 aa, Entamoeba histolytica
YGYKTESKILEELEFVRN

SEQ ID NO: 2666584 - protein, 4 aa, Entamoeba histolytica
YGYT

SEQ ID NO: 2666585 - protein, 6 aa, Entamoeba histolytica
YHAKEG

SEQ ID NO: 2666586 - protein, 4 aa, Entamoeba histolytica
YHDD

SEQ ID NO: 2666587 - protein, 7 aa, Entamoeba histolytica
YHNNKSK

SEQ ID NO: 2666588 - protein, 9 aa, Entamoeba histolytica
YHNTEAPQQ

SEQ ID NO: 2666589 - protein, 6 aa, Entamoeba histolytica
YHPDPL

SEQ ID NO: 2666590 - protein, 5 aa, Entamoeba histolytica
YHPKE

SEQ ID NO: 2666591 - protein, 5 aa, Entamoeba histolytica
YHPSN

SEQ ID NO: 2666592 - protein, 5 aa, Entamoeba histolytica
YHPSV

SEQ ID NO: 2666593 - protein, 15 aa, Entamoeba histolytica
YHPSYTTTNLTQPPL

SEQ ID NO: 2666594 - protein, 5 aa, Entamoeba histolytica
YHPTE

SEQ ID NO: 2666595 - protein, 13 aa, Entamoeba histolytica
YHQNASEEDEKYL

SEQ ID NO: 2666596 - protein, 5 aa, Entamoeba histolytica
YHQQP

SEQ ID NO: 2666597 - protein, 6 aa, Entamoeba histolytica
YHRPTK

SEQ ID NO: 2666598 - protein, 6 aa, Entamoeba histolytica
YHSSSS

SEQ ID NO: 2666599 - protein, 4 aa, Entamoeba histolytica
YHVP

SEQ ID NO: 2666600 - protein, 6 aa, Entamoeba histolytica
YIEEKK

SEQ ID NO: 2666601 - protein, 5 aa, Entamoeba histolytica
YIENG

SEQ ID NO: 2666602 - protein, 4 aa, Entamoeba histolytica
YIEP

SEQ ID NO: 2666603 - protein, 4 aa, Entamoeba histolytica
YIGS

SEQ ID NO: 2666604 - protein, 7 aa, Entamoeba histolytica
YIGTRPC

SEQ ID NO: 2666605 - protein, 4 aa, Entamoeba histolytica
YIKN

SEQ ID NO: 2666606 - protein, 10 aa, Entamoeba histolytica
YINEGKNELK

SEQ ID NO: 2666607 - protein, 11 aa, Entamoeba histolytica
YINERNKRMKE

SEQ ID NO: 2666608 - protein, 17 aa, Entamoeba histolytica
YINPGSRIGVSADKSYM

SEQ ID NO: 2666609 - protein, 9 aa, Entamoeba histolytica
YIPAPTQNH

SEQ ID NO: 2666610 - protein, 10 aa, Entamoeba histolytica
YIPPNEGELT

SEQ ID NO: 2666611 - protein, 6 aa, Entamoeba histolytica
YIPPSQ

SEQ ID NO: 2666612 - protein, 6 aa, Entamoeba histolytica
YIPSPN

SEQ ID NO: 2666613 - protein, 15 aa, Entamoeba histolytica
YIPSRSADNCIEPQK

SEQ ID NO: 2666614 - protein, 9 aa, Entamoeba histolytica
YIPTPQQPS

SEQ ID NO: 2666615 - protein, 4 aa, Entamoeba histolytica
YIQK

SEQ ID NO: 2666616 - protein, 7 aa, Entamoeba histolytica
YIQQEGK

SEQ ID NO: 2666617 - protein, 12 aa, Entamoeba histolytica
YISGGKRGEYEY

SEQ ID NO: 2666618 - protein, 10 aa, Entamoeba histolytica
YISGPNNTKI

SEQ ID NO: 2666619 - protein, 10 aa, Entamoeba histolytica
YISNGSTPFE

SEQ ID NO: 2666620 - protein, 4 aa, Entamoeba histolytica
YISP

SEQ ID NO: 2666621 - protein, 6 aa, Entamoeba histolytica
YISSTT

SEQ ID NO: 2666622 - protein, 10 aa, Entamoeba histolytica
YITNNTKTQL

SEQ ID NO: 2666623 - protein, 10 aa, Entamoeba histolytica
YITSATKGAS

SEQ ID NO: 2666624 - protein, 13 aa, Entamoeba histolytica
YITSEEDHNTTLE

SEQ ID NO: 2666625 - protein, 8 aa, Entamoeba histolytica
YKAPNGGV

SEQ ID NO: 2666626 - protein, 4 aa, Entamoeba histolytica
YKAS

SEQ ID NO: 2666627 - protein, 4 aa, Entamoeba histolytica
YKAT

SEQ ID NO: 2666628 - protein, 4 aa, Entamoeba histolytica
YKDC

SEQ ID NO: 2666629 - protein, 14 aa, Entamoeba histolytica
YKDDEAEKEIQAKQ

SEQ ID NO: 2666630 - protein, 8 aa, Entamoeba histolytica
YKDDPDSL

SEQ ID NO: 2666631 - protein, 12 aa, Entamoeba histolytica
YKDEANESFNST

SEQ ID NO: 2666632 - protein, 10 aa, Entamoeba histolytica
YKDGDNLSPS

SEQ ID NO: 2666633 - protein, 12 aa, Entamoeba histolytica
YKDGEERKTLKQ

SEQ ID NO: 2666634 - protein, 13 aa, Entamoeba histolytica
YKDITKKGTTLFT

SEQ ID NO: 2666635 - protein, 4 aa, Entamoeba histolytica
YKDK

SEQ ID NO: 2666636 - protein, 9 aa, Entamoeba histolytica
YKDKNFKSP

SEQ ID NO: 2666637 - protein, 11 aa, Entamoeba histolytica
YKDKNKNELLS

SEQ ID NO: 2666638 - protein, 24 aa, Entamoeba histolytica
YKDPAESDNSSENMEQREKDYNAL

SEQ ID NO: 2666639 - protein, 23 aa, Entamoeba histolytica
YKDPEESEKDSEDMEKREENYDA

SEQ ID NO: 2666640 - protein, 23 aa, Entamoeba histolytica
YKDPEESENDSEDMEKQEENYNA

SEQ ID NO: 2666641 - protein, 50 aa, Entamoeba histolytica
YKDPNETENQSKDMSEEERDYDPREDLNEKYDQIKDVDSEDYQDTDKESL

SEQ ID NO: 2666642 - protein, 32 aa, Entamoeba histolytica
YKDPQESDNPSEDMQEQETNYDPQKDLEEKYT

SEQ ID NO: 2666643 - protein, 10 aa, Entamoeba histolytica
YKDRKQEKRI

SEQ ID NO: 2666644 - protein, 5 aa, Entamoeba histolytica
YKDSE

SEQ ID NO: 2666645 - protein, 7 aa, Entamoeba histolytica
YKDTTED

SEQ ID NO: 2666646 - protein, 12 aa, Entamoeba histolytica
YKEDKVKEPQTS

SEQ ID NO: 2666647 - protein, 7 aa, Entamoeba histolytica
YKEDNEK

SEQ ID NO: 2666648 - protein, 4 aa, Entamoeba histolytica
YKEE

SEQ ID NO: 2666649 - protein, 12 aa, Entamoeba histolytica
YKEEGKKEEEKR

SEQ ID NO: 2666650 - protein, 9 aa, Entamoeba histolytica
YKEENNDMN

SEQ ID NO: 2666651 - protein, 5 aa, Entamoeba histolytica
YKEEV

SEQ ID NO: 2666652 - protein, 8 aa, Entamoeba histolytica
YKEFQENT

SEQ ID NO: 2666653 - protein, 9 aa, Entamoeba histolytica
YKEKERKIA

SEQ ID NO: 2666654 - protein, 12 aa, Entamoeba histolytica
YKEKGTKGSNIT

SEQ ID NO: 2666655 - protein, 12 aa, Entamoeba histolytica
YKEKKVPEFSPE

SEQ ID NO: 2666656 - protein, 9 aa, Entamoeba histolytica
YKELEERQK

SEQ ID NO: 2666657 - protein, 9 aa, Entamoeba histolytica
YKELNKPSE

SEQ ID NO: 2666658 - protein, 7 aa, Entamoeba histolytica
YKENKKY

SEQ ID NO: 2666659 - protein, 16 aa, Entamoeba histolytica
YKENRSNKWKEKFRRT

SEQ ID NO: 2666660 - protein, 5 aa, Entamoeba histolytica
YKENS

SEQ ID NO: 2666661 - protein, 6 aa, Entamoeba histolytica
YKENTL

SEQ ID NO: 2666662 - protein, 18 aa, Entamoeba histolytica
YKEQQGDEIKKINEEDPQ

SEQ ID NO: 2666663 - protein, 11 aa, Entamoeba histolytica
YKESEEYNNEH

SEQ ID NO: 2666664 - protein, 9 aa, Entamoeba histolytica
YKESTQIEV

SEQ ID NO: 2666665 - protein, 11 aa, Entamoeba histolytica
YKESYQKEGKC

SEQ ID NO: 2666666 - protein, 42 aa, Entamoeba histolytica
YKETSKSKTKGSGTLKTRPKASVIDPDNLKENFERKQAIKEK

SEQ ID NO: 2666667 - protein, 4 aa, Entamoeba histolytica
YKFN

SEQ ID NO: 2666668 - protein, 7 aa, Entamoeba histolytica
YKGAVGR

SEQ ID NO: 2666669 - protein, 10 aa, Entamoeba histolytica
YKGDIKETEL

SEQ ID NO: 2666670 - protein, 7 aa, Entamoeba histolytica
YKGDSSD

SEQ ID NO: 2666671 - protein, 13 aa, Entamoeba histolytica
YKGEGQKTNEEGM

SEQ ID NO: 2666672 - protein, 7 aa, Entamoeba histolytica
YKGEYTK

SEQ ID NO: 2666673 - protein, 7 aa, Entamoeba histolytica
YKGFKDP

SEQ ID NO: 2666674 - protein, 10 aa, Entamoeba histolytica
YKGGEGVDHK

SEQ ID NO: 2666675 - protein, 8 aa, Entamoeba histolytica
YKGGSGAK

SEQ ID NO: 2666676 - protein, 9 aa, Entamoeba histolytica
YKGKAKSIK

SEQ ID NO: 2666677 - protein, 6 aa, Entamoeba histolytica
YKGNCS

SEQ ID NO: 2666678 - protein, 5 aa, Entamoeba histolytica
YKGND

SEQ ID NO: 2666679 - protein, 5 aa, Entamoeba histolytica
YKGTK

SEQ ID NO: 2666680 - protein, 17 aa, Entamoeba histolytica
YKGTSLKEGLKWLKKKL

SEQ ID NO: 2666681 - protein, 11 aa, Entamoeba histolytica
YKINDRNVKAS

SEQ ID NO: 2666682 - protein, 6 aa, Entamoeba histolytica
YKIPQE

SEQ ID NO: 2666683 - protein, 12 aa, Entamoeba histolytica
YKKAERAYNGAR

SEQ ID NO: 2666684 - protein, 15 aa, Entamoeba histolytica
YKKAHSTKKDLNEIE

SEQ ID NO: 2666685 - protein, 16 aa, Entamoeba histolytica
YKKDGQPRAKEGDYQF

SEQ ID NO: 2666686 - protein, 16 aa, Entamoeba histolytica
YKKDINKTNKMGHEGK

SEQ ID NO: 2666687 - protein, 12 aa, Entamoeba histolytica
YKKDQHGVNETE

SEQ ID NO: 2666688 - protein, 12 aa, Entamoeba histolytica
YKKEEWNKKKSL

SEQ ID NO: 2666689 - protein, 20 aa, Entamoeba histolytica
YKKGMKKYTDETKEKRTELE

SEQ ID NO: 2666690 - protein, 4 aa, Entamoeba histolytica
YKKH

SEQ ID NO: 2666691 - protein, 6 aa, Entamoeba histolytica
YKKIGG

SEQ ID NO: 2666692 - protein, 11 aa, Entamoeba histolytica
YKKNPTSGSIN

SEQ ID NO: 2666693 - protein, 5 aa, Entamoeba histolytica
YKKPT

SEQ ID NO: 2666694 - protein, 8 aa, Entamoeba histolytica
YKKRENEL

SEQ ID NO: 2666695 - protein, 8 aa, Entamoeba histolytica
YKKRGSQQ

SEQ ID NO: 2666696 - protein, 5 aa, Entamoeba histolytica
YKKRK

SEQ ID NO: 2666697 - protein, 10 aa, Entamoeba histolytica
YKKSKHPLAE

SEQ ID NO: 2666698 - protein, 9 aa, Entamoeba histolytica
YKKSTTVKV

SEQ ID NO: 2666699 - protein, 12 aa, Entamoeba histolytica
YKKTYNYKAGSR

SEQ ID NO: 2666700 - protein, 13 aa, Entamoeba histolytica
YKKTYRKKQEKRI

SEQ ID NO: 2666701 - protein, 4 aa, Entamoeba histolytica
YKLP

SEQ ID NO: 2666702 - protein, 8 aa, Entamoeba histolytica
YKLTSNNQ

SEQ ID NO: 2666703 - protein, 7 aa, Entamoeba histolytica
YKNEEKE

SEQ ID NO: 2666704 - protein, 5 aa, Entamoeba histolytica
YKNGD

SEQ ID NO: 2666705 - protein, 7 aa, Entamoeba histolytica
YKNGQSM

SEQ ID NO: 2666706 - protein, 13 aa, Entamoeba histolytica
YKNGTKIKTTPLN

SEQ ID NO: 2666707 - protein, 8 aa, Entamoeba histolytica
YKNNVNAW

SEQ ID NO: 2666708 - protein, 24 aa, Entamoeba histolytica
YKNQKDKKELRKVDQNNKENDEDI

SEQ ID NO: 2666709 - protein, 26 aa, Entamoeba histolytica
YKNSITKVDSITGHQNLSKNNKNEKL

SEQ ID NO: 2666710 - protein, 7 aa, Entamoeba histolytica
YKNTPND

SEQ ID NO: 2666711 - protein, 14 aa, Entamoeba histolytica
YKNYRSISTDKEGI

SEQ ID NO: 2666712 - protein, 6 aa, Entamoeba histolytica
YKPDDL

SEQ ID NO: 2666713 - protein, 6 aa, Entamoeba histolytica
YKPEEL

SEQ ID NO: 2666714 - protein, 4 aa, Entamoeba histolytica
YKPG

SEQ ID NO: 2666715 - protein, 7 aa, Entamoeba histolytica
YKPIGQP

SEQ ID NO: 2666716 - protein, 4 aa, Entamoeba histolytica
YKPM

SEQ ID NO: 2666717 - protein, 13 aa, Entamoeba histolytica
YKPQSFPELPDTS

SEQ ID NO: 2666718 - protein, 8 aa, Entamoeba histolytica
YKPRENGV

SEQ ID NO: 2666719 - protein, 6 aa, Entamoeba histolytica
YKPRID

SEQ ID NO: 2666720 - protein, 7 aa, Entamoeba histolytica
YKPSITD

SEQ ID NO: 2666721 - protein, 17 aa, Entamoeba histolytica
YKPTQKKEENDSKNILP

SEQ ID NO: 2666722 - protein, 8 aa, Entamoeba histolytica
YKPTTPTL

SEQ ID NO: 2666723 - protein, 8 aa, Entamoeba histolytica
YKQLESLK

SEQ ID NO: 2666724 - protein, 9 aa, Entamoeba histolytica
YKQNNDCEP

SEQ ID NO: 2666725 - protein, 7 aa, Entamoeba histolytica
YKQPEQI

SEQ ID NO: 2666726 - protein, 31 aa, Entamoeba histolytica
YKQPKQYNYNSPLTTPRRTPRKQSKPSSPIN

SEQ ID NO: 2666727 - protein, 38 aa, Entamoeba histolytica
YKQPNNNYSQPPQPNYNYSQPPQPNYNYPQPPQPNYSY

SEQ ID NO: 2666728 - protein, 5 aa, Entamoeba histolytica
YKQPQ

SEQ ID NO: 2666729 - protein, 7 aa, Entamoeba histolytica
YKQRNDS

SEQ ID NO: 2666730 - protein, 11 aa, Entamoeba histolytica
YKQSPYSKSSI

SEQ ID NO: 2666731 - protein, 4 aa, Entamoeba histolytica
YKQT

SEQ ID NO: 2666732 - protein, 8 aa, Entamoeba histolytica
YKRGKTTK

SEQ ID NO: 2666733 - protein, 16 aa, Entamoeba histolytica
YKRKGYSSDEESEEQI

SEQ ID NO: 2666734 - protein, 7 aa, Entamoeba histolytica
YKRKQVN

SEQ ID NO: 2666735 - protein, 5 aa, Entamoeba histolytica
YKRNL

SEQ ID NO: 2666736 - protein, 8 aa, Entamoeba histolytica
YKRNRNYQ

SEQ ID NO: 2666737 - protein, 8 aa, Entamoeba histolytica
YKRVGDKK

SEQ ID NO: 2666738 - protein, 10 aa, Entamoeba histolytica
YKSDDNDREH

SEQ ID NO: 2666739 - protein, 16 aa, Entamoeba histolytica
YKSDGSEVTQVDTQSQ

SEQ ID NO: 2666740 - protein, 8 aa, Entamoeba histolytica
YKSDKSLQ

SEQ ID NO: 2666741 - protein, 9 aa, Entamoeba histolytica
YKSEGGKKV

SEQ ID NO: 2666742 - protein, 14 aa, Entamoeba histolytica
YKSEKVKKQRKAGI

SEQ ID NO: 2666743 - protein, 6 aa, Entamoeba histolytica
YKSETL

SEQ ID NO: 2666744 - protein, 10 aa, Entamoeba histolytica
YKSFAQSTEL

SEQ ID NO: 2666745 - protein, 8 aa, Entamoeba histolytica
YKSFEQPE

SEQ ID NO: 2666746 - protein, 18 aa, Entamoeba histolytica
YKSGKQEVQAGSTPEQTL

SEQ ID NO: 2666747 - protein, 10 aa, Entamoeba histolytica
YKSKDHQKRE

SEQ ID NO: 2666748 - protein, 7 aa, Entamoeba histolytica
YKSKDSM

SEQ ID NO: 2666749 - protein, 5 aa, Entamoeba histolytica
YKSKG

SEQ ID NO: 2666750 - protein, 4 aa, Entamoeba histolytica
YKSN

SEQ ID NO: 2666751 - protein, 15 aa, Entamoeba histolytica
YKSPKEKYLPKRSRL

SEQ ID NO: 2666752 - protein, 8 aa, Entamoeba histolytica
YKSQSGGF

SEQ ID NO: 2666753 - protein, 20 aa, Entamoeba histolytica
YKSTKGSPHDSLKEPIGDDP

SEQ ID NO: 2666754 - protein, 10 aa, Entamoeba histolytica
YKSTSKRVVE

SEQ ID NO: 2666755 - protein, 10 aa, Entamoeba histolytica
YKSYSNPTNL

SEQ ID NO: 2666756 - protein, 9 aa, Entamoeba histolytica
YKTKDPKEI

SEQ ID NO: 2666757 - protein, 10 aa, Entamoeba histolytica
YKTKGNTINP

SEQ ID NO: 2666758 - protein, 11 aa, Entamoeba histolytica
YKTMQTEDRMR

SEQ ID NO: 2666759 - protein, 4 aa, Entamoeba histolytica
YKTN

SEQ ID NO: 2666760 - protein, 7 aa, Entamoeba histolytica
YKTQEEK

SEQ ID NO: 2666761 - protein, 8 aa, Entamoeba histolytica
YKTQMENE

SEQ ID NO: 2666762 - protein, 22 aa, Entamoeba histolytica
YKTRTNKTFESGKEFRKQHENC

SEQ ID NO: 2666763 - protein, 10 aa, Entamoeba histolytica
YKTSNEASIA

SEQ ID NO: 2666764 - protein, 12 aa, Entamoeba histolytica
YKTTNVNSRSSE

SEQ ID NO: 2666765 - protein, 6 aa, Entamoeba histolytica
YKVPEN

SEQ ID NO: 2666766 - protein, 8 aa, Entamoeba histolytica
YKYGQQPV

SEQ ID NO: 2666767 - protein, 6 aa, Entamoeba histolytica
YKYSNS

SEQ ID NO: 2666768 - protein, 6 aa, Entamoeba histolytica
YKYTDK

SEQ ID NO: 2666769 - protein, 6 aa, Entamoeba histolytica
YLDEDS

SEQ ID NO: 2666770 - protein, 15 aa, Entamoeba histolytica
YLEEQKKKAEGSGQG

SEQ ID NO: 2666771 - protein, 13 aa, Entamoeba histolytica
YLEGKKSESCDKE

SEQ ID NO: 2666772 - protein, 16 aa, Entamoeba histolytica
YLGNSSLKDLLSQCEC

SEQ ID NO: 2666773 - protein, 7 aa, Entamoeba histolytica
YLGQPNS

SEQ ID NO: 2666774 - protein, 7 aa, Entamoeba histolytica
YLGRNGK

SEQ ID NO: 2666775 - protein, 10 aa, Entamoeba histolytica
YLKGENKELN

SEQ ID NO: 2666776 - protein, 9 aa, Entamoeba histolytica
YLKTKEKQN

SEQ ID NO: 2666777 - protein, 4 aa, Entamoeba histolytica
YLNG

SEQ ID NO: 2666778 - protein, 12 aa, Entamoeba histolytica
YLNGRKEREPYR

SEQ ID NO: 2666779 - protein, 17 aa, Entamoeba histolytica
YLPEEDKVKQKKKNEVI

SEQ ID NO: 2666780 - protein, 12 aa, Entamoeba histolytica
YLPGPENPREDE

SEQ ID NO: 2666781 - protein, 5 aa, Entamoeba histolytica
YLPQG

SEQ ID NO: 2666782 - protein, 13 aa, Entamoeba histolytica
YLPRNETVLSSLL

SEQ ID NO: 2666783 - protein, 8 aa, Entamoeba histolytica
YLPTTAEK

SEQ ID NO: 2666784 - protein, 10 aa, Entamoeba histolytica
YLQRSGRTEA

SEQ ID NO: 2666785 - protein, 5 aa, Entamoeba histolytica
YLRDD

SEQ ID NO: 2666786 - protein, 11 aa, Entamoeba histolytica
YLSGNTKELST

SEQ ID NO: 2666787 - protein, 22 aa, Entamoeba histolytica
YLSKKEKKREKKMLKKSNKNMK

SEQ ID NO: 2666788 - protein, 9 aa, Entamoeba histolytica
YLSNSSSIN

SEQ ID NO: 2666789 - protein, 10 aa, Entamoeba histolytica
YLSSSDTSSV

SEQ ID NO: 2666790 - protein, 8 aa, Entamoeba histolytica
YLSSTSST

SEQ ID NO: 2666791 - protein, 4 aa, Entamoeba histolytica
YLST

SEQ ID NO: 2666792 - protein, 11 aa, Entamoeba histolytica
YLSTESDFTSP

SEQ ID NO: 2666793 - protein, 11 aa, Entamoeba histolytica
YLTNETGEFDK

SEQ ID NO: 2666794 - protein, 12 aa, Entamoeba histolytica
YMRNGDYTPSRM

SEQ ID NO: 2666795 - protein, 5 aa, Entamoeba histolytica
YMRSG

SEQ ID NO: 2666796 - protein, 6 aa, Entamoeba histolytica
YMSPDD

SEQ ID NO: 2666797 - protein, 9 aa, Entamoeba histolytica
YNADPKKRL

SEQ ID NO: 2666798 - protein, 12 aa, Entamoeba histolytica
YNAEDKSFEVEN

SEQ ID NO: 2666799 - protein, 13 aa, Entamoeba histolytica
YNAGKKGVADAES

SEQ ID NO: 2666800 - protein, 7 aa, Entamoeba histolytica
YNAPNSE

SEQ ID NO: 2666801 - protein, 4 aa, Entamoeba histolytica
YNCP

SEQ ID NO: 2666802 - protein, 11 aa, Entamoeba histolytica
YNDDYNNTKED

SEQ ID NO: 2666803 - protein, 15 aa, Entamoeba histolytica
YNDESWLSDCENFSN

SEQ ID NO: 2666804 - protein, 5 aa, Entamoeba histolytica
YNDKY

SEQ ID NO: 2666805 - protein, 8 aa, Entamoeba histolytica
YNDNGDGY

SEQ ID NO: 2666806 - protein, 5 aa, Entamoeba histolytica
YNDPE

SEQ ID NO: 2666807 - protein, 7 aa, Entamoeba histolytica
YNDSSAK

SEQ ID NO: 2666808 - protein, 8 aa, Entamoeba histolytica
YNDSTKRL

SEQ ID NO: 2666809 - protein, 40 aa, Entamoeba histolytica
YNDTIKKEQIPEIQQKDDTKKVEDLKKQEHEVKKKEYEEV

SEQ ID NO: 2666810 - protein, 7 aa, Entamoeba histolytica
YNDTLDD

SEQ ID NO: 2666811 - protein, 8 aa, Entamoeba histolytica
YNDTTQIG

SEQ ID NO: 2666812 - protein, 12 aa, Entamoeba histolytica
YNDYETKNSGIT

SEQ ID NO: 2666813 - protein, 5 aa, Entamoeba histolytica
YNEAK

SEQ ID NO: 2666814 - protein, 12 aa, Entamoeba histolytica
YNEGKKGMANAE

SEQ ID NO: 2666815 - protein, 12 aa, Entamoeba histolytica
YNEGKKGVANAE

SEQ ID NO: 2666816 - protein, 10 aa, Entamoeba histolytica
YNEHQNEEQL

SEQ ID NO: 2666817 - protein, 5 aa, Entamoeba histolytica
YNEIN

SEQ ID NO: 2666818 - protein, 5 aa, Entamoeba histolytica
YNEKE

SEQ ID NO: 2666819 - protein, 9 aa, Entamoeba histolytica
YNEKEINDI

SEQ ID NO: 2666820 - protein, 6 aa, Entamoeba histolytica
YNEQTH

SEQ ID NO: 2666821 - protein, 12 aa, Entamoeba histolytica
YNESKSRGTDPH

SEQ ID NO: 2666822 - protein, 5 aa, Entamoeba histolytica
YNESN

SEQ ID NO: 2666823 - protein, 7 aa, Entamoeba histolytica
YNESQKK

SEQ ID NO: 2666824 - protein, 4 aa, Entamoeba histolytica
YNET

SEQ ID NO: 2666825 - protein, 8 aa, Entamoeba histolytica
YNETHPSP

SEQ ID NO: 2666826 - protein, 22 aa, Entamoeba histolytica
YNETQESVTPRSGKHQRMRSTR

SEQ ID NO: 2666827 - protein, 8 aa, Entamoeba histolytica
YNGDKHPL

SEQ ID NO: 2666828 - protein, 7 aa, Entamoeba histolytica
YNGDNRR

SEQ ID NO: 2666829 - protein, 10 aa, Entamoeba histolytica
YNGDYSSTEN

SEQ ID NO: 2666830 - protein, 6 aa, Entamoeba histolytica
YNGENR

SEQ ID NO: 2666831 - protein, 7 aa, Entamoeba histolytica
YNGGIDD

SEQ ID NO: 2666832 - protein, 15 aa, Entamoeba histolytica
YNGGLDTTTTTVDGR

SEQ ID NO: 2666833 - protein, 11 aa, Entamoeba histolytica
YNGKKPSDEEV

SEQ ID NO: 2666834 - protein, 22 aa, Entamoeba histolytica
YNGNASQKQSQPISPSSNVQQQ

SEQ ID NO: 2666835 - protein, 8 aa, Entamoeba histolytica
YNGNENTI

SEQ ID NO: 2666836 - protein, 6 aa, Entamoeba histolytica
YNGNVG

SEQ ID NO: 2666837 - protein, 5 aa, Entamoeba histolytica
YNGPS

SEQ ID NO: 2666838 - protein, 16 aa, Entamoeba histolytica
YNHNDAKDLQEKLNEY

SEQ ID NO: 2666839 - protein, 10 aa, Entamoeba histolytica
YNHTKGKGNI

SEQ ID NO: 2666840 - protein, 8 aa, Entamoeba histolytica
YNINGDSP

SEQ ID NO: 2666841 - protein, 11 aa, Entamoeba histolytica
YNKAKKPNAAI

SEQ ID NO: 2666842 - protein, 4 aa, Entamoeba histolytica
YNKE

SEQ ID NO: 2666843 - protein, 6 aa, Entamoeba histolytica
YNKEEC

SEQ ID NO: 2666844 - protein, 4 aa, Entamoeba histolytica
YNKK

SEQ ID NO: 2666845 - protein, 11 aa, Entamoeba histolytica
YNKKDKQLEGM

SEQ ID NO: 2666846 - protein, 20 aa, Entamoeba histolytica
YNKPEEVKSDEKQSKEDLKE

SEQ ID NO: 2666847 - protein, 6 aa, Entamoeba histolytica
YNKPHQ

SEQ ID NO: 2666848 - protein, 12 aa, Entamoeba histolytica
YNKPKEGKQGKI

SEQ ID NO: 2666849 - protein, 7 aa, Entamoeba histolytica
YNKPSII

SEQ ID NO: 2666850 - protein, 9 aa, Entamoeba histolytica
YNKRKEQYK

SEQ ID NO: 2666851 - protein, 6 aa, Entamoeba histolytica
YNKRVD

SEQ ID NO: 2666852 - protein, 7 aa, Entamoeba histolytica
YNKSIEP

SEQ ID NO: 2666853 - protein, 8 aa, Entamoeba histolytica
YNKSTSKL

SEQ ID NO: 2666854 - protein, 8 aa, Entamoeba histolytica
YNKTTRTI

SEQ ID NO: 2666855 - protein, 4 aa, Entamoeba histolytica
YNLA

SEQ ID NO: 2666856 - protein, 5 aa, Entamoeba histolytica
YNLEN

SEQ ID NO: 2666857 - protein, 9 aa, Entamoeba histolytica
YNLTQGKKM

SEQ ID NO: 2666858 - protein, 4 aa, Entamoeba histolytica
YNNE

SEQ ID NO: 2666859 - protein, 15 aa, Entamoeba histolytica
YNNESQYLNTEKPTR

SEQ ID NO: 2666860 - protein, 10 aa, Entamoeba histolytica
YNNETKPNLY

SEQ ID NO: 2666861 - protein, 17 aa, Entamoeba histolytica
YNNEVSTKEPMNVSEGS

SEQ ID NO: 2666862 - protein, 8 aa, Entamoeba histolytica
YNNFDSVE

SEQ ID NO: 2666863 - protein, 12 aa, Entamoeba histolytica
YNNKYENNIPSL

SEQ ID NO: 2666864 - protein, 5 aa, Entamoeba histolytica
YNNPD

SEQ ID NO: 2666865 - protein, 7 aa, Entamoeba histolytica
YNNPEIG

SEQ ID NO: 2666866 - protein, 8 aa, Entamoeba histolytica
YNNPIQPD

SEQ ID NO: 2666867 - protein, 10 aa, Entamoeba histolytica
YNNQVPQTKQ

SEQ ID NO: 2666868 - protein, 9 aa, Entamoeba histolytica
YNNSITPDQ

SEQ ID NO: 2666869 - protein, 10 aa, Entamoeba histolytica
YNNSNTSQEI

SEQ ID NO: 2666870 - protein, 9 aa, Entamoeba histolytica
YNNSPCTDC

SEQ ID NO: 2666871 - protein, 8 aa, Entamoeba histolytica
YNNVPSCS

SEQ ID NO: 2666872 - protein, 7 aa, Entamoeba histolytica
YNNYENP

SEQ ID NO: 2666873 - protein, 21 aa, Entamoeba histolytica
YNPEDNIIGSQKTETKINQTI

SEQ ID NO: 2666874 - protein, 7 aa, Entamoeba histolytica
YNPKEDG

SEQ ID NO: 2666875 - protein, 6 aa, Entamoeba histolytica
YNPKEF

SEQ ID NO: 2666876 - protein, 13 aa, Entamoeba histolytica
YNPKNKKSEEENN

SEQ ID NO: 2666877 - protein, 8 aa, Entamoeba histolytica
YNPKSQRV

SEQ ID NO: 2666878 - protein, 4 aa, Entamoeba histolytica
YNPL

SEQ ID NO: 2666879 - protein, 5 aa, Entamoeba histolytica
YNPNS

SEQ ID NO: 2666880 - protein, 7 aa, Entamoeba histolytica
YNPPQST

SEQ ID NO: 2666881 - protein, 8 aa, Entamoeba histolytica
YNPQNEHE

SEQ ID NO: 2666882 - protein, 8 aa, Entamoeba histolytica
YNPQNEYE

SEQ ID NO: 2666883 - protein, 7 aa, Entamoeba histolytica
YNPQQED

SEQ ID NO: 2666884 - protein, 5 aa, Entamoeba histolytica
YNPQT

SEQ ID NO: 2666885 - protein, 7 aa, Entamoeba histolytica
YNPSPTE

SEQ ID NO: 2666886 - protein, 7 aa, Entamoeba histolytica
YNPSTQQ

SEQ ID NO: 2666887 - protein, 8 aa, Entamoeba histolytica
YNPTIEDS

SEQ ID NO: 2666888 - protein, 19 aa, Entamoeba histolytica
YNPTKRITARDALHHPYFS

SEQ ID NO: 2666889 - protein, 10 aa, Entamoeba histolytica
YNQKAPDVAR

SEQ ID NO: 2666890 - protein, 5 aa, Entamoeba histolytica
YNQNP

SEQ ID NO: 2666891 - protein, 10 aa, Entamoeba histolytica
YNQPNTQPLS

SEQ ID NO: 2666892 - protein, 4 aa, Entamoeba histolytica
YNQT

SEQ ID NO: 2666893 - protein, 8 aa, Entamoeba histolytica
YNQTEKAH

SEQ ID NO: 2666894 - protein, 12 aa, Entamoeba histolytica
YNREKSDFPNNF

SEQ ID NO: 2666895 - protein, 5 aa, Entamoeba histolytica
YNRPL

SEQ ID NO: 2666896 - protein, 14 aa, Entamoeba histolytica
YNRPTQPLRPMPSS

SEQ ID NO: 2666897 - protein, 6 aa, Entamoeba histolytica
YNRSEG

SEQ ID NO: 2666898 - protein, 8 aa, Entamoeba histolytica
YNRTKGDC

SEQ ID NO: 2666899 - protein, 6 aa, Entamoeba histolytica
YNSANR

SEQ ID NO: 2666900 - protein, 6 aa, Entamoeba histolytica
YNSASK

SEQ ID NO: 2666901 - protein, 15 aa, Entamoeba histolytica
YNSDEDARSRNRKAK

SEQ ID NO: 2666902 - protein, 5 aa, Entamoeba histolytica
YNSES

SEQ ID NO: 2666903 - protein, 8 aa, Entamoeba histolytica
YNSESGKM

SEQ ID NO: 2666904 - protein, 14 aa, Entamoeba histolytica
YNSKTLKGVTSSLN

SEQ ID NO: 2666905 - protein, 7 aa, Entamoeba histolytica
YNSNGIH

SEQ ID NO: 2666906 - protein, 15 aa, Entamoeba histolytica
YNSNKTQWKNNDEIS

SEQ ID NO: 2666907 - protein, 10 aa, Entamoeba histolytica
YNSNQNDSQY

SEQ ID NO: 2666908 - protein, 15 aa, Entamoeba histolytica
YNSNYTDNIYDPSHS

SEQ ID NO: 2666909 - protein, 24 aa, Entamoeba histolytica
YNSQLKEEIQTKEEKIKQLEETLN

SEQ ID NO: 2666910 - protein, 10 aa, Entamoeba histolytica
YNSSENSIHQ

SEQ ID NO: 2666911 - protein, 25 aa, Entamoeba histolytica
YNSSQGRIEYSKDNEVRYTPPPKNN

SEQ ID NO: 2666912 - protein, 15 aa, Entamoeba histolytica
YNSSRAQKKQTINVS

SEQ ID NO: 2666913 - protein, 26 aa, Entamoeba histolytica
YNSTQSPRQGIPLTNPQHYPYNTSEY

SEQ ID NO: 2666914 - protein, 10 aa, Entamoeba histolytica
YNTDEDVRDP

SEQ ID NO: 2666915 - protein, 4 aa, Entamoeba histolytica
YNTE

SEQ ID NO: 2666916 - protein, 9 aa, Entamoeba histolytica
YNTNDENNQ

SEQ ID NO: 2666917 - protein, 4 aa, Entamoeba histolytica
YNTP

SEQ ID NO: 2666918 - protein, 8 aa, Entamoeba histolytica
YNTPTLNG

SEQ ID NO: 2666919 - protein, 11 aa, Entamoeba histolytica
YNTQSNSSIEV

SEQ ID NO: 2666920 - protein, 8 aa, Entamoeba histolytica
YNTQSSNM

SEQ ID NO: 2666921 - protein, 6 aa, Entamoeba histolytica
YNTRAL

SEQ ID NO: 2666922 - protein, 11 aa, Entamoeba histolytica
YNTRTNRKHTK

SEQ ID NO: 2666923 - protein, 4 aa, Entamoeba histolytica
YNTS

SEQ ID NO: 2666924 - protein, 8 aa, Entamoeba histolytica
YNTSSTNH

SEQ ID NO: 2666925 - protein, 7 aa, Entamoeba histolytica
YNTSTPL

SEQ ID NO: 2666926 - protein, 4 aa, Entamoeba histolytica
YNVE

SEQ ID NO: 2666927 - protein, 4 aa, Entamoeba histolytica
YNVP

SEQ ID NO: 2666928 - protein, 9 aa, Entamoeba histolytica
YNYGSDSSL

SEQ ID NO: 2666929 - protein, 20 aa, Entamoeba histolytica
YNYKTEKQFTDEDDKNETPR

SEQ ID NO: 2666930 - protein, 9 aa, Entamoeba histolytica
YNYNSESQE

SEQ ID NO: 2666931 - protein, 6 aa, Entamoeba histolytica
YNYPDN

SEQ ID NO: 2666932 - protein, 6 aa, Entamoeba histolytica
YPAEDE

SEQ ID NO: 2666933 - protein, 11 aa, Entamoeba histolytica
YPAEKVNNDGK

SEQ ID NO: 2666934 - protein, 4 aa, Entamoeba histolytica
YPAL

SEQ ID NO: 2666935 - protein, 11 aa, Entamoeba histolytica
YPALSAKSLSK

SEQ ID NO: 2666936 - protein, 4 aa, Entamoeba histolytica
YPAP

SEQ ID NO: 2666937 - protein, 6 aa, Entamoeba histolytica
YPAPTL

SEQ ID NO: 2666938 - protein, 8 aa, Entamoeba histolytica
YPDALRPS

SEQ ID NO: 2666939 - protein, 4 aa, Entamoeba histolytica
YPDE

SEQ ID NO: 2666940 - protein, 7 aa, Entamoeba histolytica
YPDGSAQ

SEQ ID NO: 2666941 - protein, 15 aa, Entamoeba histolytica
YPDGTKISSKRTKIV

SEQ ID NO: 2666942 - protein, 14 aa, Entamoeba histolytica
YPDNHIQTSRVTRN

SEQ ID NO: 2666943 - protein, 8 aa, Entamoeba histolytica
YPDNTPLE

SEQ ID NO: 2666944 - protein, 10 aa, Entamoeba histolytica
YPDPDIRTNA

SEQ ID NO: 2666945 - protein, 14 aa, Entamoeba histolytica
YPDQSPRKERHSDN

SEQ ID NO: 2666946 - protein, 11 aa, Entamoeba histolytica
YPDTGFDDNEN

SEQ ID NO: 2666947 - protein, 9 aa, Entamoeba histolytica
YPDTTEKPF

SEQ ID NO: 2666948 - protein, 13 aa, Entamoeba histolytica
YPDWTPDQRDIPL

SEQ ID NO: 2666949 - protein, 4 aa, Entamoeba histolytica
YPDY

SEQ ID NO: 2666950 - protein, 5 aa, Entamoeba histolytica
YPDYA

SEQ ID NO: 2666951 - protein, 4 aa, Entamoeba histolytica
YPED

SEQ ID NO: 2666952 - protein, 5 aa, Entamoeba histolytica
YPEDL

SEQ ID NO: 2666953 - protein, 7 aa, Entamoeba histolytica
YPEEGDQ

SEQ ID NO: 2666954 - protein, 15 aa, Entamoeba histolytica
YPEIKTTEESEKIKE

SEQ ID NO: 2666955 - protein, 4 aa, Entamoeba histolytica
YPEK

SEQ ID NO: 2666956 - protein, 5 aa, Entamoeba histolytica
YPEKI

SEQ ID NO: 2666957 - protein, 10 aa, Entamoeba histolytica
YPEQQTSSIV

SEQ ID NO: 2666958 - protein, 5 aa, Entamoeba histolytica
YPERV

SEQ ID NO: 2666959 - protein, 6 aa, Entamoeba histolytica
YPESLE

SEQ ID NO: 2666960 - protein, 7 aa, Entamoeba histolytica
YPETNEN

SEQ ID NO: 2666961 - protein, 10 aa, Entamoeba histolytica
YPETRKNEAV

SEQ ID NO: 2666962 - protein, 5 aa, Entamoeba histolytica
YPFGS

SEQ ID NO: 2666963 - protein, 6 aa, Entamoeba histolytica
YPFSSS

SEQ ID NO: 2666964 - protein, 7 aa, Entamoeba histolytica
YPGEYGH

SEQ ID NO: 2666965 - protein, 5 aa, Entamoeba histolytica
YPGNP

SEQ ID NO: 2666966 - protein, 14 aa, Entamoeba histolytica
YPGSNIGPEPTTDG

SEQ ID NO: 2666967 - protein, 10 aa, Entamoeba histolytica
YPGSTNKKTL

SEQ ID NO: 2666968 - protein, 10 aa, Entamoeba histolytica
YPIPNNEDTL

SEQ ID NO: 2666969 - protein, 8 aa, Entamoeba histolytica
YPKDDNEL

SEQ ID NO: 2666970 - protein, 10 aa, Entamoeba histolytica
YPKDLSTNKP

SEQ ID NO: 2666971 - protein, 12 aa, Entamoeba histolytica
YPKDPLPPPERY

SEQ ID NO: 2666972 - protein, 10 aa, Entamoeba histolytica
YPKDQLTASN

SEQ ID NO: 2666973 - protein, 6 aa, Entamoeba histolytica
YPKESK

SEQ ID NO: 2666974 - protein, 5 aa, Entamoeba histolytica
YPKEV

SEQ ID NO: 2666975 - protein, 10 aa, Entamoeba histolytica
YPKGGSRHQL

SEQ ID NO: 2666976 - protein, 8 aa, Entamoeba histolytica
YPKGTKPV

SEQ ID NO: 2666977 - protein, 5 aa, Entamoeba histolytica
YPKKR

SEQ ID NO: 2666978 - protein, 12 aa, Entamoeba histolytica
YPKKSYTPMTTS

SEQ ID NO: 2666979 - protein, 13 aa, Entamoeba histolytica
YPKNALKGHPESI

SEQ ID NO: 2666980 - protein, 6 aa, Entamoeba histolytica
YPKNEE

SEQ ID NO: 2666981 - protein, 8 aa, Entamoeba histolytica
YPKNPKIK

SEQ ID NO: 2666982 - protein, 5 aa, Entamoeba histolytica
YPKNT

SEQ ID NO: 2666983 - protein, 9 aa, Entamoeba histolytica
YPKPPSNTI

SEQ ID NO: 2666984 - protein, 5 aa, Entamoeba histolytica
YPKPR

SEQ ID NO: 2666985 - protein, 10 aa, Entamoeba histolytica
YPKRSDKKEY

SEQ ID NO: 2666986 - protein, 5 aa, Entamoeba histolytica
YPKSF

SEQ ID NO: 2666987 - protein, 5 aa, Entamoeba histolytica
YPKSI

SEQ ID NO: 2666988 - protein, 8 aa, Entamoeba histolytica
YPLDSSFK

SEQ ID NO: 2666989 - protein, 11 aa, Entamoeba histolytica
YPLEKDIQKNN

SEQ ID NO: 2666990 - protein, 14 aa, Entamoeba histolytica
YPLPPDSRTYSSTT

SEQ ID NO: 2666991 - protein, 6 aa, Entamoeba histolytica
YPLQNS

SEQ ID NO: 2666992 - protein, 8 aa, Entamoeba histolytica
YPLSANNQ

SEQ ID NO: 2666993 - protein, 7 aa, Entamoeba histolytica
YPMNPPK

SEQ ID NO: 2666994 - protein, 9 aa, Entamoeba histolytica
YPNDTTLRD

SEQ ID NO: 2666995 - protein, 4 aa, Entamoeba histolytica
YPNE

SEQ ID NO: 2666996 - protein, 16 aa, Entamoeba histolytica
YPNESVGFKRTKPKLR

SEQ ID NO: 2666997 - protein, 20 aa, Entamoeba histolytica
YPNKTEEQLTEEANNSLQKL

SEQ ID NO: 2666998 - protein, 8 aa, Entamoeba histolytica
YPNNNAQT

SEQ ID NO: 2666999 - protein, 19 aa, Entamoeba histolytica
YPNNNSNNSKELDKFNETV

SEQ ID NO: 2667000 - protein, 4 aa, Entamoeba histolytica
YPNQ

SEQ ID NO: 2667001 - protein, 7 aa, Entamoeba histolytica
YPNQPYQ

SEQ ID NO: 2667002 - protein, 11 aa, Entamoeba histolytica
YPNSGKSSVIN

SEQ ID NO: 2667003 - protein, 8 aa, Entamoeba histolytica
YPNTKNNF

SEQ ID NO: 2667004 - protein, 5 aa, Entamoeba histolytica
YPNTR

SEQ ID NO: 2667005 - protein, 5 aa, Entamoeba histolytica
YPNVY

SEQ ID NO: 2667006 - protein, 4 aa, Entamoeba histolytica
YPPA

SEQ ID NO: 2667007 - protein, 6 aa, Entamoeba histolytica
YPPEDI

SEQ ID NO: 2667008 - protein, 6 aa, Entamoeba histolytica
YPPHTT

SEQ ID NO: 2667009 - protein, 12 aa, Entamoeba histolytica
YPPLKATEEIEL

SEQ ID NO: 2667010 - protein, 5 aa, Entamoeba histolytica
YPPNI

SEQ ID NO: 2667011 - protein, 13 aa, Entamoeba histolytica
YPPPKAPQEPYSN

SEQ ID NO: 2667012 - protein, 16 aa, Entamoeba histolytica
YPPPLSISPQSKHSVD

SEQ ID NO: 2667013 - protein, 5 aa, Entamoeba histolytica
YPPQN

SEQ ID NO: 2667014 - protein, 6 aa, Entamoeba histolytica
YPPQQI

SEQ ID NO: 2667015 - protein, 5 aa, Entamoeba histolytica
YPPQY

SEQ ID NO: 2667016 - protein, 6 aa, Entamoeba histolytica
YPPSNK

SEQ ID NO: 2667017 - protein, 30 aa, Entamoeba histolytica
YPPSPYGIPPSNVPSNVPPNGYPSIPRYSQ

SEQ ID NO: 2667018 - protein, 7 aa, Entamoeba histolytica
YPPSSQR

SEQ ID NO: 2667019 - protein, 6 aa, Entamoeba histolytica
YPPTKI

SEQ ID NO: 2667020 - protein, 8 aa, Entamoeba histolytica
YPQPGETI

SEQ ID NO: 2667021 - protein, 5 aa, Entamoeba histolytica
YPQST

SEQ ID NO: 2667022 - protein, 5 aa, Entamoeba histolytica
YPQTY

SEQ ID NO: 2667023 - protein, 5 aa, Entamoeba histolytica
YPRDP

SEQ ID NO: 2667024 - protein, 4 aa, Entamoeba histolytica
YPRL

SEQ ID NO: 2667025 - protein, 7 aa, Entamoeba histolytica
YPRPQLR

SEQ ID NO: 2667026 - protein, 11 aa, Entamoeba histolytica
YPRTESTKYSS

SEQ ID NO: 2667027 - protein, 8 aa, Entamoeba histolytica
YPRTETNI

SEQ ID NO: 2667028 - protein, 4 aa, Entamoeba histolytica
YPSG

SEQ ID NO: 2667029 - protein, 9 aa, Entamoeba histolytica
YPSGDTESE

SEQ ID NO: 2667030 - protein, 6 aa, Entamoeba histolytica
YPSHSS

SEQ ID NO: 2667031 - protein, 4 aa, Entamoeba histolytica
YPSI

SEQ ID NO: 2667032 - protein, 6 aa, Entamoeba histolytica
YPSIRS

SEQ ID NO: 2667033 - protein, 8 aa, Entamoeba histolytica
YPSISNKT

SEQ ID NO: 2667034 - protein, 7 aa, Entamoeba histolytica
YPSNNTK

SEQ ID NO: 2667035 - protein, 9 aa, Entamoeba histolytica
YPSPIKGKD

SEQ ID NO: 2667036 - protein, 4 aa, Entamoeba histolytica
YPSQ

SEQ ID NO: 2667037 - protein, 11 aa, Entamoeba histolytica
YPSSNCSNTVK

SEQ ID NO: 2667038 - protein, 8 aa, Entamoeba histolytica
YPSSPIAH

SEQ ID NO: 2667039 - protein, 4 aa, Entamoeba histolytica
YPST

SEQ ID NO: 2667040 - protein, 5 aa, Entamoeba histolytica
YPTAD

SEQ ID NO: 2667041 - protein, 5 aa, Entamoeba histolytica
YPTET

SEQ ID NO: 2667042 - protein, 7 aa, Entamoeba histolytica
YPTKEEQ

SEQ ID NO: 2667043 - protein, 6 aa, Entamoeba histolytica
YPTKKE

SEQ ID NO: 2667044 - protein, 6 aa, Entamoeba histolytica
YPTKKL

SEQ ID NO: 2667045 - protein, 14 aa, Entamoeba histolytica
YPTKPISPNSSHQV

SEQ ID NO: 2667046 - protein, 6 aa, Entamoeba histolytica
YPTNEI

SEQ ID NO: 2667047 - protein, 12 aa, Entamoeba histolytica
YPTSFDSNKLEP

SEQ ID NO: 2667048 - protein, 7 aa, Entamoeba histolytica
YPTTTQQ

SEQ ID NO: 2667049 - protein, 5 aa, Entamoeba histolytica
YPTVT

SEQ ID NO: 2667050 - protein, 10 aa, Entamoeba histolytica
YPVNNTTDWK

SEQ ID NO: 2667051 - protein, 9 aa, Entamoeba histolytica
YPVSSSARD

SEQ ID NO: 2667052 - protein, 4 aa, Entamoeba histolytica
YPYE

SEQ ID NO: 2667053 - protein, 8 aa, Entamoeba histolytica
YPYETDEQ

SEQ ID NO: 2667054 - protein, 21 aa, Entamoeba histolytica
YPYSINSSSLPSSSSQPSYYN

SEQ ID NO: 2667055 - protein, 6 aa, Entamoeba histolytica
YPYSPP

SEQ ID NO: 2667056 - protein, 9 aa, Entamoeba histolytica
YQAHEGNKL

SEQ ID NO: 2667057 - protein, 4 aa, Entamoeba histolytica
YQDG

SEQ ID NO: 2667058 - protein, 9 aa, Entamoeba histolytica
YQDKPNFPK

SEQ ID NO: 2667059 - protein, 6 aa, Entamoeba histolytica
YQDNRN

SEQ ID NO: 2667060 - protein, 5 aa, Entamoeba histolytica
YQEAR

SEQ ID NO: 2667061 - protein, 7 aa, Entamoeba histolytica
YQEDSES

SEQ ID NO: 2667062 - protein, 8 aa, Entamoeba histolytica
YQEENTQL

SEQ ID NO: 2667063 - protein, 5 aa, Entamoeba histolytica
YQEEQ

SEQ ID NO: 2667064 - protein, 14 aa, Entamoeba histolytica
YQEEREDINKEIEK

SEQ ID NO: 2667065 - protein, 16 aa, Entamoeba histolytica
YQEGAKRFSPVYMNRV

SEQ ID NO: 2667066 - protein, 5 aa, Entamoeba histolytica
YQEGS

SEQ ID NO: 2667067 - protein, 6 aa, Entamoeba histolytica
YQEKTR

SEQ ID NO: 2667068 - protein, 4 aa, Entamoeba histolytica
YQEP

SEQ ID NO: 2667069 - protein, 12 aa, Entamoeba histolytica
YQESWDRQPSNI

SEQ ID NO: 2667070 - protein, 12 aa, Entamoeba histolytica
YQESYKRGGERI

SEQ ID NO: 2667071 - protein, 5 aa, Entamoeba histolytica
YQEVE

SEQ ID NO: 2667072 - protein, 15 aa, Entamoeba histolytica
YQEYGGYEEGYYEGQ

SEQ ID NO: 2667073 - protein, 12 aa, Entamoeba histolytica
YQGKSIDINDDK

SEQ ID NO: 2667074 - protein, 5 aa, Entamoeba histolytica
YQGNA

SEQ ID NO: 2667075 - protein, 18 aa, Entamoeba histolytica
YQGTYSTTQQYPSSQKEQ

SEQ ID NO: 2667076 - protein, 10 aa, Entamoeba histolytica
YQGYDTNSQM

SEQ ID NO: 2667077 - protein, 14 aa, Entamoeba histolytica
YQIENQHSTNKCVI

SEQ ID NO: 2667078 - protein, 8 aa, Entamoeba histolytica
YQIQSKKG

SEQ ID NO: 2667079 - protein, 8 aa, Entamoeba histolytica
YQKETDKI

SEQ ID NO: 2667080 - protein, 33 aa, Entamoeba histolytica; identical to SEQ ID NO: 2472016

SEQ ID NO: 2667081 - protein, 19 aa, Entamoeba histolytica
YQKPEEDAREMAKERIPSP

SEQ ID NO: 2667082 - protein, 27 aa, Entamoeba histolytica
YQKQKDSQDSLEEGGSIHKSQKTLNTL

SEQ ID NO: 2667083 - protein, 10 aa, Entamoeba histolytica
YQKQSSYYPP

SEQ ID NO: 2667084 - protein, 4 aa, Entamoeba histolytica
YQKY

SEQ ID NO: 2667085 - protein, 4 aa, Entamoeba histolytica
YQNA

SEQ ID NO: 2667086 - protein, 6 aa, Entamoeba histolytica
YQNEGI

SEQ ID NO: 2667087 - protein, 8 aa, Entamoeba histolytica
YQNEKAPD

SEQ ID NO: 2667088 - protein, 19 aa, Entamoeba histolytica
YQNEKQQCDELQKSYDNQL

SEQ ID NO: 2667089 - protein, 7 aa, Entamoeba histolytica
YQNITKN

SEQ ID NO: 2667090 - protein, 5 aa, Entamoeba histolytica
YQNKD

SEQ ID NO: 2667091 - protein, 9 aa, Entamoeba histolytica
YQNKGIKED

SEQ ID NO: 2667092 - protein, 5 aa, Entamoeba histolytica
YQNSE

SEQ ID NO: 2667093 - protein, 11 aa, Entamoeba histolytica
YQNSMKKDEDI

SEQ ID NO: 2667094 - protein, 8 aa, Entamoeba histolytica
YQPEDREN

SEQ ID NO: 2667095 - protein, 8 aa, Entamoeba histolytica
YQPHSDKE

SEQ ID NO: 2667096 - protein, 39 aa, Entamoeba histolytica
YQPIKRKPEEPQNNDLSGGKITSEEMEQKFKEKQVENDP

SEQ ID NO: 2667097 - protein, 9 aa, Entamoeba histolytica
YQPKENKVP

SEQ ID NO: 2667098 - protein, 10 aa, Entamoeba histolytica
YQPKNQGEDH

SEQ ID NO: 2667099 - protein, 15 aa, Entamoeba histolytica
YQPKRSLEPSRGKSK

SEQ ID NO: 2667100 - protein, 13 aa, Entamoeba histolytica
YQPKSKEFTTEDP

SEQ ID NO: 2667101 - protein, 45 aa, Entamoeba histolytica
YQPNGSYYNQPNQITPTYAPYSNPGQPQQQQKKPSSGGYGGFFNY

SEQ ID NO: 2667102 - protein, 5 aa, Entamoeba histolytica
YQPNP

SEQ ID NO: 2667103 - protein, 13 aa, Entamoeba histolytica
YQPPEYRPKRKVD

SEQ ID NO: 2667104 - protein, 7 aa, Entamoeba histolytica
YQPRSKE

SEQ ID NO: 2667105 - protein, 15 aa, Entamoeba histolytica
YQPSEQTEEKLNHTQ

SEQ ID NO: 2667106 - protein, 12 aa, Entamoeba histolytica
YQPSIDKQKRNF

SEQ ID NO: 2667107 - protein, 29 aa, Entamoeba histolytica
YQQASSPVLSPIGKPQIQTSGSTQVKPNT

SEQ ID NO: 2667108 - protein, 11 aa, Entamoeba histolytica
YQQEDVDKARE

SEQ ID NO: 2667109 - protein, 6 aa, Entamoeba histolytica
YQQEYH

SEQ ID NO: 2667110 - protein, 7 aa, Entamoeba histolytica
YQQKTID

SEQ ID NO: 2667111 - protein, 17 aa, Entamoeba histolytica
YQQNENQMNDNQQCQEA

SEQ ID NO: 2667112 - protein, 22 aa, Entamoeba histolytica
YQQPLSPNESQSESDDTNTQGI

SEQ ID NO: 2667113 - protein, 8 aa, Entamoeba histolytica
YQQPQTRH

SEQ ID NO: 2667114 - protein, 17 aa, Entamoeba histolytica
YQQPTETKVGNNKTHKT

SEQ ID NO: 2667115 - protein, 9 aa, Entamoeba histolytica
YQQPTQPMN

SEQ ID NO: 2667116 - protein, 14 aa, Entamoeba histolytica
YQQSLDTISKIFCK

SEQ ID NO: 2667117 - protein, 9 aa, Entamoeba histolytica
YQQTQPRRL

SEQ ID NO: 2667118 - protein, 35 aa, Entamoeba histolytica
YQRANKRGTSFNNRRRTDYSRRDNWRGRRGSNEKF

SEQ ID NO: 2667119 - protein, 24 aa, Entamoeba histolytica
YQREKKRLEEEARRREEEEDARLE

SEQ ID NO: 2667120 - protein, 4 aa, Entamoeba histolytica
YQRL

SEQ ID NO: 2667121 - protein, 10 aa, Entamoeba histolytica
YQRPIKPPME

SEQ ID NO: 2667122 - protein, 7 aa, Entamoeba histolytica
YQRPYQE

SEQ ID NO: 2667123 - protein, 4 aa, Entamoeba histolytica
YQRR

SEQ ID NO: 2667124 - protein, 5 aa, Entamoeba histolytica
YQRSK

SEQ ID NO: 2667125 - protein, 5 aa, Entamoeba histolytica
YQSDN

SEQ ID NO: 2667126 - protein, 18 aa, Entamoeba histolytica
YQSDRTIEVSQPKEKQLK

SEQ ID NO: 2667127 - protein, 18 aa, Entamoeba histolytica
YQSDTTFQSTKKVPKNIS

SEQ ID NO: 2667128 - protein, 10 aa, Entamoeba histolytica
YQSEDKDVDA

SEQ ID NO: 2667129 - protein, 12 aa, Entamoeba histolytica
YQSEKKRPKEYS

SEQ ID NO: 2667130 - protein, 5 aa, Entamoeba histolytica
YQSGR

SEQ ID NO: 2667131 - protein, 7 aa, Entamoeba histolytica
YQSGTIE

SEQ ID NO: 2667132 - protein, 7 aa, Entamoeba histolytica
YQSKEDR

SEQ ID NO: 2667133 - protein, 11 aa, Entamoeba histolytica
YQSNYSKQMAA

SEQ ID NO: 2667134 - protein, 7 aa, Entamoeba histolytica
YQSRENA

SEQ ID NO: 2667135 - protein, 18 aa, Entamoeba histolytica
YQSSKPIRTNMSEDNEPR

SEQ ID NO: 2667136 - protein, 7 aa, Entamoeba histolytica
YQSSSER

SEQ ID NO: 2667137 - protein, 7 aa, Entamoeba histolytica
YQSSSPI

SEQ ID NO: 2667138 - protein, 6 aa, Entamoeba histolytica
YQTASS

SEQ ID NO: 2667139 - protein, 4 aa, Entamoeba histolytica
YQTE

SEQ ID NO: 2667140 - protein, 22 aa, Entamoeba histolytica
YQTNKDNEWKCDGKEQAQKTNA

SEQ ID NO: 2667141 - protein, 11 aa, Entamoeba histolytica
YQTNKGKISQL

SEQ ID NO: 2667142 - protein, 8 aa, Entamoeba histolytica
YQTNNWDT

SEQ ID NO: 2667143 - protein, 8 aa, Entamoeba histolytica
YQTPKECG

SEQ ID NO: 2667144 - protein, 10 aa, Entamoeba histolytica
YQTPKKIQPY

SEQ ID NO: 2667145 - protein, 6 aa, Entamoeba histolytica
YQTQQQ

SEQ ID NO: 2667146 - protein, 9 aa, Entamoeba histolytica
YQTTPLTSQ

SEQ ID NO: 2667147 - protein, 8 aa, Entamoeba histolytica
YQTYETNS

SEQ ID NO: 2667148 - protein, 11 aa, Entamoeba histolytica
YQVCPNKKEHP

SEQ ID NO: 2667149 - protein, 26 aa, Entamoeba histolytica
YQVPYGNSTQQPTPISQQPNTNNNNM

SEQ ID NO: 2667150 - protein, 9 aa, Entamoeba histolytica
YQVRSTGPI

SEQ ID NO: 2667151 - protein, 10 aa, Entamoeba histolytica
YQWNNENESI

SEQ ID NO: 2667152 - protein, 85 aa, Entamoeba histolytica
YQYPPPQGYPQQPGQYPPQQSYPQYPPQGYPQYPPQGYPQYPPQGYPQYPPQGYPQQPGQYPPQQGYPQYPPQAYHSQAAGALPK

SEQ ID NO: 2667153 - protein, 4 aa, Entamoeba histolytica
YQYQ

SEQ ID NO: 2667154 - protein, 4 aa, Entamoeba histolytica
YRAP

SEQ ID NO: 2667155 - protein, 164 aa, Entamoeba histolytica
YRDDYRPSDRRDDYRPSESRDDYRPSDRRDDYRVNDRRDDYRTTDRRDDYRQSDIRDDYRTNERRDDYRTTDRRDDYRATDRRDDYRPSDGRDNYRPSDRRDDYRANDRREEYRPSDLRDEYRPSDSRDEYRPSDHKDEYRPGERSDRFERRGNGSSSYREERK

SEQ ID NO: 2667156 - protein, 10 aa, Entamoeba histolytica
YRDEYTPAGD

SEQ ID NO: 2667157 - protein, 45 aa, Entamoeba histolytica
YRDISPQRSLQAQESLPSSLPSSFSLSPQNSYKPGNGFIQFFQKD

SEQ ID NO: 2667158 - protein, 9 aa, Entamoeba histolytica
YRDSKNKGI

SEQ ID NO: 2667159 - protein, 24 aa, Entamoeba histolytica
YREARERKRERIEEGERELQENNS

SEQ ID NO: 2667160 - protein, 10 aa, Entamoeba histolytica
YRENSSSSLY

SEQ ID NO: 2667161 - protein, 4 aa, Entamoeba histolytica
YRET

SEQ ID NO: 2667162 - protein, 11 aa, Entamoeba histolytica
YRETGDKANEV

SEQ ID NO: 2667163 - protein, 15 aa, Entamoeba histolytica
YREVTPQRKPSEEKS

SEQ ID NO: 2667164 - protein, 5 aa, Entamoeba histolytica
YRFPG

SEQ ID NO: 2667165 - protein, 5 aa, Entamoeba histolytica
YRGAE

SEQ ID NO: 2667166 - protein, 5 aa, Entamoeba histolytica
YRGAT

SEQ ID NO: 2667167 - protein, 14 aa, Entamoeba histolytica
YRGGLDVKSGSTGI

SEQ ID NO: 2667168 - protein, 4 aa, Entamoeba histolytica
YRGK

SEQ ID NO: 2667169 - protein, 4 aa, Entamoeba histolytica
YRGN

SEQ ID NO: 2667170 - protein, 5 aa, Entamoeba histolytica
YRGSD

SEQ ID NO: 2667171 - protein, 4 aa, Entamoeba histolytica
YRGT

SEQ ID NO: 2667172 - protein, 7 aa, Entamoeba histolytica
YRIGQKK

SEQ ID NO: 2667173 - protein, 8 aa, Entamoeba histolytica
YRKEGDLR

SEQ ID NO: 2667174 - protein, 11 aa, Entamoeba histolytica
YRKENQKNNKE

SEQ ID NO: 2667175 - protein, 8 aa, Entamoeba histolytica
YRKEYTEG

SEQ ID NO: 2667176 - protein, 8 aa, Entamoeba histolytica
YRKKGIGK

SEQ ID NO: 2667177 - protein, 26 aa, Entamoeba histolytica
YRKQRDQVKNELEKYKKENEKLELEN

SEQ ID NO: 2667178 - protein, 8 aa, Entamoeba histolytica
YRNERDVK

SEQ ID NO: 2667179 - protein, 11 aa, Entamoeba histolytica
YRNGKNVQVDT

SEQ ID NO: 2667180 - protein, 9 aa, Entamoeba histolytica
YRNKDRNNI

SEQ ID NO: 2667181 - protein, 10 aa, Entamoeba histolytica
YRNKNGKEIG

SEQ ID NO: 2667182 - protein, 9 aa, Entamoeba histolytica
YRNKNKSNT

SEQ ID NO: 2667183 - protein, 10 aa, Entamoeba histolytica
YRNRTNNRYV

SEQ ID NO: 2667184 - protein, 4 aa, Entamoeba histolytica
YRPE

SEQ ID NO: 2667185 - protein, 14 aa, Entamoeba histolytica
YRPQNSQVKKEPKK

SEQ ID NO: 2667186 - protein, 14 aa, Entamoeba histolytica
YRPQTKSDLIGNKN

SEQ ID NO: 2667187 - protein, 10 aa, Entamoeba histolytica
YRPSVDNSMT

SEQ ID NO: 2667188 - protein, 4 aa, Entamoeba histolytica
YRPT

SEQ ID NO: 2667189 - protein, 7 aa, Entamoeba histolytica
YRPTGKV

SEQ ID NO: 2667190 - protein, 5 aa, Entamoeba histolytica
YRRER

SEQ ID NO: 2667191 - protein, 21 aa, Entamoeba histolytica
YRRESEKYRASLKQAKSIDDN

SEQ ID NO: 2667192 - protein, 11 aa, Entamoeba histolytica
YRRRKEKIRKI

SEQ ID NO: 2667193 - protein, 10 aa, Entamoeba histolytica
YRSEDDSESC

SEQ ID NO: 2667194 - protein, 6 aa, Entamoeba histolytica
YRSPTI

SEQ ID NO: 2667195 - protein, 5 aa, Entamoeba histolytica
YRTAL

SEQ ID NO: 2667196 - protein, 5 aa, Entamoeba histolytica
YRTEE

SEQ ID NO: 2667197 - protein, 6 aa, Entamoeba histolytica
YRTSEL

SEQ ID NO: 2667198 - protein, 6 aa, Entamoeba histolytica
YRTTSG

SEQ ID NO: 2667199 - protein, 8 aa, Entamoeba histolytica
YRVPTPIQ

SEQ ID NO: 2667200 - protein, 9 aa, Entamoeba histolytica
YRYSRSNSL

SEQ ID NO: 2667201 - protein, 12 aa, Entamoeba histolytica
YSADKGSNTISY

SEQ ID NO: 2667202 - protein, 9 aa, Entamoeba histolytica
YSAGRGVNE

SEQ ID NO: 2667203 - protein, 9 aa, Entamoeba histolytica
YSANPETVS

SEQ ID NO: 2667204 - protein, 18 aa, Entamoeba histolytica
YSASKSVKEKRNEEIKEV

SEQ ID NO: 2667205 - protein, 7 aa, Entamoeba histolytica
YSASKTL

SEQ ID NO: 2667206 - protein, 4 aa, Entamoeba histolytica
YSDA

SEQ ID NO: 2667207 - protein, 11 aa, Entamoeba histolytica
YSDDYKTEMQR

SEQ ID NO: 2667208 - protein, 9 aa, Entamoeba histolytica
YSDFGTRRR

SEQ ID NO: 2667209 - protein, 6 aa, Entamoeba histolytica
YSDKTS

SEQ ID NO: 2667210 - protein, 4 aa, Entamoeba histolytica
YSDN

SEQ ID NO: 2667211 - protein, 11 aa, Entamoeba histolytica
YSDNCNKTSMT

SEQ ID NO: 2667212 - protein, 12 aa, Entamoeba histolytica
YSDNFGKNTKMD

SEQ ID NO: 2667213 - protein, 10 aa, Entamoeba histolytica
YSDNNERNTA

SEQ ID NO: 2667214 - protein, 4 aa, Entamoeba histolytica
YSDP

SEQ ID NO: 2667215 - protein, 4 aa, Entamoeba histolytica
YSDS

SEQ ID NO: 2667216 - protein, 6 aa, Entamoeba histolytica
YSDSCF

SEQ ID NO: 2667217 - protein, 13 aa, Entamoeba histolytica
YSEDKEHGFVIIE

SEQ ID NO: 2667218 - protein, 7 aa, Entamoeba histolytica
YSEETTL

SEQ ID NO: 2667219 - protein, 10 aa, Entamoeba histolytica
YSEEVPPPIY

SEQ ID NO: 2667220 - protein, 7 aa, Entamoeba histolytica
YSEIGEK

SEQ ID NO: 2667221 - protein, 29 aa, Entamoeba histolytica
YSELQRKNSAIENTLQPKTTTIPDNEPKN

SEQ ID NO: 2667222 - protein, 6 aa, Entamoeba histolytica
YSEPEK

SEQ ID NO: 2667223 - protein, 6 aa, Entamoeba histolytica
YSEQDI

SEQ ID NO: 2667224 - protein, 5 aa, Entamoeba histolytica
YSESG

SEQ ID NO: 2667225 - protein, 6 aa, Entamoeba histolytica
YSFKGN

SEQ ID NO: 2667226 - protein, 5 aa, Entamoeba histolytica
YSFQN

SEQ ID NO: 2667227 - protein, 4 aa, Entamoeba histolytica
YSGD

SEQ ID NO: 2667228 - protein, 5 aa, Entamoeba histolytica
YSGDD

SEQ ID NO: 2667229 - protein, 6 aa, Entamoeba histolytica
YSGENI

SEQ ID NO: 2667230 - protein, 16 aa, Entamoeba histolytica
YSGENWNSETTKSLLS

SEQ ID NO: 2667231 - protein, 8 aa, Entamoeba histolytica
YSGEQDDY

SEQ ID NO: 2667232 - protein, 7 aa, Entamoeba histolytica
YSGEQYS

SEQ ID NO: 2667233 - protein, 4 aa, Entamoeba histolytica
YSGG

SEQ ID NO: 2667234 - protein, 6 aa, Entamoeba histolytica
YSGGQK

SEQ ID NO: 2667235 - protein, 6 aa, Entamoeba histolytica
YSGKTS

SEQ ID NO: 2667236 - protein, 4 aa, Entamoeba histolytica
YSGN

SEQ ID NO: 2667237 - protein, 8 aa, Entamoeba histolytica
YSGNEEVE

SEQ ID NO: 2667238 - protein, 26 aa, Entamoeba histolytica
YSGNNTDIGQNQNDIQDDQIEEEEEI

SEQ ID NO: 2667239 - protein, 8 aa, Entamoeba histolytica
YSGQTAGY

SEQ ID NO: 2667240 - protein, 5 aa, Entamoeba histolytica
YSGRG

SEQ ID NO: 2667241 - protein, 24 aa, Entamoeba histolytica
YSGRVDVKTTGGRLGPVEGDYPEL

SEQ ID NO: 2667242 - protein, 9 aa, Entamoeba histolytica
YSGTSDFTL

SEQ ID NO: 2667243 - protein, 32 aa, Entamoeba histolytica
YSGTSHQNYSINPGCSKKELGVSSKPFKQNEI

SEQ ID NO: 2667244 - protein, 8 aa, Entamoeba histolytica
YSHDEKTR

SEQ ID NO: 2667245 - protein, 6 aa, Entamoeba histolytica
YSHEDP

SEQ ID NO: 2667246 - protein, 10 aa, Entamoeba histolytica
YSHENSPSKI

SEQ ID NO: 2667247 - protein, 35 aa, Entamoeba histolytica
YSHNTTNQSSGSTINIGTRNSPTSPIRNVETPDEV

SEQ ID NO: 2667248 - protein, 15 aa, Entamoeba histolytica
YSHPSPSQIKFCMKF

SEQ ID NO: 2667249 - protein, 7 aa, Entamoeba histolytica
YSHSGEH

SEQ ID NO: 2667250 - protein, 8 aa, Entamoeba histolytica
YSKDIDNI

SEQ ID NO: 2667251 - protein, 9 aa, Entamoeba histolytica
YSKDPEETI

SEQ ID NO: 2667252 - protein, 9 aa, Entamoeba histolytica
YSKDPKKVN

SEQ ID NO: 2667253 - protein, 8 aa, Entamoeba histolytica
YSKDQKTK

SEQ ID NO: 2667254 - protein, 15 aa, Entamoeba histolytica
YSKEEFNELMKTVDV

SEQ ID NO: 2667255 - protein, 10 aa, Entamoeba histolytica
YSKEQDNVQE

SEQ ID NO: 2667256 - protein, 7 aa, Entamoeba histolytica
YSKETEV

SEQ ID NO: 2667257 - protein, 14 aa, Entamoeba histolytica
YSKKDIEKKGKAVN

SEQ ID NO: 2667258 - protein, 9 aa, Entamoeba histolytica
YSKKNANEK

SEQ ID NO: 2667259 - protein, 9 aa, Entamoeba histolytica
YSKNNIPER

SEQ ID NO: 2667260 - protein, 8 aa, Entamoeba histolytica
YSKNPHKH

SEQ ID NO: 2667261 - protein, 8 aa, Entamoeba histolytica
YSKNTTGT

SEQ ID NO: 2667262 - protein, 8 aa, Entamoeba histolytica
YSKQKEIQ

SEQ ID NO: 2667263 - protein, 23 aa, Entamoeba histolytica
YSKQPNLMKSPKTQLLQNEKKPS

SEQ ID NO: 2667264 - protein, 7 aa, Entamoeba histolytica
YSKRSRK

SEQ ID NO: 2667265 - protein, 7 aa, Entamoeba histolytica
YSKSIEY

SEQ ID NO: 2667266 - protein, 10 aa, Entamoeba histolytica
YSKSTNPIKP

SEQ ID NO: 2667267 - protein, 8 aa, Entamoeba histolytica
YSKTNGID

SEQ ID NO: 2667268 - protein, 14 aa, Entamoeba histolytica
YSKTPVKRKPSKKI

SEQ ID NO: 2667269 - protein, 8 aa, Entamoeba histolytica
YSKTSSPN

SEQ ID NO: 2667270 - protein, 10 aa, Entamoeba histolytica
YSLKENKEIA

SEQ ID NO: 2667271 - protein, 9 aa, Entamoeba histolytica
YSLKRGSGY

SEQ ID NO: 2667272 - protein, 8 aa, Entamoeba histolytica
YSLNPKDK

SEQ ID NO: 2667273 - protein, 28 aa, Entamoeba histolytica
YSLPSTNPNEITTEQQLNKTGNEKQSKI

SEQ ID NO: 2667274 - protein, 11 aa, Entamoeba histolytica
YSMSEDSNNED

SEQ ID NO: 2667275 - protein, 8 aa, Entamoeba histolytica
YSNDSYEE

SEQ ID NO: 2667276 - protein, 9 aa, Entamoeba histolytica
YSNEEEPKV

SEQ ID NO: 2667277 - protein, 38 aa, Entamoeba histolytica
YSNEKYDSEFNNNNDKESIFNDNTEMSGDEQNDEGELN

SEQ ID NO: 2667278 - protein, 11 aa, Entamoeba histolytica
YSNEQQNIYPN

SEQ ID NO: 2667279 - protein, 4 aa, Entamoeba histolytica
YSNG

SEQ ID NO: 2667280 - protein, 9 aa, Entamoeba histolytica
YSNKPKGEW

SEQ ID NO: 2667281 - protein, 7 aa, Entamoeba histolytica
YSNLNSK

SEQ ID NO: 2667282 - protein, 7 aa, Entamoeba histolytica
YSNMDGC

SEQ ID NO: 2667283 - protein, 8 aa, Entamoeba histolytica
YSNNSPEQ

SEQ ID NO: 2667284 - protein, 7 aa, Entamoeba histolytica
YSNPIHP

SEQ ID NO: 2667285 - protein, 5 aa, Entamoeba histolytica
YSNSE

SEQ ID NO: 2667286 - protein, 7 aa, Entamoeba histolytica
YSNSQTI

SEQ ID NO: 2667287 - protein, 15 aa, Entamoeba histolytica
YSNTGGQKSKATNLG

SEQ ID NO: 2667288 - protein, 9 aa, Entamoeba histolytica
YSNTNENER

SEQ ID NO: 2667289 - protein, 6 aa, Entamoeba histolytica
YSNTTE

SEQ ID NO: 2667290 - protein, 7 aa, Entamoeba histolytica
YSPANTD

SEQ ID NO: 2667291 - protein, 4 aa, Entamoeba histolytica
YSPD

SEQ ID NO: 2667292 - protein, 6 aa, Entamoeba histolytica
YSPDPL

SEQ ID NO: 2667293 - protein, 4 aa, Entamoeba histolytica
YSPE

SEQ ID NO: 2667294 - protein, 7 aa, Entamoeba histolytica
YSPEATN

SEQ ID NO: 2667295 - protein, 10 aa, Entamoeba histolytica
YSPEKRLSAS

SEQ ID NO: 2667296 - protein, 16 aa, Entamoeba histolytica
YSPIPQLPEDFSDDGL

SEQ ID NO: 2667297 - protein, 4 aa, Entamoeba histolytica
YSPK

SEQ ID NO: 2667298 - protein, 18 aa, Entamoeba histolytica
YSPKEKTTTWSTGRPSYC

SEQ ID NO: 2667299 - protein, 9 aa, Entamoeba histolytica
YSPKPIDKN

SEQ ID NO: 2667300 - protein, 16 aa, Entamoeba histolytica
YSPKVNRSKAEELARR

SEQ ID NO: 2667301 - protein, 4 aa, Entamoeba histolytica
YSPL

SEQ ID NO: 2667302 - protein, 6 aa, Entamoeba histolytica
YSPNTL

SEQ ID NO: 2667303 - protein, 10 aa, Entamoeba histolytica
YSPNVLSDKE

SEQ ID NO: 2667304 - protein, 6 aa, Entamoeba histolytica
YSPPPH

SEQ ID NO: 2667305 - protein, 6 aa, Entamoeba histolytica
YSPPVE

SEQ ID NO: 2667306 - protein, 12 aa, Entamoeba histolytica
YSPRPSPSIQYN

SEQ ID NO: 2667307 - protein, 9 aa, Entamoeba histolytica
YSPRTISSQ

SEQ ID NO: 2667308 - protein, 29 aa, Entamoeba histolytica
YSPSISPTLSKSFKEEATSLKKKKRLSGL

SEQ ID NO: 2667309 - protein, 18 aa, Entamoeba histolytica
YSPSKVNVPVDKKTHLSK

SEQ ID NO: 2667310 - protein, 6 aa, Entamoeba histolytica
YSPSPD

SEQ ID NO: 2667311 - protein, 6 aa, Entamoeba histolytica
YSPSQY

SEQ ID NO: 2667312 - protein, 6 aa, Entamoeba histolytica
YSPSSK

SEQ ID NO: 2667313 - protein, 7 aa, Entamoeba histolytica
YSPSSPD

SEQ ID NO: 2667314 - protein, 6 aa, Entamoeba histolytica
YSPSYK

SEQ ID NO: 2667315 - protein, 9 aa, Entamoeba histolytica
YSQANPQLS

SEQ ID NO: 2667316 - protein, 6 aa, Entamoeba histolytica
YSQDIQ

SEQ ID NO: 2667317 - protein, 15 aa, Entamoeba histolytica
YSQESKYSTDSNNIE

SEQ ID NO: 2667318 - protein, 13 aa, Entamoeba histolytica
YSQGINPIEPNAS

SEQ ID NO: 2667319 - protein, 9 aa, Entamoeba histolytica
YSQGVNPIE

SEQ ID NO: 2667320 - protein, 8 aa, Entamoeba histolytica
YSQNEKDM

SEQ ID NO: 2667321 - protein, 15 aa, Entamoeba histolytica
YSQQSSIQENSLKKS

SEQ ID NO: 2667322 - protein, 13 aa, Entamoeba histolytica
YSQSHDDKLKKEQ

SEQ ID NO: 2667323 - protein, 4 aa, Entamoeba histolytica
YSQT

SEQ ID NO: 2667324 - protein, 15 aa, Entamoeba histolytica
YSRKSESMDITPGMT

SEQ ID NO: 2667325 - protein, 14 aa, Entamoeba histolytica
YSRKSSAPILAGND

SEQ ID NO: 2667326 - protein, 9 aa, Entamoeba histolytica
YSSANKDAL

SEQ ID NO: 2667327 - protein, 5 aa, Entamoeba histolytica
YSSDE

SEQ ID NO: 2667328 - protein, 11 aa, Entamoeba histolytica
YSSDTKKSAKE

SEQ ID NO: 2667329 - protein, 6 aa, Entamoeba histolytica
YSSEDA

SEQ ID NO: 2667330 - protein, 7 aa, Entamoeba histolytica
YSSEKDV

SEQ ID NO: 2667331 - protein, 7 aa, Entamoeba histolytica
YSSEQNK

SEQ ID NO: 2667332 - protein, 7 aa, Entamoeba histolytica
YSSFTGE

SEQ ID NO: 2667333 - protein, 27 aa, Entamoeba histolytica
YSSGEECSNNGEGEANEKKYGCGKCED

SEQ ID NO: 2667334 - protein, 14 aa, Entamoeba histolytica
YSSGKNHSNKTETF

SEQ ID NO: 2667335 - protein, 13 aa, Entamoeba histolytica
YSSGKNNSNRTET

SEQ ID NO: 2667336 - protein, 9 aa, Entamoeba histolytica
YSSGNYSVN

SEQ ID NO: 2667337 - protein, 6 aa, Entamoeba histolytica
YSSGSS

SEQ ID NO: 2667338 - protein, 5 aa, Entamoeba histolytica
YSSLK

SEQ ID NO: 2667339 - protein, 4 aa, Entamoeba histolytica
YSSM

SEQ ID NO: 2667340 - protein, 4 aa, Entamoeba histolytica
YSSN

SEQ ID NO: 2667341 - protein, 8 aa, Entamoeba histolytica
YSSNDQVE

SEQ ID NO: 2667342 - protein, 6 aa, Entamoeba histolytica
YSSNEN

SEQ ID NO: 2667343 - protein, 16 aa, Entamoeba histolytica
YSSPENPNPSPTFGIS

SEQ ID NO: 2667344 - protein, 8 aa, Entamoeba histolytica
YSSPKTIV

SEQ ID NO: 2667345 - protein, 6 aa, Entamoeba histolytica
YSSPSP

SEQ ID NO: 2667346 - protein, 18 aa, Entamoeba histolytica
YSSSFYKAESSDEDSTLE

SEQ ID NO: 2667347 - protein, 22 aa, Entamoeba histolytica
YSSSGSGEEQTSSTEELDDDEI

SEQ ID NO: 2667348 - protein, 8 aa, Entamoeba histolytica
YSSSSIDL

SEQ ID NO: 2667349 - protein, 9 aa, Entamoeba histolytica
YSSTNDNLN

SEQ ID NO: 2667350 - protein, 11 aa, Entamoeba histolytica
YSSTNGDFEAR

SEQ ID NO: 2667351 - protein, 11 aa, Entamoeba histolytica
YSSTPNQETDI

SEQ ID NO: 2667352 - protein, 7 aa, Entamoeba histolytica
YSSTQTI

SEQ ID NO: 2667353 - protein, 7 aa, Entamoeba histolytica
YSSVPDP

SEQ ID NO: 2667354 - protein, 8 aa, Entamoeba histolytica
YSSYKETP

SEQ ID NO: 2667355 - protein, 4 aa, Entamoeba histolytica
YSTD

SEQ ID NO: 2667356 - protein, 5 aa, Entamoeba histolytica
YSTDE

SEQ ID NO: 2667357 - protein, 11 aa, Entamoeba histolytica
YSTDKATVTNA

SEQ ID NO: 2667358 - protein, 6 aa, Entamoeba histolytica
YSTDMK

SEQ ID NO: 2667359 - protein, 7 aa, Entamoeba histolytica
YSTDPLK

SEQ ID NO: 2667360 - protein, 6 aa, Entamoeba histolytica
YSTDSE

SEQ ID NO: 2667361 - protein, 5 aa, Entamoeba histolytica
YSTEE

SEQ ID NO: 2667362 - protein, 10 aa, Entamoeba histolytica
YSTESTTMTV

SEQ ID NO: 2667363 - protein, 5 aa, Entamoeba histolytica
YSTGA

SEQ ID NO: 2667364 - protein, 6 aa, Entamoeba histolytica
YSTGDS

SEQ ID NO: 2667365 - protein, 7 aa, Entamoeba histolytica
YSTGFSP

SEQ ID NO: 2667366 - protein, 19 aa, Entamoeba histolytica
YSTKHFNDEDTPKNIKVLL

SEQ ID NO: 2667367 - protein, 5 aa, Entamoeba histolytica
YSTKL

SEQ ID NO: 2667368 - protein, 11 aa, Entamoeba histolytica
YSTKQIDSYSG

SEQ ID NO: 2667369 - protein, 20 aa, Entamoeba histolytica
YSTKTSPQMSNRMGEASKGI

SEQ ID NO: 2667370 - protein, 6 aa, Entamoeba histolytica
YSTNAS

SEQ ID NO: 2667371 - protein, 6 aa, Entamoeba histolytica
YSTNED

SEQ ID NO: 2667372 - protein, 7 aa, Entamoeba histolytica
YSTNHHS

SEQ ID NO: 2667373 - protein, 6 aa, Entamoeba histolytica
YSTNSV

SEQ ID NO: 2667374 - protein, 7 aa, Entamoeba histolytica
YSTNTAV

SEQ ID NO: 2667375 - protein, 4 aa, Entamoeba histolytica
YSTP

SEQ ID NO: 2667376 - protein, 9 aa, Entamoeba histolytica
YSTPDLNGE

SEQ ID NO: 2667377 - protein, 8 aa, Entamoeba histolytica
YSTQNQQS

SEQ ID NO: 2667378 - protein, 6 aa, Entamoeba histolytica
YSTQTS

SEQ ID NO: 2667379 - protein, 9 aa, Entamoeba histolytica
YSTRTESQR

SEQ ID NO: 2667380 - protein, 7 aa, Entamoeba histolytica
YSTSHSF

SEQ ID NO: 2667381 - protein, 22 aa, Entamoeba histolytica
YSTSYNPYSTRGSERTLSNSSI

SEQ ID NO: 2667382 - protein, 7 aa, Entamoeba histolytica
YSTTEEK

SEQ ID NO: 2667383 - protein, 5 aa, Entamoeba histolytica
YSTYY

SEQ ID NO: 2667384 - protein, 37 aa, Entamoeba histolytica
YSVGSSSFSNDKKRKVIPTKHETQTIKKKKDSSSLDE

SEQ ID NO: 2667385 - protein, 13 aa, Entamoeba histolytica
YSYDGKEELYSGI

SEQ ID NO: 2667386 - protein, 9 aa, Entamoeba histolytica
YSYDPRNQT

SEQ ID NO: 2667387 - protein, 6 aa, Entamoeba histolytica
YSYENQ

SEQ ID NO: 2667388 - protein, 7 aa, Entamoeba histolytica
YSYGKEN

SEQ ID NO: 2667389 - protein, 10 aa, Entamoeba histolytica
YSYSKKQSPL

SEQ ID NO: 2667390 - protein, 9 aa, Entamoeba histolytica
YTAANDEEL

SEQ ID NO: 2667391 - protein, 5 aa, Entamoeba histolytica
YTAEE

SEQ ID NO: 2667392 - protein, 5 aa, Entamoeba histolytica
YTAGE

SEQ ID NO: 2667393 - protein, 16 aa, Entamoeba histolytica
YTANGTGGKSVYAQSG

SEQ ID NO: 2667394 - protein, 4 aa, Entamoeba histolytica
YTAP

SEQ ID NO: 2667395 - protein, 6 aa, Entamoeba histolytica
YTAPPL

SEQ ID NO: 2667396 - protein, 9 aa, Entamoeba histolytica
YTAPTDEAL

SEQ ID NO: 2667397 - protein, 5 aa, Entamoeba histolytica
YTASH

SEQ ID NO: 2667398 - protein, 7 aa, Entamoeba histolytica
YTCPPKD

SEQ ID NO: 2667399 - protein, 10 aa, Entamoeba histolytica
YTDEIKDNNY

SEQ ID NO: 2667400 - protein, 9 aa, Entamoeba histolytica
YTDENATDE

SEQ ID NO: 2667401 - protein, 7 aa, Entamoeba histolytica
YTDGGEE

SEQ ID NO: 2667402 - protein, 4 aa, Entamoeba histolytica
YTDI

SEQ ID NO: 2667403 - protein, 78 aa, Entamoeba histolytica
YTDRSRSRSREHSHRYDDYRQSDDYSRRDDYKRRDDYERRDDYKRRDDYERRDDYKRRDENSRRSDHGRSYRPSGSVV

SEQ ID NO: 2667404 - protein, 4 aa, Entamoeba histolytica
YTDS

SEQ ID NO: 2667405 - protein, 12 aa, Entamoeba histolytica
YTEEDREEYGNT

SEQ ID NO: 2667406 - protein, 7 aa, Entamoeba histolytica
YTEEDSR

SEQ ID NO: 2667407 - protein, 6 aa, Entamoeba histolytica
YTEKGE

SEQ ID NO: 2667408 - protein, 4 aa, Entamoeba histolytica
YTEQ

SEQ ID NO: 2667409 - protein, 11 aa, Entamoeba histolytica
YTEQPTSNNNI

SEQ ID NO: 2667410 - protein, 4 aa, Entamoeba histolytica
YTER

SEQ ID NO: 2667411 - protein, 22 aa, Entamoeba histolytica
YTFPETSVKDDSEQKTNQLNKT

SEQ ID NO: 2667412 - protein, 5 aa, Entamoeba histolytica
YTGDG

SEQ ID NO: 2667413 - protein, 9 aa, Entamoeba histolytica
YTGDPAASS

SEQ ID NO: 2667414 - protein, 6 aa, Entamoeba histolytica
YTGEGL

SEQ ID NO: 2667415 - protein, 7 aa, Entamoeba histolytica
YTGPHGV

SEQ ID NO: 2667416 - protein, 18 aa, Entamoeba histolytica
YTGYGGGKGEVDNSTVVG

SEQ ID NO: 2667417 - protein, 4 aa, Entamoeba histolytica
YTHP

SEQ ID NO: 2667418 - protein, 7 aa, Entamoeba histolytica
YTHPTSN

SEQ ID NO: 2667419 - protein, 9 aa, Entamoeba histolytica
YTINDSTGS

SEQ ID NO: 2667420 - protein, 11 aa, Entamoeba histolytica
YTKAGNNAVYD

SEQ ID NO: 2667421 - protein, 8 aa, Entamoeba histolytica
YTKDEQPI

SEQ ID NO: 2667422 - protein, 12 aa, Entamoeba histolytica
YTKEDREEYGNT

SEQ ID NO: 2667423 - protein, 17 aa, Entamoeba histolytica
YTKGESQTDVEVTTATD

SEQ ID NO: 2667424 - protein, 4 aa, Entamoeba histolytica
YTKN

SEQ ID NO: 2667425 - protein, 9 aa, Entamoeba histolytica
YTKNEETLN

SEQ ID NO: 2667426 - protein, 7 aa, Entamoeba histolytica
YTKNKEA

SEQ ID NO: 2667427 - protein, 12 aa, Entamoeba histolytica
YTKQNLKDVNGP

SEQ ID NO: 2667428 - protein, 9 aa, Entamoeba histolytica
YTKREDEKY

SEQ ID NO: 2667429 - protein, 10 aa, Entamoeba histolytica
YTKRQDDRSY

SEQ ID NO: 2667430 - protein, 5 aa, Entamoeba histolytica
YTKSS

SEQ ID NO: 2667431 - protein, 6 aa, Entamoeba histolytica
YTKTNP

SEQ ID NO: 2667432 - protein, 6 aa, Entamoeba histolytica
YTKTRP

SEQ ID NO: 2667433 - protein, 5 aa, Entamoeba histolytica
YTKTT

SEQ ID NO: 2667434 - protein, 13 aa, Entamoeba histolytica
YTKYDRKKYGNTI

SEQ ID NO: 2667435 - protein, 14 aa, Entamoeba histolytica
YTKYEGKKEFQSYE

SEQ ID NO: 2667436 - protein, 19 aa, Entamoeba histolytica
YTKYEKKKKVTKKKTSKKK

SEQ ID NO: 2667437 - protein, 4 aa, Entamoeba histolytica
YTLE

SEQ ID NO: 2667438 - protein, 9 aa, Entamoeba histolytica
YTLGKKSAS

SEQ ID NO: 2667439 - protein, 6 aa, Entamoeba histolytica
YTLPDG

SEQ ID NO: 2667440 - protein, 7 aa, Entamoeba histolytica
YTNARDS

SEQ ID NO: 2667441 - protein, 6 aa, Entamoeba histolytica
YTNEAR

SEQ ID NO: 2667442 - protein, 20 aa, Entamoeba histolytica
YTNEEEKKEDEKEETESKEI

SEQ ID NO: 2667443 - protein, 7 aa, Entamoeba histolytica
YTNEEEP

SEQ ID NO: 2667444 - protein, 5 aa, Entamoeba histolytica
YTNES

SEQ ID NO: 2667445 - protein, 9 aa, Entamoeba histolytica
YTNGKKIND

SEQ ID NO: 2667446 - protein, 6 aa, Entamoeba histolytica
YTNGYE

SEQ ID NO: 2667447 - protein, 9 aa, Entamoeba histolytica
YTNKQRSSL

SEQ ID NO: 2667448 - protein, 9 aa, Entamoeba histolytica
YTNKSKGYG

SEQ ID NO: 2667449 - protein, 6 aa, Entamoeba histolytica
YTNNGE

SEQ ID NO: 2667450 - protein, 7 aa, Entamoeba histolytica
YTNNPIY

SEQ ID NO: 2667451 - protein, 7 aa, Entamoeba histolytica
YTNSQVT

SEQ ID NO: 2667452 - protein, 4 aa, Entamoeba histolytica
YTNY

SEQ ID NO: 2667453 - protein, 16 aa, Entamoeba histolytica
YTPDDDRVERDDEEEF

SEQ ID NO: 2667454 - protein, 23 aa, Entamoeba histolytica
YTPDERSPCENSSSPDVFAFDEE

SEQ ID NO: 2667455 - protein, 10 aa, Entamoeba histolytica
YTPEKRPTAV

SEQ ID NO: 2667456 - protein, 4 aa, Entamoeba histolytica
YTPI

SEQ ID NO: 2667457 - protein, 37 aa, Entamoeba histolytica
YTPIQQNQTITPIKSNTEIKERQQMRVSSTKGTNQTI

SEQ ID NO: 2667458 - protein, 9 aa, Entamoeba histolytica
YTPKEQKET

SEQ ID NO: 2667459 - protein, 9 aa, Entamoeba histolytica
YTPLKENSM

SEQ ID NO: 2667460 - protein, 5 aa, Entamoeba histolytica
YTPMG

SEQ ID NO: 2667461 - protein, 4 aa, Entamoeba histolytica
YTPN

SEQ ID NO: 2667462 - protein, 6 aa, Entamoeba histolytica
YTPNEH

SEQ ID NO: 2667463 - protein, 6 aa, Entamoeba histolytica
YTPNSL

SEQ ID NO: 2667464 - protein, 7 aa, Entamoeba histolytica
YTPPKQR

SEQ ID NO: 2667465 - protein, 6 aa, Entamoeba histolytica
YTPQKQ

SEQ ID NO: 2667466 - protein, 7 aa, Entamoeba histolytica
YTPQTVK

SEQ ID NO: 2667467 - protein, 9 aa, Entamoeba histolytica
YTPSDGTKF

SEQ ID NO: 2667468 - protein, 8 aa, Entamoeba histolytica
YTPSSNVN

SEQ ID NO: 2667469 - protein, 19 aa, Entamoeba histolytica
YTPVSSKKEPQKREQENYD

SEQ ID NO: 2667470 - protein, 5 aa, Entamoeba histolytica
YTQDD

SEQ ID NO: 2667471 - protein, 20 aa, Entamoeba histolytica
YTQEDREKYGNTIQKEVDSL

SEQ ID NO: 2667472 - protein, 5 aa, Entamoeba histolytica
YTQHT

SEQ ID NO: 2667473 - protein, 20 aa, Entamoeba histolytica
YTQPSKDSLSSYDTVYNPSS

SEQ ID NO: 2667474 - protein, 4 aa, Entamoeba histolytica
YTQR

SEQ ID NO: 2667475 - protein, 39 aa, Entamoeba histolytica
YTQSIESSVSKTSPQSLQRKRIPKKKKKWSLEDKKRAVK

SEQ ID NO: 2667476 - protein, 6 aa, Entamoeba histolytica
YTQSSN

SEQ ID NO: 2667477 - protein, 16 aa, Entamoeba histolytica
YTRDDSTKEVTIEVDH

SEQ ID NO: 2667478 - protein, 23 aa, Entamoeba histolytica
YTRERTKRGCTADKTVSKKNLGR

SEQ ID NO: 2667479 - protein, 15 aa, Entamoeba histolytica
YTRSENNDLDDSYYT

SEQ ID NO: 2667480 - protein, 6 aa, Entamoeba histolytica
YTRSNK

SEQ ID NO: 2667481 - protein, 10 aa, Entamoeba histolytica
YTSDSNAPTA

SEQ ID NO: 2667482 - protein, 5 aa, Entamoeba histolytica
YTSHQ

SEQ ID NO: 2667483 - protein, 6 aa, Entamoeba histolytica
YTSPKG

SEQ ID NO: 2667484 - protein, 11 aa, Entamoeba histolytica
YTSPSSAKLTQ

SEQ ID NO: 2667485 - protein, 9 aa, Entamoeba histolytica
YTSQNNQEQ

SEQ ID NO: 2667486 - protein, 15 aa, Entamoeba histolytica
YTSQSMSKSTNETIL

SEQ ID NO: 2667487 - protein, 6 aa, Entamoeba histolytica
YTSSNL

SEQ ID NO: 2667488 - protein, 16 aa, Entamoeba histolytica
YTSSPRQNKEAPSQTL

SEQ ID NO: 2667489 - protein, 8 aa, Entamoeba histolytica
YTSTPEPF

SEQ ID NO: 2667490 - protein, 16 aa, Entamoeba histolytica
YTSTPERTGDDSRSIK

SEQ ID NO: 2667491 - protein, 13 aa, Entamoeba histolytica
YTTASPTVPTTFS

SEQ ID NO: 2667492 - protein, 6 aa, Entamoeba histolytica
YTTDET

SEQ ID NO: 2667493 - protein, 8 aa, Entamoeba histolytica
YTTEDVEH

SEQ ID NO: 2667494 - protein, 8 aa, Entamoeba histolytica
YTTEETGI

SEQ ID NO: 2667495 - protein, 6 aa, Entamoeba histolytica
YTTEPI

SEQ ID NO: 2667496 - protein, 9 aa, Entamoeba histolytica
YTTKGESVK

SEQ ID NO: 2667497 - protein, 5 aa, Entamoeba histolytica
YTTND

SEQ ID NO: 2667498 - protein, 9 aa, Entamoeba histolytica
YTTPRNSNE

SEQ ID NO: 2667499 - protein, 17 aa, Entamoeba histolytica
YTTQAKVEDVAEKSKKV

SEQ ID NO: 2667500 - protein, 10 aa, Entamoeba histolytica
YTTQREAESY

SEQ ID NO: 2667501 - protein, 6 aa, Entamoeba histolytica
YTTSHQ

SEQ ID NO: 2667502 - protein, 5 aa, Entamoeba histolytica
YTTSI

SEQ ID NO: 2667503 - protein, 10 aa, Entamoeba histolytica
YTTSRTDTRV

SEQ ID NO: 2667504 - protein, 11 aa, Entamoeba histolytica
YTTTNDAQGQK

SEQ ID NO: 2667505 - protein, 7 aa, Entamoeba histolytica
YTTTQFD

SEQ ID NO: 2667506 - protein, 5 aa, Entamoeba histolytica
YTTWS

SEQ ID NO: 2667507 - protein, 6 aa, Entamoeba histolytica
YTYDQP

SEQ ID NO: 2667508 - protein, 4 aa, Entamoeba histolytica
YVDG

SEQ ID NO: 2667509 - protein, 12 aa, Entamoeba histolytica
YVDNPTKRLGEK

SEQ ID NO: 2667510 - protein, 8 aa, Entamoeba histolytica
YVEDDDAT

SEQ ID NO: 2667511 - protein, 5 aa, Entamoeba histolytica
YVEDG

SEQ ID NO: 2667512 - protein, 10 aa, Entamoeba histolytica
YVEDQMNDNE

SEQ ID NO: 2667513 - protein, 6 aa, Entamoeba histolytica
YVEGKK

SEQ ID NO: 2667514 - protein, 8 aa, Entamoeba histolytica
YVERKKKE

SEQ ID NO: 2667515 - protein, 15 aa, Entamoeba histolytica
YVETPDYNNEPDDEW

SEQ ID NO: 2667516 - protein, 9 aa, Entamoeba histolytica
YVGTERPNQ

SEQ ID NO: 2667517 - protein, 4 aa, Entamoeba histolytica
YVNA

SEQ ID NO: 2667518 - protein, 12 aa, Entamoeba histolytica
YVPPEKPAASFN

SEQ ID NO: 2667519 - protein, 6 aa, Entamoeba histolytica
YVPPIP

SEQ ID NO: 2667520 - protein, 4 aa, Entamoeba histolytica
YVPQ

SEQ ID NO: 2667521 - protein, 9 aa, Entamoeba histolytica
YVPTPEEEL

SEQ ID NO: 2667522 - protein, 9 aa, Entamoeba histolytica
YVPTQNDEI

SEQ ID NO: 2667523 - protein, 27 aa, Entamoeba histolytica
YVQDITSDSSINISEYEQEVSEKNKQK

SEQ ID NO: 2667524 - protein, 9 aa, Entamoeba histolytica
YVRTDKKKF

SEQ ID NO: 2667525 - protein, 7 aa, Entamoeba histolytica
YVSSEKE

SEQ ID NO: 2667526 - protein, 7 aa, Entamoeba histolytica
YVSSTSK

SEQ ID NO: 2667527 - protein, 13 aa, Entamoeba histolytica
YVSSYSKQQTFTG

SEQ ID NO: 2667528 - protein, 5 aa, Entamoeba histolytica
YVSTD

SEQ ID NO: 2667529 - protein, 5 aa, Entamoeba histolytica
YVTPQ

SEQ ID NO: 2667530 - protein, 5 aa, Entamoeba histolytica
YVTSA

SEQ ID NO: 2667531 - protein, 17 aa, Entamoeba histolytica
YWERTEKDTKEQANIKS

SEQ ID NO: 2667532 - protein, 12 aa, Entamoeba histolytica
YYADSNGKRNEL

SEQ ID NO: 2667533 - protein, 13 aa, Entamoeba histolytica
YYAQGKTKEKIEQ

SEQ ID NO: 2667534 - protein, 10 aa, Entamoeba histolytica
YYDNAEDAKI

SEQ ID NO: 2667535 - protein, 16 aa, Entamoeba histolytica
YYDPNPDERIDDKEGT

SEQ ID NO: 2667536 - protein, 4 aa, Entamoeba histolytica
YYEE

SEQ ID NO: 2667537 - protein, 18 aa, Entamoeba histolytica
YYEEAEKINQKSNKSIQN

SEQ ID NO: 2667538 - protein, 6 aa, Entamoeba histolytica
YYEKNS

SEQ ID NO: 2667539 - protein, 5 aa, Entamoeba histolytica
YYESQ

SEQ ID NO: 2667540 - protein, 4 aa, Entamoeba histolytica
YYGT

SEQ ID NO: 2667541 - protein, 6 aa, Entamoeba histolytica
YYKETA

SEQ ID NO: 2667542 - protein, 5 aa, Entamoeba histolytica
YYKGP

SEQ ID NO: 2667543 - protein, 10 aa, Entamoeba histolytica
YYKSPKQSNI

SEQ ID NO: 2667544 - protein, 9 aa, Entamoeba histolytica
YYKSQGNTF

SEQ ID NO: 2667545 - protein, 7 aa, Entamoeba histolytica
YYNDYND

SEQ ID NO: 2667546 - protein, 5 aa, Entamoeba histolytica
YYNEK

SEQ ID NO: 2667547 - protein, 9 aa, Entamoeba histolytica
YYNGNDGKS

SEQ ID NO: 2667548 - protein, 8 aa, Entamoeba histolytica
YYNKQQKA

SEQ ID NO: 2667549 - protein, 13 aa, Entamoeba histolytica
YYNNEGNENTTRV

SEQ ID NO: 2667550 - protein, 16 aa, Entamoeba histolytica
YYNREGKDSFATFTSK

SEQ ID NO: 2667551 - protein, 4 aa, Entamoeba histolytica
YYPL

SEQ ID NO: 2667552 - protein, 4 aa, Entamoeba histolytica
YYPP

SEQ ID NO: 2667553 - protein, 19 aa, Entamoeba histolytica
YYPSGDSGLLASGSDSPND

SEQ ID NO: 2667554 - protein, 5 aa, Entamoeba histolytica
YYRGT

SEQ ID NO: 2667555 - protein, 4 aa, Entamoeba histolytica
YYRS

SEQ ID NO: 2667556 - protein, 4 aa, Entamoeba histolytica
YYSA

SEQ ID NO: 2667557 - protein, 20 aa, Entamoeba histolytica
YYSGSPTSSTPISKPITPTS

SEQ ID NO: 2667558 - protein, 6 aa, Entamoeba histolytica
YYSQRD

SEQ ID NO: 2667559 - protein, 8 aa, Entamoeba histolytica
YYSQTKTE

SEQ ID NO: 2667560 - protein, 35 aa, Entamoeba histolytica; identical to SEQ ID NO: 2411597

SEQ ID NO: 2667561 - protein, 5 aa, Entamoeba histolytica
YYSTS

SEQ ID NO: 2667562 - protein, 10 aa, Entamoeba histolytica
YYTKKQPTYS

SEQ ID NO: 2667563 - protein, 23 aa, Entamoeba histolytica
YYTPPRPNRKETLDEKEPRRKRK

SEQ ID NO: 2667564 - protein, 8 aa, Entamoeba histolytica
YYTSKTDL

SEQ ID NO: 2667565 - protein, 4 aa, Entamoeba histolytica
YYYP

SEQ ID NO: 2667566 - protein, 18 aa, Entamoeba histolytica
ADKTWGEIITRLRHLKTT

SEQ ID NO: 2667567 - protein, 19 aa, Entamoeba histolytica
KTQVATIIIFKGYSKENFS

SEQ ID NO: 2667568 - protein, 19 aa, Entamoeba histolytica
GRLTDGRGRTVDFKNTVVI

SEQ ID NO: 2667569 - protein, 30 aa, Entamoeba histolytica
QIQVPLESSLSFNLNDSFFLFGENAYSSLT

SEQ ID NO: 2667570 - protein, 24 aa, Entamoeba histolytica
AIRRRPYSVILFDEIEKAHPQVFN

SEQ ID NO: 2667571 - protein, 20 aa, Entamoeba histolytica
DVPSNLQCRVIGLDMGALIA

SEQ ID NO: 2667572 - protein, 25 aa, Entamoeba histolytica
FSDEHGAVCPLNWKPGKDTIEPTPD

SEQ ID NO: 2667573 - protein, 23 aa, Entamoeba histolytica
RHLKTTIIVNMHIWKSLNASFKT

SEQ ID NO: 2667574 - protein, 19 aa, Entamoeba histolytica
RYINGRFLPDKAIDLVDEA

SEQ ID NO: 2667575 - protein, 17 aa, Entamoeba histolytica
CRVIGLDMGALIAGAQY

SEQ ID NO: 2667576 - protein, 18 aa, Entamoeba histolytica
DRFSNIVIEQLKKEFTKV

SEQ ID NO: 2667577 - protein, 20 aa, Entamoeba histolytica
EIKNAVITCPAYFNDSQRQA

SEQ ID NO: 2667578 - protein, 27 aa, Entamoeba histolytica
ELKEIVKLQMGEVIKVIKKRYPGSEVE

SEQ ID NO: 2667579 - protein, 27 aa, Entamoeba histolytica
GGLGNEKRPIGSFMFLGPSGVGKTELA

SEQ ID NO: 2667580 - protein, 19 aa, Entamoeba histolytica
GSGMCKAGFAGDDAPRAVF

SEQ ID NO: 2667581 - protein, 20 aa, Entamoeba histolytica
IKEKLCYVAEDFNEEMQKAA

SEQ ID NO: 2667582 - protein, 22 aa, Entamoeba histolytica
KESKIPIILFIDEIHTVLGAGA

SEQ ID NO: 2667583 - protein, 18 aa, Entamoeba histolytica
LYPQVVLVDGNGYYHPRR

SEQ ID NO: 2667584 - protein, 17 aa, Entamoeba histolytica
MLSRGELRCIGATTLEE

SEQ ID NO: 2667585 - protein, 23 aa, Entamoeba histolytica
RKRLNQLAIKYKHLYLTNTQILL

SEQ ID NO: 2667586 - protein, 18 aa, Entamoeba histolytica
SVEDTLYILRGIREKYEN

SEQ ID NO: 2667587 - protein, 17 aa, Entamoeba histolytica
EIDINEYLGIIVTEDNR

SEQ ID NO: 2667588 - protein, 18 aa, Entamoeba histolytica
EKYPELYPQVVLVDGNGY

SEQ ID NO: 2667589 - protein, 18 aa, Entamoeba histolytica
FGLQRILGDFTFSNVLSI

SEQ ID NO: 2667590 - protein, 25 aa, Entamoeba histolytica
IIERHPREAIEVFCEIDKTMTEKER

SEQ ID NO: 2667591 - protein, 17 aa, Entamoeba histolytica
IKVIKKRYPGSEVEMTE

SEQ ID NO: 2667592 - protein, 19 aa, Entamoeba histolytica
IVHLINGKVIPNCLGNIWV

SEQ ID NO: 2667593 - protein, 17 aa, Entamoeba histolytica
PRHVSVMAGMGQKDAYV

SEQ ID NO: 2667594 - protein, 23 aa, Entamoeba histolytica
RFRCPEALFQPSFLGMECNGIHE

SEQ ID NO: 2667595 - protein, 23 aa, Entamoeba histolytica
TNEKIYGIGFLFLINDKKTKYDV

SEQ ID NO: 2667596 - protein, 23 aa, Entamoeba histolytica
YKGKSIFPVGLWDEYFILELNLH

SEQ ID NO: 2667597 - protein, 24 aa, Entamoeba histolytica
DNSIEWIKLMQCFIQRKEIDEARK

SEQ ID NO: 2667598 - protein, 24 aa, Entamoeba histolytica
FKTYKWIINLPWEFITSENYPKTI

SEQ ID NO: 2667599 - protein, 17 aa, Entamoeba histolytica
GAYFASSFIEFNKDVAN

SEQ ID NO: 2667600 - protein, 26 aa, Entamoeba histolytica
PAPINARLDYIWGIKNGRERKELKAI

SEQ ID NO: 2667601 - protein, 31 aa, Entamoeba histolytica
PKWPIYPVDGGVCILSRFPIVSQHQKIYTRG

SEQ ID NO: 2667602 - protein, 18 aa, Entamoeba histolytica
PLQYCTFDSWKSTVNPVI

SEQ ID NO: 2667603 - protein, 20 aa, Entamoeba histolytica
TELFRTKANYDLRFNVKLSN

SEQ ID NO: 2667604 - protein, 18 aa, Entamoeba histolytica
YTSITRARFEEINIDLFK

SEQ ID NO: 2667605 - protein, 22 aa, Entamoeba histolytica
CCKECCCPRIKAFKKFINTFEK

SEQ ID NO: 2667606 - protein, 19 aa, Entamoeba histolytica
DKRKEQLLLHRQRLKEMIE

SEQ ID NO: 2667607 - protein, 20 aa, Entamoeba histolytica
EAGFQKSMFERFMANTQIKR

SEQ ID NO: 2667608 - protein, 17 aa, Entamoeba histolytica
EPIRLADLISRKLLRDE

SEQ ID NO: 2667609 - protein, 25 aa, Entamoeba histolytica
FINLLKLKIVLQREWLFDEIDINEY

SEQ ID NO: 2667610 - protein, 22 aa, Entamoeba histolytica
FKEGLKKVAALLASGAKFGGNV

SEQ ID NO: 2667611 - protein, 20 aa, Entamoeba histolytica
FKLNAVRASMEMTFIGNQLL

SEQ ID NO: 2667612 - protein, 17 aa, Entamoeba histolytica
FLLSVLLGNQTATCQTL

SEQ ID NO: 2667613 - protein, 21 aa, Entamoeba histolytica
GESKGKIGIFPSHYVERDVKI

SEQ ID NO: 2667614 - protein, 19 aa, Entamoeba histolytica
GMPPPPPGMPGMPPPPPGM

SEQ ID NO: 2667615 - protein, 17 aa, Entamoeba histolytica
HPAISEFSNKMFYSSKL

SEQ ID NO: 2667616 - protein, 19 aa, Entamoeba histolytica
IGLNFPIVSTTWFPTYIRS

SEQ ID NO: 2667617 - protein, 17 aa, Entamoeba histolytica
IRLADLISRKLLRDEGL

SEQ ID NO: 2667618 - protein, 20 aa, Entamoeba histolytica
IVAFQELFGAFSSKRRIFIE

SEQ ID NO: 2667619 - protein, 23 aa, Entamoeba histolytica
KEGIPPDQQRLIFAGKQLEEGKT

SEQ ID NO: 2667620 - protein, 21 aa, Entamoeba histolytica
KSEEWKNVFDVVNRLPEHMKI

SEQ ID NO: 2667621 - protein, 20 aa, Entamoeba histolytica
LPEHMKIPLNDLLKDLLEER

SEQ ID NO: 2667622 - protein, 23 aa, Entamoeba histolytica
LTNTQILLGIRISRCKILVDNRK

SEQ ID NO: 2667623 - protein, 20 aa, Entamoeba histolytica
NSFKPYAGFIGYARNNNGLV

SEQ ID NO: 2667624 - protein, 24 aa, Entamoeba histolytica
PNAQPPYILVGAIANGFAPSINPE

SEQ ID NO: 2667625 - protein, 18 aa, Entamoeba histolytica
PNVITAWDRNGIDKAVAS

SEQ ID NO: 2667626 - protein, 26 aa, Entamoeba histolytica
PRSSLAIKYGIDIGGGVIDEDYRGEI

SEQ ID NO: 2667627 - protein, 24 aa, Entamoeba histolytica
QLCKGICKRTEYPCLQCMKDAKLR

SEQ ID NO: 2667628 - protein, 21 aa, Entamoeba histolytica
QRILGDFTFSNVLSIVSYDYN

SEQ ID NO: 2667629 - protein, 19 aa, Entamoeba histolytica
REPANFTRRMRILESEVKA

SEQ ID NO: 2667630 - protein, 18 aa, Entamoeba histolytica
RTPPIKIIDTPGFGDTRG

SEQ ID NO: 2667631 - protein, 20 aa, Entamoeba histolytica
STMAGNLKAAFQQRDSTQVV

SEQ ID NO: 2667632 - protein, 22 aa, Entamoeba histolytica
TNTQILLGIRISRCKILVDNRK

SEQ ID NO: 2667633 - protein, 17 aa, Entamoeba histolytica
TTYSCVGIWQNDRVEII

SEQ ID NO: 2667634 - protein, 18 aa, Entamoeba histolytica
VNMHIWKSLNASFKTQVA

SEQ ID NO: 2667635 - protein, 18 aa, Entamoeba histolytica
WSEEDGRCGKFNVGKQNV

SEQ ID NO: 2667636 - protein, 18 aa, Entamoeba histolytica
YFQLPAYSSVSSYSSANE

SEQ ID NO: 2667637 - protein, 25 aa, Entamoeba histolytica
YYGPTRVEGYWKYDSPELQPFTNEN

SEQ ID NO: 2667638 - protein, 17 aa, Entamoeba histolytica
ANYDLRFNVKLSNDDND

SEQ ID NO: 2667639 - protein, 27 aa, Entamoeba histolytica
AVSRAYYPGARWGITRRLVASSLQEKS

SEQ ID NO: 2667640 - protein, 18 aa, Entamoeba histolytica
CANVFVISSSEIKTSQWV

SEQ ID NO: 2667641 - protein, 19 aa, Entamoeba histolytica
CRPTIRLAALSHYPSIFVF

SEQ ID NO: 2667642 - protein, 24 aa, Entamoeba histolytica
CTLTIHWQFDVTLRGLRKVLVTDE

SEQ ID NO: 2667643 - protein, 21 aa, Entamoeba histolytica
CVGIWQNDRVEIIANDQGNRT

SEQ ID NO: 2667644 - protein, 18 aa, Entamoeba histolytica
DAELKLVGQFGLKNKKEI

SEQ ID NO: 2667645 - protein, 26 aa, Entamoeba histolytica
DANETRVAWKIAIERTNGPTLLIMAR

SEQ ID NO: 2667646 - protein, 18 aa, Entamoeba histolytica
DMMNCQYLSFVKEEKPIK

SEQ ID NO: 2667647 - protein, 20 aa, Entamoeba histolytica
EAETSFLYGNHLVKNGISKI

SEQ ID NO: 2667648 - protein, 19 aa, Entamoeba histolytica
ECWIIRNSWGTTWGENGYF

SEQ ID NO: 2667649 - protein, 22 aa, Entamoeba histolytica
EKNKKIHFILGGGFGNRELLIN

SEQ ID NO: 2667650 - protein, 26 aa, Entamoeba histolytica
ELLPHIKGNVGFIFTKGDLYQLKAKL

SEQ ID NO: 2667651 - protein, 23 aa, Entamoeba histolytica
ENAHMYREFGGRINGFKHNEKQK

SEQ ID NO: 2667652 - protein, 26 aa, Entamoeba histolytica
ENIKKMIPCIVNIFIVGDDIQKEFVA

SEQ ID NO: 2667653 - protein, 18 aa, Entamoeba histolytica
ERIFEGTEGVVLANKLLH

SEQ ID NO: 2667654 - protein, 19 aa, Entamoeba histolytica
GAWIGCGAIILPGVTIGEN

SEQ ID NO: 2667655 - protein, 20 aa, Entamoeba histolytica
GCVRSLLLNKCENIEFEIYG

SEQ ID NO: 2667656 - protein, 24 aa, Entamoeba histolytica
GILSIEAFNHFLWCQTTESISDLM

SEQ ID NO: 2667657 - protein, 22 aa, Entamoeba histolytica
GKIMNAGVCQLLHHMRVNSHFS

SEQ ID NO: 2667658 - protein, 20 aa, Entamoeba histolytica
GKTEEITRVISLVNSIQNDM

SEQ ID NO: 2667659 - protein, 19 aa, Entamoeba histolytica
GNGMGRVGVIVKREVHPGS

SEQ ID NO: 2667660 - protein, 20 aa, Entamoeba histolytica
GVEVLKEFINNGGKYLGICA

SEQ ID NO: 2667661 - protein, 19 aa, Entamoeba histolytica
GVPLMRINQRYVIATSQKV

SEQ ID NO: 2667662 - protein, 17 aa, Entamoeba histolytica
HEDNVCGCYFNLQEIIK

SEQ ID NO: 2667663 - protein, 24 aa, Entamoeba histolytica
HVKFPMVHCKPVIASKRFNLPIKA

SEQ ID NO: 2667664 - protein, 17 aa, Entamoeba histolytica
HWMLSKLGGTFAPKPSH

SEQ ID NO: 2667665 - protein, 18 aa, Entamoeba histolytica
ILTTRYFNNNTFYLDTIK

SEQ ID NO: 2667666 - protein, 24 aa, Entamoeba histolytica
INPFKYGAVIDVVYDNGIVYDAKA

SEQ ID NO: 2667667 - protein, 23 aa, Entamoeba histolytica
IPLGSSIIFSSPFAFVVDNQLNC

SEQ ID NO: 2667668 - protein, 17 aa, Entamoeba histolytica
ITRVISLVNSIQNDMNS

SEQ ID NO: 2667669 - protein, 29 aa, Entamoeba histolytica
ITYTFPLSTLMSWGTDSSKTFKNTSTDHK

SEQ ID NO: 2667670 - protein, 17 aa, Entamoeba histolytica
KAICQYIEKEFERKYKR

SEQ ID NO: 2667671 - protein, 19 aa, Entamoeba histolytica
KAKFLEYDRTLLVADPRRC

SEQ ID NO: 2667672 - protein, 21 aa, Entamoeba histolytica
KIYRLGCGDLKNAKTEFDITE

SEQ ID NO: 2667673 - protein, 17 aa, Entamoeba histolytica
KKARMGPMKKDLERQRA

SEQ ID NO: 2667674 - protein, 18 aa, Entamoeba histolytica
KKLLVCASSNNAVDVICS

SEQ ID NO: 2667675 - protein, 18 aa, Entamoeba histolytica
KLRTRKGAKITALDKPAW

SEQ ID NO: 2667676 - protein, 32 aa, Entamoeba histolytica; identical to SEQ ID NO: 2491434

SEQ ID NO: 2667677 - protein, 25 aa, Entamoeba histolytica
KRLLMKRLKTPPAVNIFANHTLDKT

SEQ ID NO: 2667678 - protein, 21 aa, Entamoeba histolytica
KSTTSSICFNPPTPLTHLDSK

SEQ ID NO: 2667679 - protein, 32 aa, Entamoeba histolytica
LEMVVYLPYLCKKLQVPYCIVKGKARLGQLIH

SEQ ID NO: 2667680 - protein, 19 aa, Entamoeba histolytica
LKIKVLIKGNRIGYIHYCD

SEQ ID NO: 2667681 - protein, 20 aa, Entamoeba histolytica
LKRLNAPHHWMLSKLGGTFA

SEQ ID NO: 2667682 - protein, 18 aa, Entamoeba histolytica
LLEGAALLRRLHNLGILP

SEQ ID NO: 2667683 - protein, 18 aa, Entamoeba histolytica
LPKNNYRGKLALKNLKCF

SEQ ID NO: 2667684 - protein, 19 aa, Entamoeba histolytica
LQCMKDAKLRKKDISDVVL

SEQ ID NO: 2667685 - protein, 26 aa, Entamoeba histolytica
MDFFVVLARPGFRVSRRKRMQDKIGR

SEQ ID NO: 2667686 - protein, 19 aa, Entamoeba histolytica
NAYRNMGMVFSKQYDDLNS

SEQ ID NO: 2667687 - protein, 18 aa, Entamoeba histolytica
NGVIKRFGVRHLPRKTHR

SEQ ID NO: 2667688 - protein, 18 aa, Entamoeba histolytica
NSTIPAKKSEIFSTYADN

SEQ ID NO: 2667689 - protein, 22 aa, Entamoeba histolytica
NVNEIDAALVLAKASDKPTLIC

SEQ ID NO: 2667690 - protein, 21 aa, Entamoeba histolytica
PHDRCLISTGIAVQIPHFCYG

SEQ ID NO: 2667691 - protein, 21 aa, Entamoeba histolytica
PNAFNLHSFILVYTSLSSLNN

SEQ ID NO: 2667692 - protein, 17 aa, Entamoeba histolytica
QRKTPKQMRRFAVASCI

SEQ ID NO: 2667693 - protein, 17 aa, Entamoeba histolytica
RARFEEINIDLFKSTIG

SEQ ID NO: 2667694 - protein, 25 aa, Entamoeba histolytica
RDQAECGGCYAFGSIAALEGRLLVE

SEQ ID NO: 2667695 - protein, 17 aa, Entamoeba histolytica
REIAKLNYLNGLKKKYK

SEQ ID NO: 2667696 - protein, 19 aa, Entamoeba histolytica
RKIKERKGPLVVYGNDDLQ

SEQ ID NO: 2667697 - protein, 25 aa, Entamoeba histolytica
RKVGKTGIESINFRKLEEKLNIWKA

SEQ ID NO: 2667698 - protein, 18 aa, Entamoeba histolytica
RNIFTEWVKRENIENETF

SEQ ID NO: 2667699 - protein, 19 aa, Entamoeba histolytica
RRLQTLVYRKGFAKSIHHA

SEQ ID NO: 2667700 - protein, 22 aa, Entamoeba histolytica
SATFPSICTAWDRNGVRINTAV

SEQ ID NO: 2667701 - protein, 21 aa, Entamoeba histolytica
SISDLMIMKNVFVILTNNEYT

SEQ ID NO: 2667702 - protein, 22 aa, Entamoeba histolytica
SVSKIGDYCFKYCTSLESIEIP

SEQ ID NO: 2667703 - protein, 18 aa, Entamoeba histolytica
TACERAKRTLSSASVANI

SEQ ID NO: 2667704 - protein, 17 aa, Entamoeba histolytica
TAIAVCLCKEGKGMIRV

SEQ ID NO: 2667705 - protein, 34 aa, Entamoeba histolytica
TCQTLVFNLTWSWVVSLRGLRKSTLDVIPTPAAN

SEQ ID NO: 2667706 - protein, 21 aa, Entamoeba histolytica
TDHTCKLWPLSISTEEDSKPA

SEQ ID NO: 2667707 - protein, 32 aa, Entamoeba histolytica
TETKLFPSLIFKSSKCVFGGNITSSRGKTVVV

SEQ ID NO: 2667708 - protein, 25 aa, Entamoeba histolytica
TIRKELRGTCEFVMGKNTLIRKAIK

SEQ ID NO: 2667709 - protein, 18 aa, Entamoeba histolytica
VCLCKEGKGMIRVNGVPL

SEQ ID NO: 2667710 - protein, 23 aa, Entamoeba histolytica
VKMKKLLEEYKQVVVVKCDNVGS

SEQ ID NO: 2667711 - protein, 17 aa, Entamoeba histolytica
VNMHIWKSLNASFKTQV

SEQ ID NO: 2667712 - protein, 17 aa, Entamoeba histolytica
VSEHLGWTIENRDVPLD

SEQ ID NO: 2667713 - protein, 23 aa, Entamoeba histolytica
VTCSRNPLFASLQMQIDNKPYPD

SEQ ID NO: 2667714 - protein, 19 aa, Entamoeba histolytica
VVCVAGVSLWGLWTNKKQK

SEQ ID NO: 2667715 - protein, 24 aa, Entamoeba histolytica
VVEMWKKQEIIDGFVDLDGMSVGA

SEQ ID NO: 2667716 - protein, 26 aa, Entamoeba histolytica
VVFLKQCIKSGALIVTGPFKINGVPL

SEQ ID NO: 2667717 - protein, 18 aa, Entamoeba histolytica
WGTGRAVARIPRISGSGS

SEQ ID NO: 2667718 - protein, 17 aa, Entamoeba histolytica
WHPARVSWTVARAGQMG

SEQ ID NO: 2667719 - protein, 18 aa, Entamoeba histolytica
WKKGKLVTRYKCNPLGTA

SEQ ID NO: 2667720 - protein, 19 aa, Entamoeba histolytica
WTVARAGQMGFFKRTEVNK

SEQ ID NO: 2667721 - protein, 26 aa, Entamoeba histolytica
YCIVKGKARLGQLIHRSTAAVVAVTE

SEQ ID NO: 2667722 - protein, 28 aa, Entamoeba histolytica
YQIKPFRKIQCPIVERLVCCMMQHGKNS

SEQ ID NO: 2667723 - protein, 17 aa, Entamoeba histolytica
YTRRYGKGKILITGFHF

SEQ ID NO: 2667724 - protein, 19 aa, Entamoeba histolytica
AAWNPDFLLSVLLGNQTAT

SEQ ID NO: 2667725 - protein, 17 aa, Entamoeba histolytica
ACERAKRTLSSASVANI

SEQ ID NO: 2667726 - protein, 21 aa, Entamoeba histolytica
ACPPLKALIYIMANGEYNGMT

SEQ ID NO: 2667727 - protein, 24 aa, Entamoeba histolytica
AEKPHLTGFLGFKAGMTHVIREVK

SEQ ID NO: 2667728 - protein, 26 aa, Entamoeba histolytica
AEMGKGSFKYAWVLDNLKAERERGIT

SEQ ID NO: 2667729 - protein, 18 aa, Entamoeba histolytica
AFTLEKFAKMWSAKFGID

SEQ ID NO: 2667730 - protein, 17 aa, Entamoeba histolytica
AILNRYKVLKAHGMKVV

SEQ ID NO: 2667731 - protein, 20 aa, Entamoeba histolytica
AKKLEVLKNMKFDEALLEGF

SEQ ID NO: 2667732 - protein, 21 aa, Entamoeba histolytica
AKRTTWPRVRGVAMNPVDHPH

SEQ ID NO: 2667733 - protein, 27 aa, Entamoeba histolytica
ALKKMRAHRGLRHYWGLRVRGQHTKTT

SEQ ID NO: 2667734 - protein, 25 aa, Entamoeba histolytica
AMLKEAKRYAAILNRYKVLKAHGMK

SEQ ID NO: 2667735 - protein, 19 aa, Entamoeba histolytica
CATIAYTLFTKHMKFDVKD

SEQ ID NO: 2667736 - protein, 19 aa, Entamoeba histolytica
CDEKGPLMMYVSKMIPTND

SEQ ID NO: 2667737 - protein, 22 aa, Entamoeba histolytica
CDRKKIMLHMIHIYKEKKEVEE

SEQ ID NO: 2667738 - protein, 22 aa, Entamoeba histolytica
CFKECTRLSIIFIPTSVSEIGN

SEQ ID NO: 2667739 - protein, 25 aa, Entamoeba histolytica
CGIKRKVKEPCFVFHYNTRETLIIE

SEQ ID NO: 2667740 - protein, 19 aa, Entamoeba histolytica
CGPHYKVAHDISLLIPEIW

SEQ ID NO: 2667741 - protein, 17 aa, Entamoeba histolytica
CGYARDCYHTQRMQKVF

SEQ ID NO: 2667742 - protein, 20 aa, Entamoeba histolytica
CKASIDISKCHLKKIIISNY

SEQ ID NO: 2667743 - protein, 20 aa, Entamoeba histolytica
CRYGIIKRRALRLENGNFSW

SEQ ID NO: 2667744 - protein, 17 aa, Entamoeba histolytica
DAKLRKKDISDVVLVGG

SEQ ID NO: 2667745 - protein, 17 aa, Entamoeba histolytica
DKCIRIYNEWCGYARDC

SEQ ID NO: 2667746 - protein, 23 aa, Entamoeba histolytica
DLHPWDVKFCDDLEKDMLFEMLK

SEQ ID NO: 2667747 - protein, 19 aa, Entamoeba histolytica
DLYLKGIGKESSYTLMTYQ

SEQ ID NO: 2667748 - protein, 25 aa, Entamoeba histolytica
DMLFEMLKAATFMNIDMLVEATAKT

SEQ ID NO: 2667749 - protein, 21 aa, Entamoeba histolytica
DVDEARKIWCFGPDNCGPNLF

SEQ ID NO: 2667750 - protein, 21 aa, Entamoeba histolytica
DVGVIRRIFERIVKQKLSTKT

SEQ ID NO: 2667751 - protein, 17 aa, Entamoeba histolytica
DVRCRYGIIKRRALRLE

SEQ ID NO: 2667752 - protein, 24 aa, Entamoeba histolytica
DYITKFIIECCQKMSEPIKQENDI

SEQ ID NO: 2667753 - protein, 17 aa, Entamoeba histolytica
DYQRKAIYNALNEDISL

SEQ ID NO: 2667754 - protein, 19 aa, Entamoeba histolytica
DYQTCSVLSCVEQQSQDIA

SEQ ID NO: 2667755 - protein, 20 aa, Entamoeba histolytica
EELDYKPGIYTQWEAAYKHE

SEQ ID NO: 2667756 - protein, 26 aa, Entamoeba histolytica
EFTQMFWKLGMKNFDDFISKLVKLPR

SEQ ID NO: 2667757 - protein, 18 aa, Entamoeba histolytica
EGEILTGYIIKSSEEEGV

SEQ ID NO: 2667758 - protein, 20 aa, Entamoeba histolytica
EGKELLKTVMKLWLPAGVTL

SEQ ID NO: 2667759 - protein, 18 aa, Entamoeba histolytica
EGVGKTCLVRQFVNKKNK

SEQ ID NO: 2667760 - protein, 20 aa, Entamoeba histolytica
EHPLMYPDFVIGDRDKNADL

SEQ ID NO: 2667761 - protein, 22 aa, Entamoeba histolytica
EIGKGCFNRCYSLRSIEIPTSV

SEQ ID NO: 2667762 - protein, 33 aa, Entamoeba histolytica
EKEKMAVPFLLRCCSDCANALLYLSQHNIIHRN

SEQ ID NO: 2667763 - protein, 19 aa, Entamoeba histolytica
EKFIGDCGVAVGMHSFGAS

SEQ ID NO: 2667764 - protein, 22 aa, Entamoeba histolytica
ELDKRLGEEGSFYKENNKRQKK

SEQ ID NO: 2667765 - protein, 20 aa, Entamoeba histolytica
ELTVTIPVSTEWRGAMRHIG

SEQ ID NO: 2667766 - protein, 19 aa, Entamoeba histolytica
EMIVLHLPSPVVAQKYRTS

SEQ ID NO: 2667767 - protein, 24 aa, Entamoeba histolytica
ENAEGKRTTPSCVSFTPTGILVGE

SEQ ID NO: 2667768 - protein, 18 aa, Entamoeba histolytica
EPSLMLIGSLCYSLEASF

SEQ ID NO: 2667769 - protein, 17 aa, Entamoeba histolytica
EPTRSWVSLYMRPVVVP

SEQ ID NO: 2667770 - protein, 22 aa, Entamoeba histolytica
ERKDFKDPFFFKKNKIKKSKKV

SEQ ID NO: 2667771 - protein, 24 aa, Entamoeba histolytica
ESCSCLSCGLTNCCFKNQYHRKMI

SEQ ID NO: 2667772 - protein, 18 aa, Entamoeba histolytica
ETKVFDLNAICFVASSSN

SEQ ID NO: 2667773 - protein, 29 aa, Entamoeba histolytica
EVIELPIKHPELFESLGIAQPKGVLLYGP

SEQ ID NO: 2667774 - protein, 18 aa, Entamoeba histolytica
EVQLLCYPKGISQSETCK

SEQ ID NO: 2667775 - protein, 24 aa, Entamoeba histolytica
EYIKIPLKEAEEIYIVSMKDYIFE

SEQ ID NO: 2667776 - protein, 24 aa, Entamoeba histolytica
FDNRIINFFPDYTNPIMFINCDGT

SEQ ID NO: 2667777 - protein, 19 aa, Entamoeba histolytica
FENTRQLLISRFKDVNKYI

SEQ ID NO: 2667778 - protein, 27 aa, Entamoeba histolytica
FEVIIPLDDLLPFAAMKMFPNGIFGNL

SEQ ID NO: 2667779 - protein, 18 aa, Entamoeba histolytica
FPSLQFIHPINNGFLCFE

SEQ ID NO: 2667780 - protein, 20 aa, Entamoeba histolytica
FSTIIPEIDEPWYLKFNNSA

SEQ ID NO: 2667781 - protein, 22 aa, Entamoeba histolytica
FTDIAKAFGVSSIFNIKEFKEF

SEQ ID NO: 2667782 - protein, 17 aa, Entamoeba histolytica
FTITDGSLRYCRTNING

SEQ ID NO: 2667783 - protein, 17 aa, Entamoeba histolytica
FTTRLNNVFVIGKGTET

SEQ ID NO: 2667784 - protein, 25 aa, Entamoeba histolytica
GDIFLLKEVKAFIDKKEKMIIEIYH

SEQ ID NO: 2667785 - protein, 25 aa, Entamoeba histolytica
GFGRIGRLVARVVLERKDFELVAIN

SEQ ID NO: 2667786 - protein, 19 aa, Entamoeba histolytica
GKDCLMIFHGLKLTTDKLR

SEQ ID NO: 2667787 - protein, 18 aa, Entamoeba histolytica
GKFKLHITALPYLAQYCS

SEQ ID NO: 2667788 - protein, 26 aa, Entamoeba histolytica
GKLEPRFIYEGEIFLAAGEKALLVPI

SEQ ID NO: 2667789 - protein, 18 aa, Entamoeba histolytica
GKNGEGWIYINGKTYSPS

SEQ ID NO: 2667790 - protein, 17 aa, Entamoeba histolytica
GKPLLPLPAKRLPKQPR

SEQ ID NO: 2667791 - protein, 19 aa, Entamoeba histolytica
GNMVSCLDFVESVFGNAGN

SEQ ID NO: 2667792 - protein, 20 aa, Entamoeba histolytica
GNNCFRECSSLQSIDIPTSV

SEQ ID NO: 2667793 - protein, 19 aa, Entamoeba histolytica
GTIDVCVYYSIKMLHSQYQ

SEQ ID NO: 2667794 - protein, 27 aa, Entamoeba histolytica
GTVAFGSGLHGWAFTLEKFAKMWSAKF

SEQ ID NO: 2667795 - protein, 20 aa, Entamoeba histolytica
GVEVLKEFINDGGKYLGICA

SEQ ID NO: 2667796 - protein, 21 aa, Entamoeba histolytica
GYCKKEVKTQISYSANLYGFA

SEQ ID NO: 2667797 - protein, 19 aa, Entamoeba histolytica
GYEYLIKQVELIEDAHYNV

SEQ ID NO: 2667798 - protein, 22 aa, Entamoeba histolytica
HASDFCRRRLAIVVKAKKMVTD

SEQ ID NO: 2667799 - protein, 21 aa, Entamoeba histolytica
HFCYGRVAPRSSLAIKYGIDI

SEQ ID NO: 2667800 - protein, 29 aa, Entamoeba histolytica
HGERTIKIFLIRWKNNFHYVPDEKVPLTT

SEQ ID NO: 2667801 - protein, 19 aa, Entamoeba histolytica
HHFFPCANVFVISSSEIKT

SEQ ID NO: 2667802 - protein, 17 aa, Entamoeba histolytica
HLIEILKEYLNDYEEQI

SEQ ID NO: 2667803 - protein, 19 aa, Entamoeba histolytica
HNNPIIKYQLEEINGIRNE

SEQ ID NO: 2667804 - protein, 20 aa, Entamoeba histolytica
IDNPWYLKFNNSAIYDDNTE

SEQ ID NO: 2667805 - protein, 30 aa, Entamoeba histolytica; identical to SEQ ID NO: 2473445

SEQ ID NO: 2667806 - protein, 18 aa, Entamoeba histolytica
IINKMIIHISSSINKERK

SEQ ID NO: 2667807 - protein, 18 aa, Entamoeba histolytica
IKDMKFSVSPVVRVAVET

SEQ ID NO: 2667808 - protein, 27 aa, Entamoeba histolytica
IKGTLHLPRKSAFLLGKYEDVIFEQST

SEQ ID NO: 2667809 - protein, 23 aa, Entamoeba histolytica
IKMLRLVDPYVTYGYPTLETVQK

SEQ ID NO: 2667810 - protein, 19 aa, Entamoeba histolytica
IKQSDGFILIYSITSKESF

SEQ ID NO: 2667811 - protein, 19 aa, Entamoeba histolytica
IKSCFTITDGSLRYCRTNI

SEQ ID NO: 2667812 - protein, 21 aa, Entamoeba histolytica
IKVRVGRGIVVGGFQGSDAAD

SEQ ID NO: 2667813 - protein, 17 aa, Entamoeba histolytica
IKYKHLYLTNTQILLGI

SEQ ID NO: 2667814 - protein, 25 aa, Entamoeba histolytica
ILLNPHFVKLVSWYDNEWGYSNRLV

SEQ ID NO: 2667815 - protein, 29 aa, Entamoeba histolytica
INDRCPIMLVCQDCFWRCTVQGGCEYICN

SEQ ID NO: 2667816 - protein, 31 aa, Entamoeba histolytica
INGKVIPNCLGNIWVYVRDWSEEDGRCGKFN

SEQ ID NO: 2667817 - protein, 24 aa, Entamoeba histolytica
IPCARRCCFACVLTGAPSLLEPMY

SEQ ID NO: 2667818 - protein, 22 aa, Entamoeba histolytica
IPLGSSIIFSSPFAFVVDNQLN

SEQ ID NO: 2667819 - protein, 21 aa, Entamoeba histolytica
IPPHLKSLIINSCKASIDISK

SEQ ID NO: 2667820 - protein, 19 aa, Entamoeba histolytica
IPRDISVVPDIHIEENTQT

SEQ ID NO: 2667821 - protein, 18 aa, Entamoeba histolytica
IPSAAALILKALKEPPKD

SEQ ID NO: 2667822 - protein, 20 aa, Entamoeba histolytica
IPVSTEWRGAMRHIGGRDYS

SEQ ID NO: 2667823 - protein, 18 aa, Entamoeba histolytica
IQRLFKKKYVETISSINI

SEQ ID NO: 2667824 - protein, 18 aa, Entamoeba histolytica
IRIKFMIDGAKGISYLHS

SEQ ID NO: 2667825 - protein, 26 aa, Entamoeba histolytica
ISEIAESIGQVFIREGWGCLTMNSKI

SEQ ID NO: 2667826 - protein, 23 aa, Entamoeba histolytica
ISIKTRNPIVFSFHPSALKCSIM

SEQ ID NO: 2667827 - protein, 20 aa, Entamoeba histolytica
ITEKGITPMGGFPHYGVVKN

SEQ ID NO: 2667828 - protein, 18 aa, Entamoeba histolytica
ITPMGGFPHYGVVKNDFL

SEQ ID NO: 2667829 - protein, 18 aa, Entamoeba histolytica
IVSTTWFPTYIRSNIDQD

SEQ ID NO: 2667830 - protein, 20 aa, Entamoeba histolytica
IYNEWCGYARDCYHTQRMQK

SEQ ID NO: 2667831 - protein, 18 aa, Entamoeba histolytica
KAIRGMLPKNNYRGKLAL

SEQ ID NO: 2667832 - protein, 24 aa, Entamoeba histolytica
KALASELFSKWLTRNSRLSRSSIY

SEQ ID NO: 2667833 - protein, 26 aa, Entamoeba histolytica
KDKFWEMTDGKSLFDPSARLDVSLIR

SEQ ID NO: 2667834 - protein, 26 aa, Entamoeba histolytica
KEHKKKWRMCHSFKDYKKKEMKKASR

SEQ ID NO: 2667835 - protein, 17 aa, Entamoeba histolytica
KELERKRMLLINENRMN

SEQ ID NO: 2667836 - protein, 17 aa, Entamoeba histolytica
KEYKNRFIIKDKKKEEE

SEQ ID NO: 2667837 - protein, 17 aa, Entamoeba histolytica
KGKRIAIKGNLKVDNND

SEQ ID NO: 2667838 - protein, 19 aa, Entamoeba histolytica
KGRFYAFGRVFSGTIRTGG

SEQ ID NO: 2667839 - protein, 28 aa, Entamoeba histolytica
KGVSTLMNFRVCFIKSISLQVSIDNGSN

SEQ ID NO: 2667840 - protein, 19 aa, Entamoeba histolytica
KINAIAIVHLINGKVIPNC

SEQ ID NO: 2667841 - protein, 23 aa, Entamoeba histolytica
KITSFKTGYIYYFININNNNNYN

SEQ ID NO: 2667842 - protein, 19 aa, Entamoeba histolytica
KKAIYCPTTSVLDPYEFTI

SEQ ID NO: 2667843 - protein, 18 aa, Entamoeba histolytica
KKGDRVALLIIEKIKQCK

SEQ ID NO: 2667844 - protein, 18 aa, Entamoeba histolytica
KKYVETISSINIKLVGMI

SEQ ID NO: 2667845 - protein, 18 aa, Entamoeba histolytica
KLPFQHLVREIAQQSKSD

SEQ ID NO: 2667846 - protein, 17 aa, Entamoeba histolytica
KNLKIALLEKARDVSTG

SEQ ID NO: 2667847 - protein, 19 aa, Entamoeba histolytica
KPTRRSCVTEQFFRINSIE

SEQ ID NO: 2667848 - protein, 25 aa, Entamoeba histolytica
KRTMLKTQYRMHPAISEFSNKMFYS

SEQ ID NO: 2667849 - protein, 22 aa, Entamoeba histolytica
KTLYYGSRWGVVRQLDAASMME

SEQ ID NO: 2667850 - protein, 18 aa, Entamoeba histolytica
KTVKPRKITKISMVKDKK

SEQ ID NO: 2667851 - protein, 22 aa, Entamoeba histolytica
KVVDFYFHRNLLYMVMEYHPSD

SEQ ID NO: 2667852 - protein, 20 aa, Entamoeba histolytica
KWISRDRFVLSNGHGSSLLY

SEQ ID NO: 2667853 - protein, 28 aa, Entamoeba histolytica
LAKSTLAWKGLRVTVRITVVNRVATYEV

SEQ ID NO: 2667854 - protein, 25 aa, Entamoeba histolytica
LEGFQSGRVLACISSRPGQTGSVEG

SEQ ID NO: 2667855 - protein, 22 aa, Entamoeba histolytica
LGMICCGYSGFVSSASYCGPHY

SEQ ID NO: 2667856 - protein, 19 aa, Entamoeba histolytica
LIINSCKASIDISKCHLKK

SEQ ID NO: 2667857 - protein, 26 aa, Entamoeba histolytica
LINPPVLRIKVFEPLFIVGKENYAKL

SEQ ID NO: 2667858 - protein, 26 aa, Entamoeba histolytica
LKEIVKLQMGEVIKVIKKRYPGSEVE

SEQ ID NO: 2667859 - protein, 18 aa, Entamoeba histolytica
LKRGYPVHTMKTAKRHYG

SEQ ID NO: 2667860 - protein, 25 aa, Entamoeba histolytica
LKTVMKLWLPAGVTLLEMIVLHLPS

SEQ ID NO: 2667861 - protein, 26 aa, Entamoeba histolytica
LKVEGAVLEKVIQWLLFHNEHPLMYP

SEQ ID NO: 2667862 - protein, 17 aa, Entamoeba histolytica
LLLHRQRLKEMIESAED

SEQ ID NO: 2667863 - protein, 24 aa, Entamoeba histolytica
LLREMSLMYSDRVVQFITDNYRYF

SEQ ID NO: 2667864 - protein, 21 aa, Entamoeba histolytica
LLSEPSCSVGEVIRAVGKDKV

SEQ ID NO: 2667865 - protein, 26 aa, Entamoeba histolytica
LLSSKSCLSLKFANNGKLEPRFIYEG

SEQ ID NO: 2667866 - protein, 23 aa, Entamoeba histolytica
LNHPNILKLFGFFEDKNRWFLVL

SEQ ID NO: 2667867 - protein, 24 aa, Entamoeba histolytica
LPHGRCVAVLLPHVIRYNGQKPRK

SEQ ID NO: 2667868 - protein, 26 aa, Entamoeba histolytica
LRLQECREKGILPWLRPDSKSQVTLE

SEQ ID NO: 2667869 - protein, 21 aa, Entamoeba histolytica
LSRSSIYLIFLGVNDKIITKR

SEQ ID NO: 2667870 - protein, 17 aa, Entamoeba histolytica
LTTRYFNNNTFYLDTIK

SEQ ID NO: 2667871 - protein, 17 aa, Entamoeba histolytica
MKGILGYTEDLVVSSDF

SEQ ID NO: 2667872 - protein, 21 aa, Entamoeba histolytica
MKITCSLAKILLKDLEKKELI

SEQ ID NO: 2667873 - protein, 21 aa, Entamoeba histolytica
MKLRPLSVFAPLHYFELPELL

SEQ ID NO: 2667874 - protein, 18 aa, Entamoeba histolytica
MWPKYNFYKADQRYMELA

SEQ ID NO: 2667875 - protein, 17 aa, Entamoeba histolytica
NDIGLIINEMIGKNDKE

SEQ ID NO: 2667876 - protein, 23 aa, Entamoeba histolytica
NDLMKIRMNDMFSKYLPTKPFSC

SEQ ID NO: 2667877 - protein, 25 aa, Entamoeba histolytica
NGAFLSYGTVCFVKEKLCENDDGIQ

SEQ ID NO: 2667878 - protein, 31 aa, Entamoeba histolytica
NITYTFPLSTLMSWGTDSSKTFKNTSTDHKM

SEQ ID NO: 2667879 - protein, 27 aa, Entamoeba histolytica
NKINELKLQFGDFIPRNVRTQIKDLTE

SEQ ID NO: 2667880 - protein, 31 aa, Entamoeba histolytica
NKSIKFNCQWYITVHFDRYICTPIEEEQTMN

SEQ ID NO: 2667881 - protein, 24 aa, Entamoeba histolytica
NLLKLKIELQREWLFDEIDINEYL

SEQ ID NO: 2667882 - protein, 23 aa, Entamoeba histolytica
NLLPSRHFGALVLTTSYGILDNT

SEQ ID NO: 2667883 - protein, 23 aa, Entamoeba histolytica
NMLPCGLYKFPVRNTTDLEMIMM

SEQ ID NO: 2667884 - protein, 24 aa, Entamoeba histolytica
NNIEFKTKCPINKLTIIESKEVSI

SEQ ID NO: 2667885 - protein, 20 aa, Entamoeba histolytica
NQNCWEFYERPPFYLTTPAT

SEQ ID NO: 2667886 - protein, 19 aa, Entamoeba histolytica
NRVNYYLTREEELLSDKSY

SEQ ID NO: 2667887 - protein, 31 aa, Entamoeba histolytica
NTNYKSFCNCFKRVKIFKALISLSIGEINVE

SEQ ID NO: 2667888 - protein, 25 aa, Entamoeba histolytica
NVRAYLPVCESFGFTADLRSHTSGQ

SEQ ID NO: 2667889 - protein, 18 aa, Entamoeba histolytica
PAQIGWGALGVDYVVEST

SEQ ID NO: 2667890 - protein, 25 aa, Entamoeba histolytica
PFGLQRILGDFTFSNVLSIVSYDYN

SEQ ID NO: 2667891 - protein, 23 aa, Entamoeba histolytica
PGDKTAPVLLKYVDEIVTVDEES

SEQ ID NO: 2667892 - protein, 20 aa, Entamoeba histolytica
PIGQCPEGTVVCNVESKPGD

SEQ ID NO: 2667893 - protein, 19 aa, Entamoeba histolytica
PKIAFLRMLKAAFYGAPDD

SEQ ID NO: 2667894 - protein, 18 aa, Entamoeba histolytica
PKLIVAIRIRGINGVSPK

SEQ ID NO: 2667895 - protein, 29 aa, Entamoeba histolytica
PKTYMKLEYCVSCGIHGRVVRVRSRTDRR

SEQ ID NO: 2667896 - protein, 19 aa, Entamoeba histolytica
PPNIYKLLCELVGDISITI

SEQ ID NO: 2667897 - protein, 24 aa, Entamoeba histolytica
PSGKDWRAGRCACANIIPASTGAA

SEQ ID NO: 2667898 - protein, 25 aa, Entamoeba histolytica
QAIRMWTCNIFPTLVSSEVKEDEDR

SEQ ID NO: 2667899 - protein, 19 aa, Entamoeba histolytica
QCQCGKHFCNGKIMNAGVC

SEQ ID NO: 2667900 - protein, 19 aa, Entamoeba histolytica
QLYFAYRFLALGTIEEKKI

SEQ ID NO: 2667901 - protein, 24 aa, Entamoeba histolytica
QPANTRLGAIRVHDVRCRYGIIKR

SEQ ID NO: 2667902 - protein, 20 aa, Entamoeba histolytica
QTIRLLACEMINKAKSGHPG

SEQ ID NO: 2667903 - protein, 23 aa, Entamoeba histolytica
QVTWSELNIPYSEETTLVKSSHA

SEQ ID NO: 2667904 - protein, 17 aa, Entamoeba histolytica
RALRLENGNFSWASQSI

SEQ ID NO: 2667905 - protein, 20 aa, Entamoeba histolytica
REACGFSAYERHMMDLLRRG

SEQ ID NO: 2667906 - protein, 17 aa, Entamoeba histolytica
REKRKSLILSLLKENDT

SEQ ID NO: 2667907 - protein, 22 aa, Entamoeba histolytica
RKEGKRVICISPDIQTITEKEN

SEQ ID NO: 2667908 - protein, 19 aa, Entamoeba histolytica
RKLAMWPKYNFYKADQRYM

SEQ ID NO: 2667909 - protein, 28 aa, Entamoeba histolytica
RKTHRGLRKVACVGAWHPARVSWTVARA

SEQ ID NO: 2667910 - protein, 21 aa, Entamoeba histolytica
RLAALSHYPSIFVFTHDSIGV

SEQ ID NO: 2667911 - protein, 18 aa, Entamoeba histolytica
RNKIAGFITHLMRRIQKG

SEQ ID NO: 2667912 - protein, 17 aa, Entamoeba histolytica
RRFCLVPLTAEQAKFKL

SEQ ID NO: 2667913 - protein, 18 aa, Entamoeba histolytica
RRYGKGKILITGFHFEFD

SEQ ID NO: 2667914 - protein, 17 aa, Entamoeba histolytica
RTTVGVFHICQSDVPVP

SEQ ID NO: 2667915 - protein, 20 aa, Entamoeba histolytica
RYKVLKAHGMKVVSFADTDA

SEQ ID NO: 2667916 - protein, 18 aa, Entamoeba histolytica
SCFYGCSSLTTISIEDVK

SEQ ID NO: 2667917 - protein, 17 aa, Entamoeba histolytica
SEGEMKGILGYTEDLVV

SEQ ID NO: 2667918 - protein, 23 aa, Entamoeba histolytica
SGCTRLKTITIFTSVSKIGSSCF

SEQ ID NO: 2667919 - protein, 26 aa, Entamoeba histolytica
SGKVWRMRASCVTFVSLVKVGAMTDL

SEQ ID NO: 2667920 - protein, 25 aa, Entamoeba histolytica
SGQAFPQCVFDHWQLLNGDVTDATS

SEQ ID NO: 2667921 - protein, 17 aa, Entamoeba histolytica
SGVPLIVTEPVVSFRET

SEQ ID NO: 2667922 - protein, 24 aa, Entamoeba histolytica
SINECTVEWNIKGEITPKEISNFY

SEQ ID NO: 2667923 - protein, 20 aa, Entamoeba histolytica
SKFAKTILHRLCLSRVNRPI

SEQ ID NO: 2667924 - protein, 19 aa, Entamoeba histolytica
SLECNELDPSFVNNYNPEI

SEQ ID NO: 2667925 - protein, 25 aa, Entamoeba histolytica
SMAVSKAEHKICCVKTAKTMADGIA

SEQ ID NO: 2667926 - protein, 24 aa, Entamoeba histolytica
SSPLEIVEAYNFVRCQSSWRNPTT

SEQ ID NO: 2667927 - protein, 22 aa, Entamoeba histolytica
SVIEIGGWCFNECKSLTSINIS

SEQ ID NO: 2667928 - protein, 21 aa, Entamoeba histolytica
SVMPEDFLKPELQDLAIYADS

SEQ ID NO: 2667929 - protein, 30 aa, Entamoeba histolytica; identical to SEQ ID NO: 2505811

SEQ ID NO: 2667930 - protein, 24 aa, Entamoeba histolytica
SYRPPEIWFGAIIYGPAVDVWSIG

SEQ ID NO: 2667931 - protein, 19 aa, Entamoeba histolytica
TAVEMLRRNAIFNMNGKIV

SEQ ID NO: 2667932 - protein, 23 aa, Entamoeba histolytica
TDLSFDICAACIKSSERFVQLGV

SEQ ID NO: 2667933 - protein, 21 aa, Entamoeba histolytica
TELFRTKANYDLRFNVKLSND

SEQ ID NO: 2667934 - protein, 19 aa, Entamoeba histolytica
TELLLRKLPFQHLVREIAQ

SEQ ID NO: 2667935 - protein, 19 aa, Entamoeba histolytica
TKCKYKLQKCLKRCKHFEL

SEQ ID NO: 2667936 - protein, 19 aa, Entamoeba histolytica
TKEVPSMKVITPAVVADRM

SEQ ID NO: 2667937 - protein, 24 aa, Entamoeba histolytica
TKKKEKRKDCILVAKTNERFVDVF

SEQ ID NO: 2667938 - protein, 24 aa, Entamoeba histolytica
TLCICLLSRWCRITIKKPTRRSCV

SEQ ID NO: 2667939 - protein, 18 aa, Entamoeba histolytica
TLQRRIIIQTGKSSSEKN

SEQ ID NO: 2667940 - protein, 22 aa, Entamoeba histolytica
TNEKIYGIGFLFLINDKKTKYD

SEQ ID NO: 2667941 - protein, 17 aa, Entamoeba histolytica
TRLNNVFVIGKGTETLV

SEQ ID NO: 2667942 - protein, 24 aa, Entamoeba histolytica
TSFGKGCFYGCGCEELLKKNARIP

SEQ ID NO: 2667943 - protein, 27 aa, Entamoeba histolytica
TVDEWRRMCFCFVINRVNYYLTRQELL

SEQ ID NO: 2667944 - protein, 25 aa, Entamoeba histolytica
TYESVKGWLKDVGYYAPKDIIKYLV

SEQ ID NO: 2667945 - protein, 17 aa, Entamoeba histolytica
VALEFVWEITRKHERIF

SEQ ID NO: 2667946 - protein, 19 aa, Entamoeba histolytica
VCGCYFNLQEIIKAPNNTI

SEQ ID NO: 2667947 - protein, 23 aa, Entamoeba histolytica
VDRSGAYCARWIAKSLVHAGLCH

SEQ ID NO: 2667948 - protein, 17 aa, Entamoeba histolytica
VGKLTFPLVSDIKRCIS

SEQ ID NO: 2667949 - protein, 19 aa, Entamoeba histolytica
VKVPKNFKRRTVGQIVVNK

SEQ ID NO: 2667950 - protein, 18 aa, Entamoeba histolytica
VLKRKWGSYGNIHNNQYY

SEQ ID NO: 2667951 - protein, 19 aa, Entamoeba histolytica
VMAREVIKYLYKVDMSEMK

SEQ ID NO: 2667952 - protein, 22 aa, Entamoeba histolytica
VMIRPASKVICEFLNVMMKHQY

SEQ ID NO: 2667953 - protein, 18 aa, Entamoeba histolytica
VMSRRRGKIISEEQRPGT

SEQ ID NO: 2667954 - protein, 24 aa, Entamoeba histolytica
VNSLGEYCFYGLKSINIPSTISKI

SEQ ID NO: 2667955 - protein, 19 aa, Entamoeba histolytica
VPIHIGIDLGTTYSSIAIY

SEQ ID NO: 2667956 - protein, 27 aa, Entamoeba histolytica
VSDRMMYKLGYVDRVMDVLKRRSNEVE

SEQ ID NO: 2667957 - protein, 18 aa, Entamoeba histolytica
VVVPGVKGVKGFEHEKAT

SEQ ID NO: 2667958 - protein, 20 aa, Entamoeba histolytica
VYSFLKKRCNEMYLFDIQRG

SEQ ID NO: 2667959 - protein, 17 aa, Entamoeba histolytica
WCFNECKSLTSINISTS

SEQ ID NO: 2667960 - protein, 21 aa, Entamoeba histolytica
WCFSECKSLRTITIPTSVIEI

SEQ ID NO: 2667961 - protein, 17 aa, Entamoeba histolytica
WKTYCTEVDAVIYIVDC

SEQ ID NO: 2667962 - protein, 17 aa, Entamoeba histolytica
WTGHSGMAILAPHLTRM

SEQ ID NO: 2667963 - protein, 37 aa, Entamoeba histolytica; identical to SEQ ID NO: 2474485

SEQ ID NO: 2667964 - protein, 19 aa, Entamoeba histolytica
AAIHSLKVNPWFTSEKDVN

SEQ ID NO: 2667965 - protein, 26 aa, Entamoeba histolytica
AAVNCPLLKLYQSFCFMIQGNTEKAL

SEQ ID NO: 2667966 - protein, 22 aa, Entamoeba histolytica
AEADIYFKPIIELKEVEQKEME

SEQ ID NO: 2667967 - protein, 17 aa, Entamoeba histolytica
AEIPEWAEVNFDAKSFI

SEQ ID NO: 2667968 - protein, 18 aa, Entamoeba histolytica
AEKMKNWLCVLAGDVTPL

SEQ ID NO: 2667969 - protein, 22 aa, Entamoeba histolytica
AEPISRLKSIKGFINGIEQLGF

SEQ ID NO: 2667970 - protein, 19 aa, Entamoeba histolytica
AEQTILHYVCNTFTSDASF

SEQ ID NO: 2667971 - protein, 22 aa, Entamoeba histolytica
AERLKGTCGLCFTNKKKEEILA

SEQ ID NO: 2667972 - protein, 19 aa, Entamoeba histolytica
AETSFLYGNHLVKNGISKI

SEQ ID NO: 2667973 - protein, 24 aa, Entamoeba histolytica
AFQRGEVIGVFNFHYEKSFTGYGI

SEQ ID NO: 2667974 - protein, 19 aa, Entamoeba histolytica
AFSGFKIPVAKGRKYVRLD

SEQ ID NO: 2667975 - protein, 24 aa, Entamoeba histolytica
AFTKTSACMSICLSATKDVIFTGH

SEQ ID NO: 2667976 - protein, 27 aa, Entamoeba histolytica
AGCYNNCNFDVFLLCFSVTQRSSFRNI

SEQ ID NO: 2667977 - protein, 25 aa, Entamoeba histolytica
AGDLPRLLKHLSIVRKTNENEISCL

SEQ ID NO: 2667978 - protein, 22 aa, Entamoeba histolytica
AGIKSEGCIKFYSINSDGQLTE

SEQ ID NO: 2667979 - protein, 24 aa, Entamoeba histolytica
AGILANKHHLCWTDRRGVHEPNYY

SEQ ID NO: 2667980 - protein, 18 aa, Entamoeba histolytica
AGIRYFDFRVVYNHKLKK

SEQ ID NO: 2667981 - protein, 25 aa, Entamoeba histolytica
AGKGRTGLMSACFLVYMLDSLNAHE

SEQ ID NO: 2667982 - protein, 18 aa, Entamoeba histolytica
AHSNVDVPVIKRVEYSLQ

SEQ ID NO: 2667983 - protein, 19 aa, Entamoeba histolytica
AIRHKLKIINILNDDGTMN

SEQ ID NO: 2667984 - protein, 24 aa, Entamoeba histolytica
AIRMWTCNIFPTLVSSEVKEDEDR

SEQ ID NO: 2667985 - protein, 20 aa, Entamoeba histolytica
AISDLSLRFGEGSRKKKVMS

SEQ ID NO: 2667986 - protein, 17 aa, Entamoeba histolytica
AKGSCLIQKENSKVISS

SEQ ID NO: 2667987 - protein, 17 aa, Entamoeba histolytica
AKLYYERQFHHSIPAIL

SEQ ID NO: 2667988 - protein, 19 aa, Entamoeba histolytica
AKNGVGIVKLMGRDAGFIA

SEQ ID NO: 2667989 - protein, 17 aa, Entamoeba histolytica
AKPLISIASDFIPGGEI

SEQ ID NO: 2667990 - protein, 22 aa, Entamoeba histolytica
AKRIKESGGMIINGRVSGDVAV

SEQ ID NO: 2667991 - protein, 40 aa, Entamoeba histolytica
ALHYCDRAGIIVIRVGSTFDLKRLCRVTGATPFISLTTEC

SEQ ID NO: 2667992 - protein, 19 aa, Entamoeba histolytica
APNFKEMYLFGDFNNWDRA

SEQ ID NO: 2667993 - protein, 26 aa, Entamoeba histolytica
AQCKGLNCAFGRWPVKSAQFILKLLK

SEQ ID NO: 2667994 - protein, 24 aa, Entamoeba histolytica
AQDLAKREGFEFIETSTKSNNNVD

SEQ ID NO: 2667995 - protein, 26 aa, Entamoeba histolytica
AQKFPSPRLGLIEVIKGDPAKQNVNT

SEQ ID NO: 2667996 - protein, 19 aa, Entamoeba histolytica
AQLECKIKEMMKKNSEKDP

SEQ ID NO: 2667997 - protein, 21 aa, Entamoeba histolytica
AQPKFYLTGVFYFALMYSGSN

SEQ ID NO: 2667998 - protein, 21 aa, Entamoeba histolytica
ARANMKIGRIEDVTPIPTDCT

SEQ ID NO: 2667999 - protein, 17 aa, Entamoeba histolytica
ARIVKEFQFNQNNTDMV

SEQ ID NO: 2668000 - protein, 19 aa, Entamoeba histolytica
ARLTLSQQYIFGNIINLFG

SEQ ID NO: 2668001 - protein, 19 aa, Entamoeba histolytica
ARWRKSLKEKAVTLGKDIG

SEQ ID NO: 2668002 - protein, 21 aa, Entamoeba histolytica
ASDYKTIKWVRYITKAGAIQY

SEQ ID NO: 2668003 - protein, 22 aa, Entamoeba histolytica
ASQERYRSLVSMYYRNTNGCLI

SEQ ID NO: 2668004 - protein, 18 aa, Entamoeba histolytica
ASTIYREFMEFLSKSRSN

SEQ ID NO: 2668005 - protein, 24 aa, Entamoeba histolytica
ATFQYGKTVSLGWYNPSIPKEITM

SEQ ID NO: 2668006 - protein, 21 aa, Entamoeba histolytica
ATPEIRWSSSMRSYLIDSISQ

SEQ ID NO: 2668007 - protein, 24 aa, Entamoeba histolytica
AVSELRTAAFYVYSTIYQNYVIDD

SEQ ID NO: 2668008 - protein, 20 aa, Entamoeba histolytica
AWKKFYGMNCAERFIDYLQT

SEQ ID NO: 2668009 - protein, 20 aa, Entamoeba histolytica
AYLKEYYPQNLVQFHKIGVK

SEQ ID NO: 2668010 - protein, 18 aa, Entamoeba histolytica
AYLSHLKSECSIVEEKVY

SEQ ID NO: 2668011 - protein, 17 aa, Entamoeba histolytica
AYSPCSKEIIVASFDGN

SEQ ID NO: 2668012 - protein, 20 aa, Entamoeba histolytica
CDFRGTRPFRLITTGEDNYP

SEQ ID NO: 2668013 - protein, 25 aa, Entamoeba histolytica
CEPPSKGIMCDILWSDPITEEFLNE

SEQ ID NO: 2668014 - protein, 18 aa, Entamoeba histolytica
CFVGCSLTTINIPSSITS

SEQ ID NO: 2668015 - protein, 17 aa, Entamoeba histolytica
CGCSSLKSIIIPSTVSI

SEQ ID NO: 2668016 - protein, 20 aa, Entamoeba histolytica
CGDLTPTLMRFFKAIPQIKT

SEQ ID NO: 2668017 - protein, 19 aa, Entamoeba histolytica
CGGLCPGLNNVIRGLVMNL

SEQ ID NO: 2668018 - protein, 22 aa, Entamoeba histolytica
CILSGLLSVDGKKVFHLDKNDY

SEQ ID NO: 2668019 - protein, 21 aa, Entamoeba histolytica
CIVVCYCPYIPKSFDRVVEAI

SEQ ID NO: 2668020 - protein, 19 aa, Entamoeba histolytica
CKARCQAFRAEVIKRTIQN

SEQ ID NO: 2668021 - protein, 17 aa, Entamoeba histolytica
CKSLRTIAIPTSVVEIG

SEQ ID NO: 2668022 - protein, 17 aa, Entamoeba histolytica
CKSPTSPIISPRQKFTP

SEQ ID NO: 2668023 - protein, 22 aa, Entamoeba histolytica
CKTEKGLTPWDYCQFSDKICID

SEQ ID NO: 2668024 - protein, 18 aa, Entamoeba histolytica
CLVLPSLYLGLMKIIEIP

SEQ ID NO: 2668025 - protein, 20 aa, Entamoeba histolytica
CPKTPCLLVGTKLDMREDKE

SEQ ID NO: 2668026 - protein, 20 aa, Entamoeba histolytica
CPYLPILPYESQFLIDNCDM

SEQ ID NO: 2668027 - protein, 17 aa, Entamoeba histolytica
CQIIIKKNENNEMKITR

SEQ ID NO: 2668028 - protein, 17 aa, Entamoeba histolytica
CQKLGCVAYIEASSVAK

SEQ ID NO: 2668029 - protein, 17 aa, Entamoeba histolytica
CQVKFQLKKVLCMGVAV

SEQ ID NO: 2668030 - protein, 19 aa, Entamoeba histolytica
CSAGPVGDDIFHWTATITG

SEQ ID NO: 2668031 - protein, 22 aa, Entamoeba histolytica
CSECIRRWLSVKEICPICKRPT

SEQ ID NO: 2668032 - protein, 19 aa, Entamoeba histolytica
CTKPHFICICGDQYIDENT

SEQ ID NO: 2668033 - protein, 19 aa, Entamoeba histolytica
CVGIWQNDRVEIIANDQGN

SEQ ID NO: 2668034 - protein, 20 aa, Entamoeba histolytica
CVGIWQNDRVEIIANDQGNR

SEQ ID NO: 2668035 - protein, 17 aa, Entamoeba histolytica
CVGMYVCGGSKDLTEQQ

SEQ ID NO: 2668036 - protein, 18 aa, Entamoeba histolytica
CWDQVLLEKIVNEFGIVF

SEQ ID NO: 2668037 - protein, 19 aa, Entamoeba histolytica
DASFIMALLQFPGINVNAK

SEQ ID NO: 2668038 - protein, 23 aa, Entamoeba histolytica
DCEYKIILRLGFDNKNNIIEINE

SEQ ID NO: 2668039 - protein, 18 aa, Entamoeba histolytica
DCGKLKSLRVRNTVVNSQ

SEQ ID NO: 2668040 - protein, 20 aa, Entamoeba histolytica
DCVPTPYKTVETIKNEEVFS

SEQ ID NO: 2668041 - protein, 21 aa, Entamoeba histolytica
DCVRAEGLQGIIFTMNYNVNK

SEQ ID NO: 2668042 - protein, 17 aa, Entamoeba histolytica
DDEKYLWKPVTIADTEK

SEQ ID NO: 2668043 - protein, 24 aa, Entamoeba histolytica
DEEYKKIFGRLVFKLVNKKNEEKV

SEQ ID NO: 2668044 - protein, 22 aa, Entamoeba histolytica
DEGKNTITFGMCFNTEEIKERF

SEQ ID NO: 2668045 - protein, 19 aa, Entamoeba histolytica
DEIDINEYLGIIVTEDNRY

SEQ ID NO: 2668046 - protein, 17 aa, Entamoeba histolytica
DEIPRDISVVPDIHIEE

SEQ ID NO: 2668047 - protein, 26 aa, Entamoeba histolytica
DEIRRMCFCFVINRVNYYLTREEELL

SEQ ID NO: 2668048 - protein, 18 aa, Entamoeba histolytica
DELIEMGKLTLRLMEQHQ

SEQ ID NO: 2668049 - protein, 18 aa, Entamoeba histolytica
DELLKAKWPKDMKMNNET

SEQ ID NO: 2668050 - protein, 24 aa, Entamoeba histolytica
DFIDEVIVGLSLADNVIITIDCAE

SEQ ID NO: 2668051 - protein, 23 aa, Entamoeba histolytica
DFYIPNIIGVLILSMSKRIMNEL

SEQ ID NO: 2668052 - protein, 17 aa, Entamoeba histolytica
DGARIVKEFQFNQNNTD

SEQ ID NO: 2668053 - protein, 26 aa, Entamoeba histolytica
DGAVGKTCLLLAFSKGEIPTAYVPTV

SEQ ID NO: 2668054 - protein, 23 aa, Entamoeba histolytica
DGIELIKSFVLNGGKFLGICAGA

SEQ ID NO: 2668055 - protein, 24 aa, Entamoeba histolytica
DGIELIKSFVLNGGKFLGICAGAY

SEQ ID NO: 2668056 - protein, 19 aa, Entamoeba histolytica
DGKFCLGGIVEPLKASEKE

SEQ ID NO: 2668057 - protein, 23 aa, Entamoeba histolytica
DGKFPRDYIPIMFDGVELDKTYR

SEQ ID NO: 2668058 - protein, 17 aa, Entamoeba histolytica
DGMKRVHFISVNESGFF

SEQ ID NO: 2668059 - protein, 23 aa, Entamoeba histolytica
DGSTFLKMVLVIDPSFSKFMEGN

SEQ ID NO: 2668060 - protein, 23 aa, Entamoeba histolytica
DGYYSKILCCNKIQLTKTKEIIT

SEQ ID NO: 2668061 - protein, 21 aa, Entamoeba histolytica
DHKMYIFQFMFMINTDTDPPK

SEQ ID NO: 2668062 - protein, 18 aa, Entamoeba histolytica
DIEFKYPYNKSMKDFVSP

SEQ ID NO: 2668063 - protein, 25 aa, Entamoeba histolytica
DIHSRFINCGRFSPDGSLCVCVSSD

SEQ ID NO: 2668064 - protein, 23 aa, Entamoeba histolytica
DIIWPEFKSLISTRGEQITINVK

SEQ ID NO: 2668065 - protein, 24 aa, Entamoeba histolytica
DIVRPRKLLYLAVDGVAPRAKMNQ

SEQ ID NO: 2668066 - protein, 29 aa, Entamoeba histolytica
DIYSLGIVFWEIFRRVVFGSYTKPWFKEY

SEQ ID NO: 2668067 - protein, 24 aa, Entamoeba histolytica
DKRKEQLLLHRQRLKEMIESAEDI

SEQ ID NO: 2668068 - protein, 21 aa, Entamoeba histolytica
DLAEIVMKYCTGRFGTFSQLY

SEQ ID NO: 2668069 - protein, 21 aa, Entamoeba histolytica
DLKLMRMGFETITEKSKITPE

SEQ ID NO: 2668070 - protein, 19 aa, Entamoeba histolytica
DLYSIGVCLYRLTTCQYPF

SEQ ID NO: 2668071 - protein, 18 aa, Entamoeba histolytica
DNCFRGCSTLKSINIPKT

SEQ ID NO: 2668072 - protein, 19 aa, Entamoeba histolytica
DNCFRGCSTLKSINIPKTV

SEQ ID NO: 2668073 - protein, 17 aa, Entamoeba histolytica
DNLYFDVAVGFKEGQPL

SEQ ID NO: 2668074 - protein, 19 aa, Entamoeba histolytica
DNVKIKVRVGRGIVVGGFQ

SEQ ID NO: 2668075 - protein, 22 aa, Entamoeba histolytica
DPAGTWTEWKAHVVGRNSKTVD

SEQ ID NO: 2668076 - protein, 20 aa, Entamoeba histolytica
DPKLVEMLLENEVEEDVNLD

SEQ ID NO: 2668077 - protein, 24 aa, Entamoeba histolytica
DPPKRSRRTPIRMKKDDDDLSMSS

SEQ ID NO: 2668078 - protein, 26 aa, Entamoeba histolytica
DPTVKWQVPDTFAFKYKELENELCIG

SEQ ID NO: 2668079 - protein, 25 aa, Entamoeba histolytica
DSKIKEILPTGAIVYEKCPNCGNET

SEQ ID NO: 2668080 - protein, 24 aa, Entamoeba histolytica
DSKMVGILIRRSFHNTGVDIVRIE

SEQ ID NO: 2668081 - protein, 17 aa, Entamoeba histolytica
DSSACLLMSTAEKVFIQ

SEQ ID NO: 2668082 - protein, 17 aa, Entamoeba histolytica
DTFPFPHYIILHDLNTL

SEQ ID NO: 2668083 - protein, 23 aa, Entamoeba histolytica
DTPESVCCAMHCASNLKYREKAA

SEQ ID NO: 2668084 - protein, 22 aa, Entamoeba histolytica
DVDEYKSVIVINNIPMTFSSNE

SEQ ID NO: 2668085 - protein, 20 aa, Entamoeba histolytica
DVFNELKLSLDYLYDNVVNS

SEQ ID NO: 2668086 - protein, 20 aa, Entamoeba histolytica
DVLVKLTMSGFFGVREVALK

SEQ ID NO: 2668087 - protein, 20 aa, Entamoeba histolytica
DWKDGVALVKLTEAVSAGQI

SEQ ID NO: 2668088 - protein, 19 aa, Entamoeba histolytica
DYKYIVLGCDGLWDTLNGN

SEQ ID NO: 2668089 - protein, 27 aa, Entamoeba histolytica
EAFKPKKGKTCVLMMVGLQGAGKTTTI

SEQ ID NO: 2668090 - protein, 25 aa, Entamoeba histolytica
EAIRRRPYSVILFDEIEKAHPQVFN

SEQ ID NO: 2668091 - protein, 17 aa, Entamoeba histolytica
EALKYCQEMNCIYCDLK

SEQ ID NO: 2668092 - protein, 21 aa, Entamoeba histolytica
EATIHYVFVVTLILANKKQYH

SEQ ID NO: 2668093 - protein, 27 aa, Entamoeba histolytica
EATLDELHFWPSFYLHAVLFNKTDPSY

SEQ ID NO: 2668094 - protein, 19 aa, Entamoeba histolytica
EAVHPCCFEEARGVETDEL

SEQ ID NO: 2668095 - protein, 23 aa, Entamoeba histolytica
EAVWKIKVEDLLAFVLVDDKGND

SEQ ID NO: 2668096 - protein, 23 aa, Entamoeba histolytica
ECEFRNLLCSTVHLNHTKESSSI

SEQ ID NO: 2668097 - protein, 23 aa, Entamoeba histolytica
ECFKECTRLSIIFIPTSVSEIGN

SEQ ID NO: 2668098 - protein, 19 aa, Entamoeba histolytica
EDEIIKLTAQYTARNGSNF

SEQ ID NO: 2668099 - protein, 25 aa, Entamoeba histolytica
EDHLLRYKFLLAFEREMLHLEDQYP

SEQ ID NO: 2668100 - protein, 23 aa, Entamoeba histolytica
EDKIYKLSPVWLATISSNSITGR

SEQ ID NO: 2668101 - protein, 24 aa, Entamoeba histolytica
EDRIFRLAYHVYKTKELIEKYGSE

SEQ ID NO: 2668102 - protein, 21 aa, Entamoeba histolytica
EDSCVICYNLYLNEEDIEKKE

SEQ ID NO: 2668103 - protein, 19 aa, Entamoeba histolytica
EECYLKIIHYFISQEEIEK

SEQ ID NO: 2668104 - protein, 26 aa, Entamoeba histolytica
EEFNCAVRIILFKFINVMLNEYRDYI

SEQ ID NO: 2668105 - protein, 21 aa, Entamoeba histolytica
EEGEVAWNYREFIVEYHSLDN

SEQ ID NO: 2668106 - protein, 22 aa, Entamoeba histolytica
EEGRNKLGYKECVECLEAGGIN

SEQ ID NO: 2668107 - protein, 29 aa, Entamoeba histolytica
EEHSKRLKIKLTVEKEVFKNTVIQQDFNV

SEQ ID NO: 2668108 - protein, 18 aa, Entamoeba histolytica
EEIEECMNQIIKLTKEIK

SEQ ID NO: 2668109 - protein, 18 aa, Entamoeba histolytica
EEIFRKCLVQVPDVEIAK

SEQ ID NO: 2668110 - protein, 21 aa, Entamoeba histolytica
EEIQLRSCCNLHINLVANKLK

SEQ ID NO: 2668111 - protein, 24 aa, Entamoeba histolytica
EEKRIKKPVIVKKERKLKEVKKFD

SEQ ID NO: 2668112 - protein, 20 aa, Entamoeba histolytica
EEQPLLVSRCIKAMPDEREP

SEQ ID NO: 2668113 - protein, 23 aa, Entamoeba histolytica
EESELNIPPGKIVKEIIITILKP

SEQ ID NO: 2668114 - protein, 23 aa, Entamoeba histolytica
EESFKPKRLGGTIERRCSEDKRR

SEQ ID NO: 2668115 - protein, 24 aa, Entamoeba histolytica
EFAKFPPLGRFAVRDMKQTVAVGV

SEQ ID NO: 2668116 - protein, 19 aa, Entamoeba histolytica
EFEKEVAMLDKFRDEYIIQ

SEQ ID NO: 2668117 - protein, 19 aa, Entamoeba histolytica
EFEKEVAMLDKFRNEYIIQ

SEQ ID NO: 2668118 - protein, 25 aa, Entamoeba histolytica
EFPNNLKRVVCDAIYSVENGFKPLA

SEQ ID NO: 2668119 - protein, 24 aa, Entamoeba histolytica
EGALFNYYLVEHWAPLEHILKKIS

SEQ ID NO: 2668120 - protein, 19 aa, Entamoeba histolytica
EGAYSYAIKIVGLDLNAST

SEQ ID NO: 2668121 - protein, 24 aa, Entamoeba histolytica
EGKEKLGSVFMWDAGSSVGEISGQ

SEQ ID NO: 2668122 - protein, 21 aa, Entamoeba histolytica
EGVAFKKCFSYAGFEQQPKLF

SEQ ID NO: 2668123 - protein, 24 aa, Entamoeba histolytica
EIEGMLKRLRVTKMKVEKRVEEIE

SEQ ID NO: 2668124 - protein, 18 aa, Entamoeba histolytica
EIGEIIKRVFEVRKLEEE

SEQ ID NO: 2668125 - protein, 17 aa, Entamoeba histolytica
EIHIARLEYKYGSVDKG

SEQ ID NO: 2668126 - protein, 19 aa, Entamoeba histolytica
EINRFCEPPSKGIMCDILW

SEQ ID NO: 2668127 - protein, 18 aa, Entamoeba histolytica
EKAAKWYAAKQMKQKAIA

SEQ ID NO: 2668128 - protein, 18 aa, Entamoeba histolytica
EKFMPALVQYYKQAREKH

SEQ ID NO: 2668129 - protein, 17 aa, Entamoeba histolytica
EKGTMFYYFGWNSWNGW

SEQ ID NO: 2668130 - protein, 18 aa, Entamoeba histolytica
EKIDCLQKQLARGKKEAQ

SEQ ID NO: 2668131 - protein, 19 aa, Entamoeba histolytica
EKKEGSVLIACIPSNSSIT

SEQ ID NO: 2668132 - protein, 18 aa, Entamoeba histolytica
EKLNIWKALMQLEANHGD

SEQ ID NO: 2668133 - protein, 19 aa, Entamoeba histolytica
EKLNIWKALMQLEANHGDE

SEQ ID NO: 2668134 - protein, 25 aa, Entamoeba histolytica
EKRVSKERLLSFMFKRKTNEKTTVS

SEQ ID NO: 2668135 - protein, 23 aa, Entamoeba histolytica
EKTLYYGSRWGVVRQLDAASMME

SEQ ID NO: 2668136 - protein, 19 aa, Entamoeba histolytica
ELINFCIERDIYLKYDDLN

SEQ ID NO: 2668137 - protein, 25 aa, Entamoeba histolytica
ELKAICCSHGPVLRTHIKENIERYR

SEQ ID NO: 2668138 - protein, 20 aa, Entamoeba histolytica
ELKDRIDAIKQIGGVYETTI

SEQ ID NO: 2668139 - protein, 27 aa, Entamoeba histolytica
ELKKPYWSLVYRIARKKRINVGHPKKK

SEQ ID NO: 2668140 - protein, 21 aa, Entamoeba histolytica
ELKMYPSEMENVWYRWLENIH

SEQ ID NO: 2668141 - protein, 23 aa, Entamoeba histolytica
ELMKATETITGFKQANIDEAAWM

SEQ ID NO: 2668142 - protein, 21 aa, Entamoeba histolytica
ELNFIPLLRTVFYKFFGERNL

SEQ ID NO: 2668143 - protein, 20 aa, Entamoeba histolytica
ELNLSINWNDFVVVETIDFN

SEQ ID NO: 2668144 - protein, 26 aa, Entamoeba histolytica
EMKEACCIGFKWAMSSGPLCEEEMRN

SEQ ID NO: 2668145 - protein, 20 aa, Entamoeba histolytica
ENDQVFRLTQRVSQLEERVF

SEQ ID NO: 2668146 - protein, 22 aa, Entamoeba histolytica
ENKFCKLYVRFIQTLRQQVGLT

SEQ ID NO: 2668147 - protein, 24 aa, Entamoeba histolytica
ENLFKHKLIDFIIEFMQEIDKEIS

SEQ ID NO: 2668148 - protein, 22 aa, Entamoeba histolytica
EQIWLHAWKYSFNSHDWIAEIP

SEQ ID NO: 2668149 - protein, 25 aa, Entamoeba histolytica
EQLICFDYLQSQGWSMLMEADGGAF

SEQ ID NO: 2668150 - protein, 42 aa, Entamoeba histolytica
EQMKCIISEILHEIPLNCKSGSYVLSCIELLIELFKSINELN

SEQ ID NO: 2668151 - protein, 22 aa, Entamoeba histolytica
ERFEKREGIKWHDNIYEQLEYE

SEQ ID NO: 2668152 - protein, 24 aa, Entamoeba histolytica
ERFKKFSLQFEDIFVDYSKNLIDE

SEQ ID NO: 2668153 - protein, 17 aa, Entamoeba histolytica
ERLIRITSVCKDGEIFG

SEQ ID NO: 2668154 - protein, 22 aa, Entamoeba histolytica
ERYRSLIPSYIRDSSAAVIVYD

SEQ ID NO: 2668155 - protein, 30 aa, Entamoeba histolytica; identical to SEQ ID NO: 2473217

SEQ ID NO: 2668156 - protein, 18 aa, Entamoeba histolytica
ETGEVFGVYIQDEISAEV

SEQ ID NO: 2668157 - protein, 23 aa, Entamoeba histolytica
ETGVLRPGTIVQFAPSGVSSECK

SEQ ID NO: 2668158 - protein, 24 aa, Entamoeba histolytica
ETLLWGLACHLHLLVVQQKQNDLA

SEQ ID NO: 2668159 - protein, 18 aa, Entamoeba histolytica
ETMRIGVIENCWNKETPS

SEQ ID NO: 2668160 - protein, 27 aa, Entamoeba histolytica
ETQRPKGCGFVKFMTHEDAKLCVEEAP

SEQ ID NO: 2668161 - protein, 18 aa, Entamoeba histolytica
ETRFQIITGPNMGGKSTY

SEQ ID NO: 2668162 - protein, 19 aa, Entamoeba histolytica
ETRRSIYPRFGMNDYNDGY

SEQ ID NO: 2668163 - protein, 23 aa, Entamoeba histolytica
ETVISIRACKECNLETQIDYRVK

SEQ ID NO: 2668164 - protein, 25 aa, Entamoeba histolytica
EVEDKLRVGLLYALKYEDKAQDIIE

SEQ ID NO: 2668165 - protein, 26 aa, Entamoeba histolytica
EVIYSRWVPHNSKVLKLRFNKDSTMI

SEQ ID NO: 2668166 - protein, 26 aa, Entamoeba histolytica
EVKKFDSKFNYKELFTDVKNRKREVD

SEQ ID NO: 2668167 - protein, 24 aa, Entamoeba histolytica
EVRSEVWKLLLLKDVDYETLKDEF

SEQ ID NO: 2668168 - protein, 18 aa, Entamoeba histolytica
EWITVISTDGEWWEGESK

SEQ ID NO: 2668169 - protein, 18 aa, Entamoeba histolytica
EYDIKQILNELGYDVSEG

SEQ ID NO: 2668170 - protein, 32 aa, Entamoeba histolytica
EYELPIFKRCIWRYPPQYFYILLNPRFVAQKL

SEQ ID NO: 2668171 - protein, 19 aa, Entamoeba histolytica
EYFDYTSLEDFCNRVPLRV

SEQ ID NO: 2668172 - protein, 20 aa, Entamoeba histolytica
EYGLPIVIKDGAWIGAGATI

SEQ ID NO: 2668173 - protein, 26 aa, Entamoeba histolytica
EYKTTCPRCKYLFCRKCGENWHEGKS

SEQ ID NO: 2668174 - protein, 26 aa, Entamoeba histolytica
EYLKKLIIKNCRGIYLKTIVRMKHLL

SEQ ID NO: 2668175 - protein, 24 aa, Entamoeba histolytica
EYNPKRFAGAIMRISSPKSTALIF

SEQ ID NO: 2668176 - protein, 27 aa, Entamoeba histolytica
EYRKAFYDFLRRILVWNPHQRLRPIQA

SEQ ID NO: 2668177 - protein, 26 aa, Entamoeba histolytica
EYRWKEGKELFSLPANEYINKCLDYV

SEQ ID NO: 2668178 - protein, 26 aa, Entamoeba histolytica
FAGKVFPYNEFHVFESLFSLFENYLS

SEQ ID NO: 2668179 - protein, 20 aa, Entamoeba histolytica
FATDELKHWTGSKLEIASQL

SEQ ID NO: 2668180 - protein, 24 aa, Entamoeba histolytica
FAVLKGMCDGGVYVPHSATRFAGA

SEQ ID NO: 2668181 - protein, 19 aa, Entamoeba histolytica
FDAVKMLRINPGLKPQNMI

SEQ ID NO: 2668182 - protein, 20 aa, Entamoeba histolytica
FDEIDINEYLGIIVTEDNRY

SEQ ID NO: 2668183 - protein, 17 aa, Entamoeba histolytica
FDKCEVDALNLPKEIHH

SEQ ID NO: 2668184 - protein, 20 aa, Entamoeba histolytica
FDLNAICFVASSSNVKLTAS

SEQ ID NO: 2668185 - protein, 25 aa, Entamoeba histolytica
FDPRYSSSRFDPRFDPRYDPRFERF

SEQ ID NO: 2668186 - protein, 17 aa, Entamoeba histolytica
FDSNPSFNEVPTQSQQS

SEQ ID NO: 2668187 - protein, 25 aa, Entamoeba histolytica
FDYRLAMSCPDLWIEYLKTKKDEDW

SEQ ID NO: 2668188 - protein, 17 aa, Entamoeba histolytica
FEDGFRRVIPYYKEFQV

SEQ ID NO: 2668189 - protein, 19 aa, Entamoeba histolytica
FEEAFEVYTKFDLQEEAMD

SEQ ID NO: 2668190 - protein, 23 aa, Entamoeba histolytica
FEECNKKEFDRCMECIDEIMQKK

SEQ ID NO: 2668191 - protein, 17 aa, Entamoeba histolytica
FEKNRFKNFLTYLQNYD

SEQ ID NO: 2668192 - protein, 23 aa, Entamoeba histolytica
FENACLPRYPISLIEQVMIDGKT

SEQ ID NO: 2668193 - protein, 18 aa, Entamoeba histolytica
FERYRWIMHEVILIEKEK

SEQ ID NO: 2668194 - protein, 17 aa, Entamoeba histolytica
FEVPRCVSPLREHPPSS

SEQ ID NO: 2668195 - protein, 18 aa, Entamoeba histolytica
FFFDVFPLATKVSIFEIQ

SEQ ID NO: 2668196 - protein, 17 aa, Entamoeba histolytica
FGGFGSFGQTNQQSNGF

SEQ ID NO: 2668197 - protein, 17 aa, Entamoeba histolytica
FGKHGMRVFHLKANKYY

SEQ ID NO: 2668198 - protein, 20 aa, Entamoeba histolytica
FGQNCYCVGMYVCGGSKDLT

SEQ ID NO: 2668199 - protein, 21 aa, Entamoeba histolytica
FIPIWDILHIIYGNQLINELF

SEQ ID NO: 2668200 - protein, 19 aa, Entamoeba histolytica
FKASVAVLINQSTLYTIDS

SEQ ID NO: 2668201 - protein, 21 aa, Entamoeba histolytica
FKEGLKKVAALLASGAKFGGN

SEQ ID NO: 2668202 - protein, 19 aa, Entamoeba histolytica
FKERGRGEIEILKHPTTKL

SEQ ID NO: 2668203 - protein, 17 aa, Entamoeba histolytica
FKHKKYGPAKVNVDIAK

SEQ ID NO: 2668204 - protein, 17 aa, Entamoeba histolytica
FKHKRFVCIVNCADVQE

SEQ ID NO: 2668205 - protein, 21 aa, Entamoeba histolytica
FKMYCRDASGVICTIIADNYF

SEQ ID NO: 2668206 - protein, 21 aa, Entamoeba histolytica
FKPTWKISCELIVKTIVVTPN

SEQ ID NO: 2668207 - protein, 36 aa, Entamoeba histolytica
FLAAGEKALLVPILFANAINWGSIFFIASNSDDEMA

SEQ ID NO: 2668208 - protein, 19 aa, Entamoeba histolytica
FLKNVIIKKEIVPFRKHNG

SEQ ID NO: 2668209 - protein, 21 aa, Entamoeba histolytica
FMIFAGILIRNSPQQSPFFLQ

SEQ ID NO: 2668210 - protein, 20 aa, Entamoeba histolytica
FNDIKGIFIVFSLDNMESLN

SEQ ID NO: 2668211 - protein, 21 aa, Entamoeba histolytica
FNNEPILKDFITYVFESDNDF

SEQ ID NO: 2668212 - protein, 22 aa, Entamoeba histolytica
FPGILKGALIVRARKITDNMAI

SEQ ID NO: 2668213 - protein, 20 aa, Entamoeba histolytica
FPKKHRSFMKRWSKTQQLGI

SEQ ID NO: 2668214 - protein, 19 aa, Entamoeba histolytica
FPKMHRYKVSKDAKDLIKE

SEQ ID NO: 2668215 - protein, 20 aa, Entamoeba histolytica
FQICKECVDNGFSNVMIDGS

SEQ ID NO: 2668216 - protein, 18 aa, Entamoeba histolytica
FRDAKLYYERQFHHSIPA

SEQ ID NO: 2668217 - protein, 18 aa, Entamoeba histolytica
FRGNMERFHFNPIPLNQY

SEQ ID NO: 2668218 - protein, 19 aa, Entamoeba histolytica
FRLTTNMIDCFGPQAENGL

SEQ ID NO: 2668219 - protein, 17 aa, Entamoeba histolytica
FSIASGHSVIPKSVHEE

SEQ ID NO: 2668220 - protein, 25 aa, Entamoeba histolytica
FSIVREIRDGFHFPMRTKEVVLSTQ

SEQ ID NO: 2668221 - protein, 26 aa, Entamoeba histolytica
FSNHIWKRRHFPLFSHIVKTMDLRLI

SEQ ID NO: 2668222 - protein, 21 aa, Entamoeba histolytica
FSSMKTFVVFIVLDNPSNESI

SEQ ID NO: 2668223 - protein, 18 aa, Entamoeba histolytica
FTNHLARAVLIIGAPYLQ

SEQ ID NO: 2668224 - protein, 25 aa, Entamoeba histolytica
FTYLYPRLDINVSMKRNHLLKAPFC

SEQ ID NO: 2668225 - protein, 19 aa, Entamoeba histolytica
FVALYARKFLQQELHPKLL

SEQ ID NO: 2668226 - protein, 21 aa, Entamoeba histolytica
FVRAWSYKSGYYMKTTEKGTM

SEQ ID NO: 2668227 - protein, 18 aa, Entamoeba histolytica
FYDIFDYLSSSQLQTTKE

SEQ ID NO: 2668228 - protein, 23 aa, Entamoeba histolytica
GAFELQCWKELKEFAKSVKGKAK

SEQ ID NO: 2668229 - protein, 21 aa, Entamoeba histolytica
GAGCTGACCAMELSKYKNLKI

SEQ ID NO: 2668230 - protein, 30 aa, Entamoeba histolytica
GAITHKEPHMWLRRGLFFCHRDINAVLDDV

SEQ ID NO: 2668231 - protein, 20 aa, Entamoeba histolytica
GAVGKTCLLISYTTNAFPNE

SEQ ID NO: 2668232 - protein, 26 aa, Entamoeba histolytica
GDIDLGRALKMPDLEEAHAYLKGISV

SEQ ID NO: 2668233 - protein, 27 aa, Entamoeba histolytica
GDMTSTFCGTAAYLAPEILLGEKYDSA

SEQ ID NO: 2668234 - protein, 19 aa, Entamoeba histolytica
GDNPFHWIVSFFGFNDNTN

SEQ ID NO: 2668235 - protein, 19 aa, Entamoeba histolytica
GDSLPVFGDKFIKNLQFLK

SEQ ID NO: 2668236 - protein, 23 aa, Entamoeba histolytica
GDVGVIRRIFERIVKQKLSTKTM

SEQ ID NO: 2668237 - protein, 18 aa, Entamoeba histolytica
GEAARFLFSPTQCKEFVS

SEQ ID NO: 2668238 - protein, 27 aa, Entamoeba histolytica
GEDNYPCWFEGPPFKFKKSMKDIHSRF

SEQ ID NO: 2668239 - protein, 22 aa, Entamoeba histolytica
GEDVNPIFIRQMVNNIKKKINS

SEQ ID NO: 2668240 - protein, 20 aa, Entamoeba histolytica
GEIFLFLVGNKLDLGHREVT

SEQ ID NO: 2668241 - protein, 18 aa, Entamoeba histolytica
GELFDRISDKTFYPEDKA

SEQ ID NO: 2668242 - protein, 26 aa, Entamoeba histolytica
GELLETGNDIIFFWVARMVMMSLELM

SEQ ID NO: 2668243 - protein, 24 aa, Entamoeba histolytica
GERIQIKITLVFRHYATMGLTGQV

SEQ ID NO: 2668244 - protein, 23 aa, Entamoeba histolytica
GEVKQECPLCHRLIPLSEMDKHM

SEQ ID NO: 2668245 - protein, 24 aa, Entamoeba histolytica
GEYKVVPVAGLFYAIGHSPNSKFL

SEQ ID NO: 2668246 - protein, 22 aa, Entamoeba histolytica
GFLKGAGIGLIPGYGQYQGIRA

SEQ ID NO: 2668247 - protein, 17 aa, Entamoeba histolytica
GFLSKGFINRLSGKSKT

SEQ ID NO: 2668248 - protein, 27 aa, Entamoeba histolytica
GGLGNEKRPIGSFMFLGPSGIGKTELA

SEQ ID NO: 2668249 - protein, 21 aa, Entamoeba histolytica
GGYACEFEVFITIKCTTKIKD

SEQ ID NO: 2668250 - protein, 24 aa, Entamoeba histolytica
GIEYSGCCALMCIIEIKDKKRIIH

SEQ ID NO: 2668251 - protein, 22 aa, Entamoeba histolytica
GILLRPIPRAKRILSSPRHLPH

SEQ ID NO: 2668252 - protein, 25 aa, Entamoeba histolytica
GIRQGKTGKCYADFEDEETWKNVKA

SEQ ID NO: 2668253 - protein, 17 aa, Entamoeba histolytica
GKEIPKVNPIEFEKDDD

SEQ ID NO: 2668254 - protein, 17 aa, Entamoeba histolytica
GKFKLHITALPYLAQCS

SEQ ID NO: 2668255 - protein, 21 aa, Entamoeba histolytica
GKGCFYHCGCEELLKKNARIP

SEQ ID NO: 2668256 - protein, 20 aa, Entamoeba histolytica
GKINAIAIVHLINGKVIPNC

SEQ ID NO: 2668257 - protein, 18 aa, Entamoeba histolytica
GKQDPAIILYSSLLSENF

SEQ ID NO: 2668258 - protein, 19 aa, Entamoeba histolytica
GKSSLLLRYIDNVFNEDTT

SEQ ID NO: 2668259 - protein, 28 aa, Entamoeba histolytica
GKTSILIRFFSGHFFKMYDPGIEDEYRT

SEQ ID NO: 2668260 - protein, 27 aa, Entamoeba histolytica
GLELRNCFLACYRRLLNLRVSSRIIDQ

SEQ ID NO: 2668261 - protein, 24 aa, Entamoeba histolytica
GLGVRVVSLPSWELFSQQSDEYRE

SEQ ID NO: 2668262 - protein, 25 aa, Entamoeba histolytica
GLGVRVVSLPSWELFSQQSDEYRES

SEQ ID NO: 2668263 - protein, 18 aa, Entamoeba histolytica
GLQGIIFTMNYNVNKFTH

SEQ ID NO: 2668264 - protein, 18 aa, Entamoeba histolytica
GMFIEFYAKATGAGTEAA

SEQ ID NO: 2668265 - protein, 19 aa, Entamoeba histolytica
GMPPPPPGMPGMPPPPPGG

SEQ ID NO: 2668266 - protein, 22 aa, Entamoeba histolytica
GNGKSSFGNFILQKNVFRVSDS

SEQ ID NO: 2668267 - protein, 18 aa, Entamoeba histolytica
GNGTLHVVGNFDEVEDNE

SEQ ID NO: 2668268 - protein, 20 aa, Entamoeba histolytica
GNKQIPSWVSFAQMENSGVI

SEQ ID NO: 2668269 - protein, 25 aa, Entamoeba histolytica
GNNQLTFPLCFTIFGATHYSLKNKA

SEQ ID NO: 2668270 - protein, 33 aa, Entamoeba histolytica
GNSEAKKKWLANRKPSLPLPKPGEVENIRMFIK

SEQ ID NO: 2668271 - protein, 20 aa, Entamoeba histolytica
GNTEKLSWRVFGPQGALIQN

SEQ ID NO: 2668272 - protein, 26 aa, Entamoeba histolytica
GNYHLKFLIQPFLHWPDTMMTVIEEM

SEQ ID NO: 2668273 - protein, 23 aa, Entamoeba histolytica
GQFGVGFYSSYLVAEKVTVITKN

SEQ ID NO: 2668274 - protein, 25 aa, Entamoeba histolytica
GQIGYNLLFLIAHGLMFGPNQTVYL

SEQ ID NO: 2668275 - protein, 22 aa, Entamoeba histolytica
GRIFKQIIWYKVSYSRYLEEKK

SEQ ID NO: 2668276 - protein, 22 aa, Entamoeba histolytica
GSHKGYCLSEFVEIMSSCLSIA

SEQ ID NO: 2668277 - protein, 17 aa, Entamoeba histolytica
GSLKVSSLMIGASNILK

SEQ ID NO: 2668278 - protein, 17 aa, Entamoeba histolytica
GSMYGEGIKALRNMLQL

SEQ ID NO: 2668279 - protein, 21 aa, Entamoeba histolytica
GSRPFGISTLIGGFDPDGTPR

SEQ ID NO: 2668280 - protein, 25 aa, Entamoeba histolytica
GTLEQRIRGAIGFDSQIFGQNMWGD

SEQ ID NO: 2668281 - protein, 21 aa, Entamoeba histolytica
GTPNPSWASVPYGIFICIQCS

SEQ ID NO: 2668282 - protein, 23 aa, Entamoeba histolytica
GVEKIPFIAPKPVWAKEEKKSTK

SEQ ID NO: 2668283 - protein, 22 aa, Entamoeba histolytica
GVGPLMVCTQVAGTLHLVDVLK

SEQ ID NO: 2668284 - protein, 20 aa, Entamoeba histolytica
GVISGAKGSCLIQKENSKVI

SEQ ID NO: 2668285 - protein, 17 aa, Entamoeba histolytica
GVPQIEVTFDIDANGIL

SEQ ID NO: 2668286 - protein, 25 aa, Entamoeba histolytica
GVVANCWDYIVSTSMRYGENVLSLN

SEQ ID NO: 2668287 - protein, 18 aa, Entamoeba histolytica
GVVPTKPGEWVWEDNQQF

SEQ ID NO: 2668288 - protein, 18 aa, Entamoeba histolytica
GYDGRFLAKYGIINIVKK

SEQ ID NO: 2668289 - protein, 20 aa, Entamoeba histolytica
HAAILWRISRFNGKTQQTIT

SEQ ID NO: 2668290 - protein, 18 aa, Entamoeba histolytica
HAGLCHRVLVQLSYAIGV

SEQ ID NO: 2668291 - protein, 20 aa, Entamoeba histolytica
HAYLKGISVKGFMNIGQKFD

SEQ ID NO: 2668292 - protein, 17 aa, Entamoeba histolytica
HEAELRQILSVLGRPLS

SEQ ID NO: 2668293 - protein, 18 aa, Entamoeba histolytica
HGSINSFSSSPCHIELIL

SEQ ID NO: 2668294 - protein, 18 aa, Entamoeba histolytica
HIDCAKAYGNEKEVGDGI

SEQ ID NO: 2668295 - protein, 19 aa, Entamoeba histolytica
HIGDFAFRLTCNPLAVYSH

SEQ ID NO: 2668296 - protein, 22 aa, Entamoeba histolytica
HIKLTDFGLCTGFHRIDTSITL

SEQ ID NO: 2668297 - protein, 18 aa, Entamoeba histolytica
HIQIPFRKFRQIQREEDK

SEQ ID NO: 2668298 - protein, 22 aa, Entamoeba histolytica
HKAEAKNTWQSVVQLRQHAEHK

SEQ ID NO: 2668299 - protein, 32 aa, Entamoeba histolytica; identical to SEQ ID NO: 2484714

SEQ ID NO: 2668300 - protein, 27 aa, Entamoeba histolytica
HKNDIWKRKTVCTMERREKRRSSEISI

SEQ ID NO: 2668301 - protein, 21 aa, Entamoeba histolytica
HKQVTALCAIQYSDVIFSGGV

SEQ ID NO: 2668302 - protein, 30 aa, Entamoeba histolytica
HKSKELFMKGVILYTDYKGLIIVEGTQKSI

SEQ ID NO: 2668303 - protein, 25 aa, Entamoeba histolytica
HLEGFKKQRVREVFNNDIIQFSDIQ

SEQ ID NO: 2668304 - protein, 26 aa, Entamoeba histolytica
HLFLKEGFRILKPNGLMIIAEPISRL

SEQ ID NO: 2668305 - protein, 24 aa, Entamoeba histolytica
HRMFCPSCDTPLVLVEDDHSHDRI

SEQ ID NO: 2668306 - protein, 18 aa, Entamoeba histolytica
HSAISWGTGRAVARIPRI

SEQ ID NO: 2668307 - protein, 19 aa, Entamoeba histolytica
HSAISWGTGRAVARIPRIS

SEQ ID NO: 2668308 - protein, 21 aa, Entamoeba histolytica
HSVDIPLYLDEVTFVVKGNGT

SEQ ID NO: 2668309 - protein, 24 aa, Entamoeba histolytica
HTFAPKLFNKWSYDVTVSDISLKE

SEQ ID NO: 2668310 - protein, 17 aa, Entamoeba histolytica
HYFDCIFGPFKNYVIKG

SEQ ID NO: 2668311 - protein, 25 aa, Entamoeba histolytica
HYFILYRSTLCWIKDIYNNKLTKQE

SEQ ID NO: 2668312 - protein, 18 aa, Entamoeba histolytica
IAENICALLFPSFSKTIT

SEQ ID NO: 2668313 - protein, 17 aa, Entamoeba histolytica
IANCANLWNSLPNTMSK

SEQ ID NO: 2668314 - protein, 19 aa, Entamoeba histolytica
IAPRKAVIAVPAHFKDEER

SEQ ID NO: 2668315 - protein, 23 aa, Entamoeba histolytica
IASQLNCELKFKITELTRENERI

SEQ ID NO: 2668316 - protein, 19 aa, Entamoeba histolytica
ICSRSSFKISNLYLLHLHH

SEQ ID NO: 2668317 - protein, 28 aa, Entamoeba histolytica
IDAIPPNKRWGALLPVGLIPPEITTPVS

SEQ ID NO: 2668318 - protein, 21 aa, Entamoeba histolytica
IDEPWYLKFNNSAIYSDKTED

SEQ ID NO: 2668319 - protein, 21 aa, Entamoeba histolytica
IDEPWYLKFNNSAIYSDNTED

SEQ ID NO: 2668320 - protein, 18 aa, Entamoeba histolytica
IDHVIYLTKPRLILINET

SEQ ID NO: 2668321 - protein, 21 aa, Entamoeba histolytica
IEARSSFKRLFFDKDSNTSVI

SEQ ID NO: 2668322 - protein, 19 aa, Entamoeba histolytica
IEDIMKCIKLREEGLTLEE

SEQ ID NO: 2668323 - protein, 25 aa, Entamoeba histolytica
IEEIKAHPFFKGFDFSCVEKNTPPY

SEQ ID NO: 2668324 - protein, 18 aa, Entamoeba histolytica
IEEVKEWIGKKEYHTIYD

SEQ ID NO: 2668325 - protein, 23 aa, Entamoeba histolytica
IEFNVKEGIYWDGGKASLFKEKI

SEQ ID NO: 2668326 - protein, 22 aa, Entamoeba histolytica
IEIPTPYIKVAIEPLKPSEKEI

SEQ ID NO: 2668327 - protein, 18 aa, Entamoeba histolytica
IEKLKCQEIHIFYYRGQE

SEQ ID NO: 2668328 - protein, 17 aa, Entamoeba histolytica
IELLKDMKININNKKEI

SEQ ID NO: 2668329 - protein, 17 aa, Entamoeba histolytica
IENGCFCECSSLKTINI

SEQ ID NO: 2668330 - protein, 20 aa, Entamoeba histolytica
IERLIEWGRGLELIDEEEIK

SEQ ID NO: 2668331 - protein, 20 aa, Entamoeba histolytica
IEVEGIFRISGNNEYIKKLI

SEQ ID NO: 2668332 - protein, 24 aa, Entamoeba histolytica
IEYIEKRINLAIQEGIDITLCHIE

SEQ ID NO: 2668333 - protein, 19 aa, Entamoeba histolytica
IGEWCRIYQSVTLGAMHFQ

SEQ ID NO: 2668334 - protein, 22 aa, Entamoeba histolytica
IGQGCSGYRNYELVNRKPKVLS

SEQ ID NO: 2668335 - protein, 17 aa, Entamoeba histolytica
IGSSCFYGCSSLTTISI

SEQ ID NO: 2668336 - protein, 20 aa, Entamoeba histolytica
IGVCLYRLTTCQYPFSTTKK

SEQ ID NO: 2668337 - protein, 22 aa, Entamoeba histolytica
IILMCYKVLYPTKIIMLRGQNE

SEQ ID NO: 2668338 - protein, 17 aa, Entamoeba histolytica
IILYLCACKINYPHRFF

SEQ ID NO: 2668339 - protein, 30 aa, Entamoeba histolytica
IINKRVENMLEWFNKMISSIELLKEKRDKI

SEQ ID NO: 2668340 - protein, 21 aa, Entamoeba histolytica
IITFECLTNFDIHSVAGALKL

SEQ ID NO: 2668341 - protein, 23 aa, Entamoeba histolytica
IKACCTEAGMFALRERRSHVTQE

SEQ ID NO: 2668342 - protein, 18 aa, Entamoeba histolytica
IKALRNMLQLFLRQLPLN

SEQ ID NO: 2668343 - protein, 24 aa, Entamoeba histolytica
IKEIGGGCFYECLSLTSMNIPTTI

SEQ ID NO: 2668344 - protein, 17 aa, Entamoeba histolytica
IKHPGFTTVEINLPKAI

SEQ ID NO: 2668345 - protein, 29 aa, Entamoeba histolytica
IKLKPNEMFELWEGLWFMIQDTCMETAVK

SEQ ID NO: 2668346 - protein, 17 aa, Entamoeba histolytica
IKNRKWYCQTSCATNGD

SEQ ID NO: 2668347 - protein, 23 aa, Entamoeba histolytica
IKPEMLGHYLGEFSITYKPVTHG

SEQ ID NO: 2668348 - protein, 17 aa, Entamoeba histolytica
IKSFLDNFTHSFYSLSS

SEQ ID NO: 2668349 - protein, 22 aa, Entamoeba histolytica
IKYLRNCLNTYGFCNVEFGNNI

SEQ ID NO: 2668350 - protein, 17 aa, Entamoeba histolytica
ILNLAEAIIQYKDVNQM

SEQ ID NO: 2668351 - protein, 20 aa, Entamoeba histolytica
ILPPFRCDYGKYISVGHDTF

SEQ ID NO: 2668352 - protein, 19 aa, Entamoeba histolytica
ILQLNSIELIRHFNIDSNI

SEQ ID NO: 2668353 - protein, 19 aa, Entamoeba histolytica
ILRIFKKPYLTFGDKTGII

SEQ ID NO: 2668354 - protein, 25 aa, Entamoeba histolytica
ILRRVNHPCILGCLNVYLTSHRAVM

SEQ ID NO: 2668355 - protein, 19 aa, Entamoeba histolytica
ILSILQLSSIRIIYNNNEI

SEQ ID NO: 2668356 - protein, 18 aa, Entamoeba histolytica
ILTYEMMVGIPPFYSEDE

SEQ ID NO: 2668357 - protein, 26 aa, Entamoeba histolytica
ILYKKYQWDILASKSLLCIGPEEKIP

SEQ ID NO: 2668358 - protein, 18 aa, Entamoeba histolytica
INAIAIVHLINGKVIPNC

SEQ ID NO: 2668359 - protein, 24 aa, Entamoeba histolytica
INEIYLHSVAMNFGVTINVSCELG

SEQ ID NO: 2668360 - protein, 33 aa, Entamoeba histolytica
INESYSVLFVLLIPRVNLFPRYNNVGVGGTFDR

SEQ ID NO: 2668361 - protein, 27 aa, Entamoeba histolytica
INGKVIPNCLGNIWVCVRDWSEEDGRC

SEQ ID NO: 2668362 - protein, 24 aa, Entamoeba histolytica
INKGKFMSCCMMYRGDVSSREVNL

SEQ ID NO: 2668363 - protein, 19 aa, Entamoeba histolytica
IPIERACYYLKRVNPEGPM

SEQ ID NO: 2668364 - protein, 21 aa, Entamoeba histolytica
IPPKCDLVLQYSYHYEINDQM

SEQ ID NO: 2668365 - protein, 22 aa, Entamoeba histolytica
IPQLPEYIKYLYVQTRDSNIVI

SEQ ID NO: 2668366 - protein, 24 aa, Entamoeba histolytica
IPRYELLIRDMLKDVGRDFPDLEQ

SEQ ID NO: 2668367 - protein, 20 aa, Entamoeba histolytica
IPTYHRYCVLNPKTSSMEAV

SEQ ID NO: 2668368 - protein, 18 aa, Entamoeba histolytica
IPVSTEWKGAMRHNGGRD

SEQ ID NO: 2668369 - protein, 18 aa, Entamoeba histolytica
IPYRRSAPSWLKTSTLEV

SEQ ID NO: 2668370 - protein, 18 aa, Entamoeba histolytica
IQCITKIFDEKHCERVEK

SEQ ID NO: 2668371 - protein, 19 aa, Entamoeba histolytica
IQFKCMKYINLALFTPNSN

SEQ ID NO: 2668372 - protein, 25 aa, Entamoeba histolytica
IQLINLRALQGFFPIIESVIMNCGV

SEQ ID NO: 2668373 - protein, 18 aa, Entamoeba histolytica
IQQECITMAIGVLTTLKL

SEQ ID NO: 2668374 - protein, 24 aa, Entamoeba histolytica
IQSGKICAICIEKNFNGKSQYKTD

SEQ ID NO: 2668375 - protein, 29 aa, Entamoeba histolytica
IQVPLESSLSFNLNDSFFLFGENAYSSLT

SEQ ID NO: 2668376 - protein, 26 aa, Entamoeba histolytica
IRDQIFKLACDHYILPYIKIKEFPNN

SEQ ID NO: 2668377 - protein, 24 aa, Entamoeba histolytica
IREGWGCLTMNSKIWERVSQYHWK

SEQ ID NO: 2668378 - protein, 23 aa, Entamoeba histolytica
IRHLKAAGIGLIPGYGQYQAIRM

SEQ ID NO: 2668379 - protein, 20 aa, Entamoeba histolytica
IRNGLLEQRLEFMEFDNFED

SEQ ID NO: 2668380 - protein, 24 aa, Entamoeba histolytica
IRVGKTGKCYADFENAETLERVKE

SEQ ID NO: 2668381 - protein, 23 aa, Entamoeba histolytica
ISAEVPLGFDNYVLWVKGEDADL

SEQ ID NO: 2668382 - protein, 23 aa, Entamoeba histolytica
ISICISHKWDFVSFYPKYTKLIF

SEQ ID NO: 2668383 - protein, 17 aa, Entamoeba histolytica
ISRDQVIELLRALGKAP

SEQ ID NO: 2668384 - protein, 24 aa, Entamoeba histolytica
ISSFDYLSCLLELQGIRKEGKRVI

SEQ ID NO: 2668385 - protein, 22 aa, Entamoeba histolytica
ISTESPANCGVYYNNTLYVATN

SEQ ID NO: 2668386 - protein, 24 aa, Entamoeba histolytica
ITHYEIGELLGTFYRIEYDKNLYP

SEQ ID NO: 2668387 - protein, 25 aa, Entamoeba histolytica
ITIGICLNGKPMLKKQFNKNISLSD

SEQ ID NO: 2668388 - protein, 21 aa, Entamoeba histolytica
ITIGICLNGNPLIKKQLNKNI

SEQ ID NO: 2668389 - protein, 26 aa, Entamoeba histolytica
ITLKDIPSLLVINRIKLTGINPDNDE

SEQ ID NO: 2668390 - protein, 27 aa, Entamoeba histolytica
ITLKDIPSLLVINRIKLTGINPDNDEK

SEQ ID NO: 2668391 - protein, 17 aa, Entamoeba histolytica
ITLKKLLIKSCYNISIN

SEQ ID NO: 2668392 - protein, 21 aa, Entamoeba histolytica
ITLQRRIIIQTGKSSSEKNQF

SEQ ID NO: 2668393 - protein, 22 aa, Entamoeba histolytica
ITQHCPCIERFLDGMKRVHFIS

SEQ ID NO: 2668394 - protein, 17 aa, Entamoeba histolytica
ITRARFEEINIDLFKST

SEQ ID NO: 2668395 - protein, 25 aa, Entamoeba histolytica
ITRSMLNHRIDLWKQEANKDAFIPY

SEQ ID NO: 2668396 - protein, 17 aa, Entamoeba histolytica
ITSKHLEEFILKEIQKI

SEQ ID NO: 2668397 - protein, 19 aa, Entamoeba histolytica
IVETFKYLPIAAVVQETYL

SEQ ID NO: 2668398 - protein, 23 aa, Entamoeba histolytica
IVGKWKLFSTRTVTENKSNKNTS

SEQ ID NO: 2668399 - protein, 18 aa, Entamoeba histolytica
IVKCFPDENGSVSIISGT

SEQ ID NO: 2668400 - protein, 21 aa, Entamoeba histolytica
IVKMWKINMPTSFKSSETLSL

SEQ ID NO: 2668401 - protein, 19 aa, Entamoeba histolytica
IVSTTWFPTYIRSNIDQDT

SEQ ID NO: 2668402 - protein, 18 aa, Entamoeba histolytica
IWNIAFVCAHIMQMKEKC

SEQ ID NO: 2668403 - protein, 23 aa, Entamoeba histolytica
IYEQKYAKEIYGFNSKDEELNQQ

SEQ ID NO: 2668404 - protein, 18 aa, Entamoeba histolytica
IYPRFGMNDYNDGYNDPY

SEQ ID NO: 2668405 - protein, 22 aa, Entamoeba histolytica
IYRNLICKILIRNVGKNELPNE

SEQ ID NO: 2668406 - protein, 29 aa, Entamoeba histolytica
KALANELHCSWCLISAKTGDGVSNVFETI

SEQ ID NO: 2668407 - protein, 22 aa, Entamoeba histolytica
KALASELFSKWVTRNSRLSRSS

SEQ ID NO: 2668408 - protein, 21 aa, Entamoeba histolytica
KANNEIIKFIANHPHIQIPFR

SEQ ID NO: 2668409 - protein, 18 aa, Entamoeba histolytica
KANYDLRFNVKLSNNDNN

SEQ ID NO: 2668410 - protein, 28 aa, Entamoeba histolytica
KCHKTCHYPCHVPFFISAFTNRFCTCIE

SEQ ID NO: 2668411 - protein, 19 aa, Entamoeba histolytica
KCWELFCLEHGIQPDGTAI

SEQ ID NO: 2668412 - protein, 17 aa, Entamoeba histolytica
KDFGIFCVTKQANVFGI

SEQ ID NO: 2668413 - protein, 24 aa, Entamoeba histolytica
KDGRIIKQIIWYKVNYSRYLEEKE

SEQ ID NO: 2668414 - protein, 21 aa, Entamoeba histolytica
KDGRLKPGMEIIEATSGNTGI

SEQ ID NO: 2668415 - protein, 20 aa, Entamoeba histolytica
KDISDVVLVGGMTRMPLIQN

SEQ ID NO: 2668416 - protein, 21 aa, Entamoeba histolytica
KDKYTLCIILNLAEAIIQYKD

SEQ ID NO: 2668417 - protein, 17 aa, Entamoeba histolytica
KDTFPLKERIIIEQSTH

SEQ ID NO: 2668418 - protein, 23 aa, Entamoeba histolytica
KDTRFYRKWEICETTNPSKFGSI

SEQ ID NO: 2668419 - protein, 19 aa, Entamoeba histolytica
KECCCPRIKAFKKFINTFE

SEQ ID NO: 2668420 - protein, 21 aa, Entamoeba histolytica
KEEEIKNIFTRTLKESKNEGG

SEQ ID NO: 2668421 - protein, 23 aa, Entamoeba histolytica
KEFPNNRRAIIYSVYEDYAQDEG

SEQ ID NO: 2668422 - protein, 19 aa, Entamoeba histolytica
KEFREMFDPEVVLNSEWYK

SEQ ID NO: 2668423 - protein, 20 aa, Entamoeba histolytica
KEGNINIVFICDRSGSMYGE

SEQ ID NO: 2668424 - protein, 19 aa, Entamoeba histolytica
KEGPGNCVTLANPPYYNKL

SEQ ID NO: 2668425 - protein, 20 aa, Entamoeba histolytica
KEHVCEFCGKAFLRKSECEI

SEQ ID NO: 2668426 - protein, 19 aa, Entamoeba histolytica
KEIGNKWTTIASCLEGRSP

SEQ ID NO: 2668427 - protein, 21 aa, Entamoeba histolytica
KEINSIMLFNFFNEHNKLTEL

SEQ ID NO: 2668428 - protein, 17 aa, Entamoeba histolytica
KEIVAKCSKVFSMDNVY

SEQ ID NO: 2668429 - protein, 17 aa, Entamoeba histolytica
KEKGCKPVPLSTKHNPT

SEQ ID NO: 2668430 - protein, 17 aa, Entamoeba histolytica
KELRRRGSPIAVVGIPK

SEQ ID NO: 2668431 - protein, 25 aa, Entamoeba histolytica
KEMEKRFKIKDVIMAKVVHIDKKKH

SEQ ID NO: 2668432 - protein, 17 aa, Entamoeba histolytica
KEMIKLKPNEMFELWEG

SEQ ID NO: 2668433 - protein, 20 aa, Entamoeba histolytica
KEMLQKYCLGYLLQNDSEFK

SEQ ID NO: 2668434 - protein, 24 aa, Entamoeba histolytica
KERRLSYNSDILWAINTIEKQLIA

SEQ ID NO: 2668435 - protein, 23 aa, Entamoeba histolytica
KETIFKMVEEFPQQETLEDVLLK

SEQ ID NO: 2668436 - protein, 20 aa, Entamoeba histolytica
KEVEVGLKLLQPIEQQFISI

SEQ ID NO: 2668437 - protein, 26 aa, Entamoeba histolytica
KFKVRCAKYLYTYICADKAKAEELKK

SEQ ID NO: 2668438 - protein, 22 aa, Entamoeba histolytica
KFPESVCTIPSLTQLELDNNNF

SEQ ID NO: 2668439 - protein, 20 aa, Entamoeba histolytica
KFVMNGGLIVGTWDGANVEI

SEQ ID NO: 2668440 - protein, 23 aa, Entamoeba histolytica
KGESLLIHCSDGWDRTSQCCSLV

SEQ ID NO: 2668441 - protein, 26 aa, Entamoeba histolytica
KGFVNSCLELAWSQIQNFLIKVLNNR

SEQ ID NO: 2668442 - protein, 18 aa, Entamoeba histolytica
KGKDCIIFGVEKKSIAKL

SEQ ID NO: 2668443 - protein, 18 aa, Entamoeba histolytica
KGKRFWSPEEKAFAIEKA

SEQ ID NO: 2668444 - protein, 28 aa, Entamoeba histolytica
KGLFIKDGFKYGCDFVVYKNHPQYCHSS

SEQ ID NO: 2668445 - protein, 22 aa, Entamoeba histolytica
KGNEKRTFVEFILEPIYKIVGM

SEQ ID NO: 2668446 - protein, 19 aa, Entamoeba histolytica
KGPAVKRMVMVKANQFVQQ

SEQ ID NO: 2668447 - protein, 21 aa, Entamoeba histolytica
KGRKYVRLDLKSFTFINKKSL

SEQ ID NO: 2668448 - protein, 19 aa, Entamoeba histolytica
KGSPFGNEYVCGRAHILFG

SEQ ID NO: 2668449 - protein, 23 aa, Entamoeba histolytica
KHKLGGMMILCIPPYRLPRDKLD

SEQ ID NO: 2668450 - protein, 19 aa, Entamoeba histolytica
KHSTGFLDEMNHGVNDVHN

SEQ ID NO: 2668451 - protein, 17 aa, Entamoeba histolytica
KIASDYKTIKWVRYITK

SEQ ID NO: 2668452 - protein, 23 aa, Entamoeba histolytica
KIEEEKKELLKEIEKEKEGNNQL

SEQ ID NO: 2668453 - protein, 18 aa, Entamoeba histolytica
KIGDGCFIGCTSLTTINI

SEQ ID NO: 2668454 - protein, 19 aa, Entamoeba histolytica
KIIDKSRMEYEDSISTESP

SEQ ID NO: 2668455 - protein, 32 aa, Entamoeba histolytica
KIIGVSWKLDFFVRPEHKEISPVFLVTLKTKE

SEQ ID NO: 2668456 - protein, 18 aa, Entamoeba histolytica
KIKRKYTAFKKVFEEHGE

SEQ ID NO: 2668457 - protein, 24 aa, Entamoeba histolytica
KINKRLELVEGFYDNSGIRLKIKN

SEQ ID NO: 2668458 - protein, 19 aa, Entamoeba histolytica
KIQFAPNIRAAGFKPEANN

SEQ ID NO: 2668459 - protein, 17 aa, Entamoeba histolytica
KISGIGTVPCGRVETGV

SEQ ID NO: 2668460 - protein, 24 aa, Entamoeba histolytica
KIYHHLKSSLLLKYSNSPDLNLAF

SEQ ID NO: 2668461 - protein, 19 aa, Entamoeba histolytica
KIYLGDYVDRGRMSTEIII

SEQ ID NO: 2668462 - protein, 23 aa, Entamoeba histolytica
KKDISDVVLVGGMTRMPLIQNTV

SEQ ID NO: 2668463 - protein, 26 aa, Entamoeba histolytica
KKEMEKRFKIKDVIMAKVVHIDKKKH

SEQ ID NO: 2668464 - protein, 20 aa, Entamoeba histolytica
KKFKSTVTKVAWSPDSLTVA

SEQ ID NO: 2668465 - protein, 30 aa, Entamoeba histolytica
KKFPSGRAYLRYLYSKRMVMLNGDNKKYKF

SEQ ID NO: 2668466 - protein, 18 aa, Entamoeba histolytica
KKIENLIGKFAKRIIMED

SEQ ID NO: 2668467 - protein, 18 aa, Entamoeba histolytica
KKKFEIMDTAFIENLIGE

SEQ ID NO: 2668468 - protein, 19 aa, Entamoeba histolytica
KKLLAMRVVEEAFEIIHLL

SEQ ID NO: 2668469 - protein, 18 aa, Entamoeba histolytica
KKLLAMRVVEESFEIIHL

SEQ ID NO: 2668470 - protein, 18 aa, Entamoeba histolytica
KKLQLEYLDLYIIHIPLT

SEQ ID NO: 2668471 - protein, 20 aa, Entamoeba histolytica
KKLREHFMKGGGIKETSIHE

SEQ ID NO: 2668472 - protein, 23 aa, Entamoeba histolytica
KKMRLDLVWIERINKISNKIIEN

SEQ ID NO: 2668473 - protein, 23 aa, Entamoeba histolytica
KKPLEAYHCSFLNLAIGYMDATE

SEQ ID NO: 2668474 - protein, 25 aa, Entamoeba histolytica
KKTEHKAGVYSVTWGSDSKTFITAS

SEQ ID NO: 2668475 - protein, 29 aa, Entamoeba histolytica
KKTMLKKNFESYALYISRVLKSVFQDIGI

SEQ ID NO: 2668476 - protein, 22 aa, Entamoeba histolytica
KKVIIICSIGEFQLLSKSFDFN

SEQ ID NO: 2668477 - protein, 18 aa, Entamoeba histolytica
KLITCYRDDAVGSLVDTI

SEQ ID NO: 2668478 - protein, 21 aa, Entamoeba histolytica
KLKRVICSHKGWVSSICFDPS

SEQ ID NO: 2668479 - protein, 18 aa, Entamoeba histolytica
KLNIEVVECKSPTSPIIS

SEQ ID NO: 2668480 - protein, 17 aa, Entamoeba histolytica
KLNIILRYYNGEKIVTN

SEQ ID NO: 2668481 - protein, 18 aa, Entamoeba histolytica
KLQGMVKHVIFPCPTGVT

SEQ ID NO: 2668482 - protein, 17 aa, Entamoeba histolytica
KLQLEYLDLYIIHIPLT

SEQ ID NO: 2668483 - protein, 31 aa, Entamoeba histolytica; identical to SEQ ID NO: 2491126

SEQ ID NO: 2668484 - protein, 19 aa, Entamoeba histolytica
KNEELAIIPDLEKLIKGIN

SEQ ID NO: 2668485 - protein, 18 aa, Entamoeba histolytica
KNGGICLHDSKRLIGETV

SEQ ID NO: 2668486 - protein, 28 aa, Entamoeba histolytica
KNKKLLKRITFCYKECYYAISNDGIIHN

SEQ ID NO: 2668487 - protein, 28 aa, Entamoeba histolytica
KNKKLSKRIRLLLMNIIQMMESGWTISP

SEQ ID NO: 2668488 - protein, 21 aa, Entamoeba histolytica
KNLVKKCLELFVEISENKEDF

SEQ ID NO: 2668489 - protein, 18 aa, Entamoeba histolytica
KNNCFVKDFLFEYTGNVR

SEQ ID NO: 2668490 - protein, 19 aa, Entamoeba histolytica
KNTALHFVVVLNRVDLINI

SEQ ID NO: 2668491 - protein, 17 aa, Entamoeba histolytica
KPGEWVWEDNQQFIFSL

SEQ ID NO: 2668492 - protein, 18 aa, Entamoeba histolytica
KPTRSIRSSQSMVSDTDS

SEQ ID NO: 2668493 - protein, 19 aa, Entamoeba histolytica
KPYAFIAATEIEYFIFGRK

SEQ ID NO: 2668494 - protein, 18 aa, Entamoeba histolytica
KPYECLICHKHFARHSDL

SEQ ID NO: 2668495 - protein, 30 aa, Entamoeba histolytica
KQIFSTLMFLRYLFVPFLKHPYILKSLQKC

SEQ ID NO: 2668496 - protein, 26 aa, Entamoeba histolytica
KQLMKLPNYFLRGCRSIELIDTKNVE

SEQ ID NO: 2668497 - protein, 28 aa, Entamoeba histolytica
KQNGCRGFGLNVSRTFISQILESLNILY

SEQ ID NO: 2668498 - protein, 17 aa, Entamoeba histolytica
KQNVTWCGGKYHPDPLH

SEQ ID NO: 2668499 - protein, 17 aa, Entamoeba histolytica
KQTVKMYLPETINLNGT

SEQ ID NO: 2668500 - protein, 20 aa, Entamoeba histolytica
KRISSPLMLGSSIEKIIEID

SEQ ID NO: 2668501 - protein, 22 aa, Entamoeba histolytica
KRISWDELFVHPFITQKLQCVF

SEQ ID NO: 2668502 - protein, 24 aa, Entamoeba histolytica
KRVKEIAEGIGMKIKVYDPFITTE

SEQ ID NO: 2668503 - protein, 18 aa, Entamoeba histolytica
KSEIARLIIEKVIDRINQ

SEQ ID NO: 2668504 - protein, 17 aa, Entamoeba histolytica
KSFIKEWKERIGIDERK

SEQ ID NO: 2668505 - protein, 21 aa, Entamoeba histolytica
KSGEGKLKITKDVFGQNCYCV

SEQ ID NO: 2668506 - protein, 24 aa, Entamoeba histolytica
KSGVLYKMSVIKQRIKDVNEEIRY

SEQ ID NO: 2668507 - protein, 17 aa, Entamoeba histolytica
KSIKSTTSSICFNPPTP

SEQ ID NO: 2668508 - protein, 17 aa, Entamoeba histolytica
KSKFHIHTNMAKASLAM

SEQ ID NO: 2668509 - protein, 19 aa, Entamoeba histolytica
KSQYKTDCYDELYQDVEAM

SEQ ID NO: 2668510 - protein, 22 aa, Entamoeba histolytica
KSRSIQLIKNFLFIGKEETKEI

SEQ ID NO: 2668511 - protein, 21 aa, Entamoeba histolytica
KSTELKALMNRNISSVDIKYL

SEQ ID NO: 2668512 - protein, 21 aa, Entamoeba histolytica
KSTTSSICFNQPTPLTHLDSK

SEQ ID NO: 2668513 - protein, 18 aa, Entamoeba histolytica
KTENGIPFSVHGCDPGWI

SEQ ID NO: 2668514 - protein, 17 aa, Entamoeba histolytica
KTLPFLDVLCISDNKVV

SEQ ID NO: 2668515 - protein, 24 aa, Entamoeba histolytica
KTLPYPFWKEWIATKCIDLKTKLN

SEQ ID NO: 2668516 - protein, 25 aa, Entamoeba histolytica
KTNSRLDQWILHRLNVMITSVQQWF

SEQ ID NO: 2668517 - protein, 20 aa, Entamoeba histolytica
KTPARRVYPIGLIYVKKGMK

SEQ ID NO: 2668518 - protein, 20 aa, Entamoeba histolytica
KTPKYRVVVRITNKTVIAQI

SEQ ID NO: 2668519 - protein, 24 aa, Entamoeba histolytica
KTQLIDLLFRYSHDKSIDVDKITT

SEQ ID NO: 2668520 - protein, 17 aa, Entamoeba histolytica
KTVEGLAEDNCYISFLL

SEQ ID NO: 2668521 - protein, 22 aa, Entamoeba histolytica
KTWEKLSLAARVIAGISNETPS

SEQ ID NO: 2668522 - protein, 22 aa, Entamoeba histolytica
KVDYKAIVVLTFIDQEKLLHYV

SEQ ID NO: 2668523 - protein, 17 aa, Entamoeba histolytica
KVEYRKAFYDFLRRILV

SEQ ID NO: 2668524 - protein, 27 aa, Entamoeba histolytica
KVIMKLCGWIIGRACLVLPSLYLGLMK

SEQ ID NO: 2668525 - protein, 17 aa, Entamoeba histolytica
KVIPCGNSVEFKDIEDG

SEQ ID NO: 2668526 - protein, 18 aa, Entamoeba histolytica
KVLKLRFNKDSTMIGTAG

SEQ ID NO: 2668527 - protein, 24 aa, Entamoeba histolytica
KVNCTTTLFFARMGSIKKEELKQY

SEQ ID NO: 2668528 - protein, 29 aa, Entamoeba histolytica
KVVCTGGIINCRYCHSLGRIIKVSLRNRE

SEQ ID NO: 2668529 - protein, 21 aa, Entamoeba histolytica
KVVRLNRLVKVVEYVHQNHQN

SEQ ID NO: 2668530 - protein, 26 aa, Entamoeba histolytica
KYCEYYCLRNVLVLREGFLKYKKMMK

SEQ ID NO: 2668531 - protein, 21 aa, Entamoeba histolytica
KYGMKIPEKFCGIADECFSGC

SEQ ID NO: 2668532 - protein, 23 aa, Entamoeba histolytica
KYHVLCKETAFIAVDKTTKKEVD

SEQ ID NO: 2668533 - protein, 19 aa, Entamoeba histolytica
KYIDVNRCVAKVSQTSSDV

SEQ ID NO: 2668534 - protein, 18 aa, Entamoeba histolytica
KYNESDWVLMFYNPTAPL

SEQ ID NO: 2668535 - protein, 17 aa, Entamoeba histolytica
KYSPSGYYICSGDVQGN

SEQ ID NO: 2668536 - protein, 18 aa, Entamoeba histolytica
KYSTVFIFYTPVLRSKFM

SEQ ID NO: 2668537 - protein, 20 aa, Entamoeba histolytica
KYYSNGYMIFTTREYVSTVG

SEQ ID NO: 2668538 - protein, 17 aa, Entamoeba histolytica
LAIFSMAEVDAIKKSGN

SEQ ID NO: 2668539 - protein, 26 aa, Entamoeba histolytica
LAYEQFKIPILMDVKDLVCERPDPKS

SEQ ID NO: 2668540 - protein, 17 aa, Entamoeba histolytica
LCLSLKKNPAIRYQQNS

SEQ ID NO: 2668541 - protein, 18 aa, Entamoeba histolytica
LCSSHLKTENGIPFSVHG

SEQ ID NO: 2668542 - protein, 25 aa, Entamoeba histolytica
LDFKMYYKSIEFIPNVERNCSYKYG

SEQ ID NO: 2668543 - protein, 23 aa, Entamoeba histolytica
LDLNANCFTEFPTQITSLTNLEE

SEQ ID NO: 2668544 - protein, 17 aa, Entamoeba histolytica
LDNQCLVQFCFISQSAN

SEQ ID NO: 2668545 - protein, 20 aa, Entamoeba histolytica
LDPALLRPGRIDRKIEFPNP

SEQ ID NO: 2668546 - protein, 18 aa, Entamoeba histolytica
LDPLGWTGHSGMAILAPH

SEQ ID NO: 2668547 - protein, 34 aa, Entamoeba histolytica
LDPQDISSCLSIALDSCWKLNKEIELIIQSKNVK

SEQ ID NO: 2668548 - protein, 19 aa, Entamoeba histolytica
LEIHIARLEYKYGSVDKGR

SEQ ID NO: 2668549 - protein, 17 aa, Entamoeba histolytica
LEIWLRDIRKYNTNIKI

SEQ ID NO: 2668550 - protein, 22 aa, Entamoeba histolytica
LEPIYKIVGMCVSKEGKELKQG

SEQ ID NO: 2668551 - protein, 19 aa, Entamoeba histolytica
LESFMKIQLIDLSHDLPAS

SEQ ID NO: 2668552 - protein, 17 aa, Entamoeba histolytica
LESLKKLQLEYLDLYII

SEQ ID NO: 2668553 - protein, 19 aa, Entamoeba histolytica
LFIHTIQCIERIFKRIYDE

SEQ ID NO: 2668554 - protein, 25 aa, Entamoeba histolytica
LFNIIWELIKLFGRIDFGVNQRSVL

SEQ ID NO: 2668555 - protein, 26 aa, Entamoeba histolytica
LFTVYNFVQGFGFDGFVFVDGRTHNE

SEQ ID NO: 2668556 - protein, 24 aa, Entamoeba histolytica
LGAYKPSLIMSKFFPALQGSMGKM

SEQ ID NO: 2668557 - protein, 19 aa, Entamoeba histolytica
LGDGSIRKGQVLEVTGNKA

SEQ ID NO: 2668558 - protein, 28 aa, Entamoeba histolytica
LGEKYDSAVDWWSFGILTYEMMVGIPPF

SEQ ID NO: 2668559 - protein, 23 aa, Entamoeba histolytica
LGELPQAFARMSALYGGTYMLRA

SEQ ID NO: 2668560 - protein, 19 aa, Entamoeba histolytica
LGTAVGWKYADVVAKNEAE

SEQ ID NO: 2668561 - protein, 19 aa, Entamoeba histolytica
LGTAVGWKYADVVAKNETE

SEQ ID NO: 2668562 - protein, 17 aa, Entamoeba histolytica
LGTTFCCCHFFNTQTNK

SEQ ID NO: 2668563 - protein, 29 aa, Entamoeba histolytica
LGVIIKRKIGKFFCCHGGISPEIKKIEEI

SEQ ID NO: 2668564 - protein, 18 aa, Entamoeba histolytica
LHDSKRLIGETVEHYNEQ

SEQ ID NO: 2668565 - protein, 24 aa, Entamoeba histolytica
LHKNHPNYPYFAQLCESYNQCLHP

SEQ ID NO: 2668566 - protein, 21 aa, Entamoeba histolytica
LHLLSDILNEFGFTFRTSKTT

SEQ ID NO: 2668567 - protein, 18 aa, Entamoeba histolytica
LHSEKNRLLHILKKQGKS

SEQ ID NO: 2668568 - protein, 20 aa, Entamoeba histolytica
LIDKIIEIHPSYLLIDCPGQ

SEQ ID NO: 2668569 - protein, 17 aa, Entamoeba histolytica
LIEIFGFETDIRTFSRG

SEQ ID NO: 2668570 - protein, 24 aa, Entamoeba histolytica
LIERRCKEMMKLDLSNGLREKTAI

SEQ ID NO: 2668571 - protein, 18 aa, Entamoeba histolytica
LILNSSLRAEHFMNLPTA

SEQ ID NO: 2668572 - protein, 26 aa, Entamoeba histolytica
LKACKVNMNAPWNMRYALPQCERYKQ

SEQ ID NO: 2668573 - protein, 22 aa, Entamoeba histolytica
LKCLMSYLPTERYGCVCQIISS

SEQ ID NO: 2668574 - protein, 20 aa, Entamoeba histolytica
LKDGISRDWYVSSNTWITEP

SEQ ID NO: 2668575 - protein, 25 aa, Entamoeba histolytica
LKEKEIKAGLTFSFAVEQIAIDKGI

SEQ ID NO: 2668576 - protein, 21 aa, Entamoeba histolytica
LKFMKYTGCTAVAGRFTPGSF

SEQ ID NO: 2668577 - protein, 25 aa, Entamoeba histolytica
LKISIKSSQISLCIPSKKNGYYLCN

SEQ ID NO: 2668578 - protein, 21 aa, Entamoeba histolytica
LKKCKEIIEEIKLNNKNNYLP

SEQ ID NO: 2668579 - protein, 24 aa, Entamoeba histolytica
LKKFDFLRSLSFDKCEVDALNLPK

SEQ ID NO: 2668580 - protein, 21 aa, Entamoeba histolytica
LKKVLCMGVAVGNVKLTEDQL

SEQ ID NO: 2668581 - protein, 21 aa, Entamoeba histolytica
LKQSVIYPGIIKYFKDIKENI

SEQ ID NO: 2668582 - protein, 20 aa, Entamoeba histolytica
LKSILMDQGMCISNEEADEA

SEQ ID NO: 2668583 - protein, 18 aa, Entamoeba histolytica
LKVSSLMIGASNILKVYF

SEQ ID NO: 2668584 - protein, 29 aa, Entamoeba histolytica
LLDFRFPDEQVRLFALKCLDAMKDYELVN

SEQ ID NO: 2668585 - protein, 24 aa, Entamoeba histolytica
LLEFRRYIIQCIDIPFDHAEMNPN

SEQ ID NO: 2668586 - protein, 17 aa, Entamoeba histolytica
LLGDMGVGKTCIVQRFC

SEQ ID NO: 2668587 - protein, 23 aa, Entamoeba histolytica
LLHPDCAKRIITEATNILKQEPN

SEQ ID NO: 2668588 - protein, 23 aa, Entamoeba histolytica
LLMTELFFIDGLAISSRLTSLPS

SEQ ID NO: 2668589 - protein, 18 aa, Entamoeba histolytica
LLRLRQINNAVFIKANAS

SEQ ID NO: 2668590 - protein, 19 aa, Entamoeba histolytica
LLRLRQINNAVFIKANAST

SEQ ID NO: 2668591 - protein, 17 aa, Entamoeba histolytica
LMMCQRGQMTGKINEGG

SEQ ID NO: 2668592 - protein, 23 aa, Entamoeba histolytica
LNLAPGCHIGRFIIWTESAFKKL

SEQ ID NO: 2668593 - protein, 19 aa, Entamoeba histolytica
LNSSFKHFILFATEFSLLD

SEQ ID NO: 2668594 - protein, 25 aa, Entamoeba histolytica
LNYHRVLEFLLIFLVNLNDSIIPSS

SEQ ID NO: 2668595 - protein, 20 aa, Entamoeba histolytica
LNYKIPVWFLNRQKDNKDGK

SEQ ID NO: 2668596 - protein, 24 aa, Entamoeba histolytica
LPDPIIFLRACLKINEMNKEWEQL

SEQ ID NO: 2668597 - protein, 18 aa, Entamoeba histolytica
LPEIKHYEPKCKMMVVGT

SEQ ID NO: 2668598 - protein, 25 aa, Entamoeba histolytica
LPIHCTKLKMDQCLFNIPKIPIDNE

SEQ ID NO: 2668599 - protein, 18 aa, Entamoeba histolytica
LPLQDVYKISGIGTVPCG

SEQ ID NO: 2668600 - protein, 23 aa, Entamoeba histolytica
LPNGEIKKAVFVKEDQLFTVYNF

SEQ ID NO: 2668601 - protein, 26 aa, Entamoeba histolytica
LPSSKSCLSLKFANNGKLEPRFIFEG

SEQ ID NO: 2668602 - protein, 23 aa, Entamoeba histolytica
LPTKSLHGHSHFISDLVLSNDGQ

SEQ ID NO: 2668603 - protein, 19 aa, Entamoeba histolytica
LQIEEDFSQMGFFERMNAE

SEQ ID NO: 2668604 - protein, 19 aa, Entamoeba histolytica
LQKFKRKYVEKEKKEQLGL

SEQ ID NO: 2668605 - protein, 23 aa, Entamoeba histolytica
LQNFPKRHDHIFEDWQINNIYLI

SEQ ID NO: 2668606 - protein, 22 aa, Entamoeba histolytica
LQVCGTLKMRLVQWELYQRKRV

SEQ ID NO: 2668607 - protein, 18 aa, Entamoeba histolytica
LRGLEILNEVYLKPIVMS

SEQ ID NO: 2668608 - protein, 20 aa, Entamoeba histolytica
LRLESCCSEGAITATNEVSL

SEQ ID NO: 2668609 - protein, 18 aa, Entamoeba histolytica
LRQILSVLGRPLSNSEVE

SEQ ID NO: 2668610 - protein, 19 aa, Entamoeba histolytica
LRRFKEIASDAMGRDVKKA

SEQ ID NO: 2668611 - protein, 18 aa, Entamoeba histolytica
LSQFKWKPIEREVNKDII

SEQ ID NO: 2668612 - protein, 25 aa, Entamoeba histolytica
LSRRKIKVSSGLMPWEYDDEDEEKK

SEQ ID NO: 2668613 - protein, 17 aa, Entamoeba histolytica
LSYPNTDLFLLCFSVIS

SEQ ID NO: 2668614 - protein, 27 aa, Entamoeba histolytica
LTNLPPVYTYFYLCVIVSSEGFVKISI

SEQ ID NO: 2668615 - protein, 19 aa, Entamoeba histolytica
LVEQCFRIISNILACSTVL

SEQ ID NO: 2668616 - protein, 21 aa, Entamoeba histolytica
LVKGCPEEQIIIGYPVSLMNR

SEQ ID NO: 2668617 - protein, 17 aa, Entamoeba histolytica
LVLYLNYKREFYETFIK

SEQ ID NO: 2668618 - protein, 23 aa, Entamoeba histolytica
LVPFPRDHFAMMSYAPIVTPEKA

SEQ ID NO: 2668619 - protein, 18 aa, Entamoeba histolytica
LWNAFKFSTMNFRKDFKA

SEQ ID NO: 2668620 - protein, 18 aa, Entamoeba histolytica
LWRDFKIYLENNQIPDIS

SEQ ID NO: 2668621 - protein, 20 aa, Entamoeba histolytica
LYAPYAVGVTSDFPLHTFMR

SEQ ID NO: 2668622 - protein, 20 aa, Entamoeba histolytica
LYFDVAVGFKEGQPLVYRLI

SEQ ID NO: 2668623 - protein, 22 aa, Entamoeba histolytica
LYPQVFPLIEFKEALGDFNYSL

SEQ ID NO: 2668624 - protein, 19 aa, Entamoeba histolytica
MAHRASLKFMKYTGCTAVA

SEQ ID NO: 2668625 - protein, 25 aa, Entamoeba histolytica
MAKELKAKRYVECTSKDYETTHNVV

SEQ ID NO: 2668626 - protein, 19 aa, Entamoeba histolytica
MDDVFYVSRAFCIKTKGSF

SEQ ID NO: 2668627 - protein, 27 aa, Entamoeba histolytica
MGPGKRLRPLSLLLFFIGGGGKIEEQK

SEQ ID NO: 2668628 - protein, 20 aa, Entamoeba histolytica
MILTCGKIKVLISLQPLSNI

SEQ ID NO: 2668629 - protein, 23 aa, Entamoeba histolytica
MKERMKEVYKRVVSSEEKTKLNF

SEQ ID NO: 2668630 - protein, 20 aa, Entamoeba histolytica
MKIGEIKPVAVWRIDTEITS

SEQ ID NO: 2668631 - protein, 18 aa, Entamoeba histolytica
MKTFLTKYLEFERKYGDE

SEQ ID NO: 2668632 - protein, 21 aa, Entamoeba histolytica
MKYCTGRFGTFSQLYEIPEDI

SEQ ID NO: 2668633 - protein, 23 aa, Entamoeba histolytica
MLNEYRDYIGYTWIADKESVVFS

SEQ ID NO: 2668634 - protein, 18 aa, Entamoeba histolytica
MLTLCLCSSHLKTENGIP

SEQ ID NO: 2668635 - protein, 19 aa, Entamoeba histolytica
MMNKNCWDQVLLEKIVNEF

SEQ ID NO: 2668636 - protein, 21 aa, Entamoeba histolytica
MNDFIVCITKGFVLGALENDN

SEQ ID NO: 2668637 - protein, 19 aa, Entamoeba histolytica
MNEVGAWKKFYGMNCAERF

SEQ ID NO: 2668638 - protein, 23 aa, Entamoeba histolytica
MNYEKFMPALMQYYKQPQEKHLI

SEQ ID NO: 2668639 - protein, 18 aa, Entamoeba histolytica
MPPPPPGMPGMPPPPPGM

SEQ ID NO: 2668640 - protein, 21 aa, Entamoeba histolytica
MSRPFGVALLIAGVDETGPRL

SEQ ID NO: 2668641 - protein, 18 aa, Entamoeba histolytica
MSTEIIITLFCMKINNPK

SEQ ID NO: 2668642 - protein, 19 aa, Entamoeba histolytica
NASCYFNGYLAKAAYQYFL

SEQ ID NO: 2668643 - protein, 18 aa, Entamoeba histolytica
NDFISFNGVISVIKDEDK

SEQ ID NO: 2668644 - protein, 24 aa, Entamoeba histolytica
NDPDFKWEFPKELEIPAELKPKLL

SEQ ID NO: 2668645 - protein, 17 aa, Entamoeba histolytica
NDRQSFESVDKWIEDVR

SEQ ID NO: 2668646 - protein, 17 aa, Entamoeba histolytica
NECKSLRTIAIPTSVVE

SEQ ID NO: 2668647 - protein, 20 aa, Entamoeba histolytica
NELICTPLIINDFISTPNKI

SEQ ID NO: 2668648 - protein, 25 aa, Entamoeba histolytica
NENTKLPLFLGREGKEFKEDGTFIN

SEQ ID NO: 2668649 - protein, 17 aa, Entamoeba histolytica
NEQFLLELNDAIFCSDF

SEQ ID NO: 2668650 - protein, 21 aa, Entamoeba histolytica
NERLPLTCLQELSKDVNDMKI

SEQ ID NO: 2668651 - protein, 26 aa, Entamoeba histolytica
NERRFSIARAKFYAAEILLALEHLHL

SEQ ID NO: 2668652 - protein, 28 aa, Entamoeba histolytica
NEVVRWFAERADMIVLVFDAHKLDISDE

SEQ ID NO: 2668653 - protein, 20 aa, Entamoeba histolytica
NEYVCGRAHILFGYDRSEHN

SEQ ID NO: 2668654 - protein, 19 aa, Entamoeba histolytica
NFNSVMSMISYLLKAPVVP

SEQ ID NO: 2668655 - protein, 22 aa, Entamoeba histolytica
NGDRLTVIFSIKFDDKDDAVFG

SEQ ID NO: 2668656 - protein, 26 aa, Entamoeba histolytica
NGQVNCLKLKLLDEGKLLTRMIEKDK

SEQ ID NO: 2668657 - protein, 24 aa, Entamoeba histolytica
NGVIRRIIERMVNVCKTVNWYEQV

SEQ ID NO: 2668658 - protein, 18 aa, Entamoeba histolytica
NHETRMMTQTMGFMSECK

SEQ ID NO: 2668659 - protein, 23 aa, Entamoeba histolytica
NHSLKCIEPILIEQSHHLNQNDV

SEQ ID NO: 2668660 - protein, 23 aa, Entamoeba histolytica
NIIARNIFTEWIKRENIENETFH

SEQ ID NO: 2668661 - protein, 31 aa, Entamoeba histolytica
NINIYYEFCESFDYLPLGVIIKRKIGKFFCC

SEQ ID NO: 2668662 - protein, 21 aa, Entamoeba histolytica
NIRETLESFGIGKEIEEVKEW

SEQ ID NO: 2668663 - protein, 24 aa, Entamoeba histolytica
NKFDPNFIATFAMDSDKVIIIDVR

SEQ ID NO: 2668664 - protein, 25 aa, Entamoeba histolytica
NKKAAQICIKFSIASGHSVIPKSVH

SEQ ID NO: 2668665 - protein, 19 aa, Entamoeba histolytica
NKLAAICAGIIAPGEIPPT

SEQ ID NO: 2668666 - protein, 24 aa, Entamoeba histolytica
NKNFDMRPGMIIKELGLTRPIFQK

SEQ ID NO: 2668667 - protein, 20 aa, Entamoeba histolytica
NKPFVCVAIAGWILSAKIPE

SEQ ID NO: 2668668 - protein, 20 aa, Entamoeba histolytica
NKQEAFDFGQTTFDFTTNNQ

SEQ ID NO: 2668669 - protein, 24 aa, Entamoeba histolytica
NKSSFKVCIDFGRMIENHRRKYCE

SEQ ID NO: 2668670 - protein, 23 aa, Entamoeba histolytica
NKTSESIAFFGVFDGHLGTSTAD

SEQ ID NO: 2668671 - protein, 23 aa, Entamoeba histolytica
NKWREKYGWVFDKDCKDCNFPKG

SEQ ID NO: 2668672 - protein, 19 aa, Entamoeba histolytica
NLECHFLKVVASGIVDKYL

SEQ ID NO: 2668673 - protein, 20 aa, Entamoeba histolytica
NLPNKRLRDVSLRVKYMKAK

SEQ ID NO: 2668674 - protein, 20 aa, Entamoeba histolytica
NLSSAPRFLNLVYVSIPNSV

SEQ ID NO: 2668675 - protein, 20 aa, Entamoeba histolytica
NLTSAPRFLNLVYVSIPTTV

SEQ ID NO: 2668676 - protein, 24 aa, Entamoeba histolytica
NNPLTQQKTVVWGNSIQPQVSSQQ

SEQ ID NO: 2668677 - protein, 18 aa, Entamoeba histolytica
NPCLFERGDDGWKFVKEL

SEQ ID NO: 2668678 - protein, 20 aa, Entamoeba histolytica
NPKVAWPCYHLMKERKTMSL

SEQ ID NO: 2668679 - protein, 24 aa, Entamoeba histolytica
NPSLLKYEFMWTFSSDDSDFIEIV

SEQ ID NO: 2668680 - protein, 18 aa, Entamoeba histolytica
NQFCRIFNPPTCNCNLLP

SEQ ID NO: 2668681 - protein, 23 aa, Entamoeba histolytica
NQGLCLGDYVSALVICHTRELAV

SEQ ID NO: 2668682 - protein, 19 aa, Entamoeba histolytica
NQVCPKGKYIAIVGTTVET

SEQ ID NO: 2668683 - protein, 22 aa, Entamoeba histolytica
NRFVQCFGSFGWSGEGVKNLSA

SEQ ID NO: 2668684 - protein, 17 aa, Entamoeba histolytica
NRTIVVLRLPKKTDESI

SEQ ID NO: 2668685 - protein, 20 aa, Entamoeba histolytica
NRTSPFAFIGNRFEFRAVGS

SEQ ID NO: 2668686 - protein, 23 aa, Entamoeba histolytica
NTILSNIKMCLGSDLLGVVEASL

SEQ ID NO: 2668687 - protein, 24 aa, Entamoeba histolytica
NTNEKIYGIGFLFLINDKKTKYDV

SEQ ID NO: 2668688 - protein, 32 aa, Entamoeba histolytica
NTNYKSFCNCFKRVKIFKALISLSIGEINVEE

SEQ ID NO: 2668689 - protein, 20 aa, Entamoeba histolytica
NTVMKRYNLAAGDFPPIDVY

SEQ ID NO: 2668690 - protein, 24 aa, Entamoeba histolytica
NWIPSECIKYGMYRDFTTNRVEGF

SEQ ID NO: 2668691 - protein, 17 aa, Entamoeba histolytica
NWNDFVVVETIDFNDFI

SEQ ID NO: 2668692 - protein, 18 aa, Entamoeba histolytica
NYLGYLIHRILSYDPTLE

SEQ ID NO: 2668693 - protein, 20 aa, Entamoeba histolytica
PAFAHRGFQMGVRKPHVVQQ

SEQ ID NO: 2668694 - protein, 21 aa, Entamoeba histolytica
PCDDFPCCVHIVGLERENISS

SEQ ID NO: 2668695 - protein, 34 aa, Entamoeba histolytica; identical to SEQ ID NO: 2499149

SEQ ID NO: 2668696 - protein, 31 aa, Entamoeba histolytica
PDFVKWQETWRHVLGINVPWCVNCWQRMYKE

SEQ ID NO: 2668697 - protein, 18 aa, Entamoeba histolytica
PDRFVYDISCLDEETQKL

SEQ ID NO: 2668698 - protein, 20 aa, Entamoeba histolytica
PEKARQVGDMILMMCQRGQM

SEQ ID NO: 2668699 - protein, 27 aa, Entamoeba histolytica
PERKAEMLCCVCGALIEVNPSSMCANC

SEQ ID NO: 2668700 - protein, 17 aa, Entamoeba histolytica
PGASIKGHFFIDHGVGV

SEQ ID NO: 2668701 - protein, 30 aa, Entamoeba histolytica; identical to SEQ ID NO: 2499471

SEQ ID NO: 2668702 - protein, 20 aa, Entamoeba histolytica
PHDRCLISTGIAVQIPHFCY

SEQ ID NO: 2668703 - protein, 20 aa, Entamoeba histolytica
PHPGCGKSFNTKKCLSVHMQ

SEQ ID NO: 2668704 - protein, 19 aa, Entamoeba histolytica
PIVDGFRCVEKGIYAAGNQ

SEQ ID NO: 2668705 - protein, 20 aa, Entamoeba histolytica
PKDFVFEDLEGFKIPTDDEQ

SEQ ID NO: 2668706 - protein, 20 aa, Entamoeba histolytica
PKDRIQLIDIVLRYAGSSKR

SEQ ID NO: 2668707 - protein, 17 aa, Entamoeba histolytica
PKGKYIAIVGTTVETSN

SEQ ID NO: 2668708 - protein, 19 aa, Entamoeba histolytica
PKIRKSRHNKGRKEEEINM

SEQ ID NO: 2668709 - protein, 18 aa, Entamoeba histolytica
PKLEDFETLKLIGKGTYG

SEQ ID NO: 2668710 - protein, 26 aa, Entamoeba histolytica
PKLFYKPKILCLNIELELKKEKDNAE

SEQ ID NO: 2668711 - protein, 17 aa, Entamoeba histolytica
PKLINTVYHELKDVFNK

SEQ ID NO: 2668712 - protein, 18 aa, Entamoeba histolytica
PKNAALCKTRCTAGSAKY

SEQ ID NO: 2668713 - protein, 24 aa, Entamoeba histolytica
PLHTFMRKWLKSLYEINVENDMKF

SEQ ID NO: 2668714 - protein, 24 aa, Entamoeba histolytica
PLLTPEQMKLIFGGVSVIYGVNTA

SEQ ID NO: 2668715 - protein, 20 aa, Entamoeba histolytica
PLSHQNRFIAFFSPRRKNEK

SEQ ID NO: 2668716 - protein, 24 aa, Entamoeba histolytica
PMLHPEAFENLGIDPPKGVLLYGP

SEQ ID NO: 2668717 - protein, 25 aa, Entamoeba histolytica
PNNIKLYVRRVFIMDDCRELIPEWL

SEQ ID NO: 2668718 - protein, 17 aa, Entamoeba histolytica
PNVGKSSLLLRYIDNVF

SEQ ID NO: 2668719 - protein, 22 aa, Entamoeba histolytica
PPAQIMFKWFNAIYKVGGDGCV

SEQ ID NO: 2668720 - protein, 18 aa, Entamoeba histolytica
PPARKKRPPPLKMVPAIR

SEQ ID NO: 2668721 - protein, 24 aa, Entamoeba histolytica
PPNGFLFRFLRDETVLFGVDAKVT

SEQ ID NO: 2668722 - protein, 17 aa, Entamoeba histolytica
PRKVFWTAIYRQLNKKG

SEQ ID NO: 2668723 - protein, 18 aa, Entamoeba histolytica
PRYELLIRDMLKDTGKDY

SEQ ID NO: 2668724 - protein, 25 aa, Entamoeba histolytica
PSALKCSIMAAKIVRDAAIAAGAPE

SEQ ID NO: 2668725 - protein, 27 aa, Entamoeba histolytica
PSDESYRFYQLLLFNFSHFVADEDFNR

SEQ ID NO: 2668726 - protein, 19 aa, Entamoeba histolytica
PSLPQPLFEEKKKSLEHEL

SEQ ID NO: 2668727 - protein, 28 aa, Entamoeba histolytica
PSSDALHLGHLIPFIFTKYLQDAFDCQL

SEQ ID NO: 2668728 - protein, 23 aa, Entamoeba histolytica
PSSFCPRCGTYLILSDSGDIVCD

SEQ ID NO: 2668729 - protein, 22 aa, Entamoeba histolytica
PSSMCANCLHKTIDITEGIPKQ

SEQ ID NO: 2668730 - protein, 24 aa, Entamoeba histolytica
PTKPFSCIIFKKSSLYQIIPFSNK

SEQ ID NO: 2668731 - protein, 19 aa, Entamoeba histolytica
PTLPHFENACLPRYPISLI

SEQ ID NO: 2668732 - protein, 22 aa, Entamoeba histolytica
PTMMAGKLYKFIPENQNGRFFP

SEQ ID NO: 2668733 - protein, 22 aa, Entamoeba histolytica
PTMMAGKLYKFIPENQNGRFYP

SEQ ID NO: 2668734 - protein, 22 aa, Entamoeba histolytica
PYCLPLIPKTVEWLNTELPPNI

SEQ ID NO: 2668735 - protein, 18 aa, Entamoeba histolytica
QAMLLMLERCKIVSEGSG

SEQ ID NO: 2668736 - protein, 24 aa, Entamoeba histolytica
QDPTIQFQWWYPLVQNLSANDFRE

SEQ ID NO: 2668737 - protein, 24 aa, Entamoeba histolytica
QFQAEINQLLSLIINAFYSNKDIF

SEQ ID NO: 2668738 - protein, 20 aa, Entamoeba histolytica
QGLVPLLRLQWNKFDPNFIA

SEQ ID NO: 2668739 - protein, 17 aa, Entamoeba histolytica
QIACSLNPTIHCNRFVQ

SEQ ID NO: 2668740 - protein, 17 aa, Entamoeba histolytica
QIGRLLFQKNLVLSINT

SEQ ID NO: 2668741 - protein, 25 aa, Entamoeba histolytica
QIKLIDFGSACFENNTLYTYIQSRH

SEQ ID NO: 2668742 - protein, 17 aa, Entamoeba histolytica
QKHDCTFVNNNNTSTTT

SEQ ID NO: 2668743 - protein, 22 aa, Entamoeba histolytica
QKKEIMKTFEYVMKELDKLTSA

SEQ ID NO: 2668744 - protein, 25 aa, Entamoeba histolytica
QKTLWIIRMRVLRRLLLKYRTTGKI

SEQ ID NO: 2668745 - protein, 18 aa, Entamoeba histolytica
QLDIGVSCHGSFNYDSPE

SEQ ID NO: 2668746 - protein, 22 aa, Entamoeba histolytica
QLMRVYGALMWSLGKVMQTPEC

SEQ ID NO: 2668747 - protein, 21 aa, Entamoeba histolytica
QLPQDRKSLLDGEEDEDGPID

SEQ ID NO: 2668748 - protein, 23 aa, Entamoeba histolytica
QMNAKRAGVPFFGIKEESDPVKV

SEQ ID NO: 2668749 - protein, 18 aa, Entamoeba histolytica
QNELKMFSEIGGFQSECF

SEQ ID NO: 2668750 - protein, 19 aa, Entamoeba histolytica
QQIISRLILNSSLRAEHFM

SEQ ID NO: 2668751 - protein, 23 aa, Entamoeba histolytica
QQLLEKFPFCRGSSANGREFIIY

SEQ ID NO: 2668752 - protein, 20 aa, Entamoeba histolytica
QQSNGFGGFGSFGQTNQQSN

SEQ ID NO: 2668753 - protein, 26 aa, Entamoeba histolytica
QQYIRSVLPPELWKRIENVAFEPNVM

SEQ ID NO: 2668754 - protein, 26 aa, Entamoeba histolytica
QRFNYKLRLGRGFTLKELRAAKIDKN

SEQ ID NO: 2668755 - protein, 18 aa, Entamoeba histolytica
QRIQHTFGAINLEDISQP

SEQ ID NO: 2668756 - protein, 18 aa, Entamoeba histolytica
QSVIYPGIIKYFKDIKEN

SEQ ID NO: 2668757 - protein, 20 aa, Entamoeba histolytica
QTAETFDFNSTIPKSQPASV

SEQ ID NO: 2668758 - protein, 21 aa, Entamoeba histolytica
QVCGTLKMRLVQWELYQRKRV

SEQ ID NO: 2668759 - protein, 18 aa, Entamoeba histolytica
QVGDMILMMCQRGQMTGK

SEQ ID NO: 2668760 - protein, 17 aa, Entamoeba histolytica
QYQGIRAYHVYKTKELI

SEQ ID NO: 2668761 - protein, 21 aa, Entamoeba histolytica
RACGVSRDVIAVAIINDKGKS

SEQ ID NO: 2668762 - protein, 20 aa, Entamoeba histolytica
RAERAKKFAISDSDSDDDDI

SEQ ID NO: 2668763 - protein, 20 aa, Entamoeba histolytica
RAERAKKFAISDSDSDDDVK

SEQ ID NO: 2668764 - protein, 21 aa, Entamoeba histolytica
RCHKCVQKKILRAFLINEHNL

SEQ ID NO: 2668765 - protein, 19 aa, Entamoeba histolytica
RCSSMFDTLNRWLYSSSGL

SEQ ID NO: 2668766 - protein, 22 aa, Entamoeba histolytica
RDKTLLKWMIKDILQRKKLSNI

SEQ ID NO: 2668767 - protein, 23 aa, Entamoeba histolytica
REPRYVISIKEYAKFVVGKSNRV

SEQ ID NO: 2668768 - protein, 25 aa, Entamoeba histolytica
RETVEACGLFSAVFTVTVGDIAEDL

SEQ ID NO: 2668769 - protein, 18 aa, Entamoeba histolytica
RFGFPKDKIELYVEKVLA

SEQ ID NO: 2668770 - protein, 17 aa, Entamoeba histolytica
RGNMERFHFNPIPLNQY

SEQ ID NO: 2668771 - protein, 27 aa, Entamoeba histolytica
RGYKPAVVGADTFRAGAYEQLQMNAKR

SEQ ID NO: 2668772 - protein, 28 aa, Entamoeba histolytica
RHLKTTIIVNLHIWKALNASFKTQIATI

SEQ ID NO: 2668773 - protein, 24 aa, Entamoeba histolytica
RIKLWDLRTKNCIKEMGGHQDGII

SEQ ID NO: 2668774 - protein, 18 aa, Entamoeba histolytica
RIKTLVIVSDTKMGKTEF

SEQ ID NO: 2668775 - protein, 20 aa, Entamoeba histolytica
RILGDFTFSNVLSIVSYDYN

SEQ ID NO: 2668776 - protein, 20 aa, Entamoeba histolytica
RKAVRGMLPKNNYRGKLALK

SEQ ID NO: 2668777 - protein, 23 aa, Entamoeba histolytica
RKKHAEGGLWYGVNVNEEGILDM

SEQ ID NO: 2668778 - protein, 22 aa, Entamoeba histolytica
RKRLNQLAIKYKHLYLTNTQIL

SEQ ID NO: 2668779 - protein, 19 aa, Entamoeba histolytica
RKVGMERKELIGINTRIMK

SEQ ID NO: 2668780 - protein, 25 aa, Entamoeba histolytica
RKYVEKEKKEQLGLKHPNDLKTPIK

SEQ ID NO: 2668781 - protein, 20 aa, Entamoeba histolytica
RLAASVLKCGNRKVWLDPNE

SEQ ID NO: 2668782 - protein, 19 aa, Entamoeba histolytica
RLFDHFLYYNHVCIVTELL

SEQ ID NO: 2668783 - protein, 19 aa, Entamoeba histolytica
RLNPKCPGMSPQWFAEQVG

SEQ ID NO: 2668784 - protein, 21 aa, Entamoeba histolytica
RLPGCTRMIVPLLSMLQQLPT

SEQ ID NO: 2668785 - protein, 24 aa, Entamoeba histolytica
RLPMPRPGQILGLVGTNGIGKSTA

SEQ ID NO: 2668786 - protein, 25 aa, Entamoeba histolytica
RLQNCDFSKFPKLDMRVINAVDDAL

SEQ ID NO: 2668787 - protein, 22 aa, Entamoeba histolytica
RLSRSSIYLIFLGVNDKIITKR

SEQ ID NO: 2668788 - protein, 21 aa, Entamoeba histolytica
RLTEYMNRLVVLPKVHAATAK

SEQ ID NO: 2668789 - protein, 23 aa, Entamoeba histolytica
RMILETIFFNGCMNKVYKELALE

SEQ ID NO: 2668790 - protein, 24 aa, Entamoeba histolytica
RMNAEGPLKFSARQIAQRAITNKR

SEQ ID NO: 2668791 - protein, 18 aa, Entamoeba histolytica
RMSALYGGTYMLRAKIQE

SEQ ID NO: 2668792 - protein, 21 aa, Entamoeba histolytica
RMTANLPLFYFSPININPPKF

SEQ ID NO: 2668793 - protein, 21 aa, Entamoeba histolytica
RNIKNKWIIELRKYAPTVPVI

SEQ ID NO: 2668794 - protein, 19 aa, Entamoeba histolytica
RNIQILKSFGVTFINSSYG

SEQ ID NO: 2668795 - protein, 18 aa, Entamoeba histolytica
RNYLELILRIFKKPYLTF

SEQ ID NO: 2668796 - protein, 17 aa, Entamoeba histolytica
RQLPISRQKINWANWKG

SEQ ID NO: 2668797 - protein, 20 aa, Entamoeba histolytica
RQWKEMKNNNGVLICSDGTI

SEQ ID NO: 2668798 - protein, 17 aa, Entamoeba histolytica
RRKTNIYNLHYKYNSKD

SEQ ID NO: 2668799 - protein, 19 aa, Entamoeba histolytica
RRKYCECIKHIQSKNTKPQ

SEQ ID NO: 2668800 - protein, 24 aa, Entamoeba histolytica
RRLGYKPKSGFVIYSVRIHRGNRK

SEQ ID NO: 2668801 - protein, 21 aa, Entamoeba histolytica
RRPFKCILDVGLARTTTGSKV

SEQ ID NO: 2668802 - protein, 26 aa, Entamoeba histolytica
RRTRKLFKRPFRGHGLSNTSTILHTY

SEQ ID NO: 2668803 - protein, 24 aa, Entamoeba histolytica
RSPEEFSARLVGEVATPEIRWSSS

SEQ ID NO: 2668804 - protein, 21 aa, Entamoeba histolytica
RTEIRNVFMFKAISGGSDGPI

SEQ ID NO: 2668805 - protein, 33 aa, Entamoeba histolytica; identical to SEQ ID NO: 2503236

SEQ ID NO: 2668806 - protein, 24 aa, Entamoeba histolytica
RTMLKTQYRMHPAISEFSNKMFYS

SEQ ID NO: 2668807 - protein, 17 aa, Entamoeba histolytica
RVCRYLKMILEGVRYLH

SEQ ID NO: 2668808 - protein, 22 aa, Entamoeba histolytica
RVIKTPKIVKAIMPKKGKGKRF

SEQ ID NO: 2668809 - protein, 24 aa, Entamoeba histolytica
RVLKEFSSYKWSRTLYYSEITTCP

SEQ ID NO: 2668810 - protein, 19 aa, Entamoeba histolytica
RVVYAHFPVTLVIADDGKS

SEQ ID NO: 2668811 - protein, 19 aa, Entamoeba histolytica
RYEIKMALPPKIDPSVSVM

SEQ ID NO: 2668812 - protein, 17 aa, Entamoeba histolytica
RYEQLLVEKEQKEEQER

SEQ ID NO: 2668813 - protein, 21 aa, Entamoeba histolytica
RYPKIRVSHQVFKELKAIQEE

SEQ ID NO: 2668814 - protein, 26 aa, Entamoeba histolytica
SAAAPHKCIAPEGAYFNLRHITLEGD

SEQ ID NO: 2668815 - protein, 24 aa, Entamoeba histolytica
SAGCKATIVMPEFASTAKVTATRG

SEQ ID NO: 2668816 - protein, 26 aa, Entamoeba histolytica
SAVRCVLLRMGIIGIKVTIMLDTDPS

SEQ ID NO: 2668817 - protein, 24 aa, Entamoeba histolytica
SCIDGRLTSAWNWCSMIEKYSYYP

SEQ ID NO: 2668818 - protein, 24 aa, Entamoeba histolytica
SCMKFCMNGGLIIGTWDGANVEIA

SEQ ID NO: 2668819 - protein, 26 aa, Entamoeba histolytica
SCNICGMKFLRKHDCNVHMRVHTGEK

SEQ ID NO: 2668820 - protein, 22 aa, Entamoeba histolytica
SDTIPFGALYVYNDRTHHVLMQ

SEQ ID NO: 2668821 - protein, 24 aa, Entamoeba histolytica
SDTLYECICLVFLEGAKNDIEKDQ

SEQ ID NO: 2668822 - protein, 26 aa, Entamoeba histolytica
SDVLRFLRRIRCWELRHLPRIHRVAR

SEQ ID NO: 2668823 - protein, 18 aa, Entamoeba histolytica
SDVVLLCFAVNNRTSFDN

SEQ ID NO: 2668824 - protein, 18 aa, Entamoeba histolytica
SEAERACRRANGMRIEEK

SEQ ID NO: 2668825 - protein, 26 aa, Entamoeba histolytica
SEAHISICDKIMCRIGAGDNIVEGMS

SEQ ID NO: 2668826 - protein, 26 aa, Entamoeba histolytica
SEEYFRFLWELRLVFNKEMTQLQELK

SEQ ID NO: 2668827 - protein, 20 aa, Entamoeba histolytica
SEGLDLWTFSRNEIVQHYDT

SEQ ID NO: 2668828 - protein, 17 aa, Entamoeba histolytica
SELKKGKISGFFETSAI

SEQ ID NO: 2668829 - protein, 27 aa, Entamoeba histolytica
SENQKLCWELCKIRCQLAMEDQFYTYA

SEQ ID NO: 2668830 - protein, 23 aa, Entamoeba histolytica
SEYGEIKKIVIIKDLKGINKGYA

SEQ ID NO: 2668831 - protein, 27 aa, Entamoeba histolytica
SGFSLDEPAAFAGRIYRMVKLGLSLDD

SEQ ID NO: 2668832 - protein, 21 aa, Entamoeba histolytica
SGSRDKTLMVWKVDTNSEAQA

SEQ ID NO: 2668833 - protein, 24 aa, Entamoeba histolytica
SHELPRYGVKLGLTNYAAAYCTGL

SEQ ID NO: 2668834 - protein, 17 aa, Entamoeba histolytica
SHKGWVSSICFDPSNQW

SEQ ID NO: 2668835 - protein, 18 aa, Entamoeba histolytica
SIEFKYAKSYYNLTDVVL

SEQ ID NO: 2668836 - protein, 23 aa, Entamoeba histolytica
SIVPIYIKYTWSTIYKLLYKTNP

SEQ ID NO: 2668837 - protein, 17 aa, Entamoeba histolytica
SKGFLSKGFINRLSGKS

SEQ ID NO: 2668838 - protein, 18 aa, Entamoeba histolytica
SKHLEEFILKEIQKIIDD

SEQ ID NO: 2668839 - protein, 20 aa, Entamoeba histolytica
SKIGDYCFKYCTSLESIEIP

SEQ ID NO: 2668840 - protein, 21 aa, Entamoeba histolytica
SKKIRIKFMIDGAKGISYLHS

SEQ ID NO: 2668841 - protein, 22 aa, Entamoeba histolytica
SKKRFKEDFVFEKEQYEILYHK

SEQ ID NO: 2668842 - protein, 23 aa, Entamoeba histolytica
SKNILPEQIKPIIEQEEEDLRVE

SEQ ID NO: 2668843 - protein, 18 aa, Entamoeba histolytica
SKRSILFNQFLTYQKGNC

SEQ ID NO: 2668844 - protein, 24 aa, Entamoeba histolytica
SKVKNWKKRWFVFHNNGMLDYFTD

SEQ ID NO: 2668845 - protein, 17 aa, Entamoeba histolytica
SKYRFDYVIEKEQQTAQ

SEQ ID NO: 2668846 - protein, 24 aa, Entamoeba histolytica
SLFKILSSMILKLNLQMMENEKTK

SEQ ID NO: 2668847 - protein, 17 aa, Entamoeba histolytica
SLVKCKYLCPGGGAMEM

SEQ ID NO: 2668848 - protein, 29 aa, Entamoeba histolytica
SMLRMTRSLLLRDRLIELLDSLLKVEINA

SEQ ID NO: 2668849 - protein, 19 aa, Entamoeba histolytica
SNAALKRSGWGRKLKSIQS

SEQ ID NO: 2668850 - protein, 25 aa, Entamoeba histolytica
SNELISLCHTCYFTCSDYQKFKLLE

SEQ ID NO: 2668851 - protein, 17 aa, Entamoeba histolytica
SNTWTVDSFKMYLNNIF

SEQ ID NO: 2668852 - protein, 20 aa, Entamoeba histolytica
SPLMFKRIIDTLASVKANVL

SEQ ID NO: 2668853 - protein, 20 aa, Entamoeba histolytica
SPRHLPHIVQLLLTAAPTIV

SEQ ID NO: 2668854 - protein, 25 aa, Entamoeba histolytica
SQNAEFKRLTLLMTNLPNKRLRDVS

SEQ ID NO: 2668855 - protein, 28 aa, Entamoeba histolytica
SQYDLLIEVGRCFKIFNNKCLNETHSVH

SEQ ID NO: 2668856 - protein, 26 aa, Entamoeba histolytica
SRAFCIKTKGSFVLPGISQEYEIEDS

SEQ ID NO: 2668857 - protein, 25 aa, Entamoeba histolytica
SREGLEWKGSERKDVAYGIKKLTII

SEQ ID NO: 2668858 - protein, 20 aa, Entamoeba histolytica
SRLTSLPSHDKFRNLVSALD

SEQ ID NO: 2668859 - protein, 19 aa, Entamoeba histolytica
SRMSIKYLVPDEVIYYITQ

SEQ ID NO: 2668860 - protein, 24 aa, Entamoeba histolytica
SSPKCKFGTFLFETEANGWVHSVA

SEQ ID NO: 2668861 - protein, 17 aa, Entamoeba histolytica
SSVIEIGDWCFSECKSL

SEQ ID NO: 2668862 - protein, 19 aa, Entamoeba histolytica
STIIPEIDEPWYLKFNNSA

SEQ ID NO: 2668863 - protein, 19 aa, Entamoeba histolytica
STIIPEIDNPWYLKFNNSA

SEQ ID NO: 2668864 - protein, 26 aa, Entamoeba histolytica
STIIPEIDSPWYLKFNNSAIYDDNTE

SEQ ID NO: 2668865 - protein, 23 aa, Entamoeba histolytica
STIKMWDIIAGKCMKTLTQHTKG

SEQ ID NO: 2668866 - protein, 31 aa, Entamoeba histolytica
STLDCIQMEFKFSVTMFPVFPPEYNFLVPKL

SEQ ID NO: 2668867 - protein, 20 aa, Entamoeba histolytica
STLESLKFEDCVVSDLEDSS

SEQ ID NO: 2668868 - protein, 17 aa, Entamoeba histolytica
STVNPVIAESLNFIHQL

SEQ ID NO: 2668869 - protein, 18 aa, Entamoeba histolytica
STVNPVIAESLNFVHQLK

SEQ ID NO: 2668870 - protein, 22 aa, Entamoeba histolytica
SVEGQIEFTALLFVPQRAPFDM

SEQ ID NO: 2668871 - protein, 23 aa, Entamoeba histolytica
SVKDRVGFNIVYQAIKDGRLKPG

SEQ ID NO: 2668872 - protein, 23 aa, Entamoeba histolytica
SVPKLTLFLKRMVLVKNGAELSD

SEQ ID NO: 2668873 - protein, 19 aa, Entamoeba histolytica
TDFRSVLFNGGKSLKEGEK

SEQ ID NO: 2668874 - protein, 23 aa, Entamoeba histolytica
TDHKMYIFQFMFMINTDTDSTKK

SEQ ID NO: 2668875 - protein, 25 aa, Entamoeba histolytica
TEEMARFYIAELFLAIDSIHKLSYI

SEQ ID NO: 2668876 - protein, 23 aa, Entamoeba histolytica
TFAPKLFNKWSYDVTVSDISLKE

SEQ ID NO: 2668877 - protein, 23 aa, Entamoeba histolytica
TFMGNEFGHPEWLDFPREGNGDS

SEQ ID NO: 2668878 - protein, 25 aa, Entamoeba histolytica
TFSRGQAFVQSWFSHWGNVPGDPLD

SEQ ID NO: 2668879 - protein, 20 aa, Entamoeba histolytica
TGCINWICERNFVARMLETL

SEQ ID NO: 2668880 - protein, 24 aa, Entamoeba histolytica
TGMSCLWQPSLVIDRGIALHKMIR

SEQ ID NO: 2668881 - protein, 25 aa, Entamoeba histolytica
TGQIPWRSPDIFYKKNQLFLDVIES

SEQ ID NO: 2668882 - protein, 25 aa, Entamoeba histolytica
TGYGEMYLDCILRDVRNMFTPIEIK

SEQ ID NO: 2668883 - protein, 29 aa, Entamoeba histolytica
TIDQCKRCKKFLAGTTWFYCEPESRELMT

SEQ ID NO: 2668884 - protein, 18 aa, Entamoeba histolytica
TIDVCVYYSIKMLHSQYQ

SEQ ID NO: 2668885 - protein, 18 aa, Entamoeba histolytica
TIIKGIRSLNGIYSQAII

SEQ ID NO: 2668886 - protein, 18 aa, Entamoeba histolytica
TIKCWDLESNKVVKHFHG

SEQ ID NO: 2668887 - protein, 22 aa, Entamoeba histolytica
TIPVSEDMLGRVFNGSGKPVDK

SEQ ID NO: 2668888 - protein, 18 aa, Entamoeba histolytica
TIVPPAQIMFKWFNAIYK

SEQ ID NO: 2668889 - protein, 26 aa, Entamoeba histolytica
TKAIKRKCIDDCFGIFSKYKRLFIHT

SEQ ID NO: 2668890 - protein, 17 aa, Entamoeba histolytica
TKAVFALFTPQLGLRIR

SEQ ID NO: 2668891 - protein, 27 aa, Entamoeba histolytica
TKGPDSILFRSSEPFLKNIDNRQPSDY

SEQ ID NO: 2668892 - protein, 26 aa, Entamoeba histolytica
TKIERIDIKTGFCFVVCETEEDAKKI

SEQ ID NO: 2668893 - protein, 17 aa, Entamoeba histolytica
TKIPPKCDLVLQYSYHY

SEQ ID NO: 2668894 - protein, 19 aa, Entamoeba histolytica
TKYMLEGKIMIPATPDGVA

SEQ ID NO: 2668895 - protein, 20 aa, Entamoeba histolytica
TLFKKVKGSCKVYKKYCNFL

SEQ ID NO: 2668896 - protein, 26 aa, Entamoeba histolytica
TLNEWRRMCFCFVINRVNYYLTEEER

SEQ ID NO: 2668897 - protein, 27 aa, Entamoeba histolytica
TLVKSSHALRPFYITLLSSKSCLSLKF

SEQ ID NO: 2668898 - protein, 24 aa, Entamoeba histolytica
TLYGSLRPFGCSLLIGGVDQHGYS

SEQ ID NO: 2668899 - protein, 27 aa, Entamoeba histolytica
TMFYYFGWNSWNGWIPAWCVNKATKTM

SEQ ID NO: 2668900 - protein, 18 aa, Entamoeba histolytica
TMKLLIKLCEAVHLKEKI

SEQ ID NO: 2668901 - protein, 17 aa, Entamoeba histolytica
TMMSRSYYEGCNAVIVV

SEQ ID NO: 2668902 - protein, 17 aa, Entamoeba histolytica
TNDWVVKMYYSFQDEEY

SEQ ID NO: 2668903 - protein, 24 aa, Entamoeba histolytica
TNETEPSVDCPFEPNNTEPNKVSN

SEQ ID NO: 2668904 - protein, 21 aa, Entamoeba histolytica
TNGCTACVVLLVGKRLYTANL

SEQ ID NO: 2668905 - protein, 19 aa, Entamoeba histolytica
TNKPLKCFGEGDRSDLVVI

SEQ ID NO: 2668906 - protein, 19 aa, Entamoeba histolytica
TNLAMSFSMLLSDHTLIGT

SEQ ID NO: 2668907 - protein, 19 aa, Entamoeba histolytica
TNPLVLKWLQTSSAFVNIL

SEQ ID NO: 2668908 - protein, 18 aa, Entamoeba histolytica
TNQCKIRDGVAVNIAKCS

SEQ ID NO: 2668909 - protein, 26 aa, Entamoeba histolytica
TNTQMSFSRIDPAARAAGIQQTNPLD

SEQ ID NO: 2668910 - protein, 24 aa, Entamoeba histolytica
TPFLEFILSTALNFSPETFQNGLN

SEQ ID NO: 2668911 - protein, 25 aa, Entamoeba histolytica
TRGMTHKKLCLRFTQDAIIKRFNKT

SEQ ID NO: 2668912 - protein, 20 aa, Entamoeba histolytica
TRPAIETVKKIVLYFESLSR

SEQ ID NO: 2668913 - protein, 21 aa, Entamoeba histolytica
TRPTLLKQKFFASIVDEAAQS

SEQ ID NO: 2668914 - protein, 20 aa, Entamoeba histolytica
TRSVALMSMVGYILGLGDRH

SEQ ID NO: 2668915 - protein, 24 aa, Entamoeba histolytica
TSILYKLKLGEIVTTIPTIGFNVE

SEQ ID NO: 2668916 - protein, 17 aa, Entamoeba histolytica
TSPCFLKPLELGADIAL

SEQ ID NO: 2668917 - protein, 20 aa, Entamoeba histolytica
TVKGSGLIPYHYSAQNSIKK

SEQ ID NO: 2668918 - protein, 25 aa, Entamoeba histolytica
TVKRDWYRLNIYYLKKAGAIVDDSK

SEQ ID NO: 2668919 - protein, 17 aa, Entamoeba histolytica
TVSRRKMLDVSRLEQDI

SEQ ID NO: 2668920 - protein, 20 aa, Entamoeba histolytica
TWFKQPFRKIRRHQTRVEKA

SEQ ID NO: 2668921 - protein, 23 aa, Entamoeba histolytica
VCCGSYNPIHYIHLLLFELTKNY

SEQ ID NO: 2668922 - protein, 17 aa, Entamoeba histolytica
VDATFTSPCFLKPLELG

SEQ ID NO: 2668923 - protein, 19 aa, Entamoeba histolytica
VDEFRGRFMMDGHNENLKY

SEQ ID NO: 2668924 - protein, 34 aa, Entamoeba histolytica
VDEIIPIKTQDAWKMARAVVKYDGIMCGMSSGAA

SEQ ID NO: 2668925 - protein, 23 aa, Entamoeba histolytica
VDIDLCVSRGFVGFNGLAEKKQN

SEQ ID NO: 2668926 - protein, 22 aa, Entamoeba histolytica
VDTIITSYVRWRHSATAYNKLY

SEQ ID NO: 2668927 - protein, 17 aa, Entamoeba histolytica
VECKSPTSPIISPRQKF

SEQ ID NO: 2668928 - protein, 21 aa, Entamoeba histolytica
VEGRNGEGWIYINGKTYSPSE

SEQ ID NO: 2668929 - protein, 19 aa, Entamoeba histolytica
VEIVECINTLSAIALNDKI

SEQ ID NO: 2668930 - protein, 18 aa, Entamoeba histolytica
VELLRQYRGELTHEKVVR

SEQ ID NO: 2668931 - protein, 20 aa, Entamoeba histolytica
VFGSHWCSIAMYLNNRTARS

SEQ ID NO: 2668932 - protein, 19 aa, Entamoeba histolytica
VFKELNWRREKLLKKAKKA

SEQ ID NO: 2668933 - protein, 26 aa, Entamoeba histolytica
VFLLEKRLQQTLTYLISSHTNIQQSP

SEQ ID NO: 2668934 - protein, 18 aa, Entamoeba histolytica
VGELFSFANCNVGGEKEE

SEQ ID NO: 2668935 - protein, 18 aa, Entamoeba histolytica
VGVTSDFPLHTFMRKWLK

SEQ ID NO: 2668936 - protein, 17 aa, Entamoeba histolytica
VHGCDPGWISVDEYYEN

SEQ ID NO: 2668937 - protein, 22 aa, Entamoeba histolytica
VHRMKRVKCEGSQMFVVTNQMI

SEQ ID NO: 2668938 - protein, 20 aa, Entamoeba histolytica
VIEIGDWCFSECKSLRTITI

SEQ ID NO: 2668939 - protein, 22 aa, Entamoeba histolytica
VIEIGLRVLHPFMPFITEELWQ

SEQ ID NO: 2668940 - protein, 23 aa, Entamoeba histolytica
VIFSGGVEGIVKMWKINMPTSFK

SEQ ID NO: 2668941 - protein, 18 aa, Entamoeba histolytica
VINGYPILEKDVKEPSEK

SEQ ID NO: 2668942 - protein, 19 aa, Entamoeba histolytica
VITATVMRKQGDFGEYISL

SEQ ID NO: 2668943 - protein, 25 aa, Entamoeba histolytica
VKEYAEAFEIIPYTLAENAGLNPME

SEQ ID NO: 2668944 - protein, 17 aa, Entamoeba histolytica
VKFDFSIVREIRDGFHF

SEQ ID NO: 2668945 - protein, 19 aa, Entamoeba histolytica
VKFQLKKVLCMGVAVGNVK

SEQ ID NO: 2668946 - protein, 27 aa, Entamoeba histolytica
VKGSCKVYKKYCNFLMRNNREEEIKNT

SEQ ID NO: 2668947 - protein, 17 aa, Entamoeba histolytica
VKKERKLKEVKKFDSKF

SEQ ID NO: 2668948 - protein, 25 aa, Entamoeba histolytica
VKLPEDVRNRFNLIYHETVERIEFS

SEQ ID NO: 2668949 - protein, 19 aa, Entamoeba histolytica
VKNSRIWLNSALSGKSKRI

SEQ ID NO: 2668950 - protein, 18 aa, Entamoeba histolytica
VKTLAKMLGIDLKDVMAI

SEQ ID NO: 2668951 - protein, 23 aa, Entamoeba histolytica
VLGELFPNIDIIGIFDGHNGEEA

SEQ ID NO: 2668952 - protein, 28 aa, Entamoeba histolytica
VLGYYYKGCQSWDWYYPYLYAPFAEDMG

SEQ ID NO: 2668953 - protein, 19 aa, Entamoeba histolytica
VLTHNKCIIDSFDRPNEYD

SEQ ID NO: 2668954 - protein, 21 aa, Entamoeba histolytica
VMEFCSHFSLFDVLNDPNQQV

SEQ ID NO: 2668955 - protein, 23 aa, Entamoeba histolytica
VMEPVMFYDLLTSLEIMKNAFFT

SEQ ID NO: 2668956 - protein, 26 aa, Entamoeba histolytica
VMKFDISNLTSFSFPVYPHSSLVPLS

SEQ ID NO: 2668957 - protein, 26 aa, Entamoeba histolytica
VMQTPECLRVYVSSFWDQPFKESLFT

SEQ ID NO: 2668958 - protein, 18 aa, Entamoeba histolytica
VMVDLFLHRELDAKKDAP

SEQ ID NO: 2668959 - protein, 33 aa, Entamoeba histolytica
VNDYKRLNVALTRAKRGLIIIGNIPTLVTSKVW

SEQ ID NO: 2668960 - protein, 26 aa, Entamoeba histolytica
VNEYIRFAFKLFIKIYYKDTWTDDDI

SEQ ID NO: 2668961 - protein, 24 aa, Entamoeba histolytica
VNLWDMRYQRCLMMKKEEVREVAI

SEQ ID NO: 2668962 - protein, 23 aa, Entamoeba histolytica
VNPKIYRFRPFIIKLTINTSFGI

SEQ ID NO: 2668963 - protein, 23 aa, Entamoeba histolytica
VPHEGSFCDLMWSDPEENEKGMR

SEQ ID NO: 2668964 - protein, 19 aa, Entamoeba histolytica
VPWCVNCWQRMYKETSEEF

SEQ ID NO: 2668965 - protein, 18 aa, Entamoeba histolytica
VQDICLLSNTLLNTLGYT

SEQ ID NO: 2668966 - protein, 21 aa, Entamoeba histolytica
VQKTFLMRVLKSVYVDEGSNE

SEQ ID NO: 2668967 - protein, 24 aa, Entamoeba histolytica
VQSPDWRIRKSIAKQLGLLAQSTP

SEQ ID NO: 2668968 - protein, 17 aa, Entamoeba histolytica
VRLPAVFLAPIRGDVVH

SEQ ID NO: 2668969 - protein, 23 aa, Entamoeba histolytica
VSENYINLIRLIRENTKYKEETK

SEQ ID NO: 2668970 - protein, 18 aa, Entamoeba histolytica
VSIIGDECFKGCSSLTSV

SEQ ID NO: 2668971 - protein, 23 aa, Entamoeba histolytica
VSKLGNGCFERCTSLSLINIPRG

SEQ ID NO: 2668972 - protein, 28 aa, Entamoeba histolytica
VSPKRIDDAFALPYGRYNVEVTQLINVV

SEQ ID NO: 2668973 - protein, 19 aa, Entamoeba histolytica
VSVLVRGANRLVLDEAERS

SEQ ID NO: 2668974 - protein, 21 aa, Entamoeba histolytica
VTDDVCKRFNLINCTINTLTC

SEQ ID NO: 2668975 - protein, 23 aa, Entamoeba histolytica
VTFKLKIKLNESGLMELSANVFG

SEQ ID NO: 2668976 - protein, 19 aa, Entamoeba histolytica
VTFNQVKGIFGFQPHDNLG

SEQ ID NO: 2668977 - protein, 18 aa, Entamoeba histolytica
VTFSIEYLTHMEIQDDEL

SEQ ID NO: 2668978 - protein, 26 aa, Entamoeba histolytica
VTGEYGWSANMERIMKAQALRDNSMS

SEQ ID NO: 2668979 - protein, 24 aa, Entamoeba histolytica
VTSSYYRSCHGVFLVYAQDDKTSF

SEQ ID NO: 2668980 - protein, 18 aa, Entamoeba histolytica
VVEFWKYWMDSTPQSDAL

SEQ ID NO: 2668981 - protein, 24 aa, Entamoeba histolytica
VVEIWKKQEIIDGFVDLDGMSVGA

SEQ ID NO: 2668982 - protein, 17 aa, Entamoeba histolytica
VVLVGGMTRMPLIQNTV

SEQ ID NO: 2668983 - protein, 27 aa, Entamoeba histolytica
VVQMIFKRLFRVYAHIYLHHLNQITQL

SEQ ID NO: 2668984 - protein, 18 aa, Entamoeba histolytica
VVSAIVLKAIKIEIQRRL

SEQ ID NO: 2668985 - protein, 23 aa, Entamoeba histolytica
VVTIELKSGAVLTGTIVGVDNYM

SEQ ID NO: 2668986 - protein, 28 aa, Entamoeba histolytica
VYMCPRDEYKYSYIDAMDYYDTVTHRMF

SEQ ID NO: 2668987 - protein, 19 aa, Entamoeba histolytica
VYPEQRFFSYIFPTIQFTL

SEQ ID NO: 2668988 - protein, 22 aa, Entamoeba histolytica
WESSHFNLLQVMGLQVQSTEQK

SEQ ID NO: 2668989 - protein, 28 aa, Entamoeba histolytica
WFCSKIRKIRIDGYYCKKVIEKHPNYFI

SEQ ID NO: 2668990 - protein, 29 aa, Entamoeba histolytica
WFYCEPESRELMTYLIKRVKGLNKLKLIN

SEQ ID NO: 2668991 - protein, 25 aa, Entamoeba histolytica
WHAPKRFPHIYPFNIDNQYAKEFII

SEQ ID NO: 2668992 - protein, 17 aa, Entamoeba histolytica
WIATKCIDLKTKLNNYI

SEQ ID NO: 2668993 - protein, 18 aa, Entamoeba histolytica
WIMHEVILIEKEKQTKMH

SEQ ID NO: 2668994 - protein, 23 aa, Entamoeba histolytica
WNSEMKNDVGIFIGKMTKAFYTK

SEQ ID NO: 2668995 - protein, 18 aa, Entamoeba histolytica
WRGLSVVHLGDRDVPNCL

SEQ ID NO: 2668996 - protein, 21 aa, Entamoeba histolytica
WSFCECPRLSIIEYNSQTPLK

SEQ ID NO: 2668997 - protein, 17 aa, Entamoeba histolytica
WSYSYCLPLLVITYGNG

SEQ ID NO: 2668998 - protein, 22 aa, Entamoeba histolytica
WTDALKRYGVENIPVDTFLTLG

SEQ ID NO: 2668999 - protein, 25 aa, Entamoeba histolytica
WTVDSFKMYLNNIFYNAGISQVNAI

SEQ ID NO: 2669000 - protein, 18 aa, Entamoeba histolytica
WVPVLVLLRIDFAATDIK

SEQ ID NO: 2669001 - protein, 22 aa, Entamoeba histolytica
YAAWNPDFLLSVLLGNQTATCQ

SEQ ID NO: 2669002 - protein, 24 aa, Entamoeba histolytica
YAKEFYPKGAAIVMPKDNNTYTII

SEQ ID NO: 2669003 - protein, 17 aa, Entamoeba histolytica
YANGEVKPIHILDPNVT

SEQ ID NO: 2669004 - protein, 18 aa, Entamoeba histolytica
YCFDGCLSLTSVTIPSSI

SEQ ID NO: 2669005 - protein, 19 aa, Entamoeba histolytica
YCQEMNCIYCDLKPENIMI

SEQ ID NO: 2669006 - protein, 20 aa, Entamoeba histolytica
YEAKEAGAYIVATGRGDFPN

SEQ ID NO: 2669007 - protein, 18 aa, Entamoeba histolytica
YFAQLCESYNQCLHPKQQ

SEQ ID NO: 2669008 - protein, 18 aa, Entamoeba histolytica
YFGKHGMRVFHLKANKYY

SEQ ID NO: 2669009 - protein, 29 aa, Entamoeba histolytica
YFTNILCTCIDFYGYCKVCGCPSSEHVNE

SEQ ID NO: 2669010 - protein, 29 aa, Entamoeba histolytica
YGCTVSLFTHWLPRFGIEVDLIDTSDVEK

SEQ ID NO: 2669011 - protein, 18 aa, Entamoeba histolytica
YGIFICIQCSGKHRGLGV

SEQ ID NO: 2669012 - protein, 36 aa, Entamoeba histolytica; identical to SEQ ID NO: 2510281

SEQ ID NO: 2669013 - protein, 23 aa, Entamoeba histolytica
YGRNALLFNLCFVFDEGTTDGAI

SEQ ID NO: 2669014 - protein, 20 aa, Entamoeba histolytica
YGSDILTIFLQKAESVCENK

SEQ ID NO: 2669015 - protein, 29 aa, Entamoeba histolytica
YHGKDFSRIFCIQRLVKVSIIDKEGLEGT

SEQ ID NO: 2669016 - protein, 22 aa, Entamoeba histolytica
YHSMNLWLEYLLLCRNSNDFKL

SEQ ID NO: 2669017 - protein, 19 aa, Entamoeba histolytica
YKFFGERNLTGFGDTLQEL

SEQ ID NO: 2669018 - protein, 18 aa, Entamoeba histolytica
YKFPSRLDLSDEVKDLIH

SEQ ID NO: 2669019 - protein, 27 aa, Entamoeba histolytica
YKKYDYVCALKVIFKRQLQQYRMEIQM

SEQ ID NO: 2669020 - protein, 25 aa, Entamoeba histolytica
YKLGLTVRETCRFNYNYNETIPREF

SEQ ID NO: 2669021 - protein, 25 aa, Entamoeba histolytica
YKLIELGIGWTCYVMIDEVGQETYH

SEQ ID NO: 2669022 - protein, 17 aa, Entamoeba histolytica
YKNRFIIKDKKKEEETK

SEQ ID NO: 2669023 - protein, 17 aa, Entamoeba histolytica
YKSGYYMKTTEKGTMFY

SEQ ID NO: 2669024 - protein, 21 aa, Entamoeba histolytica
YLKKYAITIEGIFRVSGSKEH

SEQ ID NO: 2669025 - protein, 19 aa, Entamoeba histolytica
YLKNCAKTSMQSKLIAMQR

SEQ ID NO: 2669026 - protein, 19 aa, Entamoeba histolytica
YLLEMNHLFERKLKIDQIR

SEQ ID NO: 2669027 - protein, 21 aa, Entamoeba histolytica
YLQFRAIHGSYVFTKGKVYKI

SEQ ID NO: 2669028 - protein, 24 aa, Entamoeba histolytica
YNHKLKKFYLLHGLYCQLLETALR

SEQ ID NO: 2669029 - protein, 18 aa, Entamoeba histolytica
YNLAAGDFPPIDVYKDRL

SEQ ID NO: 2669030 - protein, 29 aa, Entamoeba histolytica
YPCQCSALRKGGYVVIKGRPCKVFEMSTS

SEQ ID NO: 2669031 - protein, 18 aa, Entamoeba histolytica
YPFKAPRVTFMTKVYHPN

SEQ ID NO: 2669032 - protein, 23 aa, Entamoeba histolytica
YPHKRPVDYYAEMLKSDEHMERI

SEQ ID NO: 2669033 - protein, 23 aa, Entamoeba histolytica
YPYMKELVPLPSIYYKSYIAANQ

SEQ ID NO: 2669034 - protein, 32 aa, Entamoeba histolytica
YQEKRDFERGIKIEELQQFLPLEEKEEREEAI

SEQ ID NO: 2669035 - protein, 19 aa, Entamoeba histolytica
YQSIFDIKSGMIIEGTIKE

SEQ ID NO: 2669036 - protein, 17 aa, Entamoeba histolytica
YQYLRFFLNDDQQLEKI

SEQ ID NO: 2669037 - protein, 19 aa, Entamoeba histolytica
YRITTAFANHFLRTLFSMP

SEQ ID NO: 2669038 - protein, 19 aa, Entamoeba histolytica
YSSQFARYIISSMNIGSLI

SEQ ID NO: 2669039 - protein, 18 aa, Entamoeba histolytica
YTDKKCKKSFFALNHEVS

SEQ ID NO: 2669040 - protein, 19 aa, Entamoeba histolytica
YTDKKCKKSFFALNHEVSA

SEQ ID NO: 2669041 - protein, 22 aa, Entamoeba histolytica
YTKLIFTLFCNIGMVSCDDFFG

SEQ ID NO: 2669042 - protein, 23 aa, Entamoeba histolytica
YTLYRKYRLSVLVDKKKGKSMKE

SEQ ID NO: 2669043 - protein, 19 aa, Entamoeba histolytica
YVDRGRMSTEIIITLFCMK

SEQ ID NO: 2669044 - protein, 20 aa, Entamoeba histolytica
YVSTVGVYILNYIDGTLTYK

SEQ ID NO: 2669045 - protein, 17 aa, Entamoeba histolytica
YVVKVEAGIDIRALKPN

SEQ ID NO: 2669046 - protein, 23 aa, Entamoeba histolytica
YYIMPCCTTRYVLDAKYSDFTDG

SEQ ID NO: 2669047 - protein, 28 aa, Entamoeba histolytica
YYLRSEEDIKIFITQFVKRCVNENKFCK

SEQ ID NO: 2669048 - protein, 18 aa, Entamoeba histolytica
YYNHVCIVTELLGINIYE

SEQ ID NO: 2669049 - protein, 17 aa, Entamoeba histolytica
YYVISAYGNKREEAKTE

SEQ ID NO: 2669050 - protein, 25 aa, Entamoeba histolytica
AAAAFNYKCCLCVGLHSDKTITTQK

SEQ ID NO: 2669051 - protein, 29 aa, Entamoeba histolytica
AACERAEKENKWILAYVFKENDLECLTFI

SEQ ID NO: 2669052 - protein, 24 aa, Entamoeba histolytica
AACSEDALCFGSLVLVNKDDNSFS

SEQ ID NO: 2669053 - protein, 22 aa, Entamoeba histolytica
AADAHFCMCLANAAVHVAMAGK

SEQ ID NO: 2669054 - protein, 21 aa, Entamoeba histolytica
AADNRYGLKYQFASANFHKVF

SEQ ID NO: 2669055 - protein, 27 aa, Entamoeba histolytica
AADWQQSDFLWSGRCLVTRSPEHCIIK

SEQ ID NO: 2669056 - protein, 17 aa, Entamoeba histolytica
AAEEFSSLISLMIDEFD

SEQ ID NO: 2669057 - protein, 18 aa, Entamoeba histolytica
AAELFGVDAESLRKAIIQ

SEQ ID NO: 2669058 - protein, 24 aa, Entamoeba histolytica
AAFCCPYEGCTKAFEYPSHLFKHC

SEQ ID NO: 2669059 - protein, 18 aa, Entamoeba histolytica
AAGIYCFQPYCVTGQLEP

SEQ ID NO: 2669060 - protein, 20 aa, Entamoeba histolytica
AAGQGLMWWMQRELEEKKKF

SEQ ID NO: 2669061 - protein, 18 aa, Entamoeba histolytica
AAHVSMVIIERNLFDLNM

SEQ ID NO: 2669062 - protein, 23 aa, Entamoeba histolytica
AAIFRMKRTWEVVNQDPNKAEFD

SEQ ID NO: 2669063 - protein, 18 aa, Entamoeba histolytica
AAIPHALAGRDIIGAART

SEQ ID NO: 2669064 - protein, 32 aa, Entamoeba histolytica
AAKEIDGKEFLGYHLRADWEVNKGKKRNIRQT

SEQ ID NO: 2669065 - protein, 20 aa, Entamoeba histolytica
AAKFRGLWKSYYPNVKCIAF

SEQ ID NO: 2669066 - protein, 20 aa, Entamoeba histolytica
AAKFRGLWKSYYPNVKCIAY

SEQ ID NO: 2669067 - protein, 22 aa, Entamoeba histolytica
AAKIAGISCLRLMNEHTATALA

SEQ ID NO: 2669068 - protein, 24 aa, Entamoeba histolytica
AALEMKKDIPTIVKYMKESTASVE

SEQ ID NO: 2669069 - protein, 17 aa, Entamoeba histolytica
AALGLTIACSVALGYSN

SEQ ID NO: 2669070 - protein, 21 aa, Entamoeba histolytica
AALLWVFYIRQSFIKQHSFDK

SEQ ID NO: 2669071 - protein, 24 aa, Entamoeba histolytica
AALQKRLHEELAQLVTQEGNCVCA

SEQ ID NO: 2669072 - protein, 19 aa, Entamoeba histolytica
AALTFNYLIKLLESLGYFV

SEQ ID NO: 2669073 - protein, 21 aa, Entamoeba histolytica
AALVSRFDLLFVLLDDATQDF

SEQ ID NO: 2669074 - protein, 18 aa, Entamoeba histolytica
AAMNEIPEQYAIMKQLGY

SEQ ID NO: 2669075 - protein, 17 aa, Entamoeba histolytica
AAMSMPGMMDTILNLGL

SEQ ID NO: 2669076 - protein, 19 aa, Entamoeba histolytica
AAMSMPGMMDTILNLGLND

SEQ ID NO: 2669077 - protein, 24 aa, Entamoeba histolytica
AAPICTLALRSLRYLSSLELSAPL

SEQ ID NO: 2669078 - protein, 20 aa, Entamoeba histolytica
AAPPAYLLAGLYLIDSLIRY

SEQ ID NO: 2669079 - protein, 17 aa, Entamoeba histolytica
AAQTRSAYQMIFMNPYY

SEQ ID NO: 2669080 - protein, 17 aa, Entamoeba histolytica
AARLASFYERAGMVECL

SEQ ID NO: 2669081 - protein, 21 aa, Entamoeba histolytica
AASSFTCCFVLKNITFSSNLQ

SEQ ID NO: 2669082 - protein, 17 aa, Entamoeba histolytica
AATLCGTPLYAAPELFE

SEQ ID NO: 2669083 - protein, 17 aa, Entamoeba histolytica
AAVEWRNNREEFKKKVR

SEQ ID NO: 2669084 - protein, 17 aa, Entamoeba histolytica
AAVHSRVNSSIDMTVST

SEQ ID NO: 2669085 - protein, 24 aa, Entamoeba histolytica
AAVPRKRTALVLDQTDISVAILEE

SEQ ID NO: 2669086 - protein, 19 aa, Entamoeba histolytica
AAYLEHWWNVVNWKFVEEQ

SEQ ID NO: 2669087 - protein, 23 aa, Entamoeba histolytica
ACAAFDYQCVLVLGIVNNEIIEQ

SEQ ID NO: 2669088 - protein, 17 aa, Entamoeba histolytica
ACANATSKINALVTGKK

SEQ ID NO: 2669089 - protein, 20 aa, Entamoeba histolytica
ACCKQMKNMVISLINNNDIV

SEQ ID NO: 2669090 - protein, 20 aa, Entamoeba histolytica
ACDCRLRYTQKLSLYNPIDI

SEQ ID NO: 2669091 - protein, 22 aa, Entamoeba histolytica
ACDLETLLYCPNKLPESLKIEL

SEQ ID NO: 2669092 - protein, 18 aa, Entamoeba histolytica
ACDYGICFEQIHGNSISV

SEQ ID NO: 2669093 - protein, 24 aa, Entamoeba histolytica
ACEKSYRGLVEMLINKGANVNCCD

SEQ ID NO: 2669094 - protein, 20 aa, Entamoeba histolytica
ACFKIWKEEMGCNYCAECGV

SEQ ID NO: 2669095 - protein, 18 aa, Entamoeba histolytica
ACFKMSSNIPKTIIRSSS

SEQ ID NO: 2669096 - protein, 18 aa, Entamoeba histolytica
ACGIWECKGCKKQIAGGA

SEQ ID NO: 2669097 - protein, 25 aa, Entamoeba histolytica
ACGVFSCAYLKLSEKQEICGKRLKL

SEQ ID NO: 2669098 - protein, 19 aa, Entamoeba histolytica
ACINIRVVQVVGGVDVIRI

SEQ ID NO: 2669099 - protein, 20 aa, Entamoeba histolytica
ACKLSDYKYVRALKSTVFVL

SEQ ID NO: 2669100 - protein, 18 aa, Entamoeba histolytica
ACLALGMNRSCLKSAKLG

SEQ ID NO: 2669101 - protein, 21 aa, Entamoeba histolytica
ACNFKRIEYGPSLLSIANTSY

SEQ ID NO: 2669102 - protein, 22 aa, Entamoeba histolytica
ACNGKPFVMCLINLDPSSNKIH

SEQ ID NO: 2669103 - protein, 21 aa, Entamoeba histolytica
ACPKEFSSMIIKTNLKEYLVQ

SEQ ID NO: 2669104 - protein, 19 aa, Entamoeba histolytica
ACRLLPLIGGDAEMFESIL

SEQ ID NO: 2669105 - protein, 26 aa, Entamoeba histolytica
ACSAFNLPVIISKGILKTLEVEVPWK

SEQ ID NO: 2669106 - protein, 26 aa, Entamoeba histolytica
ACSILYKTKLPLIIVFTKTDVIPCTK

SEQ ID NO: 2669107 - protein, 29 aa, Entamoeba histolytica
ACSLYPSAVARLFLPSGAPRVMKKPIQWY

SEQ ID NO: 2669108 - protein, 29 aa, Entamoeba histolytica
ACSLYPSAVARLFLPSGAPRVMNKPLQWY

SEQ ID NO: 2669109 - protein, 30 aa, Entamoeba histolytica
ACSWVTKGLKEWGGAILVGFDGDPYGKDEE

SEQ ID NO: 2669110 - protein, 23 aa, Entamoeba histolytica
ACTTRTFDLGWIPELDRFKRSQP

SEQ ID NO: 2669111 - protein, 26 aa, Entamoeba histolytica
ACWELFSNTELFNFIIVYLSKQFDIY

SEQ ID NO: 2669112 - protein, 18 aa, Entamoeba histolytica
ADAHFCLCLANAAVHVAM

SEQ ID NO: 2669113 - protein, 19 aa, Entamoeba histolytica
ADAHFCLCLANAAVHVAMA

SEQ ID NO: 2669114 - protein, 25 aa, Entamoeba histolytica
ADALLSILQFLLIRSKIQHPFSIIK

SEQ ID NO: 2669115 - protein, 19 aa, Entamoeba histolytica
ADCCGLVFDVSNPKSFEQL

SEQ ID NO: 2669116 - protein, 18 aa, Entamoeba histolytica
ADCIFYFNRIKLPTEFLP

SEQ ID NO: 2669117 - protein, 21 aa, Entamoeba histolytica
ADDAFENDGEFVVENGENDDW

SEQ ID NO: 2669118 - protein, 26 aa, Entamoeba histolytica
ADDAVLVFDCGSSFIKVGVAGEEQPR

SEQ ID NO: 2669119 - protein, 17 aa, Entamoeba histolytica
ADEEIDRRNALMRKVID

SEQ ID NO: 2669120 - protein, 19 aa, Entamoeba histolytica
ADEELWGVFQECHKVWAKT

SEQ ID NO: 2669121 - protein, 18 aa, Entamoeba histolytica
ADEGVCLIDEFDKMDDQD

SEQ ID NO: 2669122 - protein, 24 aa, Entamoeba histolytica
ADEIRRYGEFFGMIEENMKKEHNT

SEQ ID NO: 2669123 - protein, 21 aa, Entamoeba histolytica
ADEKILKQQFEKFGGITDCKV

SEQ ID NO: 2669124 - protein, 17 aa, Entamoeba histolytica
ADEKLAFVKTLLTNFTP

SEQ ID NO: 2669125 - protein, 18 aa, Entamoeba histolytica
ADETRIREEFGKYGKVEI

SEQ ID NO: 2669126 - protein, 17 aa, Entamoeba histolytica
ADGCFQNGMALDITRYV

SEQ ID NO: 2669127 - protein, 18 aa, Entamoeba histolytica
ADGKECCPNRHNGCRIFL

SEQ ID NO: 2669128 - protein, 21 aa, Entamoeba histolytica
ADGKKGILPFYVLDQLNQMVQ

SEQ ID NO: 2669129 - protein, 21 aa, Entamoeba histolytica
ADGTCRYAMFLVSYEKMNESE

SEQ ID NO: 2669130 - protein, 19 aa, Entamoeba histolytica
ADGTFWPIPITMSVSEEEA

SEQ ID NO: 2669131 - protein, 19 aa, Entamoeba histolytica
ADHVNAFLLSLENGILDPP

SEQ ID NO: 2669132 - protein, 25 aa, Entamoeba histolytica
ADIFSLGCVLAYLFLENSLFDVSNI

SEQ ID NO: 2669133 - protein, 18 aa, Entamoeba histolytica
ADIIVPWGEIEKAQTPGV

SEQ ID NO: 2669134 - protein, 19 aa, Entamoeba histolytica
ADIIVPWGEIEKAQTPGVL

SEQ ID NO: 2669135 - protein, 24 aa, Entamoeba histolytica
ADIKAICTEAGLLALRERRMKVNQ

SEQ ID NO: 2669136 - protein, 20 aa, Entamoeba histolytica
ADILLPSFIYIVIRANTTHL

SEQ ID NO: 2669137 - protein, 21 aa, Entamoeba histolytica
ADILPLKLCVYLFSSISKLIA

SEQ ID NO: 2669138 - protein, 25 aa, Entamoeba histolytica
ADIWALGCTIIELITGNPPYYDLNP

SEQ ID NO: 2669139 - protein, 20 aa, Entamoeba histolytica
ADIWSIGVILVRMLTGKYPF

SEQ ID NO: 2669140 - protein, 19 aa, Entamoeba histolytica
ADIYSCGIVLYNMICNSFP

SEQ ID NO: 2669141 - protein, 19 aa, Entamoeba histolytica
ADKPFICKDYLHTFEILNA

SEQ ID NO: 2669142 - protein, 17 aa, Entamoeba histolytica
ADLAEIGRNCFKNCHSL

SEQ ID NO: 2669143 - protein, 28 aa, Entamoeba histolytica
ADLAPTHPIRLGLALNFSVFYYEIMNDA

SEQ ID NO: 2669144 - protein, 19 aa, Entamoeba histolytica
ADLDHLRLIDGYIHEEQQA

SEQ ID NO: 2669145 - protein, 25 aa, Entamoeba histolytica
ADLLFPLCLFLTIKAQLPYFDSTIY

SEQ ID NO: 2669146 - protein, 24 aa, Entamoeba histolytica
ADLLRKIHSLFTFSITSYDDLENS

SEQ ID NO: 2669147 - protein, 18 aa, Entamoeba histolytica
ADLSLKCLDLESAFDACK

SEQ ID NO: 2669148 - protein, 24 aa, Entamoeba histolytica
ADMFGGECMFMFINSQKLDNWKKE

SEQ ID NO: 2669149 - protein, 21 aa, Entamoeba histolytica
ADMGLEFLTRLFLINNEIIKK

SEQ ID NO: 2669150 - protein, 23 aa, Entamoeba histolytica
ADMNNRVAMMMKFIEVANELESL

SEQ ID NO: 2669151 - protein, 22 aa, Entamoeba histolytica
ADNNGSIGFYEFIALYNWVKLC

SEQ ID NO: 2669152 - protein, 23 aa, Entamoeba histolytica
ADNNGSIGFYEFIALYNWVKLCV

SEQ ID NO: 2669153 - protein, 20 aa, Entamoeba histolytica
ADNQPGVLIQVFEGEASMTN

SEQ ID NO: 2669154 - protein, 19 aa, Entamoeba histolytica
ADNVLPFIYDVFRELNNDK

SEQ ID NO: 2669155 - protein, 25 aa, Entamoeba histolytica
ADPQLGYLCKIGYVDAIICEDSDLI

SEQ ID NO: 2669156 - protein, 23 aa, Entamoeba histolytica
ADPRLPKPLFEENLPKGYESVLK

SEQ ID NO: 2669157 - protein, 27 aa, Entamoeba histolytica
ADPVPRIVSRVCDFVSCLLDNIDSNLM

SEQ ID NO: 2669158 - protein, 20 aa, Entamoeba histolytica
ADQFRPLGIQVFHIQENSTM

SEQ ID NO: 2669159 - protein, 21 aa, Entamoeba histolytica
ADQFRPLGIQVFHIQENSTMF

SEQ ID NO: 2669160 - protein, 20 aa, Entamoeba histolytica
ADSFSKLALSIHWKNRKCIA

SEQ ID NO: 2669161 - protein, 23 aa, Entamoeba histolytica
ADSKIFEVVKCITIDVQRETMKK

SEQ ID NO: 2669162 - protein, 23 aa, Entamoeba histolytica
ADSKYDIVQGFPINGQPKIIVQK

SEQ ID NO: 2669163 - protein, 18 aa, Entamoeba histolytica
ADTALYECALYLARAPKS

SEQ ID NO: 2669164 - protein, 21 aa, Entamoeba histolytica
ADTEYAHSFFIPLSTPNEDEL

SEQ ID NO: 2669165 - protein, 18 aa, Entamoeba histolytica
ADTFRPLFQYNVDSPQLI

SEQ ID NO: 2669166 - protein, 19 aa, Entamoeba histolytica
ADTTYGVFLCRDCSNCHKN

SEQ ID NO: 2669167 - protein, 17 aa, Entamoeba histolytica
ADTVIIFDSDWNPQNDL

SEQ ID NO: 2669168 - protein, 24 aa, Entamoeba histolytica
ADVCLRSAAAPSYYKPYQNYVDGG

SEQ ID NO: 2669169 - protein, 17 aa, Entamoeba histolytica
ADVIAFGMKEWAEELGA

SEQ ID NO: 2669170 - protein, 17 aa, Entamoeba histolytica
ADVQWKVYLEVALTACD

SEQ ID NO: 2669171 - protein, 23 aa, Entamoeba histolytica
ADVTRLFYKAAIMENTMLGDEES

SEQ ID NO: 2669172 - protein, 18 aa, Entamoeba histolytica
ADVVAFGMKEWAEELGAV

SEQ ID NO: 2669173 - protein, 26 aa, Entamoeba histolytica
ADVWAAGCLLYKLEFFVTPFDGSPMK

SEQ ID NO: 2669174 - protein, 25 aa, Entamoeba histolytica
ADYLHTLMFKMCDILAMKAHIIFTM

SEQ ID NO: 2669175 - protein, 24 aa, Entamoeba histolytica
ADYRIPQVLLGWDVLDIEDQLKQK

SEQ ID NO: 2669176 - protein, 20 aa, Entamoeba histolytica
AEAAMLLRNCEIMEYSDVEH

SEQ ID NO: 2669177 - protein, 18 aa, Entamoeba histolytica
AEALRINTVLKEFKFPIS

SEQ ID NO: 2669178 - protein, 21 aa, Entamoeba histolytica
AEAMIKLLIVYFKSLYNQKEI

SEQ ID NO: 2669179 - protein, 29 aa, Entamoeba histolytica
AEANAAYVRFLMKLFRILGRSEVMGVFEY

SEQ ID NO: 2669180 - protein, 28 aa, Entamoeba histolytica
AEAPSEFVFYIPSMKAFCASEEINHIMH

SEQ ID NO: 2669181 - protein, 17 aa, Entamoeba histolytica
AECGCENPQWVSVNLGI

SEQ ID NO: 2669182 - protein, 17 aa, Entamoeba histolytica
AECKMKYSLTLYYQFCS

SEQ ID NO: 2669183 - protein, 21 aa, Entamoeba histolytica
AECRIFKALAKLMTKRYCNNF

SEQ ID NO: 2669184 - protein, 18 aa, Entamoeba histolytica
AECVIKKYKNGACDRVVC

SEQ ID NO: 2669185 - protein, 17 aa, Entamoeba histolytica
AECYSLKSITLPLSIIK

SEQ ID NO: 2669186 - protein, 24 aa, Entamoeba histolytica
AEDECPCCRKSLNRLASYSSPGFI

SEQ ID NO: 2669187 - protein, 21 aa, Entamoeba histolytica
AEDHFRMLIIDSVTSLFRVDF

SEQ ID NO: 2669188 - protein, 21 aa, Entamoeba histolytica
AEDKGKEIIKLLGENKKKLVE

SEQ ID NO: 2669189 - protein, 19 aa, Entamoeba histolytica
AEEDFKMLGLDKVITVVLR

SEQ ID NO: 2669190 - protein, 22 aa, Entamoeba histolytica
AEEELRKAFTLSKKKGTKKGSS

SEQ ID NO: 2669191 - protein, 24 aa, Entamoeba histolytica
AEEFISRLVLPLTRLLQNEILRDA

SEQ ID NO: 2669192 - protein, 18 aa, Entamoeba histolytica
AEEFNRCVGSYKNILFVI

SEQ ID NO: 2669193 - protein, 25 aa, Entamoeba histolytica
AEELHCLFCEVSALDGTNITQAFTE

SEQ ID NO: 2669194 - protein, 24 aa, Entamoeba histolytica
AEELIKVYEWCLGVDEIKTYEMGG

SEQ ID NO: 2669195 - protein, 21 aa, Entamoeba histolytica
AEELKKKFGVQAIEKSWQLKL

SEQ ID NO: 2669196 - protein, 18 aa, Entamoeba histolytica
AEEMKVKLGEEVGYSIRF

SEQ ID NO: 2669197 - protein, 29 aa, Entamoeba histolytica
AEERLAILRRLKIEYRFNSVKEMIQDATS

SEQ ID NO: 2669198 - protein, 27 aa, Entamoeba histolytica
AEERRLRGQYPYQWKRTASEMAAYNYR

SEQ ID NO: 2669199 - protein, 24 aa, Entamoeba histolytica
AEESIKILLDFVAKTEVVDRLFHY

SEQ ID NO: 2669200 - protein, 22 aa, Entamoeba histolytica
AEEVLKSYIWSTVGCELANIRM

SEQ ID NO: 2669201 - protein, 17 aa, Entamoeba histolytica
AEEWFRKVIFIDPNYGD

SEQ ID NO: 2669202 - protein, 17 aa, Entamoeba histolytica
AEFAEALYLAEKAAQEE

SEQ ID NO: 2669203 - protein, 25 aa, Entamoeba histolytica
AEFRSKKRIPICTYFNQVTHGAIYR

SEQ ID NO: 2669204 - protein, 23 aa, Entamoeba histolytica
AEGFIKCGIIQKVIQCYDSISNK

SEQ ID NO: 2669205 - protein, 17 aa, Entamoeba histolytica
AEGKRTTPSYVSFTPTG

SEQ ID NO: 2669206 - protein, 23 aa, Entamoeba histolytica
AEGTCAALVKAGKCYATATEDMD

SEQ ID NO: 2669207 - protein, 17 aa, Entamoeba histolytica
AEGTGNVVFSVKFEAIV

SEQ ID NO: 2669208 - protein, 26 aa, Entamoeba histolytica
AEHPAFKCLYSFREIRNYQSEQESVL

SEQ ID NO: 2669209 - protein, 24 aa, Entamoeba histolytica
AEIFKANIVAWEYPGYTKGSHYSD

SEQ ID NO: 2669210 - protein, 25 aa, Entamoeba histolytica
AEIFRRCATMRKHWRQAQYTQHTIE

SEQ ID NO: 2669211 - protein, 19 aa, Entamoeba histolytica
AEIGSKFVLFGGAVSGEII

SEQ ID NO: 2669212 - protein, 19 aa, Entamoeba histolytica
AEIKQIIAMEFLDNYNQIN

SEQ ID NO: 2669213 - protein, 20 aa, Entamoeba histolytica
AEINPFFIGSWIDMSQQGGM

SEQ ID NO: 2669214 - protein, 17 aa, Entamoeba histolytica
AEISRVIATFILSKLFS

SEQ ID NO: 2669215 - protein, 20 aa, Entamoeba histolytica
AEITFYIKCQIAAFCELLRD

SEQ ID NO: 2669216 - protein, 25 aa, Entamoeba histolytica
AEKALEFGKSLHLRCDSIEVSHIIN

SEQ ID NO: 2669217 - protein, 33 aa, Entamoeba histolytica; identical to SEQ ID NO: 2474678

SEQ ID NO: 2669218 - protein, 24 aa, Entamoeba histolytica
AEKGEYHINCKLNRRHIAGSPFKQ

SEQ ID NO: 2669219 - protein, 17 aa, Entamoeba histolytica
AEKYVNGSIFLQKPPTE

SEQ ID NO: 2669220 - protein, 28 aa, Entamoeba histolytica
AELAPTHPIRLGLALNFSVFYFEIMNDA

SEQ ID NO: 2669221 - protein, 22 aa, Entamoeba histolytica
AELGDLPLSVFLMEKPEDIKKV

SEQ ID NO: 2669222 - protein, 17 aa, Entamoeba histolytica
AELGESINWISNITSSS

SEQ ID NO: 2669223 - protein, 21 aa, Entamoeba histolytica
AELHFKMAMIYKQHAQYEECF

SEQ ID NO: 2669224 - protein, 23 aa, Entamoeba histolytica
AELHSTLKRRSCIVSPGKLDHST

SEQ ID NO: 2669225 - protein, 36 aa, Entamoeba histolytica
AELIFTEFMFCARLQIFKTWFEDIIKKEIPLLKHQE

SEQ ID NO: 2669226 - protein, 21 aa, Entamoeba histolytica
AELKARLAKRKELAESVKMNQ

SEQ ID NO: 2669227 - protein, 26 aa, Entamoeba histolytica
AELKKAYKKLALKWHPDRNINNQQEA

SEQ ID NO: 2669228 - protein, 17 aa, Entamoeba histolytica
AELKQSHFINGKLVIEL

SEQ ID NO: 2669229 - protein, 18 aa, Entamoeba histolytica
AELLLFFLHCKVDKEVVE

SEQ ID NO: 2669230 - protein, 18 aa, Entamoeba histolytica
AELLWKDKIDDGTLELFR

SEQ ID NO: 2669231 - protein, 24 aa, Entamoeba histolytica
AELPWEKGSAIVIIRTKYGKTARY

SEQ ID NO: 2669232 - protein, 22 aa, Entamoeba histolytica
AELRKQMRIRQEMLYRTKQLMI

SEQ ID NO: 2669233 - protein, 17 aa, Entamoeba histolytica
AELTRLQGTYMFNKHRV

SEQ ID NO: 2669234 - protein, 18 aa, Entamoeba histolytica
AEMAKQLLEIRDIIRENN

SEQ ID NO: 2669235 - protein, 20 aa, Entamoeba histolytica
AEMNRPVCVVGMMKLFSLSP

SEQ ID NO: 2669236 - protein, 26 aa, Entamoeba histolytica
AENGLFLDMCTVVLKTLRHNQSVIIS

SEQ ID NO: 2669237 - protein, 21 aa, Entamoeba histolytica
AENIATWFELYSWWKDNEDAQ

SEQ ID NO: 2669238 - protein, 19 aa, Entamoeba histolytica
AENIWRLYFLVTELDVENG

SEQ ID NO: 2669239 - protein, 25 aa, Entamoeba histolytica
AENLAVKWGALYLEVSAIEGTNIDT

SEQ ID NO: 2669240 - protein, 26 aa, Entamoeba histolytica
AENLKAMWPRKGFYLGNFDIDYRHET

SEQ ID NO: 2669241 - protein, 18 aa, Entamoeba histolytica
AENLRISLWNGDVTLENL

SEQ ID NO: 2669242 - protein, 17 aa, Entamoeba histolytica
AEPDVVCMLVGNKADNN

SEQ ID NO: 2669243 - protein, 22 aa, Entamoeba histolytica
AEPSLILSKAVKLFKAVIRNNK

SEQ ID NO: 2669244 - protein, 22 aa, Entamoeba histolytica
AEPYLMKYFPGISLTDVRVEHE

SEQ ID NO: 2669245 - protein, 17 aa, Entamoeba histolytica
AEQFFVYDIKLIKKLTM

SEQ ID NO: 2669246 - protein, 29 aa, Entamoeba histolytica
AERFYEQRNFFGLCAIVFALHKIQDFDYL

SEQ ID NO: 2669247 - protein, 18 aa, Entamoeba histolytica
AERLEMEIGTKKSIIQDI

SEQ ID NO: 2669248 - protein, 18 aa, Entamoeba histolytica
AERLYICEHCLKYMSKAN

SEQ ID NO: 2669249 - protein, 20 aa, Entamoeba histolytica
AESCKAVIKKYIDVAMIYIH

SEQ ID NO: 2669250 - protein, 23 aa, Entamoeba histolytica
AESLKTVSVVLSWFAEPTEEEIS

SEQ ID NO: 2669251 - protein, 20 aa, Entamoeba histolytica
AESRKSYKELVAKRNEEVAK

SEQ ID NO: 2669252 - protein, 21 aa, Entamoeba histolytica
AETLNSFNLVLFSRVTYEELI

SEQ ID NO: 2669253 - protein, 17 aa, Entamoeba histolytica
AETYPPYYDMPPMRVLM

SEQ ID NO: 2669254 - protein, 30 aa, Entamoeba histolytica; identical to SEQ ID NO: 2474726

SEQ ID NO: 2669255 - protein, 21 aa, Entamoeba histolytica
AEVELSLYILHESWMLSEEMN

SEQ ID NO: 2669256 - protein, 24 aa, Entamoeba histolytica
AEVICKRAFQLFLLEQISKEQYIE

SEQ ID NO: 2669257 - protein, 47 aa, Entamoeba histolytica
AEVKEGENKECVQIIQLLNAHRRALDWMERSTNELKDNIDDIAQDII

SEQ ID NO: 2669258 - protein, 23 aa, Entamoeba histolytica
AEVKIIQPFVWKGVNPYEKMDVN

SEQ ID NO: 2669259 - protein, 23 aa, Entamoeba histolytica
AEVLRDFPALSIKVGDKEESIMT

SEQ ID NO: 2669260 - protein, 18 aa, Entamoeba histolytica
AEVLTTIFRELLDNKENS

SEQ ID NO: 2669261 - protein, 21 aa, Entamoeba histolytica
AEWLLKCQTYEGGFSGCPGGE

SEQ ID NO: 2669262 - protein, 30 aa, Entamoeba histolytica
AEYEKMKFGIWLKKLQIVLTEDSKEIINIS

SEQ ID NO: 2669263 - protein, 25 aa, Entamoeba histolytica
AEYIKVVICKRCYNCTRRKTNDTRV

SEQ ID NO: 2669264 - protein, 20 aa, Entamoeba histolytica
AEYLAKIVYKFRSSVESYCH

SEQ ID NO: 2669265 - protein, 20 aa, Entamoeba histolytica
AEYPCKIGGQGYDISVKNFK

SEQ ID NO: 2669266 - protein, 25 aa, Entamoeba histolytica
AEYYQCAINNYKICNDQEKVITSLK

SEQ ID NO: 2669267 - protein, 18 aa, Entamoeba histolytica
AFAKRASQLYDVYKRRCA

SEQ ID NO: 2669268 - protein, 19 aa, Entamoeba histolytica
AFALTYFRDIVVARFSDES

SEQ ID NO: 2669269 - protein, 24 aa, Entamoeba histolytica
AFARALRQLPMIIADNAGYDSADL

SEQ ID NO: 2669270 - protein, 17 aa, Entamoeba histolytica
AFDELKLIISQLSIINI

SEQ ID NO: 2669271 - protein, 31 aa, Entamoeba histolytica
AFDILILARCWLKFSYVYSFYSSEEGKITDL

SEQ ID NO: 2669272 - protein, 23 aa, Entamoeba histolytica
AFERRRLPSSIAHSSRRLLSRRL

SEQ ID NO: 2669273 - protein, 23 aa, Entamoeba histolytica
AFFFARDFCHFVNLWDMRYQRCL

SEQ ID NO: 2669274 - protein, 23 aa, Entamoeba histolytica
AFFGHLIHLFGVFYKSKDVFKSM

SEQ ID NO: 2669275 - protein, 21 aa, Entamoeba histolytica
AFFSIEIMNFILMTKKHDFNL

SEQ ID NO: 2669276 - protein, 25 aa, Entamoeba histolytica
AFGYYKMIRKPMCIENIKTKLNDNK

SEQ ID NO: 2669277 - protein, 18 aa, Entamoeba histolytica
AFHLPKISIVQQINETNK

SEQ ID NO: 2669278 - protein, 19 aa, Entamoeba histolytica
AFIIYGKCLLYYYQFEEAR

SEQ ID NO: 2669279 - protein, 17 aa, Entamoeba histolytica
AFIKKFIRFSSLDQSFS

SEQ ID NO: 2669280 - protein, 18 aa, Entamoeba histolytica
AFIMNVCMLDGFEKLFGS

SEQ ID NO: 2669281 - protein, 17 aa, Entamoeba histolytica
AFIRFEGLKRGKYCVRV

SEQ ID NO: 2669282 - protein, 18 aa, Entamoeba histolytica
AFIRFSRFIGNCITKSQK

SEQ ID NO: 2669283 - protein, 18 aa, Entamoeba histolytica
AFISLPYKTFPKYQLNLF

SEQ ID NO: 2669284 - protein, 22 aa, Entamoeba histolytica
AFKDYKGCTVYKKIKALPNEGL

SEQ ID NO: 2669285 - protein, 17 aa, Entamoeba histolytica
AFKKIPTVLSVFTQLTR

SEQ ID NO: 2669286 - protein, 19 aa, Entamoeba histolytica
AFKNCAKVSHLILSTNITS

SEQ ID NO: 2669287 - protein, 17 aa, Entamoeba histolytica
AFLAKLLAFLRKHKEKI

SEQ ID NO: 2669288 - protein, 23 aa, Entamoeba histolytica
AFLNGCGRYKNELEKEVTFQNQL

SEQ ID NO: 2669289 - protein, 17 aa, Entamoeba histolytica
AFLRPETAQGIFTMFKR

SEQ ID NO: 2669290 - protein, 17 aa, Entamoeba histolytica
AFLSRRMMEQPNKYGKG

SEQ ID NO: 2669291 - protein, 19 aa, Entamoeba histolytica
AFLTVARKVVKTMKKEDNH

SEQ ID NO: 2669292 - protein, 26 aa, Entamoeba histolytica
AFMLRCPGCLQMYYCEGCNENNHTLQ

SEQ ID NO: 2669293 - protein, 23 aa, Entamoeba histolytica
AFMSFEIIHSMFLDQTAKICDIV

SEQ ID NO: 2669294 - protein, 18 aa, Entamoeba histolytica
AFNHCPYLTSIVLPSSLK

SEQ ID NO: 2669295 - protein, 19 aa, Entamoeba histolytica
AFNKLPSTLKFVLKESEPY

SEQ ID NO: 2669296 - protein, 20 aa, Entamoeba histolytica
AFNSGFLVLHFKNFFKEEDA

SEQ ID NO: 2669297 - protein, 18 aa, Entamoeba histolytica
AFPKYVEVLNISKMLCQS

SEQ ID NO: 2669298 - protein, 26 aa, Entamoeba histolytica
AFPTAFHIAGLWKIDRLIAEMKLCYE

SEQ ID NO: 2669299 - protein, 18 aa, Entamoeba histolytica
AFQILKYLPPFYHCILLL

SEQ ID NO: 2669300 - protein, 24 aa, Entamoeba histolytica
AFQPYCLSEAITPEAALEHLSNGN

SEQ ID NO: 2669301 - protein, 18 aa, Entamoeba histolytica
AFRENGVKEIVDFLYRCM

SEQ ID NO: 2669302 - protein, 18 aa, Entamoeba histolytica
AFRMIEMYWTCYNLHHQN

SEQ ID NO: 2669303 - protein, 21 aa, Entamoeba histolytica
AFRQLIYKCLDAWSQTVNDLI

SEQ ID NO: 2669304 - protein, 23 aa, Entamoeba histolytica
AFSFSNPYGHGAIRYICDEPDTT

SEQ ID NO: 2669305 - protein, 17 aa, Entamoeba histolytica
AFSKQIEEMFGREMTIT

SEQ ID NO: 2669306 - protein, 18 aa, Entamoeba histolytica
AFSPFKLSQIKKVFENKE

SEQ ID NO: 2669307 - protein, 19 aa, Entamoeba histolytica
AFSQFIPLLNVYKTYVGNT

SEQ ID NO: 2669308 - protein, 18 aa, Entamoeba histolytica
AFSSFPRDTEFISILINE

SEQ ID NO: 2669309 - protein, 18 aa, Entamoeba histolytica
AFTCTSDGSNLIWVGEDA

SEQ ID NO: 2669310 - protein, 27 aa, Entamoeba histolytica
AFTICNNNIWLAMPMFNQIGIVSFNYQ

SEQ ID NO: 2669311 - protein, 25 aa, Entamoeba histolytica
AFTMFDQLFRYFGLKKAEYLQAGFK

SEQ ID NO: 2669312 - protein, 18 aa, Entamoeba histolytica
AFTNRFCTCIENKHCRVC

SEQ ID NO: 2669313 - protein, 18 aa, Entamoeba histolytica
AFTNRFCTCIENKLCRVC

SEQ ID NO: 2669314 - protein, 17 aa, Entamoeba histolytica
AFTQGVVNYDGRYYFMC

SEQ ID NO: 2669315 - protein, 18 aa, Entamoeba histolytica
AFVDEWFLAFSKQYHYCY

SEQ ID NO: 2669316 - protein, 17 aa, Entamoeba histolytica
AFVECWPDDAFTQYSKQ

SEQ ID NO: 2669317 - protein, 22 aa, Entamoeba histolytica
AFVLFRLIQEMAEFIGKDKKEI

SEQ ID NO: 2669318 - protein, 25 aa, Entamoeba histolytica
AFVMKEIIMGLAYLHGNNMMHRDIK

SEQ ID NO: 2669319 - protein, 18 aa, Entamoeba histolytica
AFVPWIPNNMQLAVCDIP

SEQ ID NO: 2669320 - protein, 18 aa, Entamoeba histolytica
AFVSPSFSVDFQWFPTEK

SEQ ID NO: 2669321 - protein, 18 aa, Entamoeba histolytica
AFVTQAIITCCIKTINVM

SEQ ID NO: 2669322 - protein, 24 aa, Entamoeba histolytica
AFWEERYDYFILLDKIQKSICLLK

SEQ ID NO: 2669323 - protein, 19 aa, Entamoeba histolytica
AFYGQERPVFVNGKIIKSS

SEQ ID NO: 2669324 - protein, 18 aa, Entamoeba histolytica
AFYKMSLKYHPDKHPDDK

SEQ ID NO: 2669325 - protein, 18 aa, Entamoeba histolytica
AFYRKQLKQTLKVKKVLA

SEQ ID NO: 2669326 - protein, 17 aa, Entamoeba histolytica
AGAHGKDTWGIFRVHQF

SEQ ID NO: 2669327 - protein, 24 aa, Entamoeba histolytica
AGAHGKDTWGIFRVHQFEKIEQFC

SEQ ID NO: 2669328 - protein, 17 aa, Entamoeba histolytica
AGAMVLADRGIVCVDEF

SEQ ID NO: 2669329 - protein, 20 aa, Entamoeba histolytica
AGANIEWLEEVGINYIVNCT

SEQ ID NO: 2669330 - protein, 17 aa, Entamoeba histolytica
AGAYSRIYLVKKKSTGD

SEQ ID NO: 2669331 - protein, 25 aa, Entamoeba histolytica
AGCANGVIILYEFKDNLLVELDTIN

SEQ ID NO: 2669332 - protein, 26 aa, Entamoeba histolytica
AGCCLKTGIIYTNWLKTGIVIIKCRF

SEQ ID NO: 2669333 - protein, 20 aa, Entamoeba histolytica
AGCEVMRLGGIVAILRYELN

SEQ ID NO: 2669334 - protein, 18 aa, Entamoeba histolytica
AGCGKSYVLSAIVEKLKH

SEQ ID NO: 2669335 - protein, 26 aa, Entamoeba histolytica
AGCICAELILGIPLFPGSSEYNELYK

SEQ ID NO: 2669336 - protein, 39 aa, Entamoeba histolytica; identical to SEQ ID NO: 2474801

SEQ ID NO: 2669337 - protein, 25 aa, Entamoeba histolytica
AGDLPRLLKHLSIVREVSEGNYDTL

SEQ ID NO: 2669338 - protein, 25 aa, Entamoeba histolytica
AGDLPRLLKHLTVYEIHNGDFYSVF

SEQ ID NO: 2669339 - protein, 23 aa, Entamoeba histolytica
AGDRKGILSFMYQILNKYRLGNC

SEQ ID NO: 2669340 - protein, 19 aa, Entamoeba histolytica
AGEEEVWEVLNNVIQPIIA

SEQ ID NO: 2669341 - protein, 26 aa, Entamoeba histolytica
AGETKPRKIVPFQIEKKLDEIVKNIR

SEQ ID NO: 2669342 - protein, 21 aa, Entamoeba histolytica
AGFFVCQGRFIFKELPTTISS

SEQ ID NO: 2669343 - protein, 35 aa, Entamoeba histolytica
AGFHCCWCSVNVHAKCLSLLPSHCSYGKFASVLTK

SEQ ID NO: 2669344 - protein, 20 aa, Entamoeba histolytica
AGGKSIEIGTIFKQPSSSFN

SEQ ID NO: 2669345 - protein, 26 aa, Entamoeba histolytica
AGHHQKRFKVFIAHDGIFNTEEQYIE

SEQ ID NO: 2669346 - protein, 31 aa, Entamoeba histolytica
AGICKAHGLGVMFTCKFYDRFIKRPLEKFDV

SEQ ID NO: 2669347 - protein, 23 aa, Entamoeba histolytica
AGIYKIKGGCIIVSDECVDALRY

SEQ ID NO: 2669348 - protein, 24 aa, Entamoeba histolytica
AGKGRTGLIDCLHSYEAVDLYGNA

SEQ ID NO: 2669349 - protein, 20 aa, Entamoeba histolytica
AGKGTLFLWFAYTPLKNSRK

SEQ ID NO: 2669350 - protein, 18 aa, Entamoeba histolytica
AGKIAVCRSSAWTSKIVT

SEQ ID NO: 2669351 - protein, 22 aa, Entamoeba histolytica
AGKRLVHERCFVCKVCKEKISG

SEQ ID NO: 2669352 - protein, 21 aa, Entamoeba histolytica
AGKSDGWCRDNFLQARALNKA

SEQ ID NO: 2669353 - protein, 17 aa, Entamoeba histolytica
AGLCHRVLVQLSYAIGV

SEQ ID NO: 2669354 - protein, 18 aa, Entamoeba histolytica
AGLFAELNKGTAISGGLK

SEQ ID NO: 2669355 - protein, 20 aa, Entamoeba histolytica
AGLGRSGTFIILFRIYEHHF

SEQ ID NO: 2669356 - protein, 25 aa, Entamoeba histolytica
AGLNEIRIIIKYPFKTNISLKKQLE

SEQ ID NO: 2669357 - protein, 24 aa, Entamoeba histolytica
AGLRGKMCAGFNCMNNLIVQQASQ

SEQ ID NO: 2669358 - protein, 18 aa, Entamoeba histolytica
AGMSRVYYNGALGAIVMC

SEQ ID NO: 2669359 - protein, 21 aa, Entamoeba histolytica
AGNKYRMGNLFIVGPTKTGKT

SEQ ID NO: 2669360 - protein, 21 aa, Entamoeba histolytica
AGPLLRAGIDIENVMNYYMVD

SEQ ID NO: 2669361 - protein, 26 aa, Entamoeba histolytica
AGPPVTCIGLKFIAGSLIITSARIIF

SEQ ID NO: 2669362 - protein, 18 aa, Entamoeba histolytica
AGQGTMWFMQRELDEKKK

SEQ ID NO: 2669363 - protein, 19 aa, Entamoeba histolytica
AGQGTMWWMQRELEEKKKY

SEQ ID NO: 2669364 - protein, 18 aa, Entamoeba histolytica
AGRFDREIALGIPSESQR

SEQ ID NO: 2669365 - protein, 26 aa, Entamoeba histolytica
AGRNGVLAIESWISLSDKGGCDAGWN

SEQ ID NO: 2669366 - protein, 26 aa, Entamoeba histolytica
AGRTEAGICYRLFTENTFKYDLLESP

SEQ ID NO: 2669367 - protein, 21 aa, Entamoeba histolytica
AGSLAFFSTTLNNVWANKCTK

SEQ ID NO: 2669368 - protein, 19 aa, Entamoeba histolytica
AGTELCINKILLMNLYQFF

SEQ ID NO: 2669369 - protein, 19 aa, Entamoeba histolytica
AGTFANELIVSYVFEMVIK

SEQ ID NO: 2669370 - protein, 26 aa, Entamoeba histolytica
AGTSLRLQTIIKMKYYLKKQISEKEM

SEQ ID NO: 2669371 - protein, 18 aa, Entamoeba histolytica
AGVAGGKMLAGKAKQVIE

SEQ ID NO: 2669372 - protein, 20 aa, Entamoeba histolytica
AGVIKTWIDSFAVSYDVTVK

SEQ ID NO: 2669373 - protein, 18 aa, Entamoeba histolytica
AGVITFKNGQSIRDLVKV

SEQ ID NO: 2669374 - protein, 19 aa, Entamoeba histolytica
AGVKFMYDCVMGLKQGFKG

SEQ ID NO: 2669375 - protein, 19 aa, Entamoeba histolytica
AGYCVATYILGVGDRHSDN

SEQ ID NO: 2669376 - protein, 18 aa, Entamoeba histolytica
AGYTECSIPFGIENENIP

SEQ ID NO: 2669377 - protein, 19 aa, Entamoeba histolytica
AHAKEGFDVAMTRMDAEDD

SEQ ID NO: 2669378 - protein, 20 aa, Entamoeba histolytica
AHAKEGFDVAMTRMDAEDDA

SEQ ID NO: 2669379 - protein, 20 aa, Entamoeba histolytica
AHALIDYIFYHSSYIYFNAN

SEQ ID NO: 2669380 - protein, 21 aa, Entamoeba histolytica
AHEKVCTCASIYNNGIFATGG

SEQ ID NO: 2669381 - protein, 19 aa, Entamoeba histolytica
AHFFPVKAVNCYNRKVISI

SEQ ID NO: 2669382 - protein, 25 aa, Entamoeba histolytica
AHFGEKWPGYEFEVHGLVCKNGKYY

SEQ ID NO: 2669383 - protein, 27 aa, Entamoeba histolytica
AHFHPRSEIPFVISSSYDTTVRVWDIK

SEQ ID NO: 2669384 - protein, 23 aa, Entamoeba histolytica
AHFKVCPTYPSVLVVPIEMNERM

SEQ ID NO: 2669385 - protein, 21 aa, Entamoeba histolytica
AHFQCPYCHYENTEVEQTSPI

SEQ ID NO: 2669386 - protein, 26 aa, Entamoeba histolytica
AHGDVRYGINMLQSFVKCGVTLGEKN

SEQ ID NO: 2669387 - protein, 19 aa, Entamoeba histolytica
AHGGSLVMIAKGNRSEMLT

SEQ ID NO: 2669388 - protein, 21 aa, Entamoeba histolytica
AHGKDTWGIFRVHQFEKIEQF

SEQ ID NO: 2669389 - protein, 22 aa, Entamoeba histolytica
AHGRLEELLIWAFNKQIITKDN

SEQ ID NO: 2669390 - protein, 25 aa, Entamoeba histolytica
AHIIEVLKEKLLRIRQIKSKWVKVL

SEQ ID NO: 2669391 - protein, 28 aa, Entamoeba histolytica
AHISRFCARFLGDYGFSIGISDVTPSAD

SEQ ID NO: 2669392 - protein, 20 aa, Entamoeba histolytica
AHIYSLPAMQYIGSVDNLID

SEQ ID NO: 2669393 - protein, 20 aa, Entamoeba histolytica
AHIYWRILFDHPQQTHDIML

SEQ ID NO: 2669394 - protein, 24 aa, Entamoeba histolytica
AHKEASVILLRYFNPIGAHKSGLL

SEQ ID NO: 2669395 - protein, 41 aa, Entamoeba histolytica
AHKTEFSRQTFFRLGLFSLLLHEVMLEFNISWNNSHEEETG

SEQ ID NO: 2669396 - protein, 17 aa, Entamoeba histolytica
AHLGGDCTFQGKIGKDA

SEQ ID NO: 2669397 - protein, 18 aa, Entamoeba histolytica
AHLISFQIPLLVHQLTDY

SEQ ID NO: 2669398 - protein, 20 aa, Entamoeba histolytica
AHLVPLKRLLIITNNKVTEE

SEQ ID NO: 2669399 - protein, 24 aa, Entamoeba histolytica
AHMHSAVSFLMRFSQHSLTISPND

SEQ ID NO: 2669400 - protein, 19 aa, Entamoeba histolytica
AHNQILEIPPTISRLTSLK

SEQ ID NO: 2669401 - protein, 21 aa, Entamoeba histolytica
AHPGCSRAFHLQCHDPPLFAI

SEQ ID NO: 2669402 - protein, 17 aa, Entamoeba histolytica
AHPLANVSVQFEKLFND

SEQ ID NO: 2669403 - protein, 21 aa, Entamoeba histolytica
AHQFIPILINDASVFPNNRQS

SEQ ID NO: 2669404 - protein, 26 aa, Entamoeba histolytica
AHQYQKVCIRSCVYIAEKKYIDVKDF

SEQ ID NO: 2669405 - protein, 20 aa, Entamoeba histolytica
AHRIGHEITAYYGLAHGETL

SEQ ID NO: 2669406 - protein, 17 aa, Entamoeba histolytica
AHSILSIIIPSKIISST

SEQ ID NO: 2669407 - protein, 20 aa, Entamoeba histolytica
AHTPAKLWNKLLLDKDYMKA

SEQ ID NO: 2669408 - protein, 19 aa, Entamoeba histolytica
AIAALINFFATMIRRTTFE

SEQ ID NO: 2669409 - protein, 18 aa, Entamoeba histolytica
AIAERKAQLAQRLELDEQ

SEQ ID NO: 2669410 - protein, 17 aa, Entamoeba histolytica
AIAERLWSKESVVDKES

SEQ ID NO: 2669411 - protein, 18 aa, Entamoeba histolytica
AIAQFLLMLIRGYSRKTA

SEQ ID NO: 2669412 - protein, 25 aa, Entamoeba histolytica
AIASFDIGLAVSFKTYIKCFDIRNM

SEQ ID NO: 2669413 - protein, 18 aa, Entamoeba histolytica
AIAWEIYSRIYNRLNNTI

SEQ ID NO: 2669414 - protein, 18 aa, Entamoeba histolytica
AICEGRNAGVFVYDNGKG

SEQ ID NO: 2669415 - protein, 25 aa, Entamoeba histolytica
AICLAKGRCKGGLNDTYQLIRKKLT

SEQ ID NO: 2669416 - protein, 18 aa, Entamoeba histolytica
AICSCKTLTFIDTNLAQL

SEQ ID NO: 2669417 - protein, 17 aa, Entamoeba histolytica
AIDDCVCEFKILERHKK

SEQ ID NO: 2669418 - protein, 23 aa, Entamoeba histolytica
AIDDRPVWKFFKNVVEKMEVTGI

SEQ ID NO: 2669419 - protein, 25 aa, Entamoeba histolytica
AIDGAVCAKEVIPYLSQALLDLDPQ

SEQ ID NO: 2669420 - protein, 19 aa, Entamoeba histolytica
AIDILIKIYLKFLPENGYI

SEQ ID NO: 2669421 - protein, 18 aa, Entamoeba histolytica
AIEEWDIELGKKLYEFAR

SEQ ID NO: 2669422 - protein, 25 aa, Entamoeba histolytica
AIEHAFPPTGGWGLGIDRLAMLLAD

SEQ ID NO: 2669423 - protein, 17 aa, Entamoeba histolytica
AIELLDFRYPDPQIRGF

SEQ ID NO: 2669424 - protein, 19 aa, Entamoeba histolytica
AIELRRILSTIGDNMEQKE

SEQ ID NO: 2669425 - protein, 19 aa, Entamoeba histolytica
AIERLKINPWFASSESVIK

SEQ ID NO: 2669426 - protein, 25 aa, Entamoeba histolytica
AIEYAQCSYCICRLLNRNPLCIKKY

SEQ ID NO: 2669427 - protein, 18 aa, Entamoeba histolytica
AIGARYSVGVCFQLFMPY

SEQ ID NO: 2669428 - protein, 26 aa, Entamoeba histolytica
AIGDVKCKAFVSCIPEFSEVARRSSD

SEQ ID NO: 2669429 - protein, 25 aa, Entamoeba histolytica
AIGPTPSLLIKWSYASTDNESLPIS

SEQ ID NO: 2669430 - protein, 17 aa, Entamoeba histolytica
AIHRAILEGDWVSAFER

SEQ ID NO: 2669431 - protein, 18 aa, Entamoeba histolytica
AIIGCVIVDGKIYDFVPQ

SEQ ID NO: 2669432 - protein, 30 aa, Entamoeba histolytica
AIIGNYKIELCIFYNGILRKDIKTSSFEFY

SEQ ID NO: 2669433 - protein, 17 aa, Entamoeba histolytica
AIIGRYANRIYKGDLVI

SEQ ID NO: 2669434 - protein, 21 aa, Entamoeba histolytica
AIIGSKGFKKCILRLGTAGPD

SEQ ID NO: 2669435 - protein, 18 aa, Entamoeba histolytica
AIILWKKQNEWYLSYLKR

SEQ ID NO: 2669436 - protein, 19 aa, Entamoeba histolytica
AIKEDKFFEDEEVKKYLAE

SEQ ID NO: 2669437 - protein, 27 aa, Entamoeba histolytica
AIKLNPRVANFFACRAQYYNKAKKPNA

SEQ ID NO: 2669438 - protein, 17 aa, Entamoeba histolytica
AIKRYGRDLRLWKIDFT

SEQ ID NO: 2669439 - protein, 18 aa, Entamoeba histolytica
AIKTLKGQHIGGIDECEM

SEQ ID NO: 2669440 - protein, 19 aa, Entamoeba histolytica
AILLYKPSPLYILDEVDAA

SEQ ID NO: 2669441 - protein, 25 aa, Entamoeba histolytica
AILRKSLCGKTKFKYSTRRKSADMT

SEQ ID NO: 2669442 - protein, 29 aa, Entamoeba histolytica
AINELKRCEEGIIKKNEIIELLKRENEEL

SEQ ID NO: 2669443 - protein, 18 aa, Entamoeba histolytica
AINEMKVEIASLVQSQTK

SEQ ID NO: 2669444 - protein, 19 aa, Entamoeba histolytica
AIPLFLDIIQIFLKSGDDK

SEQ ID NO: 2669445 - protein, 19 aa, Entamoeba histolytica
AIQCTLCGLNNGIDTTSFF

SEQ ID NO: 2669446 - protein, 19 aa, Entamoeba histolytica
AIQEIFLKYNTFMLRGDSL

SEQ ID NO: 2669447 - protein, 17 aa, Entamoeba histolytica
AIRKYGPPPSYREIIPL

SEQ ID NO: 2669448 - protein, 25 aa, Entamoeba histolytica
AISELRTAAFYVYFTIYQNYVIDDV

SEQ ID NO: 2669449 - protein, 20 aa, Entamoeba histolytica
AISKEAWKNIILAYEPVWAI

SEQ ID NO: 2669450 - protein, 26 aa, Entamoeba histolytica
AISPFSIPVARNFFKQLLSGVKYCHD

SEQ ID NO: 2669451 - protein, 18 aa, Entamoeba histolytica
AISSIQISGGILLTTYNL

SEQ ID NO: 2669452 - protein, 24 aa, Entamoeba histolytica
AITHYKFGVLYCKAHQTDEDEMFG

SEQ ID NO: 2669453 - protein, 18 aa, Entamoeba histolytica
AITRFNLFVVIGLADGKA

SEQ ID NO: 2669454 - protein, 25 aa, Entamoeba histolytica
AITTLRYFNEFVLCRILENENIPLI

SEQ ID NO: 2669455 - protein, 18 aa, Entamoeba histolytica
AIVIRYNQNFQVNEKFGF

SEQ ID NO: 2669456 - protein, 17 aa, Entamoeba histolytica
AIVKRKYVFSFIEEQTT

SEQ ID NO: 2669457 - protein, 19 aa, Entamoeba histolytica
AIVLKFRNIHFASFRSPLR

SEQ ID NO: 2669458 - protein, 20 aa, Entamoeba histolytica
AIVMIQRYDEIFGEFRSSFE

SEQ ID NO: 2669459 - protein, 18 aa, Entamoeba histolytica
AIVMSKKGNIRCLLPNEL

SEQ ID NO: 2669460 - protein, 17 aa, Entamoeba histolytica
AIVPSQCMSEFNSFEHQ

SEQ ID NO: 2669461 - protein, 19 aa, Entamoeba histolytica
AIYIACRRNNLKLLEKLIK

SEQ ID NO: 2669462 - protein, 19 aa, Entamoeba histolytica
AIYRCSQPLVANSSYFIGV

SEQ ID NO: 2669463 - protein, 25 aa, Entamoeba histolytica
AIYSFWLYDFCDVYLEASKGIFRGP

SEQ ID NO: 2669464 - protein, 23 aa, Entamoeba histolytica
AKACIIVYDITKAVTFNSVDKWY

SEQ ID NO: 2669465 - protein, 25 aa, Entamoeba histolytica
AKAIKQFIINCVDSLTSLLVLRQKA

SEQ ID NO: 2669466 - protein, 23 aa, Entamoeba histolytica
AKAKEVVDLLITRYLVPDNIPKD

SEQ ID NO: 2669467 - protein, 20 aa, Entamoeba histolytica
AKALFGLCELHLININEIDT

SEQ ID NO: 2669468 - protein, 18 aa, Entamoeba histolytica
AKALRLLDNPPKKGLFPE

SEQ ID NO: 2669469 - protein, 21 aa, Entamoeba histolytica
AKASELGWTINKFMTKQEKFI

SEQ ID NO: 2669470 - protein, 17 aa, Entamoeba histolytica
AKASLAISVAAEATLKA

SEQ ID NO: 2669471 - protein, 20 aa, Entamoeba histolytica
AKCAKMPLILAMPQNQITEI

SEQ ID NO: 2669472 - protein, 18 aa, Entamoeba histolytica
AKCGNPITRNMVIVKTFE

SEQ ID NO: 2669473 - protein, 21 aa, Entamoeba histolytica
AKCISGGCQITRQMIDPNAKM

SEQ ID NO: 2669474 - protein, 24 aa, Entamoeba histolytica
AKDEMGCSIGLYNNGCKLNIRLSV

SEQ ID NO: 2669475 - protein, 19 aa, Entamoeba histolytica
AKDEWDFDLELSPKEINNL

SEQ ID NO: 2669476 - protein, 37 aa, Entamoeba histolytica; identical to SEQ ID NO: 2474959

SEQ ID NO: 2669477 - protein, 17 aa, Entamoeba histolytica
AKDKRGIDCKADLFTFA

SEQ ID NO: 2669478 - protein, 32 aa, Entamoeba histolytica; identical to SEQ ID NO: 2474961

SEQ ID NO: 2669479 - protein, 17 aa, Entamoeba histolytica
AKDMIYNQYLVDIYEVL

SEQ ID NO: 2669480 - protein, 19 aa, Entamoeba histolytica
AKDNMDGRVVYGRELKVNW

SEQ ID NO: 2669481 - protein, 17 aa, Entamoeba histolytica
AKDRKRKIIPIKEAQAP

SEQ ID NO: 2669482 - protein, 18 aa, Entamoeba histolytica
AKDSMQIGAIEKTKQKIL

SEQ ID NO: 2669483 - protein, 18 aa, Entamoeba histolytica
AKDVERFSSFHSNEIYQH

SEQ ID NO: 2669484 - protein, 18 aa, Entamoeba histolytica
AKEAYHFLSKMSCGSIIG

SEQ ID NO: 2669485 - protein, 24 aa, Entamoeba histolytica
AKEFKELFEPILMLTKKIVDELDR

SEQ ID NO: 2669486 - protein, 18 aa, Entamoeba histolytica
AKEFKLKFDEYSKLASCQ

SEQ ID NO: 2669487 - protein, 24 aa, Entamoeba histolytica
AKEGCGKAMCNLGRCYFDGEGVEC

SEQ ID NO: 2669488 - protein, 24 aa, Entamoeba histolytica
AKEGIEAKGIIGIDVDLKCNGLGI

SEQ ID NO: 2669489 - protein, 20 aa, Entamoeba histolytica
AKEGNSIIQMPQLVFKQPIQ

SEQ ID NO: 2669490 - protein, 21 aa, Entamoeba histolytica
AKEILSFMPGEICKNDSDKKK

SEQ ID NO: 2669491 - protein, 23 aa, Entamoeba histolytica
AKELKKRRKALEKLQTICQSIGE

SEQ ID NO: 2669492 - protein, 17 aa, Entamoeba histolytica
AKELLSFPNEVINNSNF

SEQ ID NO: 2669493 - protein, 30 aa, Entamoeba histolytica
AKESIYITDWRIDPEIILIRRGVHWLKGKT

SEQ ID NO: 2669494 - protein, 18 aa, Entamoeba histolytica
AKEVKFLLYDTFYTMNNL

SEQ ID NO: 2669495 - protein, 28 aa, Entamoeba histolytica
AKEYSPMAFAIVRRFFGLTPESMIESIC

SEQ ID NO: 2669496 - protein, 31 aa, Entamoeba histolytica
AKFANGVLALLKRRGYTFCEKKTRPCHKTTR

SEQ ID NO: 2669497 - protein, 23 aa, Entamoeba histolytica
AKFCPNCGTSINGSKFCPNCGEK

SEQ ID NO: 2669498 - protein, 27 aa, Entamoeba histolytica
AKFIRLKPLAFDFFKIPNYRVVMEKEL

SEQ ID NO: 2669499 - protein, 24 aa, Entamoeba histolytica
AKFLSNCGAFDCASEELLHEEEID

SEQ ID NO: 2669500 - protein, 25 aa, Entamoeba histolytica
AKFQLPDCAKYLFENVKRIAMEDYV

SEQ ID NO: 2669501 - protein, 21 aa, Entamoeba histolytica
AKGACMYCYSKGTKVDGSIIP

SEQ ID NO: 2669502 - protein, 17 aa, Entamoeba histolytica
AKGCIQISPSTIIKERE

SEQ ID NO: 2669503 - protein, 17 aa, Entamoeba histolytica
AKGEASIAETLKAEDEK

SEQ ID NO: 2669504 - protein, 24 aa, Entamoeba histolytica
AKGFLGERYMRFDPVLPNNLDLDC

SEQ ID NO: 2669505 - protein, 24 aa, Entamoeba histolytica
AKGIGSIKWWFGVENNVSDYASLI

SEQ ID NO: 2669506 - protein, 22 aa, Entamoeba histolytica
AKGLSLDFLEKVFPIIEKYTRV

SEQ ID NO: 2669507 - protein, 21 aa, Entamoeba histolytica
AKGNRLLLDKEIERIKNDPYI

SEQ ID NO: 2669508 - protein, 17 aa, Entamoeba histolytica
AKHKIAATGTPMMNNLL

SEQ ID NO: 2669509 - protein, 17 aa, Entamoeba histolytica
AKHKRELKQLNEEKEVG

SEQ ID NO: 2669510 - protein, 23 aa, Entamoeba histolytica
AKHTFYCKMCFELCSNEPSCKLR

SEQ ID NO: 2669511 - protein, 20 aa, Entamoeba histolytica
AKIADQIPFIIVCDKHGYVE

SEQ ID NO: 2669512 - protein, 17 aa, Entamoeba histolytica
AKIAWILQRKGLGDFVI

SEQ ID NO: 2669513 - protein, 18 aa, Entamoeba histolytica
AKIIFFIVKVLFRCDAVD

SEQ ID NO: 2669514 - protein, 17 aa, Entamoeba histolytica
AKIILKRRTVKATVTKP

SEQ ID NO: 2669515 - protein, 25 aa, Entamoeba histolytica
AKILKCNIALFVLRERIRKALQLYS

SEQ ID NO: 2669516 - protein, 26 aa, Entamoeba histolytica
AKINGLYRSLQLFGISTTDFYQQYRS

SEQ ID NO: 2669517 - protein, 19 aa, Entamoeba histolytica
AKIPDACAFQVYMTKKERI

SEQ ID NO: 2669518 - protein, 20 aa, Entamoeba histolytica
AKIPEIIAIALRIDSLAQQY

SEQ ID NO: 2669519 - protein, 17 aa, Entamoeba histolytica
AKIVKTLFEILDTLSGI

SEQ ID NO: 2669520 - protein, 26 aa, Entamoeba histolytica
AKIVVKRLISAIGYLHSMNIVHRDLK

SEQ ID NO: 2669521 - protein, 32 aa, Entamoeba histolytica
AKKAIELDPNYAKAYARLAIALTKKHKYTEAQ

SEQ ID NO: 2669522 - protein, 18 aa, Entamoeba histolytica
AKKERKGRFVNFDQAAED

SEQ ID NO: 2669523 - protein, 17 aa, Entamoeba histolytica
AKKFDCFLNIKNGVSSH

SEQ ID NO: 2669524 - protein, 23 aa, Entamoeba histolytica
AKKIAECCICFTGNFLSPDEHIY

SEQ ID NO: 2669525 - protein, 22 aa, Entamoeba histolytica
AKKIGKLDGVFELKYLETTLEM

SEQ ID NO: 2669526 - protein, 21 aa, Entamoeba histolytica
AKKNKCSKCSFWYGTNEEGNE

SEQ ID NO: 2669527 - protein, 20 aa, Entamoeba histolytica
AKKPLSAYILFTQAKREEIA

SEQ ID NO: 2669528 - protein, 23 aa, Entamoeba histolytica
AKKRLDKIMGCGGGERLVSASDD

SEQ ID NO: 2669529 - protein, 24 aa, Entamoeba histolytica
AKKRLDKIMGCGGGERLVSASDDG

SEQ ID NO: 2669530 - protein, 22 aa, Entamoeba histolytica
AKKSETTELMFFKPSENNSEIT

SEQ ID NO: 2669531 - protein, 24 aa, Entamoeba histolytica
AKKVEVIVGVPFIYIPKVQQILAG

SEQ ID NO: 2669532 - protein, 18 aa, Entamoeba histolytica
AKKWFEQRIKQKKDKYNI

SEQ ID NO: 2669533 - protein, 20 aa, Entamoeba histolytica
AKKYGMGMVVVRNSTHFGIA

SEQ ID NO: 2669534 - protein, 17 aa, Entamoeba histolytica
AKLADFGIAKKATIEGC

SEQ ID NO: 2669535 - protein, 18 aa, Entamoeba histolytica
AKLEHYVLAFKLSLYCGI

SEQ ID NO: 2669536 - protein, 21 aa, Entamoeba histolytica
AKLFMRIGNAYFKQDKYTEAL

SEQ ID NO: 2669537 - protein, 29 aa, Entamoeba histolytica
AKLFQSICVPRKIVLFSQKHHCFITLYTR

SEQ ID NO: 2669538 - protein, 17 aa, Entamoeba histolytica
AKLKGSTFTPFILEKST

SEQ ID NO: 2669539 - protein, 20 aa, Entamoeba histolytica
AKLKKECIYEAASPHIKILV

SEQ ID NO: 2669540 - protein, 19 aa, Entamoeba histolytica
AKLRASRPKKLFVKLHNRQ

SEQ ID NO: 2669541 - protein, 20 aa, Entamoeba histolytica
AKLSPYAFIPHKGYDDIEEL

SEQ ID NO: 2669542 - protein, 23 aa, Entamoeba histolytica
AKLWDIRMENCVATFTGHDADIN

SEQ ID NO: 2669543 - protein, 24 aa, Entamoeba histolytica
AKLWDLKSGEAIQTYAVHEKGVVC

SEQ ID NO: 2669544 - protein, 28 aa, Entamoeba histolytica
AKMIFATEFAYNWYVRKFFFEEGLKDAE

SEQ ID NO: 2669545 - protein, 19 aa, Entamoeba histolytica
AKMLQKRAKAAQKRTAKSV

SEQ ID NO: 2669546 - protein, 26 aa, Entamoeba histolytica
AKNETSRFNFFILYHPLISFMSRNYQ

SEQ ID NO: 2669547 - protein, 20 aa, Entamoeba histolytica
AKNGFMLYDCFGNLQFETYK

SEQ ID NO: 2669548 - protein, 18 aa, Entamoeba histolytica
AKNIIAILGEDNHGECQS

SEQ ID NO: 2669549 - protein, 31 aa, Entamoeba histolytica
AKNLGIICYLIPCYAGSIVSYINSHYDNSVC

SEQ ID NO: 2669550 - protein, 22 aa, Entamoeba histolytica
AKPARLPFLSLALNLPPELADI

SEQ ID NO: 2669551 - protein, 18 aa, Entamoeba histolytica
AKPEICKTLKYVVLYDNT

SEQ ID NO: 2669552 - protein, 21 aa, Entamoeba histolytica
AKPFQEKDVQQNNPLTQQKTV

SEQ ID NO: 2669553 - protein, 24 aa, Entamoeba histolytica
AKPMTRLRCAGFTKEERASTNETI

SEQ ID NO: 2669554 - protein, 24 aa, Entamoeba histolytica
AKPSSLPFLKLVLSIPPLLSQQIN

SEQ ID NO: 2669555 - protein, 25 aa, Entamoeba histolytica
AKPTPTIARRVFNVLMGETMQIKKR

SEQ ID NO: 2669556 - protein, 22 aa, Entamoeba histolytica
AKQATALLGCFVLDEKPKEQVQ

SEQ ID NO: 2669557 - protein, 17 aa, Entamoeba histolytica
AKQFIVTAVSLAIYRDG

SEQ ID NO: 2669558 - protein, 17 aa, Entamoeba histolytica
AKQLTMVDFGIYKNVRP

SEQ ID NO: 2669559 - protein, 17 aa, Entamoeba histolytica
AKQPLLYSNITQDINKD

SEQ ID NO: 2669560 - protein, 22 aa, Entamoeba histolytica
AKRFASLCFEASILSQKVGDYT

SEQ ID NO: 2669561 - protein, 26 aa, Entamoeba histolytica
AKRNAKMVFSSDVLKQKLGERALPGD

SEQ ID NO: 2669562 - protein, 26 aa, Entamoeba histolytica
AKRSQIPLQLAWAISIHKSQGMTLER

SEQ ID NO: 2669563 - protein, 18 aa, Entamoeba histolytica
AKRTHIIVQLCLDDIEAN

SEQ ID NO: 2669564 - protein, 18 aa, Entamoeba histolytica
AKSAIILGSLNELPLTKE

SEQ ID NO: 2669565 - protein, 23 aa, Entamoeba histolytica
AKSILKKDCQMMITLKSIMIIDM

SEQ ID NO: 2669566 - protein, 19 aa, Entamoeba histolytica
AKSLMCIDVSVKQPSVMII

SEQ ID NO: 2669567 - protein, 25 aa, Entamoeba histolytica
AKSNSSGIWSWMGYSNVVNSQLTED

SEQ ID NO: 2669568 - protein, 20 aa, Entamoeba histolytica
AKSVIFPSVEKFDGKENRFL

SEQ ID NO: 2669569 - protein, 20 aa, Entamoeba histolytica
AKTCGVVFEILRELEQFRDK

SEQ ID NO: 2669570 - protein, 26 aa, Entamoeba histolytica
AKTDIFLCIVLKYIYDNCWPKAIEML

SEQ ID NO: 2669571 - protein, 24 aa, Entamoeba histolytica
AKTGFPQKFKYLAFDMSDDTEQDL

SEQ ID NO: 2669572 - protein, 31 aa, Entamoeba histolytica
AKTKCVCRYFMGASIVCYGISVLKRKNKESI

SEQ ID NO: 2669573 - protein, 23 aa, Entamoeba histolytica
AKTNSVQLFIPFRPMLAKPKKSI

SEQ ID NO: 2669574 - protein, 21 aa, Entamoeba histolytica
AKTQMTLFFAKMGSLMTQKQF

SEQ ID NO: 2669575 - protein, 17 aa, Entamoeba histolytica
AKTRPKIVTQYDYDPEE

SEQ ID NO: 2669576 - protein, 20 aa, Entamoeba histolytica
AKTSGGICLHDSKRLIGETV

SEQ ID NO: 2669577 - protein, 26 aa, Entamoeba histolytica
AKTTIKKGFKFSFSFDPENLKQPTSE

SEQ ID NO: 2669578 - protein, 19 aa, Entamoeba histolytica
AKTWLIPYCVYRTLVKSVD

SEQ ID NO: 2669579 - protein, 20 aa, Entamoeba histolytica
AKVFSCIRTTLEHEYEYCYY

SEQ ID NO: 2669580 - protein, 25 aa, Entamoeba histolytica
AKVHLPRKSSTILIEKGKTAQLLAD

SEQ ID NO: 2669581 - protein, 23 aa, Entamoeba histolytica
AKVKVKAMEFFLRLDEKQAAMDD

SEQ ID NO: 2669582 - protein, 19 aa, Entamoeba histolytica
AKVRSGKVWSQYIDNTIVK

SEQ ID NO: 2669583 - protein, 20 aa, Entamoeba histolytica
AKYAPKMGIMIRIMENDTSA

SEQ ID NO: 2669584 - protein, 25 aa, Entamoeba histolytica
AKYKISPRNTFKSCMEEASNRLKKQ

SEQ ID NO: 2669585 - protein, 17 aa, Entamoeba histolytica
AKYSDSCFPPFDKELNI

SEQ ID NO: 2669586 - protein, 19 aa, Entamoeba histolytica
ALAASGLRSVRYAKELPQD

SEQ ID NO: 2669587 - protein, 33 aa, Entamoeba histolytica
ALAHLIKAKVIPDCVSSIWVCCVDKRYENGRNG

SEQ ID NO: 2669588 - protein, 18 aa, Entamoeba histolytica
ALAHPFFQSGIIKEINPL

SEQ ID NO: 2669589 - protein, 19 aa, Entamoeba histolytica
ALANLHIILFDILKNPVHF

SEQ ID NO: 2669590 - protein, 22 aa, Entamoeba histolytica
ALASELFSKWLTRNSRLSRSSI

SEQ ID NO: 2669591 - protein, 19 aa, Entamoeba histolytica
ALCGKEYPNHFTPKRIIVI

SEQ ID NO: 2669592 - protein, 17 aa, Entamoeba histolytica
ALCHRLFYQPFKAKDIQ

SEQ ID NO: 2669593 - protein, 23 aa, Entamoeba histolytica
ALCKHKSYLCIHEINESKKRINE

SEQ ID NO: 2669594 - protein, 19 aa, Entamoeba histolytica
ALCKIWEIEFPICSKCYQV

SEQ ID NO: 2669595 - protein, 31 aa, Entamoeba histolytica; identical to SEQ ID NO: 2475082

SEQ ID NO: 2669596 - protein, 21 aa, Entamoeba histolytica
ALCRKYLKNPFEVFIDDGEKL

SEQ ID NO: 2669597 - protein, 23 aa, Entamoeba histolytica
ALCVESFSDLPARVLPESIKHAS

SEQ ID NO: 2669598 - protein, 21 aa, Entamoeba histolytica
ALDAECFTITSGVTLEKSQRL

SEQ ID NO: 2669599 - protein, 25 aa, Entamoeba histolytica
ALDEEIKYIYTIIKGIRSLNGIYSQ

SEQ ID NO: 2669600 - protein, 25 aa, Entamoeba histolytica
ALDETLRLVVFLNNISAEYKKYLEN

SEQ ID NO: 2669601 - protein, 26 aa, Entamoeba histolytica
ALDIYEVHGLLPLFTKIYQFVGKEKL

SEQ ID NO: 2669602 - protein, 19 aa, Entamoeba histolytica
ALDKYSRKSIRELKEEVCG

SEQ ID NO: 2669603 - protein, 21 aa, Entamoeba histolytica
ALDMYKPVVWEFNRLNITYTV

SEQ ID NO: 2669604 - protein, 19 aa, Entamoeba histolytica
ALDPLGWTGHSGMAILAPH

SEQ ID NO: 2669605 - protein, 25 aa, Entamoeba histolytica
ALDSFPIYRLEHLFLQLNENDKENF

SEQ ID NO: 2669606 - protein, 27 aa, Entamoeba histolytica
ALDSTGKICLCIGKKYMKVVDLYRGKV

SEQ ID NO: 2669607 - protein, 19 aa, Entamoeba histolytica
ALEEYITLEFARYLQDAFN

SEQ ID NO: 2669608 - protein, 19 aa, Entamoeba histolytica
ALELFARKRSKIMKGATSP

SEQ ID NO: 2669609 - protein, 17 aa, Entamoeba histolytica
ALELLDFRFPDEQVRLF

SEQ ID NO: 2669610 - protein, 17 aa, Entamoeba histolytica
ALERKGRDLEKEIDEIQ

SEQ ID NO: 2669611 - protein, 19 aa, Entamoeba histolytica
ALESYQIVINGFAKINNYW

SEQ ID NO: 2669612 - protein, 21 aa, Entamoeba histolytica
ALESYTKLIGVIDVQATDVVN

SEQ ID NO: 2669613 - protein, 18 aa, Entamoeba histolytica
ALETWPVDLFGQLLPRHL

SEQ ID NO: 2669614 - protein, 25 aa, Entamoeba histolytica
ALFMKSNVVLLPFCPYNFQVSSKMT

SEQ ID NO: 2669615 - protein, 31 aa, Entamoeba histolytica
ALFVASLLNELPIEFIGLYLLVKTILNIFNL

SEQ ID NO: 2669616 - protein, 19 aa, Entamoeba histolytica
ALGCAHLIMHINAVAQGKS

SEQ ID NO: 2669617 - protein, 21 aa, Entamoeba histolytica
ALGCMLYEFVVGYPPFNASTP

SEQ ID NO: 2669618 - protein, 19 aa, Entamoeba histolytica
ALGDELKKLLLLSLSAGKA

SEQ ID NO: 2669619 - protein, 18 aa, Entamoeba histolytica
ALGNCIACNDYVALVHPE

SEQ ID NO: 2669620 - protein, 18 aa, Entamoeba histolytica
ALHAYIFIGPVYYQKLKH

SEQ ID NO: 2669621 - protein, 18 aa, Entamoeba histolytica
ALHICNFSISMGYVKTIG

SEQ ID NO: 2669622 - protein, 17 aa, Entamoeba histolytica
ALIDHFNSITNWVISTI

SEQ ID NO: 2669623 - protein, 25 aa, Entamoeba histolytica
ALIEGKWVVSKNWIINGMKKDEFKY

SEQ ID NO: 2669624 - protein, 25 aa, Entamoeba histolytica
ALIKELPSYCFFKCTSLQQIFFYPK

SEQ ID NO: 2669625 - protein, 22 aa, Entamoeba histolytica
ALILKFRFIKDSTKIRIITALM

SEQ ID NO: 2669626 - protein, 17 aa, Entamoeba histolytica
ALINFGPTFKIKIGENN

SEQ ID NO: 2669627 - protein, 23 aa, Entamoeba histolytica
ALISELVSLIAGINTSVQTDPQQ

SEQ ID NO: 2669628 - protein, 23 aa, Entamoeba histolytica
ALISLQCICEIMGDIFEPYIIDI

SEQ ID NO: 2669629 - protein, 19 aa, Entamoeba histolytica
ALKGIIFKKRFVLTQCSVR

SEQ ID NO: 2669630 - protein, 19 aa, Entamoeba histolytica
ALKIIPIKNKVQMIKNERE

SEQ ID NO: 2669631 - protein, 19 aa, Entamoeba histolytica
ALKKTFKFTETGEMVTENE

SEQ ID NO: 2669632 - protein, 32 aa, Entamoeba histolytica; identical to SEQ ID NO: 2475125

SEQ ID NO: 2669633 - protein, 17 aa, Entamoeba histolytica
ALKNRGDMGQLFYWLLV

SEQ ID NO: 2669634 - protein, 17 aa, Entamoeba histolytica
ALKRKWGSYGSIHNDQY

SEQ ID NO: 2669635 - protein, 18 aa, Entamoeba histolytica
ALKSLSTPFGYIYRSQKP

SEQ ID NO: 2669636 - protein, 22 aa, Entamoeba histolytica
ALKTISSFLFYYKCSQCTNEQK

SEQ ID NO: 2669637 - protein, 20 aa, Entamoeba histolytica
ALLCSSQEGFSYVPDVVKID

SEQ ID NO: 2669638 - protein, 17 aa, Entamoeba histolytica
ALLDSVRIKFGDIPQSS

SEQ ID NO: 2669639 - protein, 19 aa, Entamoeba histolytica
ALLDVIEMLEGYHLSHSRK

SEQ ID NO: 2669640 - protein, 34 aa, Entamoeba histolytica
ALLGAPLPIEFKWKIPITKKKTGLFSIIETTEVT

SEQ ID NO: 2669641 - protein, 17 aa, Entamoeba histolytica
ALLKRVATESVHIKAVL

SEQ ID NO: 2669642 - protein, 25 aa, Entamoeba histolytica
ALLNRLMKLCYRISLNHEDTQMDSL

SEQ ID NO: 2669643 - protein, 24 aa, Entamoeba histolytica
ALLPYPECSLKFWDCSCDIELLQL

SEQ ID NO: 2669644 - protein, 17 aa, Entamoeba histolytica
ALLSFLVHLLLEKDNDS

SEQ ID NO: 2669645 - protein, 17 aa, Entamoeba histolytica
ALMSRFDLFFVVLDEPN

SEQ ID NO: 2669646 - protein, 20 aa, Entamoeba histolytica
ALNCCSSCNVSEAIEEWDIE

SEQ ID NO: 2669647 - protein, 21 aa, Entamoeba histolytica
ALNCIVEGFEIIFDKGLDKKI

SEQ ID NO: 2669648 - protein, 17 aa, Entamoeba histolytica
ALNDHYTPCLTPRIYRD

SEQ ID NO: 2669649 - protein, 19 aa, Entamoeba histolytica
ALNFCFWPTEGFEYDDLTK

SEQ ID NO: 2669650 - protein, 34 aa, Entamoeba histolytica
ALNRNDLNMAYHILRNSYQIIYEVIQSTAPKSVA

SEQ ID NO: 2669651 - protein, 26 aa, Entamoeba histolytica
ALPEDNVCFCLISLRMTYDGVPNIAR

SEQ ID NO: 2669652 - protein, 17 aa, Entamoeba histolytica
ALPELACQCISSLKKIT

SEQ ID NO: 2669653 - protein, 20 aa, Entamoeba histolytica
ALPSSYKIVSKVLFPNCDQS

SEQ ID NO: 2669654 - protein, 20 aa, Entamoeba histolytica
ALQEKTCCICGKKSSDWKKG

SEQ ID NO: 2669655 - protein, 26 aa, Entamoeba histolytica
ALQKDIEMALGYSMKIPQRPSQINDL

SEQ ID NO: 2669656 - protein, 18 aa, Entamoeba histolytica
ALQSIFAKYAIKIGEQYY

SEQ ID NO: 2669657 - protein, 18 aa, Entamoeba histolytica
ALQYKRLFTQEEFLKYLR

SEQ ID NO: 2669658 - protein, 26 aa, Entamoeba histolytica
ALRAIRFSGKMGFVLDEELEQEMKTK

SEQ ID NO: 2669659 - protein, 17 aa, Entamoeba histolytica
ALREICLLRQLNHRNIV

SEQ ID NO: 2669660 - protein, 19 aa, Entamoeba histolytica
ALRQVKVRRGVLYLNNSNI

SEQ ID NO: 2669661 - protein, 20 aa, Entamoeba histolytica
ALSAPRCYTKIPAKIQKQMT

SEQ ID NO: 2669662 - protein, 20 aa, Entamoeba histolytica
ALSDFKSGAVNYLIATDVAS

SEQ ID NO: 2669663 - protein, 27 aa, Entamoeba histolytica
ALSKKGVTVAYEFKRFIGKSFDDKVIE

SEQ ID NO: 2669664 - protein, 24 aa, Entamoeba histolytica
ALSLEIINLLLLESSDFVTGFINE

SEQ ID NO: 2669665 - protein, 19 aa, Entamoeba histolytica
ALSQFLVKFGYHPQQITVD

SEQ ID NO: 2669666 - protein, 29 aa, Entamoeba histolytica
ALSSEKARCALRWGVPVLNFQWLFDCLKE

SEQ ID NO: 2669667 - protein, 17 aa, Entamoeba histolytica
ALTIGFCIESVLVNSIK

SEQ ID NO: 2669668 - protein, 26 aa, Entamoeba histolytica
ALTPEIVSLIPLRLHLLIKALGDEYG

SEQ ID NO: 2669669 - protein, 36 aa, Entamoeba histolytica
ALTTLQHYLPLFKLADHLKRCYEDGTNTSVVQDNEQ

SEQ ID NO: 2669670 - protein, 26 aa, Entamoeba histolytica
ALVEVFKKALTVEGVYDTTKQLLQQY

SEQ ID NO: 2669671 - protein, 19 aa, Entamoeba histolytica
ALVMCTNLFLTKLLQTDTP

SEQ ID NO: 2669672 - protein, 18 aa, Entamoeba histolytica
ALVPSVVKGKIVLDVGCG

SEQ ID NO: 2669673 - protein, 18 aa, Entamoeba histolytica
ALWSMGRINGYDLFDNKL

SEQ ID NO: 2669674 - protein, 24 aa, Entamoeba histolytica
ALYDILRFWGIYSLYSSIDPSSTD

SEQ ID NO: 2669675 - protein, 17 aa, Entamoeba histolytica
ALYLARAPKSCAVFETM

SEQ ID NO: 2669676 - protein, 22 aa, Entamoeba histolytica
AMACAKRYLIDWDKETSNYHEN

SEQ ID NO: 2669677 - protein, 23 aa, Entamoeba histolytica
AMAKRIGAVEYIEWNDSDKEDVV

SEQ ID NO: 2669678 - protein, 19 aa, Entamoeba histolytica
AMCPCLKTIGLEGVNSLTR

SEQ ID NO: 2669679 - protein, 18 aa, Entamoeba histolytica
AMCVPDPVKVILTNVPDD

SEQ ID NO: 2669680 - protein, 18 aa, Entamoeba histolytica
AMEISPECIIEWENQGAK

SEQ ID NO: 2669681 - protein, 20 aa, Entamoeba histolytica
AMEKAEHAYHDMLKKPENKQ

SEQ ID NO: 2669682 - protein, 18 aa, Entamoeba histolytica
AMEKMKVGVNKFLEGYPN

SEQ ID NO: 2669683 - protein, 21 aa, Entamoeba histolytica
AMILPVKFIVNLAKHKQRVSI

SEQ ID NO: 2669684 - protein, 23 aa, Entamoeba histolytica
AMIPEIVSAYTIKVVAPGSSGIG

SEQ ID NO: 2669685 - protein, 18 aa, Entamoeba histolytica
AMITRPSNNQMYWVRFGP

SEQ ID NO: 2669686 - protein, 21 aa, Entamoeba histolytica
AMKAIEMSGMFFKESSPIYVS

SEQ ID NO: 2669687 - protein, 19 aa, Entamoeba histolytica
AMNCCANFAFANRGMITYR

SEQ ID NO: 2669688 - protein, 24 aa, Entamoeba histolytica
AMNRQRGEGGRFCSKKKIEQSQVS

SEQ ID NO: 2669689 - protein, 26 aa, Entamoeba histolytica
AMNWGNCAICLFNLGKKEIGIELAEK

SEQ ID NO: 2669690 - protein, 20 aa, Entamoeba histolytica
AMPAYSCVAYKYGEKEDKAQ

SEQ ID NO: 2669691 - protein, 17 aa, Entamoeba histolytica
AMRKLWGEKRIRSTNEL

SEQ ID NO: 2669692 - protein, 18 aa, Entamoeba histolytica
AMSLIGFNDVVIIGEDVA

SEQ ID NO: 2669693 - protein, 20 aa, Entamoeba histolytica
AMVLRTLYNILIKKIGNRTI

SEQ ID NO: 2669694 - protein, 22 aa, Entamoeba histolytica
AMVLRTLYNILIKRIGNRKIGK

SEQ ID NO: 2669695 - protein, 23 aa, Entamoeba histolytica
AMVLRTLYNILIKRIGNRKIGKV

SEQ ID NO: 2669696 - protein, 27 aa, Entamoeba histolytica
AMVTYKKKHCYAFLFSDELVFAKEQAV

SEQ ID NO: 2669697 - protein, 28 aa, Entamoeba histolytica
ANAEELWNYVELFGSLELENGKEGSDLD

SEQ ID NO: 2669698 - protein, 25 aa, Entamoeba histolytica
ANAELLISYYNTRIEVLKTNIEMTR

SEQ ID NO: 2669699 - protein, 23 aa, Entamoeba histolytica
ANAKQIGVLACTWNVNQSVFTRR

SEQ ID NO: 2669700 - protein, 18 aa, Entamoeba histolytica
ANARKDYAKSMLRMVQEF

SEQ ID NO: 2669701 - protein, 17 aa, Entamoeba histolytica
ANATLLRNLAKGAVEYS

SEQ ID NO: 2669702 - protein, 20 aa, Entamoeba histolytica
ANCMPGLITPFTDILSICGV

SEQ ID NO: 2669703 - protein, 25 aa, Entamoeba histolytica
ANDMKWKTEMLDFKESLQIEQKKEI

SEQ ID NO: 2669704 - protein, 18 aa, Entamoeba histolytica
ANEGIDFDKRMMDLLEMK

SEQ ID NO: 2669705 - protein, 19 aa, Entamoeba histolytica
ANEKINFYFKQIITGIQYI

SEQ ID NO: 2669706 - protein, 27 aa, Entamoeba histolytica
ANETIRLALWQLYLTWTNVFPAQTLNQ

SEQ ID NO: 2669707 - protein, 24 aa, Entamoeba histolytica
ANEVCKRVGQIIPYNKSTSKLWRN

SEQ ID NO: 2669708 - protein, 24 aa, Entamoeba histolytica
ANEYKGGQCIYAIVDYLQSEEFLQ

SEQ ID NO: 2669709 - protein, 18 aa, Entamoeba histolytica
ANEYPVYSPIISFNQKIT

SEQ ID NO: 2669710 - protein, 18 aa, Entamoeba histolytica
ANFAFANRGMITYRIRQA

SEQ ID NO: 2669711 - protein, 19 aa, Entamoeba histolytica
ANFCLPLTRLLWNMENEIM

SEQ ID NO: 2669712 - protein, 17 aa, Entamoeba histolytica
ANFDEWAFCISSTSNAN

SEQ ID NO: 2669713 - protein, 17 aa, Entamoeba histolytica
ANFKMSLNSSLLSENFP

SEQ ID NO: 2669714 - protein, 17 aa, Entamoeba histolytica
ANGKIRNCCPSKVISIS

SEQ ID NO: 2669715 - protein, 20 aa, Entamoeba histolytica
ANGLPICFSDSTQIPLRKRG

SEQ ID NO: 2669716 - protein, 17 aa, Entamoeba histolytica
ANGMCLEALQLIFKNLV

SEQ ID NO: 2669717 - protein, 17 aa, Entamoeba histolytica
ANGSVLDEAYCIECIPS

SEQ ID NO: 2669718 - protein, 24 aa, Entamoeba histolytica
ANHQWKIEGNQIIFELPKVDKKKE

SEQ ID NO: 2669719 - protein, 18 aa, Entamoeba histolytica
ANHRPATCEQWRLWQELL

SEQ ID NO: 2669720 - protein, 25 aa, Entamoeba histolytica
ANHVLRYGGIYTIGLAYCGTANEKA

SEQ ID NO: 2669721 - protein, 19 aa, Entamoeba histolytica
ANIFQKCIVDWKYDSCFGK

SEQ ID NO: 2669722 - protein, 20 aa, Entamoeba histolytica
ANIFSGSTLIYLIKGDGKTM

SEQ ID NO: 2669723 - protein, 17 aa, Entamoeba histolytica
ANIILSKGVTISESNLS

SEQ ID NO: 2669724 - protein, 24 aa, Entamoeba histolytica
ANIKKYLDGIGWKEIEIHEKKKDD

SEQ ID NO: 2669725 - protein, 17 aa, Entamoeba histolytica
ANIMADCRLNINVNKYI

SEQ ID NO: 2669726 - protein, 22 aa, Entamoeba histolytica
ANINRSLVVFGRVIHGLVQAST

SEQ ID NO: 2669727 - protein, 26 aa, Entamoeba histolytica
ANIQICILHIRTAYHLIVKTGFQLIR

SEQ ID NO: 2669728 - protein, 22 aa, Entamoeba histolytica
ANKCLPLGRSRDWHNALMDYGA

SEQ ID NO: 2669729 - protein, 21 aa, Entamoeba histolytica
ANKKCGVACFLAQHKDRLTCG

SEQ ID NO: 2669730 - protein, 18 aa, Entamoeba histolytica
ANKLLKYESLMIINDFSN

SEQ ID NO: 2669731 - protein, 17 aa, Entamoeba histolytica
ANKRPEILVKIAVITER

SEQ ID NO: 2669732 - protein, 17 aa, Entamoeba histolytica
ANKYIHGEDENSSDYDI

SEQ ID NO: 2669733 - protein, 17 aa, Entamoeba histolytica
ANLTYYAWGSKYSPSRN

SEQ ID NO: 2669734 - protein, 18 aa, Entamoeba histolytica
ANLYGRLMMELEQKIEEE

SEQ ID NO: 2669735 - protein, 19 aa, Entamoeba histolytica
ANNLIELLLIFSSKKKMSK

SEQ ID NO: 2669736 - protein, 17 aa, Entamoeba histolytica
ANPIKREEVLAVSSGFE

SEQ ID NO: 2669737 - protein, 18 aa, Entamoeba histolytica
ANQPFKCVPVKNLTEEEL

SEQ ID NO: 2669738 - protein, 23 aa, Entamoeba histolytica
ANRRRTVQCIAHLSKYADDKQLE

SEQ ID NO: 2669739 - protein, 19 aa, Entamoeba histolytica
ANRYLAGKVTLAARADSCR

SEQ ID NO: 2669740 - protein, 19 aa, Entamoeba histolytica
ANSCWKYLEDFSISLSHLL

SEQ ID NO: 2669741 - protein, 25 aa, Entamoeba histolytica
ANSNGFKGMLLVSAKTGFHVEETME

SEQ ID NO: 2669742 - protein, 16 aa, Entamoeba histolytica
ANSSLLLEKSFIIERT

SEQ ID NO: 2669743 - protein, 24 aa, Entamoeba histolytica
ANSVLISLCSLFIVTRKVFTMKDF

SEQ ID NO: 2669744 - protein, 19 aa, Entamoeba histolytica
ANTLFKIAYYYKSNAVHNK

SEQ ID NO: 2669745 - protein, 22 aa, Entamoeba histolytica
ANTQKIRDCFNFYDRDYDGKID

SEQ ID NO: 2669746 - protein, 27 aa, Entamoeba histolytica
ANVKVEGFWPIVMAKALANADIEDLIM

SEQ ID NO: 2669747 - protein, 21 aa, Entamoeba histolytica
ANVLINFCNQLGIGFGGSAED

SEQ ID NO: 2669748 - protein, 19 aa, Entamoeba histolytica
ANVLKCIDTGAVIICGKNK

SEQ ID NO: 2669749 - protein, 19 aa, Entamoeba histolytica
ANVPLVIAGCVPQADPKAC

SEQ ID NO: 2669750 - protein, 25 aa, Entamoeba histolytica
ANVYNPLGWDSCVYMNPGPTGDSKV

SEQ ID NO: 2669751 - protein, 17 aa, Entamoeba histolytica
ANYDLRFNVKLSNDDNN

SEQ ID NO: 2669752 - protein, 21 aa, Entamoeba histolytica
ANYKCMCELQMLRNEKGFDYE

SEQ ID NO: 2669753 - protein, 21 aa, Entamoeba histolytica
ANYKIEMAKVIPSLQYGMDCY

SEQ ID NO: 2669754 - protein, 26 aa, Entamoeba histolytica
APAFPESFPHLFGKQKIRCLIPCAID

SEQ ID NO: 2669755 - protein, 18 aa, Entamoeba histolytica
APAGVMAVIVWRKKGSDQ

SEQ ID NO: 2669756 - protein, 26 aa, Entamoeba histolytica
APAIALEVFIRFFPIIPLKNTKTQRD

SEQ ID NO: 2669757 - protein, 28 aa, Entamoeba histolytica
APALKILVRLCSLFPLIKKYVLACEFFR

SEQ ID NO: 2669758 - protein, 17 aa, Entamoeba histolytica
APDIFIRAAELCGEKDM

SEQ ID NO: 2669759 - protein, 28 aa, Entamoeba histolytica
APDNLKTKFVYYSRDWEDFLKSNNHSIS

SEQ ID NO: 2669760 - protein, 22 aa, Entamoeba histolytica
APEARYGKKLCFYVNGHVFAAP

SEQ ID NO: 2669761 - protein, 24 aa, Entamoeba histolytica
APEKCKPYAFPVLDVLEKYHLEKK

SEQ ID NO: 2669762 - protein, 18 aa, Entamoeba histolytica
APELLYCVPERVVISDKK

SEQ ID NO: 2669763 - protein, 19 aa, Entamoeba histolytica
APELLYCVPERVVISDKKQ

SEQ ID NO: 2669764 - protein, 19 aa, Entamoeba histolytica
APEPIKLMIDPTRYVIIPR

SEQ ID NO: 2669765 - protein, 19 aa, Entamoeba histolytica
APEPLRFILSVYDSNSREK

SEQ ID NO: 2669766 - protein, 23 aa, Entamoeba histolytica
APFCTASIKTHCFGVDSDKLISN

SEQ ID NO: 2669767 - protein, 17 aa, Entamoeba histolytica
APFNLLICKQTLGEIED

SEQ ID NO: 2669768 - protein, 19 aa, Entamoeba histolytica
APGMVVGGWTSVRVASEII

SEQ ID NO: 2669769 - protein, 26 aa, Entamoeba histolytica
APHSIAHSFALYLGWVKTEAIPSTIY

SEQ ID NO: 2669770 - protein, 33 aa, Entamoeba histolytica
APIGQGNVCYVEFGGPVPPQAPMGIGNNGYMGF

SEQ ID NO: 2669771 - protein, 18 aa, Entamoeba histolytica
APIIPICAQLKYNMDVVC

SEQ ID NO: 2669772 - protein, 29 aa, Entamoeba histolytica
APIMGRRADYMWGLGYRKALMMEKLKMEG

SEQ ID NO: 2669773 - protein, 21 aa, Entamoeba histolytica
APKLMWKVRILQGNIDASVKE

SEQ ID NO: 2669774 - protein, 26 aa, Entamoeba histolytica
APKTRYNCYAHVWDAHLRTELSKPGK

SEQ ID NO: 2669775 - protein, 18 aa, Entamoeba histolytica
APLIKCNLILSQSLNEEC

SEQ ID NO: 2669776 - protein, 21 aa, Entamoeba histolytica
APLLDTWCLFRTEVRKEAIKS

SEQ ID NO: 2669777 - protein, 18 aa, Entamoeba histolytica
APLQAMLFGLQLKPLPTV

SEQ ID NO: 2669778 - protein, 18 aa, Entamoeba histolytica
APLRCLYTTFTDTITSHL

SEQ ID NO: 2669779 - protein, 20 aa, Entamoeba histolytica
APLTYGLYEWLRVCTGAYIM

SEQ ID NO: 2669780 - protein, 42 aa, Entamoeba histolytica
APNRRGLPGFGMEWLEEISLDYGGLCMKDLLTSVDIMKEESY

SEQ ID NO: 2669781 - protein, 20 aa, Entamoeba histolytica
APNYCSRCGNIASIMKVDES

SEQ ID NO: 2669782 - protein, 20 aa, Entamoeba histolytica
APNYCSRCGNIASIMKVNEN

SEQ ID NO: 2669783 - protein, 23 aa, Entamoeba histolytica
APNYCYKCNNLAAIMELSDTGEY

SEQ ID NO: 2669784 - protein, 22 aa, Entamoeba histolytica
APNYCYRCTNDAAIFVIKGENK

SEQ ID NO: 2669785 - protein, 21 aa, Entamoeba histolytica
APPCGTELFSGLRNDKFVAQK

SEQ ID NO: 2669786 - protein, 21 aa, Entamoeba histolytica
APPFTRKCIVATNIAETSITI

SEQ ID NO: 2669787 - protein, 18 aa, Entamoeba histolytica
APPHIFHHFKLYSEGLTF

SEQ ID NO: 2669788 - protein, 17 aa, Entamoeba histolytica
APPLWLSQNSIRPEDIL

SEQ ID NO: 2669789 - protein, 23 aa, Entamoeba histolytica
APQPPAIICREILDTFIKQTKAN

SEQ ID NO: 2669790 - protein, 18 aa, Entamoeba histolytica
APQYLLLQLNRFSIASDH

SEQ ID NO: 2669791 - protein, 20 aa, Entamoeba histolytica
APRGAPRGRGGMMPPTQAPE

SEQ ID NO: 2669792 - protein, 19 aa, Entamoeba histolytica
APRVMKKPIQWYLEHLMGE

SEQ ID NO: 2669793 - protein, 20 aa, Entamoeba histolytica
APSACNYRPIKFMVINRPKL

SEQ ID NO: 2669794 - protein, 17 aa, Entamoeba histolytica
APSEIIIFCPKKHKFTI

SEQ ID NO: 2669795 - protein, 18 aa, Entamoeba histolytica
APSGILALIHHPSFSTEK

SEQ ID NO: 2669796 - protein, 18 aa, Entamoeba histolytica
APSLPTREPILLKEQDRM

SEQ ID NO: 2669797 - protein, 26 aa, Entamoeba histolytica
APTGCGKTLTALLCMLREVKVHQHDM

SEQ ID NO: 2669798 - protein, 17 aa, Entamoeba histolytica
APTGMLARGEYKSNVKF

SEQ ID NO: 2669799 - protein, 19 aa, Entamoeba histolytica
APTVKRIYEELIIPRKKRS

SEQ ID NO: 2669800 - protein, 19 aa, Entamoeba histolytica
APVEIFKPEMKQFHENCQI

SEQ ID NO: 2669801 - protein, 17 aa, Entamoeba histolytica
APVKILMISPKVGVPQL

SEQ ID NO: 2669802 - protein, 21 aa, Entamoeba histolytica
APVTCVNWSLTNNFLFCSGDE

SEQ ID NO: 2669803 - protein, 23 aa, Entamoeba histolytica
APYCLPLIPKTVEWLNTELPPNI

SEQ ID NO: 2669804 - protein, 22 aa, Entamoeba histolytica
AQAVECLRTIKALTGVTFQAQW

SEQ ID NO: 2669805 - protein, 20 aa, Entamoeba histolytica
AQCHPACKAKEISIQIVVDQ

SEQ ID NO: 2669806 - protein, 27 aa, Entamoeba histolytica
AQCKGLNCAFGRWPVKSAQFILKLLKN

SEQ ID NO: 2669807 - protein, 24 aa, Entamoeba histolytica
AQDLAKREGFEFIETSAKSNNNVD

SEQ ID NO: 2669808 - protein, 19 aa, Entamoeba histolytica
AQDPMNWYVCDDACVTNEE

SEQ ID NO: 2669809 - protein, 18 aa, Entamoeba histolytica
AQETLKYVFPSLEKARNE

SEQ ID NO: 2669810 - protein, 23 aa, Entamoeba histolytica
AQEVDEALNISGAIGTARQQINN

SEQ ID NO: 2669811 - protein, 23 aa, Entamoeba histolytica
AQFFPGMAGMGGFEQRSRGPRKG

SEQ ID NO: 2669812 - protein, 32 aa, Entamoeba histolytica
AQFYIPIARECECFGCFGIPLDIAVQRGEWKV

SEQ ID NO: 2669813 - protein, 24 aa, Entamoeba histolytica
AQGDRYRMGNLFIVGPTKTGKTEF

SEQ ID NO: 2669814 - protein, 22 aa, Entamoeba histolytica
AQGFPKVIGCLTHLDKVKNNKL

SEQ ID NO: 2669815 - protein, 26 aa, Entamoeba histolytica
AQGGIVCDIYGNPLCYPSSKKESMRH

SEQ ID NO: 2669816 - protein, 26 aa, Entamoeba histolytica
AQHFSQTRYKGWPKVEEFLNGLENHS

SEQ ID NO: 2669817 - protein, 26 aa, Entamoeba histolytica
AQINLALCYLWGCGVKKSIDDAKKCY

SEQ ID NO: 2669818 - protein, 21 aa, Entamoeba histolytica
AQISSLCRLILSKGYRTTKGF

SEQ ID NO: 2669819 - protein, 28 aa, Entamoeba histolytica
AQITKWTQSCIVLPNFLILPVQRLPRYI

SEQ ID NO: 2669820 - protein, 25 aa, Entamoeba histolytica
AQIVKDLKIVFGIEDDLKCYLRKES

SEQ ID NO: 2669821 - protein, 20 aa, Entamoeba histolytica
AQKMQMGFSQIKSSLQKLPV

SEQ ID NO: 2669822 - protein, 19 aa, Entamoeba histolytica
AQKSFFCGNITMVRETKTT

SEQ ID NO: 2669823 - protein, 19 aa, Entamoeba histolytica
AQKTVRMKKIIMVKKDNKP

SEQ ID NO: 2669824 - protein, 18 aa, Entamoeba histolytica
AQLARIDAVLAMKEPELY

SEQ ID NO: 2669825 - protein, 24 aa, Entamoeba histolytica
AQLKAVCVEAGMIALRREAIEIRH

SEQ ID NO: 2669826 - protein, 23 aa, Entamoeba histolytica
AQLKRGEIPIVFIDKIDQEIIRL

SEQ ID NO: 2669827 - protein, 24 aa, Entamoeba histolytica
AQLSSPNRITCDVRILVLSSQHED

SEQ ID NO: 2669828 - protein, 20 aa, Entamoeba histolytica
AQLVHCLRLVGFDYVFDINS

SEQ ID NO: 2669829 - protein, 21 aa, Entamoeba histolytica
AQNAFSGQVLWDLYNFSSTKK

SEQ ID NO: 2669830 - protein, 19 aa, Entamoeba histolytica
AQNGMLWQRTFFRWLRRWL

SEQ ID NO: 2669831 - protein, 21 aa, Entamoeba histolytica
AQNKNIYFCVFIDQDESLEKV

SEQ ID NO: 2669832 - protein, 24 aa, Entamoeba histolytica
AQNMLRLYMEPDLISGKGKLCKDL

SEQ ID NO: 2669833 - protein, 18 aa, Entamoeba histolytica
AQPSLPQRQPSNSNIQRT

SEQ ID NO: 2669834 - protein, 23 aa, Entamoeba histolytica
AQQLCKLNHAISLPLVKLNLSNL

SEQ ID NO: 2669835 - protein, 19 aa, Entamoeba histolytica
AQQSFLFRILVDNGFTVCL

SEQ ID NO: 2669836 - protein, 17 aa, Entamoeba histolytica
AQRAIDEPIVFREDSSI

SEQ ID NO: 2669837 - protein, 21 aa, Entamoeba histolytica
AQRALGFYIKYVEKGYALLAG

SEQ ID NO: 2669838 - protein, 18 aa, Entamoeba histolytica
AQRLETFQTHLTMPDLQN

SEQ ID NO: 2669839 - protein, 24 aa, Entamoeba histolytica
AQSGRLYALGLIFGGHGKEILTTI

SEQ ID NO: 2669840 - protein, 19 aa, Entamoeba histolytica
AQSIIRGFLYHKRYLTYKA

SEQ ID NO: 2669841 - protein, 23 aa, Entamoeba histolytica
AQSPEVMAQFLIDNNFNILFTLG

SEQ ID NO: 2669842 - protein, 25 aa, Entamoeba histolytica
AQSSRSHSIFMMDLCGRNIGSNEQR

SEQ ID NO: 2669843 - protein, 21 aa, Entamoeba histolytica
AQTCGTCRGKGFRFVQIQQGF

SEQ ID NO: 2669844 - protein, 25 aa, Entamoeba histolytica
AQTLRVYLNYILRCPYFVDHFPVFS

SEQ ID NO: 2669845 - protein, 27 aa, Entamoeba histolytica
AQVKGSALVFCSAFSSFPRDTEFISIL

SEQ ID NO: 2669846 - protein, 18 aa, Entamoeba histolytica
AQVLGIRETDRWYYGGGL

SEQ ID NO: 2669847 - protein, 25 aa, Entamoeba histolytica
AQVLSRLTFTSALAYLRKISSPVEG

SEQ ID NO: 2669848 - protein, 18 aa, Entamoeba histolytica
AQYILPKIINSIHDTPIL

SEQ ID NO: 2669849 - protein, 22 aa, Entamoeba histolytica
ARAAEEKELKERVGREEEARAK

SEQ ID NO: 2669850 - protein, 19 aa, Entamoeba histolytica
ARAATPCIIFIDEIDTVVG

SEQ ID NO: 2669851 - protein, 23 aa, Entamoeba histolytica
ARATFCYAATVALNYSLACGVEQ

SEQ ID NO: 2669852 - protein, 22 aa, Entamoeba histolytica
ARDCSVAVPFVSKGINICVDIV

SEQ ID NO: 2669853 - protein, 18 aa, Entamoeba histolytica
ARDIKRLIHIKGKRNPFA

SEQ ID NO: 2669854 - protein, 18 aa, Entamoeba histolytica
ARDPRLEQNYSLVCIELI

SEQ ID NO: 2669855 - protein, 17 aa, Entamoeba histolytica
AREALGLIVEMVKAKRM

SEQ ID NO: 2669856 - protein, 23 aa, Entamoeba histolytica
AREFLKKPIEIICGGRSQVSNTI

SEQ ID NO: 2669857 - protein, 25 aa, Entamoeba histolytica
AREGKKCQPGWVCDRSGKVLSEPGP

SEQ ID NO: 2669858 - protein, 18 aa, Entamoeba histolytica
ARETKLWVDYFKIELNEE

SEQ ID NO: 2669859 - protein, 25 aa, Entamoeba histolytica
ARFNKEMIVPGYGLRSKKGTGKLIL

SEQ ID NO: 2669860 - protein, 24 aa, Entamoeba histolytica
ARFQLPQSILLSGISIKNEPYNNS

SEQ ID NO: 2669861 - protein, 17 aa, Entamoeba histolytica
ARGGKKTNLSNLVKGSR

SEQ ID NO: 2669862 - protein, 21 aa, Entamoeba histolytica
ARGLIKMGIKKGDNLGFFSRR

SEQ ID NO: 2669863 - protein, 18 aa, Entamoeba histolytica
ARGLKKKDIRLFARAVIP

SEQ ID NO: 2669864 - protein, 22 aa, Entamoeba histolytica
ARGQALLARHGILGCLFKDKFN

SEQ ID NO: 2669865 - protein, 42 aa, Entamoeba histolytica
ARIFRALFELLLIKRWARPALKALELCKSVTRRLFNSQCPLR

SEQ ID NO: 2669866 - protein, 20 aa, Entamoeba histolytica
ARIKNMCQCCLKDIEYNIPY

SEQ ID NO: 2669867 - protein, 18 aa, Entamoeba histolytica
ARILNYYKPNIIAYNTLT

SEQ ID NO: 2669868 - protein, 17 aa, Entamoeba histolytica
ARISSLIAGKSPQQCKA

SEQ ID NO: 2669869 - protein, 17 aa, Entamoeba histolytica
ARITIWIKTNEYTILTN

SEQ ID NO: 2669870 - protein, 23 aa, Entamoeba histolytica
ARIVLKDYCCGKLVYCKPPPGIT

SEQ ID NO: 2669871 - protein, 18 aa, Entamoeba histolytica
ARIYFLLAASYTNYKNIE

SEQ ID NO: 2669872 - protein, 19 aa, Entamoeba histolytica
ARKAFPCFDEPNYKATFDI

SEQ ID NO: 2669873 - protein, 19 aa, Entamoeba histolytica
ARLAASLNQSSPRTKSVQP

SEQ ID NO: 2669874 - protein, 20 aa, Entamoeba histolytica
ARLAKANAYITSYLREQMPT

SEQ ID NO: 2669875 - protein, 21 aa, Entamoeba histolytica
ARLKSIIPQLTFDSHKGACGK

SEQ ID NO: 2669876 - protein, 17 aa, Entamoeba histolytica
ARLLIKYLKNGKIQSLH

SEQ ID NO: 2669877 - protein, 22 aa, Entamoeba histolytica
ARLPIEQHIECIGRKVLTVNQV

SEQ ID NO: 2669878 - protein, 17 aa, Entamoeba histolytica
ARLQKMKKLESDAAKGG

SEQ ID NO: 2669879 - protein, 19 aa, Entamoeba histolytica
ARMQCVIDALLVPENRVSW

SEQ ID NO: 2669880 - protein, 18 aa, Entamoeba histolytica
ARNFLVFQGDVIQVASKS

SEQ ID NO: 2669881 - protein, 19 aa, Entamoeba histolytica
ARNIHCIDSTFIITKDYFS

SEQ ID NO: 2669882 - protein, 22 aa, Entamoeba histolytica
ARNILPYISVFLVDDHKNVRNK

SEQ ID NO: 2669883 - protein, 19 aa, Entamoeba histolytica
ARNLFLLLREVFFVHSPPK

SEQ ID NO: 2669884 - protein, 29 aa, Entamoeba histolytica
ARNTFLTLFFLRYCFRPFSKVPSVLKILH

SEQ ID NO: 2669885 - protein, 25 aa, Entamoeba histolytica
ARPIMSSLLVCYTKYLNSVSKGWKQ

SEQ ID NO: 2669886 - protein, 20 aa, Entamoeba histolytica
ARPIPKLNIPPLEVQQNENI

SEQ ID NO: 2669887 - protein, 19 aa, Entamoeba histolytica
ARPIPQQQIHFDNLSSNSS

SEQ ID NO: 2669888 - protein, 20 aa, Entamoeba histolytica
ARPIPTISFQILDMRPRSIP

SEQ ID NO: 2669889 - protein, 22 aa, Entamoeba histolytica
ARPKNGRSLNIFQRRTNCTVLV

SEQ ID NO: 2669890 - protein, 25 aa, Entamoeba histolytica
ARPTECLPKVLPFPGHIETKGIVQF

SEQ ID NO: 2669891 - protein, 20 aa, Entamoeba histolytica
ARQFTTKKGIPFFETSALQR

SEQ ID NO: 2669892 - protein, 18 aa, Entamoeba histolytica
ARQLTLIASKIFNKIGRQ

SEQ ID NO: 2669893 - protein, 18 aa, Entamoeba histolytica
ARQMIFDRFLQIKDVTKL

SEQ ID NO: 2669894 - protein, 25 aa, Entamoeba histolytica
ARQSALRILHCLNSNFNENLLQEFI

SEQ ID NO: 2669895 - protein, 23 aa, Entamoeba histolytica
ARRFCNKENVFAYVIGIFPNEES

SEQ ID NO: 2669896 - protein, 20 aa, Entamoeba histolytica
ARRIKCRFYIETSALHKEGI

SEQ ID NO: 2669897 - protein, 25 aa, Entamoeba histolytica
ARRKAGKKILKIQCGMGHHNTVGYS

SEQ ID NO: 2669898 - protein, 19 aa, Entamoeba histolytica
ARRLAVGLLNGFDQPIKSI

SEQ ID NO: 2669899 - protein, 23 aa, Entamoeba histolytica
ARSALNTLEKVFVHFNLMSEKVL

SEQ ID NO: 2669900 - protein, 17 aa, Entamoeba histolytica
ARSLSVYRYRNDIEHLD

SEQ ID NO: 2669901 - protein, 19 aa, Entamoeba histolytica
ARSLVQYEPFFGEFAIYEV

SEQ ID NO: 2669902 - protein, 24 aa, Entamoeba histolytica
ARTKKQCVKSIIAHNCDVNVVNWN

SEQ ID NO: 2669903 - protein, 17 aa, Entamoeba histolytica
ARVDRFPEEPVFGYRHK

SEQ ID NO: 2669904 - protein, 26 aa, Entamoeba histolytica
ARVILFFFDLTRVMTLNNIKDWYKEA

SEQ ID NO: 2669905 - protein, 18 aa, Entamoeba histolytica
ARVLEPYSSIELSHVSKL

SEQ ID NO: 2669906 - protein, 20 aa, Entamoeba histolytica
ARVMKLCVHPNVVEFHDYFE

SEQ ID NO: 2669907 - protein, 21 aa, Entamoeba histolytica
ARVVAVEGFGRIIANQPLCCK

SEQ ID NO: 2669908 - protein, 21 aa, Entamoeba histolytica
ARYVKELYLKKNIHDTSPKQF

SEQ ID NO: 2669909 - protein, 21 aa, Entamoeba histolytica
ASAAGFFACQGRFVFEENHPT

SEQ ID NO: 2669910 - protein, 17 aa, Entamoeba histolytica
ASAEVSRPNVLLESLEK

SEQ ID NO: 2669911 - protein, 18 aa, Entamoeba histolytica
ASAEVSRPNVLLESLEKR

SEQ ID NO: 2669912 - protein, 19 aa, Entamoeba histolytica
ASAEWWKESICLSCAIHAP

SEQ ID NO: 2669913 - protein, 25 aa, Entamoeba histolytica
ASAKTCGVVFGMLKQLERFRDKENT

SEQ ID NO: 2669914 - protein, 20 aa, Entamoeba histolytica
ASALKQLYKKFGYSNDNPKV

SEQ ID NO: 2669915 - protein, 19 aa, Entamoeba histolytica
ASAQNVFKEMFKTKGQYQE

SEQ ID NO: 2669916 - protein, 17 aa, Entamoeba histolytica
ASCLMKMTPFEKQYWNI

SEQ ID NO: 2669917 - protein, 34 aa, Entamoeba histolytica
ASCLVKLPLILPFIKKKMHYRILGLNAIPHENEL

SEQ ID NO: 2669918 - protein, 24 aa, Entamoeba histolytica
ASDEFKGKCVLAINSKDKKGDRRY

SEQ ID NO: 2669919 - protein, 34 aa, Entamoeba histolytica
ASDIWSCGVMLYNMLFLFPFKKPKNMYELQITDD

SEQ ID NO: 2669920 - protein, 21 aa, Entamoeba histolytica
ASDYCSFKIFNYLVSNPHFPE

SEQ ID NO: 2669921 - protein, 17 aa, Entamoeba histolytica
ASESILTFNCFDWDNAF

SEQ ID NO: 2669922 - protein, 24 aa, Entamoeba histolytica
ASFGCIRVGGWINKYNSLVSTITP

SEQ ID NO: 2669923 - protein, 19 aa, Entamoeba histolytica
ASFKISRLLRMNDLAQIST

SEQ ID NO: 2669924 - protein, 24 aa, Entamoeba histolytica
ASFKTQIATIIIFKGYSKENFGYI

SEQ ID NO: 2669925 - protein, 19 aa, Entamoeba histolytica
ASFLERHVDKFIKGERKFV

SEQ ID NO: 2669926 - protein, 23 aa, Entamoeba histolytica
ASFPSLRCWDKFDSPAFVCSKIR

SEQ ID NO: 2669927 - protein, 17 aa, Entamoeba histolytica
ASFYERAGMVECLGSPK

SEQ ID NO: 2669928 - protein, 23 aa, Entamoeba histolytica
ASGDEKGSVILWDIKYGEHVKKI

SEQ ID NO: 2669929 - protein, 23 aa, Entamoeba histolytica
ASGDKYRMGNLFIVGPTKTGKTE

SEQ ID NO: 2669930 - protein, 18 aa, Entamoeba histolytica
ASGISTPTGSAVTTQEGN

SEQ ID NO: 2669931 - protein, 20 aa, Entamoeba histolytica
ASGKLGYPHRGFPEKFIERV

SEQ ID NO: 2669932 - protein, 17 aa, Entamoeba histolytica
ASGKTCLYNIWRGLNIP

SEQ ID NO: 2669933 - protein, 31 aa, Entamoeba histolytica
ASGKYTPYCQYMFYDCLEILPDNYLELPKEE

SEQ ID NO: 2669934 - protein, 24 aa, Entamoeba histolytica
ASGLMAKERYGLLIIDSATALYRT

SEQ ID NO: 2669935 - protein, 23 aa, Entamoeba histolytica
ASGNKYRMGNLFIVGPTKTGKTE

SEQ ID NO: 2669936 - protein, 19 aa, Entamoeba histolytica
ASGNYAWNAGIFLWTAKTI

SEQ ID NO: 2669937 - protein, 24 aa, Entamoeba histolytica
ASGTRPCLYVPQSAFENLISKQVR

SEQ ID NO: 2669938 - protein, 19 aa, Entamoeba histolytica
ASHALRWGVPVLSHQWLFD

SEQ ID NO: 2669939 - protein, 19 aa, Entamoeba histolytica
ASHVSELFSGVLDSLDMKF

SEQ ID NO: 2669940 - protein, 24 aa, Entamoeba histolytica
ASIFPKVKLSNFALCDQIENSIIP

SEQ ID NO: 2669941 - protein, 25 aa, Entamoeba histolytica
ASIFPKVKLSNFGLCDQFEQTIPNE

SEQ ID NO: 2669942 - protein, 25 aa, Entamoeba histolytica
ASIKDWLSVLAEIFKANIVAWEYPG

SEQ ID NO: 2669943 - protein, 18 aa, Entamoeba histolytica
ASIKGHFFIDHGVGVVIG

SEQ ID NO: 2669944 - protein, 19 aa, Entamoeba histolytica
ASIKGHFFIDHGVGVVIGE

SEQ ID NO: 2669945 - protein, 19 aa, Entamoeba histolytica
ASIPSMLKSDVCRLKRCVT

SEQ ID NO: 2669946 - protein, 32 aa, Entamoeba histolytica
ASIVSKCFFLKVGKTFIKRYFSKYFSQLLAEK

SEQ ID NO: 2669947 - protein, 20 aa, Entamoeba histolytica
ASIVSLREARFWGIFIGDLM

SEQ ID NO: 2669948 - protein, 17 aa, Entamoeba histolytica
ASKEFNDPAPVFNMPRD

SEQ ID NO: 2669949 - protein, 27 aa, Entamoeba histolytica
ASKEGKRVVGVLLGFIRKGIVDVMNSF

SEQ ID NO: 2669950 - protein, 19 aa, Entamoeba histolytica
ASKHCKTVEHHAMSVYADA

SEQ ID NO: 2669951 - protein, 25 aa, Entamoeba histolytica
ASKIDFKCIIYGKGFHVGITCDYAS

SEQ ID NO: 2669952 - protein, 21 aa, Entamoeba histolytica
ASKKLGVSISHCIVFEDTISG

SEQ ID NO: 2669953 - protein, 19 aa, Entamoeba histolytica
ASKLTRWNLIFEETKEFIN

SEQ ID NO: 2669954 - protein, 23 aa, Entamoeba histolytica
ASLARKLGAFFIETSCLNGSNVD

SEQ ID NO: 2669955 - protein, 17 aa, Entamoeba histolytica
ASLERRTLTSFKLLLSS

SEQ ID NO: 2669956 - protein, 22 aa, Entamoeba histolytica
ASLEVVESLAALTKGKKKEEPK

SEQ ID NO: 2669957 - protein, 17 aa, Entamoeba histolytica
ASLFSVHNTIGILPIQI

SEQ ID NO: 2669958 - protein, 18 aa, Entamoeba histolytica
ASLGEFSFEEKIRRDIKK

SEQ ID NO: 2669959 - protein, 18 aa, Entamoeba histolytica
ASLINGEEIIDCIYNTAN

SEQ ID NO: 2669960 - protein, 29 aa, Entamoeba histolytica
ASLKHFNNLCLRFHFFQSILNKVIVNSDG

SEQ ID NO: 2669961 - protein, 18 aa, Entamoeba histolytica
ASLLKKFLIQSNVSVTSR

SEQ ID NO: 2669962 - protein, 19 aa, Entamoeba histolytica
ASLLVKWDNVKEVSEMFKK

SEQ ID NO: 2669963 - protein, 18 aa, Entamoeba histolytica
ASLPYLILERQFKGKVLM

SEQ ID NO: 2669964 - protein, 18 aa, Entamoeba histolytica
ASLVIQKLPPGQMATNEL

SEQ ID NO: 2669965 - protein, 20 aa, Entamoeba histolytica
ASLVLGFIWMLFDKFQEKDI

SEQ ID NO: 2669966 - protein, 18 aa, Entamoeba histolytica
ASLYAGKGDLEFNDPIPK

SEQ ID NO: 2669967 - protein, 18 aa, Entamoeba histolytica
ASNFFLAEGILLPENIKI

SEQ ID NO: 2669968 - protein, 19 aa, Entamoeba histolytica
ASNKKAQWNTFTIDIKNGI

SEQ ID NO: 2669969 - protein, 20 aa, Entamoeba histolytica
ASPAGYRTATRLMLLAEQFA

SEQ ID NO: 2669970 - protein, 25 aa, Entamoeba histolytica
ASQARKGDCQIAIIGDEDSVTGFLL

SEQ ID NO: 2669971 - protein, 20 aa, Entamoeba histolytica
ASQCSLPIIASGGIRNGLEI

SEQ ID NO: 2669972 - protein, 24 aa, Entamoeba histolytica
ASQIECYGEFPLYYTKTSVPLCID

SEQ ID NO: 2669973 - protein, 19 aa, Entamoeba histolytica
ASQKYIFGNIIDLFGKDVK

SEQ ID NO: 2669974 - protein, 19 aa, Entamoeba histolytica
ASQKYIFGNIVDLFGKDVK

SEQ ID NO: 2669975 - protein, 19 aa, Entamoeba histolytica
ASQLYKLIASILHLEPTDI

SEQ ID NO: 2669976 - protein, 23 aa, Entamoeba histolytica
ASQMLELELGLLILKIGLNGTKT

SEQ ID NO: 2669977 - protein, 26 aa, Entamoeba histolytica
ASQNAEFKRLTLLMTNLPNKRLRDVS

SEQ ID NO: 2669978 - protein, 18 aa, Entamoeba histolytica
ASRGWLDSKRPCMLTIEN

SEQ ID NO: 2669979 - protein, 26 aa, Entamoeba histolytica
ASRLIKRSMDAIAFGKLLEVAEKASI

SEQ ID NO: 2669980 - protein, 21 aa, Entamoeba histolytica
ASRLPLVVDVNHMMTHLIECA

SEQ ID NO: 2669981 - protein, 22 aa, Entamoeba histolytica
ASRLSWREFFAHQFVYRAMQHH

SEQ ID NO: 2669982 - protein, 18 aa, Entamoeba histolytica
ASSCQRSRSHSKPSSTSN

SEQ ID NO: 2669983 - protein, 20 aa, Entamoeba histolytica
ASSFPQLLFCDIQDCFSEFC

SEQ ID NO: 2669984 - protein, 23 aa, Entamoeba histolytica
ASSIKPHLVSMVFCCSTCKANKE

SEQ ID NO: 2669985 - protein, 24 aa, Entamoeba histolytica
ASSKEPSCISSLPLSKSSGDFIEV

SEQ ID NO: 2669986 - protein, 19 aa, Entamoeba histolytica
ASSMKRLSQMINEKEVSQK

SEQ ID NO: 2669987 - protein, 24 aa, Entamoeba histolytica
ASSRRYKKWLPFILAVLDAEKKTF

SEQ ID NO: 2669988 - protein, 20 aa, Entamoeba histolytica
ASSVSYLFNRYCITQLEIKG

SEQ ID NO: 2669989 - protein, 23 aa, Entamoeba histolytica
ASTLQCNFIRIGIDDYSISDTLT

SEQ ID NO: 2669990 - protein, 21 aa, Entamoeba histolytica
ASTTRLYLRKGKGEQRIVKIY

SEQ ID NO: 2669991 - protein, 28 aa, Entamoeba histolytica
ASVYHCKVILRFVFNLIQIAFTSQHKLL

SEQ ID NO: 2669992 - protein, 17 aa, Entamoeba histolytica
ATAECFENILFPTEVWT

SEQ ID NO: 2669993 - protein, 25 aa, Entamoeba histolytica
ATAICVLHPSKFVIDRLVEELKVPK

SEQ ID NO: 2669994 - protein, 26 aa, Entamoeba histolytica
ATAIELPHSLSFLGKTAFIDCTNLQS

SEQ ID NO: 2669995 - protein, 17 aa, Entamoeba histolytica
ATASRLRTMKFDPKGEL

SEQ ID NO: 2669996 - protein, 19 aa, Entamoeba histolytica
ATCDLRPTIPPSTPQKMAT

SEQ ID NO: 2669997 - protein, 27 aa, Entamoeba histolytica
ATCFYPFLNSDVIRFIRNIPEDFLVKL

SEQ ID NO: 2669998 - protein, 23 aa, Entamoeba histolytica
ATCKICESFVGIALDYITKGETV

SEQ ID NO: 2669999 - protein, 17 aa, Entamoeba histolytica
ATCLNEKYIKENVLNTR

SEQ ID NO: 2670000 - protein, 29 aa, Entamoeba histolytica
ATCSSIDVIVPWTHLYSKPIILRLGEVIV

SEQ ID NO: 2670001 - protein, 19 aa, Entamoeba histolytica
ATDICYIYEWFVEKKQSIP

SEQ ID NO: 2670002 - protein, 21 aa, Entamoeba histolytica
ATDIHSLFDFPKPRQLDFLPY

SEQ ID NO: 2670003 - protein, 18 aa, Entamoeba histolytica
ATEFYLLLLDHLHEAIIG

SEQ ID NO: 2670004 - protein, 18 aa, Entamoeba histolytica
ATELLVKAVNAISGLKEE

SEQ ID NO: 2670005 - protein, 24 aa, Entamoeba histolytica
ATFIALADGCGWGDKPSFAAKLAV

SEQ ID NO: 2670006 - protein, 24 aa, Entamoeba histolytica
ATFTQEFHKIYGLNNLETNIPLQI

SEQ ID NO: 2670007 - protein, 20 aa, Entamoeba histolytica
ATGCGDGIVRLFKIGVTIDE

SEQ ID NO: 2670008 - protein, 20 aa, Entamoeba histolytica
ATIHYVFVVTLILANKKQYH

SEQ ID NO: 2670009 - protein, 18 aa, Entamoeba histolytica
ATILHIFNGSSFTRLFSE

SEQ ID NO: 2670010 - protein, 20 aa, Entamoeba histolytica
ATILLPLIVASTFAQKEEPT

SEQ ID NO: 2670011 - protein, 23 aa, Entamoeba histolytica
ATILRIVKEYVDNGSVLSSDQIS

SEQ ID NO: 2670012 - protein, 18 aa, Entamoeba histolytica
ATIPHLRLSDIDKKGQDF

SEQ ID NO: 2670013 - protein, 25 aa, Entamoeba histolytica
ATIPNAFEFASWIANIHKQACHVVY

SEQ ID NO: 2670014 - protein, 25 aa, Entamoeba histolytica
ATIQYRAKTFLPYYIQPLLSLIPVD

SEQ ID NO: 2670015 - protein, 17 aa, Entamoeba histolytica
ATIWIPCLFEIPQESPV

SEQ ID NO: 2670016 - protein, 24 aa, Entamoeba histolytica
ATKALPFLQIRSINFGNGDVFNFN

SEQ ID NO: 2670017 - protein, 23 aa, Entamoeba histolytica
ATKGGAEAITTVPADTAQQSTPT

SEQ ID NO: 2670018 - protein, 19 aa, Entamoeba histolytica
ATKIVCLRIFNDLFETFIE

SEQ ID NO: 2670019 - protein, 30 aa, Entamoeba histolytica
ATKRIRIGKFPKYLLIKLERQIALSYEDVR

SEQ ID NO: 2670020 - protein, 21 aa, Entamoeba histolytica
ATLCRNKLKQVYGSCHGNIND

SEQ ID NO: 2670021 - protein, 22 aa, Entamoeba histolytica
ATLFQRLCSLEIPIMLKVQYRC

SEQ ID NO: 2670022 - protein, 24 aa, Entamoeba histolytica
ATLHAFSHWSWCISNHQLIIVDLQ

SEQ ID NO: 2670023 - protein, 24 aa, Entamoeba histolytica
ATLKFLRPCEIEALKYTCEIPFVH

SEQ ID NO: 2670024 - protein, 17 aa, Entamoeba histolytica
ATLSLAEMIAAKQGKLK

SEQ ID NO: 2670025 - protein, 22 aa, Entamoeba histolytica
ATLVPTVKCLINISDAPYKVIE

SEQ ID NO: 2670026 - protein, 18 aa, Entamoeba histolytica
ATLVWKKVIINAGRALSD

SEQ ID NO: 2670027 - protein, 19 aa, Entamoeba histolytica
ATMPKELNKFVIAGCRNPY

SEQ ID NO: 2670028 - protein, 24 aa, Entamoeba histolytica
ATNECVLCPVCIEEGIPDVGEMLV

SEQ ID NO: 2670029 - protein, 25 aa, Entamoeba histolytica
ATNIEGADLFAVFDGHNGHEAATLC

SEQ ID NO: 2670030 - protein, 27 aa, Entamoeba histolytica
ATPDEYRRLFFYLISFLKKLIEMGEDK

SEQ ID NO: 2670031 - protein, 22 aa, Entamoeba histolytica
ATPTSKCLRLFGTHKDGLIRPF

SEQ ID NO: 2670032 - protein, 18 aa, Entamoeba histolytica
ATQKFGFPPIPNPILNIF

SEQ ID NO: 2670033 - protein, 18 aa, Entamoeba histolytica
ATQTSLRFTLQMLTPTSI

SEQ ID NO: 2670034 - protein, 23 aa, Entamoeba histolytica
ATRHPQMFPGFLEMLIEYKKQGG

SEQ ID NO: 2670035 - protein, 24 aa, Entamoeba histolytica
ATRLLKKLTCEWVKEDLNKHSLLE

SEQ ID NO: 2670036 - protein, 25 aa, Entamoeba histolytica
ATRVAKSFLAKVGRKYLLDIYKPFV

SEQ ID NO: 2670037 - protein, 24 aa, Entamoeba histolytica
ATSISLMPSFRSLEWNHMYITFET

SEQ ID NO: 2670038 - protein, 23 aa, Entamoeba histolytica
ATSLKIPYVLVGQRVVDKYLNLL

SEQ ID NO: 2670039 - protein, 18 aa, Entamoeba histolytica
ATSLKNLILEGGNKTDQQ

SEQ ID NO: 2670040 - protein, 25 aa, Entamoeba histolytica
ATSYFPFSGAHGIFLVYRNDDDMSF

SEQ ID NO: 2670041 - protein, 17 aa, Entamoeba histolytica
ATTLFLSRNRTFTRLIT

SEQ ID NO: 2670042 - protein, 18 aa, Entamoeba histolytica
ATTLVGTLFKLRLKVLVA

SEQ ID NO: 2670043 - protein, 29 aa, Entamoeba histolytica
ATTSMPPLYQARVLFDFESKNGECLNVKT

SEQ ID NO: 2670044 - protein, 19 aa, Entamoeba histolytica
ATVLFPKEEAGAFYNPVQE

SEQ ID NO: 2670045 - protein, 23 aa, Entamoeba histolytica
ATVLYLGCEIVKIAYVGDCSVYL

SEQ ID NO: 2670046 - protein, 17 aa, Entamoeba histolytica
ATVTRFGLYCFKDCKHL

SEQ ID NO: 2670047 - protein, 29 aa, Entamoeba histolytica
ATWKKPQEWNHKCVMCVSKMGKFSSDRSM

SEQ ID NO: 2670048 - protein, 21 aa, Entamoeba histolytica
ATYFVCGSAEQFIRSYNSESG

SEQ ID NO: 2670049 - protein, 21 aa, Entamoeba histolytica
ATYNILFEYIRNIALSTKNCN

SEQ ID NO: 2670050 - protein, 20 aa, Entamoeba histolytica
ATYVPRYYVPALKDKNGNAA

SEQ ID NO: 2670051 - protein, 27 aa, Entamoeba histolytica
AVAHSCTKLGIRFIVIRSLSDVPSEDG

SEQ ID NO: 2670052 - protein, 17 aa, Entamoeba histolytica
AVAYYKSKLDELLRTVV

SEQ ID NO: 2670053 - protein, 19 aa, Entamoeba histolytica
AVCEMVPCHFEILRMELID

SEQ ID NO: 2670054 - protein, 20 aa, Entamoeba histolytica
AVCKELKNVFGEVMSTIETK

SEQ ID NO: 2670055 - protein, 26 aa, Entamoeba histolytica
AVCNKGTYVNGWKRMPAIEEVTEFGH

SEQ ID NO: 2670056 - protein, 18 aa, Entamoeba histolytica
AVDGFVIDSAITKIKGNV

SEQ ID NO: 2670057 - protein, 24 aa, Entamoeba histolytica
AVDKLKELFGLNVINGSDDAKKAV

SEQ ID NO: 2670058 - protein, 18 aa, Entamoeba histolytica
AVDLLMKVYREFLPHGGY

SEQ ID NO: 2670059 - protein, 24 aa, Entamoeba histolytica
AVDRCCSQGLPPVIPEQIIEMMDL

SEQ ID NO: 2670060 - protein, 23 aa, Entamoeba histolytica
AVECCSKAGIIHCDVKPENILMT

SEQ ID NO: 2670061 - protein, 21 aa, Entamoeba histolytica
AVECEGCRLYYPKCYQEEHEK

SEQ ID NO: 2670062 - protein, 19 aa, Entamoeba histolytica
AVEFFGEYEDAIPLISDMK

SEQ ID NO: 2670063 - protein, 21 aa, Entamoeba histolytica
AVEIKKAPKHIGFKGEGDDDD

SEQ ID NO: 2670064 - protein, 19 aa, Entamoeba histolytica
AVELYSFYNSLPIVKTQTL

SEQ ID NO: 2670065 - protein, 18 aa, Entamoeba histolytica
AVENCIKKSTLASFVVRT

SEQ ID NO: 2670066 - protein, 22 aa, Entamoeba histolytica
AVESFSFLLTHFDEMFCEIEKR

SEQ ID NO: 2670067 - protein, 21 aa, Entamoeba histolytica
AVESIYNYLYDKGFTVPGIFR

SEQ ID NO: 2670068 - protein, 17 aa, Entamoeba histolytica
AVFPDRKGIVYGGADGR

SEQ ID NO: 2670069 - protein, 25 aa, Entamoeba histolytica
AVFVSCSLIKFGVSIENALEYGIKH

SEQ ID NO: 2670070 - protein, 21 aa, Entamoeba histolytica
AVGCACPPPPPGNSSIVMGQE

SEQ ID NO: 2670071 - protein, 18 aa, Entamoeba histolytica
AVGKTCLLVSYTTNAFPT

SEQ ID NO: 2670072 - protein, 25 aa, Entamoeba histolytica
AVGRGRLHEMFYFRGNYESPIYYDK

SEQ ID NO: 2670073 - protein, 27 aa, Entamoeba histolytica
AVICLNCGDTICEKCLEKGICPSCNEE

SEQ ID NO: 2670074 - protein, 19 aa, Entamoeba histolytica
AVIKKELASIRFLKEDYCT

SEQ ID NO: 2670075 - protein, 24 aa, Entamoeba histolytica
AVIKSGYMLLKYVNEKKIQFDRKY

SEQ ID NO: 2670076 - protein, 20 aa, Entamoeba histolytica
AVILLKRYGINEMFRSSFDD

SEQ ID NO: 2670077 - protein, 19 aa, Entamoeba histolytica
AVINLCKDFHSVNMMTYKE

SEQ ID NO: 2670078 - protein, 17 aa, Entamoeba histolytica
AVIPTQKYFAGSRPTFA

SEQ ID NO: 2670079 - protein, 18 aa, Entamoeba histolytica
AVIREFFTKMGLPDVRFK

SEQ ID NO: 2670080 - protein, 17 aa, Entamoeba histolytica
AVIRVLIKHGADVNVQT

SEQ ID NO: 2670081 - protein, 18 aa, Entamoeba histolytica
AVKEGKCDQSVLDQLTAT

SEQ ID NO: 2670082 - protein, 29 aa, Entamoeba histolytica
AVKKSSWRFPIPVFRSLQYLLTHEGKELE

SEQ ID NO: 2670083 - protein, 27 aa, Entamoeba histolytica
AVKQNCCEESLPLLKYILEDAIQGNEN

SEQ ID NO: 2670084 - protein, 22 aa, Entamoeba histolytica
AVKREYLIYSWIFINTLDEKPF

SEQ ID NO: 2670085 - protein, 17 aa, Entamoeba histolytica
AVKSAVCKVNIDSDGRL

SEQ ID NO: 2670086 - protein, 39 aa, Entamoeba histolytica
AVKTMIEIICNIFPIYDFWKHVCVVWTMCYNYTPLKKLK

SEQ ID NO: 2670087 - protein, 21 aa, Entamoeba histolytica
AVLCQCTICRKVRFFTTEKPK

SEQ ID NO: 2670088 - protein, 17 aa, Entamoeba histolytica
AVLFKKELSAMKLSTTQ

SEQ ID NO: 2670089 - protein, 17 aa, Entamoeba histolytica
AVLKEYISHLFSQIRTY

SEQ ID NO: 2670090 - protein, 25 aa, Entamoeba histolytica
AVLRMFYQICHAVAFMHSQNPPLCH

SEQ ID NO: 2670091 - protein, 19 aa, Entamoeba histolytica
AVMKRLSVMWKNLSDKERE

SEQ ID NO: 2670092 - protein, 19 aa, Entamoeba histolytica
AVNEIGGFLAVASGNELEL

SEQ ID NO: 2670093 - protein, 20 aa, Entamoeba histolytica
AVNMSGHIIAFVAGPCTEGP

SEQ ID NO: 2670094 - protein, 17 aa, Entamoeba histolytica
AVPQHSCEIPITGETVK

SEQ ID NO: 2670095 - protein, 17 aa, Entamoeba histolytica
AVSLLLYYLVFNLPINK

SEQ ID NO: 2670096 - protein, 28 aa, Entamoeba histolytica
AVSRAYYPGARWGITRRSFASSLQEKSI

SEQ ID NO: 2670097 - protein, 24 aa, Entamoeba histolytica
AVTPLLIKMFLKYQLKCSSIQEAI

SEQ ID NO: 2670098 - protein, 24 aa, Entamoeba histolytica
AVVECPYWLAPEVINGEPFTQKSD

SEQ ID NO: 2670099 - protein, 19 aa, Entamoeba histolytica
AVVGLGFHKAAITGLAVTR

SEQ ID NO: 2670100 - protein, 19 aa, Entamoeba histolytica
AVVQDIMLGNAMGKKRRQG

SEQ ID NO: 2670101 - protein, 18 aa, Entamoeba histolytica
AVVSLLFELLDRLEKMQQ

SEQ ID NO: 2670102 - protein, 26 aa, Entamoeba histolytica
AVYCLKKCQKGIVAFINRNVHVIEKK

SEQ ID NO: 2670103 - protein, 21 aa, Entamoeba histolytica
AVYIRIGFQQTFTSLEVKKVE

SEQ ID NO: 2670104 - protein, 24 aa, Entamoeba histolytica
AVYKLLENIPMPWEEIKMVDVMYH

SEQ ID NO: 2670105 - protein, 17 aa, Entamoeba histolytica
AVYVVADGCGWGVASCK

SEQ ID NO: 2670106 - protein, 23 aa, Entamoeba histolytica
AWENWPPHVVTFFKKMSADWDAE

SEQ ID NO: 2670107 - protein, 18 aa, Entamoeba histolytica
AWGTEFGRLKKKVFVFEL

SEQ ID NO: 2670108 - protein, 17 aa, Entamoeba histolytica
AWIGCGAIILPGVTIGE

SEQ ID NO: 2670109 - protein, 21 aa, Entamoeba histolytica
AWIGCGAKILPGVRIGKNAVV

SEQ ID NO: 2670110 - protein, 18 aa, Entamoeba histolytica
AWKNYPSLIPQIVQDICI

SEQ ID NO: 2670111 - protein, 25 aa, Entamoeba histolytica
AWNVLPAELFMKLFRQDIAVASLFR

SEQ ID NO: 2670112 - protein, 22 aa, Entamoeba histolytica
AYAKEFLMNYLLASLKPSLEEL

SEQ ID NO: 2670113 - protein, 17 aa, Entamoeba histolytica
AYCIPRLTENASNKLSN

SEQ ID NO: 2670114 - protein, 17 aa, Entamoeba histolytica
AYCKMQVTIAGSDDHLF

SEQ ID NO: 2670115 - protein, 36 aa, Entamoeba histolytica; identical to SEQ ID NO: 2475628

SEQ ID NO: 2670116 - protein, 27 aa, Entamoeba histolytica
AYCQVGYRFGYVPIKYLEKVNLAKELG

SEQ ID NO: 2670117 - protein, 23 aa, Entamoeba histolytica
AYDLNFRKKLFLKLEEITGIKYP

SEQ ID NO: 2670118 - protein, 24 aa, Entamoeba histolytica
AYDSYRRFVSLFGKIALNVDDEVY

SEQ ID NO: 2670119 - protein, 25 aa, Entamoeba histolytica
AYDSYRRFVSLFGKIALNVDDEVYD

SEQ ID NO: 2670120 - protein, 23 aa, Entamoeba histolytica
AYDYRCLIGMGISGYAAAIYLEN

SEQ ID NO: 2670121 - protein, 20 aa, Entamoeba histolytica
AYEKIPHIIFHFNEITPKEK

SEQ ID NO: 2670122 - protein, 24 aa, Entamoeba histolytica
AYERGEIPWSEYMKEREKYILDND

SEQ ID NO: 2670123 - protein, 24 aa, Entamoeba histolytica
AYESCNACACFSAIVNESLARDLA

SEQ ID NO: 2670124 - protein, 24 aa, Entamoeba histolytica
AYHFKRYPITPSFITIERNDLQEI

SEQ ID NO: 2670125 - protein, 20 aa, Entamoeba histolytica
AYHPLCFEGVTGLEKEITYT

SEQ ID NO: 2670126 - protein, 18 aa, Entamoeba histolytica
AYHSGVCIFGREYSFSDG

SEQ ID NO: 2670127 - protein, 22 aa, Entamoeba histolytica
AYKEINLQGAVVMATVFYEKEN

SEQ ID NO: 2670128 - protein, 18 aa, Entamoeba histolytica
AYKKMAIKYHPDKNPGDT

SEQ ID NO: 2670129 - protein, 27 aa, Entamoeba histolytica
AYKMLHELSLEWSCLSFDIIPDTLGAL

SEQ ID NO: 2670130 - protein, 26 aa, Entamoeba histolytica
AYKVIKRIDAFEIINSIIPSYSSGLF

SEQ ID NO: 2670131 - protein, 19 aa, Entamoeba histolytica
AYLDGCTYVEFRFAPIQST

SEQ ID NO: 2670132 - protein, 18 aa, Entamoeba histolytica
AYLKSVSLKGYMNTVQNF

SEQ ID NO: 2670133 - protein, 23 aa, Entamoeba histolytica
AYLSRTGYVDVVICEDSDMIPYG

SEQ ID NO: 2670134 - protein, 18 aa, Entamoeba histolytica
AYMKRVLSTMSYNKQVII

SEQ ID NO: 2670135 - protein, 18 aa, Entamoeba histolytica
AYNICYSTCLGYVDDINI

SEQ ID NO: 2670136 - protein, 17 aa, Entamoeba histolytica
AYPDLTMDIFGKKVEPI

SEQ ID NO: 2670137 - protein, 23 aa, Entamoeba histolytica
AYPFCLPVPLSLPKKNYNKLFEH

SEQ ID NO: 2670138 - protein, 23 aa, Entamoeba histolytica
AYPHKKCMTKSRIVKLDNVGKAV

SEQ ID NO: 2670139 - protein, 20 aa, Entamoeba histolytica
AYPINFFNFFQMFNPNVIVP

SEQ ID NO: 2670140 - protein, 18 aa, Entamoeba histolytica
AYQNMGMVFSKQYDDLNS

SEQ ID NO: 2670141 - protein, 17 aa, Entamoeba histolytica
AYRKLAIKYHPDKNPGN

SEQ ID NO: 2670142 - protein, 17 aa, Entamoeba histolytica
AYSIGFAAMLTGRYVCY

SEQ ID NO: 2670143 - protein, 23 aa, Entamoeba histolytica
AYYADGFGEIFSLVKGNQYIGTS

SEQ ID NO: 2670144 - protein, 17 aa, Entamoeba histolytica
AYYTLFVKPVFEIYQKT

SEQ ID NO: 2670145 - protein, 22 aa, Entamoeba histolytica
AYYTLFVKPVFEIYQKTSKIRD

SEQ ID NO: 2670146 - protein, 21 aa, Entamoeba histolytica
CAACFKRIIEHSIYPYEYFHQ

SEQ ID NO: 2670147 - protein, 17 aa, Entamoeba histolytica
CAAKGTVLILGKEKHFL

SEQ ID NO: 2670148 - protein, 20 aa, Entamoeba histolytica
CAAMLKISLSCEGVRRKLSK

SEQ ID NO: 2670149 - protein, 21 aa, Entamoeba histolytica
CAASLKELMILSSNLITIKKE

SEQ ID NO: 2670150 - protein, 22 aa, Entamoeba histolytica
CAATEYFSLRFKEMGLRTYQPI

SEQ ID NO: 2670151 - protein, 28 aa, Entamoeba histolytica
CAAVPMVRAGVCFEAVHPCCFEAVHPCC

SEQ ID NO: 2670152 - protein, 27 aa, Entamoeba histolytica
CAAVPMVRAGVCFEAVHPCCFEEARGV

SEQ ID NO: 2670153 - protein, 20 aa, Entamoeba histolytica
CACKINYPHRFFLLRGNHEN

SEQ ID NO: 2670154 - protein, 20 aa, Entamoeba histolytica
CACKINYPHRFFLLRGNHES

SEQ ID NO: 2670155 - protein, 24 aa, Entamoeba histolytica
CAGKLYFCTLCLLQHKDFDINSLT

SEQ ID NO: 2670156 - protein, 20 aa, Entamoeba histolytica
CAIELIKRGKAYVCHQTPDQ

SEQ ID NO: 2670157 - protein, 18 aa, Entamoeba histolytica
CAIKRINGSLDLIEKELQ

SEQ ID NO: 2670158 - protein, 18 aa, Entamoeba histolytica
CAILELLKVHSRVLYIDI

SEQ ID NO: 2670159 - protein, 18 aa, Entamoeba histolytica
CAILQRILDKFPDFFEKI

SEQ ID NO: 2670160 - protein, 19 aa, Entamoeba histolytica
CAILVAGMPRKVGMERKEL

SEQ ID NO: 2670161 - protein, 21 aa, Entamoeba histolytica
CAINFKNLGCFNRDYKLNNIF

SEQ ID NO: 2670162 - protein, 19 aa, Entamoeba histolytica
CAKCNKKVCNTCATTKIAL

SEQ ID NO: 2670163 - protein, 21 aa, Entamoeba histolytica
CAKFFFDCFSPEYSFEEPIYS

SEQ ID NO: 2670164 - protein, 27 aa, Entamoeba histolytica
CAKHIQPRCCYECLISLECLKNAKCPL

SEQ ID NO: 2670165 - protein, 18 aa, Entamoeba histolytica
CAKKIIFEFETEKKKEEK

SEQ ID NO: 2670166 - protein, 25 aa, Entamoeba histolytica
CALCVKKCPFEAIKIINLPKNLEQC

SEQ ID NO: 2670167 - protein, 21 aa, Entamoeba histolytica
CALHGNDFFWVHGYNKGVPKD

SEQ ID NO: 2670168 - protein, 18 aa, Entamoeba histolytica
CAMRHGLIPNLLDGGDHS

SEQ ID NO: 2670169 - protein, 18 aa, Entamoeba histolytica
CANVLFKIVNRAYNIFNQ

SEQ ID NO: 2670170 - protein, 19 aa, Entamoeba histolytica
CARIKGELPEDVIPYSKDQ

SEQ ID NO: 2670171 - protein, 24 aa, Entamoeba histolytica
CASGNKYRMGNLFIVGPTKTGKTE

SEQ ID NO: 2670172 - protein, 25 aa, Entamoeba histolytica
CAVARLYLMCIVGSAAVKSKKVGIV

SEQ ID NO: 2670173 - protein, 21 aa, Entamoeba histolytica
CAVCRKCFYKDGATLKTQRSV

SEQ ID NO: 2670174 - protein, 17 aa, Entamoeba histolytica
CAVTIFAEVSKKEKKND

SEQ ID NO: 2670175 - protein, 18 aa, Entamoeba histolytica
CCASVCPVGAIIFNGISP

SEQ ID NO: 2670176 - protein, 21 aa, Entamoeba histolytica
CCCFGCKNISFLHLSFTCLSH

SEQ ID NO: 2670177 - protein, 18 aa, Entamoeba histolytica
CCCGNSYIIPLLIKKYPS

SEQ ID NO: 2670178 - protein, 19 aa, Entamoeba histolytica
CCCPIEIIQQLKLLFPEVH

SEQ ID NO: 2670179 - protein, 23 aa, Entamoeba histolytica
CCECSCYKPELYGELKTKACGLL

SEQ ID NO: 2670180 - protein, 19 aa, Entamoeba histolytica
CCELGDFNIGFIMYSCVVQ

SEQ ID NO: 2670181 - protein, 25 aa, Entamoeba histolytica
CCELYKCSSALRVSQFGQQNKTNDG

SEQ ID NO: 2670182 - protein, 26 aa, Entamoeba histolytica
CCFGIPRKVRGFVWYALLLRPKTTQE

SEQ ID NO: 2670183 - protein, 26 aa, Entamoeba histolytica
CCFVIKRISDGIIYLHVGDFRFDSTL

SEQ ID NO: 2670184 - protein, 17 aa, Entamoeba histolytica
CCGGTKIFINGRFPYSG

SEQ ID NO: 2670185 - protein, 18 aa, Entamoeba histolytica
CCICNVGFGIPEFPKLLP

SEQ ID NO: 2670186 - protein, 17 aa, Entamoeba histolytica
CCKDLIFDYSYIPKSES

SEQ ID NO: 2670187 - protein, 30 aa, Entamoeba histolytica
CCKGKRFICTLCLLFHPKFNLGKCELYCDV

SEQ ID NO: 2670188 - protein, 25 aa, Entamoeba histolytica
CCLSWKQLKKVIGLKVLEKIEQSAF

SEQ ID NO: 2670189 - protein, 27 aa, Entamoeba histolytica
CCNHISCIPGLCGCHDGCWCWKHINQL

SEQ ID NO: 2670190 - protein, 19 aa, Entamoeba histolytica
CCNSLILRGNFLVSKLFLV

SEQ ID NO: 2670191 - protein, 22 aa, Entamoeba histolytica
CCNYPIQLGCRLAKKAKIIKFK

SEQ ID NO: 2670192 - protein, 18 aa, Entamoeba histolytica
CCPIYDKFLYDIIEHPFY

SEQ ID NO: 2670193 - protein, 23 aa, Entamoeba histolytica
CCSGFGMTELCGLMYKMPSKATH

SEQ ID NO: 2670194 - protein, 18 aa, Entamoeba histolytica
CDAKQRMLRFPGNSMNLL

SEQ ID NO: 2670195 - protein, 26 aa, Entamoeba histolytica
CDAVEILRINPLFSIKPPIGPKDFIY

SEQ ID NO: 2670196 - protein, 20 aa, Entamoeba histolytica
CDAVRFVKTLFVKTIEIPDG

SEQ ID NO: 2670197 - protein, 19 aa, Entamoeba histolytica
CDDKGYLANVFRVHPNGYL

SEQ ID NO: 2670198 - protein, 19 aa, Entamoeba histolytica
CDDKSMIGLIAYRNDLVGG

SEQ ID NO: 2670199 - protein, 23 aa, Entamoeba histolytica
CDDVLKIITEFLLKNSTSIESKV

SEQ ID NO: 2670200 - protein, 27 aa, Entamoeba histolytica
CDDYVRRCIHSMGINQIQIIKVNHHGS

SEQ ID NO: 2670201 - protein, 23 aa, Entamoeba histolytica
CDEILEILTYLIVQCQPPMLYSN

SEQ ID NO: 2670202 - protein, 17 aa, Entamoeba histolytica
CDELFSWIANTFDNEKV

SEQ ID NO: 2670203 - protein, 17 aa, Entamoeba histolytica
CDFDKMIKIIQERNKAV

SEQ ID NO: 2670204 - protein, 17 aa, Entamoeba histolytica
CDFLANELFKYLQKNCY

SEQ ID NO: 2670205 - protein, 26 aa, Entamoeba histolytica
CDIDVRRCLFNNILCAGGNTLYPGFA

SEQ ID NO: 2670206 - protein, 19 aa, Entamoeba histolytica
CDKKIKLPLPVLSLDDGCK

SEQ ID NO: 2670207 - protein, 20 aa, Entamoeba histolytica
CDKKSKLLLELTVGTELQNP

SEQ ID NO: 2670208 - protein, 17 aa, Entamoeba histolytica
CDLDKVIQLALKFKDER

SEQ ID NO: 2670209 - protein, 20 aa, Entamoeba histolytica
CDLKNAFTFKKHLASTHSSF

SEQ ID NO: 2670210 - protein, 17 aa, Entamoeba histolytica
CDLLWSDPVSEWDPDSP

SEQ ID NO: 2670211 - protein, 17 aa, Entamoeba histolytica
CDLNCWIALCAFAAQTR

SEQ ID NO: 2670212 - protein, 19 aa, Entamoeba histolytica
CDLSKLLVIPVQYLSIPKN

SEQ ID NO: 2670213 - protein, 18 aa, Entamoeba histolytica
CDLSKYGPHFIIERDFKV

SEQ ID NO: 2670214 - protein, 19 aa, Entamoeba histolytica
CDLSRGWFENVLMMYMHPS

SEQ ID NO: 2670215 - protein, 17 aa, Entamoeba histolytica
CDNEFYQKLEAMLYKIM

SEQ ID NO: 2670216 - protein, 18 aa, Entamoeba histolytica
CDNPKFIISSTHPTSLFI

SEQ ID NO: 2670217 - protein, 18 aa, Entamoeba histolytica
CDPLFKRIQQTIERALNK

SEQ ID NO: 2670218 - protein, 26 aa, Entamoeba histolytica
CDPQTGVNCKLFLNGEAVTSIIRTFL

SEQ ID NO: 2670219 - protein, 23 aa, Entamoeba histolytica
CDPSCSGSGILERQLTKEKRDPA

SEQ ID NO: 2670220 - protein, 22 aa, Entamoeba histolytica
CDQIDIYGGMIFIHNKETFSCW

SEQ ID NO: 2670221 - protein, 28 aa, Entamoeba histolytica
CDQLMCFPAGLPAIFSFSNSNSIRYAKD

SEQ ID NO: 2670222 - protein, 19 aa, Entamoeba histolytica
CDRHGFCNFLHVIEPNHSL

SEQ ID NO: 2670223 - protein, 20 aa, Entamoeba histolytica
CDRKIFVGALDILKLLVKQN

SEQ ID NO: 2670224 - protein, 24 aa, Entamoeba histolytica
CDRVKLRLTSVPELEYFVEDKVPC

SEQ ID NO: 2670225 - protein, 18 aa, Entamoeba histolytica
CDRYLLGHDYPMIKIATI

SEQ ID NO: 2670226 - protein, 17 aa, Entamoeba histolytica
CDSLSSISIEFTFQKLT

SEQ ID NO: 2670227 - protein, 20 aa, Entamoeba histolytica
CDVSCKKLNIEGEAYNLQLW

SEQ ID NO: 2670228 - protein, 20 aa, Entamoeba histolytica
CDYISFEMIDDMFLSLISIT

SEQ ID NO: 2670229 - protein, 21 aa, Entamoeba histolytica
CEAAMKPGVKWYNIHELSNKL

SEQ ID NO: 2670230 - protein, 26 aa, Entamoeba histolytica
CEAGICCVHIALYLGLPESVDKRKLK

SEQ ID NO: 2670231 - protein, 17 aa, Entamoeba histolytica
CEARGLYERFINKIKQI

SEQ ID NO: 2670232 - protein, 25 aa, Entamoeba histolytica
CEAYECFKSLCGIISILSNVSDISI

SEQ ID NO: 2670233 - protein, 25 aa, Entamoeba histolytica
CECVPLDAALIIALQCNGDLKQTTI

SEQ ID NO: 2670234 - protein, 17 aa, Entamoeba histolytica
CEEDVIVILGYNKMMYQ

SEQ ID NO: 2670235 - protein, 24 aa, Entamoeba histolytica
CEEHGLKLIGFWDFHQFYREWIKF

SEQ ID NO: 2670236 - protein, 18 aa, Entamoeba histolytica
CEEKWAVVRDEIHKVKQL

SEQ ID NO: 2670237 - protein, 18 aa, Entamoeba histolytica
CEEMIFPKGIIKIDDSYI

SEQ ID NO: 2670238 - protein, 25 aa, Entamoeba histolytica
CEEVNYWKNKFVTLQEEVNNHYNAA

SEQ ID NO: 2670239 - protein, 22 aa, Entamoeba histolytica
CEGEWQCSLETIAIVQDPISFP

SEQ ID NO: 2670240 - protein, 17 aa, Entamoeba histolytica
CEGIKTIGIIGKHCKDR

SEQ ID NO: 2670241 - protein, 19 aa, Entamoeba histolytica
CEGYKKWKQELVVYDINEQ

SEQ ID NO: 2670242 - protein, 19 aa, Entamoeba histolytica
CEICQQFGKMTHVFHSIIP

SEQ ID NO: 2670243 - protein, 26 aa, Entamoeba histolytica
CEIHLKRRATILIALLLDYIDTPKGV

SEQ ID NO: 2670244 - protein, 21 aa, Entamoeba histolytica
CEIHPALVMGVLGSIIPFPDH

SEQ ID NO: 2670245 - protein, 21 aa, Entamoeba histolytica
CEILKRLDHPNIIKLKEVYQT

SEQ ID NO: 2670246 - protein, 24 aa, Entamoeba histolytica
CEIPFVHPELIKFTKSITSLYRTL

SEQ ID NO: 2670247 - protein, 18 aa, Entamoeba histolytica
CEIRLKKDIINMVDFSSH

SEQ ID NO: 2670248 - protein, 20 aa, Entamoeba histolytica
CEKATILFENFIKLLNEQNE

SEQ ID NO: 2670249 - protein, 17 aa, Entamoeba histolytica
CEKCKKPIAGRSVQACG

SEQ ID NO: 2670250 - protein, 19 aa, Entamoeba histolytica
CEKDNPFLIKCFDVDSPPE

SEQ ID NO: 2670251 - protein, 19 aa, Entamoeba histolytica
CEKFSEYITFEVPKEKTVD

SEQ ID NO: 2670252 - protein, 18 aa, Entamoeba histolytica
CEKMLKDDLNSFVSVVDW

SEQ ID NO: 2670253 - protein, 20 aa, Entamoeba histolytica
CEKYIERWCEILSTKPKSVI

SEQ ID NO: 2670254 - protein, 17 aa, Entamoeba histolytica
CELASFTKYFTINDIQF

SEQ ID NO: 2670255 - protein, 17 aa, Entamoeba histolytica
CELCGRNAFQKMKADGW

SEQ ID NO: 2670256 - protein, 28 aa, Entamoeba histolytica
CELFIKDLTTRAGYITSYSKRKVIKKDD

SEQ ID NO: 2670257 - protein, 20 aa, Entamoeba histolytica
CELKGVIVMSVPSLTTPKVQ

SEQ ID NO: 2670258 - protein, 17 aa, Entamoeba histolytica
CELKSIHLLSLINKKYH

SEQ ID NO: 2670259 - protein, 18 aa, Entamoeba histolytica
CEMCINNEGLKCVRNNGI

SEQ ID NO: 2670260 - protein, 19 aa, Entamoeba histolytica
CEMGLQFIQMVKKHKESGL

SEQ ID NO: 2670261 - protein, 17 aa, Entamoeba histolytica
CENCKFAVNSEEERDVW

SEQ ID NO: 2670262 - protein, 17 aa, Entamoeba histolytica
CENDVSLIWNCLGTLIT

SEQ ID NO: 2670263 - protein, 29 aa, Entamoeba histolytica
CENVSLLHLIRWGKYVGNYGVEALKEGFN

SEQ ID NO: 2670264 - protein, 22 aa, Entamoeba histolytica
CEPEFIPIMKYVFGNVLIAEDA

SEQ ID NO: 2670265 - protein, 24 aa, Entamoeba histolytica
CEPITKCVRDLLVLDGKEEQGDLD

SEQ ID NO: 2670266 - protein, 20 aa, Entamoeba histolytica
CEQFIPLIMNILMEPLNTQE

SEQ ID NO: 2670267 - protein, 21 aa, Entamoeba histolytica
CEQNGYLGFHLLKQFYKTNYY

SEQ ID NO: 2670268 - protein, 25 aa, Entamoeba histolytica
CERERIIRMGGHVFAGRVNGELAIS

SEQ ID NO: 2670269 - protein, 26 aa, Entamoeba histolytica
CESKKQLTVELVIPIGSFCVLDSIKI

SEQ ID NO: 2670270 - protein, 23 aa, Entamoeba histolytica
CETIKGVGPITAFELIQQYKSIE

SEQ ID NO: 2670271 - protein, 17 aa, Entamoeba histolytica
CETKCRTKDEFLKHIPT

SEQ ID NO: 2670272 - protein, 20 aa, Entamoeba histolytica
CEVDEKPILLSPLYTFLPEE

SEQ ID NO: 2670273 - protein, 18 aa, Entamoeba histolytica
CEVKELIFSKDLKKKSED

SEQ ID NO: 2670274 - protein, 26 aa, Entamoeba histolytica
CEVKSCINLYFDEIFFKSNKEIGATL

SEQ ID NO: 2670275 - protein, 25 aa, Entamoeba histolytica
CEWGIPCDLLLLKEVKKYGLEPPKL

SEQ ID NO: 2670276 - protein, 20 aa, Entamoeba histolytica
CEWYKRGFCKHGKKCKHGHV

SEQ ID NO: 2670277 - protein, 18 aa, Entamoeba histolytica
CEYLKKEKELIINGISYL

SEQ ID NO: 2670278 - protein, 18 aa, Entamoeba histolytica
CFCGCSSLTSIIIPSTVS

SEQ ID NO: 2670279 - protein, 18 aa, Entamoeba histolytica
CFCYDIISINSLVNINVM

SEQ ID NO: 2670280 - protein, 25 aa, Entamoeba histolytica
CFDCRKNYCKHCFKEAHKDQYHSIR

SEQ ID NO: 2670281 - protein, 20 aa, Entamoeba histolytica
CFDCSWDKDCCGCILTDKIL

SEQ ID NO: 2670282 - protein, 19 aa, Entamoeba histolytica
CFDFCLGLQKCKFEEPCQI

SEQ ID NO: 2670283 - protein, 20 aa, Entamoeba histolytica
CFDKEHLRKISAVTVTNIKK

SEQ ID NO: 2670284 - protein, 18 aa, Entamoeba histolytica
CFDMRNGCYYNKKEKSLI

SEQ ID NO: 2670285 - protein, 18 aa, Entamoeba histolytica
CFEEGFHYNEFWDILHGV

SEQ ID NO: 2670286 - protein, 17 aa, Entamoeba histolytica
CFEGELVIPTIEEEKKI

SEQ ID NO: 2670287 - protein, 18 aa, Entamoeba histolytica
CFEIFLNYEHPFELKHSQ

SEQ ID NO: 2670288 - protein, 20 aa, Entamoeba histolytica
CFELPLKRMQEGLTPTTYTD

SEQ ID NO: 2670289 - protein, 19 aa, Entamoeba histolytica
CFEYHNFDTLLCILLLFNT

SEQ ID NO: 2670290 - protein, 25 aa, Entamoeba histolytica
CFGLLSLLHPLSWQGVFLPMVPHSH

SEQ ID NO: 2670291 - protein, 19 aa, Entamoeba histolytica
CFIACSFHPYSKVSYLSLD

SEQ ID NO: 2670292 - protein, 18 aa, Entamoeba histolytica
CFIEGASILYDIREHNVQ

SEQ ID NO: 2670293 - protein, 17 aa, Entamoeba histolytica
CFISTGFGNNEKPKEET

SEQ ID NO: 2670294 - protein, 21 aa, Entamoeba histolytica
CFKPKLILTNRSVFTPVKKDL

SEQ ID NO: 2670295 - protein, 17 aa, Entamoeba histolytica
CFMCANLKGRQEILKEI

SEQ ID NO: 2670296 - protein, 22 aa, Entamoeba histolytica
CFMSCLKLSSIILPTTLCSLPH

SEQ ID NO: 2670297 - protein, 19 aa, Entamoeba histolytica
CFNFGSLLLENQFYKHTIL

SEQ ID NO: 2670298 - protein, 17 aa, Entamoeba histolytica
CFNFKLFEEYEVTFNHI

SEQ ID NO: 2670299 - protein, 20 aa, Entamoeba histolytica
CFNMYYLGVCSCININGLRI

SEQ ID NO: 2670300 - protein, 30 aa, Entamoeba histolytica
CFNQEFICSVYLGRKCILIFKDKTSPLQNP

SEQ ID NO: 2670301 - protein, 35 aa, Entamoeba histolytica
CFQFAFRWFNCFLLREMSLEKGLRLWDTYLSDEDG

SEQ ID NO: 2670302 - protein, 22 aa, Entamoeba histolytica
CFRCSVCKKILNGANFAKNHGV

SEQ ID NO: 2670303 - protein, 18 aa, Entamoeba histolytica
CFSFVRDIIHAPIIKHFF

SEQ ID NO: 2670304 - protein, 21 aa, Entamoeba histolytica
CFSTFVRKGVVFIAAVDTKKK

SEQ ID NO: 2670305 - protein, 31 aa, Entamoeba histolytica
CFSYPGKLQSIIGLYLCREIENKFNKSKYHS

SEQ ID NO: 2670306 - protein, 25 aa, Entamoeba histolytica
CFTSYRYEGELNYVLINAVSGEVYG

SEQ ID NO: 2670307 - protein, 18 aa, Entamoeba histolytica
CFVHESFDPTNFSCIKTI

SEQ ID NO: 2670308 - protein, 18 aa, Entamoeba histolytica
CFWSEHWRPSSYYPKIKI

SEQ ID NO: 2670309 - protein, 17 aa, Entamoeba histolytica
CFYHCGHITEIILSDAI

SEQ ID NO: 2670310 - protein, 24 aa, Entamoeba histolytica
CGAGSRQSINWAKSDGKLEVLRKE

SEQ ID NO: 2670311 - protein, 21 aa, Entamoeba histolytica
CGAHVSFKKKQCFISSQVKHY

SEQ ID NO: 2670312 - protein, 25 aa, Entamoeba histolytica
CGALDTRLSGILEHIDTVLIDESTQ

SEQ ID NO: 2670313 - protein, 19 aa, Entamoeba histolytica
CGANIYPGHGMMFVRNDAK

SEQ ID NO: 2670314 - protein, 17 aa, Entamoeba histolytica
CGAPPPPPPPAFDTGCG

SEQ ID NO: 2670315 - protein, 17 aa, Entamoeba histolytica
CGATCYINSVIQQLHNN

SEQ ID NO: 2670316 - protein, 20 aa, Entamoeba histolytica
CGDCGCVLAGIRHIRPHQYG

SEQ ID NO: 2670317 - protein, 21 aa, Entamoeba histolytica
CGDKGDQLMAVFQSFDSDCSL

SEQ ID NO: 2670318 - protein, 20 aa, Entamoeba histolytica
CGDVPKAVQAFKELIEEYLK

SEQ ID NO: 2670319 - protein, 20 aa, Entamoeba histolytica
CGDYFFNWFNMVLKDTNKTK

SEQ ID NO: 2670320 - protein, 17 aa, Entamoeba histolytica
CGECSKWKMPIPPNNTL

SEQ ID NO: 2670321 - protein, 32 aa, Entamoeba histolytica
CGEICNYFLKTFCPSGLQVLRDFVFDDKSQNE

SEQ ID NO: 2670322 - protein, 17 aa, Entamoeba histolytica
CGETIKKSKAKAHASKC

SEQ ID NO: 2670323 - protein, 29 aa, Entamoeba histolytica
CGFDVNIWVCLPGTLTVSISIDGHMIKGF

SEQ ID NO: 2670324 - protein, 20 aa, Entamoeba histolytica
CGFGESKSSVLSLVVGDFNV

SEQ ID NO: 2670325 - protein, 17 aa, Entamoeba histolytica
CGGDGTVGWVMNELRKA

SEQ ID NO: 2670326 - protein, 20 aa, Entamoeba histolytica
CGGLCPGLNNVIRGLVLNLY

SEQ ID NO: 2670327 - protein, 20 aa, Entamoeba histolytica
CGGLYKIYIADWFAQLNHKM

SEQ ID NO: 2670328 - protein, 19 aa, Entamoeba histolytica
CGGMGGLLEQIRQGKKLKK

SEQ ID NO: 2670329 - protein, 19 aa, Entamoeba histolytica
CGGQSGINRQFVCYVEDGI

SEQ ID NO: 2670330 - protein, 20 aa, Entamoeba histolytica
CGGSLPSFLVNSQAKNVLPK

SEQ ID NO: 2670331 - protein, 23 aa, Entamoeba histolytica
CGHLYCSDCLNIIFDTPGIHYCP

SEQ ID NO: 2670332 - protein, 20 aa, Entamoeba histolytica
CGHPPVQHNCHFGSCPKCTS

SEQ ID NO: 2670333 - protein, 25 aa, Entamoeba histolytica
CGHSFCKECIFEYILTSMKENGKGI

SEQ ID NO: 2670334 - protein, 23 aa, Entamoeba histolytica
CGHSFICCFCSFKRRFFDKDMTC

SEQ ID NO: 2670335 - protein, 18 aa, Entamoeba histolytica
CGIAELKSIVSRFNFKKN

SEQ ID NO: 2670336 - protein, 22 aa, Entamoeba histolytica
CGIDQCWGAHRIGHEITAYYGL

SEQ ID NO: 2670337 - protein, 21 aa, Entamoeba histolytica
CGIDVPEVYVIHSLKHIPKEV

SEQ ID NO: 2670338 - protein, 33 aa, Entamoeba histolytica
CGIKLKYRIIEMIKKFICLFPNDFFVSENSGTL

SEQ ID NO: 2670339 - protein, 18 aa, Entamoeba histolytica
CGINNLIAAQTRIENKTA

SEQ ID NO: 2670340 - protein, 22 aa, Entamoeba histolytica
CGKNRRRALLEYAKEHGYTSIA

SEQ ID NO: 2670341 - protein, 20 aa, Entamoeba histolytica
CGKPIGMSFLEVFGKKWHEG

SEQ ID NO: 2670342 - protein, 20 aa, Entamoeba histolytica
CGKSAYPLERITAGGKDYHN

SEQ ID NO: 2670343 - protein, 25 aa, Entamoeba histolytica
CGKSGCGKTSLAQRFFSNKLQVGEV

SEQ ID NO: 2670344 - protein, 20 aa, Entamoeba histolytica
CGLAHGVAKEPTRINLDVPM

SEQ ID NO: 2670345 - protein, 19 aa, Entamoeba histolytica
CGLARLPYELQKRGNKCYA

SEQ ID NO: 2670346 - protein, 25 aa, Entamoeba histolytica
CGLDKTAFVKYQWTSEIFDPAYFIV

SEQ ID NO: 2670347 - protein, 20 aa, Entamoeba histolytica
CGLTALSRFKNRLHEWPTYC

SEQ ID NO: 2670348 - protein, 17 aa, Entamoeba histolytica
CGMNGPIVTQIRALLLP

SEQ ID NO: 2670349 - protein, 22 aa, Entamoeba histolytica
CGNEVSEFICDLEVFTLKDIID

SEQ ID NO: 2670350 - protein, 25 aa, Entamoeba histolytica
CGNISCWCSVVFSGYVLENSITQLN

SEQ ID NO: 2670351 - protein, 25 aa, Entamoeba histolytica
CGQIICSDCVDSLLLGGSELECPLC

SEQ ID NO: 2670352 - protein, 19 aa, Entamoeba histolytica
CGQKVCMPQVLKILIPYLP

SEQ ID NO: 2670353 - protein, 27 aa, Entamoeba histolytica
CGRITFIDLPCCWEESNHKGSLLNGLN

SEQ ID NO: 2670354 - protein, 20 aa, Entamoeba histolytica
CGRSECIEVFSALNEFSKIG

SEQ ID NO: 2670355 - protein, 18 aa, Entamoeba histolytica
CGRYLYVQFGYQIISNLP

SEQ ID NO: 2670356 - protein, 28 aa, Entamoeba histolytica
CGSATDMALRMGISLTKTKRLRGIGIAL

SEQ ID NO: 2670357 - protein, 21 aa, Entamoeba histolytica
CGSCGPRGFYGGTLEHLKIED

SEQ ID NO: 2670358 - protein, 17 aa, Entamoeba histolytica
CGSFTSLGFTFSPYAEP

SEQ ID NO: 2670359 - protein, 19 aa, Entamoeba histolytica
CGSGNFGMVKVLLEFGKMN

SEQ ID NO: 2670360 - protein, 19 aa, Entamoeba histolytica
CGSLEMKTTFIKFIVHLSY

SEQ ID NO: 2670361 - protein, 18 aa, Entamoeba histolytica
CGSYDILQTIIVGMFPDE

SEQ ID NO: 2670362 - protein, 18 aa, Entamoeba histolytica
CGTPEYLAPEVVEGLDYN

SEQ ID NO: 2670363 - protein, 21 aa, Entamoeba histolytica
CGTPEYLAPEVVVGKDYSEPV

SEQ ID NO: 2670364 - protein, 18 aa, Entamoeba histolytica
CGTTPFWDETMAFYSGYS

SEQ ID NO: 2670365 - protein, 19 aa, Entamoeba histolytica
CGTYFCYNCGKKIDGYEHF

SEQ ID NO: 2670366 - protein, 19 aa, Entamoeba histolytica
CGVEQCWGAHMIGHEITAY

SEQ ID NO: 2670367 - protein, 25 aa, Entamoeba histolytica
CGVNELPLHLILSWYEQKAVAVLLA

SEQ ID NO: 2670368 - protein, 18 aa, Entamoeba histolytica
CGVVPIKKPFRGGFDSCW

SEQ ID NO: 2670369 - protein, 22 aa, Entamoeba histolytica
CGYCSNPEYYSRSYSWLPLLYG

SEQ ID NO: 2670370 - protein, 18 aa, Entamoeba histolytica
CGYTAPTLMGIISDKEIQ

SEQ ID NO: 2670371 - protein, 21 aa, Entamoeba histolytica
CHAYTRLTGENGFDYEEIANK

SEQ ID NO: 2670372 - protein, 18 aa, Entamoeba histolytica
CHCPETFFDSFIKFLPHN

SEQ ID NO: 2670373 - protein, 19 aa, Entamoeba histolytica
CHFICKNFIERLILMNSNE

SEQ ID NO: 2670374 - protein, 17 aa, Entamoeba histolytica
CHGCGKPFELTQAKEIF

SEQ ID NO: 2670375 - protein, 25 aa, Entamoeba histolytica
CHLLECVKYLSPYMIYVSDSENSIK

SEQ ID NO: 2670376 - protein, 17 aa, Entamoeba histolytica
CHLPKQRRTGLFSATMP

SEQ ID NO: 2670377 - protein, 24 aa, Entamoeba histolytica
CHLREELKFYYSLYQTCIPMINKL

SEQ ID NO: 2670378 - protein, 26 aa, Entamoeba histolytica
CHPCMLNKLPKCARCNNPIKGNYVVV

SEQ ID NO: 2670379 - protein, 23 aa, Entamoeba histolytica
CHQEAFLKCPLKIITFNEGNYFR

SEQ ID NO: 2670380 - protein, 17 aa, Entamoeba histolytica
CHSLREFIIPPSVCLME

SEQ ID NO: 2670381 - protein, 19 aa, Entamoeba histolytica
CHSQVPFSLSWFNDEGKFI

SEQ ID NO: 2670382 - protein, 20 aa, Entamoeba histolytica
CHYYDILTIISMINLSCEIH

SEQ ID NO: 2670383 - protein, 25 aa, Entamoeba histolytica
CIAEYEILKNYSLTICKSPSPNELV

SEQ ID NO: 2670384 - protein, 17 aa, Entamoeba histolytica
CIALGSILEKYAQTLRV

SEQ ID NO: 2670385 - protein, 26 aa, Entamoeba histolytica
CIAPQWLMKRLNLVDGDYIDLQTVNL

SEQ ID NO: 2670386 - protein, 23 aa, Entamoeba histolytica
CICGCGYCYKCHKKVKHFSPHIL

SEQ ID NO: 2670387 - protein, 22 aa, Entamoeba histolytica
CICKYIELWPKAWGISVEEMLQ

SEQ ID NO: 2670388 - protein, 19 aa, Entamoeba histolytica
CICTGRCIYYSKKDLIIPS

SEQ ID NO: 2670389 - protein, 20 aa, Entamoeba histolytica
CIDCCCVVYIALTRLYVSTE

SEQ ID NO: 2670390 - protein, 23 aa, Entamoeba histolytica
CIDIKCPMTIPFYEEYINNSNYR

SEQ ID NO: 2670391 - protein, 25 aa, Entamoeba histolytica
CIDILDRIKLSLSIDPTNQTIKRLI

SEQ ID NO: 2670392 - protein, 20 aa, Entamoeba histolytica
CIEEITFKPIFKQINDVKNH

SEQ ID NO: 2670393 - protein, 24 aa, Entamoeba histolytica
CIEIDCPDKVIIKGLDLRNTESKV

SEQ ID NO: 2670394 - protein, 19 aa, Entamoeba histolytica
CIEKLPSTCFLGRLRKFIL

SEQ ID NO: 2670395 - protein, 25 aa, Entamoeba histolytica
CIENKLCRVCGCHHTEHVNESCKYE

SEQ ID NO: 2670396 - protein, 20 aa, Entamoeba histolytica
CIEYKCGCIQRDHRKEDVQC

SEQ ID NO: 2670397 - protein, 18 aa, Entamoeba histolytica
CIEYLKTNPLPILNYKCR

SEQ ID NO: 2670398 - protein, 19 aa, Entamoeba histolytica
CIFYNTRLTITILNSLGIL

SEQ ID NO: 2670399 - protein, 19 aa, Entamoeba histolytica
CIGDLLSLLITYITPYLSF

SEQ ID NO: 2670400 - protein, 20 aa, Entamoeba histolytica
CIGESYAFGPGVEGGVTIDK

SEQ ID NO: 2670401 - protein, 17 aa, Entamoeba histolytica
CIGGICAGVHSILDPYD

SEQ ID NO: 2670402 - protein, 17 aa, Entamoeba histolytica
CIGKDSYIDYLFPSHYK

SEQ ID NO: 2670403 - protein, 17 aa, Entamoeba histolytica
CIHAVSVIHHLLHEDYE

SEQ ID NO: 2670404 - protein, 18 aa, Entamoeba histolytica
CIIASEFSIEPDLIGITV

SEQ ID NO: 2670405 - protein, 17 aa, Entamoeba histolytica
CIIDCTISLNKKPGILT

SEQ ID NO: 2670406 - protein, 18 aa, Entamoeba histolytica
CIIIVSFLVLQSTTIDQS

SEQ ID NO: 2670407 - protein, 24 aa, Entamoeba histolytica
CIIKCIKHYPKMFDDFLKIHASNV

SEQ ID NO: 2670408 - protein, 17 aa, Entamoeba histolytica
CIIQNILACCVYSGDLC

SEQ ID NO: 2670409 - protein, 19 aa, Entamoeba histolytica
CIISLQPQLCCFGHCHYST

SEQ ID NO: 2670410 - protein, 22 aa, Entamoeba histolytica
CIKCNKYFCNGPVYNSSNCQVI

SEQ ID NO: 2670411 - protein, 19 aa, Entamoeba histolytica
CIKELQLLKVNPVVVQNTM

SEQ ID NO: 2670412 - protein, 23 aa, Entamoeba histolytica
CIKHIKTWVLHDIFEYKNELRLR

SEQ ID NO: 2670413 - protein, 23 aa, Entamoeba histolytica
CIKKEGLMKAVFVSCSLIKFGVS

SEQ ID NO: 2670414 - protein, 18 aa, Entamoeba histolytica
CIKVIEFDDPITLVDGWR

SEQ ID NO: 2670415 - protein, 19 aa, Entamoeba histolytica
CILILPGHEHYVMSAFFHP

SEQ ID NO: 2670416 - protein, 22 aa, Entamoeba histolytica
CIMACCGNDTIGCFIRKPIEST

SEQ ID NO: 2670417 - protein, 18 aa, Entamoeba histolytica
CIMGESFTTNFVQADQQG

SEQ ID NO: 2670418 - protein, 17 aa, Entamoeba histolytica
CIMLFKKMHHQVNQSIE

SEQ ID NO: 2670419 - protein, 31 aa, Entamoeba histolytica
CINCGGCMRACPFGAILPRSNLIDVLKILPT

SEQ ID NO: 2670420 - protein, 28 aa, Entamoeba histolytica
CIPTRWRPINEFCTYILFFLKAVRLVPE

SEQ ID NO: 2670421 - protein, 19 aa, Entamoeba histolytica
CIQDITWLPGGLRMMACSV

SEQ ID NO: 2670422 - protein, 19 aa, Entamoeba histolytica
CIQKVRIGKTIIRINTNLT

SEQ ID NO: 2670423 - protein, 17 aa, Entamoeba histolytica
CIQSAVQHAEFLRSNPL

SEQ ID NO: 2670424 - protein, 26 aa, Entamoeba histolytica
CIRQYELFPHFGLILIHGGSGVGKTT

SEQ ID NO: 2670425 - protein, 27 aa, Entamoeba histolytica
CISDFSRRLCTGLSLDWNTSFSLYSFD

SEQ ID NO: 2670426 - protein, 17 aa, Entamoeba histolytica
CISEIFYSSPACVHLLI

SEQ ID NO: 2670427 - protein, 22 aa, Entamoeba histolytica
CISGDLKLLVNFFKNYSYNGTN

SEQ ID NO: 2670428 - protein, 25 aa, Entamoeba histolytica
CISTFRGIPDWDWFYQFNAPPEITD

SEQ ID NO: 2670429 - protein, 27 aa, Entamoeba histolytica
CITPAIMFCDSIGFLSANFYAKNLFDE

SEQ ID NO: 2670430 - protein, 19 aa, Entamoeba histolytica
CITSCPCYFTCYYFTESIT

SEQ ID NO: 2670431 - protein, 25 aa, Entamoeba histolytica
CIVEKKVSEWFARSISSALISLSTH

SEQ ID NO: 2670432 - protein, 18 aa, Entamoeba histolytica
CIVERRFVSINNYILSLS

SEQ ID NO: 2670433 - protein, 25 aa, Entamoeba histolytica
CIVSFKLEKGVVMKIQYQEEVEENS

SEQ ID NO: 2670434 - protein, 24 aa, Entamoeba histolytica
CIYCGKRYTSLWSLESDCGGHDHS

SEQ ID NO: 2670435 - protein, 18 aa, Entamoeba histolytica
CIYQCAILQRILDKFPDF

SEQ ID NO: 2670436 - protein, 26 aa, Entamoeba histolytica
CIYTSIKSFHWQFLITKSKRSSQRML

SEQ ID NO: 2670437 - protein, 21 aa, Entamoeba histolytica
CKAFNRYLFNLIDTKKCGKID

SEQ ID NO: 2670438 - protein, 19 aa, Entamoeba histolytica
CKAMMLCGKVDGPIKNGEI

SEQ ID NO: 2670439 - protein, 19 aa, Entamoeba histolytica
CKARCQAFRAEVIKRTIKN

SEQ ID NO: 2670440 - protein, 17 aa, Entamoeba histolytica
CKCASLAGCTSKIRDDK

SEQ ID NO: 2670441 - protein, 18 aa, Entamoeba histolytica
CKCKMYFDEHNGISEKTA

SEQ ID NO: 2670442 - protein, 18 aa, Entamoeba histolytica
CKDFCSFEDKSGCCEYYF

SEQ ID NO: 2670443 - protein, 18 aa, Entamoeba histolytica
CKDFHSVNMMTYKEELTN

SEQ ID NO: 2670444 - protein, 25 aa, Entamoeba histolytica
CKDIIRWLMCVDGKRVCKLVIEEYS

SEQ ID NO: 2670445 - protein, 19 aa, Entamoeba histolytica
CKDLQKALVEELYKSDKIN

SEQ ID NO: 2670446 - protein, 22 aa, Entamoeba histolytica
CKDMFRELMKRDGIGEWTNYTV

SEQ ID NO: 2670447 - protein, 17 aa, Entamoeba histolytica
CKECFSLLHNDMDIGFE

SEQ ID NO: 2670448 - protein, 18 aa, Entamoeba histolytica
CKEELVLKRMNDIRFRRQ

SEQ ID NO: 2670449 - protein, 18 aa, Entamoeba histolytica
CKEELVLKRMNDIRFRTD

SEQ ID NO: 2670450 - protein, 18 aa, Entamoeba histolytica
CKEELVLKRMNDIRFRTN

SEQ ID NO: 2670451 - protein, 19 aa, Entamoeba histolytica
CKEELVLKRMNDIRFRTNA

SEQ ID NO: 2670452 - protein, 18 aa, Entamoeba histolytica
CKEFLMKEISCVEMCNLK

SEQ ID NO: 2670453 - protein, 17 aa, Entamoeba histolytica
CKEGLTFFEDIPKTSVF

SEQ ID NO: 2670454 - protein, 19 aa, Entamoeba histolytica
CKEIYSFLSNLLVKSNQLN

SEQ ID NO: 2670455 - protein, 19 aa, Entamoeba histolytica
CKELFKHAKDILLSDKPTP

SEQ ID NO: 2670456 - protein, 20 aa, Entamoeba histolytica
CKEMKVCGALGPLTSGNKKT

SEQ ID NO: 2670457 - protein, 18 aa, Entamoeba histolytica
CKENIGLPLQDAEQEYID

SEQ ID NO: 2670458 - protein, 19 aa, Entamoeba histolytica
CKEYMKPKYNEVLQMFLNV

SEQ ID NO: 2670459 - protein, 22 aa, Entamoeba histolytica
CKFCPKCEAGLLMTDNKVKAQC

SEQ ID NO: 2670460 - protein, 17 aa, Entamoeba histolytica
CKGIISGIGKIEHVPFN

SEQ ID NO: 2670461 - protein, 18 aa, Entamoeba histolytica
CKGNISVTILSLDSFIET

SEQ ID NO: 2670462 - protein, 19 aa, Entamoeba histolytica
CKHPNIVSFFGSYLEEGYV

SEQ ID NO: 2670463 - protein, 27 aa, Entamoeba histolytica
CKIADACLRSSAAVGYYPPYQGYADGG

SEQ ID NO: 2670464 - protein, 22 aa, Entamoeba histolytica
CKIELMSFYLITPIQRIPRYEL

SEQ ID NO: 2670465 - protein, 20 aa, Entamoeba histolytica
CKIERLPIILPLVQEDVLSM

SEQ ID NO: 2670466 - protein, 27 aa, Entamoeba histolytica
CKIGDACLRSAAAVGYYPPYQGYADGG

SEQ ID NO: 2670467 - protein, 19 aa, Entamoeba histolytica
CKIINRVGGTLTVQMKTKT

SEQ ID NO: 2670468 - protein, 24 aa, Entamoeba histolytica
CKILKNVLMTYSFFNMRVGYGQGM

SEQ ID NO: 2670469 - protein, 25 aa, Entamoeba histolytica
CKIMIKGCDLVESRVHCKLLIRYAT

SEQ ID NO: 2670470 - protein, 21 aa, Entamoeba histolytica
CKIVSDWYCIYRWASTVEIVS

SEQ ID NO: 2670471 - protein, 19 aa, Entamoeba histolytica
CKKGALFFSTLKRAFFLQE

SEQ ID NO: 2670472 - protein, 19 aa, Entamoeba histolytica
CKKIRFLLKRNEEGCDLSE

SEQ ID NO: 2670473 - protein, 19 aa, Entamoeba histolytica
CKKNTALLLDCKTHQTINE

SEQ ID NO: 2670474 - protein, 19 aa, Entamoeba histolytica
CKKSYFAMKEINEIQQRYD

SEQ ID NO: 2670475 - protein, 18 aa, Entamoeba histolytica
CKLAEKLAKEPNERLAKE

SEQ ID NO: 2670476 - protein, 19 aa, Entamoeba histolytica
CKLCDRPFDVYKWRMEESN

SEQ ID NO: 2670477 - protein, 17 aa, Entamoeba histolytica
CKLKEKINNTIVFKQSI

SEQ ID NO: 2670478 - protein, 27 aa, Entamoeba histolytica
CKLKKKWKLRFVIVNGSTLYYYKTELD

SEQ ID NO: 2670479 - protein, 20 aa, Entamoeba histolytica
CKLSEIWINSQTFQWVASKF

SEQ ID NO: 2670480 - protein, 19 aa, Entamoeba histolytica
CKLTNPLHFKRYYHGKDIV

SEQ ID NO: 2670481 - protein, 21 aa, Entamoeba histolytica
CKNCGSINHWTYQCTVEIEEK

SEQ ID NO: 2670482 - protein, 20 aa, Entamoeba histolytica
CKNHKEVYCSQNDRCSELMK

SEQ ID NO: 2670483 - protein, 17 aa, Entamoeba histolytica
CKNILCWEETGNIDFID

SEQ ID NO: 2670484 - protein, 28 aa, Entamoeba histolytica
CKNLHKHIWRCTGPCRNKPPFYGYVKRS

SEQ ID NO: 2670485 - protein, 18 aa, Entamoeba histolytica
CKQIKFDLQKIIETIGSR

SEQ ID NO: 2670486 - protein, 17 aa, Entamoeba histolytica
CKQQCTHLLSYIKEVDD

SEQ ID NO: 2670487 - protein, 23 aa, Entamoeba histolytica
CKQYRSTLKMIIYLESLIDIDQL

SEQ ID NO: 2670488 - protein, 21 aa, Entamoeba histolytica
CKRKFGIFCFKYHCERCGFVV

SEQ ID NO: 2670489 - protein, 18 aa, Entamoeba histolytica
CKRNHKPLILSNKHSPNN

SEQ ID NO: 2670490 - protein, 19 aa, Entamoeba histolytica
CKRSYSVSSNGGRTPRSSK

SEQ ID NO: 2670491 - protein, 17 aa, Entamoeba histolytica
CKSDLGCFGLFQSNTIK

SEQ ID NO: 2670492 - protein, 17 aa, Entamoeba histolytica
CKSKFELFLPLSNQISI

SEQ ID NO: 2670493 - protein, 19 aa, Entamoeba histolytica
CKSLARIISRSKRLVVLTG

SEQ ID NO: 2670494 - protein, 25 aa, Entamoeba histolytica
CKTAKYLNETIICYKEMNVNINELI

SEQ ID NO: 2670495 - protein, 17 aa, Entamoeba histolytica
CKTFFIKNEQNVWTTED

SEQ ID NO: 2670496 - protein, 25 aa, Entamoeba histolytica
CKTGDFKPSPGFKMPCKEILHGVGP

SEQ ID NO: 2670497 - protein, 17 aa, Entamoeba histolytica
CKTGLAIHKSSMKLEFA

SEQ ID NO: 2670498 - protein, 24 aa, Entamoeba histolytica
CKTKSCFLPSSLVSLQILGMKSME

SEQ ID NO: 2670499 - protein, 17 aa, Entamoeba histolytica
CKTLLPVIPSTCLSWDI

SEQ ID NO: 2670500 - protein, 20 aa, Entamoeba histolytica
CKTNELYFCMHELDTSELPK

SEQ ID NO: 2670501 - protein, 18 aa, Entamoeba histolytica
CKTPQYSVFLTLRNPSVI

SEQ ID NO: 2670502 - protein, 19 aa, Entamoeba histolytica
CKTSGIPPEHITALTRLDQ

SEQ ID NO: 2670503 - protein, 17 aa, Entamoeba histolytica
CKVCVNLAEFILRQARN

SEQ ID NO: 2670504 - protein, 23 aa, Entamoeba histolytica
CKVLDSLRKPLFLTFKNEDPEGD

SEQ ID NO: 2670505 - protein, 18 aa, Entamoeba histolytica
CKWLNSFKELLTQFFNIP

SEQ ID NO: 2670506 - protein, 23 aa, Entamoeba histolytica
CKYAPEFPGDYTVDIKLNGDKVG

SEQ ID NO: 2670507 - protein, 18 aa, Entamoeba histolytica
CKYFYSIQSISVYPINDT

SEQ ID NO: 2670508 - protein, 19 aa, Entamoeba histolytica
CKYQRVAIKVLKQQNLSKE

SEQ ID NO: 2670509 - protein, 31 aa, Entamoeba histolytica
CLDDKELNQMLSLKRLAPYDERKITQAEKER

SEQ ID NO: 2670510 - protein, 19 aa, Entamoeba histolytica
CLDKEIYLSNVFIIIPVEE

SEQ ID NO: 2670511 - protein, 18 aa, Entamoeba histolytica
CLDSFSLFSKIHGRKNIH

SEQ ID NO: 2670512 - protein, 25 aa, Entamoeba histolytica
CLDSLCVYDSYFIFYERIVSLMPKI

SEQ ID NO: 2670513 - protein, 18 aa, Entamoeba histolytica
CLEALQLIFKNLVNGYNG

SEQ ID NO: 2670514 - protein, 20 aa, Entamoeba histolytica
CLEITKSTIARMFTDGKLLG

SEQ ID NO: 2670515 - protein, 24 aa, Entamoeba histolytica
CLENKFKNCPSITEIVREENQRYI

SEQ ID NO: 2670516 - protein, 18 aa, Entamoeba histolytica
CLESLKKLQLEYLDLYII

SEQ ID NO: 2670517 - protein, 19 aa, Entamoeba histolytica
CLESLKKLQLEYLDLYIIH

SEQ ID NO: 2670518 - protein, 21 aa, Entamoeba histolytica
CLFLIATSSLYCFDINTKQFV

SEQ ID NO: 2670519 - protein, 26 aa, Entamoeba histolytica
CLFLLCVSFKGFIGVSGRICKVFFFG

SEQ ID NO: 2670520 - protein, 23 aa, Entamoeba histolytica
CLFPALRSPRLVLLGDIQQLKPV

SEQ ID NO: 2670521 - protein, 25 aa, Entamoeba histolytica
CLFSLGLCYDQNCIFDFDEQHVGWP

SEQ ID NO: 2670522 - protein, 19 aa, Entamoeba histolytica
CLFVKNSSIFEFSKNVDGC

SEQ ID NO: 2670523 - protein, 20 aa, Entamoeba histolytica
CLFVKNSSIFEFSKNVDGCN

SEQ ID NO: 2670524 - protein, 19 aa, Entamoeba histolytica
CLFYKCYHLTKIVLPEVSC

SEQ ID NO: 2670525 - protein, 18 aa, Entamoeba histolytica
CLGGTMIRRMSNLAHSLK

SEQ ID NO: 2670526 - protein, 24 aa, Entamoeba histolytica
CLGTNKEKIVCMGVYSEGQYGIPK

SEQ ID NO: 2670527 - protein, 18 aa, Entamoeba histolytica
CLHSVLTLGYIISNKTSA

SEQ ID NO: 2670528 - protein, 19 aa, Entamoeba histolytica
CLIDELGPRFILKLRSIQR

SEQ ID NO: 2670529 - protein, 20 aa, Entamoeba histolytica
CLIELELLKKEIGSYQKGIR

SEQ ID NO: 2670530 - protein, 19 aa, Entamoeba histolytica
CLINKLWFNKLLDIDIKNT

SEQ ID NO: 2670531 - protein, 25 aa, Entamoeba histolytica
CLIREFPINLSLILWDGYISEPNGN

SEQ ID NO: 2670532 - protein, 25 aa, Entamoeba histolytica
CLKCNKTCHYPCGIAGDVKDGCACI

SEQ ID NO: 2670533 - protein, 26 aa, Entamoeba histolytica
CLKCNKTCHYPCGIAGDVKDGCACID

SEQ ID NO: 2670534 - protein, 19 aa, Entamoeba histolytica
CLKEITVDFFNVFNSSYLN

SEQ ID NO: 2670535 - protein, 22 aa, Entamoeba histolytica
CLKGCNVKPVLDKGPNVMTISR

SEQ ID NO: 2670536 - protein, 29 aa, Entamoeba histolytica
CLKHFSVFTKPHWKKILLDTFNHCTNIET

SEQ ID NO: 2670537 - protein, 19 aa, Entamoeba histolytica
CLKHRRPLNNMSILDFVSK

SEQ ID NO: 2670538 - protein, 18 aa, Entamoeba histolytica
CLKNIIFINEFEVEQPSK

SEQ ID NO: 2670539 - protein, 21 aa, Entamoeba histolytica
CLKTIHCLLRNPNIVNVEGES

SEQ ID NO: 2670540 - protein, 19 aa, Entamoeba histolytica
CLLENRKVIGISFHNQPSI

SEQ ID NO: 2670541 - protein, 24 aa, Entamoeba histolytica
CLLFFTDKGFIFGVCHKRIELNIT

SEQ ID NO: 2670542 - protein, 20 aa, Entamoeba histolytica
CLLIIIECYNKPVALQYSIE

SEQ ID NO: 2670543 - protein, 19 aa, Entamoeba histolytica
CLLLHGGIDQIDRQNTIQE

SEQ ID NO: 2670544 - protein, 24 aa, Entamoeba histolytica
CLLLKKRFVPKMKDILETEDQVSH

SEQ ID NO: 2670545 - protein, 19 aa, Entamoeba histolytica
CLLYALKIKYPEHIYLIRG

SEQ ID NO: 2670546 - protein, 18 aa, Entamoeba histolytica
CLLYLFKIQFPNQFFLLR

SEQ ID NO: 2670547 - protein, 20 aa, Entamoeba histolytica
CLMKPLPSYKDRVFTTNEVG

SEQ ID NO: 2670548 - protein, 26 aa, Entamoeba histolytica
CLNFSNPNCEEAFSLFQQRSANMNAK

SEQ ID NO: 2670549 - protein, 17 aa, Entamoeba histolytica
CLNTWVGGKLYLTNYRL

SEQ ID NO: 2670550 - protein, 28 aa, Entamoeba histolytica
CLNYTNDWIDGRMIKLILGPEDPLGKMK

SEQ ID NO: 2670551 - protein, 21 aa, Entamoeba histolytica
CLPFDDFCLLAILQSTPPLET

SEQ ID NO: 2670552 - protein, 26 aa, Entamoeba histolytica
CLPIFELYGIFLLQLFCSNDFLIQTL

SEQ ID NO: 2670553 - protein, 18 aa, Entamoeba histolytica
CLQTLEILHRVSPTVFHH

SEQ ID NO: 2670554 - protein, 20 aa, Entamoeba histolytica
CLSGSEWYSIQALRAVNQAV

SEQ ID NO: 2670555 - protein, 24 aa, Entamoeba histolytica
CLSKPENKALHYARKAVEIAEDMA

SEQ ID NO: 2670556 - protein, 21 aa, Entamoeba histolytica
CLSTLRLDKDWSPVSTLNHVV

SEQ ID NO: 2670557 - protein, 18 aa, Entamoeba histolytica
CLTSLEICQKAKSYTLPN

SEQ ID NO: 2670558 - protein, 19 aa, Entamoeba histolytica
CLVDLHFLMIQEILNVEKV

SEQ ID NO: 2670559 - protein, 27 aa, Entamoeba histolytica
CLVMVGGKPIIQWQLEVLEKLNVKELE

SEQ ID NO: 2670560 - protein, 20 aa, Entamoeba histolytica
CLVTRSPEHCIIKFVENNDI

SEQ ID NO: 2670561 - protein, 17 aa, Entamoeba histolytica
CLVVLGIDGHSYVKKVL

SEQ ID NO: 2670562 - protein, 17 aa, Entamoeba histolytica
CLYDETISYTVINNLVM

SEQ ID NO: 2670563 - protein, 18 aa, Entamoeba histolytica
CLYKEVLEKRLQDFIEIY

SEQ ID NO: 2670564 - protein, 22 aa, Entamoeba histolytica
CLYPSQTGVIIAFDLAYNTYSA

SEQ ID NO: 2670565 - protein, 20 aa, Entamoeba histolytica
CLYVKDTRVYIGFKTGNFTC

SEQ ID NO: 2670566 - protein, 17 aa, Entamoeba histolytica
CMDAKYPYITFHTPNKV

SEQ ID NO: 2670567 - protein, 18 aa, Entamoeba histolytica
CMDKSRLDYIFQLKRPNE

SEQ ID NO: 2670568 - protein, 21 aa, Entamoeba histolytica
CMECIKQYGDCLNNISSTSTN

SEQ ID NO: 2670569 - protein, 21 aa, Entamoeba histolytica
CMIEIFKKLHSSWVGVQLLLN

SEQ ID NO: 2670570 - protein, 25 aa, Entamoeba histolytica
CMKCKVCNCNLSISSYKLLKGTNEI

SEQ ID NO: 2670571 - protein, 17 aa, Entamoeba histolytica
CMLGELGVGKTSIVLRY

SEQ ID NO: 2670572 - protein, 17 aa, Entamoeba histolytica
CMRLCKHPNLVEYKDFF

SEQ ID NO: 2670573 - protein, 30 aa, Entamoeba histolytica; identical to SEQ ID NO: 2476164

SEQ ID NO: 2670574 - protein, 24 aa, Entamoeba histolytica
CNCLYRGLYPYTIVQFDYFFIAFD

SEQ ID NO: 2670575 - protein, 24 aa, Entamoeba histolytica
CNCWMEEDNLLGLCLCTDETKIIL

SEQ ID NO: 2670576 - protein, 27 aa, Entamoeba histolytica
CNDRIKEMIKRGASPYQYYDSWDQLTV

SEQ ID NO: 2670577 - protein, 19 aa, Entamoeba histolytica
CNECIKKIDQTIIFQTNTN

SEQ ID NO: 2670578 - protein, 19 aa, Entamoeba histolytica
CNEQLKILLNTSSMDVIDF

SEQ ID NO: 2670579 - protein, 19 aa, Entamoeba histolytica
CNFDYRTNRILNVVDQLLE

SEQ ID NO: 2670580 - protein, 18 aa, Entamoeba histolytica
CNFTCQFCQNWDISQCAL

SEQ ID NO: 2670581 - protein, 25 aa, Entamoeba histolytica
CNFVSLVSGFCCSSFNDTKLVCGTT

SEQ ID NO: 2670582 - protein, 31 aa, Entamoeba histolytica
CNGFLPKKEMYYCLCLADFLVKQCPEFRPQM

SEQ ID NO: 2670583 - protein, 20 aa, Entamoeba histolytica
CNGKEPYIKHGILGADILRE

SEQ ID NO: 2670584 - protein, 20 aa, Entamoeba histolytica
CNGKNVLKCNDCNRHCHEFC

SEQ ID NO: 2670585 - protein, 19 aa, Entamoeba histolytica
CNGLVLWLDCDREGENICF

SEQ ID NO: 2670586 - protein, 25 aa, Entamoeba histolytica
CNGPIRWYCCGPTVYDDSHLGHART

SEQ ID NO: 2670587 - protein, 20 aa, Entamoeba histolytica
CNGYLKILMERKFIPEFKQT

SEQ ID NO: 2670588 - protein, 17 aa, Entamoeba histolytica
CNHKEMFEHAIKGGFAV

SEQ ID NO: 2670589 - protein, 19 aa, Entamoeba histolytica
CNHKEMFEHAIKGGFAVPG

SEQ ID NO: 2670590 - protein, 31 aa, Entamoeba histolytica
CNHMTCPRCHGEWCWMCRGDWKTHGTKTGGF

SEQ ID NO: 2670591 - protein, 17 aa, Entamoeba histolytica
CNHVIKRLQSIKHVSSL

SEQ ID NO: 2670592 - protein, 17 aa, Entamoeba histolytica
CNIKDVILDTTTERILK

SEQ ID NO: 2670593 - protein, 26 aa, Entamoeba histolytica
CNILPIKRMLSPLIRVEVSKALSLSG

SEQ ID NO: 2670594 - protein, 22 aa, Entamoeba histolytica
CNINGTFYHKSCMKCKVCNCNL

SEQ ID NO: 2670595 - protein, 19 aa, Entamoeba histolytica
CNIPFTIATSSDWGNVQVF

SEQ ID NO: 2670596 - protein, 18 aa, Entamoeba histolytica
CNKCHQILEVSSWDLNDK

SEQ ID NO: 2670597 - protein, 20 aa, Entamoeba histolytica
CNKEECNVFELCGGRCMYAN

SEQ ID NO: 2670598 - protein, 28 aa, Entamoeba histolytica
CNKILDIKWVGNVICCIGGLYDGKEYKD

SEQ ID NO: 2670599 - protein, 18 aa, Entamoeba histolytica
CNLIMTWPAFSNKAQFPD

SEQ ID NO: 2670600 - protein, 17 aa, Entamoeba histolytica
CNLPTGVAMITVDKTAQ

SEQ ID NO: 2670601 - protein, 17 aa, Entamoeba histolytica
CNLSTNEGFLFPMSDSF

SEQ ID NO: 2670602 - protein, 18 aa, Entamoeba histolytica
CNNSPLQKRLMPFDYEKI

SEQ ID NO: 2670603 - protein, 19 aa, Entamoeba histolytica
CNPLVEFPVCITKCQSLKI

SEQ ID NO: 2670604 - protein, 19 aa, Entamoeba histolytica
CNQLRRLGSSLDWSREVFT

SEQ ID NO: 2670605 - protein, 19 aa, Entamoeba histolytica
CNQSVRWAIENAKEHDKES

SEQ ID NO: 2670606 - protein, 18 aa, Entamoeba histolytica
CNRNWCHCIILSNPIQLY

SEQ ID NO: 2670607 - protein, 24 aa, Entamoeba histolytica
CNRTIEFVEQLGFTIEQRGTRSTK

SEQ ID NO: 2670608 - protein, 24 aa, Entamoeba histolytica
CNSCNEKEIWICLHCLHIGCSRYC

SEQ ID NO: 2670609 - protein, 21 aa, Entamoeba histolytica
CNSIKEFYIPPLAKVVEVSHC

SEQ ID NO: 2670610 - protein, 21 aa, Entamoeba histolytica
CNSIPFATKVMINFKEPPPQD

SEQ ID NO: 2670611 - protein, 19 aa, Entamoeba histolytica
CNSISWIILSFISPNNIYG

SEQ ID NO: 2670612 - protein, 19 aa, Entamoeba histolytica
CNSLKSGTILCYLAKTIDD

SEQ ID NO: 2670613 - protein, 27 aa, Entamoeba histolytica
CNSNFSFYWDLLKICQRKIKESQLPFE

SEQ ID NO: 2670614 - protein, 31 aa, Entamoeba histolytica
CNTAKFKGIPCFWGRIIKRLPYFTPNTKEYP

SEQ ID NO: 2670615 - protein, 18 aa, Entamoeba histolytica
CNTFNLILLKANIIASLL

SEQ ID NO: 2670616 - protein, 17 aa, Entamoeba histolytica
CNVFDSFDNLKEGMISV

SEQ ID NO: 2670617 - protein, 18 aa, Entamoeba histolytica
CNVGVCYGDVSVGRIFLG

SEQ ID NO: 2670618 - protein, 19 aa, Entamoeba histolytica
CNVLKKYTFDYEVYSSLMQ

SEQ ID NO: 2670619 - protein, 22 aa, Entamoeba histolytica
CNWTEDELINWLGEGLEEEDKI

SEQ ID NO: 2670620 - protein, 17 aa, Entamoeba histolytica
CNYKITITFNINQNTQN

SEQ ID NO: 2670621 - protein, 26 aa, Entamoeba histolytica
CPADYVCVGVCALFNLAITPSVRTLL

SEQ ID NO: 2670622 - protein, 27 aa, Entamoeba histolytica
CPAPHKCPVCNALIYSPFTICDIVIQP

SEQ ID NO: 2670623 - protein, 21 aa, Entamoeba histolytica
CPDCTTPYCCSLHCLYDREEH

SEQ ID NO: 2670624 - protein, 22 aa, Entamoeba histolytica
CPECISEPALTLFLNCISNKNE

SEQ ID NO: 2670625 - protein, 19 aa, Entamoeba histolytica
CPECKSLDTELIKENRINF

SEQ ID NO: 2670626 - protein, 19 aa, Entamoeba histolytica
CPEGYRVVNNIGEDAGQTV

SEQ ID NO: 2670627 - protein, 19 aa, Entamoeba histolytica
CPELIDLYSTSAWQDCFIT

SEQ ID NO: 2670628 - protein, 19 aa, Entamoeba histolytica
CPENLKLGNFEIQIDKPQP

SEQ ID NO: 2670629 - protein, 28 aa, Entamoeba histolytica
CPEWFLHHKHMFVYTLAGKPAFSRYGND

SEQ ID NO: 2670630 - protein, 22 aa, Entamoeba histolytica
CPFNRLPPKESYGFVDCGFVME

SEQ ID NO: 2670631 - protein, 17 aa, Entamoeba histolytica
CPGHCVMFASKKRSYRE

SEQ ID NO: 2670632 - protein, 17 aa, Entamoeba histolytica
CPGREFVMETTVVLTWE

SEQ ID NO: 2670633 - protein, 21 aa, Entamoeba histolytica
CPGYKIEKGTILKIIVPYGTY

SEQ ID NO: 2670634 - protein, 21 aa, Entamoeba histolytica
CPHCLTKLVSVDNCYCISMDE

SEQ ID NO: 2670635 - protein, 25 aa, Entamoeba histolytica
CPHLEDWTSICICVIHILDDLFTSS

SEQ ID NO: 2670636 - protein, 20 aa, Entamoeba histolytica
CPICRTRFSKKLRHKKEIDL

SEQ ID NO: 2670637 - protein, 19 aa, Entamoeba histolytica
CPIDCRRDLYKNIILSGGS

SEQ ID NO: 2670638 - protein, 19 aa, Entamoeba histolytica
CPITCVFDLLFVNKKIKKA

SEQ ID NO: 2670639 - protein, 20 aa, Entamoeba histolytica
CPKCGRRKCRHCDAYGISVE

SEQ ID NO: 2670640 - protein, 19 aa, Entamoeba histolytica
CPKKHKFTIRSLKQKAKIT

SEQ ID NO: 2670641 - protein, 23 aa, Entamoeba histolytica
CPKNELRFGYFKNEDIAISVYGN

SEQ ID NO: 2670642 - protein, 20 aa, Entamoeba histolytica
CPLCRHKNPIVIYTKKPMLF

SEQ ID NO: 2670643 - protein, 24 aa, Entamoeba histolytica
CPLELKSACGAILYASPYFPDHTE

SEQ ID NO: 2670644 - protein, 17 aa, Entamoeba histolytica
CPLGPDGKRDWECIEAL

SEQ ID NO: 2670645 - protein, 18 aa, Entamoeba histolytica
CPLKVEIDDCVFIHNDPP

SEQ ID NO: 2670646 - protein, 20 aa, Entamoeba histolytica
CPLLTSVELRMCSGVTDNGI

SEQ ID NO: 2670647 - protein, 24 aa, Entamoeba histolytica
CPLLTTVELRMCVNVTDSGIQMLL

SEQ ID NO: 2670648 - protein, 17 aa, Entamoeba histolytica
CPMEMTFAEVILVLKAN

SEQ ID NO: 2670649 - protein, 43 aa, Entamoeba histolytica
CPNYIEYSTWLNIIPLKMRCNEVFGVPLSVGVKKSGWRFPLPI

SEQ ID NO: 2670650 - protein, 17 aa, Entamoeba histolytica
CPPIYGHYIVKTAIVLV

SEQ ID NO: 2670651 - protein, 18 aa, Entamoeba histolytica
CPQCHKHMKYYCYNCRKQ

SEQ ID NO: 2670652 - protein, 20 aa, Entamoeba histolytica
CPRCHQGVCSVKCYQTHNNG

SEQ ID NO: 2670653 - protein, 19 aa, Entamoeba histolytica
CPSDLCGMTSLRSLDLSYN

SEQ ID NO: 2670654 - protein, 18 aa, Entamoeba histolytica
CPSNLQVLNLSSYTKNFK

SEQ ID NO: 2670655 - protein, 20 aa, Entamoeba histolytica
CPTCSLKFNLPQNASYSQQT

SEQ ID NO: 2670656 - protein, 21 aa, Entamoeba histolytica
CPTVRSLLVVLIFKIMSSGYN

SEQ ID NO: 2670657 - protein, 19 aa, Entamoeba histolytica
CPVDTCGRAIHYFDTSRNE

SEQ ID NO: 2670658 - protein, 19 aa, Entamoeba histolytica
CPVLGKTALPYSLTTLNVM

SEQ ID NO: 2670659 - protein, 18 aa, Entamoeba histolytica
CPVVKNIINSVMLQLGEM

SEQ ID NO: 2670660 - protein, 21 aa, Entamoeba histolytica
CQCRGRYDAILKFLKVTTKPS

SEQ ID NO: 2670661 - protein, 22 aa, Entamoeba histolytica
CQEKLCFRFVNKTKLYREVTPE

SEQ ID NO: 2670662 - protein, 19 aa, Entamoeba histolytica
CQFAVSFQGGVVMLIEPRT

SEQ ID NO: 2670663 - protein, 23 aa, Entamoeba histolytica
CQHLSVLRLRKLEAITKDELINW

SEQ ID NO: 2670664 - protein, 19 aa, Entamoeba histolytica
CQHRIPLILNKFPQQKISE

SEQ ID NO: 2670665 - protein, 19 aa, Entamoeba histolytica
CQIAICVKGSVSISVAKKF

SEQ ID NO: 2670666 - protein, 19 aa, Entamoeba histolytica
CQINGAIPFRQESFIEEME

SEQ ID NO: 2670667 - protein, 17 aa, Entamoeba histolytica
CQISRKFYDNNIKSLTN

SEQ ID NO: 2670668 - protein, 18 aa, Entamoeba histolytica
CQIYHQFKAFVLPPSNAF

SEQ ID NO: 2670669 - protein, 18 aa, Entamoeba histolytica
CQKFMMIYQLNSGELFGT

SEQ ID NO: 2670670 - protein, 31 aa, Entamoeba histolytica
CQKRYLERRKEVWVAPLYFEFPGYEQAMFKE

SEQ ID NO: 2670671 - protein, 22 aa, Entamoeba histolytica
CQLHSLRLISTWLDTFSPTLRS

SEQ ID NO: 2670672 - protein, 18 aa, Entamoeba histolytica
CQLLKNFIESSVTFSDIT

SEQ ID NO: 2670673 - protein, 18 aa, Entamoeba histolytica
CQLNRIHGLFEVLKDKIY

SEQ ID NO: 2670674 - protein, 19 aa, Entamoeba histolytica
CQMSKKMAIGDGIKRAFRL

SEQ ID NO: 2670675 - protein, 35 aa, Entamoeba histolytica
CQNIQDCLNLLVSSWKNTESMIINNVNMEIEKELK

SEQ ID NO: 2670676 - protein, 19 aa, Entamoeba histolytica
CQNYLFKIIETCLQDNSTE

SEQ ID NO: 2670677 - protein, 27 aa, Entamoeba histolytica
CQPGKVGFVRYNWIYPFLTKESFYKFG

SEQ ID NO: 2670678 - protein, 22 aa, Entamoeba histolytica
CQRCKQMLYSHIDLSKTINDVI

SEQ ID NO: 2670679 - protein, 24 aa, Entamoeba histolytica
CQRLRKFAKPEMKVLIEGFEKIII

SEQ ID NO: 2670680 - protein, 19 aa, Entamoeba histolytica
CQRVFGVIRDSFWRNARSK

SEQ ID NO: 2670681 - protein, 21 aa, Entamoeba histolytica
CQSCLKKTKCSGICPICTDCC

SEQ ID NO: 2670682 - protein, 17 aa, Entamoeba histolytica
CQSEIISAISIDTGIEN

SEQ ID NO: 2670683 - protein, 20 aa, Entamoeba histolytica
CQSLPLNLFLFVDKKPIIDI

SEQ ID NO: 2670684 - protein, 20 aa, Entamoeba histolytica
CQSNYICLHHWRENRREYLE

SEQ ID NO: 2670685 - protein, 19 aa, Entamoeba histolytica
CQTFYHLLCLKRLGRENHL

SEQ ID NO: 2670686 - protein, 18 aa, Entamoeba histolytica
CQTIKGLVVAIADKLSLH

SEQ ID NO: 2670687 - protein, 24 aa, Entamoeba histolytica
CQVCGAKFTTLFRKHHCRKCGLCI

SEQ ID NO: 2670688 - protein, 17 aa, Entamoeba histolytica
CQVLVLWLDCDREGENI

SEQ ID NO: 2670689 - protein, 30 aa, Entamoeba histolytica
CQYEPEVFPGLVYRMASPKVTLLVFSTGKV

SEQ ID NO: 2670690 - protein, 31 aa, Entamoeba histolytica; identical to SEQ ID NO: 2476279

SEQ ID NO: 2670691 - protein, 19 aa, Entamoeba histolytica
CRCEADGKECCPNRHNGCR

SEQ ID NO: 2670692 - protein, 17 aa, Entamoeba histolytica
CRCKGVCDKNCVCVKHG

SEQ ID NO: 2670693 - protein, 17 aa, Entamoeba histolytica
CRCKIIPEEVYMDDADE

SEQ ID NO: 2670694 - protein, 29 aa, Entamoeba histolytica
CRCLDYLTVRICLWVLYQLLCKIKTIIEM

SEQ ID NO: 2670695 - protein, 32 aa, Entamoeba histolytica
CRDEVKWAEFEYCVLFPFNVLKMTNTKVMIKY

SEQ ID NO: 2670696 - protein, 19 aa, Entamoeba histolytica
CRDVLELFSTSLIDFNTNR

SEQ ID NO: 2670697 - protein, 18 aa, Entamoeba histolytica
CREMADGTPPYMDFPPMK

SEQ ID NO: 2670698 - protein, 21 aa, Entamoeba histolytica
CRFTDSCKNILCWEETGNIDF

SEQ ID NO: 2670699 - protein, 18 aa, Entamoeba histolytica
CRICECYVHSKCVHGLSH

SEQ ID NO: 2670700 - protein, 21 aa, Entamoeba histolytica
CRIGVCRVLFVGAHFSANMGP

SEQ ID NO: 2670701 - protein, 27 aa, Entamoeba histolytica
CRKAPKPRYFVLCTDILFYTRPKKREV

SEQ ID NO: 2670702 - protein, 33 aa, Entamoeba histolytica
CRKIIPPQFKCCLCSICGIKLHEECITLIRCGC

SEQ ID NO: 2670703 - protein, 24 aa, Entamoeba histolytica
CRKTPKPRYFILFNDQLIYGTETM

SEQ ID NO: 2670704 - protein, 17 aa, Entamoeba histolytica
CRLKIDKIYCGKGIKKV

SEQ ID NO: 2670705 - protein, 19 aa, Entamoeba histolytica
CRLVNEIMDVPLYISADET

SEQ ID NO: 2670706 - protein, 17 aa, Entamoeba histolytica
CRNRHLEKNISILYRLI

SEQ ID NO: 2670707 - protein, 17 aa, Entamoeba histolytica
CRSHLSALPPSEQSMNL

SEQ ID NO: 2670708 - protein, 18 aa, Entamoeba histolytica
CRTIYQLTFDTHRDQLDP

SEQ ID NO: 2670709 - protein, 25 aa, Entamoeba histolytica
CRTMKQRPGIVGLWGEDGNVYIYDM

SEQ ID NO: 2670710 - protein, 17 aa, Entamoeba histolytica
CRYFSKESGDGIFSKSY

SEQ ID NO: 2670711 - protein, 21 aa, Entamoeba histolytica
CSAIYMKIVISKILNGLETTF

SEQ ID NO: 2670712 - protein, 19 aa, Entamoeba histolytica
CSCAGRIITWCKKYAQSKQ

SEQ ID NO: 2670713 - protein, 17 aa, Entamoeba histolytica
CSCDITLLQLIIENGLN

SEQ ID NO: 2670714 - protein, 20 aa, Entamoeba histolytica
CSCEYEDLFSALLCVSYAAE

SEQ ID NO: 2670715 - protein, 26 aa, Entamoeba histolytica
CSCGKFKVICVYGGVDIQGQINKLQS

SEQ ID NO: 2670716 - protein, 20 aa, Entamoeba histolytica
CSCNKWKKYVNNILNYLISF

SEQ ID NO: 2670717 - protein, 22 aa, Entamoeba histolytica
CSCPTLYLIPRIITFTEHQLIL

SEQ ID NO: 2670718 - protein, 19 aa, Entamoeba histolytica
CSDAGIAVQCMDNSHVSLV

SEQ ID NO: 2670719 - protein, 25 aa, Entamoeba histolytica
CSDSSIRLYDFKKTQVVNGMNPQAK

SEQ ID NO: 2670720 - protein, 19 aa, Entamoeba histolytica
CSDTSDMFCMAIISNGCNV

SEQ ID NO: 2670721 - protein, 23 aa, Entamoeba histolytica
CSEEIATICAMLQISGELFYRPK

SEQ ID NO: 2670722 - protein, 26 aa, Entamoeba histolytica
CSEFMGELYLKCFDQFNEQIRSTEGF

SEQ ID NO: 2670723 - protein, 21 aa, Entamoeba histolytica
CSENFCGLIANCAKDQSIHYE

SEQ ID NO: 2670724 - protein, 21 aa, Entamoeba histolytica
CSFDSFNLKCKNLQSIVAEST

SEQ ID NO: 2670725 - protein, 20 aa, Entamoeba histolytica
CSFETFPIAGDLPRLLKHLS

SEQ ID NO: 2670726 - protein, 18 aa, Entamoeba histolytica
CSFFLRSNFVKTWENYFY

SEQ ID NO: 2670727 - protein, 19 aa, Entamoeba histolytica
CSGIHREFGHRVKSISMAT

SEQ ID NO: 2670728 - protein, 19 aa, Entamoeba histolytica
CSGKTTFANQLVKYINENY

SEQ ID NO: 2670729 - protein, 17 aa, Entamoeba histolytica
CSGLDKYSFPITVNQGS

SEQ ID NO: 2670730 - protein, 25 aa, Entamoeba histolytica
CSHLKSSQCYILFDSNTLPELTDKI

SEQ ID NO: 2670731 - protein, 17 aa, Entamoeba histolytica
CSHPQFIEYEKFNIEEY

SEQ ID NO: 2670732 - protein, 26 aa, Entamoeba histolytica
CSIGIIADGCGWGFRSKKASSNAVSG

SEQ ID NO: 2670733 - protein, 17 aa, Entamoeba histolytica
CSIKPEILVVGNKIDSE

SEQ ID NO: 2670734 - protein, 17 aa, Entamoeba histolytica
CSIPFGIENENIPLDYN

SEQ ID NO: 2670735 - protein, 22 aa, Entamoeba histolytica
CSIRKFSTIYLFNFPEMDLSPF

SEQ ID NO: 2670736 - protein, 27 aa, Entamoeba histolytica
CSKIRKIRINIDFSMKFQLKHPNYFIQ

SEQ ID NO: 2670737 - protein, 24 aa, Entamoeba histolytica
CSKNESACLCALCFNGSDHKGHDY

SEQ ID NO: 2670738 - protein, 19 aa, Entamoeba histolytica
CSKSFEAIQQAFILSLLNN

SEQ ID NO: 2670739 - protein, 19 aa, Entamoeba histolytica
CSLGRVPSLLLIENETMIG

SEQ ID NO: 2670740 - protein, 19 aa, Entamoeba histolytica
CSLKSLVIERSTCPFPFSL

SEQ ID NO: 2670741 - protein, 17 aa, Entamoeba histolytica
CSLPTIIFMHRGVEEKR

SEQ ID NO: 2670742 - protein, 28 aa, Entamoeba histolytica
CSLYPSAIARLYLPLSSPNRMVQPIEWY

SEQ ID NO: 2670743 - protein, 24 aa, Entamoeba histolytica
CSLYPSAVARQFLPSGAPRVMKKP

SEQ ID NO: 2670744 - protein, 17 aa, Entamoeba histolytica
CSMLLSLLGEEENKNTF

SEQ ID NO: 2670745 - protein, 19 aa, Entamoeba histolytica
CSNISDFIFNPYLVDVNVI

SEQ ID NO: 2670746 - protein, 25 aa, Entamoeba histolytica
CSNKDIKMSWCAKLDSQISQTQEQT

SEQ ID NO: 2670747 - protein, 19 aa, Entamoeba histolytica
CSNLTLIDFGYGWNTIKEG

SEQ ID NO: 2670748 - protein, 20 aa, Entamoeba histolytica
CSPAFWKFLDLIGNKIELNG

SEQ ID NO: 2670749 - protein, 22 aa, Entamoeba histolytica
CSPEACGFVTMNRPGFIEENTA

SEQ ID NO: 2670750 - protein, 17 aa, Entamoeba histolytica
CSQRYCREELSIIEKEN

SEQ ID NO: 2670751 - protein, 23 aa, Entamoeba histolytica
CSRHYRAPELVFRTSKYNSSIDI

SEQ ID NO: 2670752 - protein, 26 aa, Entamoeba histolytica
CSRKDMFKKLVICILVTIKDGVCEQK

SEQ ID NO: 2670753 - protein, 24 aa, Entamoeba histolytica
CSRKEWELLKMLANKVIMKMVDRP

SEQ ID NO: 2670754 - protein, 18 aa, Entamoeba histolytica
CSRKIILKSIVDKETLRN

SEQ ID NO: 2670755 - protein, 18 aa, Entamoeba histolytica
CSSACNFGAIKPVSHIER

SEQ ID NO: 2670756 - protein, 17 aa, Entamoeba histolytica
CSSCFGIYCEKQKGRCP

SEQ ID NO: 2670757 - protein, 19 aa, Entamoeba histolytica
CSSCSSIEELELFLKSTCR

SEQ ID NO: 2670758 - protein, 17 aa, Entamoeba histolytica
CSSDLHFKFLNQEETLE

SEQ ID NO: 2670759 - protein, 19 aa, Entamoeba histolytica
CSSEELWSLALDPFLPDYL

SEQ ID NO: 2670760 - protein, 21 aa, Entamoeba histolytica
CSSFNCLFLPQLRELEIKSSI

SEQ ID NO: 2670761 - protein, 20 aa, Entamoeba histolytica
CSSKAVIYMHEYFKQFFTEY

SEQ ID NO: 2670762 - protein, 18 aa, Entamoeba histolytica
CSSLCPLNLPTTISELSF

SEQ ID NO: 2670763 - protein, 18 aa, Entamoeba histolytica
CSSLERIDIPTSVRRIRE

SEQ ID NO: 2670764 - protein, 21 aa, Entamoeba histolytica
CSSLRCLSRLMTPQIAPAIER

SEQ ID NO: 2670765 - protein, 25 aa, Entamoeba histolytica
CSSLSKLVLCSSLIHLGISSFENCK

SEQ ID NO: 2670766 - protein, 18 aa, Entamoeba histolytica
CSSLVKFGDSCFYQCHYR

SEQ ID NO: 2670767 - protein, 21 aa, Entamoeba histolytica
CSSNENWKWKYLTHLSSYLTP

SEQ ID NO: 2670768 - protein, 19 aa, Entamoeba histolytica
CSSNSFIVGVGCFNGNVFE

SEQ ID NO: 2670769 - protein, 19 aa, Entamoeba histolytica
CSSPGRIISCTPLDEYNYI

SEQ ID NO: 2670770 - protein, 21 aa, Entamoeba histolytica
CSSVCSCIPQITCHERGIDDI

SEQ ID NO: 2670771 - protein, 20 aa, Entamoeba histolytica
CSTCLREILVSDVTLNVYFH

SEQ ID NO: 2670772 - protein, 19 aa, Entamoeba histolytica
CSTFGFPPISNTLEEVICN

SEQ ID NO: 2670773 - protein, 19 aa, Entamoeba histolytica
CSTILKFVFINKKCGEVPK

SEQ ID NO: 2670774 - protein, 29 aa, Entamoeba histolytica
CSTLSLCTSSIMLKQKFFASIVDEAAQSL

SEQ ID NO: 2670775 - protein, 17 aa, Entamoeba histolytica
CSTLTICTRSIMLKQKF

SEQ ID NO: 2670776 - protein, 17 aa, Entamoeba histolytica
CSVIELEFQIGKMKMIK

SEQ ID NO: 2670777 - protein, 18 aa, Entamoeba histolytica
CSVNCPKKCISFGEDGRA

SEQ ID NO: 2670778 - protein, 19 aa, Entamoeba histolytica
CSVPFNRVKEAGIGGGNKS

SEQ ID NO: 2670779 - protein, 27 aa, Entamoeba histolytica
CSYEPQNDCALWFIKVFPGNREFMMRA

SEQ ID NO: 2670780 - protein, 30 aa, Entamoeba histolytica
CSYFIEYNYYYPIVIPFSIKVIKEVIVLNN

SEQ ID NO: 2670781 - protein, 18 aa, Entamoeba histolytica
CSYFKQSDPFLLSNISII

SEQ ID NO: 2670782 - protein, 30 aa, Entamoeba histolytica; identical to SEQ ID NO: 2476400

SEQ ID NO: 2670783 - protein, 17 aa, Entamoeba histolytica
CSYHSLNVARVLLINGI

SEQ ID NO: 2670784 - protein, 19 aa, Entamoeba histolytica
CSYKIPKKYAEKLLKECKE

SEQ ID NO: 2670785 - protein, 18 aa, Entamoeba histolytica
CSYNHSLYMVYQGMNQSC

SEQ ID NO: 2670786 - protein, 17 aa, Entamoeba histolytica
CSYRLGITKLDIPENDP

SEQ ID NO: 2670787 - protein, 21 aa, Entamoeba histolytica
CSYYALSCGKYVQYYGPLPSV

SEQ ID NO: 2670788 - protein, 26 aa, Entamoeba histolytica
CTAILDWAANQHVGFSYFVSIGSSID

SEQ ID NO: 2670789 - protein, 27 aa, Entamoeba histolytica
CTDKMILPILKFIHGIVSIELVDEIEN

SEQ ID NO: 2670790 - protein, 18 aa, Entamoeba histolytica
CTEAGMFAIRARRKVVTE

SEQ ID NO: 2670791 - protein, 19 aa, Entamoeba histolytica
CTEAGMFAIRARRKVVTER

SEQ ID NO: 2670792 - protein, 17 aa, Entamoeba histolytica
CTEDSYHLVSLKVLSTV

SEQ ID NO: 2670793 - protein, 19 aa, Entamoeba histolytica
CTEEALTIAAMLTVPNVFL

SEQ ID NO: 2670794 - protein, 17 aa, Entamoeba histolytica
CTEFRERVLLTFIHTNG

SEQ ID NO: 2670795 - protein, 17 aa, Entamoeba histolytica
CTERLIRILKLEYDGFV

SEQ ID NO: 2670796 - protein, 25 aa, Entamoeba histolytica
CTEVTKAIVVKGVIQIEINGMFFAI

SEQ ID NO: 2670797 - protein, 25 aa, Entamoeba histolytica
CTFLFCLKLQYPNRVHLLRGNHECR

SEQ ID NO: 2670798 - protein, 18 aa, Entamoeba histolytica
CTFRDCLLSLGATSQASR

SEQ ID NO: 2670799 - protein, 20 aa, Entamoeba histolytica
CTGLQGFFIYNSVGGGTGSG

SEQ ID NO: 2670800 - protein, 18 aa, Entamoeba histolytica
CTGNFCRNRNNVMGECRR

SEQ ID NO: 2670801 - protein, 19 aa, Entamoeba histolytica
CTHYSTAVDIWAFGCVVAE

SEQ ID NO: 2670802 - protein, 18 aa, Entamoeba histolytica
CTIFKLSKPPLVLFPNKQ

SEQ ID NO: 2670803 - protein, 18 aa, Entamoeba histolytica
CTIFNLDCVPPIYRQIMF

SEQ ID NO: 2670804 - protein, 18 aa, Entamoeba histolytica
CTIFSRELPHHYCFVIAQ

SEQ ID NO: 2670805 - protein, 18 aa, Entamoeba histolytica
CTIHGGKIIDGKKNNVQE

SEQ ID NO: 2670806 - protein, 22 aa, Entamoeba histolytica
CTIMRRAVRLVKSCGRFVYSTC

SEQ ID NO: 2670807 - protein, 19 aa, Entamoeba histolytica
CTIQRFSKIIKEIEIGVIN

SEQ ID NO: 2670808 - protein, 24 aa, Entamoeba histolytica
CTKEKMLSIKLHWLQNTLNESEQN

SEQ ID NO: 2670809 - protein, 19 aa, Entamoeba histolytica
CTKPHFICICGDQDSDENT

SEQ ID NO: 2670810 - protein, 20 aa, Entamoeba histolytica
CTKPHFICICGDQYIDENTN

SEQ ID NO: 2670811 - protein, 21 aa, Entamoeba histolytica
CTKQILCIVLQMVYNNVQIIG

SEQ ID NO: 2670812 - protein, 19 aa, Entamoeba histolytica
CTKRQCGINSFPLKITAEK

SEQ ID NO: 2670813 - protein, 19 aa, Entamoeba histolytica
CTKYKLPINKTRVLLFGKS

SEQ ID NO: 2670814 - protein, 21 aa, Entamoeba histolytica
CTLTIHWQFDVTLRGLRKVLV

SEQ ID NO: 2670815 - protein, 17 aa, Entamoeba histolytica
CTLTRAFCGSNVADVIR

SEQ ID NO: 2670816 - protein, 20 aa, Entamoeba histolytica
CTLTSLELVSCVKAGFVLPN

SEQ ID NO: 2670817 - protein, 20 aa, Entamoeba histolytica
CTNKTWKQYIEWLKEKDLII

SEQ ID NO: 2670818 - protein, 25 aa, Entamoeba histolytica
CTNPNCPKPGCYRSYGSAKEDNPIC

SEQ ID NO: 2670819 - protein, 18 aa, Entamoeba histolytica
CTPNIFSFDEDLQFDQHQ

SEQ ID NO: 2670820 - protein, 19 aa, Entamoeba histolytica
CTQLILADCESLKNPIFPK

SEQ ID NO: 2670821 - protein, 22 aa, Entamoeba histolytica
CTQPRRVAAISVAQRVAEEMDV

SEQ ID NO: 2670822 - protein, 20 aa, Entamoeba histolytica
CTQPRRVAAISVSQRVAEEM

SEQ ID NO: 2670823 - protein, 19 aa, Entamoeba histolytica
CTQPVFRPTINSSHENIIM

SEQ ID NO: 2670824 - protein, 26 aa, Entamoeba histolytica
CTQRMCFAESFTGYYDKTMKRITTKS

SEQ ID NO: 2670825 - protein, 18 aa, Entamoeba histolytica
CTQRMCFANKLNIVGNGK

SEQ ID NO: 2670826 - protein, 17 aa, Entamoeba histolytica
CTSKKYLEEVIKIMKDI

SEQ ID NO: 2670827 - protein, 21 aa, Entamoeba histolytica
CTSNIFFGKIFPVACFNNEGT

SEQ ID NO: 2670828 - protein, 20 aa, Entamoeba histolytica
CTSQLPYLYVYITNNPVSIP

SEQ ID NO: 2670829 - protein, 19 aa, Entamoeba histolytica
CTSSIKKRIFILLRLLTLS

SEQ ID NO: 2670830 - protein, 25 aa, Entamoeba histolytica
CTSYLCLQPKFFGYDGPIEFLNKIL

SEQ ID NO: 2670831 - protein, 18 aa, Entamoeba histolytica
CTVCQSKGPFSIDVQNTI

SEQ ID NO: 2670832 - protein, 23 aa, Entamoeba histolytica
CTVDECKKVIAAKEEISKEIGEA

SEQ ID NO: 2670833 - protein, 18 aa, Entamoeba histolytica
CTVEDGFLFGLNNLKSIL

SEQ ID NO: 2670834 - protein, 18 aa, Entamoeba histolytica
CTVERRLEISRLIEELRQ

SEQ ID NO: 2670835 - protein, 19 aa, Entamoeba histolytica
CTVFNEFFLQRLLSTLLNF

SEQ ID NO: 2670836 - protein, 19 aa, Entamoeba histolytica
CTWMAKPRNQFKVTVTQNT

SEQ ID NO: 2670837 - protein, 20 aa, Entamoeba histolytica
CTYVEFRFAPIQSTNKGLSM

SEQ ID NO: 2670838 - protein, 18 aa, Entamoeba histolytica
CTYYLKALVPSTSYELQY

SEQ ID NO: 2670839 - protein, 29 aa, Entamoeba histolytica
CVAPRAAEIIWLLCFMNYVSKQSVSTTRD

SEQ ID NO: 2670840 - protein, 23 aa, Entamoeba histolytica
CVASEFMKAIVLPGIGFIGIADK

SEQ ID NO: 2670841 - protein, 18 aa, Entamoeba histolytica
CVCCQKVVHSTCLNKMLP

SEQ ID NO: 2670842 - protein, 20 aa, Entamoeba histolytica
CVDCSINLLHVLSHIPSIII

SEQ ID NO: 2670843 - protein, 20 aa, Entamoeba histolytica
CVDDFIFFCFLVGNDFLPHI

SEQ ID NO: 2670844 - protein, 25 aa, Entamoeba histolytica
CVDINWKYVTPRSFISASNDIDSLT

SEQ ID NO: 2670845 - protein, 20 aa, Entamoeba histolytica
CVDLKRLGVIDEIIDEVDKE

SEQ ID NO: 2670846 - protein, 41 aa, Entamoeba histolytica
CVDMDFGCFLCLKCGMIHKNFLKKLGICKIEDIQKHSMNDI

SEQ ID NO: 2670847 - protein, 21 aa, Entamoeba histolytica
CVEDCICIGLYYWTYDIPSFN

SEQ ID NO: 2670848 - protein, 25 aa, Entamoeba histolytica
CVEEVDCWRNVFNTEYDKNGPIING

SEQ ID NO: 2670849 - protein, 27 aa, Entamoeba histolytica
CVEGIAICLKTFLKMREFPKYTVKSSG

SEQ ID NO: 2670850 - protein, 18 aa, Entamoeba histolytica
CVEHFAVLCEILRAITKK

SEQ ID NO: 2670851 - protein, 20 aa, Entamoeba histolytica
CVEITRLIFEKMREENEVPC

SEQ ID NO: 2670852 - protein, 25 aa, Entamoeba histolytica
CVEPTIRRDILFSLLHGIKLKNLDY

SEQ ID NO: 2670853 - protein, 19 aa, Entamoeba histolytica
CVFKVIKALILNIDSKLAS

SEQ ID NO: 2670854 - protein, 28 aa, Entamoeba histolytica
CVFQYNCYGLYFAHCMALPQYKDVVCNL

SEQ ID NO: 2670855 - protein, 18 aa, Entamoeba histolytica
CVGIKRKPNEPILETKRK

SEQ ID NO: 2670856 - protein, 18 aa, Entamoeba histolytica
CVHCCTSAQRDNFIDEIC

SEQ ID NO: 2670857 - protein, 17 aa, Entamoeba histolytica
CVHPVLYFNPLSHSEPH

SEQ ID NO: 2670858 - protein, 24 aa, Entamoeba histolytica
CVHRYSEIISFHFFNSFNYLPIAC

SEQ ID NO: 2670859 - protein, 21 aa, Entamoeba histolytica
CVIAKGAALVAVQVGTKLRLL

SEQ ID NO: 2670860 - protein, 20 aa, Entamoeba histolytica
CVIEHLWDILSPKGIGYIVI

SEQ ID NO: 2670861 - protein, 17 aa, Entamoeba histolytica
CVIFYSFTDSDLVLNDQ

SEQ ID NO: 2670862 - protein, 18 aa, Entamoeba histolytica
CVIGDMSVGKTCISNRLI

SEQ ID NO: 2670863 - protein, 17 aa, Entamoeba histolytica
CVILKRNVPLLPVDDKF

SEQ ID NO: 2670864 - protein, 22 aa, Entamoeba histolytica
CVKETCNWRCLYWTLNDEGIAY

SEQ ID NO: 2670865 - protein, 18 aa, Entamoeba histolytica
CVKEYALFQNTQLVHTNF

SEQ ID NO: 2670866 - protein, 26 aa, Entamoeba histolytica
CVKHFRIVAVLLKYWLKIRNLNCPFK

SEQ ID NO: 2670867 - protein, 21 aa, Entamoeba histolytica
CVLLHYPFILDYMIIKIIHNT

SEQ ID NO: 2670868 - protein, 17 aa, Entamoeba histolytica
CVLPIGGSCCIPIVKKT

SEQ ID NO: 2670869 - protein, 19 aa, Entamoeba histolytica
CVLSGCLKISPMAYCTIVN

SEQ ID NO: 2670870 - protein, 19 aa, Entamoeba histolytica
CVMVSRWFGGILLGPDRFK

SEQ ID NO: 2670871 - protein, 21 aa, Entamoeba histolytica
CVNCGKKAAFSLRTSSEESIE

SEQ ID NO: 2670872 - protein, 19 aa, Entamoeba histolytica
CVNCYKQGTTRLMLTEIPY

SEQ ID NO: 2670873 - protein, 19 aa, Entamoeba histolytica
CVQNELYLANALMKDKQFQ

SEQ ID NO: 2670874 - protein, 26 aa, Entamoeba histolytica
CVQNGLVEMVNWLLAKGAYVNAADKF

SEQ ID NO: 2670875 - protein, 17 aa, Entamoeba histolytica
CVRHCLNYPANNCYGYI

SEQ ID NO: 2670876 - protein, 18 aa, Entamoeba histolytica
CVRQIFRKDNICPTCQKP

SEQ ID NO: 2670877 - protein, 26 aa, Entamoeba histolytica
CVSKLPFKFTLSFRSGNNIKIGAVVG

SEQ ID NO: 2670878 - protein, 32 aa, Entamoeba histolytica
CVSPRRHPFYGGSPMPCMMIAEELNKRNKREP

SEQ ID NO: 2670879 - protein, 19 aa, Entamoeba histolytica
CVSSMCFANCVSLTSLHLQ

SEQ ID NO: 2670880 - protein, 25 aa, Entamoeba histolytica
CVSTEFKEQMLLILGDFIEDCQYEQ

SEQ ID NO: 2670881 - protein, 17 aa, Entamoeba histolytica
CVSTGFNEESKWINETT

SEQ ID NO: 2670882 - protein, 22 aa, Entamoeba histolytica
CVTNSFKSCLVKNKITNEGDEK

SEQ ID NO: 2670883 - protein, 24 aa, Entamoeba histolytica
CVVCGCPLLFTGHLFDPPEDSFLS

SEQ ID NO: 2670884 - protein, 30 aa, Entamoeba histolytica; identical to SEQ ID NO: 2476489

SEQ ID NO: 2670885 - protein, 26 aa, Entamoeba histolytica
CVVKRIFDIAFYFKLNALRSNTTTYI

SEQ ID NO: 2670886 - protein, 21 aa, Entamoeba histolytica
CVVLMLLPRSKICSGDGVNVF

SEQ ID NO: 2670887 - protein, 20 aa, Entamoeba histolytica
CVVSGPGVDGGEDLDDCNDA

SEQ ID NO: 2670888 - protein, 17 aa, Entamoeba histolytica
CVYYSIKMLHSQYQEAQ

SEQ ID NO: 2670889 - protein, 20 aa, Entamoeba histolytica
CWDPDLRLTPTQAMQHPFLL

SEQ ID NO: 2670890 - protein, 17 aa, Entamoeba histolytica
CWFELAKNWNKYGTYKI

SEQ ID NO: 2670891 - protein, 24 aa, Entamoeba histolytica
CWGKEIWMKNYIIREDGVVEVPVK

SEQ ID NO: 2670892 - protein, 23 aa, Entamoeba histolytica
CWPAEAQNGLTLSMSYEATQELK

SEQ ID NO: 2670893 - protein, 22 aa, Entamoeba histolytica
CYAASGVQLIFGISEVRNKLKQ

SEQ ID NO: 2670894 - protein, 24 aa, Entamoeba histolytica
CYAKIAWCPYRWCSHYGQKRFTAN

SEQ ID NO: 2670895 - protein, 19 aa, Entamoeba histolytica
CYAYDFPLLCGGAVDGWKK

SEQ ID NO: 2670896 - protein, 18 aa, Entamoeba histolytica
CYCSMKRFPNDVINSVGT

SEQ ID NO: 2670897 - protein, 22 aa, Entamoeba histolytica
CYDGENKFEMKVLVTENEKQPF

SEQ ID NO: 2670898 - protein, 17 aa, Entamoeba histolytica
CYDMFHWGHANVIRQAC

SEQ ID NO: 2670899 - protein, 17 aa, Entamoeba histolytica
CYEETCVPRCFKCGKPL

SEQ ID NO: 2670900 - protein, 17 aa, Entamoeba histolytica
CYEILKTLQCYDLSPAV

SEQ ID NO: 2670901 - protein, 17 aa, Entamoeba histolytica
CYENCLNVANQLQSEVL

SEQ ID NO: 2670902 - protein, 17 aa, Entamoeba histolytica
CYFELRLSINGKNENEW

SEQ ID NO: 2670903 - protein, 22 aa, Entamoeba histolytica
CYFGNFLFNCVEPINPRPESLW

SEQ ID NO: 2670904 - protein, 22 aa, Entamoeba histolytica
CYGDCKMYVYGGWIDSEKKYNS

SEQ ID NO: 2670905 - protein, 22 aa, Entamoeba histolytica
CYGMHFFHTFKLFAVAQEKRLH

SEQ ID NO: 2670906 - protein, 19 aa, Entamoeba histolytica
CYHPFHFDSILKLAIQNKY

SEQ ID NO: 2670907 - protein, 19 aa, Entamoeba histolytica
CYIGNILFGILIYLLDEFD

SEQ ID NO: 2670908 - protein, 30 aa, Entamoeba histolytica
CYKCWNSTGKCCLKCYFLEKEKANQKKLEP

SEQ ID NO: 2670909 - protein, 25 aa, Entamoeba histolytica
CYKYNSRGLYKCPILIPNADLLYEY

SEQ ID NO: 2670910 - protein, 26 aa, Entamoeba histolytica
CYLILLSDFYRSVVLLLFKPYDYTVI

SEQ ID NO: 2670911 - protein, 20 aa, Entamoeba histolytica
CYLKTCPKCDLCLKPITGAY

SEQ ID NO: 2670912 - protein, 19 aa, Entamoeba histolytica
CYLNPGYGYEVYKEGADVL

SEQ ID NO: 2670913 - protein, 26 aa, Entamoeba histolytica
CYNYHKYKKIYIVEWARSPIHRASQA

SEQ ID NO: 2670914 - protein, 18 aa, Entamoeba histolytica
CYNYIPPKKIDEGKKEKE

SEQ ID NO: 2670915 - protein, 21 aa, Entamoeba histolytica
CYPVGWDKTYSLNYIKNKYSH

SEQ ID NO: 2670916 - protein, 20 aa, Entamoeba histolytica
CYQCNNICHDPCHCPHGIKD

SEQ ID NO: 2670917 - protein, 21 aa, Entamoeba histolytica
CYQLPSYFIKGITLVVSPLVS

SEQ ID NO: 2670918 - protein, 17 aa, Entamoeba histolytica
CYQNYYHCLSLFNQNKL

SEQ ID NO: 2670919 - protein, 25 aa, Entamoeba histolytica
CYQRERLPLPAARDFENASDNYLRA

SEQ ID NO: 2670920 - protein, 21 aa, Entamoeba histolytica
CYSLPPKVHLNLNCDMKEDPD

SEQ ID NO: 2670921 - protein, 25 aa, Entamoeba histolytica
CYSQLPSLLGNYAIKVPGRIWPLMV

SEQ ID NO: 2670922 - protein, 22 aa, Entamoeba histolytica
CYSSKLRSPISLRDNDFDVMND

SEQ ID NO: 2670923 - protein, 19 aa, Entamoeba histolytica
CYSYPCLKVDASNGSTQLS

SEQ ID NO: 2670924 - protein, 24 aa, Entamoeba histolytica
CYTYHNWNNCYSLSLSLLGLKSLI

SEQ ID NO: 2670925 - protein, 18 aa, Entamoeba histolytica
CYYCRRGLIPELPQVNLP

SEQ ID NO: 2670926 - protein, 20 aa, Entamoeba histolytica
CYYPYFYSIIIEDELVTKEV

SEQ ID NO: 2670927 - protein, 23 aa, Entamoeba histolytica
CYYYCKELFLHTMFSFFYEGDSS

SEQ ID NO: 2670928 - protein, 18 aa, Entamoeba histolytica
CYYYLNSMLLNFKTDGNR

SEQ ID NO: 2670929 - protein, 17 aa, Entamoeba histolytica
DAALDFEPEVIGISNTM

SEQ ID NO: 2670930 - protein, 24 aa, Entamoeba histolytica
DACGEFYKSLPLAAVVANSAFCAH

SEQ ID NO: 2670931 - protein, 24 aa, Entamoeba histolytica
DAEASCIECISACSSQSLEKKEGI

SEQ ID NO: 2670932 - protein, 21 aa, Entamoeba histolytica
DAEKYTGAGYVQWATCVTDLF

SEQ ID NO: 2670933 - protein, 38 aa, Entamoeba histolytica
DAEMCIKIKPDFIKGYNRKAFSHFCMKEYNKALTEYER

SEQ ID NO: 2670934 - protein, 18 aa, Entamoeba histolytica
DAEMCVQENLALKPDYDY

SEQ ID NO: 2670935 - protein, 17 aa, Entamoeba histolytica
DAETGRDAMRWLDRALL

SEQ ID NO: 2670936 - protein, 24 aa, Entamoeba histolytica
DAFIKAAPFFLYMREFIGNNSNAL

SEQ ID NO: 2670937 - protein, 22 aa, Entamoeba histolytica
DAFKAIFIETVTNFAQKVGQPT

SEQ ID NO: 2670938 - protein, 23 aa, Entamoeba histolytica
DAFRIPPKYLQQLLVDARPIDDP

SEQ ID NO: 2670939 - protein, 22 aa, Entamoeba histolytica
DAFYCVMEFVIKAQCCGHFYSS

SEQ ID NO: 2670940 - protein, 20 aa, Entamoeba histolytica
DAIAAFWWDDFCDGDLEDLE

SEQ ID NO: 2670941 - protein, 19 aa, Entamoeba histolytica
DAIFIWLNLLHEMNLNIPL

SEQ ID NO: 2670942 - protein, 27 aa, Entamoeba histolytica
DAIPPNKRWGALLPVGLIPPEITTPVS

SEQ ID NO: 2670943 - protein, 18 aa, Entamoeba histolytica
DAITNCFENLLKVFTSTK

SEQ ID NO: 2670944 - protein, 22 aa, Entamoeba histolytica
DAITSFKKRDWYESSNHIILIM

SEQ ID NO: 2670945 - protein, 23 aa, Entamoeba histolytica
DAKETLTCLTLEWIDELTDRKGE

SEQ ID NO: 2670946 - protein, 31 aa, Entamoeba histolytica
DAKKAFSVMHLRWFNMHLLRVEYYPESKVPI

SEQ ID NO: 2670947 - protein, 18 aa, Entamoeba histolytica
DAKLRKKDISDVVLVGGM

SEQ ID NO: 2670948 - protein, 20 aa, Entamoeba histolytica
DAKTAFKRLVYSRYRGIPLY

SEQ ID NO: 2670949 - protein, 18 aa, Entamoeba histolytica
DALFILSCHLDRSSNREI

SEQ ID NO: 2670950 - protein, 26 aa, Entamoeba histolytica
DALKPGKDALHWGVLRPFDSSYPGID

SEQ ID NO: 2670951 - protein, 23 aa, Entamoeba histolytica
DALKRLPFGYIELMNNCPSQPML

SEQ ID NO: 2670952 - protein, 19 aa, Entamoeba histolytica
DALLDRKAFKEAMDSTTKK

SEQ ID NO: 2670953 - protein, 19 aa, Entamoeba histolytica
DALNCTAEGEGLENAETKT

SEQ ID NO: 2670954 - protein, 17 aa, Entamoeba histolytica
DALRDILDASGILYSVL

SEQ ID NO: 2670955 - protein, 24 aa, Entamoeba histolytica
DALVKIKLSFRPGAVDAEKAVAPH

SEQ ID NO: 2670956 - protein, 18 aa, Entamoeba histolytica
DANEITMPTIIVLNPGSF

SEQ ID NO: 2670957 - protein, 19 aa, Entamoeba histolytica
DAPFPSAIIECYKNQHENL

SEQ ID NO: 2670958 - protein, 18 aa, Entamoeba histolytica
DAPHYRTGTQFKCYPLYD

SEQ ID NO: 2670959 - protein, 21 aa, Entamoeba histolytica
DAPRFKWRGLMVDPSRNPLSP

SEQ ID NO: 2670960 - protein, 24 aa, Entamoeba histolytica
DAQEIMDRINLFSGVTNGLKKSFL

SEQ ID NO: 2670961 - protein, 20 aa, Entamoeba histolytica
DAQGIIICYDVTSPKSLTSI

SEQ ID NO: 2670962 - protein, 30 aa, Entamoeba histolytica
DAQKKFPFIPLILKYIEAMTFYSNDFSEFE

SEQ ID NO: 2670963 - protein, 17 aa, Entamoeba histolytica
DAQLPVDQPNFFKKENK

SEQ ID NO: 2670964 - protein, 18 aa, Entamoeba histolytica
DARIQEGQLKKWEIKYYK

SEQ ID NO: 2670965 - protein, 27 aa, Entamoeba histolytica
DARLKKGFPETIRVVTSCYVYIQCIGD

SEQ ID NO: 2670966 - protein, 23 aa, Entamoeba histolytica
DATIHLKIIRIMYRHYSLDELKN

SEQ ID NO: 2670967 - protein, 24 aa, Entamoeba histolytica
DATKRIAIVNCDWENTSARDLFAL

SEQ ID NO: 2670968 - protein, 22 aa, Entamoeba histolytica
DATMKLTVVDFLSSAIVLLETT

SEQ ID NO: 2670969 - protein, 17 aa, Entamoeba histolytica
DAYECFETIWKQVAHEN

SEQ ID NO: 2670970 - protein, 26 aa, Entamoeba histolytica
DCAVFCIADGCGMGKRPATSAHVACE

SEQ ID NO: 2670971 - protein, 20 aa, Entamoeba histolytica
DCCDYCKNKRAIQAKYLGQI

SEQ ID NO: 2670972 - protein, 25 aa, Entamoeba histolytica
DCCKKICAIGGITFSLPLFKPTYPM

SEQ ID NO: 2670973 - protein, 24 aa, Entamoeba histolytica
DCDRRGHFFFPISVAVNHKKNDIY

SEQ ID NO: 2670974 - protein, 24 aa, Entamoeba histolytica
DCEEWAREVFYFALRDTLVCENLT

SEQ ID NO: 2670975 - protein, 18 aa, Entamoeba histolytica
DCEYKRCLTKYCIPLQGI

SEQ ID NO: 2670976 - protein, 19 aa, Entamoeba histolytica
DCFGDVKKQGGAPCNFAMH

SEQ ID NO: 2670977 - protein, 22 aa, Entamoeba histolytica
DCFIKMRNALFIRDTLTPLSYY

SEQ ID NO: 2670978 - protein, 19 aa, Entamoeba histolytica
DCGCFSQWVVCTQTSTELR

SEQ ID NO: 2670979 - protein, 33 aa, Entamoeba histolytica
DCGKNKVVCLLFPWVIRPQQNIMFINSTMIKSL

SEQ ID NO: 2670980 - protein, 18 aa, Entamoeba histolytica
DCGLMSYLINVIKKPPSI

SEQ ID NO: 2670981 - protein, 21 aa, Entamoeba histolytica
DCGLPKPDIVFFLELSLEDAE

SEQ ID NO: 2670982 - protein, 20 aa, Entamoeba histolytica
DCGNYCFSHCVGLTSIPLIY

SEQ ID NO: 2670983 - protein, 22 aa, Entamoeba histolytica
DCGYETCYLEEEFLVIHIQIFV

SEQ ID NO: 2670984 - protein, 21 aa, Entamoeba histolytica
DCGYETCYLVAIKNHRTTIVL

SEQ ID NO: 2670985 - protein, 20 aa, Entamoeba histolytica
DCIAEIFAKAVREEIMDQCQ

SEQ ID NO: 2670986 - protein, 18 aa, Entamoeba histolytica
DCILPIYNILFGKFEEQE

SEQ ID NO: 2670987 - protein, 17 aa, Entamoeba histolytica
DCIYGKEGPVWKKIKED

SEQ ID NO: 2670988 - protein, 20 aa, Entamoeba histolytica
DCIYLFKTAGYLVTKKFLKE

SEQ ID NO: 2670989 - protein, 25 aa, Entamoeba histolytica
DCKADLFTFALLVTKIWTGKLPYSP

SEQ ID NO: 2670990 - protein, 17 aa, Entamoeba histolytica
DCKEIIQNIIFIISGKK

SEQ ID NO: 2670991 - protein, 23 aa, Entamoeba histolytica
DCKKEFNIIITLDYSVFMDVLEY

SEQ ID NO: 2670992 - protein, 28 aa, Entamoeba histolytica
DCKLNDLIELIQLFPNCEIISQTTLLSP

SEQ ID NO: 2670993 - protein, 20 aa, Entamoeba histolytica
DCKNYNPYIRHCMYGLDADL

SEQ ID NO: 2670994 - protein, 18 aa, Entamoeba histolytica
DCKTWLSKCKGFNKLYHC

SEQ ID NO: 2670995 - protein, 17 aa, Entamoeba histolytica
DCLCCKKGNGLTKSALH

SEQ ID NO: 2670996 - protein, 26 aa, Entamoeba histolytica
DCLCNCGRCQCKIKECKHETCIHKKN

SEQ ID NO: 2670997 - protein, 17 aa, Entamoeba histolytica
DCLFNKNQINAMKDLGF

SEQ ID NO: 2670998 - protein, 23 aa, Entamoeba histolytica
DCLPFKEVLFHSIVRDAQGRKMS

SEQ ID NO: 2670999 - protein, 17 aa, Entamoeba histolytica
DCLPLSALIDQRYFCVH

SEQ ID NO: 2671000 - protein, 18 aa, Entamoeba histolytica
DCLSMVFMFASYRVSKGE

SEQ ID NO: 2671001 - protein, 26 aa, Entamoeba histolytica
DCMTFGMNLFEEFMSLISFILSSQFK

SEQ ID NO: 2671002 - protein, 21 aa, Entamoeba histolytica
DCQLKRKRGRSRSKSKEKQSR

SEQ ID NO: 2671003 - protein, 19 aa, Entamoeba histolytica
DCQPDHLIAVPRVLQRIKM

SEQ ID NO: 2671004 - protein, 17 aa, Entamoeba histolytica
DCQPRLVSTESARQWCE

SEQ ID NO: 2671005 - protein, 19 aa, Entamoeba histolytica
DCRALKTIHIPSSITQIGN

SEQ ID NO: 2671006 - protein, 22 aa, Entamoeba histolytica
DCSCRLLRLGFFLFDCTNALRH

SEQ ID NO: 2671007 - protein, 24 aa, Entamoeba histolytica
DCSLILKTDVYSIIFLTKNNNKIL

SEQ ID NO: 2671008 - protein, 18 aa, Entamoeba histolytica
DCSLIRLPQPPLNTFERA

SEQ ID NO: 2671009 - protein, 21 aa, Entamoeba histolytica
DCSVGKTCIIGRFTSKNFDMS

SEQ ID NO: 2671010 - protein, 23 aa, Entamoeba histolytica
DCTSEILKEFSFLIELLDKDMQR

SEQ ID NO: 2671011 - protein, 17 aa, Entamoeba histolytica
DCVFKSCSHLSICSKCL

SEQ ID NO: 2671012 - protein, 19 aa, Entamoeba histolytica
DCVIQWKVPTVGLTVKLSK

SEQ ID NO: 2671013 - protein, 26 aa, Entamoeba histolytica
DCWDAEIRLSYGWVECVGHADRGDFD

SEQ ID NO: 2671014 - protein, 21 aa, Entamoeba histolytica
DCWIVPIYIGHCIDLTFFWDS

SEQ ID NO: 2671015 - protein, 25 aa, Entamoeba histolytica
DCYIKLDICLIYGVMVLCKKRGNYY

SEQ ID NO: 2671016 - protein, 20 aa, Entamoeba histolytica
DCYNKFEISYLEAMKEILKN

SEQ ID NO: 2671017 - protein, 26 aa, Entamoeba histolytica
DDAMDVIEIFKIASLTGLGGISNSPV

SEQ ID NO: 2671018 - protein, 22 aa, Entamoeba histolytica
DDCKYPNSFDKFLSCFSSAMKV

SEQ ID NO: 2671019 - protein, 24 aa, Entamoeba histolytica
DDCMFKGCTSLSVIKSKNPKNLQI

SEQ ID NO: 2671020 - protein, 22 aa, Entamoeba histolytica
DDCQKVKLFFEALQSQVDTLQS

SEQ ID NO: 2671021 - protein, 18 aa, Entamoeba histolytica
DDCYRNEILLGDFTLDLR

SEQ ID NO: 2671022 - protein, 26 aa, Entamoeba histolytica
DDDLFLVVGCVNGFINIFSIKTGVIV

SEQ ID NO: 2671023 - protein, 27 aa, Entamoeba histolytica
DDDMIFKIRFDAGVTDLIWRNQTNFLA

SEQ ID NO: 2671024 - protein, 24 aa, Entamoeba histolytica
DDDMSFRHVYNWLSEARRFCNKEN

SEQ ID NO: 2671025 - protein, 20 aa, Entamoeba histolytica
DDEFKGVFRMERSEFNMLPR

SEQ ID NO: 2671026 - protein, 21 aa, Entamoeba histolytica
DDEIANFVWNYFCRHLVRQEE

SEQ ID NO: 2671027 - protein, 20 aa, Entamoeba histolytica
DDEIIFCLNTKPFIEIKLIT

SEQ ID NO: 2671028 - protein, 23 aa, Entamoeba histolytica
DDEITVYMDIDFDDITKFEDDDD

SEQ ID NO: 2671029 - protein, 23 aa, Entamoeba histolytica
DDELKMVLFKGSKRFDSLKLIFD

SEQ ID NO: 2671030 - protein, 24 aa, Entamoeba histolytica
DDEMKAFLSWKYVRLERLVLSWLD

SEQ ID NO: 2671031 - protein, 26 aa, Entamoeba histolytica
DDEYRNPMVYDMCGTCTYKHQSDYDI

SEQ ID NO: 2671032 - protein, 23 aa, Entamoeba histolytica
DDFANDVRLVFKNAMKYNPPRNT

SEQ ID NO: 2671033 - protein, 25 aa, Entamoeba histolytica
DDFCCCSVCKIAYCEQHKNKLEIII

SEQ ID NO: 2671034 - protein, 23 aa, Entamoeba histolytica
DDFDWEEALGLVQSNLNKEEEKE

SEQ ID NO: 2671035 - protein, 29 aa, Entamoeba histolytica
DDFQFTKQFLWKWFNEQFIKKVNQTREKL

SEQ ID NO: 2671036 - protein, 26 aa, Entamoeba histolytica
DDFYGYVTWINCLTRENFIEVIIQNF

SEQ ID NO: 2671037 - protein, 25 aa, Entamoeba histolytica
DDFYHLPDCINVIPIQTISSTLVFV

SEQ ID NO: 2671038 - protein, 24 aa, Entamoeba histolytica
DDGAGLACLLALMELHPKFEHAPI

SEQ ID NO: 2671039 - protein, 23 aa, Entamoeba histolytica
DDGISLLRWSLLRPSDYKGVSPL

SEQ ID NO: 2671040 - protein, 25 aa, Entamoeba histolytica
DDGLWTVRHGHDFRRRQPKKDREED

SEQ ID NO: 2671041 - protein, 26 aa, Entamoeba histolytica
DDGTGVACGLAYMELRDKFQHPALEL

SEQ ID NO: 2671042 - protein, 26 aa, Entamoeba histolytica
DDGWVCPHCQAICPATNVISLYSMPI

SEQ ID NO: 2671043 - protein, 22 aa, Entamoeba histolytica
DDGWVMRKFTSSIEWTKKDLMS

SEQ ID NO: 2671044 - protein, 24 aa, Entamoeba histolytica
DDHEIKESPLFHKKKVIKKTISLN

SEQ ID NO: 2671045 - protein, 27 aa, Entamoeba histolytica
DDIFTRISRRAELTLSGFDEKCNGEKS

SEQ ID NO: 2671046 - protein, 19 aa, Entamoeba histolytica
DDIHFPCLCQHYINHNNKI

SEQ ID NO: 2671047 - protein, 22 aa, Entamoeba histolytica
DDIHMIPFLWIQLTFGCDGCVG

SEQ ID NO: 2671048 - protein, 17 aa, Entamoeba histolytica
DDIIPLFYIFYQNITGI

SEQ ID NO: 2671049 - protein, 22 aa, Entamoeba histolytica
DDIKIHIWKTLIGTKYLLQQRN

SEQ ID NO: 2671050 - protein, 22 aa, Entamoeba histolytica
DDIKTSVVLTERIEELTQGINE

SEQ ID NO: 2671051 - protein, 19 aa, Entamoeba histolytica
DDIPDFDFDEMINQTEECS

SEQ ID NO: 2671052 - protein, 20 aa, Entamoeba histolytica
DDISPFGMLIIFKTSFRSSF

SEQ ID NO: 2671053 - protein, 17 aa, Entamoeba histolytica
DDITDVIGIDSDINGFV

SEQ ID NO: 2671054 - protein, 24 aa, Entamoeba histolytica
DDITKCFCCIPALQCNCDNTLLYA

SEQ ID NO: 2671055 - protein, 20 aa, Entamoeba histolytica
DDKKITSQDIIKKDDQKKPP

SEQ ID NO: 2671056 - protein, 24 aa, Entamoeba histolytica
DDKLIPALVYRLTHKDTYLTEDPE

SEQ ID NO: 2671057 - protein, 27 aa, Entamoeba histolytica
DDKNVKGIITWFSLHNCQTRFEGTRKE

SEQ ID NO: 2671058 - protein, 25 aa, Entamoeba histolytica
DDKNYWCTAKPNLLLKLKHINPCPY

SEQ ID NO: 2671059 - protein, 17 aa, Entamoeba histolytica
DDKRLELNVSLASCESS

SEQ ID NO: 2671060 - protein, 20 aa, Entamoeba histolytica
DDLAIVFALFSVDPTNFKIP

SEQ ID NO: 2671061 - protein, 30 aa, Entamoeba histolytica
DDLDSFIILMKKWWCDGQPHIELNVLPMIM

SEQ ID NO: 2671062 - protein, 17 aa, Entamoeba histolytica
DDLIENIILTISDKEGG

SEQ ID NO: 2671063 - protein, 25 aa, Entamoeba histolytica
DDLIKSDFCSFVFSESDNSSESKRF

SEQ ID NO: 2671064 - protein, 20 aa, Entamoeba histolytica
DDLKGKVLITLRDPSKQIQH

SEQ ID NO: 2671065 - protein, 20 aa, Entamoeba histolytica
DDLKMKFGLISDTTNTETDD

SEQ ID NO: 2671066 - protein, 18 aa, Entamoeba histolytica
DDLLNLLTFEMIKDISNN

SEQ ID NO: 2671067 - protein, 28 aa, Entamoeba histolytica
DDLLWTRHFPIAFLMRQHMLLLGRSEEI

SEQ ID NO: 2671068 - protein, 19 aa, Entamoeba histolytica
DDLPGFGTNELRVFDEKKG

SEQ ID NO: 2671069 - protein, 17 aa, Entamoeba histolytica
DDLRRLVTMGINEEYFK

SEQ ID NO: 2671070 - protein, 21 aa, Entamoeba histolytica
DDLTLKLSRLNEEINEMSYVP

SEQ ID NO: 2671071 - protein, 18 aa, Entamoeba histolytica
DDMICFIVKMSQQQPSEE

SEQ ID NO: 2671072 - protein, 29 aa, Entamoeba histolytica
DDMKSRMYLNFTICFSSRISSELLQYFAN

SEQ ID NO: 2671073 - protein, 17 aa, Entamoeba histolytica
DDNCFIIFTQLQKFIKQ

SEQ ID NO: 2671074 - protein, 20 aa, Entamoeba histolytica
DDNEIFKDEVITLTQKIFKK

SEQ ID NO: 2671075 - protein, 25 aa, Entamoeba histolytica
DDNIKWIFELAMKFTELEDIQNAVI

SEQ ID NO: 2671076 - protein, 21 aa, Entamoeba histolytica
DDPCLFDFGYGSSRVYVHKPT

SEQ ID NO: 2671077 - protein, 24 aa, Entamoeba histolytica
DDPEFKFDLAVSLHKIDLAREMAD

SEQ ID NO: 2671078 - protein, 29 aa, Entamoeba histolytica
DDQIKGHQWFAGIDWDLLLQKKVPVPWKP

SEQ ID NO: 2671079 - protein, 24 aa, Entamoeba histolytica
DDREMVIVPLILGQGTDWDKINPE

SEQ ID NO: 2671080 - protein, 20 aa, Entamoeba histolytica
DDRIPAWCDRVLCRTQNAYP

SEQ ID NO: 2671081 - protein, 19 aa, Entamoeba histolytica
DDRIRVVGEYGGIGKSIPQ

SEQ ID NO: 2671082 - protein, 25 aa, Entamoeba histolytica
DDSPRRRLPMAITEMNCCEEAVKSD

SEQ ID NO: 2671083 - protein, 24 aa, Entamoeba histolytica
DDSVFKICLMCIIDSDGFTGAMKW

SEQ ID NO: 2671084 - protein, 18 aa, Entamoeba histolytica
DDSYPYENCIRVDPHEDH

SEQ ID NO: 2671085 - protein, 25 aa, Entamoeba histolytica
DDTINCWDISTGVPSKRITFEQTMN

SEQ ID NO: 2671086 - protein, 22 aa, Entamoeba histolytica
DDTRVRFSILLNLPIIHSFPLP

SEQ ID NO: 2671087 - protein, 20 aa, Entamoeba histolytica
DDTVVKCMICNKPFSFFIRR

SEQ ID NO: 2671088 - protein, 18 aa, Entamoeba histolytica
DDVAVVLILRYKHMNSET

SEQ ID NO: 2671089 - protein, 24 aa, Entamoeba histolytica
DDVCNRLRIAVPGISIATDIICGF

SEQ ID NO: 2671090 - protein, 19 aa, Entamoeba histolytica
DDVICKLSDYWNIQQITGV

SEQ ID NO: 2671091 - protein, 25 aa, Entamoeba histolytica
DDVLKEVISFRCAMARVKVEFKESE

SEQ ID NO: 2671092 - protein, 18 aa, Entamoeba histolytica
DDWLETVSSYTAFHRAVL

SEQ ID NO: 2671093 - protein, 27 aa, Entamoeba histolytica
DDYAWWKGRLSQMAQYFSAYRIDHILG

SEQ ID NO: 2671094 - protein, 27 aa, Entamoeba histolytica
DDYAWWKGRLSQMSQYFNAYRIDHILG

SEQ ID NO: 2671095 - protein, 23 aa, Entamoeba histolytica
DDYLKPYLRRTTLIKEIIDKNDS

SEQ ID NO: 2671096 - protein, 23 aa, Entamoeba histolytica
DDYLKPYLRRTTLIQDIIDKNKG

SEQ ID NO: 2671097 - protein, 23 aa, Entamoeba histolytica
DDYTVRVVDVFAMPQNGTGVSVE

SEQ ID NO: 2671098 - protein, 22 aa, Entamoeba histolytica
DEAAIKFKTRFVELKFDNKNTL

SEQ ID NO: 2671099 - protein, 26 aa, Entamoeba histolytica
DEAAIKFKTRFVELKFDNKNTLKFYT

SEQ ID NO: 2671100 - protein, 23 aa, Entamoeba histolytica
DEAEIPLLFIISSVLPPKRKLFN

SEQ ID NO: 2671101 - protein, 19 aa, Entamoeba histolytica
DEAFPYCFDGATSISPTGR

SEQ ID NO: 2671102 - protein, 20 aa, Entamoeba histolytica
DEALFKINLLKRMDEIKRRN

SEQ ID NO: 2671103 - protein, 25 aa, Entamoeba histolytica
DEARVSILAFQFFKQVYKLFEKCPY

SEQ ID NO: 2671104 - protein, 26 aa, Entamoeba histolytica
DECFRYCKNLEKVECYRNYSFSGRKF

SEQ ID NO: 2671105 - protein, 18 aa, Entamoeba histolytica
DECIKRIKNHLCGRGNIF

SEQ ID NO: 2671106 - protein, 18 aa, Entamoeba histolytica
DECLRKYGNLYIWNAFIS

SEQ ID NO: 2671107 - protein, 21 aa, Entamoeba histolytica
DECRDFRATLARILQEKIVLF

SEQ ID NO: 2671108 - protein, 19 aa, Entamoeba histolytica
DECSGEYALLPDLLFNISK

SEQ ID NO: 2671109 - protein, 18 aa, Entamoeba histolytica
DECYPLWFYKSTPSLFCV

SEQ ID NO: 2671110 - protein, 18 aa, Entamoeba histolytica
DEDDEFYGDYSISVEYDE

SEQ ID NO: 2671111 - protein, 26 aa, Entamoeba histolytica
DEDPDFFWKYLFKCYDAYDQITNSFV

SEQ ID NO: 2671112 - protein, 25 aa, Entamoeba histolytica
DEDRIFRLAYHVYKTKELIEKYGSE

SEQ ID NO: 2671113 - protein, 24 aa, Entamoeba histolytica
DEDRIIRIAYHIYKTKDEIQTGKI

SEQ ID NO: 2671114 - protein, 26 aa, Entamoeba histolytica
DEEFLKRVALLITCCVDNQTKFNEEF

SEQ ID NO: 2671115 - protein, 18 aa, Entamoeba histolytica
DEEGWKLFGDIFNYEEFK

SEQ ID NO: 2671116 - protein, 21 aa, Entamoeba histolytica
DEEIRELVKFCFNGISDKYYY

SEQ ID NO: 2671117 - protein, 18 aa, Entamoeba histolytica
DEELIKHHIKPMIHEGDY

SEQ ID NO: 2671118 - protein, 23 aa, Entamoeba histolytica
DEEMPEDIQLLLIQLNSTQPCLN

SEQ ID NO: 2671119 - protein, 19 aa, Entamoeba histolytica
DEEPFGQVGLICIKNQNYF

SEQ ID NO: 2671120 - protein, 20 aa, Entamoeba histolytica
DEERRAVLMLSVHALLDDGM

SEQ ID NO: 2671121 - protein, 27 aa, Entamoeba histolytica
DEESLKIVGAFVFLRLINPVLLTPLKF

SEQ ID NO: 2671122 - protein, 18 aa, Entamoeba histolytica
DEEYCLAGVIVHSGNCTG

SEQ ID NO: 2671123 - protein, 24 aa, Entamoeba histolytica
DEEYRYVVMNNLFPNDNFPLQYKF

SEQ ID NO: 2671124 - protein, 20 aa, Entamoeba histolytica
DEFAMMLQVALIYCKKEEIE

SEQ ID NO: 2671125 - protein, 24 aa, Entamoeba histolytica
DEFDIFIKVLIKWITNSKDIMLKY

SEQ ID NO: 2671126 - protein, 20 aa, Entamoeba histolytica
DEFDPHYNVVIGRNGSGKSN

SEQ ID NO: 2671127 - protein, 20 aa, Entamoeba histolytica
DEFERCRVLFITRIDQVYEN

SEQ ID NO: 2671128 - protein, 19 aa, Entamoeba histolytica
DEFFWRRRPSPKIVQHENG

SEQ ID NO: 2671129 - protein, 23 aa, Entamoeba histolytica
DEFIIRKMIRKFIKGEEIDNVKV

SEQ ID NO: 2671130 - protein, 27 aa, Entamoeba histolytica
DEFIYSIPFFFHLKKLKIGYSTYFDFS

SEQ ID NO: 2671131 - protein, 25 aa, Entamoeba histolytica
DEFKYGFQKFNLFKGKKVFATELFT

SEQ ID NO: 2671132 - protein, 21 aa, Entamoeba histolytica
DEFNIPPCISNWKNNRGYTIS

SEQ ID NO: 2671133 - protein, 17 aa, Entamoeba histolytica
DEFNLYGLRAFIEHYEE

SEQ ID NO: 2671134 - protein, 27 aa, Entamoeba histolytica
DEFTQMFWKLGMRNFDDFISKSVTLPR

SEQ ID NO: 2671135 - protein, 18 aa, Entamoeba histolytica
DEFWDFMNSLGKKVELKG

SEQ ID NO: 2671136 - protein, 19 aa, Entamoeba histolytica
DEGDFCFTEILYGQFRREV

SEQ ID NO: 2671137 - protein, 17 aa, Entamoeba histolytica
DEGISMKSILEHKKGLF

SEQ ID NO: 2671138 - protein, 21 aa, Entamoeba histolytica
DEGKKYISVCVQGIPKQWNTR

SEQ ID NO: 2671139 - protein, 18 aa, Entamoeba histolytica
DEGLNMKCSYRVYVYPFE

SEQ ID NO: 2671140 - protein, 21 aa, Entamoeba histolytica
DEGYVGMFVDVCIQNLCQMIE

SEQ ID NO: 2671141 - protein, 17 aa, Entamoeba histolytica
DEHFWEKLINYFRVDSV

SEQ ID NO: 2671142 - protein, 18 aa, Entamoeba histolytica
DEHICMVLCGNKCDMESD

SEQ ID NO: 2671143 - protein, 17 aa, Entamoeba histolytica
DEHKVFIIDGFPRNAEN

SEQ ID NO: 2671144 - protein, 20 aa, Entamoeba histolytica
DEHTFEWLANVLKHKGKSLD

SEQ ID NO: 2671145 - protein, 22 aa, Entamoeba histolytica
DEIDCLHPTLDIGILNKPTLIS

SEQ ID NO: 2671146 - protein, 37 aa, Entamoeba histolytica
DEIESCPSIPSNIDFGFRPKFGKIHLVNGKIVEEFPQ

SEQ ID NO: 2671147 - protein, 21 aa, Entamoeba histolytica
DEIIKLWRVSLLQHQIVLNDE

SEQ ID NO: 2671148 - protein, 18 aa, Entamoeba histolytica
DEIIRISEELQKEKVKGI

SEQ ID NO: 2671149 - protein, 27 aa, Entamoeba histolytica
DEIIRLACKFYYLSRLESIDAILNGVL

SEQ ID NO: 2671150 - protein, 22 aa, Entamoeba histolytica
DEILKKILDGVGIEDDDETIQI

SEQ ID NO: 2671151 - protein, 20 aa, Entamoeba histolytica
DEILKKMGLVNGFCSTKGKH

SEQ ID NO: 2671152 - protein, 19 aa, Entamoeba histolytica
DEINIGLASFNSWNRKFAK

SEQ ID NO: 2671153 - protein, 20 aa, Entamoeba histolytica
DEIPHLHVTEVYKRATHIVC

SEQ ID NO: 2671154 - protein, 24 aa, Entamoeba histolytica
DEIPKRFYELMFLIAEKIKLEGFG

SEQ ID NO: 2671155 - protein, 17 aa, Entamoeba histolytica
DEIPLYVPDTFFDMIFD

SEQ ID NO: 2671156 - protein, 18 aa, Entamoeba histolytica
DEIPRFKARQIEAMNYQA

SEQ ID NO: 2671157 - protein, 17 aa, Entamoeba histolytica
DEIREWYRVYKVAEGKK

SEQ ID NO: 2671158 - protein, 21 aa, Entamoeba histolytica
DEIRRAQFCFVINRVNYYLTR

SEQ ID NO: 2671159 - protein, 17 aa, Entamoeba histolytica
DEISAEVPLGFDNYVLW

SEQ ID NO: 2671160 - protein, 24 aa, Entamoeba histolytica
DEISHWIGTMILMFPDVEMRAKLM

SEQ ID NO: 2671161 - protein, 22 aa, Entamoeba histolytica
DEISKCDIALIGEKENKPIDYR

SEQ ID NO: 2671162 - protein, 21 aa, Entamoeba histolytica
DEIYKKVLIFLNEIPKDEKYK

SEQ ID NO: 2671163 - protein, 23 aa, Entamoeba histolytica
DEKCIGCALCSSVCPVNAIEYVK

SEQ ID NO: 2671164 - protein, 27 aa, Entamoeba histolytica
DEKDRLLRVGIIDFIRTYTWDKQLESV

SEQ ID NO: 2671165 - protein, 18 aa, Entamoeba histolytica
DEKGVTVEVCIRSTNTLI

SEQ ID NO: 2671166 - protein, 17 aa, Entamoeba histolytica
DEKIWIGIYDRYETNSH

SEQ ID NO: 2671167 - protein, 28 aa, Entamoeba histolytica
DEKKIILLTSCGLREIECKNKLDRDLWL

SEQ ID NO: 2671168 - protein, 21 aa, Entamoeba histolytica
DEKKKLFVFEDCSSESNDENN

SEQ ID NO: 2671169 - protein, 27 aa, Entamoeba histolytica
DEKKLGWFEGFKIKGEILEKIHTAGTI

SEQ ID NO: 2671170 - protein, 29 aa, Entamoeba histolytica
DEKKLWLPPRKRISTYITEDQKKEKLEDK

SEQ ID NO: 2671171 - protein, 26 aa, Entamoeba histolytica
DEKLVSNELWEWILLPKEKFQKRKKT

SEQ ID NO: 2671172 - protein, 23 aa, Entamoeba histolytica
DEKSKDLICWSREQNRPGFVVLE

SEQ ID NO: 2671173 - protein, 26 aa, Entamoeba histolytica
DEKYKSIICELYFELHPIFNKSCALN

SEQ ID NO: 2671174 - protein, 26 aa, Entamoeba histolytica
DELEADVYWSFCWILQSIQSHYTYDQ

SEQ ID NO: 2671175 - protein, 23 aa, Entamoeba histolytica
DELEKRYRLLAKDISLNYKPTQK

SEQ ID NO: 2671176 - protein, 23 aa, Entamoeba histolytica
DELFKKKVSSIFLTLTRCITSSS

SEQ ID NO: 2671177 - protein, 18 aa, Entamoeba histolytica
DELKKAKFPGGIKLDENA

SEQ ID NO: 2671178 - protein, 17 aa, Entamoeba histolytica
DELKKKCLEISNIQEEK

SEQ ID NO: 2671179 - protein, 21 aa, Entamoeba histolytica
DELKQGCSFKTALKRTEGHKI

SEQ ID NO: 2671180 - protein, 17 aa, Entamoeba histolytica
DELKRVAKKKIIMCASG

SEQ ID NO: 2671181 - protein, 24 aa, Entamoeba histolytica
DELKSTILEIGYFYTITLEEICSL

SEQ ID NO: 2671182 - protein, 22 aa, Entamoeba histolytica
DELNLKISYLLQQTKKLNQIAI

SEQ ID NO: 2671183 - protein, 21 aa, Entamoeba histolytica
DELPIKIVIIGDLGVGKTSLI

SEQ ID NO: 2671184 - protein, 19 aa, Entamoeba histolytica
DELSYCIPFTPSIQDKVIN

SEQ ID NO: 2671185 - protein, 22 aa, Entamoeba histolytica
DELWMELIRVCGNDEKEIEVVF

SEQ ID NO: 2671186 - protein, 19 aa, Entamoeba histolytica
DELYCIYIKTLVELCQTII

SEQ ID NO: 2671187 - protein, 36 aa, Entamoeba histolytica
DELYIFLWRFERDGKFDVWRCFYEIDKKITAEYQAL

SEQ ID NO: 2671188 - protein, 20 aa, Entamoeba histolytica
DELYMRVLVDYSTRLKNKYP

SEQ ID NO: 2671189 - protein, 23 aa, Entamoeba histolytica
DEMKEMYYENSLSILFNTDNKEL

SEQ ID NO: 2671190 - protein, 20 aa, Entamoeba histolytica
DEMKEYIISFGGNVATSISG

SEQ ID NO: 2671191 - protein, 20 aa, Entamoeba histolytica
DEMKFMAFDFLKIVKDLDDI

SEQ ID NO: 2671192 - protein, 22 aa, Entamoeba histolytica
DEMWKLGVPVCTIHNEVAPAQY

SEQ ID NO: 2671193 - protein, 23 aa, Entamoeba histolytica
DENEKYLLLNGIIVTLKMANPDY

SEQ ID NO: 2671194 - protein, 29 aa, Entamoeba histolytica
DENGVCYWKIPSMYSGQIIYDILDIDKKG

SEQ ID NO: 2671195 - protein, 24 aa, Entamoeba histolytica
DENIKRNRAVLVHCECGVSRSASV

SEQ ID NO: 2671196 - protein, 19 aa, Entamoeba histolytica
DENIKSFFYSRPVFKPSTI

SEQ ID NO: 2671197 - protein, 18 aa, Entamoeba histolytica
DENKKECWGFRRHPTYIA

SEQ ID NO: 2671198 - protein, 22 aa, Entamoeba histolytica
DENKRWVLSMLLSYDEKQRKQG

SEQ ID NO: 2671199 - protein, 22 aa, Entamoeba histolytica
DENLRKEFDRYLLSHSPDSIKD

SEQ ID NO: 2671200 - protein, 23 aa, Entamoeba histolytica
DENLRKEFDRYLLSHSPDSIKDY

SEQ ID NO: 2671201 - protein, 24 aa, Entamoeba histolytica
DEPEWKKKIGYSLFEQVKALETEI

SEQ ID NO: 2671202 - protein, 22 aa, Entamoeba histolytica
DEPRLMCMYVDKVLSGSHAVQT

SEQ ID NO: 2671203 - protein, 21 aa, Entamoeba histolytica
DEQHYRFILLDDINYDKNTVR

SEQ ID NO: 2671204 - protein, 20 aa, Entamoeba histolytica
DEQKRFTIQQCLNHEFVSLK

SEQ ID NO: 2671205 - protein, 27 aa, Entamoeba histolytica
DEQVEILFYLCEFCDDFKYFEPTFIYI

SEQ ID NO: 2671206 - protein, 18 aa, Entamoeba histolytica
DERFEYFTKIFLQGYSDG

SEQ ID NO: 2671207 - protein, 23 aa, Entamoeba histolytica
DERHQCTIFRQIVYDIINTIVQR

SEQ ID NO: 2671208 - protein, 23 aa, Entamoeba histolytica
DERIYRLAYHVYKTKELIEKYGS

SEQ ID NO: 2671209 - protein, 24 aa, Entamoeba histolytica
DERIYRLAYHVYKTKELIEKYGSK

SEQ ID NO: 2671210 - protein, 24 aa, Entamoeba histolytica
DERKHLFNQWSFIGGDENTTGLVR

SEQ ID NO: 2671211 - protein, 21 aa, Entamoeba histolytica
DERLKRCTIYLGFTSEMMTSG

SEQ ID NO: 2671212 - protein, 20 aa, Entamoeba histolytica
DERYIRFSFNERNRILIALT

SEQ ID NO: 2671213 - protein, 26 aa, Entamoeba histolytica
DESILPCSIDKGFGPVVFYDACGGLE

SEQ ID NO: 2671214 - protein, 25 aa, Entamoeba histolytica
DESVWKRFNATFAYLPILALINKKI

SEQ ID NO: 2671215 - protein, 22 aa, Entamoeba histolytica
DETERRRKLVIEKSQETINQIE

SEQ ID NO: 2671216 - protein, 32 aa, Entamoeba histolytica
DEVEIGRCYRYNCLPIQFCMMLYSLLSVKYAV

SEQ ID NO: 2671217 - protein, 21 aa, Entamoeba histolytica
DEVFPSLSVSLISKTLRSFRL

SEQ ID NO: 2671218 - protein, 21 aa, Entamoeba histolytica
DEVHRLEILITRRTFSLQDLK

SEQ ID NO: 2671219 - protein, 24 aa, Entamoeba histolytica
DEVKRIVADLCDFDPTELIKETMH

SEQ ID NO: 2671220 - protein, 23 aa, Entamoeba histolytica
DEVQRIRKLNGFIDHSKVNGEIV

SEQ ID NO: 2671221 - protein, 17 aa, Entamoeba histolytica
DEVVKCKCGMSYCNTKC

SEQ ID NO: 2671222 - protein, 20 aa, Entamoeba histolytica
DEVVKSLNMAGGDKKVISRL

SEQ ID NO: 2671223 - protein, 23 aa, Entamoeba histolytica
DEWKKRMEELYNKKDVVPKSQLV

SEQ ID NO: 2671224 - protein, 21 aa, Entamoeba histolytica
DEWSSPVVPIEKWEMKYSNGW

SEQ ID NO: 2671225 - protein, 19 aa, Entamoeba histolytica
DEYANGVKFTYDVKKQLMG

SEQ ID NO: 2671226 - protein, 25 aa, Entamoeba histolytica
DEYDERIGKCIISPEVIPPNIIVNF

SEQ ID NO: 2671227 - protein, 18 aa, Entamoeba histolytica
DEYSESGSPFYGEADKPF

SEQ ID NO: 2671228 - protein, 21 aa, Entamoeba histolytica
DEYYCTPCSLNFTKKGDENRM

SEQ ID NO: 2671229 - protein, 17 aa, Entamoeba histolytica
DFAKRGVKRVSIMQEGF

SEQ ID NO: 2671230 - protein, 23 aa, Entamoeba histolytica
DFAYCLFSAKSIRNKKKEELYLS

SEQ ID NO: 2671231 - protein, 26 aa, Entamoeba histolytica
DFCKDKTLIRPQRIVTITKCPSHSSS

SEQ ID NO: 2671232 - protein, 22 aa, Entamoeba histolytica
DFCPSEGTFLLFQAAKCGNENA

SEQ ID NO: 2671233 - protein, 20 aa, Entamoeba histolytica
DFDFLWKKINTFIKSNMSKY

SEQ ID NO: 2671234 - protein, 19 aa, Entamoeba histolytica
DFDGVCSPGSILNPGSIYL

SEQ ID NO: 2671235 - protein, 25 aa, Entamoeba histolytica
DFDIRFYSMELLKGMIKNRQENVRM

SEQ ID NO: 2671236 - protein, 25 aa, Entamoeba histolytica
DFDLLVCKGCALCAQSIGEDISNIL

SEQ ID NO: 2671237 - protein, 20 aa, Entamoeba histolytica
DFDSCWKPFLDTDELFGREI

SEQ ID NO: 2671238 - protein, 17 aa, Entamoeba histolytica
DFECLGFKGDGKGTLHY

SEQ ID NO: 2671239 - protein, 19 aa, Entamoeba histolytica
DFEDFKWILTETNENTNNV

SEQ ID NO: 2671240 - protein, 18 aa, Entamoeba histolytica
DFELWKYLNKLNVDVTCY

SEQ ID NO: 2671241 - protein, 25 aa, Entamoeba histolytica
DFERCLDDFIFFCFLVGNDFLPHIP

SEQ ID NO: 2671242 - protein, 18 aa, Entamoeba histolytica
DFFDDLIENIILTISDKE

SEQ ID NO: 2671243 - protein, 25 aa, Entamoeba histolytica
DFFTDEMKEFLPVIINCSISNIETS

SEQ ID NO: 2671244 - protein, 22 aa, Entamoeba histolytica
DFGHCLFCVNPTSLTVKKYNCI

SEQ ID NO: 2671245 - protein, 18 aa, Entamoeba histolytica
DFGHSVVVVSDWDFVESA

SEQ ID NO: 2671246 - protein, 19 aa, Entamoeba histolytica
DFGLFPCRCQTTACLESNC

SEQ ID NO: 2671247 - protein, 19 aa, Entamoeba histolytica
DFGSACFQDSPLYTYIQSR

SEQ ID NO: 2671248 - protein, 20 aa, Entamoeba histolytica
DFHHSYNLFIQFIIRHIEHS

SEQ ID NO: 2671249 - protein, 17 aa, Entamoeba histolytica
DFHIVRISGKLMYIPHN

SEQ ID NO: 2671250 - protein, 24 aa, Entamoeba histolytica
DFHPKEPWVLAALHTGTIYILNYQ

SEQ ID NO: 2671251 - protein, 21 aa, Entamoeba histolytica
DFHVFEIDNAFTLETNGYIHV

SEQ ID NO: 2671252 - protein, 19 aa, Entamoeba histolytica
DFIEKCFVFDFKKRPQCEE

SEQ ID NO: 2671253 - protein, 19 aa, Entamoeba histolytica
DFIGSPLFMSPEVIKKSFY

SEQ ID NO: 2671254 - protein, 22 aa, Entamoeba histolytica
DFIKICTSIEWVVERTQHFTIL

SEQ ID NO: 2671255 - protein, 18 aa, Entamoeba histolytica
DFIKSMLSANGFEEMSDE

SEQ ID NO: 2671256 - protein, 19 aa, Entamoeba histolytica
DFINIPIKWEESSFEGCSK

SEQ ID NO: 2671257 - protein, 25 aa, Entamoeba histolytica
DFIRKRVEYDPGIKQGDFIVGNMTK

SEQ ID NO: 2671258 - protein, 17 aa, Entamoeba histolytica
DFITYVFESDNDFLVEQ

SEQ ID NO: 2671259 - protein, 18 aa, Entamoeba histolytica
DFITYVFESDNDFLVEQC

SEQ ID NO: 2671260 - protein, 24 aa, Entamoeba histolytica
DFIVCPFCSYSGIMVDPIVYKKST

SEQ ID NO: 2671261 - protein, 21 aa, Entamoeba histolytica
DFKELAQSEVHLFEQASSIFL

SEQ ID NO: 2671262 - protein, 21 aa, Entamoeba histolytica
DFKFLEWRDTNYLPGLHQLID

SEQ ID NO: 2671263 - protein, 24 aa, Entamoeba histolytica
DFKLKGCPVSAILTQNLLAISNKE

SEQ ID NO: 2671264 - protein, 23 aa, Entamoeba histolytica
DFKPDEIVIRYKVHNDAKSFFIT

SEQ ID NO: 2671265 - protein, 17 aa, Entamoeba histolytica
DFKRRIDLLELKIKALP

SEQ ID NO: 2671266 - protein, 24 aa, Entamoeba histolytica
DFLIDIRYAFSITNLLPRIICIGN

SEQ ID NO: 2671267 - protein, 25 aa, Entamoeba histolytica
DFLKIHASNVFSMFKDCPIVKKAVS

SEQ ID NO: 2671268 - protein, 19 aa, Entamoeba histolytica
DFLKKCFFFNPEERWSATQ

SEQ ID NO: 2671269 - protein, 21 aa, Entamoeba histolytica
DFLLFGRTKLLGKIKISKYIE

SEQ ID NO: 2671270 - protein, 18 aa, Entamoeba histolytica
DFLQDYCHLVKMVSCKKH

SEQ ID NO: 2671271 - protein, 17 aa, Entamoeba histolytica
DFMLKKLINAERMTMYN

SEQ ID NO: 2671272 - protein, 19 aa, Entamoeba histolytica
DFNFLFTFIRELRSKFNEY

SEQ ID NO: 2671273 - protein, 20 aa, Entamoeba histolytica
DFNKNCYLDGKSLILKNELK

SEQ ID NO: 2671274 - protein, 20 aa, Entamoeba histolytica
DFNSSCLIYSVLSIFCSDIR

SEQ ID NO: 2671275 - protein, 28 aa, Entamoeba histolytica
DFNSTIPKSQPASVIKSRTNAFNFDQPK

SEQ ID NO: 2671276 - protein, 27 aa, Entamoeba histolytica
DFNSTIPKSQPASVIKSRTNAFNFDQQ

SEQ ID NO: 2671277 - protein, 23 aa, Entamoeba histolytica
DFPELIQLICIWDKEALKRRIYN

SEQ ID NO: 2671278 - protein, 27 aa, Entamoeba histolytica
DFPKTKLICCWVEKSTCNNLIDLAHHS

SEQ ID NO: 2671279 - protein, 25 aa, Entamoeba histolytica
DFPPVKGKPSWSIKSIFLGKKSYLD

SEQ ID NO: 2671280 - protein, 19 aa, Entamoeba histolytica
DFRGWSVVHHAIYEDKVEF

SEQ ID NO: 2671281 - protein, 22 aa, Entamoeba histolytica
DFRIFLDVFFEGVRSPSFIIYT

SEQ ID NO: 2671282 - protein, 19 aa, Entamoeba histolytica
DFRSFGGYGNEPGKFNEPM

SEQ ID NO: 2671283 - protein, 23 aa, Entamoeba histolytica
DFRSPRTGLYFNLQKYNLPYPEA

SEQ ID NO: 2671284 - protein, 19 aa, Entamoeba histolytica
DFRSRNGMWKRYEPKVYAS

SEQ ID NO: 2671285 - protein, 21 aa, Entamoeba histolytica
DFSDCKGLLLGTPTIVGDALP

SEQ ID NO: 2671286 - protein, 24 aa, Entamoeba histolytica
DFSSIIEFLGNINLHLINKEYSSN

SEQ ID NO: 2671287 - protein, 23 aa, Entamoeba histolytica
DFSSMKTFVVFIVLDNPSNESIL

SEQ ID NO: 2671288 - protein, 22 aa, Entamoeba histolytica
DFTCLHLHFVVVQFDSVSDSIV

SEQ ID NO: 2671289 - protein, 23 aa, Entamoeba histolytica
DFTDEEKRLLGLSQETTQTGLFN

SEQ ID NO: 2671290 - protein, 24 aa, Entamoeba histolytica
DFTNQRLCKSVQFDKQLGLDSSFD

SEQ ID NO: 2671291 - protein, 20 aa, Entamoeba histolytica
DFTRRSFLSSITKTSLPSLF

SEQ ID NO: 2671292 - protein, 25 aa, Entamoeba histolytica
DFTTNRVEGFFGHLKKIINHNNLPL

SEQ ID NO: 2671293 - protein, 20 aa, Entamoeba histolytica
DFVRCPQCQGYIPKNNTKSI

SEQ ID NO: 2671294 - protein, 25 aa, Entamoeba histolytica
DFVTIKGIVKVRWISYNIDEIPELE

SEQ ID NO: 2671295 - protein, 25 aa, Entamoeba histolytica
DFYVPDIIGALILSMSKRIMNELIY

SEQ ID NO: 2671296 - protein, 24 aa, Entamoeba histolytica
DFYVPDIIGSLILSMSKRIMNELI

SEQ ID NO: 2671297 - protein, 23 aa, Entamoeba histolytica
DGAPCGLLNHFAVSCRINARKHP

SEQ ID NO: 2671298 - protein, 26 aa, Entamoeba histolytica
DGAVYVWNLTTSKFACCVYPEVNVQQ

SEQ ID NO: 2671299 - protein, 20 aa, Entamoeba histolytica
DGCFIKCLLEKGEITLSDPR

SEQ ID NO: 2671300 - protein, 21 aa, Entamoeba histolytica
DGCPAFYKFLDLLGTKIELQG

SEQ ID NO: 2671301 - protein, 22 aa, Entamoeba histolytica
DGDFLLKWSFSNMKGVIENLKC

SEQ ID NO: 2671302 - protein, 23 aa, Entamoeba histolytica
DGDGWKPTSKFVHSREQEEGIYR

SEQ ID NO: 2671303 - protein, 26 aa, Entamoeba histolytica
DGDKALELWYNFYYLFEGIFNHSLNE

SEQ ID NO: 2671304 - protein, 22 aa, Entamoeba histolytica
DGDKINVLFSFIRTHTNSKMIV

SEQ ID NO: 2671305 - protein, 29 aa, Entamoeba histolytica
DGDKRINIIIKCLNKIILDKKEIDSVALQ

SEQ ID NO: 2671306 - protein, 24 aa, Entamoeba histolytica
DGEFKLKLLHDGLISNFEFQNYIL

SEQ ID NO: 2671307 - protein, 22 aa, Entamoeba histolytica
DGEMLNCLILANYVVQNSPNFR

SEQ ID NO: 2671308 - protein, 23 aa, Entamoeba histolytica
DGEPADCILYYNYRDKYTYERFF

SEQ ID NO: 2671309 - protein, 20 aa, Entamoeba histolytica
DGESPIIMFLKAINQKIIGP

SEQ ID NO: 2671310 - protein, 30 aa, Entamoeba histolytica
DGESYPDFFLNDWFSLKEFQNFEGQIKQSS

SEQ ID NO: 2671311 - protein, 19 aa, Entamoeba histolytica
DGETIREKRVKEKESKNQE

SEQ ID NO: 2671312 - protein, 18 aa, Entamoeba histolytica
DGFGYRPTLDKLPELSLP

SEQ ID NO: 2671313 - protein, 17 aa, Entamoeba histolytica
DGFHSEGVFRLAGQAGL

SEQ ID NO: 2671314 - protein, 18 aa, Entamoeba histolytica
DGFRACNSLEYLNLSNNS

SEQ ID NO: 2671315 - protein, 18 aa, Entamoeba histolytica
DGFYLRTGKKREVLGAEQ

SEQ ID NO: 2671316 - protein, 21 aa, Entamoeba histolytica
DGGHLIWCIVFEKLANTQFRV

SEQ ID NO: 2671317 - protein, 20 aa, Entamoeba histolytica
DGGIELYKILPSFKNVKKLD

SEQ ID NO: 2671318 - protein, 25 aa, Entamoeba histolytica
DGGVSRSDCMLQFQADICNCTVIRL

SEQ ID NO: 2671319 - protein, 20 aa, Entamoeba histolytica
DGHLLWRINEVLANRYQLIK

SEQ ID NO: 2671320 - protein, 36 aa, Entamoeba histolytica; identical to SEQ ID NO: 2476964

SEQ ID NO: 2671321 - protein, 20 aa, Entamoeba histolytica
DGHVKLADFGYAAQLNQKQK

SEQ ID NO: 2671322 - protein, 25 aa, Entamoeba histolytica
DGICASELRDFCSMLNDHDELTLMY

SEQ ID NO: 2671323 - protein, 24 aa, Entamoeba histolytica
DGIIKHFACVSIRERDSWVEALLD

SEQ ID NO: 2671324 - protein, 26 aa, Entamoeba histolytica
DGILDKLEFRSCLSSMGLIDIDFTGG

SEQ ID NO: 2671325 - protein, 21 aa, Entamoeba histolytica
DGILPGDRIKAVTNRVTIDVD

SEQ ID NO: 2671326 - protein, 17 aa, Entamoeba histolytica
DGIRFNPDIVVCGMQEL

SEQ ID NO: 2671327 - protein, 19 aa, Entamoeba histolytica
DGISRKIFERWCTDKKNGV

SEQ ID NO: 2671328 - protein, 22 aa, Entamoeba histolytica
DGITRPPFVQLLLKVNPAMYLY

SEQ ID NO: 2671329 - protein, 25 aa, Entamoeba histolytica
DGIWAALCWVSILAAESERAQRLVG

SEQ ID NO: 2671330 - protein, 19 aa, Entamoeba histolytica
DGKAGYLFMRSQKTGKMKR

SEQ ID NO: 2671331 - protein, 25 aa, Entamoeba histolytica
DGKELMKLGAKFIYLSNGSFMQKSG

SEQ ID NO: 2671332 - protein, 25 aa, Entamoeba histolytica
DGKIFKYVIWYKVEYSRYLEEKEEM

SEQ ID NO: 2671333 - protein, 19 aa, Entamoeba histolytica
DGKIKIWNVRSLYEDNVED

SEQ ID NO: 2671334 - protein, 18 aa, Entamoeba histolytica
DGKLFALRNLCILRDQII

SEQ ID NO: 2671335 - protein, 20 aa, Entamoeba histolytica
DGKQLWSYCHKNFISDIQWK

SEQ ID NO: 2671336 - protein, 26 aa, Entamoeba histolytica
DGKRFHLTEGFLFYPNSEYIPFTNNY

SEQ ID NO: 2671337 - protein, 18 aa, Entamoeba histolytica
DGKRRIRYFGGLKFVTPG

SEQ ID NO: 2671338 - protein, 21 aa, Entamoeba histolytica
DGKRYFKQCEFKLWRKQPQPI

SEQ ID NO: 2671339 - protein, 19 aa, Entamoeba histolytica
DGKSIIWEILKQLRPGMSL

SEQ ID NO: 2671340 - protein, 18 aa, Entamoeba histolytica
DGKSSLGNFILKDNKFET

SEQ ID NO: 2671341 - protein, 23 aa, Entamoeba histolytica
DGKVCYCDSCKGLVKPDIVFFGE

SEQ ID NO: 2671342 - protein, 20 aa, Entamoeba histolytica
DGKVFCALIHRHRPDLLDWE

SEQ ID NO: 2671343 - protein, 18 aa, Entamoeba histolytica
DGKYYLKNHCEINEDIKF

SEQ ID NO: 2671344 - protein, 25 aa, Entamoeba histolytica
DGLISDIWSCGVILYVMAFGLMPFD

SEQ ID NO: 2671345 - protein, 26 aa, Entamoeba histolytica
DGLKSGMGGNGFAREGGFPGGTYTFT

SEQ ID NO: 2671346 - protein, 17 aa, Entamoeba histolytica
DGLKWLELFEDELIGRV

SEQ ID NO: 2671347 - protein, 28 aa, Entamoeba histolytica
DGLVIIRGKLVWKITVCVHIINDCGNLM

SEQ ID NO: 2671348 - protein, 20 aa, Entamoeba histolytica
DGNWLIKRNVTLGEKDIGIY

SEQ ID NO: 2671349 - protein, 20 aa, Entamoeba histolytica
DGPESVTCAFDCAVNLGYRG

SEQ ID NO: 2671350 - protein, 17 aa, Entamoeba histolytica
DGPIEFLNKILAIPIKF

SEQ ID NO: 2671351 - protein, 24 aa, Entamoeba histolytica
DGPMIIEMVRLLQITPVEEFIPDD

SEQ ID NO: 2671352 - protein, 20 aa, Entamoeba histolytica
DGPSGLRIGSKLFIKNSTSF

SEQ ID NO: 2671353 - protein, 24 aa, Entamoeba histolytica
DGQFLGATGMYPPRIRMFELDQLS

SEQ ID NO: 2671354 - protein, 18 aa, Entamoeba histolytica
DGQPSLDNGEYWDQIISR

SEQ ID NO: 2671355 - protein, 22 aa, Entamoeba histolytica
DGQYKITNWKSPKIMCTNEGGV

SEQ ID NO: 2671356 - protein, 18 aa, Entamoeba histolytica
DGRFFHIDFGHFLGHFKS

SEQ ID NO: 2671357 - protein, 22 aa, Entamoeba histolytica
DGRIIKYVIWYKVNYSRYLKEK

SEQ ID NO: 2671358 - protein, 20 aa, Entamoeba histolytica
DGRITYPLVLIYSSPTGINP

SEQ ID NO: 2671359 - protein, 18 aa, Entamoeba histolytica
DGRLEIIFEKDVNGAVYS

SEQ ID NO: 2671360 - protein, 17 aa, Entamoeba histolytica
DGRRRYCHCKREVYQRS

SEQ ID NO: 2671361 - protein, 27 aa, Entamoeba histolytica
DGSVMAVSFKTAITIWDVLSNKLLFSL

SEQ ID NO: 2671362 - protein, 19 aa, Entamoeba histolytica
DGTCIRDYIHVVDLAQGHV

SEQ ID NO: 2671363 - protein, 25 aa, Entamoeba histolytica
DGTIPVFRIDVSKWVEQTYFDKQIP

SEQ ID NO: 2671364 - protein, 23 aa, Entamoeba histolytica
DGTKLLYNFALIVAHNAAATVSE

SEQ ID NO: 2671365 - protein, 22 aa, Entamoeba histolytica
DGVEFKSKFIPIIYNEENGQEL

SEQ ID NO: 2671366 - protein, 31 aa, Entamoeba histolytica
DGVGIIPLDCPWYICYFMGRPQAHFVCTTQN

SEQ ID NO: 2671367 - protein, 20 aa, Entamoeba histolytica
DGVGRIGYPLAKKVLNEYKR

SEQ ID NO: 2671368 - protein, 19 aa, Entamoeba histolytica
DGVLFECAMRKLWGEKRIR

SEQ ID NO: 2671369 - protein, 24 aa, Entamoeba histolytica
DGWICFKNSQLLSGQIEKSIIGSG

SEQ ID NO: 2671370 - protein, 17 aa, Entamoeba histolytica
DGWSNYITSFSIDSIEY

SEQ ID NO: 2671371 - protein, 30 aa, Entamoeba histolytica
DGYEYSNYFILFLLCINFLYRQNNYAFEFD

SEQ ID NO: 2671372 - protein, 26 aa, Entamoeba histolytica
DGYHPYRVILCRVVLGREGRDYVVKY

SEQ ID NO: 2671373 - protein, 19 aa, Entamoeba histolytica
DGYISYWRLFRNGRWKPVK

SEQ ID NO: 2671374 - protein, 20 aa, Entamoeba histolytica
DGYLWVAMEYMDGGCLTDLL

SEQ ID NO: 2671375 - protein, 19 aa, Entamoeba histolytica
DGYLYILIREFGFSAKLKQ

SEQ ID NO: 2671376 - protein, 20 aa, Entamoeba histolytica
DGYYSKIMCCNKIQLTKTKE

SEQ ID NO: 2671377 - protein, 22 aa, Entamoeba histolytica
DHFLCHGGMRTVEFKVVDIDPS

SEQ ID NO: 2671378 - protein, 18 aa, Entamoeba histolytica
DHFYEVLSNNALKRFNNF

SEQ ID NO: 2671379 - protein, 18 aa, Entamoeba histolytica
DHGKKYMFSLTWNAPLEA

SEQ ID NO: 2671380 - protein, 21 aa, Entamoeba histolytica
DHHNPSLIVLCHIVDDMYKYY

SEQ ID NO: 2671381 - protein, 21 aa, Entamoeba histolytica
DHHPPRFNHLLKIVGDIVDYV

SEQ ID NO: 2671382 - protein, 19 aa, Entamoeba histolytica
DHHPPRFNHLLKVVGEIVK

SEQ ID NO: 2671383 - protein, 19 aa, Entamoeba histolytica
DHIKKWLNKCEIKSYETVQ

SEQ ID NO: 2671384 - protein, 18 aa, Entamoeba histolytica
DHISEFELPGPLPLPKEF

SEQ ID NO: 2671385 - protein, 22 aa, Entamoeba histolytica
DHIVICAPFLKNQYVSYSLKKL

SEQ ID NO: 2671386 - protein, 22 aa, Entamoeba histolytica
DHKIACSFKPYGLYDGNKNVIG

SEQ ID NO: 2671387 - protein, 21 aa, Entamoeba histolytica
DHKMYIFQFMFMINNDADMPK

SEQ ID NO: 2671388 - protein, 21 aa, Entamoeba histolytica
DHKMYIFQFMFMINNDTDTPK

SEQ ID NO: 2671389 - protein, 18 aa, Entamoeba histolytica
DHLISLGNHCFVNCNKLL

SEQ ID NO: 2671390 - protein, 23 aa, Entamoeba histolytica
DHLKRCFQAGFGFALTKTYPLEK

SEQ ID NO: 2671391 - protein, 17 aa, Entamoeba histolytica
DHLPEFKESCWRVAFNG

SEQ ID NO: 2671392 - protein, 22 aa, Entamoeba histolytica
DHLPVRCIAIIKPRKINTSLLK

SEQ ID NO: 2671393 - protein, 22 aa, Entamoeba histolytica
DHMGRTALHYCALYGNAVMANI

SEQ ID NO: 2671394 - protein, 22 aa, Entamoeba histolytica
DHMPRYESVVLLVSCVGTISRT

SEQ ID NO: 2671395 - protein, 19 aa, Entamoeba histolytica
DHMYRMAILAMIFCPSHLD

SEQ ID NO: 2671396 - protein, 23 aa, Entamoeba histolytica
DHPIIGDLLRWLIDIRNYSVRCV

SEQ ID NO: 2671397 - protein, 25 aa, Entamoeba histolytica
DHPNLIKMIGCWLFGNQVFISMEYC

SEQ ID NO: 2671398 - protein, 22 aa, Entamoeba histolytica
DHPNLIKTIGCFLYDHKVYIGM

SEQ ID NO: 2671399 - protein, 19 aa, Entamoeba histolytica
DHPYIIKLYDVFDGNDGKL

SEQ ID NO: 2671400 - protein, 26 aa, Entamoeba histolytica
DHQPIIFKFFFKDDVKLGNVIIVCRP

SEQ ID NO: 2671401 - protein, 23 aa, Entamoeba histolytica
DHRMPIHLFTYIHGISYHLLEIV

SEQ ID NO: 2671402 - protein, 19 aa, Entamoeba histolytica
DHSMLCLHAGISPDLKNIG

SEQ ID NO: 2671403 - protein, 18 aa, Entamoeba histolytica
DHSSIFEHFLLRSKEKEM

SEQ ID NO: 2671404 - protein, 18 aa, Entamoeba histolytica
DHSVFKIQIIIDVDPVFT

SEQ ID NO: 2671405 - protein, 26 aa, Entamoeba histolytica
DHVIPGQKVSFCICKIRKGKCPGGSV

SEQ ID NO: 2671406 - protein, 25 aa, Entamoeba histolytica
DHVSGIIALLFNWILNDCDVYLPEG

SEQ ID NO: 2671407 - protein, 23 aa, Entamoeba histolytica
DHYKKRKGYKHKRHSISSYDQSS

SEQ ID NO: 2671408 - protein, 25 aa, Entamoeba histolytica
DIACGLRKCATCNQTNLPLIGKTQY

SEQ ID NO: 2671409 - protein, 24 aa, Entamoeba histolytica
DIAGLRKQYDYVFVGCGRQKPYTF

SEQ ID NO: 2671410 - protein, 26 aa, Entamoeba histolytica
DIAKIIYRLAYHVYKTKELIEKYGSE

SEQ ID NO: 2671411 - protein, 26 aa, Entamoeba histolytica
DIALSLIGGFVFLRLFCPALAAPEGS

SEQ ID NO: 2671412 - protein, 24 aa, Entamoeba histolytica
DIASCIRYLFFFIGSSIVDFTQTI

SEQ ID NO: 2671413 - protein, 23 aa, Entamoeba histolytica
DICILKKGIKWFIQLYGNLINSN

SEQ ID NO: 2671414 - protein, 22 aa, Entamoeba histolytica
DICKNCDLMDNFIEEIKDDKIN

SEQ ID NO: 2671415 - protein, 20 aa, Entamoeba histolytica
DICSNVDSFFEKGVIIKSII

SEQ ID NO: 2671416 - protein, 30 aa, Entamoeba histolytica
DIDEQWKLTEIKGIEFIKESNGMIICNKHK

SEQ ID NO: 2671417 - protein, 23 aa, Entamoeba histolytica
DIDKEIPAIVNVLKPSSEKLSIM

SEQ ID NO: 2671418 - protein, 27 aa, Entamoeba histolytica
DIDLLLKKCQSEGGLQSFMSDYEQTMK

SEQ ID NO: 2671419 - protein, 18 aa, Entamoeba histolytica
DIDVSFQLLNIFSSDNAQ

SEQ ID NO: 2671420 - protein, 41 aa, Entamoeba histolytica; identical to SEQ ID NO: 2477083

SEQ ID NO: 2671421 - protein, 21 aa, Entamoeba histolytica
DIEAAALCLKTMHSVEKKNVL

SEQ ID NO: 2671422 - protein, 25 aa, Entamoeba histolytica
DIEELSHAVYIYWRAKEMVKTKEYE

SEQ ID NO: 2671423 - protein, 24 aa, Entamoeba histolytica
DIEFVRKSVQAFGKCALKLEKVAD

SEQ ID NO: 2671424 - protein, 21 aa, Entamoeba histolytica
DIEGAWEIFFRIYKRIHKSIN

SEQ ID NO: 2671425 - protein, 24 aa, Entamoeba histolytica
DIEGYPFRIAVVFQSPQQLLSSAL

SEQ ID NO: 2671426 - protein, 24 aa, Entamoeba histolytica
DIEHYTRTDLFPWREEMPEVQTIR

SEQ ID NO: 2671427 - protein, 25 aa, Entamoeba histolytica
DIEKEMVCHVLTFKYPFNSEITKFD

SEQ ID NO: 2671428 - protein, 18 aa, Entamoeba histolytica
DIEKGICITNAFNNAFLT

SEQ ID NO: 2671429 - protein, 24 aa, Entamoeba histolytica
DIEKIKIALELSRYNHLHDLRKYI

SEQ ID NO: 2671430 - protein, 20 aa, Entamoeba histolytica
DIELGKKLYEFARYWNERNV

SEQ ID NO: 2671431 - protein, 28 aa, Entamoeba histolytica
DIEYLCGVLQMIVSFSMPSFLYHIENVE

SEQ ID NO: 2671432 - protein, 17 aa, Entamoeba histolytica
DIFGCFQKEPLPFSNEY

SEQ ID NO: 2671433 - protein, 27 aa, Entamoeba histolytica
DIFKLEDICFQFSMKIHSLTIPQIQYP

SEQ ID NO: 2671434 - protein, 23 aa, Entamoeba histolytica
DIFKSSHPLPSRPKSLSRSVPTL

SEQ ID NO: 2671435 - protein, 25 aa, Entamoeba histolytica
DIFSVNYYLSFDFIDEEGMKYNCAT

SEQ ID NO: 2671436 - protein, 24 aa, Entamoeba histolytica
DIFTQMFWELSMKNFDDFITKLVT

SEQ ID NO: 2671437 - protein, 20 aa, Entamoeba histolytica
DIGCTCTLIYIWEEDNKVYI

SEQ ID NO: 2671438 - protein, 19 aa, Entamoeba histolytica
DIGDFFCCHGGISPDMTTI

SEQ ID NO: 2671439 - protein, 25 aa, Entamoeba histolytica
DIGDNIEVVLKWRRGDKKENKGTIE

SEQ ID NO: 2671440 - protein, 19 aa, Entamoeba histolytica
DIGGSFAIKNIKYNDKYDS

SEQ ID NO: 2671441 - protein, 17 aa, Entamoeba histolytica
DIGKALRMPDLEEAHAY

SEQ ID NO: 2671442 - protein, 18 aa, Entamoeba histolytica
DIGYTKLRVPKLVKAENI

SEQ ID NO: 2671443 - protein, 18 aa, Entamoeba histolytica
DIHFLVSVVYTLPRLDLD

SEQ ID NO: 2671444 - protein, 19 aa, Entamoeba histolytica
DIHIFDIINSYPLKITPCE

SEQ ID NO: 2671445 - protein, 25 aa, Entamoeba histolytica
DIHPLATPCLFSFNANNYYFSLSID

SEQ ID NO: 2671446 - protein, 33 aa, Entamoeba histolytica
DIHQFCIGFYFSIQSIKEWEWISVGQNSFAFIS

SEQ ID NO: 2671447 - protein, 27 aa, Entamoeba histolytica
DIHRVIRCGFILSGGPAAGGHNVVAGL

SEQ ID NO: 2671448 - protein, 18 aa, Entamoeba histolytica
DIIEIAVVLVRFKCDYTI

SEQ ID NO: 2671449 - protein, 20 aa, Entamoeba histolytica
DIIFIKNLYIKNSFYEIRIF

SEQ ID NO: 2671450 - protein, 19 aa, Entamoeba histolytica
DIIICDWMGINLYYDSLLN

SEQ ID NO: 2671451 - protein, 18 aa, Entamoeba histolytica
DIIIPCFSFVRDIIHAPI

SEQ ID NO: 2671452 - protein, 20 aa, Entamoeba histolytica
DIIIPPRINTSIMVTPTEIQ

SEQ ID NO: 2671453 - protein, 25 aa, Entamoeba histolytica
DIINRLPSLPLYRIEVLCDDNNYSI

SEQ ID NO: 2671454 - protein, 27 aa, Entamoeba histolytica
DIIPLYDSVCIRFREGYQMEYWYYYLK

SEQ ID NO: 2671455 - protein, 18 aa, Entamoeba histolytica
DIIPRGYAFPNSNTCTKE

SEQ ID NO: 2671456 - protein, 21 aa, Entamoeba histolytica
DIIPVVFRYYEKVIITKPNKY

SEQ ID NO: 2671457 - protein, 24 aa, Entamoeba histolytica
DIIQVCLKACKFIAQHDLMENVDM

SEQ ID NO: 2671458 - protein, 18 aa, Entamoeba histolytica
DIIRLKKLVEECSNKMPL

SEQ ID NO: 2671459 - protein, 18 aa, Entamoeba histolytica
DIITCFIYSYTNKKTNQL

SEQ ID NO: 2671460 - protein, 23 aa, Entamoeba histolytica
DIIWPEFKSLISTRGEQITINIK

SEQ ID NO: 2671461 - protein, 32 aa, Entamoeba histolytica
DIIYKLTELFITFNFSNTFLYFMSRALVELHA

SEQ ID NO: 2671462 - protein, 22 aa, Entamoeba histolytica
DIKAVCYMECSALTRSGLNQVF

SEQ ID NO: 2671463 - protein, 27 aa, Entamoeba histolytica
DIKCASLALKITKIWMQKSINKEVAEL

SEQ ID NO: 2671464 - protein, 20 aa, Entamoeba histolytica
DIKDLRCFGLGIGPITWMKG

SEQ ID NO: 2671465 - protein, 25 aa, Entamoeba histolytica
DIKDSEAYLYLLHHLNNNCSLEALN

SEQ ID NO: 2671466 - protein, 22 aa, Entamoeba histolytica
DIKKCCFSYCTETAIGTLKFIH

SEQ ID NO: 2671467 - protein, 19 aa, Entamoeba histolytica
DIKKEFKDILDAFRIRATE

SEQ ID NO: 2671468 - protein, 19 aa, Entamoeba histolytica
DIKPKRVVFKLVEEYIKVP

SEQ ID NO: 2671469 - protein, 19 aa, Entamoeba histolytica
DIKSVFTAVFRLLDIKDQG

SEQ ID NO: 2671470 - protein, 19 aa, Entamoeba histolytica
DIKTFVWKQHPVVLEDFQD

SEQ ID NO: 2671471 - protein, 22 aa, Entamoeba histolytica
DIKVMYLCMFFVLKNISYSTMK

SEQ ID NO: 2671472 - protein, 26 aa, Entamoeba histolytica
DILDRLIEIVAFPRLYYKTIPLPFDY

SEQ ID NO: 2671473 - protein, 20 aa, Entamoeba histolytica
DILFEYPHTFIWQENDSILF

SEQ ID NO: 2671474 - protein, 24 aa, Entamoeba histolytica
DILGRLKKGLIYNFGSNTCWHLYG

SEQ ID NO: 2671475 - protein, 23 aa, Entamoeba histolytica
DILKDLQDGIILSRYLQIETGKV

SEQ ID NO: 2671476 - protein, 20 aa, Entamoeba histolytica
DILKEPRYNPHIDFLTVPHP

SEQ ID NO: 2671477 - protein, 17 aa, Entamoeba histolytica
DILKGFYPETIFNEENN

SEQ ID NO: 2671478 - protein, 17 aa, Entamoeba histolytica
DILNGFRIIGDLGEENG

SEQ ID NO: 2671479 - protein, 20 aa, Entamoeba histolytica
DILPCFYDSIELLHYLYSLT

SEQ ID NO: 2671480 - protein, 23 aa, Entamoeba histolytica
DILPFVCPDNIVVGGWDISKVNM

SEQ ID NO: 2671481 - protein, 22 aa, Entamoeba histolytica
DILRRAFMSRMFPSETIKKLGI

SEQ ID NO: 2671482 - protein, 22 aa, Entamoeba histolytica
DILTEYGYYFTAHPMKGKSETK

SEQ ID NO: 2671483 - protein, 25 aa, Entamoeba histolytica
DILVKRIIPLMGICDDEFIKMIMDI

SEQ ID NO: 2671484 - protein, 17 aa, Entamoeba histolytica
DIMKCLPPDATIEQIEY

SEQ ID NO: 2671485 - protein, 24 aa, Entamoeba histolytica
DIMLKYHVITVFVLIAQKKLVPHL

SEQ ID NO: 2671486 - protein, 24 aa, Entamoeba histolytica
DIMPFERLSILIKYIHARNHHQIL

SEQ ID NO: 2671487 - protein, 26 aa, Entamoeba histolytica
DINEFSRLMLVPLKRLSSGDEKVIEV

SEQ ID NO: 2671488 - protein, 27 aa, Entamoeba histolytica
DINEYKVDFCFRDCIGIKYKQTRKSSL

SEQ ID NO: 2671489 - protein, 22 aa, Entamoeba histolytica
DINKFCRIFNPPTCNCNLLPVD

SEQ ID NO: 2671490 - protein, 23 aa, Entamoeba histolytica
DINKLIIRRIIRTEYKVAYPNLY

SEQ ID NO: 2671491 - protein, 20 aa, Entamoeba histolytica
DINTLCSFYGFNILSKKGLS

SEQ ID NO: 2671492 - protein, 23 aa, Entamoeba histolytica
DIPEDRKRYFTSFYAIVNDPSVA

SEQ ID NO: 2671493 - protein, 17 aa, Entamoeba histolytica
DIPEIYPNFEFHGKYAK

SEQ ID NO: 2671494 - protein, 26 aa, Entamoeba histolytica
DIPENIFWCKYFRFLYTKCGKEKQYQ

SEQ ID NO: 2671495 - protein, 18 aa, Entamoeba histolytica
DIPFIPFAPFIEQVENLC

SEQ ID NO: 2671496 - protein, 19 aa, Entamoeba histolytica
DIPPSVTFSKDFQFISEYQ

SEQ ID NO: 2671497 - protein, 22 aa, Entamoeba histolytica
DIQDCFSEFCDLILSINEQTLF

SEQ ID NO: 2671498 - protein, 17 aa, Entamoeba histolytica
DIQELISHIFVIDPEQR

SEQ ID NO: 2671499 - protein, 20 aa, Entamoeba histolytica
DIQFFNGIIVIAFKKEIYRI

SEQ ID NO: 2671500 - protein, 32 aa, Entamoeba histolytica
DIQFKQDVVIKICWLTDKFGPDIKWKFDSMLE

SEQ ID NO: 2671501 - protein, 20 aa, Entamoeba histolytica
DIQHYFEIFSQYDSKACKWL

SEQ ID NO: 2671502 - protein, 24 aa, Entamoeba histolytica
DIQKSARVKQVFLLLKSLPEENYT

SEQ ID NO: 2671503 - protein, 25 aa, Entamoeba histolytica
DIQLPEYLICPSLSLDQWYIIILCF

SEQ ID NO: 2671504 - protein, 25 aa, Entamoeba histolytica
DIQNSWIFGVGYGFHIRGEDKSYIG

SEQ ID NO: 2671505 - protein, 18 aa, Entamoeba histolytica
DIQQGCLGDCYFLAALAS

SEQ ID NO: 2671506 - protein, 18 aa, Entamoeba histolytica
DIQYFWKNYILQLTDIKD

SEQ ID NO: 2671507 - protein, 21 aa, Entamoeba histolytica
DIREGHALLAIMKQITHTNVK

SEQ ID NO: 2671508 - protein, 23 aa, Entamoeba histolytica
DIRKSPDLLIWAVYNLVRGVDYL

SEQ ID NO: 2671509 - protein, 19 aa, Entamoeba histolytica
DIRMERCGYTIPAHSTIVT

SEQ ID NO: 2671510 - protein, 24 aa, Entamoeba histolytica
DIRNEVKCDLSLASRIVEIGSEKG

SEQ ID NO: 2671511 - protein, 22 aa, Entamoeba histolytica
DIRQFARLIAILNRGFGKDIKS

SEQ ID NO: 2671512 - protein, 18 aa, Entamoeba histolytica
DISGSFGRTTKKQSDTST

SEQ ID NO: 2671513 - protein, 18 aa, Entamoeba histolytica
DISSFPWETLASTLKRFV

SEQ ID NO: 2671514 - protein, 17 aa, Entamoeba histolytica
DISSLAWYFNQLTPNGV

SEQ ID NO: 2671515 - protein, 21 aa, Entamoeba histolytica
DITGILEAYVSFKTNRTEKQT

SEQ ID NO: 2671516 - protein, 18 aa, Entamoeba histolytica
DITLYKYIWKCITNSRLN

SEQ ID NO: 2671517 - protein, 20 aa, Entamoeba histolytica
DITNGYKWLLLAYIPDRAKV

SEQ ID NO: 2671518 - protein, 19 aa, Entamoeba histolytica
DITVIAWGFGLERPTMISY

SEQ ID NO: 2671519 - protein, 25 aa, Entamoeba histolytica
DIVGKDDKRTCCFTKSYTKIVEGTG

SEQ ID NO: 2671520 - protein, 24 aa, Entamoeba histolytica
DIVHSYFEGMNWVLGYYYKGCQSW

SEQ ID NO: 2671521 - protein, 17 aa, Entamoeba histolytica
DIVIWMGDLNYRIEMSD

SEQ ID NO: 2671522 - protein, 26 aa, Entamoeba histolytica
DIVLCKYCDFIYIAVTEDIVFSNNIK

SEQ ID NO: 2671523 - protein, 23 aa, Entamoeba histolytica
DIVLEKYFPVYLLIRQYLLISQK

SEQ ID NO: 2671524 - protein, 21 aa, Entamoeba histolytica
DIVNLPIEELVSLMNDKYQQV

SEQ ID NO: 2671525 - protein, 18 aa, Entamoeba histolytica
DIVNRYGLVIFDYNGDSR

SEQ ID NO: 2671526 - protein, 19 aa, Entamoeba histolytica
DIVPIPIGIEVEGGKFEVL

SEQ ID NO: 2671527 - protein, 19 aa, Entamoeba histolytica
DIVRPRKLLYIAIDGVAPR

SEQ ID NO: 2671528 - protein, 19 aa, Entamoeba histolytica
DIWLHVIPQIIARIQSNVP

SEQ ID NO: 2671529 - protein, 25 aa, Entamoeba histolytica
DIWQEIKILLDITMKYFPQIVSTCD

SEQ ID NO: 2671530 - protein, 25 aa, Entamoeba histolytica
DIWSYGCILAEMFLGKPLFPGSSTS

SEQ ID NO: 2671531 - protein, 17 aa, Entamoeba histolytica
DIYDEDHFIFSLENHNR

SEQ ID NO: 2671532 - protein, 18 aa, Entamoeba histolytica
DIYIKKLLLRISENDDFT

SEQ ID NO: 2671533 - protein, 19 aa, Entamoeba histolytica
DIYLKKGVILLFYTDYYLQ

SEQ ID NO: 2671534 - protein, 17 aa, Entamoeba histolytica
DIYPEWDNEITITPQNI

SEQ ID NO: 2671535 - protein, 19 aa, Entamoeba histolytica
DIYSGYFFHVEFVGEALKS

SEQ ID NO: 2671536 - protein, 21 aa, Entamoeba histolytica
DIYSLGLVIWFVFESKGTDPF

SEQ ID NO: 2671537 - protein, 18 aa, Entamoeba histolytica
DIYTVGIMPCIAKKVESQ

SEQ ID NO: 2671538 - protein, 19 aa, Entamoeba histolytica
DKAMSTCQYFFPEMSADFF

SEQ ID NO: 2671539 - protein, 26 aa, Entamoeba histolytica
DKARGAAPCVLFFDELDSIAQSRGSN

SEQ ID NO: 2671540 - protein, 25 aa, Entamoeba histolytica
DKARQAAPCVLFFDELDSIGRARGG

SEQ ID NO: 2671541 - protein, 27 aa, Entamoeba histolytica
DKCKERVLKMVLVWCKKCDSLWLSMNS

SEQ ID NO: 2671542 - protein, 28 aa, Entamoeba histolytica
DKCKERVLKMVLVWCKKCDSLWLSMNSF

SEQ ID NO: 2671543 - protein, 24 aa, Entamoeba histolytica
DKCKKMCSVVRNFDKINSIHYSIS

SEQ ID NO: 2671544 - protein, 28 aa, Entamoeba histolytica
DKDAIIRLRFVPNFFGSGNFVSILSIKI

SEQ ID NO: 2671545 - protein, 21 aa, Entamoeba histolytica
DKDGFLSFNGFIKIFEKAMIF

SEQ ID NO: 2671546 - protein, 26 aa, Entamoeba histolytica
DKDLFICGSSQKLVICDFTENVKILY

SEQ ID NO: 2671547 - protein, 19 aa, Entamoeba histolytica
DKDLKGRIITTLQLLELLL

SEQ ID NO: 2671548 - protein, 20 aa, Entamoeba histolytica
DKDLPVCFILTKSDQLQQTV

SEQ ID NO: 2671549 - protein, 26 aa, Entamoeba histolytica
DKDLRSLLLTDLRFSPDGSYLSVADD

SEQ ID NO: 2671550 - protein, 24 aa, Entamoeba histolytica
DKDPSQHIPICLVGNKSDLESERI

SEQ ID NO: 2671551 - protein, 17 aa, Entamoeba histolytica
DKDVFGIHYKIPKVDVQ

SEQ ID NO: 2671552 - protein, 25 aa, Entamoeba histolytica
DKDWGRCVCNLSDLAPVLVNGVKVK

SEQ ID NO: 2671553 - protein, 18 aa, Entamoeba histolytica
DKECIKNAEILMKYFHAH

SEQ ID NO: 2671554 - protein, 24 aa, Entamoeba histolytica
DKEDLKDVILVGGSTFIPFVQKIA

SEQ ID NO: 2671555 - protein, 26 aa, Entamoeba histolytica
DKEEILKLYTGIMKYGADFGLIELMF

SEQ ID NO: 2671556 - protein, 35 aa, Entamoeba histolytica
DKEELFEEVMCCGSFGASLFSAWMKTSSGSNLSIR

SEQ ID NO: 2671557 - protein, 24 aa, Entamoeba histolytica
DKEGGVCSNTKLAKLLSSKLGFPY

SEQ ID NO: 2671558 - protein, 25 aa, Entamoeba histolytica
DKEHKPSCYFCADIVAPTDSLSRRT

SEQ ID NO: 2671559 - protein, 18 aa, Entamoeba histolytica
DKEIMLFNRIKNIFNNEE

SEQ ID NO: 2671560 - protein, 19 aa, Entamoeba histolytica
DKEIQRFATNSADVKRLQE

SEQ ID NO: 2671561 - protein, 24 aa, Entamoeba histolytica
DKEMKEMIEAIVLPMTQKEKFEKL

SEQ ID NO: 2671562 - protein, 19 aa, Entamoeba histolytica
DKERVGCSQLLIEEGKEPE

SEQ ID NO: 2671563 - protein, 23 aa, Entamoeba histolytica
DKESWKAIPTMKLMPVLETALNY

SEQ ID NO: 2671564 - protein, 22 aa, Entamoeba histolytica
DKEVSAEIAFYVCAQVSDDTIH

SEQ ID NO: 2671565 - protein, 20 aa, Entamoeba histolytica
DKFETTVLWCLDTILEIEKI

SEQ ID NO: 2671566 - protein, 25 aa, Entamoeba histolytica
DKFTQMFWELGMKNFDDFITKLLKL

SEQ ID NO: 2671567 - protein, 24 aa, Entamoeba histolytica
DKFWKESIANIILKGGFDNQPIDE

SEQ ID NO: 2671568 - protein, 20 aa, Entamoeba histolytica
DKFWRIIRHEHIANASPYVV

SEQ ID NO: 2671569 - protein, 24 aa, Entamoeba histolytica
DKGELRPELILAINGLLQDLNHPN

SEQ ID NO: 2671570 - protein, 18 aa, Entamoeba histolytica
DKGHFVFSLVNPYGTKPV

SEQ ID NO: 2671571 - protein, 24 aa, Entamoeba histolytica
DKHNLKLSEFIGETLMVLPNANEY

SEQ ID NO: 2671572 - protein, 17 aa, Entamoeba histolytica
DKHVRKLICSCSTEQYC

SEQ ID NO: 2671573 - protein, 25 aa, Entamoeba histolytica
DKIISRGCGFLQNISDFEEGRKAIL

SEQ ID NO: 2671574 - protein, 20 aa, Entamoeba histolytica
DKIKEGFQVTKDFYKNGQSM

SEQ ID NO: 2671575 - protein, 19 aa, Entamoeba histolytica
DKIKILNKKGDWWQGECQG

SEQ ID NO: 2671576 - protein, 31 aa, Entamoeba histolytica
DKILEGLSGPNLRNELRIENEESYEEEDDDD

SEQ ID NO: 2671577 - protein, 20 aa, Entamoeba histolytica
DKILKVCVEPNIPIENVSKI

SEQ ID NO: 2671578 - protein, 31 aa, Entamoeba histolytica
DKIPITFFVLRNELFVPCSYHIASVDVERIG

SEQ ID NO: 2671579 - protein, 24 aa, Entamoeba histolytica
DKIQKCREMFKEVLNIVMDDNPPA

SEQ ID NO: 2671580 - protein, 20 aa, Entamoeba histolytica
DKIVLDFFVWWKCPIQTINT

SEQ ID NO: 2671581 - protein, 17 aa, Entamoeba histolytica
DKIYSIELTPNMTVMEF

SEQ ID NO: 2671582 - protein, 17 aa, Entamoeba histolytica
DKKADGFILVYSKQIEK

SEQ ID NO: 2671583 - protein, 23 aa, Entamoeba histolytica
DKKERMDFLLVQFRIALECEDYL

SEQ ID NO: 2671584 - protein, 17 aa, Entamoeba histolytica
DKKIQECHKRRIDMDRI

SEQ ID NO: 2671585 - protein, 18 aa, Entamoeba histolytica
DKKLLVELENIFYKPPNI

SEQ ID NO: 2671586 - protein, 17 aa, Entamoeba histolytica
DKKSIIEGINFEEFNQQ

SEQ ID NO: 2671587 - protein, 21 aa, Entamoeba histolytica
DKKVEVAQCEAEVSQVKKRLA

SEQ ID NO: 2671588 - protein, 26 aa, Entamoeba histolytica
DKKWKKRYLIWKGMVLYFYDKKGSKD

SEQ ID NO: 2671589 - protein, 22 aa, Entamoeba histolytica
DKKYKVIFERSLNEINCQVPEW

SEQ ID NO: 2671590 - protein, 25 aa, Entamoeba histolytica
DKLAIGFRLNPHFLDQIPEFDRTTK

SEQ ID NO: 2671591 - protein, 19 aa, Entamoeba histolytica
DKLDIDEEIKRVEISNKDS

SEQ ID NO: 2671592 - protein, 17 aa, Entamoeba histolytica
DKLDLSNIISIKDLSLS

SEQ ID NO: 2671593 - protein, 17 aa, Entamoeba histolytica
DKLIQIYPINKFQYSLQ

SEQ ID NO: 2671594 - protein, 19 aa, Entamoeba histolytica
DKLKEVFASVGEIKNSRVA

SEQ ID NO: 2671595 - protein, 19 aa, Entamoeba histolytica
DKLLYYLKMEHSIISSFLY

SEQ ID NO: 2671596 - protein, 21 aa, Entamoeba histolytica
DKLNKWLGLESNYLLYRNHLS

SEQ ID NO: 2671597 - protein, 35 aa, Entamoeba histolytica
DKLPERPQGEFILWQPTRHTLFLPNQILAAAGYDS

SEQ ID NO: 2671598 - protein, 19 aa, Entamoeba histolytica
DKLPKCLVMVGGKPIIQWQ

SEQ ID NO: 2671599 - protein, 22 aa, Entamoeba histolytica
DKLRLYIKTMVEYLKANSGRKI

SEQ ID NO: 2671600 - protein, 25 aa, Entamoeba histolytica
DKLSARLFFKSTIIYVGENDMSVEK

SEQ ID NO: 2671601 - protein, 29 aa, Entamoeba histolytica
DKLSSIGFELNYFITWFADLFIDVFPVRL

SEQ ID NO: 2671602 - protein, 21 aa, Entamoeba histolytica
DKLVECYQLILDVAAWINEKK

SEQ ID NO: 2671603 - protein, 20 aa, Entamoeba histolytica
DKLYICLMDGQSFCEECLHI

SEQ ID NO: 2671604 - protein, 29 aa, Entamoeba histolytica
DKMFYYKLYCSLSKCLTSSNIIVITNAVS

SEQ ID NO: 2671605 - protein, 21 aa, Entamoeba histolytica
DKMTICIKKNMGIIDDYLVND

SEQ ID NO: 2671606 - protein, 18 aa, Entamoeba histolytica
DKNFKSPYINYLSAIGEA

SEQ ID NO: 2671607 - protein, 25 aa, Entamoeba histolytica
DKNGLKVMLFSGINNCSTYLVYSQE

SEQ ID NO: 2671608 - protein, 26 aa, Entamoeba histolytica
DKNVLGTVCWALFFVVTRAAKQNPTF

SEQ ID NO: 2671609 - protein, 19 aa, Entamoeba histolytica
DKNWCGVLFSYFNDSDCFE

SEQ ID NO: 2671610 - protein, 22 aa, Entamoeba histolytica
DKPCYDGLDLIKGEIRNNLEAG

SEQ ID NO: 2671611 - protein, 22 aa, Entamoeba histolytica
DKPDVRFVIHHSLPKSLEGYYQ

SEQ ID NO: 2671612 - protein, 20 aa, Entamoeba histolytica
DKPKELDEIVTLINQLNDSN

SEQ ID NO: 2671613 - protein, 17 aa, Entamoeba histolytica
DKPKKKKARSWITDEDV

SEQ ID NO: 2671614 - protein, 21 aa, Entamoeba histolytica
DKPPLKRKVVDLQLIKNDDSQ

SEQ ID NO: 2671615 - protein, 22 aa, Entamoeba histolytica
DKPSCFPAFILNPPENSICIDA

SEQ ID NO: 2671616 - protein, 23 aa, Entamoeba histolytica
DKPSHGKLTMFGTEINEKTKESF

SEQ ID NO: 2671617 - protein, 27 aa, Entamoeba histolytica
DKPVEIEFFKPLTLITGPNGAGKTTII

SEQ ID NO: 2671618 - protein, 22 aa, Entamoeba histolytica
DKRCSCLAPWCEGEECEKCIKT

SEQ ID NO: 2671619 - protein, 26 aa, Entamoeba histolytica
DKREGIIMKIIESMIRNEVVVTTNPN

SEQ ID NO: 2671620 - protein, 21 aa, Entamoeba histolytica
DKRFPPVSGLVRAFFHISGYM

SEQ ID NO: 2671621 - protein, 23 aa, Entamoeba histolytica
DKRIKRSKSMPIIFFEEDNDKEE

SEQ ID NO: 2671622 - protein, 17 aa, Entamoeba histolytica
DKRKCIFKLNQIQTKFN

SEQ ID NO: 2671623 - protein, 21 aa, Entamoeba histolytica
DKRWKIRVKGYKELDQLIQTK

SEQ ID NO: 2671624 - protein, 21 aa, Entamoeba histolytica
DKSDGLKLCIQKFMNNLQGTV

SEQ ID NO: 2671625 - protein, 20 aa, Entamoeba histolytica
DKSGSLKISVIDFNNDVEQQ

SEQ ID NO: 2671626 - protein, 26 aa, Entamoeba histolytica
DKSGSNVFSIKELSFGTSNEKSTTNL

SEQ ID NO: 2671627 - protein, 25 aa, Entamoeba histolytica
DKSKGEVIITWYSMYQNILKQKLRI

SEQ ID NO: 2671628 - protein, 24 aa, Entamoeba histolytica
DKSKTAGWRLDYFFVSKDLVDSVT

SEQ ID NO: 2671629 - protein, 28 aa, Entamoeba histolytica
DKSPIPIRLPYSMAIKLFPLPTELHNKQ

SEQ ID NO: 2671630 - protein, 19 aa, Entamoeba histolytica
DKSQDEFIRPVFVPDSDSP

SEQ ID NO: 2671631 - protein, 17 aa, Entamoeba histolytica
DKTECLTMWKRLENKNN

SEQ ID NO: 2671632 - protein, 26 aa, Entamoeba histolytica
DKTFGDLWVEFLLRESGSLDAQQPTN

SEQ ID NO: 2671633 - protein, 20 aa, Entamoeba histolytica
DKTIECLSKAVAHCLTKDKK

SEQ ID NO: 2671634 - protein, 19 aa, Entamoeba histolytica
DKTRICWFNAGSQQLNDYK

SEQ ID NO: 2671635 - protein, 28 aa, Entamoeba histolytica
DKTRPETFFKLASCYFQGILVEKNEKLA

SEQ ID NO: 2671636 - protein, 22 aa, Entamoeba histolytica
DKTSVDPFAAFTSSTTTTNQLG

SEQ ID NO: 2671637 - protein, 19 aa, Entamoeba histolytica
DKTVRCVNFLNDLQTEVID

SEQ ID NO: 2671638 - protein, 22 aa, Entamoeba histolytica
DKVDLLIFFTELRRFCLDIINW

SEQ ID NO: 2671639 - protein, 20 aa, Entamoeba histolytica
DKVQEIKPSISLFQNNRKAA

SEQ ID NO: 2671640 - protein, 21 aa, Entamoeba histolytica
DKWITGIHCGYYLGIEDSSFV

SEQ ID NO: 2671641 - protein, 23 aa, Entamoeba histolytica
DKWSIKISLDYIDQIYKSMINAV

SEQ ID NO: 2671642 - protein, 24 aa, Entamoeba histolytica
DKYALKVISSFCGMDDLLNADILD

SEQ ID NO: 2671643 - protein, 26 aa, Entamoeba histolytica
DKYDSVFRFVLNNTLLVDTLDNARKI

SEQ ID NO: 2671644 - protein, 18 aa, Entamoeba histolytica
DKYLKLARKATFLEFRSK

SEQ ID NO: 2671645 - protein, 25 aa, Entamoeba histolytica
DKYNICVLSEAFVLYIQAMGGIFTP

SEQ ID NO: 2671646 - protein, 17 aa, Entamoeba histolytica
DKYPLEFSDSILQQRFI

SEQ ID NO: 2671647 - protein, 23 aa, Entamoeba histolytica
DKYPLLRKINCRLSCLPTKTALP

SEQ ID NO: 2671648 - protein, 24 aa, Entamoeba histolytica
DKYQLKFVGAIPIEPKICLAGETG

SEQ ID NO: 2671649 - protein, 18 aa, Entamoeba histolytica
DKYVICPLVPSSGPNQSS

SEQ ID NO: 2671650 - protein, 28 aa, Entamoeba histolytica
DKYYLSSRLHHISLWKTIFSDFLSEKVE

SEQ ID NO: 2671651 - protein, 19 aa, Entamoeba histolytica
DLADVNWAFNIRAHDIPFS

SEQ ID NO: 2671652 - protein, 22 aa, Entamoeba histolytica
DLAKTCIHYQLTHETMLYGYSR

SEQ ID NO: 2671653 - protein, 18 aa, Entamoeba histolytica
DLAPGIKSRFHPIQFDEI

SEQ ID NO: 2671654 - protein, 18 aa, Entamoeba histolytica
DLAQLPVRLFQFLPNDFE

SEQ ID NO: 2671655 - protein, 20 aa, Entamoeba histolytica
DLDIAFSKRLGILIDKKPEN

SEQ ID NO: 2671656 - protein, 25 aa, Entamoeba histolytica
DLDKLRISFRLKIIVSGVNSFLRTK

SEQ ID NO: 2671657 - protein, 23 aa, Entamoeba histolytica
DLDRQIRQNIEMSHKTTGAESQR

SEQ ID NO: 2671658 - protein, 20 aa, Entamoeba histolytica
DLDRRIGLEPVLPSEFHMMR

SEQ ID NO: 2671659 - protein, 25 aa, Entamoeba histolytica
DLDRWEYAKSAILVLFKPLDYAMGN

SEQ ID NO: 2671660 - protein, 19 aa, Entamoeba histolytica
DLDVFLVFMNNVLSRFMKV

SEQ ID NO: 2671661 - protein, 24 aa, Entamoeba histolytica
DLDWIDCLFTRFSSIPQLHQQLIQ

SEQ ID NO: 2671662 - protein, 17 aa, Entamoeba histolytica
DLEGFKIPIDDEQSLKL

SEQ ID NO: 2671663 - protein, 21 aa, Entamoeba histolytica
DLEIFRKSLDLSREPNQQEVP

SEQ ID NO: 2671664 - protein, 19 aa, Entamoeba histolytica
DLEIQQCRQTIVGHRAAIK

SEQ ID NO: 2671665 - protein, 32 aa, Entamoeba histolytica
DLEKLRLCCLPKVPYFVEMHASEFILLTKQEH

SEQ ID NO: 2671666 - protein, 31 aa, Entamoeba histolytica
DLEKYGARAVINWATLLGVLISKDFLGLRVL

SEQ ID NO: 2671667 - protein, 35 aa, Entamoeba histolytica
DLEPGEYVTNCFYCHKTCHYRCYIPGDMKRECYCI

SEQ ID NO: 2671668 - protein, 22 aa, Entamoeba histolytica
DLESLGYLFVYLLKGSLPWQDL

SEQ ID NO: 2671669 - protein, 20 aa, Entamoeba histolytica
DLFDVPKTISLNAIIPYNQE

SEQ ID NO: 2671670 - protein, 18 aa, Entamoeba histolytica
DLFEGSIIRGMRRLEELL

SEQ ID NO: 2671671 - protein, 27 aa, Entamoeba histolytica
DLFGKKVKYCMVMKKIPLINPLSLFSL

SEQ ID NO: 2671672 - protein, 26 aa, Entamoeba histolytica
DLFIDSRLKYYLSFVPESIKKVLFIG

SEQ ID NO: 2671673 - protein, 18 aa, Entamoeba histolytica
DLFIKLGTFLELCKQKES

SEQ ID NO: 2671674 - protein, 19 aa, Entamoeba histolytica
DLFILKDIYESIGSQLEST

SEQ ID NO: 2671675 - protein, 24 aa, Entamoeba histolytica
DLFMKIHISELYSWNNSNRENTAS

SEQ ID NO: 2671676 - protein, 18 aa, Entamoeba histolytica
DLFNCTFYSVYIAQDQKQ

SEQ ID NO: 2671677 - protein, 19 aa, Entamoeba histolytica
DLGARCLCYSIIGYYKLLL

SEQ ID NO: 2671678 - protein, 20 aa, Entamoeba histolytica
DLGARCLCYSIIGYYKLLLK

SEQ ID NO: 2671679 - protein, 26 aa, Entamoeba histolytica
DLGNLKWIVVGKLFGLRAIIGNSSDS

SEQ ID NO: 2671680 - protein, 19 aa, Entamoeba histolytica
DLGTTFCCCHFFNTQTNKY

SEQ ID NO: 2671681 - protein, 17 aa, Entamoeba histolytica
DLHADLYFLIHAMYQDN

SEQ ID NO: 2671682 - protein, 17 aa, Entamoeba histolytica
DLICAAKNLGIICYLIP

SEQ ID NO: 2671683 - protein, 19 aa, Entamoeba histolytica
DLIDPLLIELKENGKNIYA

SEQ ID NO: 2671684 - protein, 26 aa, Entamoeba histolytica
DLIFKLCILAEKYLKGKEYVDIMMSI

SEQ ID NO: 2671685 - protein, 20 aa, Entamoeba histolytica
DLIGCTALHCSIKTLDRVLR

SEQ ID NO: 2671686 - protein, 17 aa, Entamoeba histolytica
DLIIRRGTLMSFYCSTG

SEQ ID NO: 2671687 - protein, 17 aa, Entamoeba histolytica
DLIKLRSLFSLTSNYKR

SEQ ID NO: 2671688 - protein, 21 aa, Entamoeba histolytica
DLILEPKFEGCILPRIPQVYY

SEQ ID NO: 2671689 - protein, 19 aa, Entamoeba histolytica
DLINFPSFSSQPFKEQLKK

SEQ ID NO: 2671690 - protein, 19 aa, Entamoeba histolytica
DLIRSRIKLFRFTKNKKWR

SEQ ID NO: 2671691 - protein, 23 aa, Entamoeba histolytica
DLISINLNSCFALTAIALTVLGD

SEQ ID NO: 2671692 - protein, 27 aa, Entamoeba histolytica
DLISLKKLWIILGWYYFYETMKENELE

SEQ ID NO: 2671693 - protein, 26 aa, Entamoeba histolytica
DLKISEIGKKIGVEWKELPEEQKKKY

SEQ ID NO: 2671694 - protein, 21 aa, Entamoeba histolytica
DLKKKVDILAYWVSQSLYESV

SEQ ID NO: 2671695 - protein, 37 aa, Entamoeba histolytica
DLKTMIEIICNIFPFYKFWEHVCVVWTNCYNYTPQKQ

SEQ ID NO: 2671696 - protein, 25 aa, Entamoeba histolytica
DLKTRAIRFGAYKNQWFNITPQKNI

SEQ ID NO: 2671697 - protein, 30 aa, Entamoeba histolytica; identical to SEQ ID NO: 2477435

SEQ ID NO: 2671698 - protein, 27 aa, Entamoeba histolytica
DLKYKLIDWKSYFIITINELQSEAFKI

SEQ ID NO: 2671699 - protein, 24 aa, Entamoeba histolytica
DLLDLPWNRCWIDGNLVEGKKRKE

SEQ ID NO: 2671700 - protein, 25 aa, Entamoeba histolytica
DLLFNLIIRDSWQFLFSHSPIDLKQ

SEQ ID NO: 2671701 - protein, 17 aa, Entamoeba histolytica
DLLFYGIGYNAEQWKRN

SEQ ID NO: 2671702 - protein, 30 aa, Entamoeba histolytica; identical to SEQ ID NO: 2477443

SEQ ID NO: 2671703 - protein, 17 aa, Entamoeba histolytica
DLLIFMLQKLFALVHGE

SEQ ID NO: 2671704 - protein, 29 aa, Entamoeba histolytica
DLLLPTVCQYEIWYPVSICEALKYKNTIK

SEQ ID NO: 2671705 - protein, 17 aa, Entamoeba histolytica
DLLNALSKDCIELKKSI

SEQ ID NO: 2671706 - protein, 24 aa, Entamoeba histolytica
DLLNARGGTIISVCGTKCGLGKGV

SEQ ID NO: 2671707 - protein, 23 aa, Entamoeba histolytica
DLLNCLKTIYRASSDLDQSCLVL

SEQ ID NO: 2671708 - protein, 23 aa, Entamoeba histolytica
DLLPFLRKPILLIIDSDKQNSFI

SEQ ID NO: 2671709 - protein, 23 aa, Entamoeba histolytica
DLLQRYFCFIGNYELPNWTKEYK

SEQ ID NO: 2671710 - protein, 22 aa, Entamoeba histolytica
DLLREEVQNCYNAEDKSFEVEN

SEQ ID NO: 2671711 - protein, 21 aa, Entamoeba histolytica
DLLSRIGVIRAVGGIHFTLVE

SEQ ID NO: 2671712 - protein, 19 aa, Entamoeba histolytica
DLLSRVIARREVICLPFYS

SEQ ID NO: 2671713 - protein, 17 aa, Entamoeba histolytica
DLLVKIAEEATCPTTIT

SEQ ID NO: 2671714 - protein, 24 aa, Entamoeba histolytica
DLMRMFLELRASMIKKKLIPTLAI

SEQ ID NO: 2671715 - protein, 25 aa, Entamoeba histolytica
DLNAFKSVCSFGCIKTFEIIAICLK

SEQ ID NO: 2671716 - protein, 19 aa, Entamoeba histolytica
DLNAICFVAPSSNVRLTAS

SEQ ID NO: 2671717 - protein, 17 aa, Entamoeba histolytica
DLNCPIIELPNSLEELT

SEQ ID NO: 2671718 - protein, 24 aa, Entamoeba histolytica
DLNGVPLKFCDDFEYHDSVDGSVT

SEQ ID NO: 2671719 - protein, 18 aa, Entamoeba histolytica
DLNISLPLYTVNACCSES

SEQ ID NO: 2671720 - protein, 18 aa, Entamoeba histolytica
DLNKIILVNQFKEEINRR

SEQ ID NO: 2671721 - protein, 18 aa, Entamoeba histolytica
DLNNFPFVIVGNKSDCSD

SEQ ID NO: 2671722 - protein, 23 aa, Entamoeba histolytica
DLNRLTRDIPFLFHNKIQQLMKR

SEQ ID NO: 2671723 - protein, 30 aa, Entamoeba histolytica
DLNRYVKEEVYFPRMFMKIEDDCVRVLQNS

SEQ ID NO: 2671724 - protein, 39 aa, Entamoeba histolytica; identical to SEQ ID NO: 2477472

SEQ ID NO: 2671725 - protein, 20 aa, Entamoeba histolytica
DLPSPRFIESLEFQPTDPKI

SEQ ID NO: 2671726 - protein, 30 aa, Entamoeba histolytica
DLQDGIIFRDLLRTLGIPCGNSLEDVITAS

SEQ ID NO: 2671727 - protein, 23 aa, Entamoeba histolytica
DLQEAYFLFDQCITTPSKEITPQ

SEQ ID NO: 2671728 - protein, 17 aa, Entamoeba histolytica
DLQKALVEELYKSDKIN

SEQ ID NO: 2671729 - protein, 24 aa, Entamoeba histolytica
DLQPDLVAAVFKRFLRDLPTHVID

SEQ ID NO: 2671730 - protein, 20 aa, Entamoeba histolytica
DLQTLAGNKGDRDWLDKNTV

SEQ ID NO: 2671731 - protein, 26 aa, Entamoeba histolytica
DLRALAAKCVFKLLKVLESGKMKEIK

SEQ ID NO: 2671732 - protein, 17 aa, Entamoeba histolytica
DLRCLNENKLINVYIIE

SEQ ID NO: 2671733 - protein, 21 aa, Entamoeba histolytica
DLRGYSVLHYAVFINSSEFLD

SEQ ID NO: 2671734 - protein, 23 aa, Entamoeba histolytica
DLRIGKKLIRYGFAPRISFLTSR

SEQ ID NO: 2671735 - protein, 25 aa, Entamoeba histolytica
DLRLWKIDFTQFIPLTKVQLQYIVD

SEQ ID NO: 2671736 - protein, 20 aa, Entamoeba histolytica
DLRMIKPFLTYFHNAAVKAI

SEQ ID NO: 2671737 - protein, 28 aa, Entamoeba histolytica
DLRMKQMCRRYGIPNIRDKSVAVLNVDT

SEQ ID NO: 2671738 - protein, 23 aa, Entamoeba histolytica
DLRRLHVETVLTLWVFLQESKKN

SEQ ID NO: 2671739 - protein, 18 aa, Entamoeba histolytica
DLSIPKEHLMIIKTPNTS

SEQ ID NO: 2671740 - protein, 18 aa, Entamoeba histolytica
DLSKISWLVTVVDEAHRL

SEQ ID NO: 2671741 - protein, 29 aa, Entamoeba histolytica
DLSLGIDPLYCFKCIVEGNIETIEEIEKE

SEQ ID NO: 2671742 - protein, 23 aa, Entamoeba histolytica
DLSRYKPFIKEIVERMANNEVPE

SEQ ID NO: 2671743 - protein, 23 aa, Entamoeba histolytica
DLTCLSCSMTDPNLYFMSTKSGV

SEQ ID NO: 2671744 - protein, 19 aa, Entamoeba histolytica
DLTKSCKGQKAHTKEDEKK

SEQ ID NO: 2671745 - protein, 25 aa, Entamoeba histolytica
DLTSMLRKAMEVRRNDIADDEDDDD

SEQ ID NO: 2671746 - protein, 24 aa, Entamoeba histolytica
DLTTEIPCCLNFDKIQQHHITSQH

SEQ ID NO: 2671747 - protein, 17 aa, Entamoeba histolytica
DLVCFIIEKSIDKEYKL

SEQ ID NO: 2671748 - protein, 23 aa, Entamoeba histolytica
DLVCGCSVGSILVSMLAIGITPR

SEQ ID NO: 2671749 - protein, 24 aa, Entamoeba histolytica
DLVESIRFILERLIPFNQQLNPRR

SEQ ID NO: 2671750 - protein, 18 aa, Entamoeba histolytica
DLVIVLFIEIFRAIDSDM

SEQ ID NO: 2671751 - protein, 34 aa, Entamoeba histolytica
DLVKPRLSGTLLKNEISFIVSFTLNMFIKPVHLN

SEQ ID NO: 2671752 - protein, 23 aa, Entamoeba histolytica
DLVPIFLERLLAFPLDKLTISYK

SEQ ID NO: 2671753 - protein, 25 aa, Entamoeba histolytica
DLVQELGIFLGRYISQYLYKIYGEY

SEQ ID NO: 2671754 - protein, 18 aa, Entamoeba histolytica
DLVTMKWWNDLWLNEGFA

SEQ ID NO: 2671755 - protein, 28 aa, Entamoeba histolytica
DLVVGLNCKQIKTGAPCRSERLCKYNQL

SEQ ID NO: 2671756 - protein, 18 aa, Entamoeba histolytica
DLVVKRFKELYAEDKIQI

SEQ ID NO: 2671757 - protein, 19 aa, Entamoeba histolytica
DLVYWYCLFNEPLDRLHYI

SEQ ID NO: 2671758 - protein, 17 aa, Entamoeba histolytica
DLYKIARTIPFTRALEC

SEQ ID NO: 2671759 - protein, 21 aa, Entamoeba histolytica
DLYMKTGQGFVLVYSIIAQST

SEQ ID NO: 2671760 - protein, 22 aa, Entamoeba histolytica
DLYMKTGQGFVLVYSIIAQSTY

SEQ ID NO: 2671761 - protein, 24 aa, Entamoeba histolytica
DLYNEILLFPGLPASIQNEIGNAT

SEQ ID NO: 2671762 - protein, 23 aa, Entamoeba histolytica
DLYNRILANFVEFVHMLGEEVNP

SEQ ID NO: 2671763 - protein, 28 aa, Entamoeba histolytica
DLYSIGVCLYRLITCRFPFATTKTEFIQ

SEQ ID NO: 2671764 - protein, 18 aa, Entamoeba histolytica
DLYSLGVVLYRLATNEYP

SEQ ID NO: 2671765 - protein, 22 aa, Entamoeba histolytica
DMAKYRTITSFTTMTYTLNDLF

SEQ ID NO: 2671766 - protein, 17 aa, Entamoeba histolytica
DMARYLVDVAIKRKTLD

SEQ ID NO: 2671767 - protein, 23 aa, Entamoeba histolytica
DMELVKEFMQLYSLLPLTQSSQL

SEQ ID NO: 2671768 - protein, 26 aa, Entamoeba histolytica
DMENGICWECWKIYFPDEKWPDLEHD

SEQ ID NO: 2671769 - protein, 17 aa, Entamoeba histolytica
DMERFREQFAYIMKNNL

SEQ ID NO: 2671770 - protein, 18 aa, Entamoeba histolytica
DMIEWSKSGLVVYDSQVP

SEQ ID NO: 2671771 - protein, 19 aa, Entamoeba histolytica
DMIIRGGHNIWPAEICDIM

SEQ ID NO: 2671772 - protein, 26 aa, Entamoeba histolytica
DMKKRCLYCQLQYPFECISTQCPISF

SEQ ID NO: 2671773 - protein, 22 aa, Entamoeba histolytica
DMKKYFQIISFCFTDSFREYIE

SEQ ID NO: 2671774 - protein, 22 aa, Entamoeba histolytica
DMKRKAICIQKLTYLEMLGQET

SEQ ID NO: 2671775 - protein, 17 aa, Entamoeba histolytica
DMKSYGYEIPRDFEKNK

SEQ ID NO: 2671776 - protein, 19 aa, Entamoeba histolytica
DMKVIIKKKHKIFATEACR

SEQ ID NO: 2671777 - protein, 24 aa, Entamoeba histolytica
DMKVNCCLCNIRLGQKEESQKCIE

SEQ ID NO: 2671778 - protein, 26 aa, Entamoeba histolytica
DMLCKAIKLSPNLSHIIQLESLLFQL

SEQ ID NO: 2671779 - protein, 24 aa, Entamoeba histolytica
DMLCSYCLPFLFYKQTILFNRDLI

SEQ ID NO: 2671780 - protein, 20 aa, Entamoeba histolytica
DMLLFLKLVDYFQDDNDKEL

SEQ ID NO: 2671781 - protein, 19 aa, Entamoeba histolytica
DMMNCQYLSFVKEEKPIKH

SEQ ID NO: 2671782 - protein, 20 aa, Entamoeba histolytica
DMMQWACWFHNAGTEIDLPT

SEQ ID NO: 2671783 - protein, 19 aa, Entamoeba histolytica
DMNLLLRYIFGLIGYVPTV

SEQ ID NO: 2671784 - protein, 17 aa, Entamoeba histolytica
DMSKIFEILLAYEKTNL

SEQ ID NO: 2671785 - protein, 18 aa, Entamoeba histolytica
DMTFKGKPVMKIAEETGQ

SEQ ID NO: 2671786 - protein, 23 aa, Entamoeba histolytica
DMTKMFCPKCGYHDLRRISYYVL

SEQ ID NO: 2671787 - protein, 17 aa, Entamoeba histolytica
DMVDVFLSTPFDGMQHT

SEQ ID NO: 2671788 - protein, 26 aa, Entamoeba histolytica
DMVMIQLCFLLPFNCFASLFTTDIES

SEQ ID NO: 2671789 - protein, 30 aa, Entamoeba histolytica; identical to SEQ ID NO: 2477532

SEQ ID NO: 2671790 - protein, 23 aa, Entamoeba histolytica
DNAELRETIKLMKQQIEANNELM

SEQ ID NO: 2671791 - protein, 17 aa, Entamoeba histolytica
DNCFGCYVSKAPSYIGI

SEQ ID NO: 2671792 - protein, 22 aa, Entamoeba histolytica
DNCPPIVRRVLRKVYDELNNKF

SEQ ID NO: 2671793 - protein, 23 aa, Entamoeba histolytica
DNCVKECLKELWKRVQKKHIKRK

SEQ ID NO: 2671794 - protein, 22 aa, Entamoeba histolytica
DNDCRCSLWSKCLGNSIDKNIF

SEQ ID NO: 2671795 - protein, 23 aa, Entamoeba histolytica
DNDCVYPVFKKMGLLDSLQTGLQ

SEQ ID NO: 2671796 - protein, 25 aa, Entamoeba histolytica
DNEFAECIYGFNAFYSKKPCKDYFK

SEQ ID NO: 2671797 - protein, 20 aa, Entamoeba histolytica
DNEIEIAYYIMKVINDTIKR

SEQ ID NO: 2671798 - protein, 24 aa, Entamoeba histolytica
DNEIFRLNGEWRGVTAGGCHVFPS

SEQ ID NO: 2671799 - protein, 23 aa, Entamoeba histolytica
DNELKGLILQTFHMVQKQVNDLK

SEQ ID NO: 2671800 - protein, 34 aa, Entamoeba histolytica; identical to SEQ ID NO: 2477547

SEQ ID NO: 2671801 - protein, 23 aa, Entamoeba histolytica
DNESKYGICIDSIHIFNNNQEYM

SEQ ID NO: 2671802 - protein, 23 aa, Entamoeba histolytica
DNETKFNLFFSYHYYVDLLCESM

SEQ ID NO: 2671803 - protein, 28 aa, Entamoeba histolytica
DNEWSLPAFLPKRIRSISKEEVIKLDKN

SEQ ID NO: 2671804 - protein, 17 aa, Entamoeba histolytica
DNFFCYRGLPRNEFTTL

SEQ ID NO: 2671805 - protein, 19 aa, Entamoeba histolytica
DNFKAVITVPANFSSEQRD

SEQ ID NO: 2671806 - protein, 25 aa, Entamoeba histolytica
DNFKCGIKFCSAGSVIALMTDGVCD

SEQ ID NO: 2671807 - protein, 22 aa, Entamoeba histolytica
DNFKINLPFKQEIIRENEELTE

SEQ ID NO: 2671808 - protein, 21 aa, Entamoeba histolytica
DNGFFLPLRHYHNIVSQLKNM

SEQ ID NO: 2671809 - protein, 19 aa, Entamoeba histolytica
DNGKLLFPQNPVSSIPDYV

SEQ ID NO: 2671810 - protein, 23 aa, Entamoeba histolytica
DNGRVRYAICEMALTLKNFPPQD

SEQ ID NO: 2671811 - protein, 41 aa, Entamoeba histolytica
DNGVMFLQFAFRWINCCLLREFKLGTALRLWDSYMSVEDGT

SEQ ID NO: 2671812 - protein, 25 aa, Entamoeba histolytica
DNGYALELFTLFVKYKCFIEVTYRS

SEQ ID NO: 2671813 - protein, 18 aa, Entamoeba histolytica
DNHINLFHFIRDGKIEEI

SEQ ID NO: 2671814 - protein, 25 aa, Entamoeba histolytica
DNIAIILSVFYNWSESGQLPTSFFS

SEQ ID NO: 2671815 - protein, 23 aa, Entamoeba histolytica
DNIALQIVCFYFINYFNLLEKSN

SEQ ID NO: 2671816 - protein, 18 aa, Entamoeba histolytica
DNIFCLCGQRFCFKCLGE

SEQ ID NO: 2671817 - protein, 26 aa, Entamoeba histolytica
DNIFYFKWRYCFIDDINIKDRLQELV

SEQ ID NO: 2671818 - protein, 23 aa, Entamoeba histolytica
DNIKEVILFPTMRPEDELEKKAR

SEQ ID NO: 2671819 - protein, 23 aa, Entamoeba histolytica
DNISLELKDLISHMLIVNPKQRY

SEQ ID NO: 2671820 - protein, 22 aa, Entamoeba histolytica
DNIWKRKIYQTVLIHLLSQNNK

SEQ ID NO: 2671821 - protein, 24 aa, Entamoeba histolytica
DNKENFCRYEVLPSLIKQLNELLT

SEQ ID NO: 2671822 - protein, 23 aa, Entamoeba histolytica
DNKIKGIIFTFELMIGVEKEVGE

SEQ ID NO: 2671823 - protein, 24 aa, Entamoeba histolytica
DNKKEVLAMYGVYCMDRIMITKVL

SEQ ID NO: 2671824 - protein, 25 aa, Entamoeba histolytica
DNKKLIGTLPCKVDGNIFMVDDLII

SEQ ID NO: 2671825 - protein, 18 aa, Entamoeba histolytica
DNKMCYCRGLNYFDKICL

SEQ ID NO: 2671826 - protein, 24 aa, Entamoeba histolytica
DNKNIKIGFSYILLEINKIAEMID

SEQ ID NO: 2671827 - protein, 17 aa, Entamoeba histolytica
DNKSAEHLSFYKRVTNL

SEQ ID NO: 2671828 - protein, 18 aa, Entamoeba histolytica
DNLIKEFVFQAAKNGMDV

SEQ ID NO: 2671829 - protein, 17 aa, Entamoeba histolytica
DNLKTPKIRNGTINQIT

SEQ ID NO: 2671830 - protein, 25 aa, Entamoeba histolytica
DNLLYIKSCYEINCSEAQVKEVIIL

SEQ ID NO: 2671831 - protein, 20 aa, Entamoeba histolytica
DNLNIVNLMNFCIKKIDINE

SEQ ID NO: 2671832 - protein, 17 aa, Entamoeba histolytica
DNLPTILPETAAQGPLP

SEQ ID NO: 2671833 - protein, 24 aa, Entamoeba histolytica
DNLVYRKSRVLKRTTKIMRSTDAD

SEQ ID NO: 2671834 - protein, 17 aa, Entamoeba histolytica
DNMIISFSLHDNNCSLF

SEQ ID NO: 2671835 - protein, 25 aa, Entamoeba histolytica
DNNCSLFTLGNRIGFIHIAKTKNKR

SEQ ID NO: 2671836 - protein, 25 aa, Entamoeba histolytica
DNNDIIWDCPLNQLEQFKPQVTEEN

SEQ ID NO: 2671837 - protein, 24 aa, Entamoeba histolytica
DNNLSLPCDLSFSTSLIPLIYQGR

SEQ ID NO: 2671838 - protein, 20 aa, Entamoeba histolytica
DNNTVVLCPSLVHYYEVSIK

SEQ ID NO: 2671839 - protein, 18 aa, Entamoeba histolytica
DNNYAVVMPKSYHLISEK

SEQ ID NO: 2671840 - protein, 23 aa, Entamoeba histolytica
DNPEDCKMALSIRNRISTIGIDT

SEQ ID NO: 2671841 - protein, 18 aa, Entamoeba histolytica
DNPGFKLKLPISCTCFED

SEQ ID NO: 2671842 - protein, 18 aa, Entamoeba histolytica
DNQCLKLILKQSKLFDPT

SEQ ID NO: 2671843 - protein, 17 aa, Entamoeba histolytica
DNQFMRKLADLFSADPQ

SEQ ID NO: 2671844 - protein, 17 aa, Entamoeba histolytica
DNQGPDALVEWIRNQKE

SEQ ID NO: 2671845 - protein, 26 aa, Entamoeba histolytica
DNQITLKFIRMYRLFINFLGGDIVDL

SEQ ID NO: 2671846 - protein, 26 aa, Entamoeba histolytica
DNRAHRRGVSFGKFGNSGLFGKHDSS

SEQ ID NO: 2671847 - protein, 22 aa, Entamoeba histolytica
DNRFGLKMECVILKRNVPLLPV

SEQ ID NO: 2671848 - protein, 20 aa, Entamoeba histolytica
DNRKFASWLGANLLDKENIG

SEQ ID NO: 2671849 - protein, 24 aa, Entamoeba histolytica
DNRLSAFHYCYLNLINLIKTKHPK

SEQ ID NO: 2671850 - protein, 24 aa, Entamoeba histolytica
DNSAWKTSIAVVKICDFGSSRIQV

SEQ ID NO: 2671851 - protein, 24 aa, Entamoeba histolytica
DNSFLIKYKKVYLIPNYSQTPYYV

SEQ ID NO: 2671852 - protein, 24 aa, Entamoeba histolytica
DNSIKRLIPVYGENFDALVSNGFV

SEQ ID NO: 2671853 - protein, 19 aa, Entamoeba histolytica
DNSKCAFTQGVVNYDGRYY

SEQ ID NO: 2671854 - protein, 24 aa, Entamoeba histolytica
DNSLILPCFDHIFFGNKSLSISFT

SEQ ID NO: 2671855 - protein, 23 aa, Entamoeba histolytica
DNSLVLYLSYFIIKDNRFGPSDM

SEQ ID NO: 2671856 - protein, 20 aa, Entamoeba histolytica
DNSSLGEDVLMHMLRQKDDM

SEQ ID NO: 2671857 - protein, 20 aa, Entamoeba histolytica
DNSVCTRAILDVGYYHTSIV

SEQ ID NO: 2671858 - protein, 28 aa, Entamoeba histolytica
DNTIRRIGLRYVLMKVKGFNLENSNDVI

SEQ ID NO: 2671859 - protein, 20 aa, Entamoeba histolytica
DNTLYFAFRSLNIIRYISDI

SEQ ID NO: 2671860 - protein, 23 aa, Entamoeba histolytica
DNTRKRKGLVLDEKIVEFVDKQS

SEQ ID NO: 2671861 - protein, 21 aa, Entamoeba histolytica
DNTRVVLFEGLALTINQTINK

SEQ ID NO: 2671862 - protein, 23 aa, Entamoeba histolytica
DNVIKELKIFGGMTNYQGTNVIS

SEQ ID NO: 2671863 - protein, 24 aa, Entamoeba histolytica
DNVIKELKIFGGMTNYQGTNVISS

SEQ ID NO: 2671864 - protein, 23 aa, Entamoeba histolytica
DNVPCGVAWPYLIGAKGIGIDPK

SEQ ID NO: 2671865 - protein, 24 aa, Entamoeba histolytica
DNVWEMYYLLFGMMEQEQLDSMLN

SEQ ID NO: 2671866 - protein, 19 aa, Entamoeba histolytica
DNVWKESSSEEVIIMKKGK

SEQ ID NO: 2671867 - protein, 23 aa, Entamoeba histolytica
DNYDCMFHVAPLIPRNKNDEQSL

SEQ ID NO: 2671868 - protein, 25 aa, Entamoeba histolytica
DNYDFAKEQLKQWILTLKHLYEHVD

SEQ ID NO: 2671869 - protein, 18 aa, Entamoeba histolytica
DNYGQLALHYAAAVGCDI

SEQ ID NO: 2671870 - protein, 29 aa, Entamoeba histolytica
DNYKKEKSFRMFIELGKKILPPPQLRTKL

SEQ ID NO: 2671871 - protein, 21 aa, Entamoeba histolytica
DNYLLRIWDSIFAFPTSKFYY

SEQ ID NO: 2671872 - protein, 23 aa, Entamoeba histolytica
DNYPLKRPSVFPHIEVSVEELIR

SEQ ID NO: 2671873 - protein, 17 aa, Entamoeba histolytica
DPALLRSGRFDRKIEFP

SEQ ID NO: 2671874 - protein, 22 aa, Entamoeba histolytica
DPCNPNHPITLPLRDPEEEING

SEQ ID NO: 2671875 - protein, 20 aa, Entamoeba histolytica
DPEDPKRCYIERIIEMDPRG

SEQ ID NO: 2671876 - protein, 22 aa, Entamoeba histolytica
DPEEMSVYIGVCLDHIDDEEII

SEQ ID NO: 2671877 - protein, 19 aa, Entamoeba histolytica
DPENRLCRIKYDKEHTISP

SEQ ID NO: 2671878 - protein, 18 aa, Entamoeba histolytica
DPEQRYSIEQVIDSSFAK

SEQ ID NO: 2671879 - protein, 22 aa, Entamoeba histolytica
DPERYITGIGFFINMTLLALDQ

SEQ ID NO: 2671880 - protein, 25 aa, Entamoeba histolytica
DPESYKYWHHWALINFEIVSYIELD

SEQ ID NO: 2671881 - protein, 24 aa, Entamoeba histolytica
DPETFKVMMMLKYNKSLINPGEPV

SEQ ID NO: 2671882 - protein, 17 aa, Entamoeba histolytica
DPETGVKKHPYCDFCNI

SEQ ID NO: 2671883 - protein, 25 aa, Entamoeba histolytica
DPFRFFEEMFSGFGMFERGQNFQRK

SEQ ID NO: 2671884 - protein, 19 aa, Entamoeba histolytica
DPFVFKRKGDGKIINKIIP

SEQ ID NO: 2671885 - protein, 24 aa, Entamoeba histolytica
DPGKGTRVIYHWQGKKSNRMEKGK

SEQ ID NO: 2671886 - protein, 25 aa, Entamoeba histolytica
DPIIKNDFFILVRVYGIYGSCYNLD

SEQ ID NO: 2671887 - protein, 22 aa, Entamoeba histolytica
DPIKLISFKSLQRATIILQGEN

SEQ ID NO: 2671888 - protein, 24 aa, Entamoeba histolytica
DPIKRRYLIFMLNLYYSITQQQEI

SEQ ID NO: 2671889 - protein, 17 aa, Entamoeba histolytica
DPIKVRASHDYLFVNDS

SEQ ID NO: 2671890 - protein, 19 aa, Entamoeba histolytica
DPILLKLFRFEELKQMYLF

SEQ ID NO: 2671891 - protein, 26 aa, Entamoeba histolytica
DPIVQRFRLSFLALFKIITELCDCFD

SEQ ID NO: 2671892 - protein, 20 aa, Entamoeba histolytica
DPKLVEMLLENEVEEDVSLD

SEQ ID NO: 2671893 - protein, 19 aa, Entamoeba histolytica
DPKTVICLNNTIEIDEELL

SEQ ID NO: 2671894 - protein, 19 aa, Entamoeba histolytica
DPKVGPILNKLMSKFGQNA

SEQ ID NO: 2671895 - protein, 21 aa, Entamoeba histolytica
DPKWLTSQFNHIFIVVQPDVN

SEQ ID NO: 2671896 - protein, 19 aa, Entamoeba histolytica
DPLFCKGHSGSIIDIIACP

SEQ ID NO: 2671897 - protein, 21 aa, Entamoeba histolytica
DPLHWLQYFPPLGVEDLKLMG

SEQ ID NO: 2671898 - protein, 23 aa, Entamoeba histolytica
DPLRECYCLHLIDSFQHRGLNGI

SEQ ID NO: 2671899 - protein, 30 aa, Entamoeba histolytica
DPNAKMLLELKFNKLYGLLDSFYKISKKVS

SEQ ID NO: 2671900 - protein, 25 aa, Entamoeba histolytica
DPNAQWQWYSDKGWINYEDKQNKLI

SEQ ID NO: 2671901 - protein, 26 aa, Entamoeba histolytica
DPNRCCKACVFNNFIPGHDCKIADAC

SEQ ID NO: 2671902 - protein, 33 aa, Entamoeba histolytica
DPNRIKSHCWFKGFDWEGLFKKKLTPPFVPVLK

SEQ ID NO: 2671903 - protein, 32 aa, Entamoeba histolytica
DPNRIKSHCWFKGFDWEGLFQKKLSPPFVPVL

SEQ ID NO: 2671904 - protein, 25 aa, Entamoeba histolytica
DPNSFKLSPNFSIYPQFMFHLRRSH

SEQ ID NO: 2671905 - protein, 17 aa, Entamoeba histolytica
DPNYCIVTGLIGESNSG

SEQ ID NO: 2671906 - protein, 22 aa, Entamoeba histolytica
DPRIILVGTKCDIRDSQKLIDT

SEQ ID NO: 2671907 - protein, 19 aa, Entamoeba histolytica
DPRKVLSIFRSLIREDIET

SEQ ID NO: 2671908 - protein, 19 aa, Entamoeba histolytica
DPRSCVLAIDNFNGIELNG

SEQ ID NO: 2671909 - protein, 21 aa, Entamoeba histolytica
DPSIYHPIKIVGKGSYGTVIY

SEQ ID NO: 2671910 - protein, 25 aa, Entamoeba histolytica
DPSKCVMSGPGLKTGEVLVPQEFTV

SEQ ID NO: 2671911 - protein, 23 aa, Entamoeba histolytica
DPSRIVDIAKFLASFNLSGVSSE

SEQ ID NO: 2671912 - protein, 19 aa, Entamoeba histolytica
DPSSFKFKLLEESGGKRRV

SEQ ID NO: 2671913 - protein, 17 aa, Entamoeba histolytica
DPTEKWVAILALLQKNN

SEQ ID NO: 2671914 - protein, 25 aa, Entamoeba histolytica
DPTGDFICCLCVSMLVEIKKQLLNG

SEQ ID NO: 2671915 - protein, 25 aa, Entamoeba histolytica
DPTLIRLFLQNGLFKEFFEKHPEME

SEQ ID NO: 2671916 - protein, 18 aa, Entamoeba histolytica
DPVCGWTAYNVVLSKTDL

SEQ ID NO: 2671917 - protein, 21 aa, Entamoeba histolytica
DPVHLFNYFHSVCFDFNEVLI

SEQ ID NO: 2671918 - protein, 19 aa, Entamoeba histolytica
DPVMKRARERQERLKQIQA

SEQ ID NO: 2671919 - protein, 18 aa, Entamoeba histolytica
DPVSFLIQFEEIKNVDKC

SEQ ID NO: 2671920 - protein, 17 aa, Entamoeba histolytica
DPVSLPAIDYFLRVGDI

SEQ ID NO: 2671921 - protein, 19 aa, Entamoeba histolytica
DPVYVARLINCISQTESDV

SEQ ID NO: 2671922 - protein, 22 aa, Entamoeba histolytica
DPYFVFTVCSAFWILQDGTVSF

SEQ ID NO: 2671923 - protein, 25 aa, Entamoeba histolytica
DPYSILSSPLIKFPYIIDSTKNLIF

SEQ ID NO: 2671924 - protein, 25 aa, Entamoeba histolytica
DQCYKIIQYYSLKCVLIDKSEAVPK

SEQ ID NO: 2671925 - protein, 17 aa, Entamoeba histolytica
DQEGFKISSGDEQTLKL

SEQ ID NO: 2671926 - protein, 23 aa, Entamoeba histolytica
DQEILRLTKLINLDQSKLCLSNQ

SEQ ID NO: 2671927 - protein, 23 aa, Entamoeba histolytica
DQELRIEIMPTYTIENKLPYEMN

SEQ ID NO: 2671928 - protein, 18 aa, Entamoeba histolytica
DQERLFRRSQQLRGTKIY

SEQ ID NO: 2671929 - protein, 25 aa, Entamoeba histolytica
DQFLCLRPAKHFPGIPTPLKKCEID

SEQ ID NO: 2671930 - protein, 17 aa, Entamoeba histolytica
DQGCPEIEEPFGYTSIF

SEQ ID NO: 2671931 - protein, 24 aa, Entamoeba histolytica
DQHVSRIIIIFNMVYPEDLTDQQR

SEQ ID NO: 2671932 - protein, 17 aa, Entamoeba histolytica
DQICPIHIAIQSGVNKS

SEQ ID NO: 2671933 - protein, 17 aa, Entamoeba histolytica
DQIFGRIHFRDHSEDTF

SEQ ID NO: 2671934 - protein, 17 aa, Entamoeba histolytica
DQIIIFDGTSHWSISLK

SEQ ID NO: 2671935 - protein, 18 aa, Entamoeba histolytica
DQINICVLTLVITFTSIR

SEQ ID NO: 2671936 - protein, 17 aa, Entamoeba histolytica
DQIQRWLDVDPNDIAIY

SEQ ID NO: 2671937 - protein, 22 aa, Entamoeba histolytica
DQIRIKKLLKMRDTIVCQISRK

SEQ ID NO: 2671938 - protein, 26 aa, Entamoeba histolytica
DQKYQLPSCGFDWCNQNPDLLCTWYL

SEQ ID NO: 2671939 - protein, 25 aa, Entamoeba histolytica
DQLDGLIIECIGLMGMYAVDDMTED

SEQ ID NO: 2671940 - protein, 18 aa, Entamoeba histolytica
DQLECIIHIYSVLELFFN

SEQ ID NO: 2671941 - protein, 21 aa, Entamoeba histolytica
DQLELRASFVATHNYKTTNVN

SEQ ID NO: 2671942 - protein, 21 aa, Entamoeba histolytica
DQLKSAMNYIHLKRQNEIELK

SEQ ID NO: 2671943 - protein, 26 aa, Entamoeba histolytica
DQLLIRLKKRFYFRDRNVNDTDQQQL

SEQ ID NO: 2671944 - protein, 18 aa, Entamoeba histolytica
DQLLKGYFGISVLNVANE

SEQ ID NO: 2671945 - protein, 37 aa, Entamoeba histolytica; identical to SEQ ID NO: 2477670

SEQ ID NO: 2671946 - protein, 20 aa, Entamoeba histolytica
DQLTYTGIISYDLVTLYWSK

SEQ ID NO: 2671947 - protein, 22 aa, Entamoeba histolytica
DQMKEYCDFIAYKVSDIAEFIG

SEQ ID NO: 2671948 - protein, 23 aa, Entamoeba histolytica
DQMKRKSHRGGRRVRRIREMYGM

SEQ ID NO: 2671949 - protein, 23 aa, Entamoeba histolytica
DQMLHFYVLISHVILLKDTLLKA

SEQ ID NO: 2671950 - protein, 20 aa, Entamoeba histolytica
DQNYRFIIFDDINYDKNLLR

SEQ ID NO: 2671951 - protein, 19 aa, Entamoeba histolytica
DQRPCHVIYSNTFPKEIQP

SEQ ID NO: 2671952 - protein, 22 aa, Entamoeba histolytica
DQRRVELCYGKLINLTANVRIN

SEQ ID NO: 2671953 - protein, 24 aa, Entamoeba histolytica
DQRSLLLLHRLEWILKDTSNDNDA

SEQ ID NO: 2671954 - protein, 17 aa, Entamoeba histolytica
DQSICYLLLQKIGVVEH

SEQ ID NO: 2671955 - protein, 17 aa, Entamoeba histolytica
DQSIFIQLIHSYKRSEF

SEQ ID NO: 2671956 - protein, 24 aa, Entamoeba histolytica
DQSVWKKRNFCLSQVLQVVPCGVF

SEQ ID NO: 2671957 - protein, 23 aa, Entamoeba histolytica
DQWKRLATELYLLKKQVPTQIKT

SEQ ID NO: 2671958 - protein, 18 aa, Entamoeba histolytica
DQYFKLRTNDFFSKGTSI

SEQ ID NO: 2671959 - protein, 25 aa, Entamoeba histolytica
DQYFLMKCVCHFMTPIPFFNIMCSD

SEQ ID NO: 2671960 - protein, 26 aa, Entamoeba histolytica
DREHIRFLVCIKFLKATKCSGLPVKQ

SEQ ID NO: 2671961 - protein, 26 aa, Entamoeba histolytica
DREIFIPLEIYCKLIDLSINTKKEHM

SEQ ID NO: 2671962 - protein, 24 aa, Entamoeba histolytica
DRELFKRRCKRCGEFGHLPKECKN

SEQ ID NO: 2671963 - protein, 20 aa, Entamoeba histolytica
DRETFNWGEKTVEVRYIKHP

SEQ ID NO: 2671964 - protein, 17 aa, Entamoeba histolytica
DRFAIMDFTCLFSTKTD

SEQ ID NO: 2671965 - protein, 19 aa, Entamoeba histolytica
DRFEEDVSLLLKLPSKIKG

SEQ ID NO: 2671966 - protein, 19 aa, Entamoeba histolytica
DRFGECYQLTKGQKKRFGY

SEQ ID NO: 2671967 - protein, 22 aa, Entamoeba histolytica
DRFIEHIGLKKVIERIYDEYLP

SEQ ID NO: 2671968 - protein, 38 aa, Entamoeba histolytica
DRFQRSYFYYRFDFKRCSEPLVIILVDHFVCIYQSGTS

SEQ ID NO: 2671969 - protein, 27 aa, Entamoeba histolytica
DRGLTYTIRLIFCGDEIIQTQARRLAV

SEQ ID NO: 2671970 - protein, 20 aa, Entamoeba histolytica
DRIEEIGIEHKICYGPYKTG

SEQ ID NO: 2671971 - protein, 21 aa, Entamoeba histolytica
DRIKRLGIEFRTNAKVDNIPS

SEQ ID NO: 2671972 - protein, 19 aa, Entamoeba histolytica
DRIRFPWYVAGGSYNEKSA

SEQ ID NO: 2671973 - protein, 25 aa, Entamoeba histolytica
DRKAFCFKTPQGCFVTPTVIENKLS

SEQ ID NO: 2671974 - protein, 24 aa, Entamoeba histolytica
DRKEIKASLYSASIWDDVINMTEF

SEQ ID NO: 2671975 - protein, 20 aa, Entamoeba histolytica
DRKKIMLHMIHIYKEKKEVE

SEQ ID NO: 2671976 - protein, 25 aa, Entamoeba histolytica
DRKRAARCLGELVDLFESKIVQELI

SEQ ID NO: 2671977 - protein, 22 aa, Entamoeba histolytica
DRKTAEGIMVHFKKGFEGKDNR

SEQ ID NO: 2671978 - protein, 23 aa, Entamoeba histolytica
DRLCCYPSYDFVHCLVDSFEDIT

SEQ ID NO: 2671979 - protein, 21 aa, Entamoeba histolytica
DRLGNDLPLIIFLSTKPEYRE

SEQ ID NO: 2671980 - protein, 20 aa, Entamoeba histolytica
DRLICDLLYEDALEYINSAT

SEQ ID NO: 2671981 - protein, 21 aa, Entamoeba histolytica
DRLKELPKRMPNPKQAYGDSG

SEQ ID NO: 2671982 - protein, 26 aa, Entamoeba histolytica
DRLKRLRPLLEISVKKVDSNICIVEK

SEQ ID NO: 2671983 - protein, 19 aa, Entamoeba histolytica
DRLLWLTSIICHSQQSNIY

SEQ ID NO: 2671984 - protein, 33 aa, Entamoeba histolytica
DRLNPTFSWPKEWRGMYGYELKKIIGNGVICCD

SEQ ID NO: 2671985 - protein, 20 aa, Entamoeba histolytica
DRLQELVKRNCLLFNRVNAL

SEQ ID NO: 2671986 - protein, 31 aa, Entamoeba histolytica
DRLQLSIKVLECLSLNCHHGVILKTSTDKES

SEQ ID NO: 2671987 - protein, 24 aa, Entamoeba histolytica
DRNRCSFEGITFRHYQLIDETHLE

SEQ ID NO: 2671988 - protein, 26 aa, Entamoeba histolytica
DRNYHAICGIVFAFVRIPEIEQLKLQ

SEQ ID NO: 2671989 - protein, 21 aa, Entamoeba histolytica
DRRAGDFIIYYNTNFYIGKPE

SEQ ID NO: 2671990 - protein, 26 aa, Entamoeba histolytica
DRRHIVCPNPAFIMQLYEWQRKYHSC

SEQ ID NO: 2671991 - protein, 24 aa, Entamoeba histolytica
DRRMQFKILMGFVNEFVDQAISYF

SEQ ID NO: 2671992 - protein, 21 aa, Entamoeba histolytica
DRRRKIMSISIKRNEYDFLHH

SEQ ID NO: 2671993 - protein, 20 aa, Entamoeba histolytica
DRSLIKMCQRFGDFRKDDPN

SEQ ID NO: 2671994 - protein, 17 aa, Entamoeba histolytica
DRSTACYGHISKANPFL

SEQ ID NO: 2671995 - protein, 42 aa, Entamoeba histolytica
DRSVIYWDIPFSEYKLGRNLALIKEHVDGIILMTNKDIESSF

SEQ ID NO: 2671996 - protein, 17 aa, Entamoeba histolytica
DRTLRWWDMAHSRCKLS

SEQ ID NO: 2671997 - protein, 17 aa, Entamoeba histolytica
DRTQFLLTFNKRKKELN

SEQ ID NO: 2671998 - protein, 17 aa, Entamoeba histolytica
DRVAKLIKKWYFHRQNK

SEQ ID NO: 2671999 - protein, 19 aa, Entamoeba histolytica
DRVSEDMMRIIKNMRRRGY

SEQ ID NO: 2672000 - protein, 17 aa, Entamoeba histolytica
DRVSFINNFWHGVSSDG

SEQ ID NO: 2672001 - protein, 19 aa, Entamoeba histolytica
DRVSMKMCLECSKQNINAK

SEQ ID NO: 2672002 - protein, 19 aa, Entamoeba histolytica
DRVVISLNCPFSKCRMNNP

SEQ ID NO: 2672003 - protein, 21 aa, Entamoeba histolytica
DRVYNSWATKVFAGLDNVACV

SEQ ID NO: 2672004 - protein, 20 aa, Entamoeba histolytica
DRYEADWSMVERGWKAHVRG

SEQ ID NO: 2672005 - protein, 17 aa, Entamoeba histolytica
DRYEFPRELDLYPYCIE

SEQ ID NO: 2672006 - protein, 22 aa, Entamoeba histolytica
DRYEGYYNYLLFESYKKLHPSI

SEQ ID NO: 2672007 - protein, 17 aa, Entamoeba histolytica
DRYKHPSTSVLACALTK

SEQ ID NO: 2672008 - protein, 26 aa, Entamoeba histolytica
DSAKYVSAVLCCLSVMTSLEIPHLNV

SEQ ID NO: 2672009 - protein, 20 aa, Entamoeba histolytica
DSAPIKKAWEAEARKKKKLQ

SEQ ID NO: 2672010 - protein, 17 aa, Entamoeba histolytica
DSASNINTWGYYASDGY

SEQ ID NO: 2672011 - protein, 17 aa, Entamoeba histolytica
DSAVISMSWPEMENQQR

SEQ ID NO: 2672012 - protein, 18 aa, Entamoeba histolytica
DSCEVVRGMMASVMKYLL

SEQ ID NO: 2672013 - protein, 20 aa, Entamoeba histolytica
DSCIPKCPKCGKEMTQNLRS

SEQ ID NO: 2672014 - protein, 22 aa, Entamoeba histolytica
DSDFKFGKPCNKEWKIVTYNKE

SEQ ID NO: 2672015 - protein, 18 aa, Entamoeba histolytica
DSDIYSCLLENLRTDYAI

SEQ ID NO: 2672016 - protein, 19 aa, Entamoeba histolytica
DSDNIVWLCIVAKTENPRQ

SEQ ID NO: 2672017 - protein, 39 aa, Entamoeba histolytica
DSEEFCGHYMFPYCILNKHLPFWGGYVGSHFEIEWDDRS

SEQ ID NO: 2672018 - protein, 23 aa, Entamoeba histolytica
DSELWDLRMLKLKKTTDLLNGCY

SEQ ID NO: 2672019 - protein, 26 aa, Entamoeba histolytica
DSENILCFAGAFLISGNCGENEESRL

SEQ ID NO: 2672020 - protein, 19 aa, Entamoeba histolytica
DSEQICALLPETTSRLLRI

SEQ ID NO: 2672021 - protein, 24 aa, Entamoeba histolytica
DSERLDDILLFSGFKDIKQRELAT

SEQ ID NO: 2672022 - protein, 37 aa, Entamoeba histolytica
DSESGYKFILGMMFSLYRKYCICRSVSDESNNFKTGN

SEQ ID NO: 2672023 - protein, 20 aa, Entamoeba histolytica
DSESIIFPFLYENEIIQWLT

SEQ ID NO: 2672024 - protein, 22 aa, Entamoeba histolytica
DSEVWKEYDLVLKKGYKAIKFE

SEQ ID NO: 2672025 - protein, 28 aa, Entamoeba histolytica
DSEVYHWAVKLKKQFETLWKNAFKEKKP

SEQ ID NO: 2672026 - protein, 17 aa, Entamoeba histolytica
DSFAPTWTKSGLRELRF

SEQ ID NO: 2672027 - protein, 24 aa, Entamoeba histolytica
DSFDLRKCIPLNIVGNGAYGTIIK

SEQ ID NO: 2672028 - protein, 23 aa, Entamoeba histolytica
DSFEYAKLLQLFSENDFVLIRNE

SEQ ID NO: 2672029 - protein, 17 aa, Entamoeba histolytica
DSFFASELWEAFDDEKR

SEQ ID NO: 2672030 - protein, 19 aa, Entamoeba histolytica
DSFLHKISGLSILNYGTIN

SEQ ID NO: 2672031 - protein, 18 aa, Entamoeba histolytica
DSFLSSSYFYHYQVSSNN

SEQ ID NO: 2672032 - protein, 17 aa, Entamoeba histolytica
DSFPAELFVDKKYIKVL

SEQ ID NO: 2672033 - protein, 23 aa, Entamoeba histolytica
DSFSTAFLPMILNLAFDSTSNVR

SEQ ID NO: 2672034 - protein, 25 aa, Entamoeba histolytica
DSFVDGKAFLALLCSLDKDQKTFDK

SEQ ID NO: 2672035 - protein, 18 aa, Entamoeba histolytica
DSFYRQLISFGIHPWHCG

SEQ ID NO: 2672036 - protein, 18 aa, Entamoeba histolytica
DSFYYFMKKIRSINEKTT

SEQ ID NO: 2672037 - protein, 17 aa, Entamoeba histolytica
DSGCILLKHISYNNFDE

SEQ ID NO: 2672038 - protein, 23 aa, Entamoeba histolytica
DSGDSIFTYFGYRKFSKGNYKGF

SEQ ID NO: 2672039 - protein, 25 aa, Entamoeba histolytica
DSGKRIWKELVFKPNSFEIISECLS

SEQ ID NO: 2672040 - protein, 25 aa, Entamoeba histolytica
DSGLMAKMHLIDYSMLVGVHNLTEE

SEQ ID NO: 2672041 - protein, 23 aa, Entamoeba histolytica
DSGQCARALKLQHFSLKYLLQKY

SEQ ID NO: 2672042 - protein, 23 aa, Entamoeba histolytica
DSHKVFIKNGSIYFNELTYTNPF

SEQ ID NO: 2672043 - protein, 24 aa, Entamoeba histolytica
DSHSELRPILPSLDTFQSTPSPIK

SEQ ID NO: 2672044 - protein, 19 aa, Entamoeba histolytica
DSIDIPILVPIPVVKNQSC

SEQ ID NO: 2672045 - protein, 24 aa, Entamoeba histolytica
DSIHRCVNELLKLVNVTAQPINEK

SEQ ID NO: 2672046 - protein, 32 aa, Entamoeba histolytica; identical to SEQ ID NO: 2477776

SEQ ID NO: 2672047 - protein, 17 aa, Entamoeba histolytica
DSIIHFIVEMVIVKKMI

SEQ ID NO: 2672048 - protein, 31 aa, Entamoeba histolytica; identical to SEQ ID NO: 2521198

SEQ ID NO: 2672049 - protein, 25 aa, Entamoeba histolytica
DSIKLIGKYAFKSSILLQPPNIPNG

SEQ ID NO: 2672050 - protein, 25 aa, Entamoeba histolytica
DSIKTRSSFTIKRSKYFNPITNKLS

SEQ ID NO: 2672051 - protein, 18 aa, Entamoeba histolytica
DSILSIPLTNSFQSSESV

SEQ ID NO: 2672052 - protein, 24 aa, Entamoeba histolytica
DSINKFCSFDWWCQAIESGEKLCL

SEQ ID NO: 2672053 - protein, 19 aa, Entamoeba histolytica
DSIPEPKDCIPFVPFSLHS

SEQ ID NO: 2672054 - protein, 20 aa, Entamoeba histolytica
DSIPLFGFVGRICEQKGVFL

SEQ ID NO: 2672055 - protein, 27 aa, Entamoeba histolytica
DSIRFVSKRIFYCFIHQLPKCNLEILS

SEQ ID NO: 2672056 - protein, 19 aa, Entamoeba histolytica
DSISFWYGNNDCRCLDYLT

SEQ ID NO: 2672057 - protein, 21 aa, Entamoeba histolytica
DSIVAKGRFHLFTAKGELKDK

SEQ ID NO: 2672058 - protein, 19 aa, Entamoeba histolytica
DSKILATLCEQGNTNQFIP

SEQ ID NO: 2672059 - protein, 19 aa, Entamoeba histolytica
DSKKKCEIVLDIQCLSYHV

SEQ ID NO: 2672060 - protein, 27 aa, Entamoeba histolytica
DSKVKAPMILKCFLTFAERLNIDDSLY

SEQ ID NO: 2672061 - protein, 21 aa, Entamoeba histolytica
DSKYSAILCGNKIDSEDRIVT

SEQ ID NO: 2672062 - protein, 24 aa, Entamoeba histolytica
DSLAPTIIKLCIGFNEDSIKKRAI

SEQ ID NO: 2672063 - protein, 21 aa, Entamoeba histolytica
DSLCGNLKPAVYASLHDYITS

SEQ ID NO: 2672064 - protein, 24 aa, Entamoeba histolytica
DSLETCLWIFINITSMSDVYVFHV

SEQ ID NO: 2672065 - protein, 24 aa, Entamoeba histolytica
DSLGGNCKTVIIGTVSPSLSSIKE

SEQ ID NO: 2672066 - protein, 35 aa, Entamoeba histolytica
DSLIDKITWWAGRLFFNEFEMLMKVLKESNENSGQ

SEQ ID NO: 2672067 - protein, 19 aa, Entamoeba histolytica
DSLIPVPILYDIIRTAIDH

SEQ ID NO: 2672068 - protein, 19 aa, Entamoeba histolytica
DSLLFLYIEFIIKLNEMLS

SEQ ID NO: 2672069 - protein, 23 aa, Entamoeba histolytica
DSLPEFLPDGILKKLTKKVGAKM

SEQ ID NO: 2672070 - protein, 20 aa, Entamoeba histolytica
DSLRSLLLKNERVIDQLFQY

SEQ ID NO: 2672071 - protein, 18 aa, Entamoeba histolytica
DSMARKVAIQTLMETTKS

SEQ ID NO: 2672072 - protein, 24 aa, Entamoeba histolytica
DSNAHPILLCFQSSPIFSQQETRF

SEQ ID NO: 2672073 - protein, 22 aa, Entamoeba histolytica
DSNDIFSGLSYSSSKKQHNSNS

SEQ ID NO: 2672074 - protein, 18 aa, Entamoeba histolytica
DSNIPYFIDHINRVVYDD

SEQ ID NO: 2672075 - protein, 24 aa, Entamoeba histolytica
DSNLKRTLDFGGFGSESGKFNEPT

SEQ ID NO: 2672076 - protein, 21 aa, Entamoeba histolytica
DSNPIPFGSVDFSNFHVDFTS

SEQ ID NO: 2672077 - protein, 25 aa, Entamoeba histolytica
DSPECALCKVKFTFVNRRHHCRKCG

SEQ ID NO: 2672078 - protein, 22 aa, Entamoeba histolytica
DSPIKRRPVINMTQRGQRNSPL

SEQ ID NO: 2672079 - protein, 18 aa, Entamoeba histolytica
DSPILICTLVCDKEANVV

SEQ ID NO: 2672080 - protein, 23 aa, Entamoeba histolytica
DSPNSLHCFRILSLSSSEVDITF

SEQ ID NO: 2672081 - protein, 24 aa, Entamoeba histolytica
DSQCCKLSLLSPIISQCIKTLKEN

SEQ ID NO: 2672082 - protein, 26 aa, Entamoeba histolytica
DSQCKYMAIASGRADVYLRLPRNLSY

SEQ ID NO: 2672083 - protein, 31 aa, Entamoeba histolytica
DSQLNIIEFFIAMACLNHYILFKKLPIKIPV

SEQ ID NO: 2672084 - protein, 24 aa, Entamoeba histolytica
DSQLRKSTILDLAKYFKQVYVWQG

SEQ ID NO: 2672085 - protein, 24 aa, Entamoeba histolytica
DSQRKSEMTGIVFPSQRMRGGPLK

SEQ ID NO: 2672086 - protein, 22 aa, Entamoeba histolytica
DSQRLETCIVCNKRIEGEFVSA

SEQ ID NO: 2672087 - protein, 18 aa, Entamoeba histolytica
DSRLTLMEIELSKKTVAY

SEQ ID NO: 2672088 - protein, 17 aa, Entamoeba histolytica
DSRMFSIDIEIGKDKQI

SEQ ID NO: 2672089 - protein, 25 aa, Entamoeba histolytica
DSRMKEFINDLVLAKKRVEKGVPNS

SEQ ID NO: 2672090 - protein, 27 aa, Entamoeba histolytica
DSSEIQKCIKGYSYILIFLKFNYGNIL

SEQ ID NO: 2672091 - protein, 23 aa, Entamoeba histolytica
DSSFKQPLCDIIMKIFPHVQSLL

SEQ ID NO: 2672092 - protein, 23 aa, Entamoeba histolytica
DSSILKHQKDFFVLVKSQLEQQQ

SEQ ID NO: 2672093 - protein, 24 aa, Entamoeba histolytica
DSSKAFIKREFHALKINPKGKAQD

SEQ ID NO: 2672094 - protein, 25 aa, Entamoeba histolytica
DSSRSKLLYDFTINFTIENQEESLV

SEQ ID NO: 2672095 - protein, 22 aa, Entamoeba histolytica
DSSVGKTCIIGRFMNGDFNTGY

SEQ ID NO: 2672096 - protein, 22 aa, Entamoeba histolytica
DSSVGKTCIIGRFMTGDFNTGY

SEQ ID NO: 2672097 - protein, 18 aa, Entamoeba histolytica
DSTCNSNFSFYWDLLKIC

SEQ ID NO: 2672098 - protein, 24 aa, Entamoeba histolytica
DSTIKGEILIALTKLSARIPSQFN

SEQ ID NO: 2672099 - protein, 23 aa, Entamoeba histolytica
DSTKKRYGFQFKYGKHTQKLLTD

SEQ ID NO: 2672100 - protein, 22 aa, Entamoeba histolytica
DSTKWTIVPALSFNPSQADFMT

SEQ ID NO: 2672101 - protein, 17 aa, Entamoeba histolytica
DSVFEAIAMEYPDVTAE

SEQ ID NO: 2672102 - protein, 19 aa, Entamoeba histolytica
DSVIIWDAIFAYGNSLKLC

SEQ ID NO: 2672103 - protein, 26 aa, Entamoeba histolytica
DSVIRFGKIQRIICMNSHRPDMPHSL

SEQ ID NO: 2672104 - protein, 17 aa, Entamoeba histolytica
DSVYEGLYWILFKNQSN

SEQ ID NO: 2672105 - protein, 24 aa, Entamoeba histolytica
DSWIEIENGFKLYQEKSGTVFTIP

SEQ ID NO: 2672106 - protein, 24 aa, Entamoeba histolytica
DSYGCLFLPSFNLRSYLSQEEDCK

SEQ ID NO: 2672107 - protein, 19 aa, Entamoeba histolytica
DSYHTLGMIYLDLGDTKTA

SEQ ID NO: 2672108 - protein, 23 aa, Entamoeba histolytica
DSYINFSPFWKKKDGTKIPEGTK

SEQ ID NO: 2672109 - protein, 18 aa, Entamoeba histolytica
DSYIPFRSSPLTRILQDA

SEQ ID NO: 2672110 - protein, 23 aa, Entamoeba histolytica
DSYKYSICLTNLSSFYLYESYDS

SEQ ID NO: 2672111 - protein, 25 aa, Entamoeba histolytica
DSYYKICKMIQSFWEGEKCLYLQIF

SEQ ID NO: 2672112 - protein, 24 aa, Entamoeba histolytica
DTCGICGASFGLITRRHHCRRCGK

SEQ ID NO: 2672113 - protein, 18 aa, Entamoeba histolytica
DTDFSRNNWIWSRVIELN

SEQ ID NO: 2672114 - protein, 25 aa, Entamoeba histolytica
DTDILFKFNEAFAVAKTKGSDELHL

SEQ ID NO: 2672115 - protein, 26 aa, Entamoeba histolytica
DTDILFKFNEAFAVAKTKGSDELHLH

SEQ ID NO: 2672116 - protein, 25 aa, Entamoeba histolytica
DTDKLVECYQLILDVAAWINEKKLY

SEQ ID NO: 2672117 - protein, 18 aa, Entamoeba histolytica
DTEDCIKPLYSMEKTMGM

SEQ ID NO: 2672118 - protein, 33 aa, Entamoeba histolytica
DTEFKGEILDFIGESKWNIIRIIIYNKSLKSST

SEQ ID NO: 2672119 - protein, 21 aa, Entamoeba histolytica
DTEGIFRISVSVKDLEETMTK

SEQ ID NO: 2672120 - protein, 20 aa, Entamoeba histolytica
DTEIMFCKRNHKPLILSNKH

SEQ ID NO: 2672121 - protein, 24 aa, Entamoeba histolytica
DTEKPETFTVFFGKKQQNQVSKSK

SEQ ID NO: 2672122 - protein, 25 aa, Entamoeba histolytica
DTELCPYCNGHIKKANFKIHELRCR

SEQ ID NO: 2672123 - protein, 24 aa, Entamoeba histolytica
DTELIELGKWIGINEKLIFESKEV

SEQ ID NO: 2672124 - protein, 19 aa, Entamoeba histolytica
DTFLRRQSRSFQRAITPKH

SEQ ID NO: 2672125 - protein, 22 aa, Entamoeba histolytica
DTFLRRQSRSFQRAITPRKTGK

SEQ ID NO: 2672126 - protein, 23 aa, Entamoeba histolytica
DTGQKYFHWEFEGEMKKSMIEQE

SEQ ID NO: 2672127 - protein, 19 aa, Entamoeba histolytica
DTHLSTVVSSCFQKTIHLS

SEQ ID NO: 2672128 - protein, 28 aa, Entamoeba histolytica
DTIIARKFLCCGPLFIVEKVTEIPQKWM

SEQ ID NO: 2672129 - protein, 24 aa, Entamoeba histolytica
DTIIKCGKLLYGEKYIDNGEQNTS

SEQ ID NO: 2672130 - protein, 25 aa, Entamoeba histolytica
DTKGDGEGCWWGCVIKGDHVIDVKR

SEQ ID NO: 2672131 - protein, 24 aa, Entamoeba histolytica
DTKKRIIGLLKIWTSTVSPNIIQA

SEQ ID NO: 2672132 - protein, 19 aa, Entamoeba histolytica
DTKLWKYIIPYVNIAIKQK

SEQ ID NO: 2672133 - protein, 27 aa, Entamoeba histolytica
DTKMICGGGCVEMELSLAVEEAAKKTE

SEQ ID NO: 2672134 - protein, 17 aa, Entamoeba histolytica
DTKPGMVQLKCEGQTIN

SEQ ID NO: 2672135 - protein, 27 aa, Entamoeba histolytica
DTKRELIHILRIMLPLKKENNNNNKEE

SEQ ID NO: 2672136 - protein, 20 aa, Entamoeba histolytica
DTKTQFPVVFGRGKEGTRDG

SEQ ID NO: 2672137 - protein, 18 aa, Entamoeba histolytica
DTKTVFILQMANYIEAEW

SEQ ID NO: 2672138 - protein, 20 aa, Entamoeba histolytica
DTLCKLIKRDIDIENGDIEI

SEQ ID NO: 2672139 - protein, 23 aa, Entamoeba histolytica
DTLEMKLYRLSETVMPSLNYGSM

SEQ ID NO: 2672140 - protein, 19 aa, Entamoeba histolytica
DTLGNIVIEFMKRMNELTP

SEQ ID NO: 2672141 - protein, 26 aa, Entamoeba histolytica
DTLKEETRIKILMLLKNITKCNDHQL

SEQ ID NO: 2672142 - protein, 24 aa, Entamoeba histolytica
DTLLSILLRLDFDVKYQSKEDRCY

SEQ ID NO: 2672143 - protein, 21 aa, Entamoeba histolytica
DTLPCLRYLFDSDAPKYHVPL

SEQ ID NO: 2672144 - protein, 21 aa, Entamoeba histolytica
DTLPEGFSFSFNKQNNKEEYS

SEQ ID NO: 2672145 - protein, 21 aa, Entamoeba histolytica
DTLTYILLSWIIKGIPLEHAV

SEQ ID NO: 2672146 - protein, 17 aa, Entamoeba histolytica
DTMTVIIYQTVVDYLNS

SEQ ID NO: 2672147 - protein, 20 aa, Entamoeba histolytica
DTNICYLNLVSPHHEATPEA

SEQ ID NO: 2672148 - protein, 19 aa, Entamoeba histolytica
DTPFTFNLLEEIKHVDPEN

SEQ ID NO: 2672149 - protein, 17 aa, Entamoeba histolytica
DTPLPITVESLCNILLP

SEQ ID NO: 2672150 - protein, 19 aa, Entamoeba histolytica
DTRKSFVRGSLAFVYCTIF

SEQ ID NO: 2672151 - protein, 20 aa, Entamoeba histolytica
DTSFISFKILTLLYPQPIWN

SEQ ID NO: 2672152 - protein, 28 aa, Entamoeba histolytica
DTSITLIIKMLCEWGLFYHPNNKNQGNI

SEQ ID NO: 2672153 - protein, 25 aa, Entamoeba histolytica
DTTEIKNAMSFMFASLYEKIINIEV

SEQ ID NO: 2672154 - protein, 19 aa, Entamoeba histolytica
DTTICLVGSHLAAHQPEIN

SEQ ID NO: 2672155 - protein, 21 aa, Entamoeba histolytica
DTVHPLFQFKTLPVQVLLKLQ

SEQ ID NO: 2672156 - protein, 17 aa, Entamoeba histolytica
DTVYDGWERKSFNKHVM

SEQ ID NO: 2672157 - protein, 19 aa, Entamoeba histolytica
DTYLACVRCCKDYANSPYK

SEQ ID NO: 2672158 - protein, 23 aa, Entamoeba histolytica
DVACVINFDCPISIVSYTHRIGR

SEQ ID NO: 2672159 - protein, 23 aa, Entamoeba histolytica
DVAPKKVMYCLSIFIESTKHLTS

SEQ ID NO: 2672160 - protein, 18 aa, Entamoeba histolytica
DVATIFKVLIPKGKSVTF

SEQ ID NO: 2672161 - protein, 20 aa, Entamoeba histolytica
DVDCLWKKEFKRFAQTRSLL

SEQ ID NO: 2672162 - protein, 19 aa, Entamoeba histolytica
DVDKVECKGAKEMLLMIPE

SEQ ID NO: 2672163 - protein, 29 aa, Entamoeba histolytica
DVDMLFKKYQHALSFLAEIKFISKDRNPF

SEQ ID NO: 2672164 - protein, 24 aa, Entamoeba histolytica
DVDRIPIRFNKHIIRNKRFTTTVL

SEQ ID NO: 2672165 - protein, 21 aa, Entamoeba histolytica
DVDRTVALYGYVRGTNMRPNA

SEQ ID NO: 2672166 - protein, 21 aa, Entamoeba histolytica
DVDSWTSIVCEGKFVNEICPQ

SEQ ID NO: 2672167 - protein, 21 aa, Entamoeba histolytica
DVDYCRTLFESPMWNADDVKL

SEQ ID NO: 2672168 - protein, 24 aa, Entamoeba histolytica
DVDYNTAMAFVQSWLNVTSQNLSR

SEQ ID NO: 2672169 - protein, 25 aa, Entamoeba histolytica
DVEGFACGFLKQTHKAVIISMANSE

SEQ ID NO: 2672170 - protein, 34 aa, Entamoeba histolytica
DVEGVPVYINHLWRKCYGDESCKNYLNIRYPLPE

SEQ ID NO: 2672171 - protein, 24 aa, Entamoeba histolytica
DVEMWKKQEIIDGFVDLDGMSVGA

SEQ ID NO: 2672172 - protein, 25 aa, Entamoeba histolytica
DVFDWAMKRISAFTHNIVYHDPVEG

SEQ ID NO: 2672173 - protein, 25 aa, Entamoeba histolytica
DVFGMPSALSFPFDVIFRQPSTSSF

SEQ ID NO: 2672174 - protein, 29 aa, Entamoeba histolytica
DVFKIKDIWKRVCIVWTKCFNHFSKDEIK

SEQ ID NO: 2672175 - protein, 29 aa, Entamoeba histolytica
DVFTIKDIWKRVCIVWNKCDIDEVRGIGK

SEQ ID NO: 2672176 - protein, 25 aa, Entamoeba histolytica
DVFTSIKCLLQLKMNDVLTAENEVA

SEQ ID NO: 2672177 - protein, 18 aa, Entamoeba histolytica
DVFYQYELDNHKNDILKF

SEQ ID NO: 2672178 - protein, 17 aa, Entamoeba histolytica
DVGCGTGILSMFAARNG

SEQ ID NO: 2672179 - protein, 17 aa, Entamoeba histolytica
DVGEFYFRVLKSEELLT

SEQ ID NO: 2672180 - protein, 18 aa, Entamoeba histolytica
DVGIKFGVGDDISDDEIN

SEQ ID NO: 2672181 - protein, 24 aa, Entamoeba histolytica
DVHAKFAIALQCGNFKAALEAAKQ

SEQ ID NO: 2672182 - protein, 20 aa, Entamoeba histolytica
DVICELRKVTILMLQQNRIK

SEQ ID NO: 2672183 - protein, 24 aa, Entamoeba histolytica
DVICELRKVTILMLQQNRIKEVPD

SEQ ID NO: 2672184 - protein, 20 aa, Entamoeba histolytica
DVICGVLLGKAFIPFGAPEH

SEQ ID NO: 2672185 - protein, 23 aa, Entamoeba histolytica
DVICPECIVRPSYVSEVRKDDED

SEQ ID NO: 2672186 - protein, 23 aa, Entamoeba histolytica
DVIDFAKRCYYWIHFGFTELGDL

SEQ ID NO: 2672187 - protein, 25 aa, Entamoeba histolytica
DVIEFKNIIKFICECYNMKIFAEEF

SEQ ID NO: 2672188 - protein, 17 aa, Entamoeba histolytica
DVIEMINEFLIFNDGVF

SEQ ID NO: 2672189 - protein, 26 aa, Entamoeba histolytica
DVIEPKSYMCVIGEGFTIKHHPEEHG

SEQ ID NO: 2672190 - protein, 24 aa, Entamoeba histolytica
DVIFDPKKDWTFDSLSTCFSKSER

SEQ ID NO: 2672191 - protein, 19 aa, Entamoeba histolytica
DVIKEWSYEVFFNTNGTSN

SEQ ID NO: 2672192 - protein, 23 aa, Entamoeba histolytica
DVIKKEKRYTFSLDKSIMNCKYV

SEQ ID NO: 2672193 - protein, 24 aa, Entamoeba histolytica
DVILKDELRGMRRVLKRLGYVSED

SEQ ID NO: 2672194 - protein, 17 aa, Entamoeba histolytica
DVIMSSYFINYIGLGVK

SEQ ID NO: 2672195 - protein, 24 aa, Entamoeba histolytica
DVINGCFNFQIPEYNLINFSMEHS

SEQ ID NO: 2672196 - protein, 18 aa, Entamoeba histolytica
DVIPIVVICSQFVKEDHR

SEQ ID NO: 2672197 - protein, 23 aa, Entamoeba histolytica
DVIRLREKLTYSHTFGIYVDLQL

SEQ ID NO: 2672198 - protein, 23 aa, Entamoeba histolytica
DVISKFAPYCCLLNLDECKDVNK

SEQ ID NO: 2672199 - protein, 34 aa, Entamoeba histolytica
DVISPLRLKIMNFVRIWIKNAWRDFEGQTELIEK

SEQ ID NO: 2672200 - protein, 22 aa, Entamoeba histolytica
DVKKKGIIKYSRKPKVEDKEED

SEQ ID NO: 2672201 - protein, 18 aa, Entamoeba histolytica
DVKKNFIAMLTFCDGEEP

SEQ ID NO: 2672202 - protein, 18 aa, Entamoeba histolytica
DVKKNFVAMLTFCDGEKP

SEQ ID NO: 2672203 - protein, 22 aa, Entamoeba histolytica
DVKRNFLILLNFFVKTGHFNDQ

SEQ ID NO: 2672204 - protein, 24 aa, Entamoeba histolytica
DVKYSTQTSFGFCVASNNSIVLLS

SEQ ID NO: 2672205 - protein, 17 aa, Entamoeba histolytica
DVLEKSGVLIFKDSSAN

SEQ ID NO: 2672206 - protein, 18 aa, Entamoeba histolytica
DVLFKECINQFLSNDYSF

SEQ ID NO: 2672207 - protein, 18 aa, Entamoeba histolytica
DVLKHLSQFTYFYECNAP

SEQ ID NO: 2672208 - protein, 21 aa, Entamoeba histolytica
DVLKKYCYDKILMKQNKDLSN

SEQ ID NO: 2672209 - protein, 25 aa, Entamoeba histolytica
DVLKTCSITKSFKLYYDIVSQSTIR

SEQ ID NO: 2672210 - protein, 20 aa, Entamoeba histolytica
DVLKYMCLILSIQPIYSKFI

SEQ ID NO: 2672211 - protein, 17 aa, Entamoeba histolytica
DVLPTRNLIGVTILYGP

SEQ ID NO: 2672212 - protein, 23 aa, Entamoeba histolytica
DVLSGSLATFVAWSKLNQDFQDE

SEQ ID NO: 2672213 - protein, 17 aa, Entamoeba histolytica
DVLYTIKIVFVGDPCTL

SEQ ID NO: 2672214 - protein, 25 aa, Entamoeba histolytica
DVMLEKTLMEFSRRSVVDCIQGSVV

SEQ ID NO: 2672215 - protein, 28 aa, Entamoeba histolytica
DVNALNCLILFPCLKFVEFCLIEEKQNS

SEQ ID NO: 2672216 - protein, 41 aa, Entamoeba histolytica; identical to SEQ ID NO: 2477962

SEQ ID NO: 2672217 - protein, 18 aa, Entamoeba histolytica
DVNECKICQSEIKKKKKY

SEQ ID NO: 2672218 - protein, 25 aa, Entamoeba histolytica
DVNELRMKATSFKAVNIEEITSALS

SEQ ID NO: 2672219 - protein, 17 aa, Entamoeba histolytica
DVNGCGINKLGDMMRGM

SEQ ID NO: 2672220 - protein, 17 aa, Entamoeba histolytica
DVNGGIIYNIVARNDEQ

SEQ ID NO: 2672221 - protein, 25 aa, Entamoeba histolytica
DVNVFKILIISSIKLGKDVMQFEET

SEQ ID NO: 2672222 - protein, 31 aa, Entamoeba histolytica
DVPAGYYDIRICTYSGMTRFAVYTRVCEVSK

SEQ ID NO: 2672223 - protein, 25 aa, Entamoeba histolytica
DVPLKEGLPLPVYDSLKYFKENPTL

SEQ ID NO: 2672224 - protein, 26 aa, Entamoeba histolytica
DVPLSGICLYFDCTFLKKSYLTTKPD

SEQ ID NO: 2672225 - protein, 17 aa, Entamoeba histolytica
DVQIYVYSIKFGDKKYL

SEQ ID NO: 2672226 - protein, 19 aa, Entamoeba histolytica
DVQKLLIIREHCWQKNFEF

SEQ ID NO: 2672227 - protein, 20 aa, Entamoeba histolytica
DVQLPLLMSLVRTFTNRSTG

SEQ ID NO: 2672228 - protein, 24 aa, Entamoeba histolytica
DVRTPEFLNAIALGDIVIVEVPNI

SEQ ID NO: 2672229 - protein, 27 aa, Entamoeba histolytica
DVRVAYEATRILCNLINLKSEYANTIM

SEQ ID NO: 2672230 - protein, 19 aa, Entamoeba histolytica
DVRVQRMIIHLLANIAGDS

SEQ ID NO: 2672231 - protein, 26 aa, Entamoeba histolytica
DVSAVCYIELIAFMSFVNYQKEIPIV

SEQ ID NO: 2672232 - protein, 25 aa, Entamoeba histolytica
DVSIRETICAWDWKMREQAGSDKYG

SEQ ID NO: 2672233 - protein, 22 aa, Entamoeba histolytica
DVSLIWNCLGTLITSFTSTSNG

SEQ ID NO: 2672234 - protein, 24 aa, Entamoeba histolytica
DVSLKYPLHPNAMYSLISVRGKQQ

SEQ ID NO: 2672235 - protein, 23 aa, Entamoeba histolytica
DVSRVSMNWLIKLRLMHINSQLK

SEQ ID NO: 2672236 - protein, 17 aa, Entamoeba histolytica
DVSRYLIDIALKRQSFD

SEQ ID NO: 2672237 - protein, 24 aa, Entamoeba histolytica
DVTCYSFRWVSMLFIDDFSIKDVI

SEQ ID NO: 2672238 - protein, 17 aa, Entamoeba histolytica
DVTHYIQGLPFIAQTAL

SEQ ID NO: 2672239 - protein, 20 aa, Entamoeba histolytica
DVTIPIEFEEQGIKISGIVS

SEQ ID NO: 2672240 - protein, 21 aa, Entamoeba histolytica
DVTPCLIHFGIPPEGCTAYYS

SEQ ID NO: 2672241 - protein, 25 aa, Entamoeba histolytica
DVTVMIEIFYRGLGVSFVEGEVLKK

SEQ ID NO: 2672242 - protein, 22 aa, Entamoeba histolytica
DVVGLTGWKIFESRKYKSEPKY

SEQ ID NO: 2672243 - protein, 20 aa, Entamoeba histolytica
DVVILWDAIFAFGHQLKLVD

SEQ ID NO: 2672244 - protein, 21 aa, Entamoeba histolytica
DVVKGWELIDYILKFQPSLYQ

SEQ ID NO: 2672245 - protein, 17 aa, Entamoeba histolytica
DVVQVEGGFTFIIIDYF

SEQ ID NO: 2672246 - protein, 20 aa, Entamoeba histolytica
DVVRYLVYWGKAKVIEAVFL

SEQ ID NO: 2672247 - protein, 23 aa, Entamoeba histolytica
DVVTSVSVNEIWKGITDNTNEYT

SEQ ID NO: 2672248 - protein, 25 aa, Entamoeba histolytica
DVYISFKGSIPFLRKTSPMHLTHDQ

SEQ ID NO: 2672249 - protein, 37 aa, Entamoeba histolytica
DVYLASILICLPLLPPHRRVVLRIAKNIFIKENIQLP

SEQ ID NO: 2672250 - protein, 19 aa, Entamoeba histolytica
DVYLFKPYMDKIFENINPL

SEQ ID NO: 2672251 - protein, 19 aa, Entamoeba histolytica
DVYSFGILVFHVLTQLVNT

SEQ ID NO: 2672252 - protein, 24 aa, Entamoeba histolytica
DVYYVYNCIDLIFIHLQGSEEVVF

SEQ ID NO: 2672253 - protein, 19 aa, Entamoeba histolytica
DWAEVVNAPQGGNVEGIEK

SEQ ID NO: 2672254 - protein, 30 aa, Entamoeba histolytica; identical to SEQ ID NO: 2478004

SEQ ID NO: 2672255 - protein, 26 aa, Entamoeba histolytica
DWCISRQLWWGHRIPAYLIKSKKEKE

SEQ ID NO: 2672256 - protein, 22 aa, Entamoeba histolytica
DWENSIHCYYVFEQAIFSLIEL

SEQ ID NO: 2672257 - protein, 19 aa, Entamoeba histolytica
DWIDVEAFVNKRCQDRITF

SEQ ID NO: 2672258 - protein, 18 aa, Entamoeba histolytica
DWIHLTLEVGKWSLETMK

SEQ ID NO: 2672259 - protein, 21 aa, Entamoeba histolytica
DWIYIRAAAIARKVYLNNGIG

SEQ ID NO: 2672260 - protein, 20 aa, Entamoeba histolytica
DWLKECLEYIKGNVKLITEF

SEQ ID NO: 2672261 - protein, 20 aa, Entamoeba histolytica
DWLTERIILSYLEYFEFVAS

SEQ ID NO: 2672262 - protein, 26 aa, Entamoeba histolytica
DWSKCMGCGMCAMRCNYGVLHKSGPR

SEQ ID NO: 2672263 - protein, 27 aa, Entamoeba histolytica
DWSKCMGCGMCATKCTFGVLVKQPPKI

SEQ ID NO: 2672264 - protein, 25 aa, Entamoeba histolytica
DWTFYCHKCDGMASLRTCPHTKKDR

SEQ ID NO: 2672265 - protein, 22 aa, Entamoeba histolytica
DYAEALIFCISHKVQLSNHDIT

SEQ ID NO: 2672266 - protein, 19 aa, Entamoeba histolytica
DYAIYCVQTLAAKGAEEKM

SEQ ID NO: 2672267 - protein, 37 aa, Entamoeba histolytica
DYAKSMLRMVQEFRQKRICGQTTLYYGTVKDALETYL

SEQ ID NO: 2672268 - protein, 19 aa, Entamoeba histolytica
DYCVFALNNICLKYQDYEL

SEQ ID NO: 2672269 - protein, 19 aa, Entamoeba histolytica
DYDPLPVFLVRSTYGSETA

SEQ ID NO: 2672270 - protein, 29 aa, Entamoeba histolytica
DYEGDVVLCSLSWCEIKQQRQCEHAGERY

SEQ ID NO: 2672271 - protein, 22 aa, Entamoeba histolytica
DYEGKVSWLMERSMYEEAFKFL

SEQ ID NO: 2672272 - protein, 25 aa, Entamoeba histolytica
DYEIPSGKFNNEWAITLYNSTDKDI

SEQ ID NO: 2672273 - protein, 19 aa, Entamoeba histolytica
DYEVLEYLTDISISNIHSK

SEQ ID NO: 2672274 - protein, 27 aa, Entamoeba histolytica
DYFFCYKWNALLFKRFFINEDLIRIWD

SEQ ID NO: 2672275 - protein, 25 aa, Entamoeba histolytica
DYFIFPFPLCLIVTKQLSVETMKEV

SEQ ID NO: 2672276 - protein, 23 aa, Entamoeba histolytica
DYFKSLSQLCLKEIINKKDYSFV

SEQ ID NO: 2672277 - protein, 17 aa, Entamoeba histolytica
DYFPKNRVEILTKLKTI

SEQ ID NO: 2672278 - protein, 27 aa, Entamoeba histolytica
DYGLKFWLRILHCCGNPSSISDNKVFA

SEQ ID NO: 2672279 - protein, 18 aa, Entamoeba histolytica
DYGYEMPVSLVAKKTADF

SEQ ID NO: 2672280 - protein, 17 aa, Entamoeba histolytica
DYHIIRYIIEMSGLDDL

SEQ ID NO: 2672281 - protein, 17 aa, Entamoeba histolytica
DYHKPYCIIVMNEVGAW

SEQ ID NO: 2672282 - protein, 19 aa, Entamoeba histolytica
DYIESFRFGSWPHAGCGIG

SEQ ID NO: 2672283 - protein, 19 aa, Entamoeba histolytica
DYILYSISMLFDFKTNPDV

SEQ ID NO: 2672284 - protein, 26 aa, Entamoeba histolytica
DYIMKPELFQTCPLHIRNQIYSYTAL

SEQ ID NO: 2672285 - protein, 17 aa, Entamoeba histolytica
DYIRTSGGYGITKSYAE

SEQ ID NO: 2672286 - protein, 17 aa, Entamoeba histolytica
DYKDCPNMNNFIEHSVE

SEQ ID NO: 2672287 - protein, 26 aa, Entamoeba histolytica
DYKITFPFREIIAFSYIQTKTTTTIT

SEQ ID NO: 2672288 - protein, 18 aa, Entamoeba histolytica
DYLIARRIGMNFGAMIKG

SEQ ID NO: 2672289 - protein, 19 aa, Entamoeba histolytica
DYLIGPILYQESWKELIKE

SEQ ID NO: 2672290 - protein, 33 aa, Entamoeba histolytica
DYLIIRSKFLRRRFCTFVIMKLGGLCSVEDMKE

SEQ ID NO: 2672291 - protein, 19 aa, Entamoeba histolytica
DYLKQAIEFSTHISHEVKT

SEQ ID NO: 2672292 - protein, 20 aa, Entamoeba histolytica
DYLLNGINLFNCYKLHKLTL

SEQ ID NO: 2672293 - protein, 25 aa, Entamoeba histolytica
DYLRIIFDISHSFQREELVIVPRTK

SEQ ID NO: 2672294 - protein, 24 aa, Entamoeba histolytica
DYNFEFNHLASLYFIDKKKEGYFN

SEQ ID NO: 2672295 - protein, 22 aa, Entamoeba histolytica
DYNWAVTVLNHLVFCNPKNLRA

SEQ ID NO: 2672296 - protein, 23 aa, Entamoeba histolytica
DYPAPFNALITRKKDKKSGQSQL

SEQ ID NO: 2672297 - protein, 23 aa, Entamoeba histolytica
DYPKMEISMYIPIQPDSGSPLKH

SEQ ID NO: 2672298 - protein, 23 aa, Entamoeba histolytica
DYQKLLDWRAHFPVLNDADYCEL

SEQ ID NO: 2672299 - protein, 25 aa, Entamoeba histolytica
DYQVCVQCTLIALLNEQYSFLIQRP

SEQ ID NO: 2672300 - protein, 25 aa, Entamoeba histolytica
DYREWRLVSELVIKTMSYFSHVNVR

SEQ ID NO: 2672301 - protein, 24 aa, Entamoeba histolytica
DYRILYWKRILGIEEISQELKEEF

SEQ ID NO: 2672302 - protein, 23 aa, Entamoeba histolytica
DYRIQPKKGCMVLPGQIHPGLGI

SEQ ID NO: 2672303 - protein, 19 aa, Entamoeba histolytica
DYSEAFPKYVEVLNISKML

SEQ ID NO: 2672304 - protein, 26 aa, Entamoeba histolytica
DYSELRAFCLFSPYTNKQRSSLCGNI

SEQ ID NO: 2672305 - protein, 18 aa, Entamoeba histolytica
DYSKLSVIAFTFELTERY

SEQ ID NO: 2672306 - protein, 19 aa, Entamoeba histolytica
DYSTIDGWLLLSIPGIHKG

SEQ ID NO: 2672307 - protein, 33 aa, Entamoeba histolytica
DYTCKKLTWTSGHIWKGTITLVRPRTLKWSYSL

SEQ ID NO: 2672308 - protein, 24 aa, Entamoeba histolytica
DYTIEFKHIKGLDIGDNIEVVLKW

SEQ ID NO: 2672309 - protein, 19 aa, Entamoeba histolytica
DYTLIPVTVTNNFKDINDM

SEQ ID NO: 2672310 - protein, 24 aa, Entamoeba histolytica
DYVCLKCYDELQVETKRRNSLTTS

SEQ ID NO: 2672311 - protein, 17 aa, Entamoeba histolytica
DYWIRYESKNQITFSII

SEQ ID NO: 2672312 - protein, 17 aa, Entamoeba histolytica
DYWRVVGANVKGVEKEF

SEQ ID NO: 2672313 - protein, 23 aa, Entamoeba histolytica
DYYFILLRKVHLYAHSVGPNISV

SEQ ID NO: 2672314 - protein, 26 aa, Entamoeba histolytica
DYYYFFVPIEWCCKTKLYEKKSAKHF

SEQ ID NO: 2672315 - protein, 32 aa, Entamoeba histolytica
DYYYQRLKSWIGLEKYKIILNEKVTSLTNERI

SEQ ID NO: 2672316 - protein, 19 aa, Entamoeba histolytica
EAAAFEYRLTGKIENLYWR

SEQ ID NO: 2672317 - protein, 17 aa, Entamoeba histolytica
EAAGLPMEMYEDAPDDD

SEQ ID NO: 2672318 - protein, 19 aa, Entamoeba histolytica
EACECLQGFQVTHSLGGGT

SEQ ID NO: 2672319 - protein, 31 aa, Entamoeba histolytica
EADAVARIFSILCSFKPYPIVTSNNTIQFTG

SEQ ID NO: 2672320 - protein, 17 aa, Entamoeba histolytica
EAEEWQTTFEILQENAE

SEQ ID NO: 2672321 - protein, 19 aa, Entamoeba histolytica
EAEGIFRISGKLNDINIIK

SEQ ID NO: 2672322 - protein, 17 aa, Entamoeba histolytica
EAEKEKRLGEAERLARE

SEQ ID NO: 2672323 - protein, 18 aa, Entamoeba histolytica
EAEKGKYHVIGFYCRDFS

SEQ ID NO: 2672324 - protein, 28 aa, Entamoeba histolytica
EAELLSYTGYFMFYRFVGNYIASSSNET

SEQ ID NO: 2672325 - protein, 22 aa, Entamoeba histolytica
EAEMKLAPIGVVAKAQMHPHVD

SEQ ID NO: 2672326 - protein, 25 aa, Entamoeba histolytica
EAEQECALICLLIYEGFNMQFSVPR

SEQ ID NO: 2672327 - protein, 19 aa, Entamoeba histolytica
EAEQFKKHVEEVLKQEKER

SEQ ID NO: 2672328 - protein, 23 aa, Entamoeba histolytica
EAERVKIELSRNVDCEINLSHIL

SEQ ID NO: 2672329 - protein, 25 aa, Entamoeba histolytica
EAESCFKLASEKGVSSISKYFSQEY

SEQ ID NO: 2672330 - protein, 21 aa, Entamoeba histolytica
EAESKLVRRMKLRHKEVHTDG

SEQ ID NO: 2672331 - protein, 23 aa, Entamoeba histolytica
EAFACKLEFPVKLSEILPDIKKV

SEQ ID NO: 2672332 - protein, 18 aa, Entamoeba histolytica
EAFIYKSAIGRTFSINKK

SEQ ID NO: 2672333 - protein, 24 aa, Entamoeba histolytica
EAFKRGEGIFDRMDETERRRKLVI

SEQ ID NO: 2672334 - protein, 19 aa, Entamoeba histolytica
EAFKYATGCANNLDNYLVY

SEQ ID NO: 2672335 - protein, 18 aa, Entamoeba histolytica
EAFNECYDIFLTQDETMS

SEQ ID NO: 2672336 - protein, 19 aa, Entamoeba histolytica
EAFVPRKVSHEEHRHENNE

SEQ ID NO: 2672337 - protein, 18 aa, Entamoeba histolytica
EAHYCSRKQCGVCNKDLM

SEQ ID NO: 2672338 - protein, 22 aa, Entamoeba histolytica
EAIDKRGILSLEYPMQKEPIDY

SEQ ID NO: 2672339 - protein, 20 aa, Entamoeba histolytica
EAIFKRIRMNDYHWPTETSD

SEQ ID NO: 2672340 - protein, 21 aa, Entamoeba histolytica
EAIFTKTIQGFVDFSLKVVSR

SEQ ID NO: 2672341 - protein, 18 aa, Entamoeba histolytica
EAIIQYKDVNQMGIGNIA

SEQ ID NO: 2672342 - protein, 19 aa, Entamoeba histolytica
EAIIQYKDVNQMGIGNIAV

SEQ ID NO: 2672343 - protein, 18 aa, Entamoeba histolytica
EAINSIDVVLLREVCREF

SEQ ID NO: 2672344 - protein, 20 aa, Entamoeba histolytica
EAIQRLIALRIQQGNNDEAI

SEQ ID NO: 2672345 - protein, 17 aa, Entamoeba histolytica
EAIRACLKKSKENSTGN

SEQ ID NO: 2672346 - protein, 18 aa, Entamoeba histolytica
EAIRCFESALTIDSNLIS

SEQ ID NO: 2672347 - protein, 23 aa, Entamoeba histolytica
EAIRLGKEAAVFVTTKFPRPINL

SEQ ID NO: 2672348 - protein, 18 aa, Entamoeba histolytica
EAIVYFFKGLCGAATKEL

SEQ ID NO: 2672349 - protein, 18 aa, Entamoeba histolytica
EAKECINIKYKYGKNSMC

SEQ ID NO: 2672350 - protein, 32 aa, Entamoeba histolytica
EAKESIYITDWRIDPEIILIRRGVHWLKGKTL

SEQ ID NO: 2672351 - protein, 17 aa, Entamoeba histolytica
EAKKLLYIPTVNLDEDC

SEQ ID NO: 2672352 - protein, 25 aa, Entamoeba histolytica
EAKKVEILLPFDFVACDKFGEDANT

SEQ ID NO: 2672353 - protein, 25 aa, Entamoeba histolytica
EAKRKEVIDSFEFYADRLLDLYTLS

SEQ ID NO: 2672354 - protein, 20 aa, Entamoeba histolytica
EAKRKNCPVIAYTYNEPTVF

SEQ ID NO: 2672355 - protein, 24 aa, Entamoeba histolytica
EAKTKYRSVYLFLFNDTVILTKIN

SEQ ID NO: 2672356 - protein, 20 aa, Entamoeba histolytica
EALCVFRIAQAVLLCCDGQV

SEQ ID NO: 2672357 - protein, 21 aa, Entamoeba histolytica
EALETWPVPMFENLLPRHLQI

SEQ ID NO: 2672358 - protein, 24 aa, Entamoeba histolytica
EALFKHASEFISIFENVLSVQVLS

SEQ ID NO: 2672359 - protein, 25 aa, Entamoeba histolytica
EALFSLDDTEYWLKEQAVVSLNRLM

SEQ ID NO: 2672360 - protein, 19 aa, Entamoeba histolytica
EALILWDYYFAKGCFNVVY

SEQ ID NO: 2672361 - protein, 19 aa, Entamoeba histolytica
EALISLTIVIYEFMVMTGN

SEQ ID NO: 2672362 - protein, 17 aa, Entamoeba histolytica
EALKELFNTASKECNEA

SEQ ID NO: 2672363 - protein, 22 aa, Entamoeba histolytica
EALKPLIKCELIGWDNEISQSK

SEQ ID NO: 2672364 - protein, 19 aa, Entamoeba histolytica
EALKRLDVINTQILEQQTL

SEQ ID NO: 2672365 - protein, 17 aa, Entamoeba histolytica
EALKYCQEMNCIHRDLK

SEQ ID NO: 2672366 - protein, 20 aa, Entamoeba histolytica
EALLKGRPFISVSKVCQLIP

SEQ ID NO: 2672367 - protein, 22 aa, Entamoeba histolytica
EALPIHDMFQALLTLINEVIPA

SEQ ID NO: 2672368 - protein, 29 aa, Entamoeba histolytica
EALQEAVILPIKFPQLFTDKRKPWTGILL

SEQ ID NO: 2672369 - protein, 23 aa, Entamoeba histolytica
EALSLIFKCKVIKWDNLVSTNKD

SEQ ID NO: 2672370 - protein, 19 aa, Entamoeba histolytica
EALTALTLLSFIGAAKPSL

SEQ ID NO: 2672371 - protein, 18 aa, Entamoeba histolytica
EALYQLKSWKELHALAMK

SEQ ID NO: 2672372 - protein, 20 aa, Entamoeba histolytica
EAMKFLLARYYAGRMIQPSY

SEQ ID NO: 2672373 - protein, 17 aa, Entamoeba histolytica
EAMKIVLETEGNVLIAM

SEQ ID NO: 2672374 - protein, 30 aa, Entamoeba histolytica
EAMRMRVDWFFKECIFKRVNISGSEALITA

SEQ ID NO: 2672375 - protein, 21 aa, Entamoeba histolytica
EANCYYVDLFVRKSNETAIGM

SEQ ID NO: 2672376 - protein, 51 aa, Entamoeba histolytica; identical to SEQ ID NO: 2478157

SEQ ID NO: 2672377 - protein, 24 aa, Entamoeba histolytica
EANPFIVIILLKYFFLSLPQSFFC

SEQ ID NO: 2672378 - protein, 18 aa, Entamoeba histolytica
EAPFNLRIDEQRVVGLYC

SEQ ID NO: 2672379 - protein, 18 aa, Entamoeba histolytica
EAPITFLPTYKFEKGTKN

SEQ ID NO: 2672380 - protein, 26 aa, Entamoeba histolytica
EAPPPVPAPRRGLMLGRRSSSISSEE

SEQ ID NO: 2672381 - protein, 30 aa, Entamoeba histolytica
EAPVPEHRERKASFLTRPKKGVNTNDSEQQ

SEQ ID NO: 2672382 - protein, 22 aa, Entamoeba histolytica
EAQGRKAFLGMGFQERSEAFDF

SEQ ID NO: 2672383 - protein, 27 aa, Entamoeba histolytica
EAQPHKSDIPFGWFDFESSFSTSTLGL

SEQ ID NO: 2672384 - protein, 23 aa, Entamoeba histolytica
EAQRWWVRDQKPSVEFNVGFIET

SEQ ID NO: 2672385 - protein, 20 aa, Entamoeba histolytica
EAQWKFDCLLNTAMESDKYI

SEQ ID NO: 2672386 - protein, 20 aa, Entamoeba histolytica
EARLKISEMIIGQVTSEGKD

SEQ ID NO: 2672387 - protein, 31 aa, Entamoeba histolytica; identical to SEQ ID NO: 2478170

SEQ ID NO: 2672388 - protein, 24 aa, Entamoeba histolytica
EARTNICPHLSLAKITSILENLIV

SEQ ID NO: 2672389 - protein, 21 aa, Entamoeba histolytica
EARYISQMELGLFKYKEPIEK

SEQ ID NO: 2672390 - protein, 23 aa, Entamoeba histolytica
EASWSELNIPYSEETTLVKSSHT

SEQ ID NO: 2672391 - protein, 19 aa, Entamoeba histolytica
EATFKTMIHISMGVETNMS

SEQ ID NO: 2672392 - protein, 19 aa, Entamoeba histolytica
EATIYWLQRLIEMGENPKY

SEQ ID NO: 2672393 - protein, 23 aa, Entamoeba histolytica
EAVFPNMDIVDAMFYNKNIVLIG

SEQ ID NO: 2672394 - protein, 18 aa, Entamoeba histolytica
EAVKQGPVSLVLVLVQGQ

SEQ ID NO: 2672395 - protein, 19 aa, Entamoeba histolytica
EAVLREFIKSYQLEDEESV

SEQ ID NO: 2672396 - protein, 21 aa, Entamoeba histolytica
EAVMFPFGFHCTGMPIKACAD

SEQ ID NO: 2672397 - protein, 19 aa, Entamoeba histolytica
EAVNRGCSSHERVGEVEMN

SEQ ID NO: 2672398 - protein, 18 aa, Entamoeba histolytica
EAVRMCVIKSIKITLTGL

SEQ ID NO: 2672399 - protein, 18 aa, Entamoeba histolytica
EAVSFCLKAGTFANELIV

SEQ ID NO: 2672400 - protein, 21 aa, Entamoeba histolytica
EAYCCKDCRNNSFIYCYLSNL

SEQ ID NO: 2672401 - protein, 28 aa, Entamoeba histolytica
EAYSVIKYSFVFEFFIKDYEIIYKLFNF

SEQ ID NO: 2672402 - protein, 19 aa, Entamoeba histolytica
ECAIKEGICAKCREKKQIV

SEQ ID NO: 2672403 - protein, 21 aa, Entamoeba histolytica
ECCGKCEKKAKKEAKKAQKKS

SEQ ID NO: 2672404 - protein, 23 aa, Entamoeba histolytica
ECCKECCCPRIKAFKKFINTFEK

SEQ ID NO: 2672405 - protein, 21 aa, Entamoeba histolytica
ECDICKIPILREITKSDVEKI

SEQ ID NO: 2672406 - protein, 17 aa, Entamoeba histolytica
ECENCQIIIKKNENNEM

SEQ ID NO: 2672407 - protein, 20 aa, Entamoeba histolytica
ECENEIKIGVWMNQKNNSIM

SEQ ID NO: 2672408 - protein, 21 aa, Entamoeba histolytica
ECERDELKIPLQNSLTTVLLN

SEQ ID NO: 2672409 - protein, 24 aa, Entamoeba histolytica
ECFKECTRLSIIFIPTSVSEIGNG

SEQ ID NO: 2672410 - protein, 17 aa, Entamoeba histolytica
ECFKECYSLTSFNIPTT

SEQ ID NO: 2672411 - protein, 23 aa, Entamoeba histolytica
ECGEYLLYFVRIFLQYKPKTIKE

SEQ ID NO: 2672412 - protein, 18 aa, Entamoeba histolytica
ECGFAIGIITRIKREGVF

SEQ ID NO: 2672413 - protein, 19 aa, Entamoeba histolytica
ECGFNPYLVELLKTLFESF

SEQ ID NO: 2672414 - protein, 18 aa, Entamoeba histolytica
ECGKLEPEWISLNLGIVI

SEQ ID NO: 2672415 - protein, 21 aa, Entamoeba histolytica
ECGPLDALVRPLALAPCTSDT

SEQ ID NO: 2672416 - protein, 24 aa, Entamoeba histolytica
ECHEILELYASVYEDLLAVPVIRG

SEQ ID NO: 2672417 - protein, 25 aa, Entamoeba histolytica
ECHRKAVGATLPYLGMFLTDLLFTE

SEQ ID NO: 2672418 - protein, 24 aa, Entamoeba histolytica
ECKCYLCLNKEKIIGKKRVPWTII

SEQ ID NO: 2672419 - protein, 17 aa, Entamoeba histolytica
ECKDIIILLSQFIGASG

SEQ ID NO: 2672420 - protein, 24 aa, Entamoeba histolytica
ECKKAEEELGWKAKLTLEDMCKDS

SEQ ID NO: 2672421 - protein, 19 aa, Entamoeba histolytica
ECKKTCPINRAGGLCIEVL

SEQ ID NO: 2672422 - protein, 21 aa, Entamoeba histolytica
ECKLSICYYQLLKQLVYSLRD

SEQ ID NO: 2672423 - protein, 19 aa, Entamoeba histolytica
ECKNLFIPVLLKLQDDSSI

SEQ ID NO: 2672424 - protein, 28 aa, Entamoeba histolytica
ECLEQILDILITFCFYQINIPINEDYEF

SEQ ID NO: 2672425 - protein, 21 aa, Entamoeba histolytica
ECLNSPNIIWFFKFSLQTICP

SEQ ID NO: 2672426 - protein, 24 aa, Entamoeba histolytica
ECMTFPFFCLLKIKITEHNGVCYT

SEQ ID NO: 2672427 - protein, 24 aa, Entamoeba histolytica
ECNDFRDSWNRGWIHQFFGKEIAY

SEQ ID NO: 2672428 - protein, 25 aa, Entamoeba histolytica
ECNGIELKKIISILNKFEWNKIRVI

SEQ ID NO: 2672429 - protein, 25 aa, Entamoeba histolytica
ECNNKEFIEFIPLLIEGAGNLYNKS

SEQ ID NO: 2672430 - protein, 21 aa, Entamoeba histolytica
ECPRCSIKRNLFIKINKTKLE

SEQ ID NO: 2672431 - protein, 22 aa, Entamoeba histolytica
ECQFKINSIDVIYQKSKIKLND

SEQ ID NO: 2672432 - protein, 22 aa, Entamoeba histolytica
ECQICKKVSPLICHEPSDETIL

SEQ ID NO: 2672433 - protein, 27 aa, Entamoeba histolytica
ECRLEIIKEIILFIKFVCQKHNIIKEE

SEQ ID NO: 2672434 - protein, 17 aa, Entamoeba histolytica
ECSSFAFTEKHRGVIAS

SEQ ID NO: 2672435 - protein, 26 aa, Entamoeba histolytica
ECSSVFWKFMDLIASKKEQLNWNRFI

SEQ ID NO: 2672436 - protein, 24 aa, Entamoeba histolytica
ECSYLFNRINAVIQRSSLLTTKFK

SEQ ID NO: 2672437 - protein, 24 aa, Entamoeba histolytica
ECTGKRFIENFIMPKTYSAKRILL

SEQ ID NO: 2672438 - protein, 20 aa, Entamoeba histolytica
ECTRLSIITIPTCVNEIGYW

SEQ ID NO: 2672439 - protein, 19 aa, Entamoeba histolytica
ECVNPFIPISFRPPLLTKQ

SEQ ID NO: 2672440 - protein, 20 aa, Entamoeba histolytica
ECVSILLLDLHKFIQKKTTI

SEQ ID NO: 2672441 - protein, 21 aa, Entamoeba histolytica
ECVSVAFNIIQYVFYSPETKS

SEQ ID NO: 2672442 - protein, 21 aa, Entamoeba histolytica
ECYPQYGKGEFARIDDKSGQV

SEQ ID NO: 2672443 - protein, 18 aa, Entamoeba histolytica
ECYVHSGMIFKKKGDRLI

SEQ ID NO: 2672444 - protein, 27 aa, Entamoeba histolytica
EDADPAQCWAEGPGVEGGCKTCDMAEF

SEQ ID NO: 2672445 - protein, 24 aa, Entamoeba histolytica
EDAIKYVCSPPMKTEESRQALWSA

SEQ ID NO: 2672446 - protein, 19 aa, Entamoeba histolytica
EDAIWKWKEDCSNSEDYSR

SEQ ID NO: 2672447 - protein, 24 aa, Entamoeba histolytica
EDAIYLLRCQIINSCISYMEEYAT

SEQ ID NO: 2672448 - protein, 23 aa, Entamoeba histolytica
EDARLIKAVQEFGTDNWIAIQST

SEQ ID NO: 2672449 - protein, 23 aa, Entamoeba histolytica
EDARPVAEGRFHRLLGKLKEKPF

SEQ ID NO: 2672450 - protein, 17 aa, Entamoeba histolytica
EDCELNQIYTCKNLEEI

SEQ ID NO: 2672451 - protein, 22 aa, Entamoeba histolytica
EDCTGYCYLPCFLPQNQSQSNS

SEQ ID NO: 2672452 - protein, 18 aa, Entamoeba histolytica
EDCVSALDTLNCISPYRG

SEQ ID NO: 2672453 - protein, 24 aa, Entamoeba histolytica
EDDIMKWTCVIFGPDDTIWESGIF

SEQ ID NO: 2672454 - protein, 23 aa, Entamoeba histolytica
EDEELLKCFLFNIERLLNMVIQI

SEQ ID NO: 2672455 - protein, 22 aa, Entamoeba histolytica
EDEGIKLFALHISAQLAQYGSQ

SEQ ID NO: 2672456 - protein, 27 aa, Entamoeba histolytica
EDEGMIFRNGERFFFGKNVDDDEAIET

SEQ ID NO: 2672457 - protein, 36 aa, Entamoeba histolytica; identical to SEQ ID NO: 2478263

SEQ ID NO: 2672458 - protein, 22 aa, Entamoeba histolytica
EDEKICRMYGFFNECSRFKDDQ

SEQ ID NO: 2672459 - protein, 25 aa, Entamoeba histolytica
EDEPIREFNILKSFLDKYVVFLHKH

SEQ ID NO: 2672460 - protein, 17 aa, Entamoeba histolytica
EDEYCVGHFEDNEKKPK

SEQ ID NO: 2672461 - protein, 31 aa, Entamoeba histolytica
EDFEGITPILLKWDFPTPRVLPLIDSLEKAV

SEQ ID NO: 2672462 - protein, 17 aa, Entamoeba histolytica
EDFFVFNVQKFIKTRAS

SEQ ID NO: 2672463 - protein, 19 aa, Entamoeba histolytica
EDFHIVAAQKSFFCGNITM

SEQ ID NO: 2672464 - protein, 23 aa, Entamoeba histolytica
EDFKKDMKLIFENAKIYNSSENS

SEQ ID NO: 2672465 - protein, 18 aa, Entamoeba histolytica
EDFSRSPFVLEIREIAKI

SEQ ID NO: 2672466 - protein, 22 aa, Entamoeba histolytica
EDGARIVKEFQFNQNNTDMVKL

SEQ ID NO: 2672467 - protein, 26 aa, Entamoeba histolytica
EDGCLVSILSNGFWDTVVLHIKNGEI

SEQ ID NO: 2672468 - protein, 20 aa, Entamoeba histolytica
EDGELFCIDCFIEGKSMSYH

SEQ ID NO: 2672469 - protein, 25 aa, Entamoeba histolytica
EDGELWVSGWCVLTFQNKATNKSYC

SEQ ID NO: 2672470 - protein, 25 aa, Entamoeba histolytica
EDGFGELQGGWAFSVPQSMCRRIMG

SEQ ID NO: 2672471 - protein, 18 aa, Entamoeba histolytica
EDGINYLINCMKIEDKEI

SEQ ID NO: 2672472 - protein, 23 aa, Entamoeba histolytica
EDGKRYFKQCEFKLWRKQPQPIK

SEQ ID NO: 2672473 - protein, 22 aa, Entamoeba histolytica
EDGNFGVKSWILNNNTQDNALA

SEQ ID NO: 2672474 - protein, 23 aa, Entamoeba histolytica
EDGRIFKYVIWYDVSYSRYLKEK

SEQ ID NO: 2672475 - protein, 25 aa, Entamoeba histolytica
EDGRIFKYVIWYKVDYSRYLEEKEE

SEQ ID NO: 2672476 - protein, 24 aa, Entamoeba histolytica
EDGRIIKYVIWYKVSYSRYLKEKE

SEQ ID NO: 2672477 - protein, 26 aa, Entamoeba histolytica
EDHIKLLKFVTGQVRAPVGGFANLKT

SEQ ID NO: 2672478 - protein, 27 aa, Entamoeba histolytica
EDIDKRYECITMFFQLLIKLIQKKNFN

SEQ ID NO: 2672479 - protein, 17 aa, Entamoeba histolytica
EDIEFKVLMKKGRDELE

SEQ ID NO: 2672480 - protein, 20 aa, Entamoeba histolytica
EDIEIFILKYIIGKITENEL

SEQ ID NO: 2672481 - protein, 24 aa, Entamoeba histolytica
EDIELKKRMSIIGSPITDINVQET

SEQ ID NO: 2672482 - protein, 25 aa, Entamoeba histolytica
EDIFKQMFWELSMKSFDDFITKLVT

SEQ ID NO: 2672483 - protein, 20 aa, Entamoeba histolytica
EDIIKCLHKFMPKNQRILSL

SEQ ID NO: 2672484 - protein, 21 aa, Entamoeba histolytica
EDIIPHKKESVTRISDGSRFS

SEQ ID NO: 2672485 - protein, 26 aa, Entamoeba histolytica
EDILKEDWTTIKLYQFLIPIIFHYQE

SEQ ID NO: 2672486 - protein, 30 aa, Entamoeba histolytica
EDILKQRDGILFYKKFNSIEHSSQVDSDFK

SEQ ID NO: 2672487 - protein, 22 aa, Entamoeba histolytica
EDILRRKLESIKRCERISQSLD

SEQ ID NO: 2672488 - protein, 25 aa, Entamoeba histolytica
EDILRYESRLEKICYTDLYENDILA

SEQ ID NO: 2672489 - protein, 20 aa, Entamoeba histolytica
EDINGVLPLFADRGRVPKVV

SEQ ID NO: 2672490 - protein, 21 aa, Entamoeba histolytica
EDINWRVSVTLGSDKMANIEE

SEQ ID NO: 2672491 - protein, 19 aa, Entamoeba histolytica
EDIPILIHLLKQFNEENIE

SEQ ID NO: 2672492 - protein, 18 aa, Entamoeba histolytica
EDIQRIEILTGKTAGEVI

SEQ ID NO: 2672493 - protein, 24 aa, Entamoeba histolytica
EDIRLRLCPHIPLDDIKTFLYLNI

SEQ ID NO: 2672494 - protein, 33 aa, Entamoeba histolytica
EDITKYCSVKGWKLSSLEIKLIMTLRVDFSKQK

SEQ ID NO: 2672495 - protein, 18 aa, Entamoeba histolytica
EDIVKALTLSGGSISKEL

SEQ ID NO: 2672496 - protein, 27 aa, Entamoeba histolytica
EDKEHIIFAFNFFKGIGLVELAKPLQQ

SEQ ID NO: 2672497 - protein, 28 aa, Entamoeba histolytica
EDKKGVILCFKEFVGALLELKNKETPTQ

SEQ ID NO: 2672498 - protein, 26 aa, Entamoeba histolytica
EDKRKEQLLLHRQRLKEMIESAEDIQ

SEQ ID NO: 2672499 - protein, 19 aa, Entamoeba histolytica
EDKTWGEIITRLRHLKTTI

SEQ ID NO: 2672500 - protein, 29 aa, Entamoeba histolytica
EDKVFSWFSLTVIDHWVCMKPQQLPLEQM

SEQ ID NO: 2672501 - protein, 18 aa, Entamoeba histolytica
EDKYKFFLEATQLDMIKE

SEQ ID NO: 2672502 - protein, 23 aa, Entamoeba histolytica
EDKYLIHIGNYFEREKHQATERI

SEQ ID NO: 2672503 - protein, 26 aa, Entamoeba histolytica
EDLAIDAFCSMKCKYKNEQLILNLCQ

SEQ ID NO: 2672504 - protein, 26 aa, Entamoeba histolytica
EDLGNLKWIVVGKLFGLRTIVNKRPK

SEQ ID NO: 2672505 - protein, 21 aa, Entamoeba histolytica
EDLITIPFNMFLKPLSLSPTT

SEQ ID NO: 2672506 - protein, 27 aa, Entamoeba histolytica
EDLIYRPFLRLTYKEAIEMLRASGETI

SEQ ID NO: 2672507 - protein, 23 aa, Entamoeba histolytica
EDLKEIFKEFNVVSAKVVTYNHR

SEQ ID NO: 2672508 - protein, 21 aa, Entamoeba histolytica
EDLKTGVNLILLVEKLTNKHC

SEQ ID NO: 2672509 - protein, 17 aa, Entamoeba histolytica
EDLLFRVHVKLLLGDSV

SEQ ID NO: 2672510 - protein, 25 aa, Entamoeba histolytica
EDLNEKICYSRFVSYQWNDEITIFV

SEQ ID NO: 2672511 - protein, 33 aa, Entamoeba histolytica
EDLRFEQMVKCFLKFVDVFKLYSSFVNNYDNAR

SEQ ID NO: 2672512 - protein, 17 aa, Entamoeba histolytica
EDLRGTFLVTEPNNEGP

SEQ ID NO: 2672513 - protein, 26 aa, Entamoeba histolytica
EDLRIKIFLWKTIQCDKALGTVRGGK

SEQ ID NO: 2672514 - protein, 17 aa, Entamoeba histolytica
EDLSHTGIRLSLSRFNT

SEQ ID NO: 2672515 - protein, 25 aa, Entamoeba histolytica
EDLTYPLNCRRFMHMLFTYTEELFN

SEQ ID NO: 2672516 - protein, 30 aa, Entamoeba histolytica
EDLYNFIMEMCIDIPFVLRKPFGKNNWVIN

SEQ ID NO: 2672517 - protein, 21 aa, Entamoeba histolytica
EDMKELLPFAIKKLTNDEEPI

SEQ ID NO: 2672518 - protein, 23 aa, Entamoeba histolytica
EDMKIELNDVWNLDIILTTGAAK

SEQ ID NO: 2672519 - protein, 22 aa, Entamoeba histolytica
EDMLFRIKFDLYNPQREKIETL

SEQ ID NO: 2672520 - protein, 23 aa, Entamoeba histolytica
EDMLFRIKFDLYNPQREKIETLY

SEQ ID NO: 2672521 - protein, 23 aa, Entamoeba histolytica
EDMLMLCCYDINQHQSEYNQIVD

SEQ ID NO: 2672522 - protein, 19 aa, Entamoeba histolytica
EDMVLWGLFSLANAIHFLN

SEQ ID NO: 2672523 - protein, 19 aa, Entamoeba histolytica
EDNAEYGFGMFKANEQRRL

SEQ ID NO: 2672524 - protein, 19 aa, Entamoeba histolytica
EDNDIFLARQVLRNLTHNT

SEQ ID NO: 2672525 - protein, 25 aa, Entamoeba histolytica
EDNYPCWFEGPPFKFKKSMKDIHSR

SEQ ID NO: 2672526 - protein, 17 aa, Entamoeba histolytica
EDPELAMNYLLQNLQIG

SEQ ID NO: 2672527 - protein, 18 aa, Entamoeba histolytica
EDPLHRIIDELGDVEQYN

SEQ ID NO: 2672528 - protein, 20 aa, Entamoeba histolytica
EDPLKLDYWIKGKKKSTKKE

SEQ ID NO: 2672529 - protein, 21 aa, Entamoeba histolytica
EDPQGLLIFYNFINDLICLLT

SEQ ID NO: 2672530 - protein, 24 aa, Entamoeba histolytica
EDPSCKISVLLQVYIGRLTLPGFV

SEQ ID NO: 2672531 - protein, 22 aa, Entamoeba histolytica
EDPSLIKIKAMIDTNTKLVEQL

SEQ ID NO: 2672532 - protein, 22 aa, Entamoeba histolytica
EDRAKASKFIKVNQELRSQFGL

SEQ ID NO: 2672533 - protein, 21 aa, Entamoeba histolytica
EDRFTQYFLPKKIFNTDSDYE

SEQ ID NO: 2672534 - protein, 21 aa, Entamoeba histolytica
EDRIFRLAYHVYKTKELIEKY

SEQ ID NO: 2672535 - protein, 23 aa, Entamoeba histolytica
EDRIFRLAYHVYKTKELIEKYGS

SEQ ID NO: 2672536 - protein, 28 aa, Entamoeba histolytica
EDRIKRIEGIYKRKEKIIGKNEIIRNKL

SEQ ID NO: 2672537 - protein, 24 aa, Entamoeba histolytica
EDRIYRLAHHVYKTKELIEKYGSE

SEQ ID NO: 2672538 - protein, 24 aa, Entamoeba histolytica
EDRIYRLAYHVYKTKELIEKYGSE

SEQ ID NO: 2672539 - protein, 26 aa, Entamoeba histolytica
EDRQIDLWPNFQIFLNEQAKEKYGDA

SEQ ID NO: 2672540 - protein, 21 aa, Entamoeba histolytica
EDRYLPMNMLFSGKNHLPNLP

SEQ ID NO: 2672541 - protein, 17 aa, Entamoeba histolytica
EDSALKCVEVFHNSNQV

SEQ ID NO: 2672542 - protein, 19 aa, Entamoeba histolytica
EDSIFCNKKGSFLVEEFVG

SEQ ID NO: 2672543 - protein, 21 aa, Entamoeba histolytica
EDSLEMKECLNYVVERIVDAT

SEQ ID NO: 2672544 - protein, 29 aa, Entamoeba histolytica
EDSVGELFLKFSPFFIVYRNFLINHNKAF

SEQ ID NO: 2672545 - protein, 24 aa, Entamoeba histolytica
EDSYINFSPFWKKKDGTKIPEGTK

SEQ ID NO: 2672546 - protein, 20 aa, Entamoeba histolytica
EDTGSLWVGMSLYEIKEGRI

SEQ ID NO: 2672547 - protein, 18 aa, Entamoeba histolytica
EDTRAFFLELYDSLLKDE

SEQ ID NO: 2672548 - protein, 17 aa, Entamoeba histolytica
EDVCLMPKLEVLTLSNN

SEQ ID NO: 2672549 - protein, 17 aa, Entamoeba histolytica
EDVECFNEKVSVLSESL

SEQ ID NO: 2672550 - protein, 21 aa, Entamoeba histolytica
EDVEKIVGWAFAHEIEKRPDK

SEQ ID NO: 2672551 - protein, 20 aa, Entamoeba histolytica
EDVILKYGWCHSELEMLVNE

SEQ ID NO: 2672552 - protein, 22 aa, Entamoeba histolytica
EDVKARCDLVNWIYAITERYRL

SEQ ID NO: 2672553 - protein, 20 aa, Entamoeba histolytica
EDVKRVGMKEVIEAINKKFV

SEQ ID NO: 2672554 - protein, 27 aa, Entamoeba histolytica
EDVPLKEGLPLPVYDSLKYFKENPTLL

SEQ ID NO: 2672555 - protein, 18 aa, Entamoeba histolytica
EDVRELALLCPPEEIEGK

SEQ ID NO: 2672556 - protein, 22 aa, Entamoeba histolytica
EDVVEIWDAIFAYGENLKLVDG

SEQ ID NO: 2672557 - protein, 25 aa, Entamoeba histolytica
EDYECLRKILYMNANFFVICYSIDK

SEQ ID NO: 2672558 - protein, 23 aa, Entamoeba histolytica
EDYEGTTCCKFLVKLKGIESKER

SEQ ID NO: 2672559 - protein, 18 aa, Entamoeba histolytica
EDYFPNRRSHIIELIHEI

SEQ ID NO: 2672560 - protein, 25 aa, Entamoeba histolytica
EDYKIFATEFFKEGVHGFLPQAKQF

SEQ ID NO: 2672561 - protein, 27 aa, Entamoeba histolytica
EDYKIHFYYRFLIILTNHRMYIYNIRK

SEQ ID NO: 2672562 - protein, 26 aa, Entamoeba histolytica
EDYYNCCGFCLKTLYSKDPTNKYNKV

SEQ ID NO: 2672563 - protein, 21 aa, Entamoeba histolytica
EEAFKFLKNLCMNKRDKDIGE

SEQ ID NO: 2672564 - protein, 17 aa, Entamoeba histolytica
EEAKASLAISVAAEATL

SEQ ID NO: 2672565 - protein, 21 aa, Entamoeba histolytica
EEAKEIIGRFGCGNNIKWIGV

SEQ ID NO: 2672566 - protein, 17 aa, Entamoeba histolytica
EEAKIAWILQRKGLGDF

SEQ ID NO: 2672567 - protein, 19 aa, Entamoeba histolytica
EEAKRKAAEERKRLEEEKK

SEQ ID NO: 2672568 - protein, 20 aa, Entamoeba histolytica
EEAKVVVGDVCINNHLVQLG

SEQ ID NO: 2672569 - protein, 24 aa, Entamoeba histolytica
EEALIRKECFLFIFYSIQQHYIPL

SEQ ID NO: 2672570 - protein, 25 aa, Entamoeba histolytica
EEARAKETWKVRALEAENASTKANE

SEQ ID NO: 2672571 - protein, 23 aa, Entamoeba histolytica
EEARKEKEWGKWRNEKRERKTLL

SEQ ID NO: 2672572 - protein, 29 aa, Entamoeba histolytica
EEASKHVLETLIFLRFILPPLAQTPQLLK

SEQ ID NO: 2672573 - protein, 25 aa, Entamoeba histolytica
EEASNRLKKQFGFELKEIKSGNSGK

SEQ ID NO: 2672574 - protein, 21 aa, Entamoeba histolytica
EEAVKALSLDGLTIKGASVKV

SEQ ID NO: 2672575 - protein, 18 aa, Entamoeba histolytica
EEAVKYIISKGVDTESKN

SEQ ID NO: 2672576 - protein, 17 aa, Entamoeba histolytica
EEAWKVISSQADIINEF

SEQ ID NO: 2672577 - protein, 18 aa, Entamoeba histolytica
EEAYKEFMEHSSDYEDEE

SEQ ID NO: 2672578 - protein, 19 aa, Entamoeba histolytica
EECDLCGAKVSLKQMQYHK

SEQ ID NO: 2672579 - protein, 21 aa, Entamoeba histolytica
EECGTALILFKANDQSKETQA

SEQ ID NO: 2672580 - protein, 18 aa, Entamoeba histolytica
EECKECFSKIINNCITKQ

SEQ ID NO: 2672581 - protein, 17 aa, Entamoeba histolytica
EECKGIISGIGKIEHVP

SEQ ID NO: 2672582 - protein, 19 aa, Entamoeba histolytica
EECQCKIAFASSDDTPDLV

SEQ ID NO: 2672583 - protein, 17 aa, Entamoeba histolytica
EECVWFYQSNFRLLEKY

SEQ ID NO: 2672584 - protein, 22 aa, Entamoeba histolytica
EEDCFKFGKLLKESCHSLENDS

SEQ ID NO: 2672585 - protein, 17 aa, Entamoeba histolytica
EEDELKTEFNVEPKKSP

SEQ ID NO: 2672586 - protein, 23 aa, Entamoeba histolytica
EEDICVPHDKIVIVNPAACSYMV

SEQ ID NO: 2672587 - protein, 23 aa, Entamoeba histolytica
EEDIKKILPFLLDRRNIKKFFKS

SEQ ID NO: 2672588 - protein, 24 aa, Entamoeba histolytica
EEDIKLAFKFGCHAIDQLLNKGTF

SEQ ID NO: 2672589 - protein, 30 aa, Entamoeba histolytica
EEDRFGKFCLWFSYVCDFLMIYENYIYNLP

SEQ ID NO: 2672590 - protein, 24 aa, Entamoeba histolytica
EEDRKWDISGCVLRVYELLSQIYQ

SEQ ID NO: 2672591 - protein, 24 aa, Entamoeba histolytica
EEDSRKFIISKYVESVGKDITPLI

SEQ ID NO: 2672592 - protein, 22 aa, Entamoeba histolytica
EEECESCYDFLDIDYYNDDLIP

SEQ ID NO: 2672593 - protein, 29 aa, Entamoeba histolytica
EEECWKALIPRVDVLYEFYEFSNQLKDRF

SEQ ID NO: 2672594 - protein, 19 aa, Entamoeba histolytica
EEEDDWLSLILDITSYICK

SEQ ID NO: 2672595 - protein, 57 aa, Entamoeba histolytica
EEEDIYRIVKEMIKGTCLEKYLTPEIIKDCKHYEKEEVVKLLQTMGLEEIIQKNQYY

SEQ ID NO: 2672596 - protein, 22 aa, Entamoeba histolytica
EEEEFRKKRKCDTVLSEAVNST

SEQ ID NO: 2672597 - protein, 24 aa, Entamoeba histolytica
EEEFCIISTKLFHFFSKKEISYED

SEQ ID NO: 2672598 - protein, 18 aa, Entamoeba histolytica
EEEFTCLFELVDHVKDML

SEQ ID NO: 2672599 - protein, 23 aa, Entamoeba histolytica
EEEFTCVSLGKTIYLGGKEGVFE

SEQ ID NO: 2672600 - protein, 17 aa, Entamoeba histolytica
EEEICMQTIIKSKEQEK

SEQ ID NO: 2672601 - protein, 24 aa, Entamoeba histolytica
EEEKESKSGLFGMLKDKKKKEEKK

SEQ ID NO: 2672602 - protein, 24 aa, Entamoeba histolytica
EEEKKLKECIDMEKEIKELQESHL

SEQ ID NO: 2672603 - protein, 23 aa, Entamoeba histolytica
EEEMKASLLFCKQRIEKLGNEIE

SEQ ID NO: 2672604 - protein, 23 aa, Entamoeba histolytica
EEEPRFLKGKIKEIINSKINEVE

SEQ ID NO: 2672605 - protein, 17 aa, Entamoeba histolytica
EEERKKKEEAIKRKKEE

SEQ ID NO: 2672606 - protein, 23 aa, Entamoeba histolytica
EEERKRKEEEAKRKIEQERQRKI

SEQ ID NO: 2672607 - protein, 21 aa, Entamoeba histolytica
EEERLSFYSGLLLEKSSAVTL

SEQ ID NO: 2672608 - protein, 31 aa, Entamoeba histolytica
EEERTAAVLACEWVDEVVDGIVWWCTPYDFV

SEQ ID NO: 2672609 - protein, 23 aa, Entamoeba histolytica
EEESFEQWAIIFDECARKLFNMS

SEQ ID NO: 2672610 - protein, 23 aa, Entamoeba histolytica
EEESGLSYMNWIFEDGERTLLLL

SEQ ID NO: 2672611 - protein, 19 aa, Entamoeba histolytica
EEEVIALICQYLKEQKLQE

SEQ ID NO: 2672612 - protein, 23 aa, Entamoeba histolytica
EEFGIDIPQNFAIKALGDKCFES

SEQ ID NO: 2672613 - protein, 26 aa, Entamoeba histolytica
EEFIIRRLKEINVRDISNGVSSKTAS

SEQ ID NO: 2672614 - protein, 19 aa, Entamoeba histolytica
EEFKKCDELADTLESINEN

SEQ ID NO: 2672615 - protein, 24 aa, Entamoeba histolytica
EEFKKTLLKMMAYECEKRATWDDV

SEQ ID NO: 2672616 - protein, 17 aa, Entamoeba histolytica
EEFKYVRVIGAFYLRLI

SEQ ID NO: 2672617 - protein, 18 aa, Entamoeba histolytica
EEFLKFRKTSSFYLFRKC

SEQ ID NO: 2672618 - protein, 22 aa, Entamoeba histolytica
EEFNCMLTFTDFLLFGRTKLLG

SEQ ID NO: 2672619 - protein, 21 aa, Entamoeba histolytica
EEFNSFLLKFTNWEQWENYNF

SEQ ID NO: 2672620 - protein, 25 aa, Entamoeba histolytica
EEFPLKGEDGFLCLKAVNHFATMVP

SEQ ID NO: 2672621 - protein, 21 aa, Entamoeba histolytica
EEFQKQPVIEKFIKVVEKTGG

SEQ ID NO: 2672622 - protein, 21 aa, Entamoeba histolytica
EEFSSLISLMIDEFDVIKEWS

SEQ ID NO: 2672623 - protein, 19 aa, Entamoeba histolytica
EEFVKCYDELMGSSYPPTK

SEQ ID NO: 2672624 - protein, 18 aa, Entamoeba histolytica
EEGFTEIITIPFVVEEDY

SEQ ID NO: 2672625 - protein, 25 aa, Entamoeba histolytica
EEGHIIKGNVLIISDDVKHTNSSEF

SEQ ID NO: 2672626 - protein, 27 aa, Entamoeba histolytica
EEGKVNMCALNIKMGYDNLYEFVLGKQ

SEQ ID NO: 2672627 - protein, 22 aa, Entamoeba histolytica
EEGLAFKALNKIAGHKIEGKIE

SEQ ID NO: 2672628 - protein, 20 aa, Entamoeba histolytica
EEGRKAILEQGITKNLIEGF

SEQ ID NO: 2672629 - protein, 32 aa, Entamoeba histolytica
EEGVFKGKLLLVWKWTPSVILNIECKEESERY

SEQ ID NO: 2672630 - protein, 17 aa, Entamoeba histolytica
EEGYRIYTLEELGLDKN

SEQ ID NO: 2672631 - protein, 21 aa, Entamoeba histolytica
EEGYVWVVMEFMDSGCLTEVL

SEQ ID NO: 2672632 - protein, 26 aa, Entamoeba histolytica
EEHQKSIPGWGNWVGEGIEKKVKKSK

SEQ ID NO: 2672633 - protein, 20 aa, Entamoeba histolytica
EEHSDLSFSYGVMTDESFTD

SEQ ID NO: 2672634 - protein, 27 aa, Entamoeba histolytica
EEHTKFIKAITWLGCTSTRRLPVKLIS

SEQ ID NO: 2672635 - protein, 17 aa, Entamoeba histolytica
EEIEMKYFPSLGNNDKI

SEQ ID NO: 2672636 - protein, 20 aa, Entamoeba histolytica
EEIGCLGAAGLVPGELLTEK

SEQ ID NO: 2672637 - protein, 19 aa, Entamoeba histolytica
EEIIDCIYNTANIDIIAFI

SEQ ID NO: 2672638 - protein, 23 aa, Entamoeba histolytica
EEIKFEPLKCDHEMTGNEVIEHF

SEQ ID NO: 2672639 - protein, 24 aa, Entamoeba histolytica
EEIKKAYRKLALKLHPDKLIDVDP

SEQ ID NO: 2672640 - protein, 17 aa, Entamoeba histolytica
EEIKKGIEIQEKQVKEI

SEQ ID NO: 2672641 - protein, 22 aa, Entamoeba histolytica
EEIKKWVKMMKEIKNTKEEQKQ

SEQ ID NO: 2672642 - protein, 17 aa, Entamoeba histolytica
EEIKLSFEIVFDKEYYF

SEQ ID NO: 2672643 - protein, 20 aa, Entamoeba histolytica
EEIKMVKEVERLEQEKAKIK

SEQ ID NO: 2672644 - protein, 33 aa, Entamoeba histolytica; identical to SEQ ID NO: 2478469

SEQ ID NO: 2672645 - protein, 18 aa, Entamoeba histolytica
EEIMRKWYIKEHPNRKVD

SEQ ID NO: 2672646 - protein, 18 aa, Entamoeba histolytica
EEINEEFSFISTFQYSKG

SEQ ID NO: 2672647 - protein, 23 aa, Entamoeba histolytica
EEINRISLYLMVGLVSRLDLDAN

SEQ ID NO: 2672648 - protein, 17 aa, Entamoeba histolytica
EEIPSLCCLPKTEIEEL

SEQ ID NO: 2672649 - protein, 21 aa, Entamoeba histolytica
EEITEWCCVVCEKTFKSENQL

SEQ ID NO: 2672650 - protein, 18 aa, Entamoeba histolytica
EEITRLALTGLDVSDNYI

SEQ ID NO: 2672651 - protein, 20 aa, Entamoeba histolytica
EEIYESLGIISKYLPIERVK

SEQ ID NO: 2672652 - protein, 21 aa, Entamoeba histolytica
EEIYNLYPLFDILLGAPEINI

SEQ ID NO: 2672653 - protein, 24 aa, Entamoeba histolytica
EEKCSAEGKICCFKLPELAEEAKI

SEQ ID NO: 2672654 - protein, 23 aa, Entamoeba histolytica
EEKEAWKSIIYDQFRYIDEIIEN

SEQ ID NO: 2672655 - protein, 19 aa, Entamoeba histolytica
EEKECFVENLLDFIDESLY

SEQ ID NO: 2672656 - protein, 24 aa, Entamoeba histolytica
EEKEGKCYVEMNVAVGILEEKKNE

SEQ ID NO: 2672657 - protein, 18 aa, Entamoeba histolytica
EEKERKIAEEKRKKEEEE

SEQ ID NO: 2672658 - protein, 19 aa, Entamoeba histolytica
EEKEVRMLFILAPHSHLLF

SEQ ID NO: 2672659 - protein, 19 aa, Entamoeba histolytica
EEKGLSFKSFEEYYEKNSD

SEQ ID NO: 2672660 - protein, 19 aa, Entamoeba histolytica
EEKGRIFGGYDDDVKQLRR

SEQ ID NO: 2672661 - protein, 22 aa, Entamoeba histolytica
EEKHNCKGKMQHKPEPSEDNKY

SEQ ID NO: 2672662 - protein, 20 aa, Entamoeba histolytica
EEKIRIIGISLKDVVDELKE

SEQ ID NO: 2672663 - protein, 27 aa, Entamoeba histolytica
EEKKLDGIVLEGEWKKGFDAGNIISNP

SEQ ID NO: 2672664 - protein, 17 aa, Entamoeba histolytica
EEKKPKKKWDVVNEDFL

SEQ ID NO: 2672665 - protein, 34 aa, Entamoeba histolytica
EEKKWYEFFSFKGKRIGGKISIESTWNCNIKKMN

SEQ ID NO: 2672666 - protein, 33 aa, Entamoeba histolytica
EEKLIIDWFGRFGIEVGDFKTSFNDGLLICQVI

SEQ ID NO: 2672667 - protein, 20 aa, Entamoeba histolytica
EEKLNIWKALMQLEANHGDE

SEQ ID NO: 2672668 - protein, 18 aa, Entamoeba histolytica
EEKMKWMQLFTGIDGIVV

SEQ ID NO: 2672669 - protein, 20 aa, Entamoeba histolytica
EEKNRIITIIEKVPDLVTEN

SEQ ID NO: 2672670 - protein, 23 aa, Entamoeba histolytica
EEKRIKKPVIVKKERKLKEVKKF

SEQ ID NO: 2672671 - protein, 24 aa, Entamoeba histolytica
EEKRIKKPVIVKKERKLKEVKKID

SEQ ID NO: 2672672 - protein, 20 aa, Entamoeba histolytica
EEKSFLFSMMNNFVPIAKTI

SEQ ID NO: 2672673 - protein, 25 aa, Entamoeba histolytica
EEKYRYLVNYFNKYVNFIKVTRKVR

SEQ ID NO: 2672674 - protein, 22 aa, Entamoeba histolytica
EELCKGCNIIQNLEIYKGIIPF

SEQ ID NO: 2672675 - protein, 18 aa, Entamoeba histolytica
EELCSFKQNYKYLRAYLS

SEQ ID NO: 2672676 - protein, 28 aa, Entamoeba histolytica
EELELFLKSTCRVLGLNWDEMKQFFNTE

SEQ ID NO: 2672677 - protein, 24 aa, Entamoeba histolytica
EELERRFGEEMAHDKSIRKELIDS

SEQ ID NO: 2672678 - protein, 25 aa, Entamoeba histolytica
EELEVACKRLGIEVNKTKKEKVIEN

SEQ ID NO: 2672679 - protein, 17 aa, Entamoeba histolytica
EELFEFKSSYEVEKFHR

SEQ ID NO: 2672680 - protein, 20 aa, Entamoeba histolytica
EELGIKYVVEPAFGEFLSIN

SEQ ID NO: 2672681 - protein, 22 aa, Entamoeba histolytica
EELIRITALAKIAAREGEKERS

SEQ ID NO: 2672682 - protein, 23 aa, Entamoeba histolytica
EELKEKLHPLGLFKNIESLSITK

SEQ ID NO: 2672683 - protein, 23 aa, Entamoeba histolytica
EELKELYTSLVVDRLKKRPSFIL

SEQ ID NO: 2672684 - protein, 24 aa, Entamoeba histolytica
EELKHSRRGIGIFSKFSKSNDLLT

SEQ ID NO: 2672685 - protein, 21 aa, Entamoeba histolytica
EELKIKVIHLEKEIDISNERL

SEQ ID NO: 2672686 - protein, 17 aa, Entamoeba histolytica
EELKKFFGRDTLVVGIE

SEQ ID NO: 2672687 - protein, 26 aa, Entamoeba histolytica
EELKKRFCKRIEFGTAGLRGKMCAGF

SEQ ID NO: 2672688 - protein, 19 aa, Entamoeba histolytica
EELKKSIGRELTLKEQWYK

SEQ ID NO: 2672689 - protein, 30 aa, Entamoeba histolytica
EELKMKDSFTVGKIKAAQGIEEDKNWEGKI

SEQ ID NO: 2672690 - protein, 20 aa, Entamoeba histolytica
EELKNKLTETQRLLEEEKKE

SEQ ID NO: 2672691 - protein, 17 aa, Entamoeba histolytica
EELKPIIKKEEPKPIIK

SEQ ID NO: 2672692 - protein, 25 aa, Entamoeba histolytica
EELLPSICLHQVIIPLPAHRVTMPK

SEQ ID NO: 2672693 - protein, 18 aa, Entamoeba histolytica
EELLPSYHSVPILVEPIK
